United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 186

SEQ ID NO: 7749585 - DNA, 22 bp, Homo sapiens
ttcattagcaaggtcttcaagt

SEQ ID NO: 7749586 - DNA, 22 bp, Homo sapiens
ttcattagttctgaagatgtct

SEQ ID NO: 7749587 - DNA, 22 bp, Homo sapiens
ttcattcacccaggaaacatct

SEQ ID NO: 7749588 - DNA, 22 bp, Homo sapiens
ttcagcccaggcatagggcaaa

SEQ ID NO: 7749589 - DNA, 22 bp, Homo sapiens
ttcagcccacgccaccttcttg

SEQ ID NO: 7749590 - DNA, 21 bp, Homo sapiens
ttcagccctgtttgaggctac

SEQ ID NO: 7749591 - DNA, 22 bp, Homo sapiens
ttcactgaattaatttccttct

SEQ ID NO: 7749592 - DNA, 22 bp, Homo sapiens
ttcagcatagcagcttcaggac

SEQ ID NO: 7749593 - DNA, 22 bp, Homo sapiens
ttattcagtctgtctagggagt

SEQ ID NO: 7749594 - DNA, 22 bp, Homo sapiens
ttattcccactgtgaaatgagg

SEQ ID NO: 7749595 - DNA, 22 bp, Homo sapiens
ttagtatctggaaatcacatta

SEQ ID NO: 7749596 - DNA, 22 bp, Homo sapiens
ttagtcttctcatagtaaaact

SEQ ID NO: 7749597 - DNA, 22 bp, Homo sapiens
ttagtcacatgcccatctctga

SEQ ID NO: 7749598 - DNA, 22 bp, Homo sapiens
ttagtcacttcttccttcatca

SEQ ID NO: 7749599 - DNA, 22 bp, Homo sapiens
ttagtcccattatatgacttct

SEQ ID NO: 7749600 - DNA, 18 bp, Homo sapiens
ttatctctggcatgtgcc

SEQ ID NO: 7749601 - DNA, 22 bp, Homo sapiens
ttatgatttgccacagattggt

SEQ ID NO: 7749602 - DNA, 22 bp, Homo sapiens
ttatgagctaagttgtggcccc

SEQ ID NO: 7749603 - DNA, 22 bp, Homo sapiens
ttagcatttcatttcaagagga

SEQ ID NO: 7749604 - DNA, 22 bp, Homo sapiens
ttagcatttcagtacacatgtt

SEQ ID NO: 7749605 - DNA, 22 bp, Homo sapiens
ttagcattgtacatttgtgctt

SEQ ID NO: 7749606 - DNA, 22 bp, Homo sapiens
ttagcatttctggaatcacaag

SEQ ID NO: 7749607 - DNA, 22 bp, Homo sapiens
ttagcattttctgggctgaaat

SEQ ID NO: 7749608 - DNA, 22 bp, Homo sapiens
ttagcactttgattcatgcaga

SEQ ID NO: 7749609 - DNA, 22 bp, Homo sapiens
ttagcatctgctgtaagcttat

SEQ ID NO: 7749610 - DNA, 22 bp, Homo sapiens
ttagcattctcatttgcataaa

SEQ ID NO: 7749611 - DNA, 22 bp, Homo sapiens
ttagcattctctgtgtgcataa

SEQ ID NO: 7749612 - DNA, 22 bp, Homo sapiens
ttagcattcttctggggggcac

SEQ ID NO: 7749613 - DNA, 22 bp, Homo sapiens
ttagcattctgcctcctatatc

SEQ ID NO: 7749614 - DNA, 22 bp, Homo sapiens
ttaaactatagcttgatgtgaa

SEQ ID NO: 7749615 - DNA, 22 bp, Homo sapiens
ttaataagtagtagttattgtt

SEQ ID NO: 7749616 - DNA, 22 bp, Homo sapiens
ttaataataatgagcccatttt

SEQ ID NO: 7749617 - DNA, 22 bp, Homo sapiens
ttaataataatgagcccatttt

SEQ ID NO: 7749618 - DNA, 22 bp, Homo sapiens
ttacaacatatttagcttgatt

SEQ ID NO: 7749619 - DNA, 21 bp, Homo sapiens
ttacaacatttgtgttctatg

SEQ ID NO: 7749620 - DNA, 23 bp, Homo sapiens
ttacaacagtgtccatatttgta

SEQ ID NO: 7749621 - DNA, 22 bp, Homo sapiens
ttacaacaaaggcacgtgcatg

SEQ ID NO: 7749622 - DNA, 22 bp, Homo sapiens
ttacaaagagaagttgtagaat

SEQ ID NO: 7749623 - DNA, 22 bp, Homo sapiens
ttacagaaaatgtgttttaact

SEQ ID NO: 7749624 - DNA, 22 bp, Homo sapiens
ttacacaaaagcaagtgtgtgt

SEQ ID NO: 7749625 - DNA, 22 bp, Homo sapiens
ttacacaaacacattccagata

SEQ ID NO: 7749626 - DNA, 17 bp, Homo sapiens
ttacagcagcaatagag

SEQ ID NO: 7749627 - DNA, 22 bp, Homo sapiens
ttacagcatttaatgagatctg

SEQ ID NO: 7749628 - DNA, 18 bp, Homo sapiens
ttacagcagcaacaggaa

SEQ ID NO: 7749629 - DNA, 17 bp, Homo sapiens
ttacagcagcaatagag

SEQ ID NO: 7749630 - DNA, 22 bp, Homo sapiens
tgtgggcaggcccgggtctgag

SEQ ID NO: 7749631 - DNA, 20 bp, Homo sapiens
tgtgggcccttggctggcaa

SEQ ID NO: 7749632 - DNA, 20 bp, Homo sapiens
tgtgggccttcggcgtgctc

SEQ ID NO: 7749633 - DNA, 22 bp, Homo sapiens
tgtgggaggtctggaaggctcc

SEQ ID NO: 7749634 - DNA, 22 bp, Homo sapiens
tgtgggcactaatgacatgcag

SEQ ID NO: 7749635 - DNA, 22 bp, Homo sapiens
tgtgggcagatacacagacacg

SEQ ID NO: 7749636 - DNA, 19 bp, Homo sapiens
tgtgggcaagggatggcag

SEQ ID NO: 7749637 - DNA, 22 bp, Homo sapiens
tgtggctgcagacactggagcc

SEQ ID NO: 7749638 - DNA, 22 bp, Homo sapiens
tgtgggaagagcagtggcagca

SEQ ID NO: 7749639 - DNA, 22 bp, Homo sapiens
tgtggccttgcagcctggaggt

SEQ ID NO: 7749640 - DNA, 22 bp, Homo sapiens
tgtggaaggcttccctggggtc

SEQ ID NO: 7749641 - DNA, 18 bp, Homo sapiens
tgtttatttttctcttac

SEQ ID NO: 7749642 - DNA, 22 bp, Homo sapiens
tgttttaaagccattgcctttc

SEQ ID NO: 7749643 - DNA, 22 bp, Homo sapiens
tgttttaagggtcaactgtcac

SEQ ID NO: 7749644 - DNA, 22 bp, Homo sapiens
tgttttaagctctagaagggga

SEQ ID NO: 7749645 - DNA, 22 bp, Homo sapiens
tgttttaagagcgcactttata

SEQ ID NO: 7749646 - DNA, 22 bp, Homo sapiens
tgttttaagggtcaactgtcac

SEQ ID NO: 7749647 - DNA, 22 bp, Homo sapiens
tgttttaatctcccattgctct

SEQ ID NO: 7749648 - DNA, 22 bp, Homo sapiens
tgttcttagcaggagcatctat

SEQ ID NO: 7749649 - DNA, 22 bp, Homo sapiens
tgttaagaagaggcagtactta

SEQ ID NO: 7749650 - DNA, 22 bp, Homo sapiens
tgtttattttcaggatggattg

SEQ ID NO: 7749651 - DNA, 22 bp, Homo sapiens
tgtttattgcagtgctgggctg

SEQ ID NO: 7749652 - DNA, 22 bp, Homo sapiens
tgtttattgctgcaattgtgcc

SEQ ID NO: 7749653 - DNA, 18 bp, Homo sapiens
tgtttattctcctgacag

SEQ ID NO: 7749654 - DNA, 22 bp, Homo sapiens
tgtttattgagtgcctactata

SEQ ID NO: 7749655 - DNA, 22 bp, Homo sapiens
tgtttattacagttcttggaat

SEQ ID NO: 7749656 - DNA, 22 bp, Homo sapiens
tgtttattcatggctaatgaaa

SEQ ID NO: 7749657 - DNA, 22 bp, Homo sapiens
tgtgcaggatgcgggggtacca

SEQ ID NO: 7749658 - DNA, 22 bp, Homo sapiens
tgtgcatgacagcatacaaacg

SEQ ID NO: 7749659 - DNA, 22 bp, Homo sapiens
tgtgaatgtctaggttttatgt

SEQ ID NO: 7749660 - DNA, 22 bp, Homo sapiens
tgtgaatgtctaggttttatgt

SEQ ID NO: 7749661 - DNA, 22 bp, Homo sapiens
tgtgaatgtatagtttgtatat

SEQ ID NO: 7749662 - DNA, 22 bp, Homo sapiens
tgtgactggttgtcccgctttc

SEQ ID NO: 7749663 - DNA, 22 bp, Homo sapiens
tgtctgaaacttatgatatact

SEQ ID NO: 7749664 - DNA, 22 bp, Homo sapiens
tgtcttcaggagtaaatatcat

SEQ ID NO: 7749665 - DNA, 22 bp, Homo sapiens
tgtcttcattctgtatgtccag

SEQ ID NO: 7749666 - DNA, 22 bp, Homo sapiens
acacacagaaggaagccccact

SEQ ID NO: 7749667 - DNA, 22 bp, Homo sapiens
acacacatggtattgttcagaa

SEQ ID NO: 7749668 - DNA, 22 bp, Homo sapiens
agcagaaaactttcatgctctg

SEQ ID NO: 7749669 - DNA, 22 bp, Homo sapiens
agcagaaagcttattttgactg

SEQ ID NO: 7749670 - DNA, 22 bp, Homo sapiens
acacaccatgatttatttaccc

SEQ ID NO: 7749671 - DNA, 22 bp, Homo sapiens
acacactgggcatggtttatgc

SEQ ID NO: 7749672 - DNA, 23 bp, Homo sapiens
acacagaagaagacccaaggaag

SEQ ID NO: 7749673 - DNA, 22 bp, Homo sapiens
acacagaacctcatagcctctc

SEQ ID NO: 7749674 - DNA, 22 bp, Homo sapiens
agcagccagtgggagtgataca

SEQ ID NO: 7749675 - DNA, 22 bp, Homo sapiens
agcagccaggaatctgcagagc

SEQ ID NO: 7749676 - DNA, 22 bp, Homo sapiens
agcagctgagccccagctgtga

SEQ ID NO: 7749677 - DNA, 22 bp, Homo sapiens
agcaggaacgagttcatgggga

SEQ ID NO: 7749678 - DNA, 23 bp, Homo sapiens
agcagccatagggaagcaataca

SEQ ID NO: 7749679 - DNA, 22 bp, Homo sapiens
agcagccatccttagagaaaga

SEQ ID NO: 7749680 - DNA, 22 bp, Homo sapiens
agcagccatagatagcatgcaa

SEQ ID NO: 7749681 - DNA, 21 bp, Homo sapiens
agcagccatttcacagagact

SEQ ID NO: 7749682 - DNA, 22 bp, Homo sapiens
agcagcccaaacagactaagac

SEQ ID NO: 7749683 - DNA, 22 bp, Homo sapiens
agcagttatattactctcaggt

SEQ ID NO: 7749684 - DNA, 22 bp, Homo sapiens
agcctgtgagggatgctgcagt

SEQ ID NO: 7749685 - DNA, 22 bp, Homo sapiens
agcctgtgacattgactatgaa

SEQ ID NO: 7749686 - DNA, 22 bp, Homo sapiens
agcctgtgaaatctctgccact

SEQ ID NO: 7749687 - DNA, 22 bp, Homo sapiens
agcctgtgtgctttggacaggg

SEQ ID NO: 7749688 - DNA, 22 bp, Homo sapiens
agcctgtgttgctctggcgata

SEQ ID NO: 7749689 - DNA, 22 bp, Homo sapiens
agccttaaatgctagattcata

SEQ ID NO: 7749690 - DNA, 22 bp, Homo sapiens
agcctgtgtgaagccctcagag

SEQ ID NO: 7749691 - DNA, 22 bp, Homo sapiens
agcctgtgtcctcatctgcagc

SEQ ID NO: 7749692 - DNA, 22 bp, Homo sapiens
agcctgtggatccctgcactgg

SEQ ID NO: 7749693 - DNA, 20 bp, Homo sapiens
agcctgtgtacttgcctgtg

SEQ ID NO: 7749694 - DNA, 22 bp, Homo sapiens
agcctgtggaaactgggtgcag

SEQ ID NO: 7749695 - DNA, 22 bp, Homo sapiens
acagacatatttggcccatagc

SEQ ID NO: 7749696 - DNA, 22 bp, Homo sapiens
acagaacatggatttttgaagt

SEQ ID NO: 7749697 - DNA, 22 bp, Homo sapiens
acagaactgtgtgatgattaag

SEQ ID NO: 7749698 - DNA, 22 bp, Homo sapiens
agcatgaaaacatgaaacagca

SEQ ID NO: 7749699 - DNA, 22 bp, Homo sapiens
agcatctggtgagggcctagtt

SEQ ID NO: 7749700 - DNA, 22 bp, Homo sapiens
agcatttaatcctacatagatc

SEQ ID NO: 7749701 - DNA, 22 bp, Homo sapiens
agcattggtggccagagtgcct

SEQ ID NO: 7749702 - DNA, 22 bp, Homo sapiens
agccaggctaaatgagccatga

SEQ ID NO: 7749703 - DNA, 22 bp, Homo sapiens
agccaggctactccttgctgac

SEQ ID NO: 7749704 - DNA, 22 bp, Homo sapiens
acagaacagagggttttagaat

SEQ ID NO: 7749705 - DNA, 22 bp, Homo sapiens
agagaaatgattcctgggcaga

SEQ ID NO: 7749706 - DNA, 22 bp, Homo sapiens
agagaaatatttaggaaaggag

SEQ ID NO: 7749707 - DNA, 20 bp, Homo sapiens
agagagcacaggcaggaaag

SEQ ID NO: 7749708 - DNA, 20 bp, Homo sapiens
agacaccccctgacagggaa

SEQ ID NO: 7749709 - DNA, 22 bp, Homo sapiens
agactgcagcaaccccttcagc

SEQ ID NO: 7749710 - DNA, 22 bp, Homo sapiens
agaatctaagtacacagacaga

SEQ ID NO: 7749711 - DNA, 22 bp, Homo sapiens
aatgtacaggctggctatgggg

SEQ ID NO: 7749712 - DNA, 22 bp, Homo sapiens
agaattttatctaaagggagta

SEQ ID NO: 7749713 - DNA, 22 bp, Homo sapiens
agaatttttgattatctactcg

SEQ ID NO: 7749714 - DNA, 22 bp, Homo sapiens
aatgtaaacagcaagagaaggg

SEQ ID NO: 7749715 - DNA, 22 bp, Homo sapiens
agaataaaatagtctgaagatg

SEQ ID NO: 7749716 - DNA, 22 bp, Homo sapiens
aatggaatacctaggtggccca

SEQ ID NO: 7749717 - DNA, 22 bp, Homo sapiens
agagggcattaactctgtcttg

SEQ ID NO: 7749718 - DNA, 22 bp, Homo sapiens
aatttattatatcctaggggaa

SEQ ID NO: 7749719 - DNA, 22 bp, Homo sapiens
agagggcataaaatagagcacg

SEQ ID NO: 7749720 - DNA, 22 bp, Homo sapiens
agatatcaccagttttacatac

SEQ ID NO: 7749721 - DNA, 22 bp, Homo sapiens
agatcggctttgcagacctcat

SEQ ID NO: 7749722 - DNA, 22 bp, Homo sapiens
accaccccagaatttttcaagg

SEQ ID NO: 7749723 - DNA, 22 bp, Homo sapiens
accaccccaaatgaacctctgt

SEQ ID NO: 7749724 - DNA, 22 bp, Homo sapiens
aagtaaaacacacagtccaccg

SEQ ID NO: 7749725 - DNA, 22 bp, Homo sapiens
accaggaaatttggcaacaaag

SEQ ID NO: 7749726 - DNA, 22 bp, Homo sapiens
accaggaaaaacactgtgttgg

SEQ ID NO: 7749727 - DNA, 22 bp, Homo sapiens
accaggaaactctcgtctagtt

SEQ ID NO: 7749728 - DNA, 22 bp, Homo sapiens
accaggaaactgtgcccacgac

SEQ ID NO: 7749729 - DNA, 22 bp, Homo sapiens
acatagaaatttatttcttaca

SEQ ID NO: 7749730 - DNA, 23 bp, Homo sapiens
acatagaacagaatatatttgtg

SEQ ID NO: 7749731 - DNA, 22 bp, Homo sapiens
acatacattgcctcattggtaa

SEQ ID NO: 7749732 - DNA, 18 bp, Homo sapiens
acaggcttaggaaatgtg

SEQ ID NO: 7749733 - DNA, 22 bp, Homo sapiens
acaggcttagggcaggctgacc

SEQ ID NO: 7749734 - DNA, 22 bp, Homo sapiens
acaggcttctcacagaaaaggg

SEQ ID NO: 7749735 - DNA, 22 bp, Homo sapiens
acaggctttatgtagtgactta

SEQ ID NO: 7749736 - DNA, 20 bp, Homo sapiens
acaggctttctgaggctggc

SEQ ID NO: 7749737 - DNA, 20 bp, Homo sapiens
acaggctttggagtctgaat

SEQ ID NO: 7749738 - DNA, 22 bp, Homo sapiens
acaggcttttttagaatgacat

SEQ ID NO: 7749739 - DNA, 22 bp, Homo sapiens
acaggtctccagagtgagagga

SEQ ID NO: 7749740 - DNA, 22 bp, Homo sapiens
acaggtctggtctgggtgggac

SEQ ID NO: 7749741 - DNA, 22 bp, Homo sapiens
acagtttagaatgccacatagt

SEQ ID NO: 7749742 - DNA, 22 bp, Homo sapiens
acagatttggaggcctcacccc

SEQ ID NO: 7749743 - DNA, 22 bp, Homo sapiens
acagatttattgaagctgctgc

SEQ ID NO: 7749744 - DNA, 22 bp, Homo sapiens
acaggaacagcttgatggcatc

SEQ ID NO: 7749745 - DNA, 22 bp, Homo sapiens
acaggaacccagaaacatttct

SEQ ID NO: 7749746 - DNA, 22 bp, Homo sapiens
acaggaaattggcatatcagtt

SEQ ID NO: 7749747 - DNA, 22 bp, Homo sapiens
acaggaaccaggcaggtcgatt

SEQ ID NO: 7749748 - DNA, 22 bp, Homo sapiens
acaggagcccaggatgggcgga

SEQ ID NO: 7749749 - DNA, 22 bp, Homo sapiens
acaggcagagaactcagccaga

SEQ ID NO: 7749750 - DNA, 22 bp, Homo sapiens
acaggccagaggtggggcagcc

SEQ ID NO: 7749751 - DNA, 22 bp, Homo sapiens
aagtggcagttcaggaagcaga

SEQ ID NO: 7749752 - DNA, 22 bp, Homo sapiens
aagtggagctataggctcagat

SEQ ID NO: 7749753 - DNA, 22 bp, Homo sapiens
actcagtacatctggagttggc

SEQ ID NO: 7749754 - DNA, 22 bp, Homo sapiens
aataaagaatggatgagatcgt

SEQ ID NO: 7749755 - DNA, 22 bp, Homo sapiens
aataaagccttattgattttac

SEQ ID NO: 7749756 - DNA, 22 bp, Homo sapiens
actgagaagattctcactctta

SEQ ID NO: 7749757 - DNA, 22 bp, Homo sapiens
aagttttattggaacatagcca

SEQ ID NO: 7749758 - DNA, 23 bp, Homo sapiens
aagtgaacaggagctagatggtc

SEQ ID NO: 7749759 - DNA, 22 bp, Homo sapiens
agaaaataatttcttggctggt

SEQ ID NO: 7749760 - DNA, 22 bp, Homo sapiens
agaaaatattcattgagaggct

SEQ ID NO: 7749761 - DNA, 21 bp, Homo sapiens
agaaaatggcgttttagattt

SEQ ID NO: 7749762 - DNA, 22 bp, Homo sapiens
aatcttctacttgacagttctc

SEQ ID NO: 7749763 - DNA, 22 bp, Homo sapiens
aatcttctttcttaacagtaca

SEQ ID NO: 7749764 - DNA, 22 bp, Homo sapiens
aatcttcattttgacaagattc

SEQ ID NO: 7749765 - DNA, 22 bp, Homo sapiens
aatcttcataaaaatctagtag

SEQ ID NO: 7749766 - DNA, 22 bp, Homo sapiens
agaaactatcctgagtagcaaa

SEQ ID NO: 7749767 - DNA, 22 bp, Homo sapiens
acttccagctgccctgtgtgct

SEQ ID NO: 7749768 - DNA, 22 bp, Homo sapiens
acttccaggttccacccaagac

SEQ ID NO: 7749769 - DNA, 22 bp, Homo sapiens
acttccagggtagaggggaaga

SEQ ID NO: 7749770 - DNA, 16 bp, Homo sapiens
acttccaggggagccc

SEQ ID NO: 7749771 - DNA, 22 bp, Homo sapiens
acttccaggaggtgtcactgaa

SEQ ID NO: 7749772 - DNA, 22 bp, Homo sapiens
acttccaggaactgccgctaac

SEQ ID NO: 7749773 - DNA, 22 bp, Homo sapiens
acttccagctttataattcagt

SEQ ID NO: 7749774 - DNA, 22 bp, Homo sapiens
acttagcattatgtaattacta

SEQ ID NO: 7749775 - DNA, 22 bp, Homo sapiens
acttagcagtttagaatatgtc

SEQ ID NO: 7749776 - DNA, 22 bp, Homo sapiens
acttagcaggtactttcatatt

SEQ ID NO: 7749777 - DNA, 22 bp, Homo sapiens
acttagcaatttgattaaaaga

SEQ ID NO: 7749778 - DNA, 22 bp, Homo sapiens
acttccagtgtctgctgctagc

SEQ ID NO: 7749779 - DNA, 23 bp, Homo sapiens
acttccagttataggaactcttc

SEQ ID NO: 7749780 - DNA, 23 bp, Homo sapiens
acttccagttgcttcagcatatg

SEQ ID NO: 7749781 - DNA, 22 bp, Homo sapiens
acttccagttttaattaaattg

SEQ ID NO: 7749782 - DNA, 22 bp, Homo sapiens
aatactttcctatataaggtgc

SEQ ID NO: 7749783 - DNA, 22 bp, Homo sapiens
aatactttgccaagttcgaaga

SEQ ID NO: 7749784 - DNA, 22 bp, Homo sapiens
aacttggctaccagcgttaaat

SEQ ID NO: 7749785 - DNA, 22 bp, Homo sapiens
aagaaagctgaatattctgtgt

SEQ ID NO: 7749786 - DNA, 22 bp, Homo sapiens
aacttttagacttgggtataaa

SEQ ID NO: 7749787 - DNA, 22 bp, Homo sapiens
aagaatggtggtggggccagca

SEQ ID NO: 7749788 - DNA, 22 bp, Homo sapiens
aagcaaaggaaagctgactttt

SEQ ID NO: 7749789 - DNA, 22 bp, Homo sapiens
aagcagcataattgctatttta

SEQ ID NO: 7749790 - DNA, 22 bp, Homo sapiens
aagcagcagacctgattttgaa

SEQ ID NO: 7749791 - DNA, 22 bp, Homo sapiens
aagcagcaacaaactggataaa

SEQ ID NO: 7749792 - DNA, 22 bp, Homo sapiens
aagcagcaagtttatttctatc

SEQ ID NO: 7749793 - DNA, 22 bp, Homo sapiens
aagcactaggtcacacaagtta

SEQ ID NO: 7749794 - DNA, 22 bp, Homo sapiens
aactcacagctgtttggattag

SEQ ID NO: 7749795 - DNA, 23 bp, Homo sapiens
aactgagataatgtatgtaaagc

SEQ ID NO: 7749796 - DNA, 22 bp, Homo sapiens
aactgagattacaagagacatt

SEQ ID NO: 7749797 - DNA, 22 bp, Homo sapiens
aacttgaattctgccattcaga

SEQ ID NO: 7749798 - DNA, 22 bp, Homo sapiens
aactgagacacgaactatgatt

SEQ ID NO: 7749799 - DNA, 22 bp, Homo sapiens
aactcagacatgtataaagact

SEQ ID NO: 7749800 - DNA, 22 bp, Homo sapiens
aacagtctgggagttccttata

SEQ ID NO: 7749801 - DNA, 22 bp, Homo sapiens
aacattcaagttctggtttatg

SEQ ID NO: 7749802 - DNA, 22 bp, Homo sapiens
aacaagaacacctacagttcta

SEQ ID NO: 7749803 - DNA, 23 bp, Homo sapiens
aacacaaagctgattccagtggc

SEQ ID NO: 7749804 - DNA, 22 bp, Homo sapiens
aacacaaagaagctgcaggatc

SEQ ID NO: 7749805 - DNA, 21 bp, Homo sapiens
aacacatccagagtatttgac

SEQ ID NO: 7749806 - DNA, 22 bp, Homo sapiens
aaagcacagggtgctagagagt

SEQ ID NO: 7749807 - DNA, 22 bp, Homo sapiens
aacaacagctgctaaagagttg

SEQ ID NO: 7749808 - DNA, 22 bp, Homo sapiens
aacaaattagttgcaagactgg

SEQ ID NO: 7749809 - DNA, 22 bp, Homo sapiens
aaaccacatgccttcaaatgct

SEQ ID NO: 7749810 - DNA, 22 bp, Homo sapiens
aaaccacacttagcagtttcgt

SEQ ID NO: 7749811 - DNA, 22 bp, Homo sapiens
aaacacagggatatatattcca

SEQ ID NO: 7749812 - DNA, 20 bp, Homo sapiens
aaacacagcctctctttaca

SEQ ID NO: 7749813 - DNA, 19 bp, Homo sapiens
aaacacagatttcttacca

SEQ ID NO: 7749814 - DNA, 22 bp, Homo sapiens
aaagaagacagacatttctttc

SEQ ID NO: 7749815 - DNA, 22 bp, Homo sapiens
aaagatctatgggcatttagct

SEQ ID NO: 7749816 - DNA, 22 bp, Homo sapiens
aaaagtattttggatctcagat

SEQ ID NO: 7749817 - DNA, 22 bp, Homo sapiens
aaacacacagaaatgaatgagg

SEQ ID NO: 7749818 - DNA, 22 bp, Homo sapiens
aaacacacctttggaactgtga

SEQ ID NO: 7749819 - DNA, 22 bp, Homo sapiens
aaacaaagccagggaagttatg

SEQ ID NO: 7749820 - DNA, 22 bp, Homo sapiens
aaacaaagcatcttgctatgca

SEQ ID NO: 7749821 - DNA, 22 bp, Homo sapiens
aaagatgtcatacacattaaga

SEQ ID NO: 7749822 - DNA, 23 bp, Homo sapiens
aaagatgtgagtattcatatggc

SEQ ID NO: 7749823 - DNA, 22 bp, Homo sapiens
aaagatgtgcctgtttcatagt

SEQ ID NO: 7749824 - DNA, 22 bp, Homo sapiens
aaatatgttttccagttgtcat

SEQ ID NO: 7749825 - DNA, 22 bp, Homo sapiens
aaatgctatttgggaacaacat

SEQ ID NO: 7749826 - DNA, 22 bp, Homo sapiens
aaatgctacatacacatcaggg

SEQ ID NO: 7749827 - DNA, 22 bp, Homo sapiens
aaacggagggcaaatgctgtta

SEQ ID NO: 7749828 - DNA, 22 bp, Homo sapiens
aaactaagactaatgaagaact

SEQ ID NO: 7749829 - DNA, 22 bp, Homo sapiens
aaactaagggagatgtgggctg

SEQ ID NO: 7749830 - DNA, 22 bp, Homo sapiens
aaactaaggtgctgtggactga

SEQ ID NO: 7749831 - DNA, 19 bp, Homo sapiens
aaactaaggggaaatgttt

SEQ ID NO: 7749832 - DNA, 23 bp, Homo sapiens
aaactacatttatagtttttctc

SEQ ID NO: 7749833 - DNA, 22 bp, Homo sapiens
acactaaatgagtctacagtac

SEQ ID NO: 7749834 - DNA, 22 bp, Homo sapiens
acacggaatcccttttgtgaca

SEQ ID NO: 7749835 - DNA, 22 bp, Homo sapiens
acactacaatctcagaactata

SEQ ID NO: 7749836 - DNA, 22 bp, Homo sapiens
aagagtggagaataaaatagga

SEQ ID NO: 7749837 - DNA, 22 bp, Homo sapiens
acacacagagtttatacaggca

SEQ ID NO: 7749838 - DNA, 20 bp, Homo sapiens
acacacagagacatgcgcat

SEQ ID NO: 7749839 - DNA, 22 bp, Homo sapiens
acacacagcgcctaccatgtgc

SEQ ID NO: 7749840 - DNA, 22 bp, Homo sapiens
acacacaggtaaaggagcctgg

SEQ ID NO: 7749841 - DNA, 22 bp, Homo sapiens
aagaggcagcccgctgaggctg

SEQ ID NO: 7749842 - DNA, 22 bp, Homo sapiens
acagaagacagagtgttcatct

SEQ ID NO: 7749843 - DNA, 22 bp, Homo sapiens
acagaagaaagggaggttttgc

SEQ ID NO: 7749844 - DNA, 22 bp, Homo sapiens
aagatttcttacttattgatgc

SEQ ID NO: 7749845 - DNA, 22 bp, Homo sapiens
acagaagagcacatttagtatg

SEQ ID NO: 7749846 - DNA, 22 bp, Homo sapiens
aagattttcagtgcctaaaaca

SEQ ID NO: 7749847 - DNA, 22 bp, Homo sapiens
aagattttcagctaatggtgca

SEQ ID NO: 7749848 - DNA, 18 bp, Homo sapiens
acagaggcagacatgtat

SEQ ID NO: 7749849 - DNA, 22 bp, Homo sapiens
acagagcttcccagcctgagca

SEQ ID NO: 7749850 - DNA, 22 bp, Homo sapiens
acaagaaaggtaggattcaggt

SEQ ID NO: 7749851 - DNA, 22 bp, Homo sapiens
acaagaagagcatttgcagggt

SEQ ID NO: 7749852 - DNA, 22 bp, Homo sapiens
acaagaagggtgattaggggca

SEQ ID NO: 7749853 - DNA, 22 bp, Homo sapiens
acaagaagtcacatctaggagt

SEQ ID NO: 7749854 - DNA, 22 bp, Homo sapiens
acaactgttggaggaacacagg

SEQ ID NO: 7749855 - DNA, 22 bp, Homo sapiens
acaactgtcagtaaagaatatt

SEQ ID NO: 7749856 - DNA, 22 bp, Homo sapiens
aattagctaattaattgtagcc

SEQ ID NO: 7749857 - DNA, 22 bp, Homo sapiens
aagacaagcatcaaatcaggca

SEQ ID NO: 7749858 - DNA, 22 bp, Homo sapiens
aatgttaagtttagattataac

SEQ ID NO: 7749859 - DNA, 22 bp, Homo sapiens
aatgtgaaaccgcacagaataa

SEQ ID NO: 7749860 - DNA, 22 bp, Homo sapiens
aactttccatcatttgaagccc

SEQ ID NO: 7749861 - DNA, 22 bp, Homo sapiens
aatgtattttgggagtttcttt

SEQ ID NO: 7749862 - DNA, 22 bp, Homo sapiens
aatgtatttgatgtattagcct

SEQ ID NO: 7749863 - DNA, 22 bp, Homo sapiens
aaattgctaaggatctcatgtg

SEQ ID NO: 7749864 - DNA, 22 bp, Homo sapiens
aagctgtcaatgtatctagtct

SEQ ID NO: 7749865 - DNA, 22 bp, Homo sapiens
aagctgggacttagcgcagata

SEQ ID NO: 7749866 - DNA, 20 bp, Homo sapiens
aagctgggtaggagaggagc

SEQ ID NO: 7749867 - DNA, 18 bp, Homo sapiens
aagctgggaaggagacag

SEQ ID NO: 7749868 - DNA, 22 bp, Homo sapiens
aagctgattccactttttccac

SEQ ID NO: 7749869 - DNA, 22 bp, Homo sapiens
aagctgatgtcccagtttgaag

SEQ ID NO: 7749870 - DNA, 22 bp, Homo sapiens
aagctgattctaaaatttatta

SEQ ID NO: 7749871 - DNA, 22 bp, Homo sapiens
aagccagtaagtttttgtcatt

SEQ ID NO: 7749872 - DNA, 22 bp, Homo sapiens
aagccagtattcaatggggcta

SEQ ID NO: 7749873 - DNA, 22 bp, Homo sapiens
aagccagtgggcatagcagttg

SEQ ID NO: 7749874 - DNA, 22 bp, Homo sapiens
aagccagtggtgagaagatagc

SEQ ID NO: 7749875 - DNA, 22 bp, Homo sapiens
aagccagtgtccagaatgggca

SEQ ID NO: 7749876 - DNA, 22 bp, Homo sapiens
aagccagtgtgacaggaaactt

SEQ ID NO: 7749877 - DNA, 22 bp, Homo sapiens
aagccagtcctctactgggcac

SEQ ID NO: 7749878 - DNA, 22 bp, Homo sapiens
aagccagtggcttctccctgct

SEQ ID NO: 7749879 - DNA, 22 bp, Homo sapiens
aagccagttagcacatcattgc

SEQ ID NO: 7749880 - DNA, 16 bp, Homo sapiens
aagccagttcagcatt

SEQ ID NO: 7749881 - DNA, 22 bp, Homo sapiens
aagccagtgtggtctgcccatt

SEQ ID NO: 7749882 - DNA, 22 bp, Homo sapiens
aagccagtgtttttgagagttg

SEQ ID NO: 7749883 - DNA, 22 bp, Homo sapiens
aagccatcttgtttatatgtta

SEQ ID NO: 7749884 - DNA, 22 bp, Homo sapiens
aagtacagaaatagcaggtgca

SEQ ID NO: 7749885 - DNA, 22 bp, Homo sapiens
aagttgaatcagtaacacagtt

SEQ ID NO: 7749886 - DNA, 22 bp, Homo sapiens
aagtatttcgttctgaaaaagt

SEQ ID NO: 7749887 - DNA, 20 bp, Homo sapiens
aactcctagcctcaagtgat

SEQ ID NO: 7749888 - DNA, 22 bp, Homo sapiens
aaccaggatttaagattctaga

SEQ ID NO: 7749889 - DNA, 20 bp, Homo sapiens
aaccaggatagaccagggaa

SEQ ID NO: 7749890 - DNA, 22 bp, Homo sapiens
aaccaggagattaaagaaaggt

SEQ ID NO: 7749891 - DNA, 22 bp, Homo sapiens
aaccaggacaatttgaatagaa

SEQ ID NO: 7749892 - DNA, 19 bp, Homo sapiens
aaccaggacaaggggctgg

SEQ ID NO: 7749893 - DNA, 22 bp, Homo sapiens
aaccaggacaattttgaaagta

SEQ ID NO: 7749894 - DNA, 22 bp, Homo sapiens
aaccaggaacttttgtgagagc

SEQ ID NO: 7749895 - DNA, 22 bp, Homo sapiens
aaccaggaagggcgcaaattat

SEQ ID NO: 7749896 - DNA, 22 bp, Homo sapiens
aaccaggaaaagttatgaatag

SEQ ID NO: 7749897 - DNA, 19 bp, Homo sapiens
aaccaggaactaaagcaga

SEQ ID NO: 7749898 - DNA, 22 bp, Homo sapiens
aaccaggaattgcagggctgca

SEQ ID NO: 7749899 - DNA, 22 bp, Homo sapiens
aaccagctgagaatgcttctgc

SEQ ID NO: 7749900 - DNA, 22 bp, Homo sapiens
aacattctttggaggattattc

SEQ ID NO: 7749901 - DNA, 22 bp, Homo sapiens
aatatttgcatcattagctatt

SEQ ID NO: 7749902 - DNA, 22 bp, Homo sapiens
agccagcaggtgcagaattcca

SEQ ID NO: 7749903 - DNA, 22 bp, Homo sapiens
agccagcaggtgagtgcagcct

SEQ ID NO: 7749904 - DNA, 22 bp, Homo sapiens
cagagctcagagcagggcactc

SEQ ID NO: 7749905 - DNA, 22 bp, Homo sapiens
cagagccttcctagcagactct

SEQ ID NO: 7749906 - DNA, 22 bp, Homo sapiens
cagagacccctggcatggtggt

SEQ ID NO: 7749907 - DNA, 22 bp, Homo sapiens
cagagacccttctcagtggcca

SEQ ID NO: 7749908 - DNA, 22 bp, Homo sapiens
agccctggcagagccaggtagt

SEQ ID NO: 7749909 - DNA, 18 bp, Homo sapiens
agcctgggctctgcctgg

SEQ ID NO: 7749910 - DNA, 21 bp, Homo sapiens
agcctgggtatcctttgagga

SEQ ID NO: 7749911 - DNA, 22 bp, Homo sapiens
cagcaagaaaattcacatgctc

SEQ ID NO: 7749912 - DNA, 22 bp, Homo sapiens
cagcaagaacagcctgatgtgc

SEQ ID NO: 7749913 - DNA, 22 bp, Homo sapiens
agcctgggcatgggacgggagg

SEQ ID NO: 7749914 - DNA, 22 bp, Homo sapiens
agcctgggaatttagagttcgg

SEQ ID NO: 7749915 - DNA, 21 bp, Homo sapiens
agcctgggaggcggaggttgc

SEQ ID NO: 7749916 - DNA, 22 bp, Homo sapiens
cagcaactcctatattgaaagc

SEQ ID NO: 7749917 - DNA, 22 bp, Homo sapiens
cagcaacatatatgaaactgtg

SEQ ID NO: 7749918 - DNA, 22 bp, Homo sapiens
agcagcccagttgtactgagtg

SEQ ID NO: 7749919 - DNA, 22 bp, Homo sapiens
agcagcccaggcaaagataaaa

SEQ ID NO: 7749920 - DNA, 22 bp, Homo sapiens
agcagccctatgtaattggact

SEQ ID NO: 7749921 - DNA, 22 bp, Homo sapiens
agcagctagacttcagaatctg

SEQ ID NO: 7749922 - DNA, 22 bp, Homo sapiens
cacagagatcggaacagaagta

SEQ ID NO: 7749923 - DNA, 22 bp, Homo sapiens
cacagagattagaattagacta

SEQ ID NO: 7749924 - DNA, 22 bp, Homo sapiens
caaaggctgccactgtggctgt

SEQ ID NO: 7749925 - DNA, 22 bp, Homo sapiens
agcactagacatgtaagtgagc

SEQ ID NO: 7749926 - DNA, 17 bp, Homo sapiens
agcactaaaatgcttcc

SEQ ID NO: 7749927 - DNA, 22 bp, Homo sapiens
agcactagagccaaaatttggg

SEQ ID NO: 7749928 - DNA, 22 bp, Homo sapiens
agcactagctttaagcattctg

SEQ ID NO: 7749929 - DNA, 22 bp, Homo sapiens
agcactagcctgttttgctgtg

SEQ ID NO: 7749930 - DNA, 20 bp, Homo sapiens
agcactaggtgtggcaggtg

SEQ ID NO: 7749931 - DNA, 22 bp, Homo sapiens
agcactcttctgtgatagttgt

SEQ ID NO: 7749932 - DNA, 22 bp, Homo sapiens
agcagagctgcagtggcctgct

SEQ ID NO: 7749933 - DNA, 22 bp, Homo sapiens
agcagagcgcctgctcagaggg

SEQ ID NO: 7749934 - DNA, 22 bp, Homo sapiens
agcagagctgggatcctgggtc

SEQ ID NO: 7749935 - DNA, 22 bp, Homo sapiens
agcagagctttttggactcaga

SEQ ID NO: 7749936 - DNA, 22 bp, Homo sapiens
caataatatcctgtgctgtttg

SEQ ID NO: 7749937 - DNA, 20 bp, Homo sapiens
agcagagtgcccatcccgga

SEQ ID NO: 7749938 - DNA, 22 bp, Homo sapiens
agcagtggcctggggctctgtg

SEQ ID NO: 7749939 - DNA, 18 bp, Homo sapiens
agcatgagagaggctgtg

SEQ ID NO: 7749940 - DNA, 18 bp, Homo sapiens
agcatgagtcaggggtgc

SEQ ID NO: 7749941 - DNA, 22 bp, Homo sapiens
agcagtggacctcagtgctatt

SEQ ID NO: 7749942 - DNA, 22 bp, Homo sapiens
agcagtaagcaactgagcttgc

SEQ ID NO: 7749943 - DNA, 22 bp, Homo sapiens
agcagggctgcagtgtgtcttt

SEQ ID NO: 7749944 - DNA, 22 bp, Homo sapiens
agcattaataagaaatggctcc

SEQ ID NO: 7749945 - DNA, 23 bp, Homo sapiens
agcattagagatgccagccctgt

SEQ ID NO: 7749946 - DNA, 22 bp, Homo sapiens
cactgttgaagatacttcctct

SEQ ID NO: 7749947 - DNA, 22 bp, Homo sapiens
agcattaagcctggctcagagg

SEQ ID NO: 7749948 - DNA, 22 bp, Homo sapiens
agcattaagagagactgaactg

SEQ ID NO: 7749949 - DNA, 22 bp, Homo sapiens
agcatgttgggatgagaaggaa

SEQ ID NO: 7749950 - DNA, 22 bp, Homo sapiens
agcatgtaaagctcttagcacc

SEQ ID NO: 7749951 - DNA, 19 bp, Homo sapiens
agcatggcctacagtgtgc

SEQ ID NO: 7749952 - DNA, 22 bp, Homo sapiens
agcatggccacgggggtaggta

SEQ ID NO: 7749953 - DNA, 22 bp, Homo sapiens
agcatgctatattgattgtagt

SEQ ID NO: 7749954 - DNA, 22 bp, Homo sapiens
agcaggcttatggttgaaggga

SEQ ID NO: 7749955 - DNA, 22 bp, Homo sapiens
cacagcagaaagtgtaggagga

SEQ ID NO: 7749956 - DNA, 22 bp, Homo sapiens
cacagcagaaatatgaaggcag

SEQ ID NO: 7749957 - DNA, 22 bp, Homo sapiens
cacagcagaacttaatttcaaa

SEQ ID NO: 7749958 - DNA, 22 bp, Homo sapiens
cacagcagagggagccattgaa

SEQ ID NO: 7749959 - DNA, 22 bp, Homo sapiens
agcaggaagtcctctcaggaga

SEQ ID NO: 7749960 - DNA, 22 bp, Homo sapiens
agcaggaagtagtctgtaagca

SEQ ID NO: 7749961 - DNA, 22 bp, Homo sapiens
agcaggaaggggatgatgggca

SEQ ID NO: 7749962 - DNA, 22 bp, Homo sapiens
agcaggaaggggcctagcctgg

SEQ ID NO: 7749963 - DNA, 22 bp, Homo sapiens
agcaggaaggtctgtgtgagtc

SEQ ID NO: 7749964 - DNA, 22 bp, Homo sapiens
caccagcagaagactgagggtg

SEQ ID NO: 7749965 - DNA, 22 bp, Homo sapiens
agcagggcagctgatgcgcacg

SEQ ID NO: 7749966 - DNA, 22 bp, Homo sapiens
agagcacaggctctggagtcta

SEQ ID NO: 7749967 - DNA, 22 bp, Homo sapiens
agagcacaggtgctggagccca

SEQ ID NO: 7749968 - DNA, 21 bp, Homo sapiens
agagcacaggtggacaatgct

SEQ ID NO: 7749969 - DNA, 22 bp, Homo sapiens
agagcaccccgggaagagcaag

SEQ ID NO: 7749970 - DNA, 22 bp, Homo sapiens
agagcagacatccttgtcttgt

SEQ ID NO: 7749971 - DNA, 22 bp, Homo sapiens
agagcagaggcatggccgtggg

SEQ ID NO: 7749972 - DNA, 22 bp, Homo sapiens
agagcagagggctctgggacaa

SEQ ID NO: 7749973 - DNA, 22 bp, Homo sapiens
agagcagatttcaaatattggc

SEQ ID NO: 7749974 - DNA, 22 bp, Homo sapiens
agagcagatggagctggaagag

SEQ ID NO: 7749975 - DNA, 22 bp, Homo sapiens
agagcagatggccagggggcct

SEQ ID NO: 7749976 - DNA, 22 bp, Homo sapiens
agagccaggccaggccggggca

SEQ ID NO: 7749977 - DNA, 22 bp, Homo sapiens
agagctggctgctgcggtgctt

SEQ ID NO: 7749978 - DNA, 21 bp, Homo sapiens
agagctggcctgccaggccct

SEQ ID NO: 7749979 - DNA, 22 bp, Homo sapiens
agagccctggagggcagtcccg

SEQ ID NO: 7749980 - DNA, 22 bp, Homo sapiens
agagccctctgcaatgcctcag

SEQ ID NO: 7749981 - DNA, 22 bp, Homo sapiens
agagaatccccagacagagtta

SEQ ID NO: 7749982 - DNA, 22 bp, Homo sapiens
agagaagggtgtagcctgggcc

SEQ ID NO: 7749983 - DNA, 22 bp, Homo sapiens
agagaatgcagggcttcggaca

SEQ ID NO: 7749984 - DNA, 22 bp, Homo sapiens
agagagcccgggccagggcaca

SEQ ID NO: 7749985 - DNA, 22 bp, Homo sapiens
agagagcatggcacagaggggt

SEQ ID NO: 7749986 - DNA, 22 bp, Homo sapiens
agacagaatttgtcagataaat

SEQ ID NO: 7749987 - DNA, 22 bp, Homo sapiens
agacagaacagaataattgttg

SEQ ID NO: 7749988 - DNA, 22 bp, Homo sapiens
agacccaggattggggctgccg

SEQ ID NO: 7749989 - DNA, 22 bp, Homo sapiens
agaatattgaaagttcttgaca

SEQ ID NO: 7749990 - DNA, 22 bp, Homo sapiens
agacaaggctggagtttaggca

SEQ ID NO: 7749991 - DNA, 22 bp, Homo sapiens
agacacattttacattaactgt

SEQ ID NO: 7749992 - DNA, 22 bp, Homo sapiens
agacaacaccaaatgctagtgt

SEQ ID NO: 7749993 - DNA, 22 bp, Homo sapiens
agacaagaaactgggagtctct

SEQ ID NO: 7749994 - DNA, 21 bp, Homo sapiens
atgaaggcagtgccaagggct

SEQ ID NO: 7749995 - DNA, 22 bp, Homo sapiens
atgaacacatgtacacatttct

SEQ ID NO: 7749996 - DNA, 23 bp, Homo sapiens
agaggcacagcacttggctggcc

SEQ ID NO: 7749997 - DNA, 22 bp, Homo sapiens
agaggcacagaggcagtcccct

SEQ ID NO: 7749998 - DNA, 22 bp, Homo sapiens
agaggcacatggagggtggaag

SEQ ID NO: 7749999 - DNA, 22 bp, Homo sapiens
agaggcacaaactggaaaggac

SEQ ID NO: 7750000 - DNA, 22 bp, Homo sapiens
agaggcacaacagtcccattgt

SEQ ID NO: 7750001 - DNA, 22 bp, Homo sapiens
agaggcacccgcgcgcggccat

SEQ ID NO: 7750002 - DNA, 22 bp, Homo sapiens
agaggcaccgtctgcagcgtgc

SEQ ID NO: 7750003 - DNA, 23 bp, Homo sapiens
agaggcacctaaagtcaagttgt

SEQ ID NO: 7750004 - DNA, 22 bp, Homo sapiens
agaggcacccagttaagctgca

SEQ ID NO: 7750005 - DNA, 22 bp, Homo sapiens
agaggcaccatctggaacagcc

SEQ ID NO: 7750006 - DNA, 23 bp, Homo sapiens
agaggcactaattattcagagat

SEQ ID NO: 7750007 - DNA, 22 bp, Homo sapiens
agaggcactaagggaagagcag

SEQ ID NO: 7750008 - DNA, 22 bp, Homo sapiens
agaggcacggaggctgcatgga

SEQ ID NO: 7750009 - DNA, 22 bp, Homo sapiens
agaggccagcagtgcctatctg

SEQ ID NO: 7750010 - DNA, 18 bp, Homo sapiens
agaggctggacaggggat

SEQ ID NO: 7750011 - DNA, 22 bp, Homo sapiens
agaggccagctagcgggccatc

SEQ ID NO: 7750012 - DNA, 22 bp, Homo sapiens
agagtcaaaatttaccagaatg

SEQ ID NO: 7750013 - DNA, 22 bp, Homo sapiens
agagtcaagggtgcagaggaag

SEQ ID NO: 7750014 - DNA, 22 bp, Homo sapiens
agagtcaacatcgagccactgg

SEQ ID NO: 7750015 - DNA, 21 bp, Homo sapiens
agagtctgagtgtgcaagggc

SEQ ID NO: 7750016 - DNA, 22 bp, Homo sapiens
agagggcttccctaggagtgag

SEQ ID NO: 7750017 - DNA, 22 bp, Homo sapiens
agaggctgggaagggtccccgg

SEQ ID NO: 7750018 - DNA, 22 bp, Homo sapiens
agaggctgggtacgggccacct

SEQ ID NO: 7750019 - DNA, 19 bp, Homo sapiens
agcaacaccgtttatttcc

SEQ ID NO: 7750020 - DNA, 22 bp, Homo sapiens
agcaagaagctttgctgtgata

SEQ ID NO: 7750021 - DNA, 22 bp, Homo sapiens
agcaagaagggcaaggaagttt

SEQ ID NO: 7750022 - DNA, 21 bp, Homo sapiens
agcaagaatcaggaaggctct

SEQ ID NO: 7750023 - DNA, 20 bp, Homo sapiens
agcaagaaggttgtgggagc

SEQ ID NO: 7750024 - DNA, 22 bp, Homo sapiens
agatatttgtatcttgctattg

SEQ ID NO: 7750025 - DNA, 22 bp, Homo sapiens
acccagggtcaccccgtagggt

SEQ ID NO: 7750026 - DNA, 22 bp, Homo sapiens
acccagggtagagtgcagtggc

SEQ ID NO: 7750027 - DNA, 22 bp, Homo sapiens
agggcctgagaccgtggcttga

SEQ ID NO: 7750028 - DNA, 19 bp, Homo sapiens
agggcctgagcagatgttg

SEQ ID NO: 7750029 - DNA, 22 bp, Homo sapiens
agggcctctggaacactgaggg

SEQ ID NO: 7750030 - DNA, 22 bp, Homo sapiens
accctgggggtggccagtgcca

SEQ ID NO: 7750031 - DNA, 22 bp, Homo sapiens
accctggggtcacccttctctg

SEQ ID NO: 7750032 - DNA, 16 bp, Homo sapiens
accctgggtagtcctg

SEQ ID NO: 7750033 - DNA, 22 bp, Homo sapiens
accctgggtatttcccaaactt

SEQ ID NO: 7750034 - DNA, 22 bp, Homo sapiens
accctgggtcatatacagtgtg

SEQ ID NO: 7750035 - DNA, 21 bp, Homo sapiens
accctgggttctccataccct

SEQ ID NO: 7750036 - DNA, 22 bp, Homo sapiens
accctgggtgagaggcaaacag

SEQ ID NO: 7750037 - DNA, 22 bp, Homo sapiens
accctgggtctcaatcatccta

SEQ ID NO: 7750038 - DNA, 22 bp, Homo sapiens
accctgggttcccgcagcacca

SEQ ID NO: 7750039 - DNA, 22 bp, Homo sapiens
accctgggcacaccatttcccc

SEQ ID NO: 7750040 - DNA, 22 bp, Homo sapiens
accctgggcttggcctgctcag

SEQ ID NO: 7750041 - DNA, 23 bp, Homo sapiens
accctgggcaagtcacctaacct

SEQ ID NO: 7750042 - DNA, 18 bp, Homo sapiens
accctgggcaattcactc

SEQ ID NO: 7750043 - DNA, 22 bp, Homo sapiens
accctgggacttccgagttgag

SEQ ID NO: 7750044 - DNA, 22 bp, Homo sapiens
accctgggagggagaaatcaga

SEQ ID NO: 7750045 - DNA, 22 bp, Homo sapiens
accctgggacctggaggtggat

SEQ ID NO: 7750046 - DNA, 22 bp, Homo sapiens
accctgggaactggaaactgga

SEQ ID NO: 7750047 - DNA, 22 bp, Homo sapiens
accacagctttgcaccaggtgt

SEQ ID NO: 7750048 - DNA, 22 bp, Homo sapiens
accaggaacaagccatggagga

SEQ ID NO: 7750049 - DNA, 20 bp, Homo sapiens
accaggaatcttttctgagc

SEQ ID NO: 7750050 - DNA, 22 bp, Homo sapiens
accaggactttgtattcagctt

SEQ ID NO: 7750051 - DNA, 22 bp, Homo sapiens
accaggacattttagtcatctt

SEQ ID NO: 7750052 - DNA, 22 bp, Homo sapiens
accaggaagtgtgggccaacgt

SEQ ID NO: 7750053 - DNA, 22 bp, Homo sapiens
accaggaatattttgctcattt

SEQ ID NO: 7750054 - DNA, 18 bp, Homo sapiens
accaggaagcttcttgtc

SEQ ID NO: 7750055 - DNA, 22 bp, Homo sapiens
accaggaagcatccctttgtaa

SEQ ID NO: 7750056 - DNA, 22 bp, Homo sapiens
accaggaagctgtgagaccttt

SEQ ID NO: 7750057 - DNA, 22 bp, Homo sapiens
accaggaactcacccgcagagg

SEQ ID NO: 7750058 - DNA, 19 bp, Homo sapiens
accaggaacttccctaggc

SEQ ID NO: 7750059 - DNA, 22 bp, Homo sapiens
accaggaagagattccaattta

SEQ ID NO: 7750060 - DNA, 22 bp, Homo sapiens
accaggaagaacaggcaaggca

SEQ ID NO: 7750061 - DNA, 22 bp, Homo sapiens
agggcctcgaaggcagagggat

SEQ ID NO: 7750062 - DNA, 22 bp, Homo sapiens
agggcctcgggctcagtgggtc

SEQ ID NO: 7750063 - DNA, 23 bp, Homo sapiens
agggcccaagcctggacagcagg

SEQ ID NO: 7750064 - DNA, 22 bp, Homo sapiens
aggctgtgcaattagggtaaga

SEQ ID NO: 7750065 - DNA, 22 bp, Homo sapiens
aggccacagatactgtgaagta

SEQ ID NO: 7750066 - DNA, 22 bp, Homo sapiens
aggccacacaactcttagagat

SEQ ID NO: 7750067 - DNA, 22 bp, Homo sapiens
aggcatgggtagaagagaagcc

SEQ ID NO: 7750068 - DNA, 22 bp, Homo sapiens
aggccacaggattgcacagcat

SEQ ID NO: 7750069 - DNA, 19 bp, Homo sapiens
aggcatgggaagagaagtc

SEQ ID NO: 7750070 - DNA, 22 bp, Homo sapiens
aggcatggggctgcagtcaggt

SEQ ID NO: 7750071 - DNA, 22 bp, Homo sapiens
aggcatggcattcctcaagcaa

SEQ ID NO: 7750072 - DNA, 22 bp, Homo sapiens
acatacatgggattaaaaaatt

SEQ ID NO: 7750073 - DNA, 22 bp, Homo sapiens
acatgaaaagactatctgatta

SEQ ID NO: 7750074 - DNA, 22 bp, Homo sapiens
acatgaaaaatgtttgcagttt

SEQ ID NO: 7750075 - DNA, 22 bp, Homo sapiens
aggccaggtggtcatgcttgct

SEQ ID NO: 7750076 - DNA, 22 bp, Homo sapiens
acatgaaactgttgcattagaa

SEQ ID NO: 7750077 - DNA, 22 bp, Homo sapiens
agctgggagctgaaggctgatt

SEQ ID NO: 7750078 - DNA, 22 bp, Homo sapiens
agctgtgggcctgggagagctg

SEQ ID NO: 7750079 - DNA, 20 bp, Homo sapiens
agcttcagccctaggattgc

SEQ ID NO: 7750080 - DNA, 22 bp, Homo sapiens
agcttcagcttgcagctgtgat

SEQ ID NO: 7750081 - DNA, 22 bp, Homo sapiens
agcttcaggaacaggcagcctg

SEQ ID NO: 7750082 - DNA, 20 bp, Homo sapiens
agcttcaggctcaagagaac

SEQ ID NO: 7750083 - DNA, 22 bp, Homo sapiens
agcttcagggacttgtggcaga

SEQ ID NO: 7750084 - DNA, 22 bp, Homo sapiens
agcttcagatttatctttctgt

SEQ ID NO: 7750085 - DNA, 19 bp, Homo sapiens
agctgtggggcctagcacc

SEQ ID NO: 7750086 - DNA, 22 bp, Homo sapiens
agctgtggggcaggcagcgagg

SEQ ID NO: 7750087 - DNA, 22 bp, Homo sapiens
agctgtggggaggaggctagca

SEQ ID NO: 7750088 - DNA, 22 bp, Homo sapiens
agctgtggttctgggcagcgac

SEQ ID NO: 7750089 - DNA, 22 bp, Homo sapiens
agcttttattggctgtcatttg

SEQ ID NO: 7750090 - DNA, 23 bp, Homo sapiens
agcttttaggtggaaatggcact

SEQ ID NO: 7750091 - DNA, 19 bp, Homo sapiens
agcttttactaacagcaga

SEQ ID NO: 7750092 - DNA, 22 bp, Homo sapiens
agcttccaatttctccaagaga

SEQ ID NO: 7750093 - DNA, 22 bp, Homo sapiens
agcttcatggaacctgaggcta

SEQ ID NO: 7750094 - DNA, 22 bp, Homo sapiens
agcttcaggtggtcttgtttct

SEQ ID NO: 7750095 - DNA, 22 bp, Homo sapiens
agcttcagtgtcaggcccgtgg

SEQ ID NO: 7750096 - DNA, 17 bp, Homo sapiens
agcttcagttgcaaaac

SEQ ID NO: 7750097 - DNA, 22 bp, Homo sapiens
agcttcagttttctattgttaa

SEQ ID NO: 7750098 - DNA, 22 bp, Homo sapiens
aggaagccatggtggacgtcta

SEQ ID NO: 7750099 - DNA, 22 bp, Homo sapiens
aggaagccaggcccttgggtgg

SEQ ID NO: 7750100 - DNA, 22 bp, Homo sapiens
aggaagccactgaatgaaagtt

SEQ ID NO: 7750101 - DNA, 22 bp, Homo sapiens
aggaagccaagcctgacactca

SEQ ID NO: 7750102 - DNA, 20 bp, Homo sapiens
aggaagccaaaggctgtctt

SEQ ID NO: 7750103 - DNA, 22 bp, Homo sapiens
aggaagccacgagtggcacggg

SEQ ID NO: 7750104 - DNA, 22 bp, Homo sapiens
aggaaactttcttttgcttcat

SEQ ID NO: 7750105 - DNA, 22 bp, Homo sapiens
aggaaacttcagagttttggtc

SEQ ID NO: 7750106 - DNA, 22 bp, Homo sapiens
aggaaactgatgttttttacaa

SEQ ID NO: 7750107 - DNA, 22 bp, Homo sapiens
aggaaactgggcctcaggttag

SEQ ID NO: 7750108 - DNA, 22 bp, Homo sapiens
aggaaactgggtatggttatac

SEQ ID NO: 7750109 - DNA, 22 bp, Homo sapiens
aggaaactaacttatctttata

SEQ ID NO: 7750110 - DNA, 22 bp, Homo sapiens
acagccagtgctccgtgaggac

SEQ ID NO: 7750111 - DNA, 22 bp, Homo sapiens
agctgcagcttcctagtccagc

SEQ ID NO: 7750112 - DNA, 22 bp, Homo sapiens
acagccagaggtggtcctgggt

SEQ ID NO: 7750113 - DNA, 22 bp, Homo sapiens
acagccaggtaaaggcatggca

SEQ ID NO: 7750114 - DNA, 22 bp, Homo sapiens
acagccagggtctcaggaggcg

SEQ ID NO: 7750115 - DNA, 22 bp, Homo sapiens
acagccagtcctcccacagggt

SEQ ID NO: 7750116 - DNA, 22 bp, Homo sapiens
acagccagtgactgcagaccct

SEQ ID NO: 7750117 - DNA, 22 bp, Homo sapiens
acagccagtcatctcagcaggg

SEQ ID NO: 7750118 - DNA, 18 bp, Homo sapiens
aggacttgcctcagttgc

SEQ ID NO: 7750119 - DNA, 22 bp, Homo sapiens
aggagacatctaactgtaggtt

SEQ ID NO: 7750120 - DNA, 23 bp, Homo sapiens
aggaaggaggtcctaacagtatc

SEQ ID NO: 7750121 - DNA, 22 bp, Homo sapiens
aggaagggatacataggatagt

SEQ ID NO: 7750122 - DNA, 22 bp, Homo sapiens
aggaagcctgggaggtttggga

SEQ ID NO: 7750123 - DNA, 22 bp, Homo sapiens
aggaagcctggagtcctgccca

SEQ ID NO: 7750124 - DNA, 22 bp, Homo sapiens
aggaagcctggcattaaaaagc

SEQ ID NO: 7750125 - DNA, 22 bp, Homo sapiens
aggaagcctggggctgccctcg

SEQ ID NO: 7750126 - DNA, 22 bp, Homo sapiens
aggaagcctgcaggtgactgct

SEQ ID NO: 7750127 - DNA, 22 bp, Homo sapiens
aggaagcccttgtcatttctgt

SEQ ID NO: 7750128 - DNA, 22 bp, Homo sapiens
aggaagcccaagtctcatcttc

SEQ ID NO: 7750129 - DNA, 23 bp, Homo sapiens
aggaagcccattttagtctacct

SEQ ID NO: 7750130 - DNA, 22 bp, Homo sapiens
acagggtcaagggtgctacaag

SEQ ID NO: 7750131 - DNA, 22 bp, Homo sapiens
aggagccattgcaggatggcag

SEQ ID NO: 7750132 - DNA, 20 bp, Homo sapiens
aggagccattgactgcagca

SEQ ID NO: 7750133 - DNA, 22 bp, Homo sapiens
aggagccatggaggtgaggcgg

SEQ ID NO: 7750134 - DNA, 22 bp, Homo sapiens
aggagccatgagtgacatcaca

SEQ ID NO: 7750135 - DNA, 22 bp, Homo sapiens
aggagcccagcctgggctcgga

SEQ ID NO: 7750136 - DNA, 22 bp, Homo sapiens
aggagcctgaatcagagggtga

SEQ ID NO: 7750137 - DNA, 22 bp, Homo sapiens
aggagcctgagtcacagtgcct

SEQ ID NO: 7750138 - DNA, 22 bp, Homo sapiens
acatacatatgacaactttcct

SEQ ID NO: 7750139 - DNA, 22 bp, Homo sapiens
aggcaacataacacgaaagtct

SEQ ID NO: 7750140 - DNA, 22 bp, Homo sapiens
aggcaacatgggccaggcagaa

SEQ ID NO: 7750141 - DNA, 22 bp, Homo sapiens
aggcaacacttgcattttttag

SEQ ID NO: 7750142 - DNA, 22 bp, Homo sapiens
aggcaacaggaaaccacatgat

SEQ ID NO: 7750143 - DNA, 22 bp, Homo sapiens
aggcacacagaccccagcaagt

SEQ ID NO: 7750144 - DNA, 22 bp, Homo sapiens
aggcacacccagtgacctcccg

SEQ ID NO: 7750145 - DNA, 22 bp, Homo sapiens
aggcacaagaaactgctcccca

SEQ ID NO: 7750146 - DNA, 18 bp, Homo sapiens
aggcacagagcatacata

SEQ ID NO: 7750147 - DNA, 22 bp, Homo sapiens
aggcacagagaggttaaatgca

SEQ ID NO: 7750148 - DNA, 22 bp, Homo sapiens
aggcacagaatggcattcagtg

SEQ ID NO: 7750149 - DNA, 22 bp, Homo sapiens
aggcacacagcttgcataaatc

SEQ ID NO: 7750150 - DNA, 22 bp, Homo sapiens
aggcacagagaagtaaagtatc

SEQ ID NO: 7750151 - DNA, 22 bp, Homo sapiens
aggcacagagaatgccctccat

SEQ ID NO: 7750152 - DNA, 22 bp, Homo sapiens
aggaggcttttgcaggtgccac

SEQ ID NO: 7750153 - DNA, 22 bp, Homo sapiens
aggatggcgattcgagcacctc

SEQ ID NO: 7750154 - DNA, 20 bp, Homo sapiens
aggatggcaagcaagtgcat

SEQ ID NO: 7750155 - DNA, 22 bp, Homo sapiens
agtcacccaggtgtgatggatg

SEQ ID NO: 7750156 - DNA, 18 bp, Homo sapiens
agtagtgggtttagcttc

SEQ ID NO: 7750157 - DNA, 22 bp, Homo sapiens
agtagtggggccagggtttgaa

SEQ ID NO: 7750158 - DNA, 22 bp, Homo sapiens
agtagtggcttcctggagtgct

SEQ ID NO: 7750159 - DNA, 22 bp, Homo sapiens
acccttcatagaggagaagctg

SEQ ID NO: 7750160 - DNA, 22 bp, Homo sapiens
aggtcaaaccacagctctaggc

SEQ ID NO: 7750161 - DNA, 21 bp, Homo sapiens
aggtcaaaggcatccatgagg

SEQ ID NO: 7750162 - DNA, 22 bp, Homo sapiens
aggtcaaagaacctagctatag

SEQ ID NO: 7750163 - DNA, 20 bp, Homo sapiens
aggtcttccaatcagctcct

SEQ ID NO: 7750164 - DNA, 22 bp, Homo sapiens
actagaaagaagttttttgaga

SEQ ID NO: 7750165 - DNA, 19 bp, Homo sapiens
agtgaacacaaagagaagg

SEQ ID NO: 7750166 - DNA, 22 bp, Homo sapiens
agtgaacagtttggaacacatg

SEQ ID NO: 7750167 - DNA, 22 bp, Homo sapiens
agtgaacaagttaagaacacta

SEQ ID NO: 7750168 - DNA, 23 bp, Homo sapiens
actgagccagggcctgggtcagc

SEQ ID NO: 7750169 - DNA, 22 bp, Homo sapiens
actgagccttgaagctagatag

SEQ ID NO: 7750170 - DNA, 22 bp, Homo sapiens
actgagcctctcttcccacctc

SEQ ID NO: 7750171 - DNA, 22 bp, Homo sapiens
actgagcctgtgccctcatcag

SEQ ID NO: 7750172 - DNA, 22 bp, Homo sapiens
actctgaaacttgcaacacatt

SEQ ID NO: 7750173 - DNA, 22 bp, Homo sapiens
actggcttgaagtagattcaaa

SEQ ID NO: 7750174 - DNA, 22 bp, Homo sapiens
agtgtccttgaggttcctagga

SEQ ID NO: 7750175 - DNA, 22 bp, Homo sapiens
actgcctgccttccaggtactg

SEQ ID NO: 7750176 - DNA, 21 bp, Homo sapiens
actgcctggggtgctggccaa

SEQ ID NO: 7750177 - DNA, 22 bp, Homo sapiens
actgcctgctcctggctccaca

SEQ ID NO: 7750178 - DNA, 22 bp, Homo sapiens
actgcctggcctggcctcactg

SEQ ID NO: 7750179 - DNA, 22 bp, Homo sapiens
actttacacatcttttctcatt

SEQ ID NO: 7750180 - DNA, 22 bp, Homo sapiens
acttctctccacccaagtccct

SEQ ID NO: 7750181 - DNA, 22 bp, Homo sapiens
acttctctcattcagacatagc

SEQ ID NO: 7750182 - DNA, 22 bp, Homo sapiens
acttctctgctacctgcaaaga

SEQ ID NO: 7750183 - DNA, 22 bp, Homo sapiens
acttctctggttgaggtccaat

SEQ ID NO: 7750184 - DNA, 22 bp, Homo sapiens
acttctcttcataggtggcaat

SEQ ID NO: 7750185 - DNA, 22 bp, Homo sapiens
ataatttttgtttgatgtccaa

SEQ ID NO: 7750186 - DNA, 22 bp, Homo sapiens
actgttttctgtaaagggccag

SEQ ID NO: 7750187 - DNA, 22 bp, Homo sapiens
acttccagcaacttggtgctat

SEQ ID NO: 7750188 - DNA, 22 bp, Homo sapiens
acttccagctaggttctgctaa

SEQ ID NO: 7750189 - DNA, 22 bp, Homo sapiens
acttccagcacctcaagcggaa

SEQ ID NO: 7750190 - DNA, 22 bp, Homo sapiens
acttccagcccctgtcagcaaa

SEQ ID NO: 7750191 - DNA, 22 bp, Homo sapiens
agttttatgtagacaattcatt

SEQ ID NO: 7750192 - DNA, 22 bp, Homo sapiens
agttttataaaggcacctcagt

SEQ ID NO: 7750193 - DNA, 22 bp, Homo sapiens
agttttatatcttccattggtt

SEQ ID NO: 7750194 - DNA, 22 bp, Homo sapiens
agttttatctgtaagctgttca

SEQ ID NO: 7750195 - DNA, 21 bp, Homo sapiens
agttttatattataagctaaa

SEQ ID NO: 7750196 - DNA, 22 bp, Homo sapiens
agttttatgcagtgttctgata

SEQ ID NO: 7750197 - DNA, 22 bp, Homo sapiens
agttttatggctcaacctaata

SEQ ID NO: 7750198 - DNA, 22 bp, Homo sapiens
agaaagctccccatgagatgat

SEQ ID NO: 7750199 - DNA, 22 bp, Homo sapiens
agaaagcagcatttatgatctc

SEQ ID NO: 7750200 - DNA, 22 bp, Homo sapiens
agaaagattttcaacaggaggt

SEQ ID NO: 7750201 - DNA, 22 bp, Homo sapiens
agaaagcactctgtcttttacc

SEQ ID NO: 7750202 - DNA, 22 bp, Homo sapiens
atcagtttaaatgggctgttgg

SEQ ID NO: 7750203 - DNA, 22 bp, Homo sapiens
agaaatcaggaacagtaaggag

SEQ ID NO: 7750204 - DNA, 22 bp, Homo sapiens
atcagtatcctgcagtttctat

SEQ ID NO: 7750205 - DNA, 22 bp, Homo sapiens
atattttggtagctctcaatga

SEQ ID NO: 7750206 - DNA, 22 bp, Homo sapiens
agaacatatctgttttctaact

SEQ ID NO: 7750207 - DNA, 22 bp, Homo sapiens
agaacatggattgtcaaaggta

SEQ ID NO: 7750208 - DNA, 22 bp, Homo sapiens
atccattttttcagaatgctct

SEQ ID NO: 7750209 - DNA, 22 bp, Homo sapiens
atccatttttgcaaagttgttc

SEQ ID NO: 7750210 - DNA, 22 bp, Homo sapiens
atccaggagtcgtggcgctcag

SEQ ID NO: 7750211 - DNA, 22 bp, Homo sapiens
atccaggagggctgactcctta

SEQ ID NO: 7750212 - DNA, 22 bp, Homo sapiens
atctctggcccctggggtccga

SEQ ID NO: 7750213 - DNA, 22 bp, Homo sapiens
agaaggcagatgggacggagca

SEQ ID NO: 7750214 - DNA, 22 bp, Homo sapiens
agaaggcactcacactggcacg

SEQ ID NO: 7750215 - DNA, 19 bp, Homo sapiens
catatttttgggctggcat

SEQ ID NO: 7750216 - DNA, 22 bp, Homo sapiens
catattttagttgctgaacagc

SEQ ID NO: 7750217 - DNA, 22 bp, Homo sapiens
cagttccttgagaatggttgct

SEQ ID NO: 7750218 - DNA, 22 bp, Homo sapiens
cagttatcaaatactatgaagg

SEQ ID NO: 7750219 - DNA, 19 bp, Homo sapiens
cagttccagcttcttgacc

SEQ ID NO: 7750220 - DNA, 22 bp, Homo sapiens
aggaggctgcaaccctgaggcc

SEQ ID NO: 7750221 - DNA, 22 bp, Homo sapiens
catcactgaaccccaactttct

SEQ ID NO: 7750222 - DNA, 22 bp, Homo sapiens
catcactgtcaccatctttcct

SEQ ID NO: 7750223 - DNA, 22 bp, Homo sapiens
catcagaacaaatcggttaaga

SEQ ID NO: 7750224 - DNA, 22 bp, Homo sapiens
cagtgcaggctgggggccctgc

SEQ ID NO: 7750225 - DNA, 22 bp, Homo sapiens
aggagctggcctagaaaggaga

SEQ ID NO: 7750226 - DNA, 22 bp, Homo sapiens
aggagctggccactaggatgca

SEQ ID NO: 7750227 - DNA, 22 bp, Homo sapiens
aggagctgggagaaggactaaa

SEQ ID NO: 7750228 - DNA, 22 bp, Homo sapiens
aggagctgggcccaaggatgct

SEQ ID NO: 7750229 - DNA, 18 bp, Homo sapiens
aggcaggcggatcacaag

SEQ ID NO: 7750230 - DNA, 22 bp, Homo sapiens
aggcaggcctacacaatgggag

SEQ ID NO: 7750231 - DNA, 22 bp, Homo sapiens
aggcaggccctctggaaaggta

SEQ ID NO: 7750232 - DNA, 22 bp, Homo sapiens
aggcaggctgctatggagtaga

SEQ ID NO: 7750233 - DNA, 22 bp, Homo sapiens
aggcaggctcaggcccatgctt

SEQ ID NO: 7750234 - DNA, 22 bp, Homo sapiens
aggcagaggaagggtggatttg

SEQ ID NO: 7750235 - DNA, 19 bp, Homo sapiens
aggcagaggcttggctagc

SEQ ID NO: 7750236 - DNA, 23 bp, Homo sapiens
aggcactgaatgtgtcagtgagt

SEQ ID NO: 7750237 - DNA, 23 bp, Homo sapiens
aggcagagccaaggtcaaaaccc

SEQ ID NO: 7750238 - DNA, 22 bp, Homo sapiens
aggcacagtgcctggaatcaaa

SEQ ID NO: 7750239 - DNA, 19 bp, Homo sapiens
aggcacaggttgtctggac

SEQ ID NO: 7750240 - DNA, 22 bp, Homo sapiens
aggcacagtggctcacacctgt

SEQ ID NO: 7750241 - DNA, 22 bp, Homo sapiens
aggcacaggtggacttcacagt

SEQ ID NO: 7750242 - DNA, 22 bp, Homo sapiens
aggatacaagtctcagaatgct

SEQ ID NO: 7750243 - DNA, 22 bp, Homo sapiens
aggatacacggggatttatgta

SEQ ID NO: 7750244 - DNA, 22 bp, Homo sapiens
caggaagaccagggctgtggct

SEQ ID NO: 7750245 - DNA, 22 bp, Homo sapiens
caggaaatcactctgattttgg

SEQ ID NO: 7750246 - DNA, 22 bp, Homo sapiens
caggaacctaaagagacattac

SEQ ID NO: 7750247 - DNA, 22 bp, Homo sapiens
caggaaccatgaagacatatac

SEQ ID NO: 7750248 - DNA, 17 bp, Homo sapiens
caggaaaatatgagtga

SEQ ID NO: 7750249 - DNA, 22 bp, Homo sapiens
agctggaggataactcacttct

SEQ ID NO: 7750250 - DNA, 21 bp, Homo sapiens
agctgggcctcagcctgcagt

SEQ ID NO: 7750251 - DNA, 22 bp, Homo sapiens
agctgggctgatgactcatgtt

SEQ ID NO: 7750252 - DNA, 22 bp, Homo sapiens
agctggagaaacctgggagggt

SEQ ID NO: 7750253 - DNA, 19 bp, Homo sapiens
agctggagattggagggca

SEQ ID NO: 7750254 - DNA, 22 bp, Homo sapiens
agctggagattctggggacagt

SEQ ID NO: 7750255 - DNA, 22 bp, Homo sapiens
agctggagccagtgtgaggctt

SEQ ID NO: 7750256 - DNA, 21 bp, Homo sapiens
agctgggtgggctgagtgaca

SEQ ID NO: 7750257 - DNA, 22 bp, Homo sapiens
caggcagaggtaccaagattga

SEQ ID NO: 7750258 - DNA, 19 bp, Homo sapiens
agctgggtgttagtggaga

SEQ ID NO: 7750259 - DNA, 22 bp, Homo sapiens
agctgggttgacaagatggaaa

SEQ ID NO: 7750260 - DNA, 22 bp, Homo sapiens
agctggtcagagtggggataga

SEQ ID NO: 7750261 - DNA, 22 bp, Homo sapiens
agctggtcctaattgagccatt

SEQ ID NO: 7750262 - DNA, 20 bp, Homo sapiens
agctggtccccaagcctctc

SEQ ID NO: 7750263 - DNA, 22 bp, Homo sapiens
agctggtccacttttgtatctt

SEQ ID NO: 7750264 - DNA, 22 bp, Homo sapiens
agctggtccttggcagttctca

SEQ ID NO: 7750265 - DNA, 22 bp, Homo sapiens
agctggtccttccctgccctgt

SEQ ID NO: 7750266 - DNA, 22 bp, Homo sapiens
agctggtccttcaatctagcat

SEQ ID NO: 7750267 - DNA, 22 bp, Homo sapiens
agctggtcttaaatgtgtccag

SEQ ID NO: 7750268 - DNA, 22 bp, Homo sapiens
agctggtctgctgcatggagtg

SEQ ID NO: 7750269 - DNA, 20 bp, Homo sapiens
agctggtcttaagtaactga

SEQ ID NO: 7750270 - DNA, 22 bp, Homo sapiens
caggtcctcacgcctcaccctt

SEQ ID NO: 7750271 - DNA, 22 bp, Homo sapiens
caggtcctgccttggttaccct

SEQ ID NO: 7750272 - DNA, 22 bp, Homo sapiens
aggaagtgaaagggaaggagtt

SEQ ID NO: 7750273 - DNA, 21 bp, Homo sapiens
aggaagtcctgctgtgctgtc

SEQ ID NO: 7750274 - DNA, 22 bp, Homo sapiens
aggaagcaaaaggcagggtcta

SEQ ID NO: 7750275 - DNA, 21 bp, Homo sapiens
aggaagatctggaggtcggcg

SEQ ID NO: 7750276 - DNA, 22 bp, Homo sapiens
cagggtgcttagaaatggacct

SEQ ID NO: 7750277 - DNA, 17 bp, Homo sapiens
aggaaacattttctttc

SEQ ID NO: 7750278 - DNA, 22 bp, Homo sapiens
aggaaacatccttatctattct

SEQ ID NO: 7750279 - DNA, 22 bp, Homo sapiens
cagggacataagaggaacatgg

SEQ ID NO: 7750280 - DNA, 22 bp, Homo sapiens
cagggacaggggagaaaagatg

SEQ ID NO: 7750281 - DNA, 22 bp, Homo sapiens
cagggacattggtggccaggtt

SEQ ID NO: 7750282 - DNA, 22 bp, Homo sapiens
cagggacatttccaagagaatt

SEQ ID NO: 7750283 - DNA, 22 bp, Homo sapiens
aggaaaagtgtgaagtatggag

SEQ ID NO: 7750284 - DNA, 22 bp, Homo sapiens
aggaaaacagaccaaggagctc

SEQ ID NO: 7750285 - DNA, 22 bp, Homo sapiens
aggaaaatcaatgtctttttaa

SEQ ID NO: 7750286 - DNA, 22 bp, Homo sapiens
caggcttgctgctagagcactt

SEQ ID NO: 7750287 - DNA, 22 bp, Homo sapiens
caggcttgctagaggagccaaa

SEQ ID NO: 7750288 - DNA, 21 bp, Homo sapiens
caggcttgaggaatgtgcctg

SEQ ID NO: 7750289 - DNA, 22 bp, Homo sapiens
aggcgtgggaggatctgaggcc

SEQ ID NO: 7750290 - DNA, 22 bp, Homo sapiens
ccaggaaggtgtttaactagag

SEQ ID NO: 7750291 - DNA, 22 bp, Homo sapiens
ccaggaagtatgacccaacaga

SEQ ID NO: 7750292 - DNA, 22 bp, Homo sapiens
ccaggaatgaaatgtagataaa

SEQ ID NO: 7750293 - DNA, 22 bp, Homo sapiens
aggcctggcctttatgttcaag

SEQ ID NO: 7750294 - DNA, 22 bp, Homo sapiens
aggcctggccccagttgctagg

SEQ ID NO: 7750295 - DNA, 22 bp, Homo sapiens
ccaggaaggcaggcctccccgc

SEQ ID NO: 7750296 - DNA, 22 bp, Homo sapiens
aggcctgggacgggagccgtga

SEQ ID NO: 7750297 - DNA, 22 bp, Homo sapiens
ccaggaagggctctttaaagac

SEQ ID NO: 7750298 - DNA, 22 bp, Homo sapiens
ccaggaaggtatgggaagaaaa

SEQ ID NO: 7750299 - DNA, 22 bp, Homo sapiens
ccaggaaggcgttgttcctctc

SEQ ID NO: 7750300 - DNA, 22 bp, Homo sapiens
ccaggaaggcctggatgccccc

SEQ ID NO: 7750301 - DNA, 22 bp, Homo sapiens
aggcctgccttgagcaaccagc

SEQ ID NO: 7750302 - DNA, 22 bp, Homo sapiens
ccagctgacgatgcctggtctc

SEQ ID NO: 7750303 - DNA, 22 bp, Homo sapiens
ccagctgagaagtgtaaagtga

SEQ ID NO: 7750304 - DNA, 20 bp, Homo sapiens
ccagctgagccaaggggaga

SEQ ID NO: 7750305 - DNA, 22 bp, Homo sapiens
ccagcaggagactagcaacata

SEQ ID NO: 7750306 - DNA, 22 bp, Homo sapiens
aggccatgtggccccagagtct

SEQ ID NO: 7750307 - DNA, 22 bp, Homo sapiens
aggccaggttcctcaatcttga

SEQ ID NO: 7750308 - DNA, 22 bp, Homo sapiens
ccagagaaaaatgtgtccctgt

SEQ ID NO: 7750309 - DNA, 22 bp, Homo sapiens
ccagagaaagctcacaggcagt

SEQ ID NO: 7750310 - DNA, 18 bp, Homo sapiens
aggcaggctggagtgact

SEQ ID NO: 7750311 - DNA, 22 bp, Homo sapiens
ccagaaaatgcagaacatagaa

SEQ ID NO: 7750312 - DNA, 22 bp, Homo sapiens
ccagaaacacctggattctgtt

SEQ ID NO: 7750313 - DNA, 22 bp, Homo sapiens
ccagaaaatatggctaaggtga

SEQ ID NO: 7750314 - DNA, 22 bp, Homo sapiens
ccagaacacagtggaagaatat

SEQ ID NO: 7750315 - DNA, 22 bp, Homo sapiens
ccagaagacaagaatgttctta

SEQ ID NO: 7750316 - DNA, 22 bp, Homo sapiens
aggctgaggcaagaggatcact

SEQ ID NO: 7750317 - DNA, 22 bp, Homo sapiens
aggctgaggcaggtggatcacc

SEQ ID NO: 7750318 - DNA, 22 bp, Homo sapiens
ccagggctggtgggagatgctg

SEQ ID NO: 7750319 - DNA, 22 bp, Homo sapiens
ccagggctggtggctgcagagg

SEQ ID NO: 7750320 - DNA, 22 bp, Homo sapiens
ccagggctccattgctcatcct

SEQ ID NO: 7750321 - DNA, 19 bp, Homo sapiens
ccagggctccaagctgagt

SEQ ID NO: 7750322 - DNA, 22 bp, Homo sapiens
ccagggcctgccacttagcaag

SEQ ID NO: 7750323 - DNA, 22 bp, Homo sapiens
ccaggctgtaaacaccttcaaa

SEQ ID NO: 7750324 - DNA, 22 bp, Homo sapiens
aggctacactgttttgatgtct

SEQ ID NO: 7750325 - DNA, 22 bp, Homo sapiens
aggcgtggttgaggcgagcata

SEQ ID NO: 7750326 - DNA, 22 bp, Homo sapiens
ccaggctgggcggggaacctgg

SEQ ID NO: 7750327 - DNA, 22 bp, Homo sapiens
ccaggctggagtatagtggcgc

SEQ ID NO: 7750328 - DNA, 22 bp, Homo sapiens
aggctgggctccgcccaactcc

SEQ ID NO: 7750329 - DNA, 22 bp, Homo sapiens
ccatttgtaaccttagagcaat

SEQ ID NO: 7750330 - DNA, 22 bp, Homo sapiens
aggctggagtgctggagtgctg

SEQ ID NO: 7750331 - DNA, 22 bp, Homo sapiens
aggctggagtgcagtggcgtga

SEQ ID NO: 7750332 - DNA, 22 bp, Homo sapiens
aggctggacccgacacctgccc

SEQ ID NO: 7750333 - DNA, 22 bp, Homo sapiens
agggctggagccacagctggga

SEQ ID NO: 7750334 - DNA, 22 bp, Homo sapiens
agggcgtggtggtgctggagca

SEQ ID NO: 7750335 - DNA, 22 bp, Homo sapiens
cctcaggccctgtccctgcgcc

SEQ ID NO: 7750336 - DNA, 22 bp, Homo sapiens
cctcaggatccgcaggtgcagt

SEQ ID NO: 7750337 - DNA, 20 bp, Homo sapiens
cctcaggatgagggtgagca

SEQ ID NO: 7750338 - DNA, 22 bp, Homo sapiens
agggcctggaactggagaccac

SEQ ID NO: 7750339 - DNA, 22 bp, Homo sapiens
agggcctgcatcaggagcttgg

SEQ ID NO: 7750340 - DNA, 22 bp, Homo sapiens
agggtagggcccggagacagac

SEQ ID NO: 7750341 - DNA, 22 bp, Homo sapiens
agggtaggaactgagtggaagg

SEQ ID NO: 7750342 - DNA, 22 bp, Homo sapiens
cctgagagtgagtgccacctta

SEQ ID NO: 7750343 - DNA, 22 bp, Homo sapiens
agggtagggccgtagggccatg

SEQ ID NO: 7750344 - DNA, 22 bp, Homo sapiens
agggtagtacagagagtgtcct

SEQ ID NO: 7750345 - DNA, 22 bp, Homo sapiens
agggtcaacaggagtcaagatg

SEQ ID NO: 7750346 - DNA, 22 bp, Homo sapiens
agggtcaagtcactggttcacg

SEQ ID NO: 7750347 - DNA, 22 bp, Homo sapiens
cctgagagggggccctagaaat

SEQ ID NO: 7750348 - DNA, 22 bp, Homo sapiens
cctgagaggccctctcactgtc

SEQ ID NO: 7750349 - DNA, 22 bp, Homo sapiens
cctgagagcattccacactgaa

SEQ ID NO: 7750350 - DNA, 22 bp, Homo sapiens
aggggatggagctggaaggcag

SEQ ID NO: 7750351 - DNA, 22 bp, Homo sapiens
cctcttcatcctggaagctgct

SEQ ID NO: 7750352 - DNA, 22 bp, Homo sapiens
cctcttccactgggccccatcc

SEQ ID NO: 7750353 - DNA, 22 bp, Homo sapiens
cctcttcaggcactcgaaggcc

SEQ ID NO: 7750354 - DNA, 22 bp, Homo sapiens
aggctgtgaaggttaaagacga

SEQ ID NO: 7750355 - DNA, 22 bp, Homo sapiens
aggctgtgaaatgtggcaagga

SEQ ID NO: 7750356 - DNA, 22 bp, Homo sapiens
aggctgtgaactctatgctgaa

SEQ ID NO: 7750357 - DNA, 22 bp, Homo sapiens
cccaggaatgaggggcggaggc

SEQ ID NO: 7750358 - DNA, 22 bp, Homo sapiens
aggctgtgacagggtcatggag

SEQ ID NO: 7750359 - DNA, 22 bp, Homo sapiens
aggctgggtacctgtcatatgc

SEQ ID NO: 7750360 - DNA, 22 bp, Homo sapiens
cccaggaatgggaaggaggaat

SEQ ID NO: 7750361 - DNA, 22 bp, Homo sapiens
cccaggaattcagggctcaagg

SEQ ID NO: 7750362 - DNA, 22 bp, Homo sapiens
ccctagggctaagcaggactgc

SEQ ID NO: 7750363 - DNA, 22 bp, Homo sapiens
ccctaggctgaggccagggtgc

SEQ ID NO: 7750364 - DNA, 22 bp, Homo sapiens
ccctaggggcaatgatggtgct

SEQ ID NO: 7750365 - DNA, 22 bp, Homo sapiens
ccctcactctgcctcctggggt

SEQ ID NO: 7750366 - DNA, 17 bp, Homo sapiens
ccctcactcctgccggg

SEQ ID NO: 7750367 - DNA, 22 bp, Homo sapiens
ccctcacttcacgctctgcaga

SEQ ID NO: 7750368 - DNA, 22 bp, Homo sapiens
ccctcccaagcactctgacata

SEQ ID NO: 7750369 - DNA, 22 bp, Homo sapiens
ccctcagctccaccctcagcag

SEQ ID NO: 7750370 - DNA, 22 bp, Homo sapiens
ccctcagctcaagcccctgtgc

SEQ ID NO: 7750371 - DNA, 22 bp, Homo sapiens
ccctcccaggagtggccagaga

SEQ ID NO: 7750372 - DNA, 20 bp, Homo sapiens
ccctcccagatgcttcccaa

SEQ ID NO: 7750373 - DNA, 22 bp, Homo sapiens
ccctcccagatgggcttgaggt

SEQ ID NO: 7750374 - DNA, 22 bp, Homo sapiens
agtgtcaaatcagcatctgggt

SEQ ID NO: 7750375 - DNA, 22 bp, Homo sapiens
agtgtattgtctcacagttctt

SEQ ID NO: 7750376 - DNA, 22 bp, Homo sapiens
agtgtctttgtctctcaagcac

SEQ ID NO: 7750377 - DNA, 22 bp, Homo sapiens
agtgtctttctctctccaagtg

SEQ ID NO: 7750378 - DNA, 22 bp, Homo sapiens
agtggcctggagccccgcctgg

SEQ ID NO: 7750379 - DNA, 22 bp, Homo sapiens
agttaacacagtcaggagtaac

SEQ ID NO: 7750380 - DNA, 22 bp, Homo sapiens
ctgagctgaaacttgagaggct

SEQ ID NO: 7750381 - DNA, 22 bp, Homo sapiens
agtggagaagaggatggtctcc

SEQ ID NO: 7750382 - DNA, 22 bp, Homo sapiens
agtggagacaggacagtcgata

SEQ ID NO: 7750383 - DNA, 22 bp, Homo sapiens
agtggagaccccacttctacat

SEQ ID NO: 7750384 - DNA, 22 bp, Homo sapiens
agtggagaatatgcagaaagcc

SEQ ID NO: 7750385 - DNA, 22 bp, Homo sapiens
agtgattctcctgcctcagcct

SEQ ID NO: 7750386 - DNA, 22 bp, Homo sapiens
cctgtgggagcccaggcagata

SEQ ID NO: 7750387 - DNA, 22 bp, Homo sapiens
cctgggtccaccctgtgaagta

SEQ ID NO: 7750388 - DNA, 22 bp, Homo sapiens
cctgtgggtacaacagggtcac

SEQ ID NO: 7750389 - DNA, 22 bp, Homo sapiens
cctgtggggctgaaagaggctt

SEQ ID NO: 7750390 - DNA, 22 bp, Homo sapiens
cctgtgggcttgagtgtagggt

SEQ ID NO: 7750391 - DNA, 22 bp, Homo sapiens
cctgtggggccatctcagtcac

SEQ ID NO: 7750392 - DNA, 22 bp, Homo sapiens
cctgtggggagagatctcttag

SEQ ID NO: 7750393 - DNA, 22 bp, Homo sapiens
cctgtgggccctggacagagac

SEQ ID NO: 7750394 - DNA, 22 bp, Homo sapiens
cctgtgggctgagaacaagggc

SEQ ID NO: 7750395 - DNA, 22 bp, Homo sapiens
cctgtgggcgcagctggagtca

SEQ ID NO: 7750396 - DNA, 22 bp, Homo sapiens
cctgtgggcctgcacgtgggga

SEQ ID NO: 7750397 - DNA, 22 bp, Homo sapiens
cctgtgggagggagcggctgga

SEQ ID NO: 7750398 - DNA, 22 bp, Homo sapiens
cctgtgggaggggcctggcgcg

SEQ ID NO: 7750399 - DNA, 22 bp, Homo sapiens
cctgtgggaggttctgtgagtc

SEQ ID NO: 7750400 - DNA, 22 bp, Homo sapiens
aggtcagaaaaggagagcattg

SEQ ID NO: 7750401 - DNA, 22 bp, Homo sapiens
aggtcaccatggcatgctccac

SEQ ID NO: 7750402 - DNA, 22 bp, Homo sapiens
aggtcacccgtttgactatcca

SEQ ID NO: 7750403 - DNA, 22 bp, Homo sapiens
aggtcacagggttgaagtactt

SEQ ID NO: 7750404 - DNA, 22 bp, Homo sapiens
aggtcacaggctttgaaatcaa

SEQ ID NO: 7750405 - DNA, 22 bp, Homo sapiens
aggtcacatacaaatgctcctt

SEQ ID NO: 7750406 - DNA, 18 bp, Homo sapiens
aggtacacatacttctca

SEQ ID NO: 7750407 - DNA, 23 bp, Homo sapiens
aggtacacattatagaaatagac

SEQ ID NO: 7750408 - DNA, 22 bp, Homo sapiens
ctaggaacagttcaacagttta

SEQ ID NO: 7750409 - DNA, 22 bp, Homo sapiens
ctaggaccactgtaacaaagta

SEQ ID NO: 7750410 - DNA, 22 bp, Homo sapiens
agtcacatgcattttcttcaat

SEQ ID NO: 7750411 - DNA, 22 bp, Homo sapiens
agtaacaaagaaagcctttgga

SEQ ID NO: 7750412 - DNA, 22 bp, Homo sapiens
ccttctctaccatgtgaggaaa

SEQ ID NO: 7750413 - DNA, 22 bp, Homo sapiens
ccttctctactcctgatgcatg

SEQ ID NO: 7750414 - DNA, 22 bp, Homo sapiens
ccttctctctgaagaccccaaa

SEQ ID NO: 7750415 - DNA, 22 bp, Homo sapiens
agtagccaccaaccatgtgtgg

SEQ ID NO: 7750416 - DNA, 22 bp, Homo sapiens
agtagccatttcatgagtttgt

SEQ ID NO: 7750417 - DNA, 22 bp, Homo sapiens
agtaacaagtgccaacgttaga

SEQ ID NO: 7750418 - DNA, 22 bp, Homo sapiens
agtaacaaatattcattggatt

SEQ ID NO: 7750419 - DNA, 22 bp, Homo sapiens
agtaacaaatagctgcctttaa

SEQ ID NO: 7750420 - DNA, 22 bp, Homo sapiens
agtaacaaagtgggagaatgat

SEQ ID NO: 7750421 - DNA, 22 bp, Homo sapiens
agtagacaatatggatttaatg

SEQ ID NO: 7750422 - DNA, 20 bp, Homo sapiens
atacacattcatagaaaaat

SEQ ID NO: 7750423 - DNA, 22 bp, Homo sapiens
ctggcacacagaggccctcggg

SEQ ID NO: 7750424 - DNA, 22 bp, Homo sapiens
ctggcaggttatagagctgccc

SEQ ID NO: 7750425 - DNA, 22 bp, Homo sapiens
atagtggaaactggagggaaga

SEQ ID NO: 7750426 - DNA, 22 bp, Homo sapiens
ctggcctttaaaatgaccttat

SEQ ID NO: 7750427 - DNA, 22 bp, Homo sapiens
ctggccttttgtttctggagaa

SEQ ID NO: 7750428 - DNA, 22 bp, Homo sapiens
ctggcctttcgtgagagctggg

SEQ ID NO: 7750429 - DNA, 22 bp, Homo sapiens
ctgctgggctcctcatgtgact

SEQ ID NO: 7750430 - DNA, 22 bp, Homo sapiens
ctgcctggaaggagcaagggga

SEQ ID NO: 7750431 - DNA, 22 bp, Homo sapiens
ctgcctggtctcaggcatgggg

SEQ ID NO: 7750432 - DNA, 18 bp, Homo sapiens
ctgctgtgtcgtctgggc

SEQ ID NO: 7750433 - DNA, 22 bp, Homo sapiens
ctgctggggtcagagcactggg

SEQ ID NO: 7750434 - DNA, 22 bp, Homo sapiens
atacacatatgtgtgtatatgt

SEQ ID NO: 7750435 - DNA, 20 bp, Homo sapiens
atacacatattcttgcaact

SEQ ID NO: 7750436 - DNA, 22 bp, Homo sapiens
atacacatctatttaagagaca

SEQ ID NO: 7750437 - DNA, 22 bp, Homo sapiens
ctgcagggaccacaagcaggtt

SEQ ID NO: 7750438 - DNA, 22 bp, Homo sapiens
ctgcagggagaggggacagcct

SEQ ID NO: 7750439 - DNA, 22 bp, Homo sapiens
ctgcagggaactgaggcccaga

SEQ ID NO: 7750440 - DNA, 22 bp, Homo sapiens
ctgcaggctgagcgcctgccgg

SEQ ID NO: 7750441 - DNA, 22 bp, Homo sapiens
ctgcaggcttccagggctgtgg

SEQ ID NO: 7750442 - DNA, 22 bp, Homo sapiens
cttattagagttgtgttctgtt

SEQ ID NO: 7750443 - DNA, 19 bp, Homo sapiens
cttattagagtgagagctt

SEQ ID NO: 7750444 - DNA, 22 bp, Homo sapiens
cttattagtgtctgtctgagtt

SEQ ID NO: 7750445 - DNA, 19 bp, Homo sapiens
cttattagagtgagagctt

SEQ ID NO: 7750446 - DNA, 22 bp, Homo sapiens
cttattagaaagaaaagacatg

SEQ ID NO: 7750447 - DNA, 19 bp, Homo sapiens
cttatgcagctgagcttgg

SEQ ID NO: 7750448 - DNA, 22 bp, Homo sapiens
cttcctctatgttcaggtagaa

SEQ ID NO: 7750449 - DNA, 22 bp, Homo sapiens
atccatttgaaagaacagtcca

SEQ ID NO: 7750450 - DNA, 19 bp, Homo sapiens
cttctgcagggtgacagtg

SEQ ID NO: 7750451 - DNA, 22 bp, Homo sapiens
atctgtcttgccttgcatattt

SEQ ID NO: 7750452 - DNA, 22 bp, Homo sapiens
atctgtcttccaccacacatcc

SEQ ID NO: 7750453 - DNA, 22 bp, Homo sapiens
atctgtcttttattcatgagct

SEQ ID NO: 7750454 - DNA, 22 bp, Homo sapiens
atctgtctatgtggctatgtat

SEQ ID NO: 7750455 - DNA, 22 bp, Homo sapiens
atctgtctatgatatagtctgt

SEQ ID NO: 7750456 - DNA, 22 bp, Homo sapiens
atctgtctgagtgcttaggacc

SEQ ID NO: 7750457 - DNA, 22 bp, Homo sapiens
atcttatttaacacagcaaaac

SEQ ID NO: 7750458 - DNA, 22 bp, Homo sapiens
atcagtttaactgtcaagagcc

SEQ ID NO: 7750459 - DNA, 22 bp, Homo sapiens
atcagctggaacaagtgtctga

SEQ ID NO: 7750460 - DNA, 22 bp, Homo sapiens
atcagtttggaacattcaggcc

SEQ ID NO: 7750461 - DNA, 22 bp, Homo sapiens
atcagtttgataataaggcttg

SEQ ID NO: 7750462 - DNA, 22 bp, Homo sapiens
atcagtttgagtgctgtgtcaa

SEQ ID NO: 7750463 - DNA, 22 bp, Homo sapiens
atcagtttctgtgaagaacaca

SEQ ID NO: 7750464 - DNA, 22 bp, Homo sapiens
atcagtttctaccatgtggaat

SEQ ID NO: 7750465 - DNA, 22 bp, Homo sapiens
atcagtttcacttgcttgcaaa

SEQ ID NO: 7750466 - DNA, 22 bp, Homo sapiens
atcagtttatacttataaatct

SEQ ID NO: 7750467 - DNA, 22 bp, Homo sapiens
atcagtttgtatatgaaacact

SEQ ID NO: 7750468 - DNA, 22 bp, Homo sapiens
atcagttttgttcactactata

SEQ ID NO: 7750469 - DNA, 22 bp, Homo sapiens
atcagtttggtgctttcagtga

SEQ ID NO: 7750470 - DNA, 22 bp, Homo sapiens
atcagttttgggggacatactg

SEQ ID NO: 7750471 - DNA, 22 bp, Homo sapiens
atcagtttttattaatgtagct

SEQ ID NO: 7750472 - DNA, 22 bp, Homo sapiens
atcagcacaacgtacagagaaa

SEQ ID NO: 7750473 - DNA, 22 bp, Homo sapiens
atcacagatttgatacttttgt

SEQ ID NO: 7750474 - DNA, 22 bp, Homo sapiens
atcacagattgtgaataactat

SEQ ID NO: 7750475 - DNA, 22 bp, Homo sapiens
atcacagagattgcttttaaaa

SEQ ID NO: 7750476 - DNA, 22 bp, Homo sapiens
ctggtccctgtaggtatttgac

SEQ ID NO: 7750477 - DNA, 22 bp, Homo sapiens
ctggggctgtgggagacaaggc

SEQ ID NO: 7750478 - DNA, 22 bp, Homo sapiens
ctggggcttcaatgcttcggtg

SEQ ID NO: 7750479 - DNA, 22 bp, Homo sapiens
ctgggggcaagcagacagctgt

SEQ ID NO: 7750480 - DNA, 22 bp, Homo sapiens
ctggtccctgcagtgtgctggg

SEQ ID NO: 7750481 - DNA, 22 bp, Homo sapiens
ctggtccctgagtagttatgca

SEQ ID NO: 7750482 - DNA, 22 bp, Homo sapiens
ctggtccctggacctccctgga

SEQ ID NO: 7750483 - DNA, 22 bp, Homo sapiens
ctggtccccagactgggcttag

SEQ ID NO: 7750484 - DNA, 17 bp, Homo sapiens
ctggtcccaccaagccc

SEQ ID NO: 7750485 - DNA, 22 bp, Homo sapiens
ctggtcccagaggcaagagatg

SEQ ID NO: 7750486 - DNA, 22 bp, Homo sapiens
ctggtccagtggatgctgaggg

SEQ ID NO: 7750487 - DNA, 22 bp, Homo sapiens
ctggtcccatcctggcttcatg

SEQ ID NO: 7750488 - DNA, 22 bp, Homo sapiens
ctggtcccagcagagctctgag

SEQ ID NO: 7750489 - DNA, 22 bp, Homo sapiens
ctggtcccagctctgccaccaa

SEQ ID NO: 7750490 - DNA, 22 bp, Homo sapiens
atattattttccctggagttgt

SEQ ID NO: 7750491 - DNA, 22 bp, Homo sapiens
gcaggctgtgaggctcagatgg

SEQ ID NO: 7750492 - DNA, 22 bp, Homo sapiens
gcaggctgtctaaagttagagt

SEQ ID NO: 7750493 - DNA, 22 bp, Homo sapiens
gcaggatgccagggcagcagcg

SEQ ID NO: 7750494 - DNA, 22 bp, Homo sapiens
gcaggagcaaactgcagtgtgg

SEQ ID NO: 7750495 - DNA, 22 bp, Homo sapiens
gcaggagcagtcaggggcagct

SEQ ID NO: 7750496 - DNA, 22 bp, Homo sapiens
gcagggatgctgaggctcagtg

SEQ ID NO: 7750497 - DNA, 16 bp, Homo sapiens
attgttttcaattaga

SEQ ID NO: 7750498 - DNA, 20 bp, Homo sapiens
attgtgcagcccttggcaga

SEQ ID NO: 7750499 - DNA, 22 bp, Homo sapiens
gcagtgcagtgggacagggcgc

SEQ ID NO: 7750500 - DNA, 22 bp, Homo sapiens
gcagtgcattactcacatgttt

SEQ ID NO: 7750501 - DNA, 22 bp, Homo sapiens
gcagtgcatgtcggaactcatt

SEQ ID NO: 7750502 - DNA, 18 bp, Homo sapiens
gcagtgcaggaagaagag

SEQ ID NO: 7750503 - DNA, 22 bp, Homo sapiens
gcagtgcaggaacatagcttct

SEQ ID NO: 7750504 - DNA, 22 bp, Homo sapiens
gcagtgcaggacaaatcagtgc

SEQ ID NO: 7750505 - DNA, 22 bp, Homo sapiens
gcaacacagatcttctttgttg

SEQ ID NO: 7750506 - DNA, 22 bp, Homo sapiens
gcacacaggggagttctcagaa

SEQ ID NO: 7750507 - DNA, 22 bp, Homo sapiens
gcacacagggatttttgaatgg

SEQ ID NO: 7750508 - DNA, 20 bp, Homo sapiens
gcaactcacccacagcagct

SEQ ID NO: 7750509 - DNA, 22 bp, Homo sapiens
gcaacagcattctcattgacat

SEQ ID NO: 7750510 - DNA, 22 bp, Homo sapiens
gcactgggtgtgaggcagcgtc

SEQ ID NO: 7750511 - DNA, 22 bp, Homo sapiens
gcactgggggcagcagtgaggg

SEQ ID NO: 7750512 - DNA, 22 bp, Homo sapiens
gcagaggcctaggtggaaggcc

SEQ ID NO: 7750513 - DNA, 22 bp, Homo sapiens
gcagaatgtaggccttcagtgt

SEQ ID NO: 7750514 - DNA, 22 bp, Homo sapiens
gcagaatgtcagtatggtcacc

SEQ ID NO: 7750515 - DNA, 22 bp, Homo sapiens
gcagaagggaataaggagcttt

SEQ ID NO: 7750516 - DNA, 22 bp, Homo sapiens
gcagaaggttgtttgggaaagg

SEQ ID NO: 7750517 - DNA, 22 bp, Homo sapiens
gcagaggctgtagggaaggttg

SEQ ID NO: 7750518 - DNA, 22 bp, Homo sapiens
gcagaggctgggtgtcccagtc

SEQ ID NO: 7750519 - DNA, 21 bp, Homo sapiens
gcagccaggactttgggctgg

SEQ ID NO: 7750520 - DNA, 22 bp, Homo sapiens
gcagccaggggctgtgacctgt

SEQ ID NO: 7750521 - DNA, 22 bp, Homo sapiens
gcagccaggctacagcgggctt

SEQ ID NO: 7750522 - DNA, 22 bp, Homo sapiens
gcagccagggagagaaccaggg

SEQ ID NO: 7750523 - DNA, 22 bp, Homo sapiens
gcagccagggctaagctgggga

SEQ ID NO: 7750524 - DNA, 22 bp, Homo sapiens
gcagccaggtttgaggaccact

SEQ ID NO: 7750525 - DNA, 22 bp, Homo sapiens
gcagccttcctgacctctaccc

SEQ ID NO: 7750526 - DNA, 22 bp, Homo sapiens
atttacagtttagcatttcaag

SEQ ID NO: 7750527 - DNA, 22 bp, Homo sapiens
atttacagtgtgcctactatat

SEQ ID NO: 7750528 - DNA, 22 bp, Homo sapiens
atttacagacgtggattagtgc

SEQ ID NO: 7750529 - DNA, 22 bp, Homo sapiens
gccagagggattcctggtgtgt

SEQ ID NO: 7750530 - DNA, 19 bp, Homo sapiens
gccctcatgatattcagat

SEQ ID NO: 7750531 - DNA, 22 bp, Homo sapiens
gccctccctacagcctatttct

SEQ ID NO: 7750532 - DNA, 22 bp, Homo sapiens
attttacataaggaaggtttaa

SEQ ID NO: 7750533 - DNA, 22 bp, Homo sapiens
gcctgcccacggggctggcata

SEQ ID NO: 7750534 - DNA, 22 bp, Homo sapiens
gcctgcctagaattgcagcttt

SEQ ID NO: 7750535 - DNA, 22 bp, Homo sapiens
attttaataagattcccaagta

SEQ ID NO: 7750536 - DNA, 23 bp, Homo sapiens
atttgacagagcatagcatttct

SEQ ID NO: 7750537 - DNA, 22 bp, Homo sapiens
gctaatgactgagtttttagca

SEQ ID NO: 7750538 - DNA, 22 bp, Homo sapiens
gctcagggctaaggctgagggg

SEQ ID NO: 7750539 - DNA, 22 bp, Homo sapiens
gcgttggggaccccgaagctgg

SEQ ID NO: 7750540 - DNA, 22 bp, Homo sapiens
gcctggctcctaaggactggct

SEQ ID NO: 7750541 - DNA, 21 bp, Homo sapiens
gcctggctctcactggcctgg

SEQ ID NO: 7750542 - DNA, 22 bp, Homo sapiens
gctcaggggaatgggctgccgt

SEQ ID NO: 7750543 - DNA, 19 bp, Homo sapiens
gctctgagaggggcatggg

SEQ ID NO: 7750544 - DNA, 22 bp, Homo sapiens
gctctgagaggatgctgagcag

SEQ ID NO: 7750545 - DNA, 22 bp, Homo sapiens
gctgaggaggtgtggttaggtg

SEQ ID NO: 7750546 - DNA, 22 bp, Homo sapiens
gctgaggaaaggctggaaggga

SEQ ID NO: 7750547 - DNA, 22 bp, Homo sapiens
gctgaggaaaccaatgctcaga

SEQ ID NO: 7750548 - DNA, 22 bp, Homo sapiens
gctgaggagcgagaactctgct

SEQ ID NO: 7750549 - DNA, 22 bp, Homo sapiens
gctgaggacatcatggaaggaa

SEQ ID NO: 7750550 - DNA, 22 bp, Homo sapiens
gaacatcatgaagaaaacatat

SEQ ID NO: 7750551 - DNA, 20 bp, Homo sapiens
gaacatggcaggtggagggg

SEQ ID NO: 7750552 - DNA, 22 bp, Homo sapiens
gaacatcagtcataatttaacg

SEQ ID NO: 7750553 - DNA, 22 bp, Homo sapiens
gaacattactgcttgggagagg

SEQ ID NO: 7750554 - DNA, 22 bp, Homo sapiens
gaactttattccagaagaaagc

SEQ ID NO: 7750555 - DNA, 22 bp, Homo sapiens
gaactttaatcccttgggctta

SEQ ID NO: 7750556 - DNA, 22 bp, Homo sapiens
gaactttaccatttaggtaact

SEQ ID NO: 7750557 - DNA, 22 bp, Homo sapiens
gaaatctccaatcttttcttta

SEQ ID NO: 7750558 - DNA, 22 bp, Homo sapiens
gaaatcttttccaattgtttag

SEQ ID NO: 7750559 - DNA, 22 bp, Homo sapiens
atgaggcatgggatcaaaatga

SEQ ID NO: 7750560 - DNA, 22 bp, Homo sapiens
gaacatatgcatgtttgttttg

SEQ ID NO: 7750561 - DNA, 22 bp, Homo sapiens
gaaaactaacggaaaagttagg

SEQ ID NO: 7750562 - DNA, 22 bp, Homo sapiens
gaaaatctgcttatattatttt

SEQ ID NO: 7750563 - DNA, 22 bp, Homo sapiens
atgaatgagtgctaggtttgtc

SEQ ID NO: 7750564 - DNA, 22 bp, Homo sapiens
atgaatgactgtctactttggg

SEQ ID NO: 7750565 - DNA, 21 bp, Homo sapiens
atgaatgatttctactcttaa

SEQ ID NO: 7750566 - DNA, 21 bp, Homo sapiens
gaaaaccatttgcatcatgag

SEQ ID NO: 7750567 - DNA, 22 bp, Homo sapiens
gaaaaccacctcccatcaagca

SEQ ID NO: 7750568 - DNA, 22 bp, Homo sapiens
atgaattgaggaaaacagtcgt

SEQ ID NO: 7750569 - DNA, 22 bp, Homo sapiens
atgaatgaagaacatctgtgcc

SEQ ID NO: 7750570 - DNA, 23 bp, Homo sapiens
atgaatgaataaggcaggaaagc

SEQ ID NO: 7750571 - DNA, 22 bp, Homo sapiens
atgaatgaatgagagtaggtca

SEQ ID NO: 7750572 - DNA, 22 bp, Homo sapiens
cttgagcacagcggcttcagga

SEQ ID NO: 7750573 - DNA, 22 bp, Homo sapiens
cttgagagggagtagtttagga

SEQ ID NO: 7750574 - DNA, 23 bp, Homo sapiens
gaagcagatgtctgagtaggcag

SEQ ID NO: 7750575 - DNA, 22 bp, Homo sapiens
gaatcatagaacattaatagaa

SEQ ID NO: 7750576 - DNA, 22 bp, Homo sapiens
gaagcacatggctgtgagcaac

SEQ ID NO: 7750577 - DNA, 22 bp, Homo sapiens
gaagcacactgattttatttct

SEQ ID NO: 7750578 - DNA, 22 bp, Homo sapiens
gaccctggagccgtctgaggca

SEQ ID NO: 7750579 - DNA, 22 bp, Homo sapiens
gaccctggaactttcagcagag

SEQ ID NO: 7750580 - DNA, 22 bp, Homo sapiens
gaccctgataggagtagaagaa

SEQ ID NO: 7750581 - DNA, 22 bp, Homo sapiens
gaccctcaaacaattacactgc

SEQ ID NO: 7750582 - DNA, 22 bp, Homo sapiens
gaccctcattgtcaccgtgagc

SEQ ID NO: 7750583 - DNA, 22 bp, Homo sapiens
gaccctcctgtcttctaaccaa

SEQ ID NO: 7750584 - DNA, 22 bp, Homo sapiens
gaccctcctactaccctggaaa

SEQ ID NO: 7750585 - DNA, 21 bp, Homo sapiens
gaccccagaccagcagacaca

SEQ ID NO: 7750586 - DNA, 22 bp, Homo sapiens
atgcttaatacactgttaaagg

SEQ ID NO: 7750587 - DNA, 22 bp, Homo sapiens
gacagggcatggtgcagagttc

SEQ ID NO: 7750588 - DNA, 22 bp, Homo sapiens
gacagggccgcagatggagact

SEQ ID NO: 7750589 - DNA, 22 bp, Homo sapiens
gaggaagcagggcttggctgag

SEQ ID NO: 7750590 - DNA, 22 bp, Homo sapiens
gaggaaggctaaggggcttaga

SEQ ID NO: 7750591 - DNA, 22 bp, Homo sapiens
gaggaaggatttagtttgaggg

SEQ ID NO: 7750592 - DNA, 22 bp, Homo sapiens
atgtaacatatgtgatcgcatt

SEQ ID NO: 7750593 - DNA, 22 bp, Homo sapiens
gagcagctcagaggactagtgt

SEQ ID NO: 7750594 - DNA, 22 bp, Homo sapiens
gagaggctgaaatcacaggagc

SEQ ID NO: 7750595 - DNA, 22 bp, Homo sapiens
gagaggctgatcctgcagagaa

SEQ ID NO: 7750596 - DNA, 22 bp, Homo sapiens
gagcctgggactgggggtcatg

SEQ ID NO: 7750597 - DNA, 22 bp, Homo sapiens
gagcgcacagaaggaagcagcc

SEQ ID NO: 7750598 - DNA, 22 bp, Homo sapiens
gatctggaatctgaaggctgag

SEQ ID NO: 7750599 - DNA, 22 bp, Homo sapiens
gaggttggggctgcagtgagct

SEQ ID NO: 7750600 - DNA, 22 bp, Homo sapiens
gagtccaggcatccctcccata

SEQ ID NO: 7750601 - DNA, 22 bp, Homo sapiens
gagggggctccctgaagccagt

SEQ ID NO: 7750602 - DNA, 22 bp, Homo sapiens
gagggcactgggtttcaatgtc

SEQ ID NO: 7750603 - DNA, 22 bp, Homo sapiens
gagggcagaaaattatgcggtg

SEQ ID NO: 7750604 - DNA, 22 bp, Homo sapiens
gaggctgtttgtggcagtgatg

SEQ ID NO: 7750605 - DNA, 22 bp, Homo sapiens
gaggctgttggctgatctgagt

SEQ ID NO: 7750606 - DNA, 22 bp, Homo sapiens
gaggctgttcagtgtccagctt

SEQ ID NO: 7750607 - DNA, 22 bp, Homo sapiens
gaggccacagtcctgaggcatc

SEQ ID NO: 7750608 - DNA, 22 bp, Homo sapiens
gaggccacagtcagtgttcatc

SEQ ID NO: 7750609 - DNA, 22 bp, Homo sapiens
gaggctgtgtcttggggtggaa

SEQ ID NO: 7750610 - DNA, 22 bp, Homo sapiens
gaggctgtgtgtccctctggac

SEQ ID NO: 7750611 - DNA, 22 bp, Homo sapiens
gaggctgtgtttcagtgaggcc

SEQ ID NO: 7750612 - DNA, 22 bp, Homo sapiens
gaggctgttaggagggactctg

SEQ ID NO: 7750613 - DNA, 22 bp, Homo sapiens
gaggctgttagggcctgaggta

SEQ ID NO: 7750614 - DNA, 22 bp, Homo sapiens
atgtcacagttgcaacatgaat

SEQ ID NO: 7750615 - DNA, 22 bp, Homo sapiens
cagcagaacagttaaagaaacc

SEQ ID NO: 7750616 - DNA, 22 bp, Homo sapiens
cagcagaagcaacattcaggct

SEQ ID NO: 7750617 - DNA, 22 bp, Homo sapiens
cagcactatgacatttaattct

SEQ ID NO: 7750618 - DNA, 22 bp, Homo sapiens
ggtggcagtagcactgggcctg

SEQ ID NO: 7750619 - DNA, 20 bp, Homo sapiens
cagcagagacccatggggag

SEQ ID NO: 7750620 - DNA, 22 bp, Homo sapiens
cagcagaagtgcatttgtgatt

SEQ ID NO: 7750621 - DNA, 22 bp, Homo sapiens
cagcagaagtccgactccagtc

SEQ ID NO: 7750622 - DNA, 22 bp, Homo sapiens
cagataaaggcttactagtagt

SEQ ID NO: 7750623 - DNA, 22 bp, Homo sapiens
cagataaaattaatattaccaa

SEQ ID NO: 7750624 - DNA, 22 bp, Homo sapiens
cagataatccaagtagttttca

SEQ ID NO: 7750625 - DNA, 22 bp, Homo sapiens
ggtgcagagcagtgtcagagca

SEQ ID NO: 7750626 - DNA, 22 bp, Homo sapiens
ggtgcagaggagccagctgggg

SEQ ID NO: 7750627 - DNA, 22 bp, Homo sapiens
ggggtagggtgattgtgaagta

SEQ ID NO: 7750628 - DNA, 22 bp, Homo sapiens
cagaggctgatggctgtagcca

SEQ ID NO: 7750629 - DNA, 21 bp, Homo sapiens
cagaggctgagagggcaatct

SEQ ID NO: 7750630 - DNA, 22 bp, Homo sapiens
cagaggcaggataagaactgcg

SEQ ID NO: 7750631 - DNA, 22 bp, Homo sapiens
ggggtagtaccttcgtatgctg

SEQ ID NO: 7750632 - DNA, 22 bp, Homo sapiens
ggggtagtcctggtgatggctg

SEQ ID NO: 7750633 - DNA, 22 bp, Homo sapiens
gggctctgcacgttctggcgtc

SEQ ID NO: 7750634 - DNA, 22 bp, Homo sapiens
gggctcaggagtttgaggctgc

SEQ ID NO: 7750635 - DNA, 22 bp, Homo sapiens
cagagctttctgtcacattagt

SEQ ID NO: 7750636 - DNA, 22 bp, Homo sapiens
ggggcgccccgagggtgcgcac

SEQ ID NO: 7750637 - DNA, 22 bp, Homo sapiens
ggggcgcgtcagttccccgcct

SEQ ID NO: 7750638 - DNA, 22 bp, Homo sapiens
cagaggacctgtgtggccagag

SEQ ID NO: 7750639 - DNA, 23 bp, Homo sapiens
gggggagctggactcctagatcc

SEQ ID NO: 7750640 - DNA, 22 bp, Homo sapiens
gggggagctgttattggcaggg

SEQ ID NO: 7750641 - DNA, 22 bp, Homo sapiens
gggggatgctcaggaggctgct

SEQ ID NO: 7750642 - DNA, 22 bp, Homo sapiens
cagaggcaggaagatgggcagt

SEQ ID NO: 7750643 - DNA, 21 bp, Homo sapiens
cagagcagcgttctgctgtgg

SEQ ID NO: 7750644 - DNA, 22 bp, Homo sapiens
cagagcaggaatagggtgttga

SEQ ID NO: 7750645 - DNA, 22 bp, Homo sapiens
cagagcaggcccactgccctcc

SEQ ID NO: 7750646 - DNA, 17 bp, Homo sapiens
gggcgcgggtagagccc

SEQ ID NO: 7750647 - DNA, 22 bp, Homo sapiens
gggcgcgggaaggagcccgaga

SEQ ID NO: 7750648 - DNA, 22 bp, Homo sapiens
cagagcagcagagcttccatgg

SEQ ID NO: 7750649 - DNA, 22 bp, Homo sapiens
cagagagcatgggaggcccgag

SEQ ID NO: 7750650 - DNA, 22 bp, Homo sapiens
cagcccttgcgacaccctggct

SEQ ID NO: 7750651 - DNA, 22 bp, Homo sapiens
cagcccttgtttctaaagctgc

SEQ ID NO: 7750652 - DNA, 22 bp, Homo sapiens
gtgctgagaattgatgtccttg

SEQ ID NO: 7750653 - DNA, 22 bp, Homo sapiens
gtgctgagcatcatgaggcact

SEQ ID NO: 7750654 - DNA, 22 bp, Homo sapiens
gtgctgagcacaccttggagca

SEQ ID NO: 7750655 - DNA, 22 bp, Homo sapiens
cagcagggaagctgtgctgttt

SEQ ID NO: 7750656 - DNA, 22 bp, Homo sapiens
cagcagagctgggctttgaatt

SEQ ID NO: 7750657 - DNA, 22 bp, Homo sapiens
cagcagagatgagattcctata

SEQ ID NO: 7750658 - DNA, 22 bp, Homo sapiens
cagcagtggctgcaggcagctg

SEQ ID NO: 7750659 - DNA, 22 bp, Homo sapiens
cagcatgaccctggagcctgca

SEQ ID NO: 7750660 - DNA, 22 bp, Homo sapiens
gtgcaaagtgcatggggaaggg

SEQ ID NO: 7750661 - DNA, 22 bp, Homo sapiens
gtgcaaagcttaacattctgca

SEQ ID NO: 7750662 - DNA, 22 bp, Homo sapiens
gtgcaggagccaggggtaggaa

SEQ ID NO: 7750663 - DNA, 22 bp, Homo sapiens
gtgaatgaaaggatgattcttt

SEQ ID NO: 7750664 - DNA, 22 bp, Homo sapiens
gtgaatgaaaggatgattcttt

SEQ ID NO: 7750665 - DNA, 22 bp, Homo sapiens
gtgaatgacatattttgtactg

SEQ ID NO: 7750666 - DNA, 22 bp, Homo sapiens
gtgaatgacatattttgtactg

SEQ ID NO: 7750667 - DNA, 22 bp, Homo sapiens
gtgaatgatagcttctctttgg

SEQ ID NO: 7750668 - DNA, 22 bp, Homo sapiens
gtgaatgactgttttcagcatt

SEQ ID NO: 7750669 - DNA, 22 bp, Homo sapiens
gtctctgtcttaggccaggcct

SEQ ID NO: 7750670 - DNA, 22 bp, Homo sapiens
gtctttctgctgcacggactgc

SEQ ID NO: 7750671 - DNA, 22 bp, Homo sapiens
gtctttcttcagagcttggact

SEQ ID NO: 7750672 - DNA, 22 bp, Homo sapiens
ggcaggacattgactacagtga

SEQ ID NO: 7750673 - DNA, 22 bp, Homo sapiens
cacatgcattggcaaaagtgta

SEQ ID NO: 7750674 - DNA, 22 bp, Homo sapiens
ggcaggtgccttctgtgctagc

SEQ ID NO: 7750675 - DNA, 22 bp, Homo sapiens
cacatgctccatacagaatggg

SEQ ID NO: 7750676 - DNA, 22 bp, Homo sapiens
ggagtgaatcactagatgcaga

SEQ ID NO: 7750677 - DNA, 21 bp, Homo sapiens
ggagtttttctggaagggact

SEQ ID NO: 7750678 - DNA, 21 bp, Homo sapiens
ggagtctgtggatgctgtttc

SEQ ID NO: 7750679 - DNA, 19 bp, Homo sapiens
ggatccagaggatctgcca

SEQ ID NO: 7750680 - DNA, 22 bp, Homo sapiens
ggatcacacatgcactgtttga

SEQ ID NO: 7750681 - DNA, 22 bp, Homo sapiens
ggcaggaaaacaatgagccagg

SEQ ID NO: 7750682 - DNA, 22 bp, Homo sapiens
ggcaggaagctcatgtggactg

SEQ ID NO: 7750683 - DNA, 22 bp, Homo sapiens
ggcaggaagcattaaaacgatt

SEQ ID NO: 7750684 - DNA, 22 bp, Homo sapiens
cacccaggcaggtggctgagaa

SEQ ID NO: 7750685 - DNA, 22 bp, Homo sapiens
cacccaggaggttgggaagggc

SEQ ID NO: 7750686 - DNA, 22 bp, Homo sapiens
cacccaggcatgggttgagatg

SEQ ID NO: 7750687 - DNA, 22 bp, Homo sapiens
cacccaggctagagtgcagtgg

SEQ ID NO: 7750688 - DNA, 22 bp, Homo sapiens
cacccaggacaaaatatggaat

SEQ ID NO: 7750689 - DNA, 22 bp, Homo sapiens
ggcgccagcggtaagtaagaca

SEQ ID NO: 7750690 - DNA, 22 bp, Homo sapiens
ggcgccaggcttcactttaaag

SEQ ID NO: 7750691 - DNA, 22 bp, Homo sapiens
ggcgcccccttcaaacagagca

SEQ ID NO: 7750692 - DNA, 22 bp, Homo sapiens
ggcgccagcccaggccgtcgtg

SEQ ID NO: 7750693 - DNA, 22 bp, Homo sapiens
ggcgccagcactgcagcgcctc

SEQ ID NO: 7750694 - DNA, 22 bp, Homo sapiens
cactgcaacctccacctcctgg

SEQ ID NO: 7750695 - DNA, 22 bp, Homo sapiens
cactgagttccctgacatttca

SEQ ID NO: 7750696 - DNA, 22 bp, Homo sapiens
ggcgcggtgactcagcctcgct

SEQ ID NO: 7750697 - DNA, 22 bp, Homo sapiens
ggcgctcagtgttgccccagag

SEQ ID NO: 7750698 - DNA, 22 bp, Homo sapiens
ggcgccgcactcggtgcagccg

SEQ ID NO: 7750699 - DNA, 22 bp, Homo sapiens
ggcgcctaggcaaggaacccct

SEQ ID NO: 7750700 - DNA, 22 bp, Homo sapiens
ggctgcggccgcgggtctgtgc

SEQ ID NO: 7750701 - DNA, 23 bp, Homo sapiens
ggctgcgagtgcctgggcctgtg

SEQ ID NO: 7750702 - DNA, 22 bp, Homo sapiens
ggctgcggatctaaggctggga

SEQ ID NO: 7750703 - DNA, 22 bp, Homo sapiens
ggctgcagattgtagtctgtta

SEQ ID NO: 7750704 - DNA, 22 bp, Homo sapiens
ggctgaggctcatgccatcttg

SEQ ID NO: 7750705 - DNA, 22 bp, Homo sapiens
ggctgcagcagagggactcacg

SEQ ID NO: 7750706 - DNA, 22 bp, Homo sapiens
ggctgcagcggattggggattg

SEQ ID NO: 7750707 - DNA, 22 bp, Homo sapiens
ggctgggagccccacagagtca

SEQ ID NO: 7750708 - DNA, 22 bp, Homo sapiens
cagaacagaagtaaaatttacc

SEQ ID NO: 7750709 - DNA, 22 bp, Homo sapiens
cagaaattcccatttcagattc

SEQ ID NO: 7750710 - DNA, 22 bp, Homo sapiens
cagaaattggaatagagaaata

SEQ ID NO: 7750711 - DNA, 22 bp, Homo sapiens
cagaacacaggctaaactgaga

SEQ ID NO: 7750712 - DNA, 22 bp, Homo sapiens
cagaaatgtactgacatgcagt

SEQ ID NO: 7750713 - DNA, 22 bp, Homo sapiens
cagaaatggagcccaggaatct

SEQ ID NO: 7750714 - DNA, 22 bp, Homo sapiens
cagaacagagtcaaaagtatgt

SEQ ID NO: 7750715 - DNA, 22 bp, Homo sapiens
cagaacagtacctagcacatag

SEQ ID NO: 7750716 - DNA, 23 bp, Homo sapiens
ggcttgagctggaacagcttggt

SEQ ID NO: 7750717 - DNA, 22 bp, Homo sapiens
ggctgggagctggacaggccgg

SEQ ID NO: 7750718 - DNA, 19 bp, Homo sapiens
ggcttcagggagttagcat

SEQ ID NO: 7750719 - DNA, 20 bp, Homo sapiens
caagttcaccttctcctctc

SEQ ID NO: 7750720 - DNA, 22 bp, Homo sapiens
gctgggctcaccaggccactag

SEQ ID NO: 7750721 - DNA, 22 bp, Homo sapiens
caatctgagttgggaatgtatt

SEQ ID NO: 7750722 - DNA, 17 bp, Homo sapiens
gctggtccttggtaact

SEQ ID NO: 7750723 - DNA, 22 bp, Homo sapiens
gctggtcctggggttgcagcat

SEQ ID NO: 7750724 - DNA, 22 bp, Homo sapiens
gctggtctagggatgggcgtat

SEQ ID NO: 7750725 - DNA, 22 bp, Homo sapiens
gctggtcctcaagggcacagcc

SEQ ID NO: 7750726 - DNA, 22 bp, Homo sapiens
gctggtgcattagctgcagttc

SEQ ID NO: 7750727 - DNA, 22 bp, Homo sapiens
gcttccagaccccagtccctca

SEQ ID NO: 7750728 - DNA, 20 bp, Homo sapiens
gcttccagaggaggccccgt

SEQ ID NO: 7750729 - DNA, 22 bp, Homo sapiens
gcttccagagagccccgcctgg

SEQ ID NO: 7750730 - DNA, 22 bp, Homo sapiens
ggaacacagaagggctgaaaaa

SEQ ID NO: 7750731 - DNA, 22 bp, Homo sapiens
ggaacacaaatgggagagctgg

SEQ ID NO: 7750732 - DNA, 22 bp, Homo sapiens
ggaacacagtgccttacaaact

SEQ ID NO: 7750733 - DNA, 22 bp, Homo sapiens
gcttccagccttttctcctctg

SEQ ID NO: 7750734 - DNA, 19 bp, Homo sapiens
gcttccagcactgcaggag

SEQ ID NO: 7750735 - DNA, 22 bp, Homo sapiens
gcttccaggcttcctacctttg

SEQ ID NO: 7750736 - DNA, 22 bp, Homo sapiens
gcttccagggctcagtcactgc

SEQ ID NO: 7750737 - DNA, 20 bp, Homo sapiens
gctgggctaccactggccct

SEQ ID NO: 7750738 - DNA, 22 bp, Homo sapiens
gctgaggtcaggagctgtgggg

SEQ ID NO: 7750739 - DNA, 22 bp, Homo sapiens
gctgaggtgaggctggaaagga

SEQ ID NO: 7750740 - DNA, 22 bp, Homo sapiens
cacagctgaagtagccatgtgg

SEQ ID NO: 7750741 - DNA, 22 bp, Homo sapiens
cacagcattaactgggacagct

SEQ ID NO: 7750742 - DNA, 22 bp, Homo sapiens
cacagcaggtgcttaatgatta

SEQ ID NO: 7750743 - DNA, 22 bp, Homo sapiens
cacagcagtctttcactaaata

SEQ ID NO: 7750744 - DNA, 22 bp, Homo sapiens
cacagcagtctttcactaaata

SEQ ID NO: 7750745 - DNA, 22 bp, Homo sapiens
cacagcagggatgaatggagtg

SEQ ID NO: 7750746 - DNA, 22 bp, Homo sapiens
ggagctggccctctgagtttgt

SEQ ID NO: 7750747 - DNA, 22 bp, Homo sapiens
ggagctggccgcctatgtgcag

SEQ ID NO: 7750748 - DNA, 22 bp, Homo sapiens
ggacacacaagttatctaatga

SEQ ID NO: 7750749 - DNA, 22 bp, Homo sapiens
ggacacagacctttctgttcta

SEQ ID NO: 7750750 - DNA, 22 bp, Homo sapiens
ggaacactgccttttattttcc

SEQ ID NO: 7750751 - DNA, 22 bp, Homo sapiens
ggaacactggctcaattatatc

SEQ ID NO: 7750752 - DNA, 22 bp, Homo sapiens
ggaacactgccttttattttcc

SEQ ID NO: 7750753 - DNA, 22 bp, Homo sapiens
ggaacagactgacttcttgaat

SEQ ID NO: 7750754 - DNA, 22 bp, Homo sapiens
cacagagacagatctattttgc

SEQ ID NO: 7750755 - DNA, 22 bp, Homo sapiens
cacagagaattcccatatgtga

SEQ ID NO: 7750756 - DNA, 22 bp, Homo sapiens
cacagagacatgatgtcattgc

SEQ ID NO: 7750757 - DNA, 22 bp, Homo sapiens
cattaataaacatttcagaaga

SEQ ID NO: 7750758 - DNA, 22 bp, Homo sapiens
cattaatattgttcttctttag

SEQ ID NO: 7750759 - DNA, 22 bp, Homo sapiens
tccaggggtaccggccaggcag

SEQ ID NO: 7750760 - DNA, 22 bp, Homo sapiens
tccaggggagactagacccaca

SEQ ID NO: 7750761 - DNA, 21 bp, Homo sapiens
tccaggggccagcacccaagc

SEQ ID NO: 7750762 - DNA, 19 bp, Homo sapiens
tccaggggctccacctcct

SEQ ID NO: 7750763 - DNA, 20 bp, Homo sapiens
tccagcaccctcacagagaa

SEQ ID NO: 7750764 - DNA, 22 bp, Homo sapiens
tccagcagaaccagagacctgg

SEQ ID NO: 7750765 - DNA, 22 bp, Homo sapiens
catgcttatgatttgctaagcc

SEQ ID NO: 7750766 - DNA, 22 bp, Homo sapiens
catgggctcttctggactgcac

SEQ ID NO: 7750767 - DNA, 22 bp, Homo sapiens
catggaacaaggaagatgtttg

SEQ ID NO: 7750768 - DNA, 22 bp, Homo sapiens
catgtaaaaaattaggtcatct

SEQ ID NO: 7750769 - DNA, 22 bp, Homo sapiens
catgtaaaacactcagaacagt

SEQ ID NO: 7750770 - DNA, 22 bp, Homo sapiens
catgtaaatccttctttaggcc

SEQ ID NO: 7750771 - DNA, 22 bp, Homo sapiens
catgtaaagcatccttctaggg

SEQ ID NO: 7750772 - DNA, 22 bp, Homo sapiens
catgtaaagaatttcacacaag

SEQ ID NO: 7750773 - DNA, 22 bp, Homo sapiens
tccaagaagtttatgttgtttc

SEQ ID NO: 7750774 - DNA, 22 bp, Homo sapiens
tccaagaatacagatttgtgaa

SEQ ID NO: 7750775 - DNA, 22 bp, Homo sapiens
tccaagaagtcatctaaactgt

SEQ ID NO: 7750776 - DNA, 22 bp, Homo sapiens
catgctgtactctgtgtcagaa

SEQ ID NO: 7750777 - DNA, 22 bp, Homo sapiens
catgctgatgaacttctacttg

SEQ ID NO: 7750778 - DNA, 22 bp, Homo sapiens
catgctgagcacattctgtatt

SEQ ID NO: 7750779 - DNA, 19 bp, Homo sapiens
catgctgacctgctgtggt

SEQ ID NO: 7750780 - DNA, 22 bp, Homo sapiens
tcatcagtccttttcattatga

SEQ ID NO: 7750781 - DNA, 22 bp, Homo sapiens
tcatcagtcagaacttaagctt

SEQ ID NO: 7750782 - DNA, 22 bp, Homo sapiens
tcatcactcattggacaacaga

SEQ ID NO: 7750783 - DNA, 22 bp, Homo sapiens
catcaggaaaaaactggagcca

SEQ ID NO: 7750784 - DNA, 22 bp, Homo sapiens
catcagttcatgtctagctgct

SEQ ID NO: 7750785 - DNA, 22 bp, Homo sapiens
catcagtttggtcaatgatggg

SEQ ID NO: 7750786 - DNA, 22 bp, Homo sapiens
catcagtttggagaggcggttt

SEQ ID NO: 7750787 - DNA, 22 bp, Homo sapiens
catcagttcccaggcccagaca

SEQ ID NO: 7750788 - DNA, 22 bp, Homo sapiens
catcagttcctgcccctgcccc

SEQ ID NO: 7750789 - DNA, 22 bp, Homo sapiens
catcagttttagaggggtgaaa

SEQ ID NO: 7750790 - DNA, 22 bp, Homo sapiens
cagtgtaagctctagactagaa

SEQ ID NO: 7750791 - DNA, 22 bp, Homo sapiens
cagtgtaagaattcaaagccta

SEQ ID NO: 7750792 - DNA, 22 bp, Homo sapiens
tcaggaggcggaggttgcagtg

SEQ ID NO: 7750793 - DNA, 22 bp, Homo sapiens
tcaggcagaattatcaaaagat

SEQ ID NO: 7750794 - DNA, 22 bp, Homo sapiens
tcaggctgcccgttcagggctc

SEQ ID NO: 7750795 - DNA, 22 bp, Homo sapiens
ccagaggtcccctgccaggagg

SEQ ID NO: 7750796 - DNA, 22 bp, Homo sapiens
ccagattgaactaaaggttata

SEQ ID NO: 7750797 - DNA, 22 bp, Homo sapiens
ccagcaaggtccagcataggga

SEQ ID NO: 7750798 - DNA, 22 bp, Homo sapiens
tctctgtcacacaatctacaca

SEQ ID NO: 7750799 - DNA, 19 bp, Homo sapiens
ccacccctttgctgggccc

SEQ ID NO: 7750800 - DNA, 22 bp, Homo sapiens
ccacccctgggtgcagggagcg

SEQ ID NO: 7750801 - DNA, 22 bp, Homo sapiens
ccacccctgtagagggacagac

SEQ ID NO: 7750802 - DNA, 22 bp, Homo sapiens
tctcagtggcttcctcactttt

SEQ ID NO: 7750803 - DNA, 22 bp, Homo sapiens
tcctgaggtggattgagcagag

SEQ ID NO: 7750804 - DNA, 23 bp, Homo sapiens
ccaagactgttaggagtggggag

SEQ ID NO: 7750805 - DNA, 23 bp, Homo sapiens
ccaagactgttaggagtggggag

SEQ ID NO: 7750806 - DNA, 22 bp, Homo sapiens
ccacagggcacagacaggaagc

SEQ ID NO: 7750807 - DNA, 22 bp, Homo sapiens
ccacagggcacagacaggaagc

SEQ ID NO: 7750808 - DNA, 22 bp, Homo sapiens
ccacagggaacatgacagcctt

SEQ ID NO: 7750809 - DNA, 22 bp, Homo sapiens
catttccacttctgaaaactgg

SEQ ID NO: 7750810 - DNA, 19 bp, Homo sapiens
tccataatgaagatagagg

SEQ ID NO: 7750811 - DNA, 22 bp, Homo sapiens
tcctgagggcattttggtgact

SEQ ID NO: 7750812 - DNA, 22 bp, Homo sapiens
cattttatgtttatggagtgct

SEQ ID NO: 7750813 - DNA, 22 bp, Homo sapiens
cattttatcctctgggaagcta

SEQ ID NO: 7750814 - DNA, 22 bp, Homo sapiens
tacacagaggcagctgtctgct

SEQ ID NO: 7750815 - DNA, 22 bp, Homo sapiens
tacacagaggctgatgtcttag

SEQ ID NO: 7750816 - DNA, 22 bp, Homo sapiens
tacacagagactcaaaagggca

SEQ ID NO: 7750817 - DNA, 22 bp, Homo sapiens
tacacagatatgtgatcaatca

SEQ ID NO: 7750818 - DNA, 22 bp, Homo sapiens
tacacagaagccagaaggcctg

SEQ ID NO: 7750819 - DNA, 22 bp, Homo sapiens
tacacagactcttcaattcaga

SEQ ID NO: 7750820 - DNA, 22 bp, Homo sapiens
tacacagatttcagtatcatca

SEQ ID NO: 7750821 - DNA, 22 bp, Homo sapiens
tacacagatttaaaagcaggga

SEQ ID NO: 7750822 - DNA, 22 bp, Homo sapiens
gtggagaggagcagctacctca

SEQ ID NO: 7750823 - DNA, 21 bp, Homo sapiens
gtggagagtgattttgatgca

SEQ ID NO: 7750824 - DNA, 20 bp, Homo sapiens
gtggagaggctggcgggact

SEQ ID NO: 7750825 - DNA, 22 bp, Homo sapiens
caggccctgcactaggccctgg

SEQ ID NO: 7750826 - DNA, 22 bp, Homo sapiens
caggccctcaggcaagggctct

SEQ ID NO: 7750827 - DNA, 22 bp, Homo sapiens
caggccctcgcccgcagcgacc

SEQ ID NO: 7750828 - DNA, 22 bp, Homo sapiens
caggccctgccttgagggacct

SEQ ID NO: 7750829 - DNA, 22 bp, Homo sapiens
caggctctaggttagtaggaga

SEQ ID NO: 7750830 - DNA, 22 bp, Homo sapiens
caggctcggtccagtggcaccc

SEQ ID NO: 7750831 - DNA, 22 bp, Homo sapiens
caggctccctgcaggccagtga

SEQ ID NO: 7750832 - DNA, 22 bp, Homo sapiens
tacagagagtacagcatccaca

SEQ ID NO: 7750833 - DNA, 22 bp, Homo sapiens
tacagagactttatggcacaaa

SEQ ID NO: 7750834 - DNA, 22 bp, Homo sapiens
caggcctggagtgcaatggcac

SEQ ID NO: 7750835 - DNA, 22 bp, Homo sapiens
caggcctgtgagttgaggcccc

SEQ ID NO: 7750836 - DNA, 22 bp, Homo sapiens
cagggatgaccagagggatgtg

SEQ ID NO: 7750837 - DNA, 22 bp, Homo sapiens
tagcagagtttggtacctgggg

SEQ ID NO: 7750838 - DNA, 22 bp, Homo sapiens
tagcagcaaagcaggatctgct

SEQ ID NO: 7750839 - DNA, 22 bp, Homo sapiens
tagcagcaattacacagtccgt

SEQ ID NO: 7750840 - DNA, 22 bp, Homo sapiens
tagcagcacaaatggactatga

SEQ ID NO: 7750841 - DNA, 22 bp, Homo sapiens
tagcagcaatttcagaagtttg

SEQ ID NO: 7750842 - DNA, 22 bp, Homo sapiens
cagggatgagcagatggagcaa

SEQ ID NO: 7750843 - DNA, 22 bp, Homo sapiens
cagggatgagagatggcacaga

SEQ ID NO: 7750844 - DNA, 22 bp, Homo sapiens
cagggatgctgcttaggcagtt

SEQ ID NO: 7750845 - DNA, 20 bp, Homo sapiens
tagcagcagaaagaacttag

SEQ ID NO: 7750846 - DNA, 22 bp, Homo sapiens
tagcagcaggggaaacagctgt

SEQ ID NO: 7750847 - DNA, 22 bp, Homo sapiens
tagcagcacctttctaatctga

SEQ ID NO: 7750848 - DNA, 22 bp, Homo sapiens
tagcagcactatttgttgtagt

SEQ ID NO: 7750849 - DNA, 22 bp, Homo sapiens
tagcagcacatggtggttttat

SEQ ID NO: 7750850 - DNA, 22 bp, Homo sapiens
tagcattaaaggtaagacatta

SEQ ID NO: 7750851 - DNA, 22 bp, Homo sapiens
tagcattagagatagaaatagt

SEQ ID NO: 7750852 - DNA, 22 bp, Homo sapiens
cagggccaagctgcagcatctg

SEQ ID NO: 7750853 - DNA, 22 bp, Homo sapiens
caggctgattaggcctcgtcca

SEQ ID NO: 7750854 - DNA, 22 bp, Homo sapiens
caggctgagggttaggccttag

SEQ ID NO: 7750855 - DNA, 22 bp, Homo sapiens
taccctcacgagacttcaagtc

SEQ ID NO: 7750856 - DNA, 19 bp, Homo sapiens
taccctcagggcctcattt

SEQ ID NO: 7750857 - DNA, 22 bp, Homo sapiens
tacctcattacatctgcaatga

SEQ ID NO: 7750858 - DNA, 22 bp, Homo sapiens
tatgtacatgatttcatttgct

SEQ ID NO: 7750859 - DNA, 22 bp, Homo sapiens
cagtaatgtcatggagccatat

SEQ ID NO: 7750860 - DNA, 22 bp, Homo sapiens
tatgtacatcgttgaattcaaa

SEQ ID NO: 7750861 - DNA, 22 bp, Homo sapiens
tatgatatgcactttatcagaa

SEQ ID NO: 7750862 - DNA, 22 bp, Homo sapiens
tatgatattctaaattgacacc

SEQ ID NO: 7750863 - DNA, 22 bp, Homo sapiens
tatgaagactcatttattgggt

SEQ ID NO: 7750864 - DNA, 20 bp, Homo sapiens
tatgaagactcaagtagggc

SEQ ID NO: 7750865 - DNA, 22 bp, Homo sapiens
tagtgtttagtacatatgcata

SEQ ID NO: 7750866 - DNA, 22 bp, Homo sapiens
tagtgatttagaattcaaatgt

SEQ ID NO: 7750867 - DNA, 22 bp, Homo sapiens
tagtaacacattgaacgatcgc

SEQ ID NO: 7750868 - DNA, 20 bp, Homo sapiens
cagtagcaataattagaagc

SEQ ID NO: 7750869 - DNA, 22 bp, Homo sapiens
tcaaagcaatttcaccagtgcc

SEQ ID NO: 7750870 - DNA, 23 bp, Homo sapiens
tcaaaggaggcatcgttctgcag

SEQ ID NO: 7750871 - DNA, 22 bp, Homo sapiens
cagtccgccggcctcacccctg

SEQ ID NO: 7750872 - DNA, 22 bp, Homo sapiens
tcactgcaagctccacctcccg

SEQ ID NO: 7750873 - DNA, 22 bp, Homo sapiens
cagtggcaatgggacagagcac

SEQ ID NO: 7750874 - DNA, 22 bp, Homo sapiens
cagtggcagagaacagagacct

SEQ ID NO: 7750875 - DNA, 22 bp, Homo sapiens
tcacacctgtaatcccaggcct

SEQ ID NO: 7750876 - DNA, 22 bp, Homo sapiens
tcacacgtgaggttctatcctg

SEQ ID NO: 7750877 - DNA, 22 bp, Homo sapiens
tcacacgtccttgctactcctc

SEQ ID NO: 7750878 - DNA, 22 bp, Homo sapiens
cagtggaggctcaagtgtgctt

SEQ ID NO: 7750879 - DNA, 22 bp, Homo sapiens
cagtgcagaggtgcaagcatgt

SEQ ID NO: 7750880 - DNA, 22 bp, Homo sapiens
cagtgcaggtggcagaggacag

SEQ ID NO: 7750881 - DNA, 22 bp, Homo sapiens
cagtgcagtttcccagatgctg

SEQ ID NO: 7750882 - DNA, 22 bp, Homo sapiens
ccagtgctaaggtagcctctgc

SEQ ID NO: 7750883 - DNA, 22 bp, Homo sapiens
tgagcagagacttcaagggcag

SEQ ID NO: 7750884 - DNA, 22 bp, Homo sapiens
tgagttttggaagacaacacaa

SEQ ID NO: 7750885 - DNA, 22 bp, Homo sapiens
tgaggctgagatatcagggagg

SEQ ID NO: 7750886 - DNA, 22 bp, Homo sapiens
tgaggccatgcccgtgccggcc

SEQ ID NO: 7750887 - DNA, 22 bp, Homo sapiens
tgcaggaatcagaggggaagcg

SEQ ID NO: 7750888 - DNA, 22 bp, Homo sapiens
tgcaggacagtttggaagagag

SEQ ID NO: 7750889 - DNA, 20 bp, Homo sapiens
tgcaggacagagcctgtgtg

SEQ ID NO: 7750890 - DNA, 22 bp, Homo sapiens
tgcaggacccgggctgtggtca

SEQ ID NO: 7750891 - DNA, 22 bp, Homo sapiens
tgcaggactcaagggtagcagg

SEQ ID NO: 7750892 - DNA, 22 bp, Homo sapiens
tgcaggcccagtgtagaggctc

SEQ ID NO: 7750893 - DNA, 22 bp, Homo sapiens
tgcaggccagggtagggactag

SEQ ID NO: 7750894 - DNA, 22 bp, Homo sapiens
cccagcagcttgcacagtgctg

SEQ ID NO: 7750895 - DNA, 21 bp, Homo sapiens
tgcaggcaggcagagatgctg

SEQ ID NO: 7750896 - DNA, 22 bp, Homo sapiens
tgcaggagaaagtacggagcgt

SEQ ID NO: 7750897 - DNA, 22 bp, Homo sapiens
tgcaggcagggccagcgtgagg

SEQ ID NO: 7750898 - DNA, 22 bp, Homo sapiens
tgcaggcaggggatgagcagcc

SEQ ID NO: 7750899 - DNA, 22 bp, Homo sapiens
tgcaggcagtaggccagctcca

SEQ ID NO: 7750900 - DNA, 22 bp, Homo sapiens
tgcaggcataaccgatgttgat

SEQ ID NO: 7750901 - DNA, 22 bp, Homo sapiens
cccagcaggaggaggttgcagt

SEQ ID NO: 7750902 - DNA, 22 bp, Homo sapiens
tgcactagccacatttcaaatg

SEQ ID NO: 7750903 - DNA, 22 bp, Homo sapiens
cccaagggagtgcctggtcaac

SEQ ID NO: 7750904 - DNA, 22 bp, Homo sapiens
tcttgcaggcatgaaaggactc

SEQ ID NO: 7750905 - DNA, 22 bp, Homo sapiens
tgaaatgacagtcttaagctct

SEQ ID NO: 7750906 - DNA, 21 bp, Homo sapiens
ccaggctgggagggcagttcc

SEQ ID NO: 7750907 - DNA, 22 bp, Homo sapiens
ccagggcctcgtgttctgagtg

SEQ ID NO: 7750908 - DNA, 22 bp, Homo sapiens
ccagggctgagctgtgaccatg

SEQ ID NO: 7750909 - DNA, 22 bp, Homo sapiens
ccagggctctgcttctgccatg

SEQ ID NO: 7750910 - DNA, 22 bp, Homo sapiens
tgaaatgagcatttattcttta

SEQ ID NO: 7750911 - DNA, 22 bp, Homo sapiens
ccagggaagctggtcacgcagg

SEQ ID NO: 7750912 - DNA, 22 bp, Homo sapiens
ccagcactctgtcccagcttcc

SEQ ID NO: 7750913 - DNA, 22 bp, Homo sapiens
ccagcactctattgaatattct

SEQ ID NO: 7750914 - DNA, 22 bp, Homo sapiens
ccagcactcctgtctcaagtct

SEQ ID NO: 7750915 - DNA, 22 bp, Homo sapiens
tctgggcctcagtttcttcatc

SEQ ID NO: 7750916 - DNA, 22 bp, Homo sapiens
ccaggagccctgccacaatggt

SEQ ID NO: 7750917 - DNA, 22 bp, Homo sapiens
ccaggagcattaagagaacata

SEQ ID NO: 7750918 - DNA, 22 bp, Homo sapiens
ccaggagcaggagctggacaga

SEQ ID NO: 7750919 - DNA, 22 bp, Homo sapiens
ccaggagcaggagctgcagctg

SEQ ID NO: 7750920 - DNA, 22 bp, Homo sapiens
ccaggagcagccggcccacctg

SEQ ID NO: 7750921 - DNA, 22 bp, Homo sapiens
ccaggagcagatatggacataa

SEQ ID NO: 7750922 - DNA, 22 bp, Homo sapiens
ccaggcaattctgaaagcattt

SEQ ID NO: 7750923 - DNA, 22 bp, Homo sapiens
ccaggaggcttcgtccgtggag

SEQ ID NO: 7750924 - DNA, 22 bp, Homo sapiens
ccaggaggctctgactggaccc

SEQ ID NO: 7750925 - DNA, 22 bp, Homo sapiens
ccaggcagagtgctccagaaag

SEQ ID NO: 7750926 - DNA, 22 bp, Homo sapiens
ccaggcagagggatccccatcc

SEQ ID NO: 7750927 - DNA, 22 bp, Homo sapiens
ccaggcagagggaatagcaagt

SEQ ID NO: 7750928 - DNA, 22 bp, Homo sapiens
tcttctggatcgatcacattgt

SEQ ID NO: 7750929 - DNA, 17 bp, Homo sapiens
tcttctcttccagtctt

SEQ ID NO: 7750930 - DNA, 22 bp, Homo sapiens
tcttcctcatgaattctcgtat

SEQ ID NO: 7750931 - DNA, 22 bp, Homo sapiens
tcttctctcctgcttggcagaa

SEQ ID NO: 7750932 - DNA, 22 bp, Homo sapiens
tcttctctgtggcctggtggtg

SEQ ID NO: 7750933 - DNA, 22 bp, Homo sapiens
tcttcctcaatgtaacaacccc

SEQ ID NO: 7750934 - DNA, 22 bp, Homo sapiens
ccaggcctcctgtgagtggacc

SEQ ID NO: 7750935 - DNA, 22 bp, Homo sapiens
tcttctggatgagagcggaggc

SEQ ID NO: 7750936 - DNA, 22 bp, Homo sapiens
ccaggcaggcagcgttctcagg

SEQ ID NO: 7750937 - DNA, 22 bp, Homo sapiens
tgggcctggagccctggagagt

SEQ ID NO: 7750938 - DNA, 23 bp, Homo sapiens
tggggagagttaccctggaagcg

SEQ ID NO: 7750939 - DNA, 22 bp, Homo sapiens
tggggagaggtatcattgagat

SEQ ID NO: 7750940 - DNA, 22 bp, Homo sapiens
cctgcagctttgcctcctgaac

SEQ ID NO: 7750941 - DNA, 22 bp, Homo sapiens
cctgagtggagggattctgcag

SEQ ID NO: 7750942 - DNA, 22 bp, Homo sapiens
cctgcatgtggtcagcactcct

SEQ ID NO: 7750943 - DNA, 22 bp, Homo sapiens
cctgcaggttgcagaggcggaa

SEQ ID NO: 7750944 - DNA, 19 bp, Homo sapiens
cctgcagggatgagaggtt

SEQ ID NO: 7750945 - DNA, 22 bp, Homo sapiens
cctgcaggtccccggatgcgca

SEQ ID NO: 7750946 - DNA, 22 bp, Homo sapiens
cctgcagggtgctgccacagat

SEQ ID NO: 7750947 - DNA, 22 bp, Homo sapiens
tggtacataaatggatgttttc

SEQ ID NO: 7750948 - DNA, 23 bp, Homo sapiens
cctcccacctatttcactttctt

SEQ ID NO: 7750949 - DNA, 22 bp, Homo sapiens
cctcccacatcctagctctgct

SEQ ID NO: 7750950 - DNA, 22 bp, Homo sapiens
tgggcagaaggaagagccacct

SEQ ID NO: 7750951 - DNA, 22 bp, Homo sapiens
tggcttggactaaatggaccgt

SEQ ID NO: 7750952 - DNA, 19 bp, Homo sapiens
tggcttggctgcagatgct

SEQ ID NO: 7750953 - DNA, 22 bp, Homo sapiens
tggcttggtgagcagagtgtag

SEQ ID NO: 7750954 - DNA, 22 bp, Homo sapiens
ccctgggaagtattccagctat

SEQ ID NO: 7750955 - DNA, 22 bp, Homo sapiens
ccctttcaacattctgccttgt

SEQ ID NO: 7750956 - DNA, 22 bp, Homo sapiens
cccttgcatcccatgtgtggcc

SEQ ID NO: 7750957 - DNA, 22 bp, Homo sapiens
ccctggaggtcagaggcctggg

SEQ ID NO: 7750958 - DNA, 22 bp, Homo sapiens
tggaaactgggagttaaatgta

SEQ ID NO: 7750959 - DNA, 22 bp, Homo sapiens
tggaaactctacctctctaaga

SEQ ID NO: 7750960 - DNA, 19 bp, Homo sapiens
tggaaactcctgatattag

SEQ ID NO: 7750961 - DNA, 22 bp, Homo sapiens
tggaaactgtggtatttcttta

SEQ ID NO: 7750962 - DNA, 22 bp, Homo sapiens
tggaaactagagagtttgtatt

SEQ ID NO: 7750963 - DNA, 22 bp, Homo sapiens
ccctccctgtgtgcctcatttg

SEQ ID NO: 7750964 - DNA, 22 bp, Homo sapiens
tggaggcattttaggttgtcac

SEQ ID NO: 7750965 - DNA, 22 bp, Homo sapiens
tggaggcataggcctgggccct

SEQ ID NO: 7750966 - DNA, 23 bp, Homo sapiens
tggaggaaacacatcagaagacc

SEQ ID NO: 7750967 - DNA, 22 bp, Homo sapiens
tggaggacaggactggacagcc

SEQ ID NO: 7750968 - DNA, 22 bp, Homo sapiens
tgctaatgtttcatttttagat

SEQ ID NO: 7750969 - DNA, 23 bp, Homo sapiens
tgctggggtagtttgtggcacag

SEQ ID NO: 7750970 - DNA, 22 bp, Homo sapiens
ccctccccagggtcatattgaa

SEQ ID NO: 7750971 - DNA, 22 bp, Homo sapiens
ccctccccacaaagcttcacac

SEQ ID NO: 7750972 - DNA, 22 bp, Homo sapiens
ccccaggcagggcctaacagag

SEQ ID NO: 7750973 - DNA, 22 bp, Homo sapiens
gaggggaaaacaggaattaaca

SEQ ID NO: 7750974 - DNA, 22 bp, Homo sapiens
gagggcttccatggggagcccc

SEQ ID NO: 7750975 - DNA, 22 bp, Homo sapiens
gaggctgaggcggatggatcac

SEQ ID NO: 7750976 - DNA, 22 bp, Homo sapiens
gaggctcagagactttaagttt

SEQ ID NO: 7750977 - DNA, 22 bp, Homo sapiens
gaggctcagagtggttaaataa

SEQ ID NO: 7750978 - DNA, 22 bp, Homo sapiens
gaggctcattgcattgtgcatt

SEQ ID NO: 7750979 - DNA, 22 bp, Homo sapiens
gaggctcagttattttagcctg

SEQ ID NO: 7750980 - DNA, 22 bp, Homo sapiens
gaggctcagggagtatatgaat

SEQ ID NO: 7750981 - DNA, 22 bp, Homo sapiens
gaggcataaatcacagtgttca

SEQ ID NO: 7750982 - DNA, 22 bp, Homo sapiens
gaggctcacctagggagcactg

SEQ ID NO: 7750983 - DNA, 22 bp, Homo sapiens
gaggagcacatgaggctgaggg

SEQ ID NO: 7750984 - DNA, 22 bp, Homo sapiens
gaggcaggaggattgcttgagc

SEQ ID NO: 7750985 - DNA, 22 bp, Homo sapiens
gaggcaggcagattgcttgagg

SEQ ID NO: 7750986 - DNA, 22 bp, Homo sapiens
gaggagccatagatagtgctgc

SEQ ID NO: 7750987 - DNA, 22 bp, Homo sapiens
gagcaggcttgcagagaagggg

SEQ ID NO: 7750988 - DNA, 22 bp, Homo sapiens
gagcagtggtcacagggaggga

SEQ ID NO: 7750989 - DNA, 21 bp, Homo sapiens
gagcatggcttacatcagcag

SEQ ID NO: 7750990 - DNA, 22 bp, Homo sapiens
gagcatggctgcctccctgtgc

SEQ ID NO: 7750991 - DNA, 22 bp, Homo sapiens
gaggaacagagacgggatcgct

SEQ ID NO: 7750992 - DNA, 22 bp, Homo sapiens
gaggaacagagggcaaggccag

SEQ ID NO: 7750993 - DNA, 22 bp, Homo sapiens
gaggaacaagctgctttatctt

SEQ ID NO: 7750994 - DNA, 18 bp, Homo sapiens
gaggaacattcacctcct

SEQ ID NO: 7750995 - DNA, 22 bp, Homo sapiens
gaggaacagcagccacatgtcc

SEQ ID NO: 7750996 - DNA, 22 bp, Homo sapiens
gaggaacatgaggtgacctggg

SEQ ID NO: 7750997 - DNA, 23 bp, Homo sapiens
gaggaaagaatatagatgcaatc

SEQ ID NO: 7750998 - DNA, 22 bp, Homo sapiens
gagctgaggctcaggctggcgt

SEQ ID NO: 7750999 - DNA, 22 bp, Homo sapiens
gaatgatatattagcagatttt

SEQ ID NO: 7751000 - DNA, 22 bp, Homo sapiens
gaatgatattatttcgtgctgg

SEQ ID NO: 7751001 - DNA, 22 bp, Homo sapiens
gaatgataaatggaagcagcat

SEQ ID NO: 7751002 - DNA, 22 bp, Homo sapiens
gaatgatagagctgccttcgga

SEQ ID NO: 7751003 - DNA, 22 bp, Homo sapiens
gaatgagttaatatttgcttgg

SEQ ID NO: 7751004 - DNA, 22 bp, Homo sapiens
gaatgacattgaaaagacattg

SEQ ID NO: 7751005 - DNA, 22 bp, Homo sapiens
gaatgacattgagccataacat

SEQ ID NO: 7751006 - DNA, 22 bp, Homo sapiens
gaagggtgcatggagggaagtc

SEQ ID NO: 7751007 - DNA, 22 bp, Homo sapiens
gaagggcttggctgggaggcca

SEQ ID NO: 7751008 - DNA, 22 bp, Homo sapiens
gaagggctttctgggagaagag

SEQ ID NO: 7751009 - DNA, 22 bp, Homo sapiens
gaatattttcagtacagatggt

SEQ ID NO: 7751010 - DNA, 22 bp, Homo sapiens
gaatatttgtaattactgttga

SEQ ID NO: 7751011 - DNA, 22 bp, Homo sapiens
gaaggtttgaaataggtataga

SEQ ID NO: 7751012 - DNA, 22 bp, Homo sapiens
gaaaggaaattgagggacgcat

SEQ ID NO: 7751013 - DNA, 18 bp, Homo sapiens
gaaaggagagacagtagg

SEQ ID NO: 7751014 - DNA, 22 bp, Homo sapiens
gaaaggagagggttaaggagct

SEQ ID NO: 7751015 - DNA, 20 bp, Homo sapiens
gaagccagaggggaaaggag

SEQ ID NO: 7751016 - DNA, 22 bp, Homo sapiens
gaaggagctaccaagactgaat

SEQ ID NO: 7751017 - DNA, 22 bp, Homo sapiens
gaaggccacggaatggagctgg

SEQ ID NO: 7751018 - DNA, 22 bp, Homo sapiens
gactcctcagtcaccctcagct

SEQ ID NO: 7751019 - DNA, 22 bp, Homo sapiens
gactcctctctaacccactgga

SEQ ID NO: 7751020 - DNA, 17 bp, Homo sapiens
gaccaggagaaaccagg

SEQ ID NO: 7751021 - DNA, 22 bp, Homo sapiens
gagacgtggcctttgcctgagc

SEQ ID NO: 7751022 - DNA, 22 bp, Homo sapiens
gagagaaaggataacagctcaa

SEQ ID NO: 7751023 - DNA, 22 bp, Homo sapiens
gagagaaaagggggaattgatt

SEQ ID NO: 7751024 - DNA, 22 bp, Homo sapiens
gagagaagaaagccatggtcct

SEQ ID NO: 7751025 - DNA, 22 bp, Homo sapiens
gagagaacacaaagggccagct

SEQ ID NO: 7751026 - DNA, 22 bp, Homo sapiens
gagagaaattagttggtttgct

SEQ ID NO: 7751027 - DNA, 22 bp, Homo sapiens
gactgcctcagtttccctgcag

SEQ ID NO: 7751028 - DNA, 22 bp, Homo sapiens
gagaaagattgtccttcagggg

SEQ ID NO: 7751029 - DNA, 23 bp, Homo sapiens
gagaccagggccagctgtgtcat

SEQ ID NO: 7751030 - DNA, 22 bp, Homo sapiens
ctggtctgagggctcttgaggc

SEQ ID NO: 7751031 - DNA, 22 bp, Homo sapiens
ctggtgaatattggaggcattg

SEQ ID NO: 7751032 - DNA, 22 bp, Homo sapiens
ctggtctggctacccagcgaat

SEQ ID NO: 7751033 - DNA, 22 bp, Homo sapiens
ctgggcttgcactgcagcgaga

SEQ ID NO: 7751034 - DNA, 22 bp, Homo sapiens
ctgggcttgtgttagctgacaa

SEQ ID NO: 7751035 - DNA, 22 bp, Homo sapiens
ctggggaacgcagcgagcagcg

SEQ ID NO: 7751036 - DNA, 22 bp, Homo sapiens
ctgtagcaagttattcaataaa

SEQ ID NO: 7751037 - DNA, 20 bp, Homo sapiens
ctgtagggtgcagcaggctc

SEQ ID NO: 7751038 - DNA, 22 bp, Homo sapiens
ctgtcagcttctcctggccaga

SEQ ID NO: 7751039 - DNA, 22 bp, Homo sapiens
ctgtgctgaacaattctgcatt

SEQ ID NO: 7751040 - DNA, 22 bp, Homo sapiens
ctgtgctgattcagcacaggcc

SEQ ID NO: 7751041 - DNA, 22 bp, Homo sapiens
ctgtgctggagatgggccagag

SEQ ID NO: 7751042 - DNA, 23 bp, Homo sapiens
ctgtgctgggtcccatcttgggc

SEQ ID NO: 7751043 - DNA, 22 bp, Homo sapiens
ctgggatgtgaggagcgcctct

SEQ ID NO: 7751044 - DNA, 17 bp, Homo sapiens
ctgggatgtggactctt

SEQ ID NO: 7751045 - DNA, 22 bp, Homo sapiens
ctgggcagctgtatcagggagt

SEQ ID NO: 7751046 - DNA, 22 bp, Homo sapiens
ctgggcagcctcacacaatgtt

SEQ ID NO: 7751047 - DNA, 22 bp, Homo sapiens
ctgggcactttggggagcctac

SEQ ID NO: 7751048 - DNA, 22 bp, Homo sapiens
ctgggccttgatcacacaggtg

SEQ ID NO: 7751049 - DNA, 22 bp, Homo sapiens
ctgggccttgccaggggtgtct

SEQ ID NO: 7751050 - DNA, 22 bp, Homo sapiens
ctgggccttgccttgcccacag

SEQ ID NO: 7751051 - DNA, 22 bp, Homo sapiens
ctgggccttatgagtacctgga

SEQ ID NO: 7751052 - DNA, 22 bp, Homo sapiens
ctgggcctgtgactcccatcct

SEQ ID NO: 7751053 - DNA, 22 bp, Homo sapiens
ctgggcctgtccctgattgagg

SEQ ID NO: 7751054 - DNA, 22 bp, Homo sapiens
ctgggcctgtgggcacacggac

SEQ ID NO: 7751055 - DNA, 22 bp, Homo sapiens
ctgggccttagggcactccctt

SEQ ID NO: 7751056 - DNA, 22 bp, Homo sapiens
ctgggcctggtgtggcacctgc

SEQ ID NO: 7751057 - DNA, 22 bp, Homo sapiens
ctgggcctcctctgcccaagct

SEQ ID NO: 7751058 - DNA, 22 bp, Homo sapiens
ctgggcctttacctacggagtt

SEQ ID NO: 7751059 - DNA, 22 bp, Homo sapiens
ctgggcctttgcttattaattt

SEQ ID NO: 7751060 - DNA, 22 bp, Homo sapiens
ctgggcctttgggagttcggtg

SEQ ID NO: 7751061 - DNA, 22 bp, Homo sapiens
ctgggccttggattgacactgt

SEQ ID NO: 7751062 - DNA, 22 bp, Homo sapiens
ctgggctgtttgttctggtctc

SEQ ID NO: 7751063 - DNA, 22 bp, Homo sapiens
ctgggacagctgagacaggaga

SEQ ID NO: 7751064 - DNA, 22 bp, Homo sapiens
ctgggagatgactcagagcagg

SEQ ID NO: 7751065 - DNA, 22 bp, Homo sapiens
ctgggagaggtggtgggaagta

SEQ ID NO: 7751066 - DNA, 22 bp, Homo sapiens
ctgggacttgcagagcaggagg

SEQ ID NO: 7751067 - DNA, 22 bp, Homo sapiens
ctgggactgggtcctcaggaca

SEQ ID NO: 7751068 - DNA, 22 bp, Homo sapiens
ctgctgtgtggattcaatggct

SEQ ID NO: 7751069 - DNA, 22 bp, Homo sapiens
cttctcagatctcagctttgag

SEQ ID NO: 7751070 - DNA, 22 bp, Homo sapiens
cttccagctgattggcatccag

SEQ ID NO: 7751071 - DNA, 22 bp, Homo sapiens
cttccagcttgtggcgctttcc

SEQ ID NO: 7751072 - DNA, 22 bp, Homo sapiens
cttcctttccccaatcatatcg

SEQ ID NO: 7751073 - DNA, 22 bp, Homo sapiens
cttccagctgattacaggctat

SEQ ID NO: 7751074 - DNA, 22 bp, Homo sapiens
cttaggatttaatttcagactc

SEQ ID NO: 7751075 - DNA, 22 bp, Homo sapiens
cttagcatgcagtgttctgccc

SEQ ID NO: 7751076 - DNA, 22 bp, Homo sapiens
cttagcagataaaaaccttcag

SEQ ID NO: 7751077 - DNA, 20 bp, Homo sapiens
cttagctagtaagaagctgt

SEQ ID NO: 7751078 - DNA, 22 bp, Homo sapiens
cttagccagctaacttaagcac

SEQ ID NO: 7751079 - DNA, 22 bp, Homo sapiens
cttagcatgtggtgtccttgta

SEQ ID NO: 7751080 - DNA, 22 bp, Homo sapiens
cttagcttcattattggtggcc

SEQ ID NO: 7751081 - DNA, 20 bp, Homo sapiens
cttagcttctaaggttctgg

SEQ ID NO: 7751082 - DNA, 22 bp, Homo sapiens
cttagcttcactgggtctcagt

SEQ ID NO: 7751083 - DNA, 22 bp, Homo sapiens
cttagcttttccagcttctaga

SEQ ID NO: 7751084 - DNA, 22 bp, Homo sapiens
cttagctttgtttaacacaggg

SEQ ID NO: 7751085 - DNA, 22 bp, Homo sapiens
cttagctttgtcctaggtctct

SEQ ID NO: 7751086 - DNA, 22 bp, Homo sapiens
cttccaaacccagggtatgggc

SEQ ID NO: 7751087 - DNA, 22 bp, Homo sapiens
cttcagtgttggttcattacga

SEQ ID NO: 7751088 - DNA, 22 bp, Homo sapiens
ctgtggaacttagtgggagaca

SEQ ID NO: 7751089 - DNA, 22 bp, Homo sapiens
ctgttttatctcaagagttcaa

SEQ ID NO: 7751090 - DNA, 22 bp, Homo sapiens
cttagcagaattccaagcttga

SEQ ID NO: 7751091 - DNA, 22 bp, Homo sapiens
cttagcagaagcttcagcttca

SEQ ID NO: 7751092 - DNA, 22 bp, Homo sapiens
cttagaaatgcagattctcagg

SEQ ID NO: 7751093 - DNA, 22 bp, Homo sapiens
cttctggggatggagcccagaa

SEQ ID NO: 7751094 - DNA, 22 bp, Homo sapiens
cttctgggcatggcagagcctg

SEQ ID NO: 7751095 - DNA, 22 bp, Homo sapiens
cttctgggcattcagctgcaca

SEQ ID NO: 7751096 - DNA, 22 bp, Homo sapiens
cttctggcgttggaggtctgag

SEQ ID NO: 7751097 - DNA, 22 bp, Homo sapiens
cttctgggtgtggagtgaggac

SEQ ID NO: 7751098 - DNA, 22 bp, Homo sapiens
cttctgggtgcctgtgagtgtt

SEQ ID NO: 7751099 - DNA, 22 bp, Homo sapiens
cttgttttggaacagagtgaat

SEQ ID NO: 7751100 - DNA, 22 bp, Homo sapiens
cttgtttttaagagatgtttac

SEQ ID NO: 7751101 - DNA, 22 bp, Homo sapiens
cttgttttggctagtatgatgt

SEQ ID NO: 7751102 - DNA, 22 bp, Homo sapiens
cttgttttcttctgcagtctat

SEQ ID NO: 7751103 - DNA, 22 bp, Homo sapiens
cttgttttctaaaacatcattt

SEQ ID NO: 7751104 - DNA, 22 bp, Homo sapiens
cttgttttgaaagcagtggcca

SEQ ID NO: 7751105 - DNA, 21 bp, Homo sapiens
cttgttttgaaaggactggcc

SEQ ID NO: 7751106 - DNA, 22 bp, Homo sapiens
ctttaaggtgatgagagatgct

SEQ ID NO: 7751107 - DNA, 22 bp, Homo sapiens
ctttgaaaacacacgaatagac

SEQ ID NO: 7751108 - DNA, 22 bp, Homo sapiens
ctttgaaaaatggtttcctaga

SEQ ID NO: 7751109 - DNA, 22 bp, Homo sapiens
ctttgaaaacttaaataacagc

SEQ ID NO: 7751110 - DNA, 22 bp, Homo sapiens
ctttgaaaatgtggttaagggt

SEQ ID NO: 7751111 - DNA, 22 bp, Homo sapiens
ctttgaaacctgctctgcagaa

SEQ ID NO: 7751112 - DNA, 22 bp, Homo sapiens
ctttgaaagctcccaggactta

SEQ ID NO: 7751113 - DNA, 22 bp, Homo sapiens
ctttgaaaggaagccacacagc

SEQ ID NO: 7751114 - DNA, 22 bp, Homo sapiens
ctttgaaattcttcagctgaag

SEQ ID NO: 7751115 - DNA, 22 bp, Homo sapiens
ctttgaattgccgtttcatctg

SEQ ID NO: 7751116 - DNA, 22 bp, Homo sapiens
cttttacatttgttgaagagta

SEQ ID NO: 7751117 - DNA, 17 bp, Homo sapiens
gaaagcatcacatgctc

SEQ ID NO: 7751118 - DNA, 22 bp, Homo sapiens
gaaagataatcaattactcctt

SEQ ID NO: 7751119 - DNA, 22 bp, Homo sapiens
gaaaatgtttcctgttatttgc

SEQ ID NO: 7751120 - DNA, 22 bp, Homo sapiens
tttgaagggcacgacaatagtt

SEQ ID NO: 7751121 - DNA, 20 bp, Homo sapiens
ctctgctgcccgccggctgc

SEQ ID NO: 7751122 - DNA, 22 bp, Homo sapiens
tttcttagcgatgcttgataaa

SEQ ID NO: 7751123 - DNA, 22 bp, Homo sapiens
tttcttaggctctaaaatgact

SEQ ID NO: 7751124 - DNA, 22 bp, Homo sapiens
ctctgagggctcgagggacgcg

SEQ ID NO: 7751125 - DNA, 22 bp, Homo sapiens
ctctgaggctccatgcaggctt

SEQ ID NO: 7751126 - DNA, 22 bp, Homo sapiens
ctctctggacctcaactatttt

SEQ ID NO: 7751127 - DNA, 22 bp, Homo sapiens
ctctctggcacttcattgctgt

SEQ ID NO: 7751128 - DNA, 22 bp, Homo sapiens
ctctctggcccatcctgttgcc

SEQ ID NO: 7751129 - DNA, 22 bp, Homo sapiens
ctctctggatatttgtatgctg

SEQ ID NO: 7751130 - DNA, 22 bp, Homo sapiens
ctctctggacttgagtatcagc

SEQ ID NO: 7751131 - DNA, 22 bp, Homo sapiens
tttctctggcctcagtttaaca

SEQ ID NO: 7751132 - DNA, 22 bp, Homo sapiens
tttctctgagttgttacaaaac

SEQ ID NO: 7751133 - DNA, 22 bp, Homo sapiens
tttctctctggccctgattgtc

SEQ ID NO: 7751134 - DNA, 22 bp, Homo sapiens
ctccccacatttctccctgtct

SEQ ID NO: 7751135 - DNA, 18 bp, Homo sapiens
ctcggggacaagggcggc

SEQ ID NO: 7751136 - DNA, 22 bp, Homo sapiens
ctcggggatccatccacgtggc

SEQ ID NO: 7751137 - DNA, 22 bp, Homo sapiens
tttcaaagtggagaattagaca

SEQ ID NO: 7751138 - DNA, 22 bp, Homo sapiens
tttacacaaaagatagcacacc

SEQ ID NO: 7751139 - DNA, 22 bp, Homo sapiens
tttacacagaggacactgggct

SEQ ID NO: 7751140 - DNA, 22 bp, Homo sapiens
tttacacaaaatgttagtagat

SEQ ID NO: 7751141 - DNA, 22 bp, Homo sapiens
tttacacatacctctttaaagt

SEQ ID NO: 7751142 - DNA, 22 bp, Homo sapiens
ctgctggcctagcccatcctct

SEQ ID NO: 7751143 - DNA, 22 bp, Homo sapiens
ctgcctgccttggcctccagga

SEQ ID NO: 7751144 - DNA, 22 bp, Homo sapiens
ctgagggccttctatgctgagc

SEQ ID NO: 7751145 - DNA, 23 bp, Homo sapiens
ctgagggctggtctgaagtctgc

SEQ ID NO: 7751146 - DNA, 22 bp, Homo sapiens
ctgagggctggagctgaggcct

SEQ ID NO: 7751147 - DNA, 22 bp, Homo sapiens
ctgagagttcgttccaccctcc

SEQ ID NO: 7751148 - DNA, 20 bp, Homo sapiens
ctgagagtctgtgcttagtc

SEQ ID NO: 7751149 - DNA, 22 bp, Homo sapiens
ctgagatggccactgggtctca

SEQ ID NO: 7751150 - DNA, 22 bp, Homo sapiens
ctgagatggtctctttgttact

SEQ ID NO: 7751151 - DNA, 22 bp, Homo sapiens
ctgagatggtctctttgttact

SEQ ID NO: 7751152 - DNA, 22 bp, Homo sapiens
ctgaataatacagactagcttc

SEQ ID NO: 7751153 - DNA, 22 bp, Homo sapiens
ctgaggctgggcatggggtcca

SEQ ID NO: 7751154 - DNA, 22 bp, Homo sapiens
ctgaggaaggagttaggcagtt

SEQ ID NO: 7751155 - DNA, 22 bp, Homo sapiens
tttttctcttctgtaaagtggt

SEQ ID NO: 7751156 - DNA, 22 bp, Homo sapiens
ctgaaagaataagatgtttaca

SEQ ID NO: 7751157 - DNA, 22 bp, Homo sapiens
ttccaaattaaaatgtacaatg

SEQ ID NO: 7751158 - DNA, 20 bp, Homo sapiens
cgggacactcaagctctggg

SEQ ID NO: 7751159 - DNA, 22 bp, Homo sapiens
cgggaacatgctttcatttcag

SEQ ID NO: 7751160 - DNA, 22 bp, Homo sapiens
ttccaaattccaatcccctgaa

SEQ ID NO: 7751161 - DNA, 22 bp, Homo sapiens
cggctgggttcggctgcaggcc

SEQ ID NO: 7751162 - DNA, 21 bp, Homo sapiens
ttccagaaatctctttcttca

SEQ ID NO: 7751163 - DNA, 17 bp, Homo sapiens
ttcctcctcaccatgtt

SEQ ID NO: 7751164 - DNA, 22 bp, Homo sapiens
ttctacacttttcattagctag

SEQ ID NO: 7751165 - DNA, 22 bp, Homo sapiens
ttcctttttacataatcacatt

SEQ ID NO: 7751166 - DNA, 22 bp, Homo sapiens
ctacatcaagtaatcttcaaaa

SEQ ID NO: 7751167 - DNA, 22 bp, Homo sapiens
ttctcataaatcctgagaccta

SEQ ID NO: 7751168 - DNA, 21 bp, Homo sapiens
ttctcatgggataagtacatg

SEQ ID NO: 7751169 - DNA, 22 bp, Homo sapiens
ttctccttgaaaagctgcatct

SEQ ID NO: 7751170 - DNA, 22 bp, Homo sapiens
ctagttttaagctccttgaggt

SEQ ID NO: 7751171 - DNA, 22 bp, Homo sapiens
ttcttaaagaggcaaaacacag

SEQ ID NO: 7751172 - DNA, 22 bp, Homo sapiens
ttcttaagtgagaaagcaggag

SEQ ID NO: 7751173 - DNA, 19 bp, Homo sapiens
ttgaatatgcaaactgaag

SEQ ID NO: 7751174 - DNA, 22 bp, Homo sapiens
ttgaatgaagtccctttttact

SEQ ID NO: 7751175 - DNA, 22 bp, Homo sapiens
ttgaatgaaattgctgtgttat

SEQ ID NO: 7751176 - DNA, 22 bp, Homo sapiens
ctcagaaaacctctttcttgat

SEQ ID NO: 7751177 - DNA, 22 bp, Homo sapiens
ttgctgagcagtgtttaattgt

SEQ ID NO: 7751178 - DNA, 22 bp, Homo sapiens
ttgccgccgtctgctcgccccg

SEQ ID NO: 7751179 - DNA, 22 bp, Homo sapiens
ttgatattttgcacgcttggta

SEQ ID NO: 7751180 - DNA, 22 bp, Homo sapiens
ccttctggaagctctaagggag

SEQ ID NO: 7751181 - DNA, 22 bp, Homo sapiens
ccttctggagggtgtacgagag

SEQ ID NO: 7751182 - DNA, 22 bp, Homo sapiens
ccttctggatgtgctaaggaag

SEQ ID NO: 7751183 - DNA, 22 bp, Homo sapiens
ccttctgggccaacttccagga

SEQ ID NO: 7751184 - DNA, 21 bp, Homo sapiens
ccttctcttgcttcagcttca

SEQ ID NO: 7751185 - DNA, 22 bp, Homo sapiens
ttatctagatgtgttatcagac

SEQ ID NO: 7751186 - DNA, 22 bp, Homo sapiens
cgcagagggagccgcgggctgc

SEQ ID NO: 7751187 - DNA, 22 bp, Homo sapiens
cgcagagggcaggcagtgctgg

SEQ ID NO: 7751188 - DNA, 22 bp, Homo sapiens
ttcaaaacagctagatattgga

SEQ ID NO: 7751189 - DNA, 18 bp, Homo sapiens
ttattcagacgcatatga

SEQ ID NO: 7751190 - DNA, 22 bp, Homo sapiens
ttatttcattgatttctaagac

SEQ ID NO: 7751191 - DNA, 22 bp, Homo sapiens
cgcaccactgaattccagcctg

SEQ ID NO: 7751192 - DNA, 22 bp, Homo sapiens
ttatgtacccactcatattccc

SEQ ID NO: 7751193 - DNA, 22 bp, Homo sapiens
ttatgtactctgcaatgtttga

SEQ ID NO: 7751194 - DNA, 22 bp, Homo sapiens
cctttcttgcttagtggctcat

SEQ ID NO: 7751195 - DNA, 22 bp, Homo sapiens
tgttgatttgtgggctgcaaaa

SEQ ID NO: 7751196 - DNA, 22 bp, Homo sapiens
tgttgcaggcccctggggtatg

SEQ ID NO: 7751197 - DNA, 23 bp, Homo sapiens
cctggggcacttgagtcctcatc

SEQ ID NO: 7751198 - DNA, 22 bp, Homo sapiens
cctggggagccgcctgagcccc

SEQ ID NO: 7751199 - DNA, 21 bp, Homo sapiens
ttacaaagctacagatgttgc

SEQ ID NO: 7751200 - DNA, 22 bp, Homo sapiens
cctgtggaccaggaggcagccc

SEQ ID NO: 7751201 - DNA, 22 bp, Homo sapiens
ttaatactataatttgaagtac

SEQ ID NO: 7751202 - DNA, 22 bp, Homo sapiens
gagggggaaagtccctggagtc

SEQ ID NO: 7751203 - DNA, 22 bp, Homo sapiens
gaggggcttgaggccctgatgg

SEQ ID NO: 7751204 - DNA, 22 bp, Homo sapiens
gcacagcatgaagagaggaagc

SEQ ID NO: 7751205 - DNA, 22 bp, Homo sapiens
gcacagcagtggcataaacaat

SEQ ID NO: 7751206 - DNA, 22 bp, Homo sapiens
gcaaggaagagcaggtggtgct

SEQ ID NO: 7751207 - DNA, 22 bp, Homo sapiens
gcaagctgtccttttgcatggc

SEQ ID NO: 7751208 - DNA, 22 bp, Homo sapiens
gcaagctgtgatttatgtgaat

SEQ ID NO: 7751209 - DNA, 22 bp, Homo sapiens
gcaagctgtgccttctcaggat

SEQ ID NO: 7751210 - DNA, 21 bp, Homo sapiens
gcaagccaccactgctgccac

SEQ ID NO: 7751211 - DNA, 16 bp, Homo sapiens
gcaagccatcaggcaa

SEQ ID NO: 7751212 - DNA, 22 bp, Homo sapiens
gcaagctgctcttatgtggagg

SEQ ID NO: 7751213 - DNA, 22 bp, Homo sapiens
gcaagctgatgtgatagtgaaa

SEQ ID NO: 7751214 - DNA, 22 bp, Homo sapiens
gcagaggacacaggagggcaag

SEQ ID NO: 7751215 - DNA, 22 bp, Homo sapiens
gcagaggagcaagctggacacc

SEQ ID NO: 7751216 - DNA, 23 bp, Homo sapiens
gcagaggagcaagctggacacca

SEQ ID NO: 7751217 - DNA, 22 bp, Homo sapiens
gcagaggactcaatcaaggtat

SEQ ID NO: 7751218 - DNA, 22 bp, Homo sapiens
gcagaggaggacccaggaatta

SEQ ID NO: 7751219 - DNA, 22 bp, Homo sapiens
gcagcagctctcaaagtggtct

SEQ ID NO: 7751220 - DNA, 22 bp, Homo sapiens
gcagcaggcacggtctcgacat

SEQ ID NO: 7751221 - DNA, 22 bp, Homo sapiens
gcagcaggagagtttgtcctgc

SEQ ID NO: 7751222 - DNA, 22 bp, Homo sapiens
gcagcagtaggaaataacacag

SEQ ID NO: 7751223 - DNA, 22 bp, Homo sapiens
gcaggagctggaaagtgatgtt

SEQ ID NO: 7751224 - DNA, 22 bp, Homo sapiens
gcaggaggccaggtatgcttta

SEQ ID NO: 7751225 - DNA, 22 bp, Homo sapiens
gcaggaggttgagccaggactg

SEQ ID NO: 7751226 - DNA, 22 bp, Homo sapiens
gcaggctgagagtccaagaagg

SEQ ID NO: 7751227 - DNA, 22 bp, Homo sapiens
gcaggctgaaactcggggtcta

SEQ ID NO: 7751228 - DNA, 19 bp, Homo sapiens
gcaggcctcttgggaatta

SEQ ID NO: 7751229 - DNA, 22 bp, Homo sapiens
gcagggccttagcagcggctgc

SEQ ID NO: 7751230 - DNA, 22 bp, Homo sapiens
gcaggctgccaccttctgagtt

SEQ ID NO: 7751231 - DNA, 22 bp, Homo sapiens
gcaggctgatgactggagttgg

SEQ ID NO: 7751232 - DNA, 22 bp, Homo sapiens
gcaggctgatagaggattccat

SEQ ID NO: 7751233 - DNA, 22 bp, Homo sapiens
gccagcaggttgtcaaggagct

SEQ ID NO: 7751234 - DNA, 20 bp, Homo sapiens
gccaaggaggagaaacaggc

SEQ ID NO: 7751235 - DNA, 21 bp, Homo sapiens
gccaaggaggctagagaacat

SEQ ID NO: 7751236 - DNA, 22 bp, Homo sapiens
gccagagcatgcactgcctgca

SEQ ID NO: 7751237 - DNA, 22 bp, Homo sapiens
gccagagagatggaaaagctta

SEQ ID NO: 7751238 - DNA, 22 bp, Homo sapiens
gccaaggggttcaaaatgtata

SEQ ID NO: 7751239 - DNA, 21 bp, Homo sapiens
gccaagggggtagctattcct

SEQ ID NO: 7751240 - DNA, 22 bp, Homo sapiens
gccaagggggcagtgcatgggt

SEQ ID NO: 7751241 - DNA, 19 bp, Homo sapiens
gccaagggacttgcttctt

SEQ ID NO: 7751242 - DNA, 22 bp, Homo sapiens
gccaagggaactgagccggagg

SEQ ID NO: 7751243 - DNA, 22 bp, Homo sapiens
gccagagagactgatacatgct

SEQ ID NO: 7751244 - DNA, 22 bp, Homo sapiens
gccaagggtagtggaggcccct

SEQ ID NO: 7751245 - DNA, 22 bp, Homo sapiens
gcagtgaacataacacagaagg

SEQ ID NO: 7751246 - DNA, 22 bp, Homo sapiens
gcagtgaagatggcaggttggg

SEQ ID NO: 7751247 - DNA, 22 bp, Homo sapiens
gcagtgaagatttgggctctgg

SEQ ID NO: 7751248 - DNA, 22 bp, Homo sapiens
gcatctaatccagtccagcatc

SEQ ID NO: 7751249 - DNA, 23 bp, Homo sapiens
gcatcttaaaacctacatatgtg

SEQ ID NO: 7751250 - DNA, 22 bp, Homo sapiens
gcatctgatccaatagatatat

SEQ ID NO: 7751251 - DNA, 22 bp, Homo sapiens
gcatgaggttcttggccagcat

SEQ ID NO: 7751252 - DNA, 20 bp, Homo sapiens
gcatgaggaatcattgcagc

SEQ ID NO: 7751253 - DNA, 22 bp, Homo sapiens
gcatgaggtttgggctctgtga

SEQ ID NO: 7751254 - DNA, 22 bp, Homo sapiens
gccaggtcgtctccatgtccaa

SEQ ID NO: 7751255 - DNA, 22 bp, Homo sapiens
gccaggatgactatacaacagc

SEQ ID NO: 7751256 - DNA, 22 bp, Homo sapiens
gccaggcaaattaaggaatgca

SEQ ID NO: 7751257 - DNA, 22 bp, Homo sapiens
gccaggactagagggaggtgag

SEQ ID NO: 7751258 - DNA, 22 bp, Homo sapiens
gccaggactcttcctagaaggt

SEQ ID NO: 7751259 - DNA, 22 bp, Homo sapiens
gccaggactgagaatgggagca

SEQ ID NO: 7751260 - DNA, 22 bp, Homo sapiens
gccaggaatttcaagagccact

SEQ ID NO: 7751261 - DNA, 22 bp, Homo sapiens
gccaggaatggagaggtggcct

SEQ ID NO: 7751262 - DNA, 22 bp, Homo sapiens
gccaggagactccattcatttg

SEQ ID NO: 7751263 - DNA, 22 bp, Homo sapiens
gccaggagaatgctagcagagg

SEQ ID NO: 7751264 - DNA, 22 bp, Homo sapiens
gccagtaagtggtagagactta

SEQ ID NO: 7751265 - DNA, 22 bp, Homo sapiens
gccagtggcttgccaggcagga

SEQ ID NO: 7751266 - DNA, 22 bp, Homo sapiens
gcccagagtgagtcctgggccc

SEQ ID NO: 7751267 - DNA, 18 bp, Homo sapiens
gcccagaggtctgggccc

SEQ ID NO: 7751268 - DNA, 20 bp, Homo sapiens
gcctcagccaacccatgggg

SEQ ID NO: 7751269 - DNA, 22 bp, Homo sapiens
gcctcagccggcggacgccagg

SEQ ID NO: 7751270 - DNA, 22 bp, Homo sapiens
gcctcagctcccagcccaggct

SEQ ID NO: 7751271 - DNA, 22 bp, Homo sapiens
gcctcagctgttgcaggggccc

SEQ ID NO: 7751272 - DNA, 22 bp, Homo sapiens
gccctgagcctatgagcctctc

SEQ ID NO: 7751273 - DNA, 22 bp, Homo sapiens
gcccagggcttcaaagagagaa

SEQ ID NO: 7751274 - DNA, 22 bp, Homo sapiens
gcccagggctgcaagtggacgc

SEQ ID NO: 7751275 - DNA, 22 bp, Homo sapiens
gcccagggcgatggtcggggcc

SEQ ID NO: 7751276 - DNA, 22 bp, Homo sapiens
gcctggggcatgcagctgatac

SEQ ID NO: 7751277 - DNA, 22 bp, Homo sapiens
gccttcagagtaccatgtcctc

SEQ ID NO: 7751278 - DNA, 22 bp, Homo sapiens
gccttagcctgcacttcctgtt

SEQ ID NO: 7751279 - DNA, 22 bp, Homo sapiens
gccttcaggtgctgccaggcta

SEQ ID NO: 7751280 - DNA, 22 bp, Homo sapiens
gcctcagggataggatgagcat

SEQ ID NO: 7751281 - DNA, 22 bp, Homo sapiens
gcctcaggcctatagctgctgt

SEQ ID NO: 7751282 - DNA, 22 bp, Homo sapiens
gcggcggagacagcaggaagcc

SEQ ID NO: 7751283 - DNA, 22 bp, Homo sapiens
gccttgccaaggggcagcagag

SEQ ID NO: 7751284 - DNA, 22 bp, Homo sapiens
gctatctaccacatcagccagg

SEQ ID NO: 7751285 - DNA, 22 bp, Homo sapiens
gctatctctttagtactagatt

SEQ ID NO: 7751286 - DNA, 22 bp, Homo sapiens
gctataggaagaaatttgtttt

SEQ ID NO: 7751287 - DNA, 22 bp, Homo sapiens
gctatagggtacatttgtgttt

SEQ ID NO: 7751288 - DNA, 23 bp, Homo sapiens
gctataggtagaaggaatctttt

SEQ ID NO: 7751289 - DNA, 22 bp, Homo sapiens
gctgaaggtatgagttttatct

SEQ ID NO: 7751290 - DNA, 22 bp, Homo sapiens
gctgaagttgcctattttaata

SEQ ID NO: 7751291 - DNA, 21 bp, Homo sapiens
gctgcaaattctaacaattat

SEQ ID NO: 7751292 - DNA, 22 bp, Homo sapiens
gctgatgtcccactgacagcca

SEQ ID NO: 7751293 - DNA, 22 bp, Homo sapiens
gctgatctcccttttctcacag

SEQ ID NO: 7751294 - DNA, 22 bp, Homo sapiens
gctgcagggggtgggcgtctcc

SEQ ID NO: 7751295 - DNA, 22 bp, Homo sapiens
gctgcaggttgggcaacagagt

SEQ ID NO: 7751296 - DNA, 22 bp, Homo sapiens
gctgcaggatgaggctctgctc

SEQ ID NO: 7751297 - DNA, 22 bp, Homo sapiens
gctgcaggtttgtctagtctgg

SEQ ID NO: 7751298 - DNA, 22 bp, Homo sapiens
gctgcaggagctggagctgtgg

SEQ ID NO: 7751299 - DNA, 22 bp, Homo sapiens
gctgcaggagattttgagagtc

SEQ ID NO: 7751300 - DNA, 22 bp, Homo sapiens
gctctcagatgctccagcagcc

SEQ ID NO: 7751301 - DNA, 22 bp, Homo sapiens
gctctcagaagagccaggctac

SEQ ID NO: 7751302 - DNA, 22 bp, Homo sapiens
gctctcagaagtaacttgtcca

SEQ ID NO: 7751303 - DNA, 22 bp, Homo sapiens
gctcagggaactttttgcaggc

SEQ ID NO: 7751304 - DNA, 20 bp, Homo sapiens
gctgggggtgtgctgagtga

SEQ ID NO: 7751305 - DNA, 22 bp, Homo sapiens
gctggggtctgtgaggagggct

SEQ ID NO: 7751306 - DNA, 18 bp, Homo sapiens
gctggggttgagctctcc

SEQ ID NO: 7751307 - DNA, 22 bp, Homo sapiens
gctggggtgtggtggataagct

SEQ ID NO: 7751308 - DNA, 22 bp, Homo sapiens
gctgggtgtcacggggctcgtg

SEQ ID NO: 7751309 - DNA, 22 bp, Homo sapiens
gctgggtggatcggaggctctg

SEQ ID NO: 7751310 - DNA, 22 bp, Homo sapiens
gctgtgagtacaaggccctggg

SEQ ID NO: 7751311 - DNA, 19 bp, Homo sapiens
gctgtgaaagcagccatat

SEQ ID NO: 7751312 - DNA, 22 bp, Homo sapiens
gctgtgaacatgcacatggagt

SEQ ID NO: 7751313 - DNA, 22 bp, Homo sapiens
gctgtgaaaagaaaagccgtca

SEQ ID NO: 7751314 - DNA, 22 bp, Homo sapiens
gctgtgaaacctcagtgatagt

SEQ ID NO: 7751315 - DNA, 22 bp, Homo sapiens
gctgtgaagaggccactgcatg

SEQ ID NO: 7751316 - DNA, 22 bp, Homo sapiens
gctgtgaaagctgccacactgt

SEQ ID NO: 7751317 - DNA, 22 bp, Homo sapiens
gctgtgaagaacctagtgaacc

SEQ ID NO: 7751318 - DNA, 22 bp, Homo sapiens
gctgtgaattattcttaactgg

SEQ ID NO: 7751319 - DNA, 19 bp, Homo sapiens
gctgtgaatatcatgaggg

SEQ ID NO: 7751320 - DNA, 22 bp, Homo sapiens
gctgtgaagctgcctggggctg

SEQ ID NO: 7751321 - DNA, 22 bp, Homo sapiens
gctgtgaatctgaagactaaaa

SEQ ID NO: 7751322 - DNA, 22 bp, Homo sapiens
gcttccaagcggtagatagcat

SEQ ID NO: 7751323 - DNA, 22 bp, Homo sapiens
gcttccagtaagttgctgccat

SEQ ID NO: 7751324 - DNA, 22 bp, Homo sapiens
gctgggacaacaggtgagcacc

SEQ ID NO: 7751325 - DNA, 22 bp, Homo sapiens
gctgggaagtggcagagctgga

SEQ ID NO: 7751326 - DNA, 22 bp, Homo sapiens
gctgggaaccatgggaaggcag

SEQ ID NO: 7751327 - DNA, 22 bp, Homo sapiens
gctgggagacagacttggaacc

SEQ ID NO: 7751328 - DNA, 22 bp, Homo sapiens
gctggctgcacaggggctcact

SEQ ID NO: 7751329 - DNA, 22 bp, Homo sapiens
gctggcacaggtggatgctggc

SEQ ID NO: 7751330 - DNA, 22 bp, Homo sapiens
gctggcacacagtacacgcctt

SEQ ID NO: 7751331 - DNA, 22 bp, Homo sapiens
gctggcagactgggggcagaac

SEQ ID NO: 7751332 - DNA, 20 bp, Homo sapiens
ggactacaatttgcagtgtg

SEQ ID NO: 7751333 - DNA, 22 bp, Homo sapiens
ggactcagcagccaggagtggc

SEQ ID NO: 7751334 - DNA, 22 bp, Homo sapiens
ggaccctgtaaagtcgtgtcca

SEQ ID NO: 7751335 - DNA, 20 bp, Homo sapiens
ggaccctgggttcttctgag

SEQ ID NO: 7751336 - DNA, 22 bp, Homo sapiens
ggaccctgggcttgctcctggg

SEQ ID NO: 7751337 - DNA, 22 bp, Homo sapiens
ggaccctgggctctgggcctat

SEQ ID NO: 7751338 - DNA, 22 bp, Homo sapiens
ggaccctggagacccactggga

SEQ ID NO: 7751339 - DNA, 22 bp, Homo sapiens
ggaccctgggcagctggctgct

SEQ ID NO: 7751340 - DNA, 22 bp, Homo sapiens
ggacagacagtgtgagtgaggc

SEQ ID NO: 7751341 - DNA, 22 bp, Homo sapiens
ggacaccccgggtaccaggtct

SEQ ID NO: 7751342 - DNA, 22 bp, Homo sapiens
ggaagccaaggtggcctctatt

SEQ ID NO: 7751343 - DNA, 22 bp, Homo sapiens
ggaacataccgaaaatacttaa

SEQ ID NO: 7751344 - DNA, 20 bp, Homo sapiens
ggaacatgaatgtgagtggc

SEQ ID NO: 7751345 - DNA, 22 bp, Homo sapiens
ggaacatgtagagggcctgtag

SEQ ID NO: 7751346 - DNA, 22 bp, Homo sapiens
ggaacccatgattatggttagg

SEQ ID NO: 7751347 - DNA, 22 bp, Homo sapiens
ggaaccttagtgttcttttacc

SEQ ID NO: 7751348 - DNA, 22 bp, Homo sapiens
ggaaccagtggaatgatatgct

SEQ ID NO: 7751349 - DNA, 22 bp, Homo sapiens
ggaacccagagctcataaaatt

SEQ ID NO: 7751350 - DNA, 22 bp, Homo sapiens
ggaaccaggagttacacgagtt

SEQ ID NO: 7751351 - DNA, 22 bp, Homo sapiens
ggaaccagtaactggtcattgc

SEQ ID NO: 7751352 - DNA, 18 bp, Homo sapiens
ggaaggaagaatgcattt

SEQ ID NO: 7751353 - DNA, 22 bp, Homo sapiens
ggaaagctcagatcttgttgga

SEQ ID NO: 7751354 - DNA, 22 bp, Homo sapiens
ggcctgcctcacagtcagcacc

SEQ ID NO: 7751355 - DNA, 22 bp, Homo sapiens
ggcggtctcagcaccctcttgg

SEQ ID NO: 7751356 - DNA, 21 bp, Homo sapiens
ggcctaggggcagatggtgct

SEQ ID NO: 7751357 - DNA, 22 bp, Homo sapiens
ggcctagggcttggtcatggca

SEQ ID NO: 7751358 - DNA, 22 bp, Homo sapiens
ggccaggagatggacaccacat

SEQ ID NO: 7751359 - DNA, 22 bp, Homo sapiens
ggccaggaacttttgggatggg

SEQ ID NO: 7751360 - DNA, 22 bp, Homo sapiens
ggccaggaagggaagatcagca

SEQ ID NO: 7751361 - DNA, 23 bp, Homo sapiens
ggcatgcaatggacagagctgga

SEQ ID NO: 7751362 - DNA, 22 bp, Homo sapiens
ggcatgagtaacgtgagtgagg

SEQ ID NO: 7751363 - DNA, 22 bp, Homo sapiens
ggcatctccaaaacatgaactc

SEQ ID NO: 7751364 - DNA, 21 bp, Homo sapiens
ggcatgagggcagtgagcaga

SEQ ID NO: 7751365 - DNA, 20 bp, Homo sapiens
ggcatgagatgtgagggagg

SEQ ID NO: 7751366 - DNA, 22 bp, Homo sapiens
ggcatgagaggtcctggggatt

SEQ ID NO: 7751367 - DNA, 18 bp, Homo sapiens
ggcaggagcaagaatagg

SEQ ID NO: 7751368 - DNA, 22 bp, Homo sapiens
ggcaggagctctccagtttgcc

SEQ ID NO: 7751369 - DNA, 17 bp, Homo sapiens
ggcagggtgctgggtat

SEQ ID NO: 7751370 - DNA, 22 bp, Homo sapiens
ggagatgtagtgtcactggact

SEQ ID NO: 7751371 - DNA, 21 bp, Homo sapiens
ggagatgttgtgcaggagggt

SEQ ID NO: 7751372 - DNA, 22 bp, Homo sapiens
ggagcagagctcttcatctgca

SEQ ID NO: 7751373 - DNA, 22 bp, Homo sapiens
ggagcagagctgggcttggctg

SEQ ID NO: 7751374 - DNA, 19 bp, Homo sapiens
ggatgagggtcaggcatag

SEQ ID NO: 7751375 - DNA, 22 bp, Homo sapiens
ggagttggtgagcaccaggctt

SEQ ID NO: 7751376 - DNA, 22 bp, Homo sapiens
ggatgctgtctaagctgaggac

SEQ ID NO: 7751377 - DNA, 22 bp, Homo sapiens
ggatgcatgtgcattttgaaaa

SEQ ID NO: 7751378 - DNA, 22 bp, Homo sapiens
ggatgcttaggttgttttatta

SEQ ID NO: 7751379 - DNA, 22 bp, Homo sapiens
ggatggccgagaagacagcgta

SEQ ID NO: 7751380 - DNA, 20 bp, Homo sapiens
ggatggccggaccagagcct

SEQ ID NO: 7751381 - DNA, 22 bp, Homo sapiens
ggatggctccagaaagcagggt

SEQ ID NO: 7751382 - DNA, 22 bp, Homo sapiens
ggatggccttcttgctcaggaa

SEQ ID NO: 7751383 - DNA, 18 bp, Homo sapiens
ggcactggtgatgcagag

SEQ ID NO: 7751384 - DNA, 21 bp, Homo sapiens
ggcagaagtagcatggacggg

SEQ ID NO: 7751385 - DNA, 22 bp, Homo sapiens
ggcagcagcaaggttggagctg

SEQ ID NO: 7751386 - DNA, 22 bp, Homo sapiens
ggcagaaggcaattagagactg

SEQ ID NO: 7751387 - DNA, 19 bp, Homo sapiens
ggcagaaggtgtaggggga

SEQ ID NO: 7751388 - DNA, 22 bp, Homo sapiens
gggagctggagctggaagactc

SEQ ID NO: 7751389 - DNA, 19 bp, Homo sapiens
gggagctgaggtctttggt

SEQ ID NO: 7751390 - DNA, 22 bp, Homo sapiens
gggagctgaggagccccgtcgg

SEQ ID NO: 7751391 - DNA, 22 bp, Homo sapiens
gggagctgagggacctctgtgg

SEQ ID NO: 7751392 - DNA, 22 bp, Homo sapiens
gggagctgagctggaagagaat

SEQ ID NO: 7751393 - DNA, 22 bp, Homo sapiens
gggagctgagaaacaacattct

SEQ ID NO: 7751394 - DNA, 22 bp, Homo sapiens
gggagctgagctctgagccacg

SEQ ID NO: 7751395 - DNA, 22 bp, Homo sapiens
gggagctgacctgcaggttccc

SEQ ID NO: 7751396 - DNA, 22 bp, Homo sapiens
gggaagtttgtttggactggga

SEQ ID NO: 7751397 - DNA, 22 bp, Homo sapiens
gggaagtttgtgggaggaatat

SEQ ID NO: 7751398 - DNA, 21 bp, Homo sapiens
gggagctgacagcagcacggc

SEQ ID NO: 7751399 - DNA, 22 bp, Homo sapiens
ggctttgacatgctgaattaaa

SEQ ID NO: 7751400 - DNA, 22 bp, Homo sapiens
gggagctggcctactattagat

SEQ ID NO: 7751401 - DNA, 22 bp, Homo sapiens
gggagctggatgattgaggcaa

SEQ ID NO: 7751402 - DNA, 22 bp, Homo sapiens
gggagctggatcgcgcgcccgg

SEQ ID NO: 7751403 - DNA, 22 bp, Homo sapiens
gggagctggagttgtgttgcct

SEQ ID NO: 7751404 - DNA, 22 bp, Homo sapiens
ggctggagacaacgtcctgccc

SEQ ID NO: 7751405 - DNA, 21 bp, Homo sapiens
ggctgggtcatgcagctggcc

SEQ ID NO: 7751406 - DNA, 22 bp, Homo sapiens
ggctgtgacaaggctgcgggaa

SEQ ID NO: 7751407 - DNA, 22 bp, Homo sapiens
ggctgtgagtttgtcctccatg

SEQ ID NO: 7751408 - DNA, 22 bp, Homo sapiens
ggctgtgattggtggatgtgaa

SEQ ID NO: 7751409 - DNA, 22 bp, Homo sapiens
ggctgtgagcaggcagaatgct

SEQ ID NO: 7751410 - DNA, 22 bp, Homo sapiens
ggctgtgacccccacaggggtg

SEQ ID NO: 7751411 - DNA, 21 bp, Homo sapiens
ggctgtgacgctgctccacag

SEQ ID NO: 7751412 - DNA, 22 bp, Homo sapiens
ggctgtgatgcaattaacacgg

SEQ ID NO: 7751413 - DNA, 22 bp, Homo sapiens
ggctgagggtcccagaccctaa

SEQ ID NO: 7751414 - DNA, 22 bp, Homo sapiens
ggctgagggccagggctagtct

SEQ ID NO: 7751415 - DNA, 22 bp, Homo sapiens
ggctgaggggcccagaggaaca

SEQ ID NO: 7751416 - DNA, 18 bp, Homo sapiens
ggctgaggttgactagaa

SEQ ID NO: 7751417 - DNA, 22 bp, Homo sapiens
ggctgagggttaagatcagaca

SEQ ID NO: 7751418 - DNA, 22 bp, Homo sapiens
ggctctggggggaagtctgttg

SEQ ID NO: 7751419 - DNA, 22 bp, Homo sapiens
ggctctggttgaccatgatggc

SEQ ID NO: 7751420 - DNA, 22 bp, Homo sapiens
ggctccagggagtggagagaag

SEQ ID NO: 7751421 - DNA, 22 bp, Homo sapiens
gggggaagaggcatgaagtcct

SEQ ID NO: 7751422 - DNA, 21 bp, Homo sapiens
gggggaagaggagttgctagt

SEQ ID NO: 7751423 - DNA, 22 bp, Homo sapiens
gggggaagaaagaacatggcat

SEQ ID NO: 7751424 - DNA, 22 bp, Homo sapiens
gggggaagactgggctagtgat

SEQ ID NO: 7751425 - DNA, 22 bp, Homo sapiens
ggggcttctttctgccaccgac

SEQ ID NO: 7751426 - DNA, 22 bp, Homo sapiens
gggggagctacaggtcccttgg

SEQ ID NO: 7751427 - DNA, 22 bp, Homo sapiens
gggggagctagtccagctgagg

SEQ ID NO: 7751428 - DNA, 22 bp, Homo sapiens
gggggcgccgccgctcatctca

SEQ ID NO: 7751429 - DNA, 22 bp, Homo sapiens
gggggcgccccatggaggtgag

SEQ ID NO: 7751430 - DNA, 22 bp, Homo sapiens
gggggcgcacagtcaccacaaa

SEQ ID NO: 7751431 - DNA, 22 bp, Homo sapiens
gggctgggatggcttgaagatt

SEQ ID NO: 7751432 - DNA, 22 bp, Homo sapiens
gggctgggaatggctaagtatg

SEQ ID NO: 7751433 - DNA, 22 bp, Homo sapiens
ggggatggattccgggtccctg

SEQ ID NO: 7751434 - DNA, 22 bp, Homo sapiens
ggggatggtagaccggtgacgt

SEQ ID NO: 7751435 - DNA, 22 bp, Homo sapiens
ggggcagaaagcccacagagtg

SEQ ID NO: 7751436 - DNA, 22 bp, Homo sapiens
gggcctgagactgagggtgagg

SEQ ID NO: 7751437 - DNA, 22 bp, Homo sapiens
gggcctgattagcaggctagct

SEQ ID NO: 7751438 - DNA, 22 bp, Homo sapiens
gggcctgcaggttctgagaggc

SEQ ID NO: 7751439 - DNA, 22 bp, Homo sapiens
gggcatgcaggactgtggcaga

SEQ ID NO: 7751440 - DNA, 22 bp, Homo sapiens
gggcatgagagggcagctggca

SEQ ID NO: 7751441 - DNA, 22 bp, Homo sapiens
gggcatgacttttggagtggga

SEQ ID NO: 7751442 - DNA, 22 bp, Homo sapiens
gggcatgagaggcaggcaagtg

SEQ ID NO: 7751443 - DNA, 23 bp, Homo sapiens
gggcatctgctattacagcactg

SEQ ID NO: 7751444 - DNA, 22 bp, Homo sapiens
gggcatcttgtagccttcactt

SEQ ID NO: 7751445 - DNA, 22 bp, Homo sapiens
gggcatctggtggagcctcagg

SEQ ID NO: 7751446 - DNA, 22 bp, Homo sapiens
gggcatcttctgtagccatctc

SEQ ID NO: 7751447 - DNA, 22 bp, Homo sapiens
gggcctgaaaccttcagggctt

SEQ ID NO: 7751448 - DNA, 22 bp, Homo sapiens
gggctccaggagccctaagaga

SEQ ID NO: 7751449 - DNA, 22 bp, Homo sapiens
gggctccagcagaggcagccgg

SEQ ID NO: 7751450 - DNA, 19 bp, Homo sapiens
gggctctcgagcaaccaac

SEQ ID NO: 7751451 - DNA, 22 bp, Homo sapiens
ggtacacattgtgactgtatta

SEQ ID NO: 7751452 - DNA, 19 bp, Homo sapiens
ggtagaagggaagtgtttt

SEQ ID NO: 7751453 - DNA, 22 bp, Homo sapiens
ggtagaaggggaagaggtccat

SEQ ID NO: 7751454 - DNA, 22 bp, Homo sapiens
ggtaaactaaccattttaattt

SEQ ID NO: 7751455 - DNA, 22 bp, Homo sapiens
ggtaacaaacttctgacttaag

SEQ ID NO: 7751456 - DNA, 22 bp, Homo sapiens
ggtaacacatggaacatttaca

SEQ ID NO: 7751457 - DNA, 22 bp, Homo sapiens
ggtaacacaggtgcagttttaa

SEQ ID NO: 7751458 - DNA, 22 bp, Homo sapiens
ggtaacttgagtgtgttgttca

SEQ ID NO: 7751459 - DNA, 22 bp, Homo sapiens
gtgctgggccctgagaccaggg

SEQ ID NO: 7751460 - DNA, 22 bp, Homo sapiens
gtgctgggggtttctgtaggtc

SEQ ID NO: 7751461 - DNA, 22 bp, Homo sapiens
gtgctgggtgctgcagacaggt

SEQ ID NO: 7751462 - DNA, 22 bp, Homo sapiens
gtgcctaggatggaggtgggtt

SEQ ID NO: 7751463 - DNA, 22 bp, Homo sapiens
gtgctgggattacaggtgtgag

SEQ ID NO: 7751464 - DNA, 22 bp, Homo sapiens
gtcttattaaattgaaccctca

SEQ ID NO: 7751465 - DNA, 22 bp, Homo sapiens
gtcttattaggttaaccctgct

SEQ ID NO: 7751466 - DNA, 22 bp, Homo sapiens
gtcttatttaaagagatcatac

SEQ ID NO: 7751467 - DNA, 22 bp, Homo sapiens
gtctcctgccacactcagtccc

SEQ ID NO: 7751468 - DNA, 22 bp, Homo sapiens
gtgatatttttaaagattaagg

SEQ ID NO: 7751469 - DNA, 22 bp, Homo sapiens
gtcttctggaagagagccagct

SEQ ID NO: 7751470 - DNA, 22 bp, Homo sapiens
gtaacacagaaatgaaattcca

SEQ ID NO: 7751471 - DNA, 22 bp, Homo sapiens
gtaacagagaactcaggtgtta

SEQ ID NO: 7751472 - DNA, 22 bp, Homo sapiens
gtaacagagggtttgcagatat

SEQ ID NO: 7751473 - DNA, 22 bp, Homo sapiens
gtaacagaaagtcatgctcatt

SEQ ID NO: 7751474 - DNA, 22 bp, Homo sapiens
gtaataatactagtcagccttg

SEQ ID NO: 7751475 - DNA, 22 bp, Homo sapiens
gtaataagaaacagcaattatt

SEQ ID NO: 7751476 - DNA, 22 bp, Homo sapiens
gtaataatggtccccaaacact

SEQ ID NO: 7751477 - DNA, 22 bp, Homo sapiens
gtaatattcagctattgagttg

SEQ ID NO: 7751478 - DNA, 22 bp, Homo sapiens
gtaataatttgctacctggtgg

SEQ ID NO: 7751479 - DNA, 22 bp, Homo sapiens
gtaacaaacggttccaagatgc

SEQ ID NO: 7751480 - DNA, 16 bp, Homo sapiens
gtagccgtggccgctg

SEQ ID NO: 7751481 - DNA, 22 bp, Homo sapiens
gtagcattctgagttcgcagag

SEQ ID NO: 7751482 - DNA, 23 bp, Homo sapiens
gtaatgatgggaatttacttaga

SEQ ID NO: 7751483 - DNA, 22 bp, Homo sapiens
gtaatgatgtctgagaagtatg

SEQ ID NO: 7751484 - DNA, 22 bp, Homo sapiens
gtagaccatttatctggggagt

SEQ ID NO: 7751485 - DNA, 22 bp, Homo sapiens
gtaggaagctctgaggctagtt

SEQ ID NO: 7751486 - DNA, 22 bp, Homo sapiens
gtcctctgaaagatgaaccatg

SEQ ID NO: 7751487 - DNA, 22 bp, Homo sapiens
gtcctctgagggggctgcacgc

SEQ ID NO: 7751488 - DNA, 22 bp, Homo sapiens
gtccctggatctgggacagctg

SEQ ID NO: 7751489 - DNA, 22 bp, Homo sapiens
gtcattcaactgcacattaggt

SEQ ID NO: 7751490 - DNA, 22 bp, Homo sapiens
gtcaggggccatgggccaagga

SEQ ID NO: 7751491 - DNA, 22 bp, Homo sapiens
gtcaggggatgtgctggtggcc

SEQ ID NO: 7751492 - DNA, 22 bp, Homo sapiens
gtcacatgccagtgcacacagg

SEQ ID NO: 7751493 - DNA, 22 bp, Homo sapiens
gtcacaaatcccctcagcaact

SEQ ID NO: 7751494 - DNA, 22 bp, Homo sapiens
gtcacaggtgtggaggtgctgg

SEQ ID NO: 7751495 - DNA, 22 bp, Homo sapiens
taggctgggagcctgaggctag

SEQ ID NO: 7751496 - DNA, 22 bp, Homo sapiens
taggttccatttaaacaaagaa

SEQ ID NO: 7751497 - DNA, 22 bp, Homo sapiens
taggctggaacttaggcagagg

SEQ ID NO: 7751498 - DNA, 22 bp, Homo sapiens
taggctggaggaagcagtgcct

SEQ ID NO: 7751499 - DNA, 22 bp, Homo sapiens
tagtcacaaccttcaagttgtc

SEQ ID NO: 7751500 - DNA, 22 bp, Homo sapiens
tagtcacacaattgtgtacatt

SEQ ID NO: 7751501 - DNA, 22 bp, Homo sapiens
tagtcacaggaagtttcaatgt

SEQ ID NO: 7751502 - DNA, 22 bp, Homo sapiens
tagtcacagtacaggataaaga

SEQ ID NO: 7751503 - DNA, 22 bp, Homo sapiens
tagtcacatgatcacaggatcg

SEQ ID NO: 7751504 - DNA, 22 bp, Homo sapiens
tagtattttagaaaaccatgaa

SEQ ID NO: 7751505 - DNA, 22 bp, Homo sapiens
tagtcccattttgaggtatttg

SEQ ID NO: 7751506 - DNA, 20 bp, Homo sapiens
tagtccagtaggggggcttt

SEQ ID NO: 7751507 - DNA, 19 bp, Homo sapiens
tagtggagtgacaagttct

SEQ ID NO: 7751508 - DNA, 22 bp, Homo sapiens
taggcgaaggtctgggtgggca

SEQ ID NO: 7751509 - DNA, 22 bp, Homo sapiens
taggaaggcctgtcactacttg

SEQ ID NO: 7751510 - DNA, 22 bp, Homo sapiens
taggaatgcagtgagacacaga

SEQ ID NO: 7751511 - DNA, 22 bp, Homo sapiens
taggaagctatgggagatgtga

SEQ ID NO: 7751512 - DNA, 22 bp, Homo sapiens
taggaagcatttaaagagatgg

SEQ ID NO: 7751513 - DNA, 22 bp, Homo sapiens
tagccatttttattaatgctgg

SEQ ID NO: 7751514 - DNA, 22 bp, Homo sapiens
tagccattgacttaaagcttat

SEQ ID NO: 7751515 - DNA, 22 bp, Homo sapiens
tagccacatgcagactttcatg

SEQ ID NO: 7751516 - DNA, 22 bp, Homo sapiens
tagcatttcactgatcttcact

SEQ ID NO: 7751517 - DNA, 22 bp, Homo sapiens
tagcactatatgttagctatta

SEQ ID NO: 7751518 - DNA, 22 bp, Homo sapiens
tagcactatttttcactatcct

SEQ ID NO: 7751519 - DNA, 22 bp, Homo sapiens
tagcactacttaggtacagcca

SEQ ID NO: 7751520 - DNA, 22 bp, Homo sapiens
tagcagaaactgttacagaagg

SEQ ID NO: 7751521 - DNA, 22 bp, Homo sapiens
tagcagaaccagcagtcaattt

SEQ ID NO: 7751522 - DNA, 22 bp, Homo sapiens
tagcacccacctcgtggggttt

SEQ ID NO: 7751523 - DNA, 22 bp, Homo sapiens
tagcacccatggaatctgctgg

SEQ ID NO: 7751524 - DNA, 22 bp, Homo sapiens
tagcaagaccaatatgtagata

SEQ ID NO: 7751525 - DNA, 22 bp, Homo sapiens
tagcaagaagtagctctggatt

SEQ ID NO: 7751526 - DNA, 22 bp, Homo sapiens
tagaggcagaagaaattgacaa

SEQ ID NO: 7751527 - DNA, 22 bp, Homo sapiens
tagaggcaaccagtgttgagaa

SEQ ID NO: 7751528 - DNA, 22 bp, Homo sapiens
tagaggcacagtctatgtagag

SEQ ID NO: 7751529 - DNA, 23 bp, Homo sapiens
tagagcagccccgaggtgctgtc

SEQ ID NO: 7751530 - DNA, 21 bp, Homo sapiens
tagagccagtggtgttctgac

SEQ ID NO: 7751531 - DNA, 22 bp, Homo sapiens
tatattttagacaccctcacgc

SEQ ID NO: 7751532 - DNA, 20 bp, Homo sapiens
tatattttctctttggcctt

SEQ ID NO: 7751533 - DNA, 22 bp, Homo sapiens
tatctagcaagtaacatgctga

SEQ ID NO: 7751534 - DNA, 22 bp, Homo sapiens
tatctttaacttgcagtattta

SEQ ID NO: 7751535 - DNA, 22 bp, Homo sapiens
tagttaattctttaagaacaag

SEQ ID NO: 7751536 - DNA, 22 bp, Homo sapiens
tagtgttttctagaatggtttt

SEQ ID NO: 7751537 - DNA, 20 bp, Homo sapiens
tatactaacatatatctgtt

SEQ ID NO: 7751538 - DNA, 22 bp, Homo sapiens
tatttgtagcttcccaaagctt

SEQ ID NO: 7751539 - DNA, 22 bp, Homo sapiens
tatttggatagacagggagatg

SEQ ID NO: 7751540 - DNA, 22 bp, Homo sapiens
tatttggatacaatcatttgct

SEQ ID NO: 7751541 - DNA, 22 bp, Homo sapiens
tatttggagctgtgtgagctca

SEQ ID NO: 7751542 - DNA, 22 bp, Homo sapiens
tatttggaggccactgttgagt

SEQ ID NO: 7751543 - DNA, 22 bp, Homo sapiens
tatttggagtgatggaaatgtt

SEQ ID NO: 7751544 - DNA, 22 bp, Homo sapiens
tatttcacatgtgggaaacata

SEQ ID NO: 7751545 - DNA, 22 bp, Homo sapiens
tattgtatcttaccacatgtat

SEQ ID NO: 7751546 - DNA, 22 bp, Homo sapiens
tatgttattttcatacaacaga

SEQ ID NO: 7751547 - DNA, 22 bp, Homo sapiens
tacatacagccaagtatgaagt

SEQ ID NO: 7751548 - DNA, 22 bp, Homo sapiens
tacatacaagcattcaatttta

SEQ ID NO: 7751549 - DNA, 22 bp, Homo sapiens
tacattcacagttgttcatctc

SEQ ID NO: 7751550 - DNA, 22 bp, Homo sapiens
tacattcagagaaagtttccat

SEQ ID NO: 7751551 - DNA, 22 bp, Homo sapiens
tacatacaagatgtgtttaaaa

SEQ ID NO: 7751552 - DNA, 22 bp, Homo sapiens
tacagcagagtgggatgcatct

SEQ ID NO: 7751553 - DNA, 22 bp, Homo sapiens
tacctggcaagggtcccaggat

SEQ ID NO: 7751554 - DNA, 22 bp, Homo sapiens
tacccacagcctctcttcaaaa

SEQ ID NO: 7751555 - DNA, 22 bp, Homo sapiens
tacttgaattggtttctgcaga

SEQ ID NO: 7751556 - DNA, 20 bp, Homo sapiens
tacttgaatgttgcagcagt

SEQ ID NO: 7751557 - DNA, 22 bp, Homo sapiens
tacttctggatattcagaactt

SEQ ID NO: 7751558 - DNA, 21 bp, Homo sapiens
tactgagacctcacagtgtgc

SEQ ID NO: 7751559 - DNA, 22 bp, Homo sapiens
taagcaccactccaaaattgtt

SEQ ID NO: 7751560 - DNA, 22 bp, Homo sapiens
taagtttctccaaagcacagaa

SEQ ID NO: 7751561 - DNA, 18 bp, Homo sapiens
taatgataagccttgaag

SEQ ID NO: 7751562 - DNA, 22 bp, Homo sapiens
taatggattaacgtccctgtcg

SEQ ID NO: 7751563 - DNA, 22 bp, Homo sapiens
taatgcttaattttcacaagcc

SEQ ID NO: 7751564 - DNA, 22 bp, Homo sapiens
tacaccagcttgcctgggctct

SEQ ID NO: 7751565 - DNA, 22 bp, Homo sapiens
tacacaaaggcactctgttgtt

SEQ ID NO: 7751566 - DNA, 21 bp, Homo sapiens
tacacaaagcgtggtccagag

SEQ ID NO: 7751567 - DNA, 22 bp, Homo sapiens
gttcctgggcctgcattcacca

SEQ ID NO: 7751568 - DNA, 22 bp, Homo sapiens
gttcctggtggtcatggcagct

SEQ ID NO: 7751569 - DNA, 22 bp, Homo sapiens
gttcctgttgatttcccaggag

SEQ ID NO: 7751570 - DNA, 22 bp, Homo sapiens
gtttctgagcacttttattgca

SEQ ID NO: 7751571 - DNA, 22 bp, Homo sapiens
gttccaaagttagagtgtattg

SEQ ID NO: 7751572 - DNA, 22 bp, Homo sapiens
gttccaaacaagtcataaagta

SEQ ID NO: 7751573 - DNA, 22 bp, Homo sapiens
gttacaaatgccaaagctgaga

SEQ ID NO: 7751574 - DNA, 20 bp, Homo sapiens
gttaggaggttggacatgga

SEQ ID NO: 7751575 - DNA, 22 bp, Homo sapiens
gttagcatgacttagaatcagg

SEQ ID NO: 7751576 - DNA, 22 bp, Homo sapiens
gttagcatttgtttaatatcag

SEQ ID NO: 7751577 - DNA, 22 bp, Homo sapiens
gttagcatgattcctgctcatt

SEQ ID NO: 7751578 - DNA, 22 bp, Homo sapiens
taacaaaggttgccaaactaag

SEQ ID NO: 7751579 - DNA, 21 bp, Homo sapiens
taacaaagacttctggtcagg

SEQ ID NO: 7751580 - DNA, 22 bp, Homo sapiens
taacacagagtaagtggtcaat

SEQ ID NO: 7751581 - DNA, 20 bp, Homo sapiens
taacacagaaagcttccttc

SEQ ID NO: 7751582 - DNA, 22 bp, Homo sapiens
taacacactgaaggtgagatgg

SEQ ID NO: 7751583 - DNA, 17 bp, Homo sapiens
taacacaggctcagaga

SEQ ID NO: 7751584 - DNA, 22 bp, Homo sapiens
taacacataagctgagaccatg

SEQ ID NO: 7751585 - DNA, 22 bp, Homo sapiens
gttttcagccaggagcacattt

SEQ ID NO: 7751586 - DNA, 22 bp, Homo sapiens
taaacatcagtacaaagactaa

SEQ ID NO: 7751587 - DNA, 23 bp, Homo sapiens
gttttcaacacaataaatgtaac

SEQ ID NO: 7751588 - DNA, 22 bp, Homo sapiens
gttttatttccatgagagaccg

SEQ ID NO: 7751589 - DNA, 22 bp, Homo sapiens
gttttattggaacacagccatg

SEQ ID NO: 7751590 - DNA, 22 bp, Homo sapiens
tccgggcaactgaagggaggtt

SEQ ID NO: 7751591 - DNA, 22 bp, Homo sapiens
tcctcattcttggtgcatcaaa

SEQ ID NO: 7751592 - DNA, 22 bp, Homo sapiens
tcctcattgtcactggcccgca

SEQ ID NO: 7751593 - DNA, 22 bp, Homo sapiens
tcctcctctatcagacagtgcc

SEQ ID NO: 7751594 - DNA, 22 bp, Homo sapiens
tccctggggcagtggctcggag

SEQ ID NO: 7751595 - DNA, 22 bp, Homo sapiens
tccctggggatgttggcctgcc

SEQ ID NO: 7751596 - DNA, 22 bp, Homo sapiens
tccctggggaagggcaagcaag

SEQ ID NO: 7751597 - DNA, 22 bp, Homo sapiens
tccctgggcctcctgctatgca

SEQ ID NO: 7751598 - DNA, 21 bp, Homo sapiens
tccctgtgagcagctcttcct

SEQ ID NO: 7751599 - DNA, 22 bp, Homo sapiens
tccctgttttatatcctaacaa

SEQ ID NO: 7751600 - DNA, 22 bp, Homo sapiens
tccctgttcaaagtcacatagc

SEQ ID NO: 7751601 - DNA, 19 bp, Homo sapiens
tcccttctatagtaataaa

SEQ ID NO: 7751602 - DNA, 22 bp, Homo sapiens
tccctgagcttctctgaaatgg

SEQ ID NO: 7751603 - DNA, 23 bp, Homo sapiens
tccctgggcccgtgccagcggtg

SEQ ID NO: 7751604 - DNA, 22 bp, Homo sapiens
tccctgggccacagctgtgagc

SEQ ID NO: 7751605 - DNA, 22 bp, Homo sapiens
tccctgggcatcacgttgcttc

SEQ ID NO: 7751606 - DNA, 22 bp, Homo sapiens
tccctgggcacaatctgctggc

SEQ ID NO: 7751607 - DNA, 22 bp, Homo sapiens
tccacagcacaaagccagtgtg

SEQ ID NO: 7751608 - DNA, 22 bp, Homo sapiens
tcattaatcccggggtccaggg

SEQ ID NO: 7751609 - DNA, 22 bp, Homo sapiens
tcattaatttgcttagacttat

SEQ ID NO: 7751610 - DNA, 22 bp, Homo sapiens
tccacaatggcagagaaatgtc

SEQ ID NO: 7751611 - DNA, 18 bp, Homo sapiens
tcatggctttagtccctc

SEQ ID NO: 7751612 - DNA, 22 bp, Homo sapiens
tccacttgccctcttctgtgct

SEQ ID NO: 7751613 - DNA, 22 bp, Homo sapiens
tccacttccacgtgtgcagaat

SEQ ID NO: 7751614 - DNA, 22 bp, Homo sapiens
tccagaaactgctgagataaga

SEQ ID NO: 7751615 - DNA, 22 bp, Homo sapiens
tccagccttccttttcactctc

SEQ ID NO: 7751616 - DNA, 22 bp, Homo sapiens
tccaggaaggactaatggtttg

SEQ ID NO: 7751617 - DNA, 22 bp, Homo sapiens
tccaggaagccacactgggcct

SEQ ID NO: 7751618 - DNA, 22 bp, Homo sapiens
tccaggaatagatcagagattt

SEQ ID NO: 7751619 - DNA, 22 bp, Homo sapiens
tccaggaatagtcatgttttag

SEQ ID NO: 7751620 - DNA, 22 bp, Homo sapiens
tccaggaagcagtgtttggagc

SEQ ID NO: 7751621 - DNA, 22 bp, Homo sapiens
tccaggaagcagctacagatcc

SEQ ID NO: 7751622 - DNA, 22 bp, Homo sapiens
tccaggaactgaagccaggtgt

SEQ ID NO: 7751623 - DNA, 22 bp, Homo sapiens
tccaggaagaggtgtgttggga

SEQ ID NO: 7751624 - DNA, 22 bp, Homo sapiens
tccaggaactcttgatggtgat

SEQ ID NO: 7751625 - DNA, 22 bp, Homo sapiens
tccaggaacagaatgttagtgc

SEQ ID NO: 7751626 - DNA, 22 bp, Homo sapiens
tccaggaacgagaggctgggca

SEQ ID NO: 7751627 - DNA, 22 bp, Homo sapiens
tccaggaaatcataaattgctt

SEQ ID NO: 7751628 - DNA, 22 bp, Homo sapiens
tccaggaaatcagaagtggtaa

SEQ ID NO: 7751629 - DNA, 22 bp, Homo sapiens
tccaggaatctgtgcctagccc

SEQ ID NO: 7751630 - DNA, 20 bp, Homo sapiens
tccaggaatggtagaggact

SEQ ID NO: 7751631 - DNA, 21 bp, Homo sapiens
tccaggaatgtctgttcatct

SEQ ID NO: 7751632 - DNA, 22 bp, Homo sapiens
tccaggaatgtgtgtgggctag

SEQ ID NO: 7751633 - DNA, 22 bp, Homo sapiens
tccaggaatttcccctttcctg

SEQ ID NO: 7751634 - DNA, 22 bp, Homo sapiens
tcaggggaaatctctcagcgaa

SEQ ID NO: 7751635 - DNA, 22 bp, Homo sapiens
tcaggggacttaggagagaagt

SEQ ID NO: 7751636 - DNA, 22 bp, Homo sapiens
tcaggggacagccagctggagg

SEQ ID NO: 7751637 - DNA, 22 bp, Homo sapiens
tcaggggcagccggggaagcca

SEQ ID NO: 7751638 - DNA, 22 bp, Homo sapiens
tcaggggaggttgaatcgtctc

SEQ ID NO: 7751639 - DNA, 22 bp, Homo sapiens
tcagggcagcctaaggcacctc

SEQ ID NO: 7751640 - DNA, 22 bp, Homo sapiens
tcaggctcaggttaggggccaa

SEQ ID NO: 7751641 - DNA, 22 bp, Homo sapiens
tcaggctgaaggaggcctatct

SEQ ID NO: 7751642 - DNA, 22 bp, Homo sapiens
tcagggcacattctgcagtggc

SEQ ID NO: 7751643 - DNA, 22 bp, Homo sapiens
tcagggcaagtctcagaaggtt

SEQ ID NO: 7751644 - DNA, 22 bp, Homo sapiens
tcagttttcaatttcatcagag

SEQ ID NO: 7751645 - DNA, 19 bp, Homo sapiens
tcagttttagtcatcagtt

SEQ ID NO: 7751646 - DNA, 22 bp, Homo sapiens
tcagttttaaggtttgagaatt

SEQ ID NO: 7751647 - DNA, 21 bp, Homo sapiens
tcagttcctaagggaggccgc

SEQ ID NO: 7751648 - DNA, 22 bp, Homo sapiens
tcagttcctctgcccaaggcag

SEQ ID NO: 7751649 - DNA, 22 bp, Homo sapiens
tcagtttttctatactttgtag

SEQ ID NO: 7751650 - DNA, 22 bp, Homo sapiens
tcagtttttgtttgccagatag

SEQ ID NO: 7751651 - DNA, 22 bp, Homo sapiens
tcagttttcatttcatgagcag

SEQ ID NO: 7751652 - DNA, 22 bp, Homo sapiens
tcagttttctcatctgtaattt

SEQ ID NO: 7751653 - DNA, 22 bp, Homo sapiens
tcagttttctcatctgtgaaat

SEQ ID NO: 7751654 - DNA, 22 bp, Homo sapiens
tcagttttctcatttatgagat

SEQ ID NO: 7751655 - DNA, 22 bp, Homo sapiens
tcagttttgattcctggttctc

SEQ ID NO: 7751656 - DNA, 22 bp, Homo sapiens
tcagttttgaaaacattgaatg

SEQ ID NO: 7751657 - DNA, 22 bp, Homo sapiens
tcagtttttacggtcacaggga

SEQ ID NO: 7751658 - DNA, 22 bp, Homo sapiens
tcagtttttaagagttatgcga

SEQ ID NO: 7751659 - DNA, 22 bp, Homo sapiens
tcagtttttaaatgatataatt

SEQ ID NO: 7751660 - DNA, 23 bp, Homo sapiens
tcagttttggctgttcagtgttg

SEQ ID NO: 7751661 - DNA, 22 bp, Homo sapiens
tcagttttgtatgttgtaagtc

SEQ ID NO: 7751662 - DNA, 22 bp, Homo sapiens
tcatctatttatgtagaacaag

SEQ ID NO: 7751663 - DNA, 22 bp, Homo sapiens
tcaggcaggatcccagggaagg

SEQ ID NO: 7751664 - DNA, 22 bp, Homo sapiens
tcaggcaggaagggaggacttg

SEQ ID NO: 7751665 - DNA, 21 bp, Homo sapiens
tcaggcaggcgcagagggaag

SEQ ID NO: 7751666 - DNA, 22 bp, Homo sapiens
tcaggaggacagataaggatag

SEQ ID NO: 7751667 - DNA, 22 bp, Homo sapiens
tcagcccttcctggagctttta

SEQ ID NO: 7751668 - DNA, 22 bp, Homo sapiens
tcagccagttaagtcaagaaat

SEQ ID NO: 7751669 - DNA, 22 bp, Homo sapiens
tcagccagggggagagaatgga

SEQ ID NO: 7751670 - DNA, 22 bp, Homo sapiens
tcagccagggcagagcaggtga

SEQ ID NO: 7751671 - DNA, 23 bp, Homo sapiens
tcacacagctggtcaggtacaga

SEQ ID NO: 7751672 - DNA, 22 bp, Homo sapiens
tcacacagcttggagttatggt

SEQ ID NO: 7751673 - DNA, 22 bp, Homo sapiens
tcacacagggtcggaaagagtg

SEQ ID NO: 7751674 - DNA, 22 bp, Homo sapiens
tcacacagctgacagagccttt

SEQ ID NO: 7751675 - DNA, 22 bp, Homo sapiens
tcacacagctgctctgttttat

SEQ ID NO: 7751676 - DNA, 22 bp, Homo sapiens
tcacacagcagccccgggtgtt

SEQ ID NO: 7751677 - DNA, 22 bp, Homo sapiens
tcacacagctcctttccttagt

SEQ ID NO: 7751678 - DNA, 22 bp, Homo sapiens
tcacacagctagtaagggccga

SEQ ID NO: 7751679 - DNA, 22 bp, Homo sapiens
tcacacagattggtagagctga

SEQ ID NO: 7751680 - DNA, 22 bp, Homo sapiens
tcacagagagtgacttgttgct

SEQ ID NO: 7751681 - DNA, 22 bp, Homo sapiens
tcacagcaaaagtgtgcagagc

SEQ ID NO: 7751682 - DNA, 22 bp, Homo sapiens
tcacagaatgtcagagttgggg

SEQ ID NO: 7751683 - DNA, 22 bp, Homo sapiens
tcacagaatgtctagcataatt

SEQ ID NO: 7751684 - DNA, 22 bp, Homo sapiens
tcacagaattgacatgggaatc

SEQ ID NO: 7751685 - DNA, 22 bp, Homo sapiens
tcacagaatttttgcttccagt

SEQ ID NO: 7751686 - DNA, 20 bp, Homo sapiens
tcacagaatgcctgaagaag

SEQ ID NO: 7751687 - DNA, 22 bp, Homo sapiens
tcacagaatctctgataagtct

SEQ ID NO: 7751688 - DNA, 22 bp, Homo sapiens
tcacagaatagcactgtaagcg

SEQ ID NO: 7751689 - DNA, 18 bp, Homo sapiens
tcacagaatattgagtgg

SEQ ID NO: 7751690 - DNA, 22 bp, Homo sapiens
tcacacagtggtaaaaccctga

SEQ ID NO: 7751691 - DNA, 22 bp, Homo sapiens
tcacacagtgagaaagtgcgga

SEQ ID NO: 7751692 - DNA, 22 bp, Homo sapiens
tcacacaggtttgcaatgattt

SEQ ID NO: 7751693 - DNA, 22 bp, Homo sapiens
tcacacagtgagcggggctcag

SEQ ID NO: 7751694 - DNA, 22 bp, Homo sapiens
tcacacagggttctggtctcat

SEQ ID NO: 7751695 - DNA, 22 bp, Homo sapiens
tcacatcacatgacagtaggcc

SEQ ID NO: 7751696 - DNA, 22 bp, Homo sapiens
tcacatcaggtgtctccccaag

SEQ ID NO: 7751697 - DNA, 22 bp, Homo sapiens
tcacatcactagctggtaatga

SEQ ID NO: 7751698 - DNA, 22 bp, Homo sapiens
tcacatcaccctgctcttaatt

SEQ ID NO: 7751699 - DNA, 22 bp, Homo sapiens
tcacatcaacattatagcatga

SEQ ID NO: 7751700 - DNA, 17 bp, Homo sapiens
tcacatcacacaagcaa

SEQ ID NO: 7751701 - DNA, 22 bp, Homo sapiens
tcacatcaaggactgtctggct

SEQ ID NO: 7751702 - DNA, 22 bp, Homo sapiens
tcacatcattaagacttctcct

SEQ ID NO: 7751703 - DNA, 18 bp, Homo sapiens
tcacatcatcccatgctt

SEQ ID NO: 7751704 - DNA, 22 bp, Homo sapiens
tcacatcatggagaattatggg

SEQ ID NO: 7751705 - DNA, 22 bp, Homo sapiens
tcacatcacatgagtgcaagga

SEQ ID NO: 7751706 - DNA, 22 bp, Homo sapiens
tcacagcagggtaacaggaaga

SEQ ID NO: 7751707 - DNA, 22 bp, Homo sapiens
tcacagcattgtcacaaggctg

SEQ ID NO: 7751708 - DNA, 22 bp, Homo sapiens
tcacagcattgtcacaaggctg

SEQ ID NO: 7751709 - DNA, 22 bp, Homo sapiens
tcacagcattcgcaatggacag

SEQ ID NO: 7751710 - DNA, 22 bp, Homo sapiens
tcacagcacatggaccgagtcc

SEQ ID NO: 7751711 - DNA, 22 bp, Homo sapiens
tcacagcaccaggatctctcca

SEQ ID NO: 7751712 - DNA, 22 bp, Homo sapiens
tcacagcaaccctgaggcgagt

SEQ ID NO: 7751713 - DNA, 22 bp, Homo sapiens
tcacagcaacactggggcagac

SEQ ID NO: 7751714 - DNA, 22 bp, Homo sapiens
tcagagagctggtgggcagagg

SEQ ID NO: 7751715 - DNA, 18 bp, Homo sapiens
tcagagagcagctttatt

SEQ ID NO: 7751716 - DNA, 22 bp, Homo sapiens
tcagaggccaaactgagcaggg

SEQ ID NO: 7751717 - DNA, 21 bp, Homo sapiens
tcagaggcactgagagcaatg

SEQ ID NO: 7751718 - DNA, 21 bp, Homo sapiens
tcacctggcttctgacctggc

SEQ ID NO: 7751719 - DNA, 22 bp, Homo sapiens
tcaccttgtgatctccctgcct

SEQ ID NO: 7751720 - DNA, 22 bp, Homo sapiens
tcacccctacatttcccttgct

SEQ ID NO: 7751721 - DNA, 22 bp, Homo sapiens
tcacccctaccaaggagcactg

SEQ ID NO: 7751722 - DNA, 22 bp, Homo sapiens
tcacccctccattctctcatgt

SEQ ID NO: 7751723 - DNA, 22 bp, Homo sapiens
tcacccctggcccagtcttgga

SEQ ID NO: 7751724 - DNA, 22 bp, Homo sapiens
tcaccccttgtgaatgctgctc

SEQ ID NO: 7751725 - DNA, 22 bp, Homo sapiens
tcacccatcctggatgagattc

SEQ ID NO: 7751726 - DNA, 22 bp, Homo sapiens
tcaccgaggctggagtgcagtg

SEQ ID NO: 7751727 - DNA, 22 bp, Homo sapiens
ttctgatgaggaggtctctaag

SEQ ID NO: 7751728 - DNA, 22 bp, Homo sapiens
ttctgatgcatgggtctctgtt

SEQ ID NO: 7751729 - DNA, 19 bp, Homo sapiens
ttctctgtgctagactctg

SEQ ID NO: 7751730 - DNA, 22 bp, Homo sapiens
ttcgctcacctgtccccggctg

SEQ ID NO: 7751731 - DNA, 22 bp, Homo sapiens
ttccctctcacttaaagcttgg

SEQ ID NO: 7751732 - DNA, 22 bp, Homo sapiens
ttccctcccccagcctggcagg

SEQ ID NO: 7751733 - DNA, 22 bp, Homo sapiens
ttctttcttctcaggctgggta

SEQ ID NO: 7751734 - DNA, 22 bp, Homo sapiens
ttctttctcactctttaggaag

SEQ ID NO: 7751735 - DNA, 22 bp, Homo sapiens
ttctggctttgaccaagttcaa

SEQ ID NO: 7751736 - DNA, 19 bp, Homo sapiens
ttgagggcattctggtgtt

SEQ ID NO: 7751737 - DNA, 22 bp, Homo sapiens
ttgagggtctggatctgctgct

SEQ ID NO: 7751738 - DNA, 19 bp, Homo sapiens
ttgagaaatgggaaaagca

SEQ ID NO: 7751739 - DNA, 22 bp, Homo sapiens
ttgaccactgaatggttctgaa

SEQ ID NO: 7751740 - DNA, 23 bp, Homo sapiens
ttgaaagattgctaagtaaaaat

SEQ ID NO: 7751741 - DNA, 22 bp, Homo sapiens
ttagtgtctttcaaaaggttta

SEQ ID NO: 7751742 - DNA, 22 bp, Homo sapiens
ttagtggaataaacggtcatgt

SEQ ID NO: 7751743 - DNA, 22 bp, Homo sapiens
tcctccttgttttgtctctgct

SEQ ID NO: 7751744 - DNA, 23 bp, Homo sapiens
tcctccttttgcttgtgcttccc

SEQ ID NO: 7751745 - DNA, 22 bp, Homo sapiens
tcctccttcgggactgcttgac

SEQ ID NO: 7751746 - DNA, 19 bp, Homo sapiens
tcctccttacttcctcttg

SEQ ID NO: 7751747 - DNA, 22 bp, Homo sapiens
ttagttagaataatacaagtaa

SEQ ID NO: 7751748 - DNA, 22 bp, Homo sapiens
ttagttaggaaacaaagttgtt

SEQ ID NO: 7751749 - DNA, 22 bp, Homo sapiens
ttatgtgcagaacctgggcttc

SEQ ID NO: 7751750 - DNA, 22 bp, Homo sapiens
ttatttaggaggaaactgaggt

SEQ ID NO: 7751751 - DNA, 22 bp, Homo sapiens
ttatttgttttctgagaagtat

SEQ ID NO: 7751752 - DNA, 22 bp, Homo sapiens
ttatttacaactcttctcttcc

SEQ ID NO: 7751753 - DNA, 22 bp, Homo sapiens
ttcaagaggcttaattctggat

SEQ ID NO: 7751754 - DNA, 22 bp, Homo sapiens
ttattttctcctcagaaagtgg

SEQ ID NO: 7751755 - DNA, 22 bp, Homo sapiens
ttattttaccttcctctgagct

SEQ ID NO: 7751756 - DNA, 22 bp, Homo sapiens
ttccaagacacctttagtcact

SEQ ID NO: 7751757 - DNA, 19 bp, Homo sapiens
ttccaaaatcaggatttga

SEQ ID NO: 7751758 - DNA, 22 bp, Homo sapiens
ttcaatatctctaagaatgagg

SEQ ID NO: 7751759 - DNA, 22 bp, Homo sapiens
ttcagaccacaggggtactatt

SEQ ID NO: 7751760 - DNA, 22 bp, Homo sapiens
ttcagaccaagctggtggcatg

SEQ ID NO: 7751761 - DNA, 22 bp, Homo sapiens
ttcagacagtaagaaagaggtt

SEQ ID NO: 7751762 - DNA, 22 bp, Homo sapiens
ttcagacaataagagtcatctc

SEQ ID NO: 7751763 - DNA, 22 bp, Homo sapiens
ttcatatttgaaacagaagtta

SEQ ID NO: 7751764 - DNA, 22 bp, Homo sapiens
ttgtgcctggggtctgacagcc

SEQ ID NO: 7751765 - DNA, 22 bp, Homo sapiens
ttgtgcagagttgcctttattt

SEQ ID NO: 7751766 - DNA, 22 bp, Homo sapiens
ttgtgcagagaaatctttcttg

SEQ ID NO: 7751767 - DNA, 23 bp, Homo sapiens
ttgtatctctggaaattcttcaa

SEQ ID NO: 7751768 - DNA, 22 bp, Homo sapiens
ttgtattaattgaaatgaatgc

SEQ ID NO: 7751769 - DNA, 22 bp, Homo sapiens
ttgtattaattgaaatgaatgc

SEQ ID NO: 7751770 - DNA, 22 bp, Homo sapiens
ttgtattagtaagtcagctgct

SEQ ID NO: 7751771 - DNA, 22 bp, Homo sapiens
ttggggaagagttgactttgga

SEQ ID NO: 7751772 - DNA, 20 bp, Homo sapiens
ttggaacagtggatcagcag

SEQ ID NO: 7751773 - DNA, 22 bp, Homo sapiens
ttgctaaaggattttgtattta

SEQ ID NO: 7751774 - DNA, 22 bp, Homo sapiens
ttgctaataaagtttttatgtg

SEQ ID NO: 7751775 - DNA, 21 bp, Homo sapiens
tttatttatataggacacatg

SEQ ID NO: 7751776 - DNA, 23 bp, Homo sapiens
tttatttatttaggctgagggat

SEQ ID NO: 7751777 - DNA, 22 bp, Homo sapiens
tttcacatatggttgttgattg

SEQ ID NO: 7751778 - DNA, 22 bp, Homo sapiens
tttcacatcagaggtagattag

SEQ ID NO: 7751779 - DNA, 22 bp, Homo sapiens
tttcacatgtggaatgccaggt

SEQ ID NO: 7751780 - DNA, 22 bp, Homo sapiens
tttcacatgtgctgttgtcaat

SEQ ID NO: 7751781 - DNA, 22 bp, Homo sapiens
tttcacatggtactgcctgttt

SEQ ID NO: 7751782 - DNA, 22 bp, Homo sapiens
tttcacatgtatataggcatta

SEQ ID NO: 7751783 - DNA, 22 bp, Homo sapiens
tttcacatcatgggatggaagc

SEQ ID NO: 7751784 - DNA, 22 bp, Homo sapiens
tttcacatcctgaagccccact

SEQ ID NO: 7751785 - DNA, 20 bp, Homo sapiens
tttcacatctgtccctttaa

SEQ ID NO: 7751786 - DNA, 22 bp, Homo sapiens
tttcacatcccgcgcgccctta

SEQ ID NO: 7751787 - DNA, 22 bp, Homo sapiens
tttcacatgcagcagggaagtg

SEQ ID NO: 7751788 - DNA, 22 bp, Homo sapiens
tttcacatggaagctctcgaga

SEQ ID NO: 7751789 - DNA, 22 bp, Homo sapiens
tttcacatggactttttgttct

SEQ ID NO: 7751790 - DNA, 22 bp, Homo sapiens
tttcacatttaggcgtgaattg

SEQ ID NO: 7751791 - DNA, 23 bp, Homo sapiens
tttcacatttactgttagatggc

SEQ ID NO: 7751792 - DNA, 22 bp, Homo sapiens
tttcacatttgttttaagaagt

SEQ ID NO: 7751793 - DNA, 22 bp, Homo sapiens
tttcacattagatatgtcattt

SEQ ID NO: 7751794 - DNA, 23 bp, Homo sapiens
tttcacattaatgtttagcagga

SEQ ID NO: 7751795 - DNA, 22 bp, Homo sapiens
tttcacattcagatatagactt

SEQ ID NO: 7751796 - DNA, 22 bp, Homo sapiens
tttcacattcttctgaatctac

SEQ ID NO: 7751797 - DNA, 22 bp, Homo sapiens
tttcacattctctggttatcga

SEQ ID NO: 7751798 - DNA, 22 bp, Homo sapiens
tttcacattggcttctatttct

SEQ ID NO: 7751799 - DNA, 22 bp, Homo sapiens
tttcctttgcccaatacatgtc

SEQ ID NO: 7751800 - DNA, 22 bp, Homo sapiens
tttccatgatcgttatagaact

SEQ ID NO: 7751801 - DNA, 22 bp, Homo sapiens
tttccagattaagataccactt

SEQ ID NO: 7751802 - DNA, 22 bp, Homo sapiens
tttacacattattttcagtgtg

SEQ ID NO: 7751803 - DNA, 22 bp, Homo sapiens
tttaacatgttcaagaaacata

SEQ ID NO: 7751804 - DNA, 23 bp, Homo sapiens
tttagcatgaagcagctggagaa

SEQ ID NO: 7751805 - DNA, 22 bp, Homo sapiens
tttagcatcgaagtaaatttag

SEQ ID NO: 7751806 - DNA, 22 bp, Homo sapiens
tttagcattactaaaatgaaaa

SEQ ID NO: 7751807 - DNA, 23 bp, Homo sapiens
tttagcttccctttagttagggg

SEQ ID NO: 7751808 - DNA, 22 bp, Homo sapiens
tttagcttcatttggcgtgatt

SEQ ID NO: 7751809 - DNA, 22 bp, Homo sapiens
tttagcttgaaagttttggagg

SEQ ID NO: 7751810 - DNA, 22 bp, Homo sapiens
tttagcttgttggaacaattga

SEQ ID NO: 7751811 - DNA, 22 bp, Homo sapiens
tttagctttacctcatagattt

SEQ ID NO: 7751812 - DNA, 22 bp, Homo sapiens
tttagctttgaaggatatggtt

SEQ ID NO: 7751813 - DNA, 22 bp, Homo sapiens
tttattggatatttacaagata

SEQ ID NO: 7751814 - DNA, 20 bp, Homo sapiens
tttattggcctttcaggaac

SEQ ID NO: 7751815 - DNA, 22 bp, Homo sapiens
tttatgtacatatccacaagga

SEQ ID NO: 7751816 - DNA, 22 bp, Homo sapiens
tttatgagcctcaaatctgagt

SEQ ID NO: 7751817 - DNA, 22 bp, Homo sapiens
tttttgtctattcactgattca

SEQ ID NO: 7751818 - DNA, 22 bp, Homo sapiens
ttttttagttaggtcagaatgt

SEQ ID NO: 7751819 - DNA, 22 bp, Homo sapiens
tttgtggatggaaaatagcagg

SEQ ID NO: 7751820 - DNA, 22 bp, Homo sapiens
ttttacaggtgtgagccaccat

SEQ ID NO: 7751821 - DNA, 22 bp, Homo sapiens
ttttacaggtgaaaaatgaaga

SEQ ID NO: 7751822 - DNA, 22 bp, Homo sapiens
ttttacagttccatgcaaagcg

SEQ ID NO: 7751823 - DNA, 22 bp, Homo sapiens
ttttacagtcagtcaaactcag

SEQ ID NO: 7751824 - DNA, 22 bp, Homo sapiens
ttttacagttccatgcaaagcg

SEQ ID NO: 7751825 - DNA, 21 bp, Homo sapiens
ttttacagatgaggggaaggg

SEQ ID NO: 7751826 - DNA, 22 bp, Homo sapiens
ttttaattttgcaaatctggtg

SEQ ID NO: 7751827 - DNA, 22 bp, Homo sapiens
tttgaagactactgggagtgaa

SEQ ID NO: 7751828 - DNA, 22 bp, Homo sapiens
tttgctgagttgaagtttgagg

SEQ ID NO: 7751829 - DNA, 22 bp, Homo sapiens
tttgctgatattttgctgatac

SEQ ID NO: 7751830 - DNA, 22 bp, Homo sapiens
tttgctgaccccattctgagtc

SEQ ID NO: 7751831 - DNA, 22 bp, Homo sapiens
tttgggctcttgctgacctggg

SEQ ID NO: 7751832 - DNA, 20 bp, Homo sapiens
tttggcttcaagtgcattgc

SEQ ID NO: 7751833 - DNA, 22 bp, Homo sapiens
tttggctttagtgccttctgat

SEQ ID NO: 7751834 - DNA, 22 bp, Homo sapiens
tttggctctcacttgcactcag

SEQ ID NO: 7751835 - DNA, 22 bp, Homo sapiens
tttggctcgatggactttgaat

SEQ ID NO: 7751836 - DNA, 22 bp, Homo sapiens
acagataaggcagttaagagtt

SEQ ID NO: 7751837 - DNA, 22 bp, Homo sapiens
acagataaatttataggagtgt

SEQ ID NO: 7751838 - DNA, 15 bp, Homo sapiens
agccccctcagagga

SEQ ID NO: 7751839 - DNA, 22 bp, Homo sapiens
agccccctccctagtgactgga

SEQ ID NO: 7751840 - DNA, 22 bp, Homo sapiens
agcccctctccgccctgagtcg

SEQ ID NO: 7751841 - DNA, 22 bp, Homo sapiens
acagagcatttgggacagagag

SEQ ID NO: 7751842 - DNA, 22 bp, Homo sapiens
acagagcataatgtctagcaca

SEQ ID NO: 7751843 - DNA, 22 bp, Homo sapiens
acagagcagtaagaacacagct

SEQ ID NO: 7751844 - DNA, 22 bp, Homo sapiens
acagagcaggtccagaagtgcc

SEQ ID NO: 7751845 - DNA, 17 bp, Homo sapiens
acagagcacatcaagat

SEQ ID NO: 7751846 - DNA, 22 bp, Homo sapiens
agccatggcgccactagaggga

SEQ ID NO: 7751847 - DNA, 22 bp, Homo sapiens
agccatctaagaaatacaaaat

SEQ ID NO: 7751848 - DNA, 22 bp, Homo sapiens
agccacagtctgatgcctgaga

SEQ ID NO: 7751849 - DNA, 22 bp, Homo sapiens
agccagggtgggtgaatgctat

SEQ ID NO: 7751850 - DNA, 23 bp, Homo sapiens
acagcaagaggaccagatgtgag

SEQ ID NO: 7751851 - DNA, 20 bp, Homo sapiens
agcctgccagctggcccaga

SEQ ID NO: 7751852 - DNA, 22 bp, Homo sapiens
agcctgcctgtgaggctttgag

SEQ ID NO: 7751853 - DNA, 21 bp, Homo sapiens
agcctgcctgaactctgtggc

SEQ ID NO: 7751854 - DNA, 22 bp, Homo sapiens
agcctgccttgggctgcttgag

SEQ ID NO: 7751855 - DNA, 17 bp, Homo sapiens
agcctgccccatgctgc

SEQ ID NO: 7751856 - DNA, 22 bp, Homo sapiens
agcctgcctcagactcaggata

SEQ ID NO: 7751857 - DNA, 22 bp, Homo sapiens
agcctgccaggcgctgcctgga

SEQ ID NO: 7751858 - DNA, 22 bp, Homo sapiens
agcagtgggtgacagagctgag

SEQ ID NO: 7751859 - DNA, 22 bp, Homo sapiens
agcagtgggtggtttttgagca

SEQ ID NO: 7751860 - DNA, 22 bp, Homo sapiens
acagaaattctgggacagaaaa

SEQ ID NO: 7751861 - DNA, 19 bp, Homo sapiens
acagaaattagttattttc

SEQ ID NO: 7751862 - DNA, 22 bp, Homo sapiens
acagaacaagacctgcttattg

SEQ ID NO: 7751863 - DNA, 22 bp, Homo sapiens
acaccacaagtaactcttttcc

SEQ ID NO: 7751864 - DNA, 22 bp, Homo sapiens
acaccacaagtaactcttttcc

SEQ ID NO: 7751865 - DNA, 22 bp, Homo sapiens
acacagattttacatgttatgc

SEQ ID NO: 7751866 - DNA, 22 bp, Homo sapiens
acacaggacagggatgtgtttt

SEQ ID NO: 7751867 - DNA, 22 bp, Homo sapiens
agcaccctggggaagcacaaag

SEQ ID NO: 7751868 - DNA, 22 bp, Homo sapiens
agcaccctttgtgagcataagt

SEQ ID NO: 7751869 - DNA, 22 bp, Homo sapiens
agcacctccgtgcagcgtggcc

SEQ ID NO: 7751870 - DNA, 22 bp, Homo sapiens
agcagcagtacatataagacta

SEQ ID NO: 7751871 - DNA, 22 bp, Homo sapiens
acaaacagagttgaaaaatagg

SEQ ID NO: 7751872 - DNA, 22 bp, Homo sapiens
acaaacagctaacatatgttaa

SEQ ID NO: 7751873 - DNA, 22 bp, Homo sapiens
agaggccatgctagaggcctgg

SEQ ID NO: 7751874 - DNA, 22 bp, Homo sapiens
aattttattagaaggcaagggg

SEQ ID NO: 7751875 - DNA, 22 bp, Homo sapiens
aattttattaactggatgtagc

SEQ ID NO: 7751876 - DNA, 22 bp, Homo sapiens
aattttatgccttgcacgttgg

SEQ ID NO: 7751877 - DNA, 22 bp, Homo sapiens
acaagttcatggtgctttcctg

SEQ ID NO: 7751878 - DNA, 22 bp, Homo sapiens
acaagtttcattgtttagaacc

SEQ ID NO: 7751879 - DNA, 22 bp, Homo sapiens
acaagtttatttgattagaaca

SEQ ID NO: 7751880 - DNA, 22 bp, Homo sapiens
agatgggtaattgatggcagta

SEQ ID NO: 7751881 - DNA, 22 bp, Homo sapiens
agcaagcagaaatgccatggca

SEQ ID NO: 7751882 - DNA, 22 bp, Homo sapiens
agcaagcacacttcatgtgaac

SEQ ID NO: 7751883 - DNA, 22 bp, Homo sapiens
agcaagctacctagatagtcta

SEQ ID NO: 7751884 - DNA, 22 bp, Homo sapiens
agcaaggaaactatggagagat

SEQ ID NO: 7751885 - DNA, 22 bp, Homo sapiens
agcaaggaaagtaggcacggaa

SEQ ID NO: 7751886 - DNA, 22 bp, Homo sapiens
agcaaggagtagaacaagagtg

SEQ ID NO: 7751887 - DNA, 22 bp, Homo sapiens
agaagggtagggacttatccaa

SEQ ID NO: 7751888 - DNA, 22 bp, Homo sapiens
agacagcaatatgggagacgga

SEQ ID NO: 7751889 - DNA, 22 bp, Homo sapiens
agacagcacttttgtatggggg

SEQ ID NO: 7751890 - DNA, 22 bp, Homo sapiens
agacagagatactatgttgtca

SEQ ID NO: 7751891 - DNA, 22 bp, Homo sapiens
aatgcaatgcagcacctccttg

SEQ ID NO: 7751892 - DNA, 22 bp, Homo sapiens
agacagggtgatcgcttgagcc

SEQ ID NO: 7751893 - DNA, 22 bp, Homo sapiens
agacagggagggagcgcggctg

SEQ ID NO: 7751894 - DNA, 22 bp, Homo sapiens
aattagctgtcaatgaggatct

SEQ ID NO: 7751895 - DNA, 22 bp, Homo sapiens
aattagcttcagcttgtggggc

SEQ ID NO: 7751896 - DNA, 22 bp, Homo sapiens
aattagcttatgtgtacttttc

SEQ ID NO: 7751897 - DNA, 20 bp, Homo sapiens
aattagcttaagtcaatcag

SEQ ID NO: 7751898 - DNA, 22 bp, Homo sapiens
aattagctttccgccatcacac

SEQ ID NO: 7751899 - DNA, 22 bp, Homo sapiens
aattagctttacctaggattgt

SEQ ID NO: 7751900 - DNA, 22 bp, Homo sapiens
aagtcacaagcatatatgcatt

SEQ ID NO: 7751901 - DNA, 22 bp, Homo sapiens
aagtcacaaagtgctgtacatg

SEQ ID NO: 7751902 - DNA, 22 bp, Homo sapiens
aagtcacaagcatatatgcatt

SEQ ID NO: 7751903 - DNA, 22 bp, Homo sapiens
accccaggtctccaggctctgg

SEQ ID NO: 7751904 - DNA, 22 bp, Homo sapiens
accccaggtcatctgagagtcc

SEQ ID NO: 7751905 - DNA, 22 bp, Homo sapiens
aagtacatgttgttcaaaagcc

SEQ ID NO: 7751906 - DNA, 17 bp, Homo sapiens
aaggtgagagctgttct

SEQ ID NO: 7751907 - DNA, 22 bp, Homo sapiens
aaggtaggctcagggttgttct

SEQ ID NO: 7751908 - DNA, 22 bp, Homo sapiens
accatcctgaaaccttcatgct

SEQ ID NO: 7751909 - DNA, 22 bp, Homo sapiens
aaggtggtaatagtgcaggatt

SEQ ID NO: 7751910 - DNA, 22 bp, Homo sapiens
aagggcatttgtattccctgca

SEQ ID NO: 7751911 - DNA, 22 bp, Homo sapiens
aaggctggggtgcagacggcct

SEQ ID NO: 7751912 - DNA, 22 bp, Homo sapiens
aaggcttggtctagtcatgcca

SEQ ID NO: 7751913 - DNA, 19 bp, Homo sapiens
aaggcttggctgagctggg

SEQ ID NO: 7751914 - DNA, 22 bp, Homo sapiens
aaggcttggaccagctacagtg

SEQ ID NO: 7751915 - DNA, 22 bp, Homo sapiens
aaggcttgatatttacagtctt

SEQ ID NO: 7751916 - DNA, 22 bp, Homo sapiens
aaggcttgttggacggcggggc

SEQ ID NO: 7751917 - DNA, 22 bp, Homo sapiens
aaggcttgtgtgttcagtgagg

SEQ ID NO: 7751918 - DNA, 22 bp, Homo sapiens
aaggcttgttgagtatctactg

SEQ ID NO: 7751919 - DNA, 22 bp, Homo sapiens
aaggcttgttgtcacgctcttg

SEQ ID NO: 7751920 - DNA, 22 bp, Homo sapiens
aaggaagaagactctttactcc

SEQ ID NO: 7751921 - DNA, 22 bp, Homo sapiens
aaggaacactacaaggctggga

SEQ ID NO: 7751922 - DNA, 22 bp, Homo sapiens
acagttctttgtttatagcttg

SEQ ID NO: 7751923 - DNA, 22 bp, Homo sapiens
aaggcaggtattgatgccacag

SEQ ID NO: 7751924 - DNA, 22 bp, Homo sapiens
acagggctggcgttgggacaga

SEQ ID NO: 7751925 - DNA, 22 bp, Homo sapiens
acaggcaggttgagaaacattt

SEQ ID NO: 7751926 - DNA, 22 bp, Homo sapiens
aagccaggctgcacttgctggg

SEQ ID NO: 7751927 - DNA, 22 bp, Homo sapiens
aagccaggccattctctggttc

SEQ ID NO: 7751928 - DNA, 22 bp, Homo sapiens
aagccagggattcctgagggag

SEQ ID NO: 7751929 - DNA, 22 bp, Homo sapiens
aagccagggtttgtggatctat

SEQ ID NO: 7751930 - DNA, 22 bp, Homo sapiens
aagccagggtcaggggcctcct

SEQ ID NO: 7751931 - DNA, 22 bp, Homo sapiens
aataattttagctcagagttgt

SEQ ID NO: 7751932 - DNA, 22 bp, Homo sapiens
aataatttccagccaactggaa

SEQ ID NO: 7751933 - DNA, 22 bp, Homo sapiens
actgcctgtttggcatggcccc

SEQ ID NO: 7751934 - DNA, 22 bp, Homo sapiens
aataagacacacaactgtcaag

SEQ ID NO: 7751935 - DNA, 22 bp, Homo sapiens
aagtttatgaagtctaagccaa

SEQ ID NO: 7751936 - DNA, 22 bp, Homo sapiens
aagtttatgttctttgaaggca

SEQ ID NO: 7751937 - DNA, 22 bp, Homo sapiens
aagtttatgttggtaagatatc

SEQ ID NO: 7751938 - DNA, 22 bp, Homo sapiens
aagtcaggctggggtctggcag

SEQ ID NO: 7751939 - DNA, 22 bp, Homo sapiens
aagtcacagaacccattgtaac

SEQ ID NO: 7751940 - DNA, 19 bp, Homo sapiens
aatattttagcctcttcct

SEQ ID NO: 7751941 - DNA, 22 bp, Homo sapiens
aatatttttgaggccctgttat

SEQ ID NO: 7751942 - DNA, 22 bp, Homo sapiens
aatattttaggctttccaggct

SEQ ID NO: 7751943 - DNA, 22 bp, Homo sapiens
aatccctttttcatttaataga

SEQ ID NO: 7751944 - DNA, 22 bp, Homo sapiens
acttgttttatctgtcaataga

SEQ ID NO: 7751945 - DNA, 22 bp, Homo sapiens
acttgtttacaagcagttctga

SEQ ID NO: 7751946 - DNA, 22 bp, Homo sapiens
agaaaacactgccccctctctc

SEQ ID NO: 7751947 - DNA, 22 bp, Homo sapiens
agaaaacagaaagtcattggtg

SEQ ID NO: 7751948 - DNA, 22 bp, Homo sapiens
agaaaacataggagacaggaaa

SEQ ID NO: 7751949 - DNA, 22 bp, Homo sapiens
aatgaacaagagagagaacttt

SEQ ID NO: 7751950 - DNA, 22 bp, Homo sapiens
agaaaactctacatctgtatgt

SEQ ID NO: 7751951 - DNA, 22 bp, Homo sapiens
agaaaacattacataggtgtgt

SEQ ID NO: 7751952 - DNA, 22 bp, Homo sapiens
aatgactaataagttttactgt

SEQ ID NO: 7751953 - DNA, 21 bp, Homo sapiens
agaagggattgtggtaaagat

SEQ ID NO: 7751954 - DNA, 22 bp, Homo sapiens
aatgagatggaattcccgccta

SEQ ID NO: 7751955 - DNA, 22 bp, Homo sapiens
aaataagcacttaactgtatca

SEQ ID NO: 7751956 - DNA, 22 bp, Homo sapiens
aaataagttagcagattccagt

SEQ ID NO: 7751957 - DNA, 22 bp, Homo sapiens
aagctcttttcaccattaaagt

SEQ ID NO: 7751958 - DNA, 22 bp, Homo sapiens
aaatgcatgagaaagtattctg

SEQ ID NO: 7751959 - DNA, 22 bp, Homo sapiens
aaagagtttggagacaagatca

SEQ ID NO: 7751960 - DNA, 22 bp, Homo sapiens
aacaaacaaacattttgtcatc

SEQ ID NO: 7751961 - DNA, 22 bp, Homo sapiens
aaagccagtggtatgagagaaa

SEQ ID NO: 7751962 - DNA, 22 bp, Homo sapiens
aacagatggccaagtgcatggg

SEQ ID NO: 7751963 - DNA, 22 bp, Homo sapiens
aacagataatttctaagttact

SEQ ID NO: 7751964 - DNA, 22 bp, Homo sapiens
aaagctcttatagcagagtgtg

SEQ ID NO: 7751965 - DNA, 22 bp, Homo sapiens
aaagctctttcacttccgttct

SEQ ID NO: 7751966 - DNA, 22 bp, Homo sapiens
aaagcttctattcacttacttg

SEQ ID NO: 7751967 - DNA, 22 bp, Homo sapiens
aaagcttctaggcctattgctt

SEQ ID NO: 7751968 - DNA, 22 bp, Homo sapiens
aaaggttttcatcacagcaaga

SEQ ID NO: 7751969 - DNA, 22 bp, Homo sapiens
aaaggaaaataagtagttccat

SEQ ID NO: 7751970 - DNA, 22 bp, Homo sapiens
aaaggaagatctatacacccca

SEQ ID NO: 7751971 - DNA, 22 bp, Homo sapiens
aaaggttgtgttctggggtgag

SEQ ID NO: 7751972 - DNA, 22 bp, Homo sapiens
aaagtatttgtgatttttacca

SEQ ID NO: 7751973 - DNA, 22 bp, Homo sapiens
aaagtattcaaaaatatttggt

SEQ ID NO: 7751974 - DNA, 22 bp, Homo sapiens
aaacagaaatttcctcatgctc

SEQ ID NO: 7751975 - DNA, 22 bp, Homo sapiens
aaacagagagatgtatgtggag

SEQ ID NO: 7751976 - DNA, 22 bp, Homo sapiens
aaacacaggtactgcagaagtg

SEQ ID NO: 7751977 - DNA, 22 bp, Homo sapiens
aaaatcttgactgtttttagaa

SEQ ID NO: 7751978 - DNA, 23 bp, Homo sapiens
aaacaagccctaatgaagagtcc

SEQ ID NO: 7751979 - DNA, 22 bp, Homo sapiens
aaactcagacacagtatctgtt

SEQ ID NO: 7751980 - DNA, 22 bp, Homo sapiens
aaagacatggaactagagatgg

SEQ ID NO: 7751981 - DNA, 22 bp, Homo sapiens
aaaagtatagggtttggagtca

SEQ ID NO: 7751982 - DNA, 22 bp, Homo sapiens
aaattaagggtgagaagagttg

SEQ ID NO: 7751983 - DNA, 22 bp, Homo sapiens
aaaggtcaagctggactcaggt

SEQ ID NO: 7751984 - DNA, 22 bp, Homo sapiens
aaaggtcagacttaggctgggc

SEQ ID NO: 7751985 - DNA, 22 bp, Homo sapiens
aaaggtcattgaaaaggaggaa

SEQ ID NO: 7751986 - DNA, 22 bp, Homo sapiens
aaacagcttgtaaggtgtaatt

SEQ ID NO: 7751987 - DNA, 17 bp, Homo sapiens
acacagtacttttttgc

SEQ ID NO: 7751988 - DNA, 22 bp, Homo sapiens
acacagtaaatatgtattgaat

SEQ ID NO: 7751989 - DNA, 20 bp, Homo sapiens
acacagtagcaattagtgca

SEQ ID NO: 7751990 - DNA, 22 bp, Homo sapiens
acacagtagtgtggaaaaacat

SEQ ID NO: 7751991 - DNA, 22 bp, Homo sapiens
acacaggaaatggtttagtttt

SEQ ID NO: 7751992 - DNA, 22 bp, Homo sapiens
aagatttccttcagtagagcta

SEQ ID NO: 7751993 - DNA, 22 bp, Homo sapiens
aagatttctctcctggaaagca

SEQ ID NO: 7751994 - DNA, 22 bp, Homo sapiens
aagatttctgctcctgagagaa

SEQ ID NO: 7751995 - DNA, 22 bp, Homo sapiens
aagatttctgcttttggaggca

SEQ ID NO: 7751996 - DNA, 22 bp, Homo sapiens
aagatttcagagtttgggggaa

SEQ ID NO: 7751997 - DNA, 22 bp, Homo sapiens
aagatttcctggatgtaattcc

SEQ ID NO: 7751998 - DNA, 17 bp, Homo sapiens
aagatttcattagctga

SEQ ID NO: 7751999 - DNA, 22 bp, Homo sapiens
aagatttccatttctagctcat

SEQ ID NO: 7752000 - DNA, 19 bp, Homo sapiens
aagcattagccaaagcatt

SEQ ID NO: 7752001 - DNA, 22 bp, Homo sapiens
aagccaggaagagagccttcac

SEQ ID NO: 7752002 - DNA, 22 bp, Homo sapiens
aagccaggaagggagctgtccc

SEQ ID NO: 7752003 - DNA, 22 bp, Homo sapiens
aagccaggagcgaggcctcggc

SEQ ID NO: 7752004 - DNA, 22 bp, Homo sapiens
acagcagcttgtctgttcttta

SEQ ID NO: 7752005 - DNA, 22 bp, Homo sapiens
acagcagcttcctgactgtact

SEQ ID NO: 7752006 - DNA, 22 bp, Homo sapiens
aagcagcatgtgggttatcggg

SEQ ID NO: 7752007 - DNA, 22 bp, Homo sapiens
aagcagcatgctatgctggtgg

SEQ ID NO: 7752008 - DNA, 22 bp, Homo sapiens
aagcagcatgattgtaatacta

SEQ ID NO: 7752009 - DNA, 22 bp, Homo sapiens
aagcagcattcagtgaaatgtg

SEQ ID NO: 7752010 - DNA, 22 bp, Homo sapiens
aagagatgtggaatcatttaca

SEQ ID NO: 7752011 - DNA, 22 bp, Homo sapiens
aatgttttcattatcctaactg

SEQ ID NO: 7752012 - DNA, 22 bp, Homo sapiens
aatgttttacagatcccattag

SEQ ID NO: 7752013 - DNA, 22 bp, Homo sapiens
aagaataacacttaggttttgc

SEQ ID NO: 7752014 - DNA, 22 bp, Homo sapiens
aagaataagaggatttagaaca

SEQ ID NO: 7752015 - DNA, 22 bp, Homo sapiens
aacatgctgggtgtttttgatg

SEQ ID NO: 7752016 - DNA, 22 bp, Homo sapiens
aacatgctctggattgctgtga

SEQ ID NO: 7752017 - DNA, 22 bp, Homo sapiens
aatagtttgaatttatcagatg

SEQ ID NO: 7752018 - DNA, 22 bp, Homo sapiens
aacatttttaagaccaagtgct

SEQ ID NO: 7752019 - DNA, 22 bp, Homo sapiens
aatgatatgcaaattatcatca

SEQ ID NO: 7752020 - DNA, 22 bp, Homo sapiens
aatgatatttattgaatagatg

SEQ ID NO: 7752021 - DNA, 22 bp, Homo sapiens
aatgatatagcagacatagcct

SEQ ID NO: 7752022 - DNA, 22 bp, Homo sapiens
aacaaagtagctgctgttctta

SEQ ID NO: 7752023 - DNA, 22 bp, Homo sapiens
aaattgatgttcccagttgaaa

SEQ ID NO: 7752024 - DNA, 22 bp, Homo sapiens
aagtccaccagtcagactagga

SEQ ID NO: 7752025 - DNA, 22 bp, Homo sapiens
aagtccagaactcctgtgatag

SEQ ID NO: 7752026 - DNA, 22 bp, Homo sapiens
aaggtccttttgcagtgtgatc

SEQ ID NO: 7752027 - DNA, 22 bp, Homo sapiens
aacagcagctgcctgaatttgc

SEQ ID NO: 7752028 - DNA, 22 bp, Homo sapiens
aacagcagggatggggtggcca

SEQ ID NO: 7752029 - DNA, 22 bp, Homo sapiens
aacactgaaatgtcttaagatt

SEQ ID NO: 7752030 - DNA, 22 bp, Homo sapiens
aacacatagacgtttgatatca

SEQ ID NO: 7752031 - DNA, 22 bp, Homo sapiens
aacaaagtgtacttccatactg

SEQ ID NO: 7752032 - DNA, 22 bp, Homo sapiens
agcaggctgatgggcatgcttg

SEQ ID NO: 7752033 - DNA, 17 bp, Homo sapiens
agcaggctgcagaggcc

SEQ ID NO: 7752034 - DNA, 19 bp, Homo sapiens
cacagtcctatgtttatca

SEQ ID NO: 7752035 - DNA, 22 bp, Homo sapiens
cacacagaaccgctcgccactt

SEQ ID NO: 7752036 - DNA, 22 bp, Homo sapiens
agcagctgcagggagggtctgc

SEQ ID NO: 7752037 - DNA, 21 bp, Homo sapiens
agcagctgcagtttctatctg

SEQ ID NO: 7752038 - DNA, 22 bp, Homo sapiens
cacacacagttttgtattctgt

SEQ ID NO: 7752039 - DNA, 22 bp, Homo sapiens
agcagctgccagagagagttcc

SEQ ID NO: 7752040 - DNA, 22 bp, Homo sapiens
cacccaggctggagtgcagggg

SEQ ID NO: 7752041 - DNA, 22 bp, Homo sapiens
cacccaggctggagtgcagtga

SEQ ID NO: 7752042 - DNA, 22 bp, Homo sapiens
agcatagagaatctagatgcct

SEQ ID NO: 7752043 - DNA, 22 bp, Homo sapiens
cacccaggctggagtgcagtgg

SEQ ID NO: 7752044 - DNA, 22 bp, Homo sapiens
caccgaggctggagtgcagtgg

SEQ ID NO: 7752045 - DNA, 22 bp, Homo sapiens
caccgcggagtgatggagaaac

SEQ ID NO: 7752046 - DNA, 23 bp, Homo sapiens
agcagcaggaggtattgataagg

SEQ ID NO: 7752047 - DNA, 22 bp, Homo sapiens
cacaagacttatttgtgtagaa

SEQ ID NO: 7752048 - DNA, 22 bp, Homo sapiens
agcagccagaaatccagaggtg

SEQ ID NO: 7752049 - DNA, 22 bp, Homo sapiens
agcagccaattggaggatgaag

SEQ ID NO: 7752050 - DNA, 22 bp, Homo sapiens
agcagccacagtctgggacagg

SEQ ID NO: 7752051 - DNA, 22 bp, Homo sapiens
caaatattccaggtacatccct

SEQ ID NO: 7752052 - DNA, 22 bp, Homo sapiens
caacagaaggtgtactactgaa

SEQ ID NO: 7752053 - DNA, 22 bp, Homo sapiens
caacagctgatctttgatgaag

SEQ ID NO: 7752054 - DNA, 22 bp, Homo sapiens
caacagctgatctttgatgaag

SEQ ID NO: 7752055 - DNA, 22 bp, Homo sapiens
agcaccaggaaagaaggggcca

SEQ ID NO: 7752056 - DNA, 22 bp, Homo sapiens
agcaaagaagggttcttcatta

SEQ ID NO: 7752057 - DNA, 22 bp, Homo sapiens
agcacatgagctgatggtgggc

SEQ ID NO: 7752058 - DNA, 22 bp, Homo sapiens
agcacaggtgaaacagtcaggt

SEQ ID NO: 7752059 - DNA, 22 bp, Homo sapiens
cagagggagccctccaggagca

SEQ ID NO: 7752060 - DNA, 22 bp, Homo sapiens
cagcagctgaggcgctggcgtg

SEQ ID NO: 7752061 - DNA, 22 bp, Homo sapiens
cagcagctcctctgcggctatg

SEQ ID NO: 7752062 - DNA, 22 bp, Homo sapiens
cagctcatgacctttgttatct

SEQ ID NO: 7752063 - DNA, 22 bp, Homo sapiens
cagctcattcctcaatctagga

SEQ ID NO: 7752064 - DNA, 22 bp, Homo sapiens
agctcagcttcctctccatgct

SEQ ID NO: 7752065 - DNA, 22 bp, Homo sapiens
cagcagtgtctccagcatcaca

SEQ ID NO: 7752066 - DNA, 22 bp, Homo sapiens
cagagaaaaaatcctgctctca

SEQ ID NO: 7752067 - DNA, 22 bp, Homo sapiens
cagagaaagaagcccattcatt

SEQ ID NO: 7752068 - DNA, 22 bp, Homo sapiens
cagagaaactcagatagctgat

SEQ ID NO: 7752069 - DNA, 22 bp, Homo sapiens
cagagaaagacttgcccttagt

SEQ ID NO: 7752070 - DNA, 22 bp, Homo sapiens
cagagaaagggtgaattccttc

SEQ ID NO: 7752071 - DNA, 22 bp, Homo sapiens
agcccaggctggagtgcagtgg

SEQ ID NO: 7752072 - DNA, 22 bp, Homo sapiens
cagacatgagatacagctgcta

SEQ ID NO: 7752073 - DNA, 22 bp, Homo sapiens
cagacatgatgtaagcagaggc

SEQ ID NO: 7752074 - DNA, 22 bp, Homo sapiens
agccagagactgtgtctgtaat

SEQ ID NO: 7752075 - DNA, 22 bp, Homo sapiens
agccagagagtgttggagatgt

SEQ ID NO: 7752076 - DNA, 22 bp, Homo sapiens
cagaatatgacaagattttcct

SEQ ID NO: 7752077 - DNA, 22 bp, Homo sapiens
agccaccctaccagccctgaaa

SEQ ID NO: 7752078 - DNA, 22 bp, Homo sapiens
agcatagagtcctgagggcagg

SEQ ID NO: 7752079 - DNA, 22 bp, Homo sapiens
agaccaggtctttatggctcca

SEQ ID NO: 7752080 - DNA, 22 bp, Homo sapiens
agaccaggaaggcctacagata

SEQ ID NO: 7752081 - DNA, 18 bp, Homo sapiens
agagaagaggtgttagtc

SEQ ID NO: 7752082 - DNA, 21 bp, Homo sapiens
agagaagaggactttctcaca

SEQ ID NO: 7752083 - DNA, 22 bp, Homo sapiens
agagaccaagggaatagtctca

SEQ ID NO: 7752084 - DNA, 22 bp, Homo sapiens
atggctaatacgccactggaca

SEQ ID NO: 7752085 - DNA, 22 bp, Homo sapiens
atggcctgatgcacctgtccca

SEQ ID NO: 7752086 - DNA, 22 bp, Homo sapiens
atggcctggggagcatgggaag

SEQ ID NO: 7752087 - DNA, 20 bp, Homo sapiens
atggcctgctagaagtctgt

SEQ ID NO: 7752088 - DNA, 22 bp, Homo sapiens
agagatggcgtctcagagcctg

SEQ ID NO: 7752089 - DNA, 22 bp, Homo sapiens
agagccagagacctgggttcac

SEQ ID NO: 7752090 - DNA, 22 bp, Homo sapiens
agagccagaccattgccgtgca

SEQ ID NO: 7752091 - DNA, 22 bp, Homo sapiens
atgtcaaagcagactgagagcg

SEQ ID NO: 7752092 - DNA, 22 bp, Homo sapiens
agagcctgcagtggagaccttg

SEQ ID NO: 7752093 - DNA, 22 bp, Homo sapiens
atgtggggacaaaatgatggcc

SEQ ID NO: 7752094 - DNA, 22 bp, Homo sapiens
atgtgggccgtgcgggtgtcct

SEQ ID NO: 7752095 - DNA, 22 bp, Homo sapiens
agacaaatggtaattatgtcta

SEQ ID NO: 7752096 - DNA, 22 bp, Homo sapiens
agacaaataactttttatgtcc

SEQ ID NO: 7752097 - DNA, 22 bp, Homo sapiens
agaagtggtgtgtggccgagct

SEQ ID NO: 7752098 - DNA, 22 bp, Homo sapiens
agaaggctggccctgggtggcc

SEQ ID NO: 7752099 - DNA, 22 bp, Homo sapiens
agaagtcaatgatgagagtgct

SEQ ID NO: 7752100 - DNA, 22 bp, Homo sapiens
agaagtctattgatggcagtcc

SEQ ID NO: 7752101 - DNA, 22 bp, Homo sapiens
agaagtctggaattcctgcagg

SEQ ID NO: 7752102 - DNA, 20 bp, Homo sapiens
agaagtcagctcagaagtga

SEQ ID NO: 7752103 - DNA, 20 bp, Homo sapiens
agaagtcagctcagaagtga

SEQ ID NO: 7752104 - DNA, 23 bp, Homo sapiens
agaagtggaatggccgtggggtc

SEQ ID NO: 7752105 - DNA, 19 bp, Homo sapiens
agacagctctattattttg

SEQ ID NO: 7752106 - DNA, 22 bp, Homo sapiens
agacagctccaagtgtctctgt

SEQ ID NO: 7752107 - DNA, 22 bp, Homo sapiens
agacagcatggagctgataaca

SEQ ID NO: 7752108 - DNA, 22 bp, Homo sapiens
atgcacccttatgaatatgatc

SEQ ID NO: 7752109 - DNA, 22 bp, Homo sapiens
agaggctgtgcagagggagtgc

SEQ ID NO: 7752110 - DNA, 22 bp, Homo sapiens
attccattgtatgtgtagacta

SEQ ID NO: 7752111 - DNA, 22 bp, Homo sapiens
attattagtgatgttgttactg

SEQ ID NO: 7752112 - DNA, 22 bp, Homo sapiens
attattagtgatgttgttactg

SEQ ID NO: 7752113 - DNA, 22 bp, Homo sapiens
attattaggtgctctctgacaa

SEQ ID NO: 7752114 - DNA, 22 bp, Homo sapiens
attattaggtgctctctgacaa

SEQ ID NO: 7752115 - DNA, 22 bp, Homo sapiens
attattagattcttaattgtaa

SEQ ID NO: 7752116 - DNA, 22 bp, Homo sapiens
attattaggactactggggttg

SEQ ID NO: 7752117 - DNA, 22 bp, Homo sapiens
attattagattcttaattgtaa

SEQ ID NO: 7752118 - DNA, 22 bp, Homo sapiens
attattagacttatatggtagt

SEQ ID NO: 7752119 - DNA, 22 bp, Homo sapiens
attattagacttatatggtagt

SEQ ID NO: 7752120 - DNA, 21 bp, Homo sapiens
attattatttctgtgtccagc

SEQ ID NO: 7752121 - DNA, 22 bp, Homo sapiens
agaggcactcgggagtctgtgg

SEQ ID NO: 7752122 - DNA, 22 bp, Homo sapiens
agaggcactgttcttagcgact

SEQ ID NO: 7752123 - DNA, 22 bp, Homo sapiens
agaggcactccagccactggtc

SEQ ID NO: 7752124 - DNA, 22 bp, Homo sapiens
atgtttatgacctccataagga

SEQ ID NO: 7752125 - DNA, 22 bp, Homo sapiens
agagctgtgtcctgtgcactag

SEQ ID NO: 7752126 - DNA, 22 bp, Homo sapiens
agagctgtttggacatctgagt

SEQ ID NO: 7752127 - DNA, 22 bp, Homo sapiens
agagctgggacttggactcaat

SEQ ID NO: 7752128 - DNA, 22 bp, Homo sapiens
agataaattcctaagatttcag

SEQ ID NO: 7752129 - DNA, 22 bp, Homo sapiens
atttcacagctgtcagtgttac

SEQ ID NO: 7752130 - DNA, 19 bp, Homo sapiens
agagttgggcactgtttca

SEQ ID NO: 7752131 - DNA, 22 bp, Homo sapiens
agagttctgcggtatgtgagaa

SEQ ID NO: 7752132 - DNA, 21 bp, Homo sapiens
agagttcttgctgagcaagcc

SEQ ID NO: 7752133 - DNA, 22 bp, Homo sapiens
attgctgactcaataattgaag

SEQ ID NO: 7752134 - DNA, 22 bp, Homo sapiens
attgctgactttaatattatat

SEQ ID NO: 7752135 - DNA, 22 bp, Homo sapiens
attgctgaaatgaaaggatatg

SEQ ID NO: 7752136 - DNA, 22 bp, Homo sapiens
attgctgaaagtattttatgac

SEQ ID NO: 7752137 - DNA, 21 bp, Homo sapiens
caaaaggataggaaattaggg

SEQ ID NO: 7752138 - DNA, 22 bp, Homo sapiens
atttcctcatgatcataatgca

SEQ ID NO: 7752139 - DNA, 22 bp, Homo sapiens
atttggacatttacaatagtga

SEQ ID NO: 7752140 - DNA, 22 bp, Homo sapiens
aggtccagttttcagttctcat

SEQ ID NO: 7752141 - DNA, 22 bp, Homo sapiens
aggtctacagcctgtgacactt

SEQ ID NO: 7752142 - DNA, 22 bp, Homo sapiens
aggtccagttgccagaatggcc

SEQ ID NO: 7752143 - DNA, 22 bp, Homo sapiens
acctgcaggtgtttccacactt

SEQ ID NO: 7752144 - DNA, 22 bp, Homo sapiens
acctgcaggggtgctctctggg

SEQ ID NO: 7752145 - DNA, 22 bp, Homo sapiens
acctgcagccacttctctcctt

SEQ ID NO: 7752146 - DNA, 22 bp, Homo sapiens
accctcccatttccatgtagca

SEQ ID NO: 7752147 - DNA, 22 bp, Homo sapiens
accctcggatttggcctaggac

SEQ ID NO: 7752148 - DNA, 22 bp, Homo sapiens
accctcgatatgatctgatgaa

SEQ ID NO: 7752149 - DNA, 22 bp, Homo sapiens
accctccccaagaggtcgtgcc

SEQ ID NO: 7752150 - DNA, 22 bp, Homo sapiens
agtcaacatttgagatgcaatg

SEQ ID NO: 7752151 - DNA, 22 bp, Homo sapiens
agtcaacagtttttgatgtaaa

SEQ ID NO: 7752152 - DNA, 22 bp, Homo sapiens
actcaggaaatgagaggctctc

SEQ ID NO: 7752153 - DNA, 22 bp, Homo sapiens
agtcccagcttcccccatgcag

SEQ ID NO: 7752154 - DNA, 22 bp, Homo sapiens
agtcccagctctgccacttact

SEQ ID NO: 7752155 - DNA, 22 bp, Homo sapiens
agtcccagctcagaaccactag

SEQ ID NO: 7752156 - DNA, 22 bp, Homo sapiens
actaggggctcaggcccaggga

SEQ ID NO: 7752157 - DNA, 22 bp, Homo sapiens
agtatactagtgcagcatgtat

SEQ ID NO: 7752158 - DNA, 22 bp, Homo sapiens
agtatactccccatcctagaaa

SEQ ID NO: 7752159 - DNA, 22 bp, Homo sapiens
actagtcatttaggtgatatta

SEQ ID NO: 7752160 - DNA, 22 bp, Homo sapiens
agtattttcgccatcacaagaa

SEQ ID NO: 7752161 - DNA, 22 bp, Homo sapiens
agtaaacagaaagcaagatgat

SEQ ID NO: 7752162 - DNA, 20 bp, Homo sapiens
aggtggctcctgctgggggt

SEQ ID NO: 7752163 - DNA, 22 bp, Homo sapiens
aggtggctcctcccatggctgg

SEQ ID NO: 7752164 - DNA, 23 bp, Homo sapiens
acgccctcgcatcctgagagccc

SEQ ID NO: 7752165 - DNA, 22 bp, Homo sapiens
acgccctctcggtagaggagct

SEQ ID NO: 7752166 - DNA, 21 bp, Homo sapiens
agtggggtctctgtggaggcc

SEQ ID NO: 7752167 - DNA, 22 bp, Homo sapiens
actggaaagtattctttcactg

SEQ ID NO: 7752168 - DNA, 22 bp, Homo sapiens
agtgcacaacatgcaggtttgt

SEQ ID NO: 7752169 - DNA, 22 bp, Homo sapiens
actccttactaaaaggaacata

SEQ ID NO: 7752170 - DNA, 22 bp, Homo sapiens
actcggggtggagagagcggtg

SEQ ID NO: 7752171 - DNA, 22 bp, Homo sapiens
agtcttggacatattctacttc

SEQ ID NO: 7752172 - DNA, 22 bp, Homo sapiens
agtcttctttgtgttctctcat

SEQ ID NO: 7752173 - DNA, 22 bp, Homo sapiens
agtctttactaaacagaccacc

SEQ ID NO: 7752174 - DNA, 22 bp, Homo sapiens
agtcccagtgagatgagccacg

SEQ ID NO: 7752175 - DNA, 22 bp, Homo sapiens
agtcccagtgagatgaaccagg

SEQ ID NO: 7752176 - DNA, 22 bp, Homo sapiens
agtcccagttcggttcttcctc

SEQ ID NO: 7752177 - DNA, 22 bp, Homo sapiens
agtcccaggcagccgagccggt

SEQ ID NO: 7752178 - DNA, 21 bp, Homo sapiens
agtcccaggggtgagtgatgt

SEQ ID NO: 7752179 - DNA, 19 bp, Homo sapiens
agtcccaggcccgaaagag

SEQ ID NO: 7752180 - DNA, 22 bp, Homo sapiens
agtcccagtgacttggccagaa

SEQ ID NO: 7752181 - DNA, 22 bp, Homo sapiens
atatttcatggggttccatact

SEQ ID NO: 7752182 - DNA, 21 bp, Homo sapiens
atatttcagatttccgtaatc

SEQ ID NO: 7752183 - DNA, 20 bp, Homo sapiens
atatttcaggtagtgtgccc

SEQ ID NO: 7752184 - DNA, 22 bp, Homo sapiens
agaaaataaattgatggtggaa

SEQ ID NO: 7752185 - DNA, 21 bp, Homo sapiens
agaaaagtagagttttcagag

SEQ ID NO: 7752186 - DNA, 23 bp, Homo sapiens
agaaaagttcatacctttttaac

SEQ ID NO: 7752187 - DNA, 22 bp, Homo sapiens
actttcaacttggtgggagagc

SEQ ID NO: 7752188 - DNA, 22 bp, Homo sapiens
agaaattatgcagtagttttat

SEQ ID NO: 7752189 - DNA, 22 bp, Homo sapiens
agaacacatagagaagttttat

SEQ ID NO: 7752190 - DNA, 22 bp, Homo sapiens
acttctcttccccggaactcta

SEQ ID NO: 7752191 - DNA, 22 bp, Homo sapiens
acttctctttagtactaaatgt

SEQ ID NO: 7752192 - DNA, 22 bp, Homo sapiens
acttctggaggcctagggaaga

SEQ ID NO: 7752193 - DNA, 22 bp, Homo sapiens
acttctggatagagtcagcttt

SEQ ID NO: 7752194 - DNA, 22 bp, Homo sapiens
acttctgggtcccacccccaga

SEQ ID NO: 7752195 - DNA, 22 bp, Homo sapiens
acttctggtgtcatactgcatt

SEQ ID NO: 7752196 - DNA, 22 bp, Homo sapiens
atactgaaaataagtgagttga

SEQ ID NO: 7752197 - DNA, 23 bp, Homo sapiens
atactgaaactgttgtttatctg

SEQ ID NO: 7752198 - DNA, 22 bp, Homo sapiens
actgtcacctaaattttcattg

SEQ ID NO: 7752199 - DNA, 22 bp, Homo sapiens
actgtgatgatgaagcatggtt

SEQ ID NO: 7752200 - DNA, 22 bp, Homo sapiens
ataatgaaatatgaggaaggtc

SEQ ID NO: 7752201 - DNA, 22 bp, Homo sapiens
ataatgaatcagcatagggtga

SEQ ID NO: 7752202 - DNA, 22 bp, Homo sapiens
acccaggacttggcaacctcat

SEQ ID NO: 7752203 - DNA, 22 bp, Homo sapiens
acccaggagacggaggtgcagt

SEQ ID NO: 7752204 - DNA, 22 bp, Homo sapiens
acccaggacacagagatgaccc

SEQ ID NO: 7752205 - DNA, 22 bp, Homo sapiens
acccagataaatgacagggctt

SEQ ID NO: 7752206 - DNA, 22 bp, Homo sapiens
acccaggctggcgtgcagtggc

SEQ ID NO: 7752207 - DNA, 22 bp, Homo sapiens
accctcagtaatcgtgcagttt

SEQ ID NO: 7752208 - DNA, 22 bp, Homo sapiens
acccaggctggagtgcagtgac

SEQ ID NO: 7752209 - DNA, 22 bp, Homo sapiens
acccaggctggagtgcagtgat

SEQ ID NO: 7752210 - DNA, 22 bp, Homo sapiens
acccaggctggagtgcagtggc

SEQ ID NO: 7752211 - DNA, 22 bp, Homo sapiens
acccaggctggagtgcagtggg

SEQ ID NO: 7752212 - DNA, 22 bp, Homo sapiens
acccaggctggagtgcagtgtc

SEQ ID NO: 7752213 - DNA, 22 bp, Homo sapiens
acccaggctggagtgcagtggt

SEQ ID NO: 7752214 - DNA, 22 bp, Homo sapiens
accagcagctgccagagtggag

SEQ ID NO: 7752215 - DNA, 22 bp, Homo sapiens
accagcagcctagagcgttctt

SEQ ID NO: 7752216 - DNA, 22 bp, Homo sapiens
accagcaggtggcagtatgtat

SEQ ID NO: 7752217 - DNA, 22 bp, Homo sapiens
accagcaggccaggggcactgc

SEQ ID NO: 7752218 - DNA, 22 bp, Homo sapiens
accagcagttatgaggccagga

SEQ ID NO: 7752219 - DNA, 22 bp, Homo sapiens
accagcatcacctggaggcctg

SEQ ID NO: 7752220 - DNA, 19 bp, Homo sapiens
agggagaattccaagagga

SEQ ID NO: 7752221 - DNA, 21 bp, Homo sapiens
aggcttgggtaaaaaggtcat

SEQ ID NO: 7752222 - DNA, 22 bp, Homo sapiens
aggcttggtgccaaggagcctg

SEQ ID NO: 7752223 - DNA, 22 bp, Homo sapiens
aggcttggtttatagaagtaat

SEQ ID NO: 7752224 - DNA, 19 bp, Homo sapiens
aggcttggttgcagcaagc

SEQ ID NO: 7752225 - DNA, 20 bp, Homo sapiens
aggcttggcttggcaggaac

SEQ ID NO: 7752226 - DNA, 22 bp, Homo sapiens
aggcttgggactgcttaggagc

SEQ ID NO: 7752227 - DNA, 22 bp, Homo sapiens
acatgctgggcaatgttgtttt

SEQ ID NO: 7752228 - DNA, 22 bp, Homo sapiens
acatgctgtcctgtctttgtca

SEQ ID NO: 7752229 - DNA, 22 bp, Homo sapiens
acatcagtaactgtaaaacagg

SEQ ID NO: 7752230 - DNA, 22 bp, Homo sapiens
acatcagacaattaattattaa

SEQ ID NO: 7752231 - DNA, 22 bp, Homo sapiens
acatcagtaattaagtctcaag

SEQ ID NO: 7752232 - DNA, 18 bp, Homo sapiens
acatcagttaccaggcca

SEQ ID NO: 7752233 - DNA, 22 bp, Homo sapiens
acatcagtcttttgcatacata

SEQ ID NO: 7752234 - DNA, 22 bp, Homo sapiens
acatcagtccaccactgcagtt

SEQ ID NO: 7752235 - DNA, 22 bp, Homo sapiens
acatcagtgctcttggttcttg

SEQ ID NO: 7752236 - DNA, 20 bp, Homo sapiens
aggcctgagagatgactggg

SEQ ID NO: 7752237 - DNA, 22 bp, Homo sapiens
aggcctcttgtcttcctcacat

SEQ ID NO: 7752238 - DNA, 22 bp, Homo sapiens
acatgttagaaatgcagaatct

SEQ ID NO: 7752239 - DNA, 22 bp, Homo sapiens
acatgttagggacagagtatgt

SEQ ID NO: 7752240 - DNA, 22 bp, Homo sapiens
aggccagggcactgctctttag

SEQ ID NO: 7752241 - DNA, 22 bp, Homo sapiens
aggctgagctggtagtgagtac

SEQ ID NO: 7752242 - DNA, 22 bp, Homo sapiens
aggctgaggagggatgttgctt

SEQ ID NO: 7752243 - DNA, 22 bp, Homo sapiens
aggctgagactgtgcattagtg

SEQ ID NO: 7752244 - DNA, 22 bp, Homo sapiens
aggcctgcccgtgggacctgtg

SEQ ID NO: 7752245 - DNA, 18 bp, Homo sapiens
aggcctgcccagcactgt

SEQ ID NO: 7752246 - DNA, 22 bp, Homo sapiens
acatttcagaatcacacagctt

SEQ ID NO: 7752247 - DNA, 22 bp, Homo sapiens
acagctgtattcaagttgcaag

SEQ ID NO: 7752248 - DNA, 22 bp, Homo sapiens
agctgaatgttctcagaccaga

SEQ ID NO: 7752249 - DNA, 22 bp, Homo sapiens
aggaagacaatctgtgtgctgt

SEQ ID NO: 7752250 - DNA, 18 bp, Homo sapiens
aggaagaccatcagatat

SEQ ID NO: 7752251 - DNA, 19 bp, Homo sapiens
acaggggctagcggaagca

SEQ ID NO: 7752252 - DNA, 22 bp, Homo sapiens
aggacacaacatcatttctgtg

SEQ ID NO: 7752253 - DNA, 22 bp, Homo sapiens
aggacacacaaagagtgagaac

SEQ ID NO: 7752254 - DNA, 22 bp, Homo sapiens
aggacacacagaatacaaatcc

SEQ ID NO: 7752255 - DNA, 22 bp, Homo sapiens
aggacacactgcaagagcctgg

SEQ ID NO: 7752256 - DNA, 22 bp, Homo sapiens
aggacacacttctgaggtcttt

SEQ ID NO: 7752257 - DNA, 22 bp, Homo sapiens
acaggggattgattggaagtct

SEQ ID NO: 7752258 - DNA, 22 bp, Homo sapiens
acaggggaatttactgtcatta

SEQ ID NO: 7752259 - DNA, 22 bp, Homo sapiens
acaggggacctaggaccctcgg

SEQ ID NO: 7752260 - DNA, 22 bp, Homo sapiens
acaggcaggcttcggccagagc

SEQ ID NO: 7752261 - DNA, 22 bp, Homo sapiens
aggagcagaccgtagtcctgca

SEQ ID NO: 7752262 - DNA, 23 bp, Homo sapiens
aggagcactttcagtttgtaaag

SEQ ID NO: 7752263 - DNA, 22 bp, Homo sapiens
acaggtttagctcttagtagtc

SEQ ID NO: 7752264 - DNA, 22 bp, Homo sapiens
aggacacagctcttcagtaaga

SEQ ID NO: 7752265 - DNA, 22 bp, Homo sapiens
aggacacagactgattgcagca

SEQ ID NO: 7752266 - DNA, 22 bp, Homo sapiens
aggacacagacttagatttaaa

SEQ ID NO: 7752267 - DNA, 22 bp, Homo sapiens
acaggttttggactccagattt

SEQ ID NO: 7752268 - DNA, 22 bp, Homo sapiens
acagtaaaaagccttagaattt

SEQ ID NO: 7752269 - DNA, 22 bp, Homo sapiens
acagtaaaacatttttattagg

SEQ ID NO: 7752270 - DNA, 22 bp, Homo sapiens
acagtcaatcagaacagcatgt

SEQ ID NO: 7752271 - DNA, 22 bp, Homo sapiens
acagtttatgtaaagctgccaa

SEQ ID NO: 7752272 - DNA, 22 bp, Homo sapiens
aggatgccttcattgcatggcc

SEQ ID NO: 7752273 - DNA, 22 bp, Homo sapiens
acagtttaggatgagagaacac

SEQ ID NO: 7752274 - DNA, 22 bp, Homo sapiens
acatagaacttcgatgtctttt

SEQ ID NO: 7752275 - DNA, 18 bp, Homo sapiens
acatacattctgtctgca

SEQ ID NO: 7752276 - DNA, 22 bp, Homo sapiens
cctgaggatgccagcatgggtg

SEQ ID NO: 7752277 - DNA, 22 bp, Homo sapiens
cctgaggagattgtggctgggg

SEQ ID NO: 7752278 - DNA, 19 bp, Homo sapiens
cctgaggaaaagatgattg

SEQ ID NO: 7752279 - DNA, 22 bp, Homo sapiens
cctgaggacacacgctgcagga

SEQ ID NO: 7752280 - DNA, 22 bp, Homo sapiens
agggctgatgcaccatgtagcc

SEQ ID NO: 7752281 - DNA, 22 bp, Homo sapiens
cctctgggcctggaagggcagt

SEQ ID NO: 7752282 - DNA, 22 bp, Homo sapiens
cctctgggaagccagtcctgct

SEQ ID NO: 7752283 - DNA, 22 bp, Homo sapiens
ccgcagggaaagccccaggaag

SEQ ID NO: 7752284 - DNA, 22 bp, Homo sapiens
ccgccctcacgaggtaggtacc

SEQ ID NO: 7752285 - DNA, 21 bp, Homo sapiens
ccgccgctgatagctctgggc

SEQ ID NO: 7752286 - DNA, 22 bp, Homo sapiens
ccgaggcagggtggagccgcct

SEQ ID NO: 7752287 - DNA, 22 bp, Homo sapiens
ccgaggaatttttataagatct

SEQ ID NO: 7752288 - DNA, 22 bp, Homo sapiens
ccctttcctgaagaatattttt

SEQ ID NO: 7752289 - DNA, 22 bp, Homo sapiens
agggccagagtacatcagggct

SEQ ID NO: 7752290 - DNA, 22 bp, Homo sapiens
agggatgactcttggctgattc

SEQ ID NO: 7752291 - DNA, 22 bp, Homo sapiens
agggatgatcagggtagaggct

SEQ ID NO: 7752292 - DNA, 22 bp, Homo sapiens
agggagaaaattggatgcacaa

SEQ ID NO: 7752293 - DNA, 22 bp, Homo sapiens
agggagaaggtccatgcctgtc

SEQ ID NO: 7752294 - DNA, 22 bp, Homo sapiens
ccctctgaacctggtagcagaa

SEQ ID NO: 7752295 - DNA, 22 bp, Homo sapiens
agggcagagatctgagtgggca

SEQ ID NO: 7752296 - DNA, 22 bp, Homo sapiens
agggcagagcactgaattggga

SEQ ID NO: 7752297 - DNA, 22 bp, Homo sapiens
agggcagagagatgaatgggat

SEQ ID NO: 7752298 - DNA, 19 bp, Homo sapiens
aggcttggattgtggccaa

SEQ ID NO: 7752299 - DNA, 21 bp, Homo sapiens
aggcttggatctagacaggcc

SEQ ID NO: 7752300 - DNA, 22 bp, Homo sapiens
aggcttggaagtggcagaactg

SEQ ID NO: 7752301 - DNA, 22 bp, Homo sapiens
agggaacaaaactctaaaattc

SEQ ID NO: 7752302 - DNA, 23 bp, Homo sapiens
agggaacaagcaagctgctagtc

SEQ ID NO: 7752303 - DNA, 22 bp, Homo sapiens
cccaggatgatcgagagtggga

SEQ ID NO: 7752304 - DNA, 22 bp, Homo sapiens
cccaggggaggtcctcagggaa

SEQ ID NO: 7752305 - DNA, 19 bp, Homo sapiens
cccaggggacccagcccta

SEQ ID NO: 7752306 - DNA, 22 bp, Homo sapiens
cccaggggtaaggcgcagcgtg

SEQ ID NO: 7752307 - DNA, 22 bp, Homo sapiens
ccaggaggaaattctaaaggta

SEQ ID NO: 7752308 - DNA, 22 bp, Homo sapiens
ccaggagctatgtacacactat

SEQ ID NO: 7752309 - DNA, 22 bp, Homo sapiens
ccagggtgaccagctggcctag

SEQ ID NO: 7752310 - DNA, 22 bp, Homo sapiens
ccagggtgagaaaaggctggat

SEQ ID NO: 7752311 - DNA, 22 bp, Homo sapiens
ccagggtgagtgtcatgggtta

SEQ ID NO: 7752312 - DNA, 22 bp, Homo sapiens
ccagggactttgcattgtttat

SEQ ID NO: 7752313 - DNA, 22 bp, Homo sapiens
ccagggaatctctgagtgtgtt

SEQ ID NO: 7752314 - DNA, 22 bp, Homo sapiens
ccagggaatcaggcagaagtca

SEQ ID NO: 7752315 - DNA, 22 bp, Homo sapiens
aggctgagtcgggaggatcact

SEQ ID NO: 7752316 - DNA, 22 bp, Homo sapiens
aggctgaggtaggaggatcgct

SEQ ID NO: 7752317 - DNA, 22 bp, Homo sapiens
aggctgaggtgtgctgtgatcg

SEQ ID NO: 7752318 - DNA, 22 bp, Homo sapiens
aggctctgtgatgtgccaggca

SEQ ID NO: 7752319 - DNA, 22 bp, Homo sapiens
aggctgaggcgggtagatcacc

SEQ ID NO: 7752320 - DNA, 22 bp, Homo sapiens
ccatggtctctgtgaagcctgt

SEQ ID NO: 7752321 - DNA, 22 bp, Homo sapiens
ccatgggcactgggtggaggta

SEQ ID NO: 7752322 - DNA, 22 bp, Homo sapiens
ccaggagagcattgcacagagg

SEQ ID NO: 7752323 - DNA, 22 bp, Homo sapiens
ccaggagagcagaagcccaggc

SEQ ID NO: 7752324 - DNA, 22 bp, Homo sapiens
aggccctggcactgcctgggag

SEQ ID NO: 7752325 - DNA, 22 bp, Homo sapiens
ccaggacaattcgtcactttct

SEQ ID NO: 7752326 - DNA, 22 bp, Homo sapiens
ccagcactgctctcagactgag

SEQ ID NO: 7752327 - DNA, 22 bp, Homo sapiens
aggcatggatggatccagggct

SEQ ID NO: 7752328 - DNA, 22 bp, Homo sapiens
aggcatggatgtagcagtgacc

SEQ ID NO: 7752329 - DNA, 22 bp, Homo sapiens
aggcatggcactgagcagcttc

SEQ ID NO: 7752330 - DNA, 22 bp, Homo sapiens
aggcatggacatttcggcagct

SEQ ID NO: 7752331 - DNA, 22 bp, Homo sapiens
aggcatgcaaacagtctagagt

SEQ ID NO: 7752332 - DNA, 22 bp, Homo sapiens
ccagagaaagtgaagcaaatgt

SEQ ID NO: 7752333 - DNA, 22 bp, Homo sapiens
caggaagagaacatggaggctg

SEQ ID NO: 7752334 - DNA, 22 bp, Homo sapiens
caggaaggcgcggctgtgcctg

SEQ ID NO: 7752335 - DNA, 22 bp, Homo sapiens
agctgatttttaggagacagga

SEQ ID NO: 7752336 - DNA, 22 bp, Homo sapiens
cagctgagaaggtctgatcagg

SEQ ID NO: 7752337 - DNA, 22 bp, Homo sapiens
caggagccccaggctgacaata

SEQ ID NO: 7752338 - DNA, 22 bp, Homo sapiens
caggaggattgcttgaggccag

SEQ ID NO: 7752339 - DNA, 22 bp, Homo sapiens
caggcacactgtctacactgag

SEQ ID NO: 7752340 - DNA, 22 bp, Homo sapiens
caggcactggccagtcagcaca

SEQ ID NO: 7752341 - DNA, 22 bp, Homo sapiens
agctgtgcacactgtgaagtag

SEQ ID NO: 7752342 - DNA, 22 bp, Homo sapiens
agctgtggaaatcaggcaatga

SEQ ID NO: 7752343 - DNA, 22 bp, Homo sapiens
agctgtggcagcagccgtggca

SEQ ID NO: 7752344 - DNA, 22 bp, Homo sapiens
caggctgctccagggtaggaaa

SEQ ID NO: 7752345 - DNA, 22 bp, Homo sapiens
caggcctgtctgcacatgaggc

SEQ ID NO: 7752346 - DNA, 18 bp, Homo sapiens
agctggggcctctggtcc

SEQ ID NO: 7752347 - DNA, 22 bp, Homo sapiens
caggctccactgtaggcagctc

SEQ ID NO: 7752348 - DNA, 22 bp, Homo sapiens
caggctcagctctggccagtgc

SEQ ID NO: 7752349 - DNA, 22 bp, Homo sapiens
caggctgctgcctagaatgaca

SEQ ID NO: 7752350 - DNA, 22 bp, Homo sapiens
caggctggacattagatacata

SEQ ID NO: 7752351 - DNA, 22 bp, Homo sapiens
cagggagaaatctccaggaggt

SEQ ID NO: 7752352 - DNA, 22 bp, Homo sapiens
cagggagctggctggctgtgcc

SEQ ID NO: 7752353 - DNA, 22 bp, Homo sapiens
cagggatgggatggagtcagtt

SEQ ID NO: 7752354 - DNA, 22 bp, Homo sapiens
cagggagctttcccaggaccct

SEQ ID NO: 7752355 - DNA, 19 bp, Homo sapiens
cagggatgggtagggactc

SEQ ID NO: 7752356 - DNA, 22 bp, Homo sapiens
cagggtgacaagtggcaaggag

SEQ ID NO: 7752357 - DNA, 22 bp, Homo sapiens
caggtgcaatgagacagctctg

SEQ ID NO: 7752358 - DNA, 22 bp, Homo sapiens
caggtcctttagtgtccagaac

SEQ ID NO: 7752359 - DNA, 22 bp, Homo sapiens
cagggtgcgccactcagatgta

SEQ ID NO: 7752360 - DNA, 22 bp, Homo sapiens
cagggtgcctgtcctcagcaaa

SEQ ID NO: 7752361 - DNA, 22 bp, Homo sapiens
cagggatgtgatgagctgagcc

SEQ ID NO: 7752362 - DNA, 22 bp, Homo sapiens
cagggcctcctaaggcatctaa

SEQ ID NO: 7752363 - DNA, 22 bp, Homo sapiens
cagggcctcgaagcctctgggc

SEQ ID NO: 7752364 - DNA, 22 bp, Homo sapiens
cagggcctctgtgggctctctc

SEQ ID NO: 7752365 - DNA, 22 bp, Homo sapiens
cagggcctgagggctgctctgc

SEQ ID NO: 7752366 - DNA, 22 bp, Homo sapiens
cagggcctgcaagagacctggg

SEQ ID NO: 7752367 - DNA, 22 bp, Homo sapiens
cagtgcctcaggccagcctgca

SEQ ID NO: 7752368 - DNA, 22 bp, Homo sapiens
aggagaagtaaggctagatgat

SEQ ID NO: 7752369 - DNA, 22 bp, Homo sapiens
cagtggccatggtggcaggggt

SEQ ID NO: 7752370 - DNA, 22 bp, Homo sapiens
aggaccctgaggtctcctgtga

SEQ ID NO: 7752371 - DNA, 22 bp, Homo sapiens
aggaccctgagcgggcatgccg

SEQ ID NO: 7752372 - DNA, 22 bp, Homo sapiens
aggaccctgctcaagcatctcc

SEQ ID NO: 7752373 - DNA, 22 bp, Homo sapiens
aggacccagaaggtgcagcaga

SEQ ID NO: 7752374 - DNA, 22 bp, Homo sapiens
aggaccagtatgagagcatctg

SEQ ID NO: 7752375 - DNA, 22 bp, Homo sapiens
aggaccagcctccaggtctctt

SEQ ID NO: 7752376 - DNA, 22 bp, Homo sapiens
aggacatgtgcctccagggcag

SEQ ID NO: 7752377 - DNA, 22 bp, Homo sapiens
caggtgcagctggatggaagcc

SEQ ID NO: 7752378 - DNA, 22 bp, Homo sapiens
cagttttatacactgcagctcc

SEQ ID NO: 7752379 - DNA, 22 bp, Homo sapiens
cagttttatgaatgcttattag

SEQ ID NO: 7752380 - DNA, 22 bp, Homo sapiens
cagttttatcatctgtgaaatg

SEQ ID NO: 7752381 - DNA, 22 bp, Homo sapiens
cagttttatgtcgaatgtatac

SEQ ID NO: 7752382 - DNA, 22 bp, Homo sapiens
aggagggagcttaagccaggca

SEQ ID NO: 7752383 - DNA, 22 bp, Homo sapiens
cagtttatattctagtgctgtt

SEQ ID NO: 7752384 - DNA, 22 bp, Homo sapiens
cagttctggaggatagaagtct

SEQ ID NO: 7752385 - DNA, 22 bp, Homo sapiens
cagtttatgcagctggaataga

SEQ ID NO: 7752386 - DNA, 22 bp, Homo sapiens
cagtttatttccaagatgacaa

SEQ ID NO: 7752387 - DNA, 22 bp, Homo sapiens
cagttttaaattttgaatgtct

SEQ ID NO: 7752388 - DNA, 22 bp, Homo sapiens
cagttttaaattgttagataat

SEQ ID NO: 7752389 - DNA, 22 bp, Homo sapiens
cagttttacccaagcttatttt

SEQ ID NO: 7752390 - DNA, 16 bp, Homo sapiens
cagttttaaggcccaa

SEQ ID NO: 7752391 - DNA, 22 bp, Homo sapiens
cagttttagctagagcaaacca

SEQ ID NO: 7752392 - DNA, 22 bp, Homo sapiens
cagttttaggacatgtggatgt

SEQ ID NO: 7752393 - DNA, 22 bp, Homo sapiens
cagttttagggcaatgtgaaga

SEQ ID NO: 7752394 - DNA, 22 bp, Homo sapiens
catgggctgtgaacccaggctg

SEQ ID NO: 7752395 - DNA, 22 bp, Homo sapiens
catgggcttgctctctgagctc

SEQ ID NO: 7752396 - DNA, 22 bp, Homo sapiens
aggatttcccatatagctccat

SEQ ID NO: 7752397 - DNA, 22 bp, Homo sapiens
aggatttctgtgcctggaaaat

SEQ ID NO: 7752398 - DNA, 22 bp, Homo sapiens
catgtcaaccaagatgagatat

SEQ ID NO: 7752399 - DNA, 22 bp, Homo sapiens
catgtcaacaggcccagaaaat

SEQ ID NO: 7752400 - DNA, 22 bp, Homo sapiens
catggcactgagcaggtatgca

SEQ ID NO: 7752401 - DNA, 22 bp, Homo sapiens
catgctaaccagagacataaag

SEQ ID NO: 7752402 - DNA, 22 bp, Homo sapiens
catggacagtgggacagtgtgt

SEQ ID NO: 7752403 - DNA, 22 bp, Homo sapiens
catttgaaatagttcattcttg

SEQ ID NO: 7752404 - DNA, 22 bp, Homo sapiens
ccaagctgactgtgctgttgtg

SEQ ID NO: 7752405 - DNA, 22 bp, Homo sapiens
aggtttatgtttggtgcaggag

SEQ ID NO: 7752406 - DNA, 22 bp, Homo sapiens
aggtttattatagaggatgacg

SEQ ID NO: 7752407 - DNA, 22 bp, Homo sapiens
cctttaggagtgaggaccgagc

SEQ ID NO: 7752408 - DNA, 22 bp, Homo sapiens
cctttatactaaggcatacaat

SEQ ID NO: 7752409 - DNA, 17 bp, Homo sapiens
aggtgtggtcaagggag

SEQ ID NO: 7752410 - DNA, 19 bp, Homo sapiens
aggtgtgggggctgcagac

SEQ ID NO: 7752411 - DNA, 22 bp, Homo sapiens
aggtgtgggaaacgggtgacct

SEQ ID NO: 7752412 - DNA, 22 bp, Homo sapiens
aggtgtggctggggcagaggcc

SEQ ID NO: 7752413 - DNA, 22 bp, Homo sapiens
ctacacagagcctacttctgca

SEQ ID NO: 7752414 - DNA, 22 bp, Homo sapiens
agtcagagtcgccgacagtcaa

SEQ ID NO: 7752415 - DNA, 22 bp, Homo sapiens
ctacagaagaaactatcactat

SEQ ID NO: 7752416 - DNA, 22 bp, Homo sapiens
ctacagaaacctttttcataca

SEQ ID NO: 7752417 - DNA, 21 bp, Homo sapiens
ctacacagctttctataggaa

SEQ ID NO: 7752418 - DNA, 22 bp, Homo sapiens
ctacaccggagcctggaaggta

SEQ ID NO: 7752419 - DNA, 22 bp, Homo sapiens
ctacacagttctgcctaatggc

SEQ ID NO: 7752420 - DNA, 20 bp, Homo sapiens
cgtgctgtgaccttgagcat

SEQ ID NO: 7752421 - DNA, 22 bp, Homo sapiens
cgcggtctcagccgctcgcagc

SEQ ID NO: 7752422 - DNA, 22 bp, Homo sapiens
cgcggtctctttaaggcgggtc

SEQ ID NO: 7752423 - DNA, 22 bp, Homo sapiens
cgctcacccgcccgcctgttgt

SEQ ID NO: 7752424 - DNA, 18 bp, Homo sapiens
cgctcaccaggtaagtct

SEQ ID NO: 7752425 - DNA, 22 bp, Homo sapiens
aggtgagggtgccagtgcatgg

SEQ ID NO: 7752426 - DNA, 22 bp, Homo sapiens
aggtctggtgttgggcctgaaa

SEQ ID NO: 7752427 - DNA, 22 bp, Homo sapiens
aggtctggtgagagcaggtgct

SEQ ID NO: 7752428 - DNA, 22 bp, Homo sapiens
aggtctgggcaccactggctgc

SEQ ID NO: 7752429 - DNA, 22 bp, Homo sapiens
aggtctggaggcggagtcagga

SEQ ID NO: 7752430 - DNA, 22 bp, Homo sapiens
aggtctggaaacagcagggaga

SEQ ID NO: 7752431 - DNA, 18 bp, Homo sapiens
aggtctgaggaagagcct

SEQ ID NO: 7752432 - DNA, 22 bp, Homo sapiens
cctggtcccattgcggctgcct

SEQ ID NO: 7752433 - DNA, 20 bp, Homo sapiens
aggtgcaaggcatggcatgt

SEQ ID NO: 7752434 - DNA, 22 bp, Homo sapiens
aggtagtgtagctgagtgggat

SEQ ID NO: 7752435 - DNA, 23 bp, Homo sapiens
agggtgagcaagctatggagacc

SEQ ID NO: 7752436 - DNA, 17 bp, Homo sapiens
agggggaacctgggagg

SEQ ID NO: 7752437 - DNA, 22 bp, Homo sapiens
agggtgctgccggacaggtggg

SEQ ID NO: 7752438 - DNA, 22 bp, Homo sapiens
agtgcacagcgtgatgtattgg

SEQ ID NO: 7752439 - DNA, 20 bp, Homo sapiens
ctccatgacttgaattagta

SEQ ID NO: 7752440 - DNA, 22 bp, Homo sapiens
agtgacagtctgatttctcaaa

SEQ ID NO: 7752441 - DNA, 22 bp, Homo sapiens
ctcctccctctttgccacacat

SEQ ID NO: 7752442 - DNA, 22 bp, Homo sapiens
ctcctccctgcgattgctctgc

SEQ ID NO: 7752443 - DNA, 22 bp, Homo sapiens
agtgggctgtaatttaggaatg

SEQ ID NO: 7752444 - DNA, 22 bp, Homo sapiens
agtgggctgagcttgctgggtg

SEQ ID NO: 7752445 - DNA, 22 bp, Homo sapiens
ctctgagatgataccttctgga

SEQ ID NO: 7752446 - DNA, 22 bp, Homo sapiens
ctctgagatgcttgaagaggat

SEQ ID NO: 7752447 - DNA, 22 bp, Homo sapiens
ctctgagacttttcacctccca

SEQ ID NO: 7752448 - DNA, 22 bp, Homo sapiens
ctctgagaggctgccctgccat

SEQ ID NO: 7752449 - DNA, 22 bp, Homo sapiens
ctctgagaggatcctgcccggg

SEQ ID NO: 7752450 - DNA, 22 bp, Homo sapiens
ctctgagaaagctgtgagctaa

SEQ ID NO: 7752451 - DNA, 22 bp, Homo sapiens
ctctgagaatatgagctctttg

SEQ ID NO: 7752452 - DNA, 22 bp, Homo sapiens
ctctgagaatataagactattt

SEQ ID NO: 7752453 - DNA, 22 bp, Homo sapiens
ctctgagacttagcatctacat

SEQ ID NO: 7752454 - DNA, 22 bp, Homo sapiens
ctctctggtcccagattccaga

SEQ ID NO: 7752455 - DNA, 22 bp, Homo sapiens
ctctctgggcccagttggcacc

SEQ ID NO: 7752456 - DNA, 18 bp, Homo sapiens
ctctctgggtgaggacaa

SEQ ID NO: 7752457 - DNA, 22 bp, Homo sapiens
ctctctgggtcctcttttatag

SEQ ID NO: 7752458 - DNA, 20 bp, Homo sapiens
ctcttaaatgtaaagtaggc

SEQ ID NO: 7752459 - DNA, 22 bp, Homo sapiens
agttttctgctaaaccagctaa

SEQ ID NO: 7752460 - DNA, 22 bp, Homo sapiens
agttttcattaccatgctgcaa

SEQ ID NO: 7752461 - DNA, 22 bp, Homo sapiens
agttttcacactcaccaaaagg

SEQ ID NO: 7752462 - DNA, 20 bp, Homo sapiens
agttttcagcagaacaccca

SEQ ID NO: 7752463 - DNA, 22 bp, Homo sapiens
ctgccctgtctgcagcctggct

SEQ ID NO: 7752464 - DNA, 22 bp, Homo sapiens
ataagcctgattcacttgtcat

SEQ ID NO: 7752465 - DNA, 22 bp, Homo sapiens
ataagctctggacagccacatt

SEQ ID NO: 7752466 - DNA, 22 bp, Homo sapiens
ataataatactgtgcaatggat

SEQ ID NO: 7752467 - DNA, 23 bp, Homo sapiens
ataataattatggcagcaaagtg

SEQ ID NO: 7752468 - DNA, 22 bp, Homo sapiens
ataataatgaaagccactgtgt

SEQ ID NO: 7752469 - DNA, 18 bp, Homo sapiens
ctgcctgctctccagctt

SEQ ID NO: 7752470 - DNA, 22 bp, Homo sapiens
ctgcctgctgacattctttata

SEQ ID NO: 7752471 - DNA, 22 bp, Homo sapiens
agtttatttctccatttaccta

SEQ ID NO: 7752472 - DNA, 22 bp, Homo sapiens
agtttcacagagggttagacgc

SEQ ID NO: 7752473 - DNA, 22 bp, Homo sapiens
agtttcacagtctgtcattgtt

SEQ ID NO: 7752474 - DNA, 22 bp, Homo sapiens
agtttcacagaatatgaaggtt

SEQ ID NO: 7752475 - DNA, 21 bp, Homo sapiens
agtttcacagaggggccgtcc

SEQ ID NO: 7752476 - DNA, 22 bp, Homo sapiens
agtttcacaaattgtcaatagc

SEQ ID NO: 7752477 - DNA, 22 bp, Homo sapiens
agtttcacacaacatttgcatg

SEQ ID NO: 7752478 - DNA, 22 bp, Homo sapiens
agtttatttttgataagtcttg

SEQ ID NO: 7752479 - DNA, 22 bp, Homo sapiens
agtttattctgcttggccctcc

SEQ ID NO: 7752480 - DNA, 22 bp, Homo sapiens
agtttattctctggtcttagta

SEQ ID NO: 7752481 - DNA, 17 bp, Homo sapiens
agtttatttagccttct

SEQ ID NO: 7752482 - DNA, 22 bp, Homo sapiens
agtttattgtatatggtagttt

SEQ ID NO: 7752483 - DNA, 22 bp, Homo sapiens
agtgttcatttattcattcact

SEQ ID NO: 7752484 - DNA, 23 bp, Homo sapiens
agtgttccagttggttgagagtg

SEQ ID NO: 7752485 - DNA, 19 bp, Homo sapiens
agtttattataggtgattc

SEQ ID NO: 7752486 - DNA, 20 bp, Homo sapiens
agtttattccaggagaactg

SEQ ID NO: 7752487 - DNA, 22 bp, Homo sapiens
agtttatgtagaattggcaata

SEQ ID NO: 7752488 - DNA, 22 bp, Homo sapiens
agtttatgtctttacttcagct

SEQ ID NO: 7752489 - DNA, 22 bp, Homo sapiens
agtttatgtgtaagacagctgt

SEQ ID NO: 7752490 - DNA, 22 bp, Homo sapiens
agtttatgttgtttataagcca

SEQ ID NO: 7752491 - DNA, 21 bp, Homo sapiens
agtgttataggagcagggaaa

SEQ ID NO: 7752492 - DNA, 22 bp, Homo sapiens
agttttatgttcacagaaggat

SEQ ID NO: 7752493 - DNA, 22 bp, Homo sapiens
ctgatattattgaagctggagt

SEQ ID NO: 7752494 - DNA, 22 bp, Homo sapiens
ctgatattcattatggagctcc

SEQ ID NO: 7752495 - DNA, 22 bp, Homo sapiens
ctgatattctattttgcttgct

SEQ ID NO: 7752496 - DNA, 22 bp, Homo sapiens
ctgatattctttgagctgctaa

SEQ ID NO: 7752497 - DNA, 22 bp, Homo sapiens
agttttattaaatccacagaag

SEQ ID NO: 7752498 - DNA, 22 bp, Homo sapiens
agttttattccaatgtgcagca

SEQ ID NO: 7752499 - DNA, 22 bp, Homo sapiens
agttttattgtcccagaggtga

SEQ ID NO: 7752500 - DNA, 22 bp, Homo sapiens
ctgatatgatgggtgattttca

SEQ ID NO: 7752501 - DNA, 22 bp, Homo sapiens
ctgagtgggtttctgcttgtca

SEQ ID NO: 7752502 - DNA, 23 bp, Homo sapiens
agtttcacattttacatgtggct

SEQ ID NO: 7752503 - DNA, 22 bp, Homo sapiens
agtttcactaaggtctgtgtgt

SEQ ID NO: 7752504 - DNA, 22 bp, Homo sapiens
agtttcacatagctcagtgctc

SEQ ID NO: 7752505 - DNA, 22 bp, Homo sapiens
agtttcacatgcatggatgtgt

SEQ ID NO: 7752506 - DNA, 22 bp, Homo sapiens
atagggcctaaaaagtattgct

SEQ ID NO: 7752507 - DNA, 22 bp, Homo sapiens
atagggaaattgatgtcccgag

SEQ ID NO: 7752508 - DNA, 22 bp, Homo sapiens
atagcagtggatgtggagaaag

SEQ ID NO: 7752509 - DNA, 21 bp, Homo sapiens
ctggaacaaatactagcaaac

SEQ ID NO: 7752510 - DNA, 22 bp, Homo sapiens
atacagaagcctgtatttctgg

SEQ ID NO: 7752511 - DNA, 21 bp, Homo sapiens
atacagaaggcagactctctc

SEQ ID NO: 7752512 - DNA, 22 bp, Homo sapiens
atacagaactctcagttgtata

SEQ ID NO: 7752513 - DNA, 21 bp, Homo sapiens
atacagaacattgatccaaga

SEQ ID NO: 7752514 - DNA, 22 bp, Homo sapiens
ctgtgccttggcgctgtgccac

SEQ ID NO: 7752515 - DNA, 22 bp, Homo sapiens
ctgtgcctgcaggccacatcaa

SEQ ID NO: 7752516 - DNA, 20 bp, Homo sapiens
ctgtgcctaaacctccgggt

SEQ ID NO: 7752517 - DNA, 22 bp, Homo sapiens
ctgtgcctaagatgcatgtctc

SEQ ID NO: 7752518 - DNA, 22 bp, Homo sapiens
atcattaaatataagcttcaca

SEQ ID NO: 7752519 - DNA, 21 bp, Homo sapiens
cttcagcaaatacttggcagg

SEQ ID NO: 7752520 - DNA, 22 bp, Homo sapiens
cttcagcaactttggaatgttt

SEQ ID NO: 7752521 - DNA, 22 bp, Homo sapiens
cttcagcaccatagctccttct

SEQ ID NO: 7752522 - DNA, 22 bp, Homo sapiens
cttcagcagatgtgctagagat

SEQ ID NO: 7752523 - DNA, 22 bp, Homo sapiens
cttcagcacctcagctggagag

SEQ ID NO: 7752524 - DNA, 22 bp, Homo sapiens
cttcagcagatgcaaaacccct

SEQ ID NO: 7752525 - DNA, 23 bp, Homo sapiens
cttcagcagaaacataaattctc

SEQ ID NO: 7752526 - DNA, 22 bp, Homo sapiens
cttcagcatctttttcttgggg

SEQ ID NO: 7752527 - DNA, 19 bp, Homo sapiens
cttcagcatctccggagct

SEQ ID NO: 7752528 - DNA, 22 bp, Homo sapiens
cttcagcagcctcttgcataaa

SEQ ID NO: 7752529 - DNA, 22 bp, Homo sapiens
ctgggctgtcaatggccctctg

SEQ ID NO: 7752530 - DNA, 22 bp, Homo sapiens
ctgggctgtcccagggcggcag

SEQ ID NO: 7752531 - DNA, 21 bp, Homo sapiens
ctgtccaaatttcataacttt

SEQ ID NO: 7752532 - DNA, 22 bp, Homo sapiens
atattttccgaacttgaggtag

SEQ ID NO: 7752533 - DNA, 22 bp, Homo sapiens
atattttcactgaaccaaagta

SEQ ID NO: 7752534 - DNA, 22 bp, Homo sapiens
atatttgtttggcagagttcag

SEQ ID NO: 7752535 - DNA, 22 bp, Homo sapiens
ctgtatgaaattgtcattttta

SEQ ID NO: 7752536 - DNA, 22 bp, Homo sapiens
ctgtatgattccatttctataa

SEQ ID NO: 7752537 - DNA, 22 bp, Homo sapiens
ctgggccagttatgtctcatct

SEQ ID NO: 7752538 - DNA, 17 bp, Homo sapiens
ctgggcctctgcccttt

SEQ ID NO: 7752539 - DNA, 20 bp, Homo sapiens
ctgggctgggctacagggtc

SEQ ID NO: 7752540 - DNA, 22 bp, Homo sapiens
ctgggcctggggctgttgagag

SEQ ID NO: 7752541 - DNA, 22 bp, Homo sapiens
ctgggctgcagcgggagcgacg

SEQ ID NO: 7752542 - DNA, 22 bp, Homo sapiens
ctgggctgggtttaccctcttc

SEQ ID NO: 7752543 - DNA, 22 bp, Homo sapiens
ctgggcctggagcccacgagcc

SEQ ID NO: 7752544 - DNA, 22 bp, Homo sapiens
ctgggcctggacgggcagatct

SEQ ID NO: 7752545 - DNA, 22 bp, Homo sapiens
ctgggcctgggaggccaggtct

SEQ ID NO: 7752546 - DNA, 22 bp, Homo sapiens
ctgggcctgccaccatcttagg

SEQ ID NO: 7752547 - DNA, 19 bp, Homo sapiens
ctgggcctgcatggttgtt

SEQ ID NO: 7752548 - DNA, 22 bp, Homo sapiens
ctgggcctgagctctgaagagt

SEQ ID NO: 7752549 - DNA, 22 bp, Homo sapiens
atagtcactgccttccatttgt

SEQ ID NO: 7752550 - DNA, 22 bp, Homo sapiens
gcagggcagtgtgtctgtgggg

SEQ ID NO: 7752551 - DNA, 22 bp, Homo sapiens
gcagggcatccctgagcgggtg

SEQ ID NO: 7752552 - DNA, 22 bp, Homo sapiens
gcagggcaaacccaggtgttca

SEQ ID NO: 7752553 - DNA, 22 bp, Homo sapiens
attgcaagtgctagctaaaata

SEQ ID NO: 7752554 - DNA, 22 bp, Homo sapiens
gcatggcaaatatcgagggcag

SEQ ID NO: 7752555 - DNA, 22 bp, Homo sapiens
attctcagttcactagtttctt

SEQ ID NO: 7752556 - DNA, 22 bp, Homo sapiens
attctcatttgctggctatatg

SEQ ID NO: 7752557 - DNA, 22 bp, Homo sapiens
gcaggcaggaaggactaagtaa

SEQ ID NO: 7752558 - DNA, 22 bp, Homo sapiens
gcaggcaattttggaaggtcag

SEQ ID NO: 7752559 - DNA, 22 bp, Homo sapiens
gattcctttcgcctgccgagct

SEQ ID NO: 7752560 - DNA, 22 bp, Homo sapiens
gattccttggctctgtctcagg

SEQ ID NO: 7752561 - DNA, 22 bp, Homo sapiens
gattccttccctacccaggcct

SEQ ID NO: 7752562 - DNA, 22 bp, Homo sapiens
gatggcacacagacatccccgc

SEQ ID NO: 7752563 - DNA, 22 bp, Homo sapiens
gatggcaggtagtggtctcatc

SEQ ID NO: 7752564 - DNA, 22 bp, Homo sapiens
gatggcaggtgatagccgagtc

SEQ ID NO: 7752565 - DNA, 21 bp, Homo sapiens
atgttattctgttcctccagc

SEQ ID NO: 7752566 - DNA, 22 bp, Homo sapiens
gcacacagctagattaccattc

SEQ ID NO: 7752567 - DNA, 22 bp, Homo sapiens
gcacacagccagctgagggcta

SEQ ID NO: 7752568 - DNA, 22 bp, Homo sapiens
gcacacaggcagtttccagcca

SEQ ID NO: 7752569 - DNA, 22 bp, Homo sapiens
gcacacagactaaccatatttc

SEQ ID NO: 7752570 - DNA, 22 bp, Homo sapiens
gcacacagagaggtggtatgtc

SEQ ID NO: 7752571 - DNA, 22 bp, Homo sapiens
gcacacagattaggaaacagaa

SEQ ID NO: 7752572 - DNA, 16 bp, Homo sapiens
gcacacagccagcctt

SEQ ID NO: 7752573 - DNA, 22 bp, Homo sapiens
gcaccaggcttagagccccagg

SEQ ID NO: 7752574 - DNA, 22 bp, Homo sapiens
gcacacagaattgattcactgt

SEQ ID NO: 7752575 - DNA, 22 bp, Homo sapiens
attatcacaggtgagtctcact

SEQ ID NO: 7752576 - DNA, 22 bp, Homo sapiens
attatcacatggactttgcttt

SEQ ID NO: 7752577 - DNA, 19 bp, Homo sapiens
gcagagatgtggtagcttg

SEQ ID NO: 7752578 - DNA, 22 bp, Homo sapiens
gcagagactccactgtcttgtg

SEQ ID NO: 7752579 - DNA, 22 bp, Homo sapiens
gcagagagttgggctgcgccag

SEQ ID NO: 7752580 - DNA, 22 bp, Homo sapiens
gcagagaggaatgaagccatcc

SEQ ID NO: 7752581 - DNA, 22 bp, Homo sapiens
gcacccagaataaggacaggac

SEQ ID NO: 7752582 - DNA, 22 bp, Homo sapiens
atttattaagcatctgctatgt

SEQ ID NO: 7752583 - DNA, 22 bp, Homo sapiens
atttattatgggatttggcaca

SEQ ID NO: 7752584 - DNA, 22 bp, Homo sapiens
atttattatgggatttggcaca

SEQ ID NO: 7752585 - DNA, 22 bp, Homo sapiens
atttattacctcggagtttctg

SEQ ID NO: 7752586 - DNA, 20 bp, Homo sapiens
gcatggcatgtagtgaagtg

SEQ ID NO: 7752587 - DNA, 22 bp, Homo sapiens
gcatggcatttgaaggtagaag

SEQ ID NO: 7752588 - DNA, 18 bp, Homo sapiens
gccagccaggcgttgctc

SEQ ID NO: 7752589 - DNA, 22 bp, Homo sapiens
gccagccataggccagcactgg

SEQ ID NO: 7752590 - DNA, 22 bp, Homo sapiens
gcccagggtgaagtgcagttgt

SEQ ID NO: 7752591 - DNA, 22 bp, Homo sapiens
gcccagggtgcttagaacccat

SEQ ID NO: 7752592 - DNA, 22 bp, Homo sapiens
gccatgactctccataccaaag

SEQ ID NO: 7752593 - DNA, 22 bp, Homo sapiens
gccctggggaaggtgtctccaa

SEQ ID NO: 7752594 - DNA, 22 bp, Homo sapiens
gccctgggctccctgctccaca

SEQ ID NO: 7752595 - DNA, 22 bp, Homo sapiens
atttgtatcaatctcaatatat

SEQ ID NO: 7752596 - DNA, 21 bp, Homo sapiens
attttcattaattcagtgtgg

SEQ ID NO: 7752597 - DNA, 22 bp, Homo sapiens
attttcatgactaccttaaata

SEQ ID NO: 7752598 - DNA, 22 bp, Homo sapiens
caaaagcagttctatctgagtt

SEQ ID NO: 7752599 - DNA, 22 bp, Homo sapiens
caaaagcaaagtccctgaatgt

SEQ ID NO: 7752600 - DNA, 22 bp, Homo sapiens
attttgatgctatctaatgaat

SEQ ID NO: 7752601 - DNA, 22 bp, Homo sapiens
gaagctggagaatgggtctagg

SEQ ID NO: 7752602 - DNA, 22 bp, Homo sapiens
gaagctggggtgctgagggcaa

SEQ ID NO: 7752603 - DNA, 22 bp, Homo sapiens
atgagcccagggaattcctttc

SEQ ID NO: 7752604 - DNA, 22 bp, Homo sapiens
atgagcccagaaatctcccttt

SEQ ID NO: 7752605 - DNA, 22 bp, Homo sapiens
atgagcagtaggttcatggctg

SEQ ID NO: 7752606 - DNA, 22 bp, Homo sapiens
atgagcagtttttaagtagcaa

SEQ ID NO: 7752607 - DNA, 22 bp, Homo sapiens
atgatgttgataaattacttta

SEQ ID NO: 7752608 - DNA, 22 bp, Homo sapiens
atgatgttaccagtacttagag

SEQ ID NO: 7752609 - DNA, 20 bp, Homo sapiens
gaagtcatatgaagcagctt

SEQ ID NO: 7752610 - DNA, 22 bp, Homo sapiens
gaagtacattctgatagggaag

SEQ ID NO: 7752611 - DNA, 22 bp, Homo sapiens
gaagtacacgtgtaagcttttc

SEQ ID NO: 7752612 - DNA, 21 bp, Homo sapiens
gaagtacaccaggaaggccac

SEQ ID NO: 7752613 - DNA, 22 bp, Homo sapiens
gaagtacagaaaggggcccctt

SEQ ID NO: 7752614 - DNA, 22 bp, Homo sapiens
gaagtacaggttgtgagagaat

SEQ ID NO: 7752615 - DNA, 22 bp, Homo sapiens
gaagtacaggggttcttaggta

SEQ ID NO: 7752616 - DNA, 22 bp, Homo sapiens
gaagtacagttttatctagcca

SEQ ID NO: 7752617 - DNA, 22 bp, Homo sapiens
gaagtacactactccttgagtc

SEQ ID NO: 7752618 - DNA, 22 bp, Homo sapiens
atctttctctgcactatacaat

SEQ ID NO: 7752619 - DNA, 22 bp, Homo sapiens
atctttctccatatacatcttt

SEQ ID NO: 7752620 - DNA, 22 bp, Homo sapiens
atctttctatggtactttctcc

SEQ ID NO: 7752621 - DNA, 22 bp, Homo sapiens
atctggagaataaatgtccaag

SEQ ID NO: 7752622 - DNA, 22 bp, Homo sapiens
atctttgatgtgtgcccattca

SEQ ID NO: 7752623 - DNA, 22 bp, Homo sapiens
atctttgattgaagggaccctg

SEQ ID NO: 7752624 - DNA, 22 bp, Homo sapiens
atctttgactgccattcttgac

SEQ ID NO: 7752625 - DNA, 22 bp, Homo sapiens
atctttgaagaggacttgaagt

SEQ ID NO: 7752626 - DNA, 22 bp, Homo sapiens
atctttgaatcaatgaatcagt

SEQ ID NO: 7752627 - DNA, 21 bp, Homo sapiens
atctttgaagcatgcagtgag

SEQ ID NO: 7752628 - DNA, 22 bp, Homo sapiens
atctttgatgactaatgctttg

SEQ ID NO: 7752629 - DNA, 22 bp, Homo sapiens
atctttgatctttattgctaag

SEQ ID NO: 7752630 - DNA, 22 bp, Homo sapiens
cttgttttaaactgttgtggct

SEQ ID NO: 7752631 - DNA, 17 bp, Homo sapiens
cttgttttccactggga

SEQ ID NO: 7752632 - DNA, 22 bp, Homo sapiens
ctttattagatgtagactttct

SEQ ID NO: 7752633 - DNA, 22 bp, Homo sapiens
ctttattagatgtagactttct

SEQ ID NO: 7752634 - DNA, 22 bp, Homo sapiens
atgagcaggaagagcacaaaga

SEQ ID NO: 7752635 - DNA, 22 bp, Homo sapiens
atgagatgtgtctaatggaacc

SEQ ID NO: 7752636 - DNA, 22 bp, Homo sapiens
gagcacagcagggctctgggtg

SEQ ID NO: 7752637 - DNA, 22 bp, Homo sapiens
atggcagacgaggcagcagggg

SEQ ID NO: 7752638 - DNA, 22 bp, Homo sapiens
atggcagagaaagcgagccaca

SEQ ID NO: 7752639 - DNA, 22 bp, Homo sapiens
gagaatattagagttagtttat

SEQ ID NO: 7752640 - DNA, 22 bp, Homo sapiens
gagaatatcttggcagtctctg

SEQ ID NO: 7752641 - DNA, 22 bp, Homo sapiens
gagaatatttttagctttcctc

SEQ ID NO: 7752642 - DNA, 22 bp, Homo sapiens
gagacaggcagctagtgggtca

SEQ ID NO: 7752643 - DNA, 22 bp, Homo sapiens
atggcacagatgttctgattat

SEQ ID NO: 7752644 - DNA, 22 bp, Homo sapiens
atggcacagattagggtcacag

SEQ ID NO: 7752645 - DNA, 22 bp, Homo sapiens
atggcagacctcctggccacaa

SEQ ID NO: 7752646 - DNA, 22 bp, Homo sapiens
atggcagaattaggatttcaag

SEQ ID NO: 7752647 - DNA, 22 bp, Homo sapiens
atggcagacacaggcaggcaga

SEQ ID NO: 7752648 - DNA, 22 bp, Homo sapiens
atggcagaatcaagccgacagc

SEQ ID NO: 7752649 - DNA, 22 bp, Homo sapiens
gagaaggggtgatgtgggtaat

SEQ ID NO: 7752650 - DNA, 22 bp, Homo sapiens
gagaaggtggacctgaaggagc

SEQ ID NO: 7752651 - DNA, 22 bp, Homo sapiens
atgcttaactctgtacatagtt

SEQ ID NO: 7752652 - DNA, 22 bp, Homo sapiens
atgcttaaccttggtgtacaat

SEQ ID NO: 7752653 - DNA, 22 bp, Homo sapiens
atgctgggaaactgaaaggaat

SEQ ID NO: 7752654 - DNA, 22 bp, Homo sapiens
gaggttggcgccctgcctggcc

SEQ ID NO: 7752655 - DNA, 22 bp, Homo sapiens
atgtattatggttttccttaag

SEQ ID NO: 7752656 - DNA, 22 bp, Homo sapiens
gaggcacagagtaggtgcacac

SEQ ID NO: 7752657 - DNA, 22 bp, Homo sapiens
gaggcacagagccctaggagct

SEQ ID NO: 7752658 - DNA, 22 bp, Homo sapiens
gaggcacaccagggagtcttgt

SEQ ID NO: 7752659 - DNA, 22 bp, Homo sapiens
gaggcacagttcttcctccaga

SEQ ID NO: 7752660 - DNA, 22 bp, Homo sapiens
gaggcacagtgtttggtcagtg

SEQ ID NO: 7752661 - DNA, 22 bp, Homo sapiens
gaggcacagtcccgaggcaagg

SEQ ID NO: 7752662 - DNA, 22 bp, Homo sapiens
atgtagctgcagatgataatgc

SEQ ID NO: 7752663 - DNA, 18 bp, Homo sapiens
gaggcacatagttggggc

SEQ ID NO: 7752664 - DNA, 22 bp, Homo sapiens
gaggcacatatatacagagccc

SEQ ID NO: 7752665 - DNA, 22 bp, Homo sapiens
cagatttcatgcgaaatggggt

SEQ ID NO: 7752666 - DNA, 22 bp, Homo sapiens
cagatttctatttcaaatacat

SEQ ID NO: 7752667 - DNA, 22 bp, Homo sapiens
cagatttctttagcaagctaag

SEQ ID NO: 7752668 - DNA, 20 bp, Homo sapiens
cagcaaaatgaaaatggatt

SEQ ID NO: 7752669 - DNA, 22 bp, Homo sapiens
cagcagcagccccaggaaggtt

SEQ ID NO: 7752670 - DNA, 22 bp, Homo sapiens
cagcagccactagagggctcac

SEQ ID NO: 7752671 - DNA, 22 bp, Homo sapiens
cagcagccgagagggggctctg

SEQ ID NO: 7752672 - DNA, 22 bp, Homo sapiens
gtacacactgtttgatcatttc

SEQ ID NO: 7752673 - DNA, 22 bp, Homo sapiens
gtacacactatttaaagtgttt

SEQ ID NO: 7752674 - DNA, 22 bp, Homo sapiens
gtacacactatgtattgtacac

SEQ ID NO: 7752675 - DNA, 22 bp, Homo sapiens
gtactagatgagacagcgtggg

SEQ ID NO: 7752676 - DNA, 22 bp, Homo sapiens
gtacttgaaatgtccctccatt

SEQ ID NO: 7752677 - DNA, 22 bp, Homo sapiens
cagcatctcctgtgcagaggga

SEQ ID NO: 7752678 - DNA, 22 bp, Homo sapiens
gtcacagggtccccatatggag

SEQ ID NO: 7752679 - DNA, 22 bp, Homo sapiens
gtcacaggcctggatgaggggc

SEQ ID NO: 7752680 - DNA, 22 bp, Homo sapiens
gtcacaggaagcagcaggcact

SEQ ID NO: 7752681 - DNA, 22 bp, Homo sapiens
gtattttatggcatgcagtggc

SEQ ID NO: 7752682 - DNA, 22 bp, Homo sapiens
gtgagcagaataagggttgaga

SEQ ID NO: 7752683 - DNA, 22 bp, Homo sapiens
gtgagcagacatcaaaggctgc

SEQ ID NO: 7752684 - DNA, 23 bp, Homo sapiens
gtgagcagcccactaggaatgcc

SEQ ID NO: 7752685 - DNA, 23 bp, Homo sapiens
gtgagcagcaccatgaggctaga

SEQ ID NO: 7752686 - DNA, 22 bp, Homo sapiens
gtgagcagagatcgcgtgattg

SEQ ID NO: 7752687 - DNA, 22 bp, Homo sapiens
gggtacagttcttccagtgtca

SEQ ID NO: 7752688 - DNA, 18 bp, Homo sapiens
gggtcctgttcttggaag

SEQ ID NO: 7752689 - DNA, 19 bp, Homo sapiens
cagatgttttcagttcatt

SEQ ID NO: 7752690 - DNA, 22 bp, Homo sapiens
cagatgttgttcctgcctgtag

SEQ ID NO: 7752691 - DNA, 22 bp, Homo sapiens
cagatgttattaacggctgtag

SEQ ID NO: 7752692 - DNA, 22 bp, Homo sapiens
ggtcaagacgggctctgccctt

SEQ ID NO: 7752693 - DNA, 22 bp, Homo sapiens
ggtcaacactgtgaccaacagg

SEQ ID NO: 7752694 - DNA, 22 bp, Homo sapiens
ggtcaaagttgaagaagggcat

SEQ ID NO: 7752695 - DNA, 22 bp, Homo sapiens
ggtcaaagtgaggagtcaggtt

SEQ ID NO: 7752696 - DNA, 22 bp, Homo sapiens
gggctggagttgggaagacaaa

SEQ ID NO: 7752697 - DNA, 18 bp, Homo sapiens
gggctgtgagatgggaag

SEQ ID NO: 7752698 - DNA, 22 bp, Homo sapiens
gggctgtgagagtggggctgct

SEQ ID NO: 7752699 - DNA, 20 bp, Homo sapiens
gggctgtgcctcctcgtggt

SEQ ID NO: 7752700 - DNA, 22 bp, Homo sapiens
gggctgtgctgagtaggaggtg

SEQ ID NO: 7752701 - DNA, 22 bp, Homo sapiens
gggctgtgcctcaggtggggtc

SEQ ID NO: 7752702 - DNA, 22 bp, Homo sapiens
gggctgtggagccgcgagggct

SEQ ID NO: 7752703 - DNA, 22 bp, Homo sapiens
gggctgtgggacccggcacttt

SEQ ID NO: 7752704 - DNA, 22 bp, Homo sapiens
gggctgtgtactatgaggaggg

SEQ ID NO: 7752705 - DNA, 22 bp, Homo sapiens
gggctggaggagatccagaggc

SEQ ID NO: 7752706 - DNA, 21 bp, Homo sapiens
gggctggaggatgggaagccc

SEQ ID NO: 7752707 - DNA, 22 bp, Homo sapiens
cagagccagcccactgttcccg

SEQ ID NO: 7752708 - DNA, 22 bp, Homo sapiens
ggggcagatggaacagagcaca

SEQ ID NO: 7752709 - DNA, 22 bp, Homo sapiens
ggggcagcctccaggaaagctg

SEQ ID NO: 7752710 - DNA, 22 bp, Homo sapiens
ggggcagctaccggaagtaggg

SEQ ID NO: 7752711 - DNA, 22 bp, Homo sapiens
ggggcagagagaaggaagcttg

SEQ ID NO: 7752712 - DNA, 22 bp, Homo sapiens
gggatgagagctgggacagaag

SEQ ID NO: 7752713 - DNA, 22 bp, Homo sapiens
cagagcagaagcggtcctcaca

SEQ ID NO: 7752714 - DNA, 22 bp, Homo sapiens
cagagaagagtctggcctctct

SEQ ID NO: 7752715 - DNA, 22 bp, Homo sapiens
cagagaacttagctagttttcc

SEQ ID NO: 7752716 - DNA, 22 bp, Homo sapiens
cagagcaggggtttcccaggtt

SEQ ID NO: 7752717 - DNA, 22 bp, Homo sapiens
cagagcagacgttgagattaag

SEQ ID NO: 7752718 - DNA, 22 bp, Homo sapiens
cagagcagaaggtccaagcctg

SEQ ID NO: 7752719 - DNA, 22 bp, Homo sapiens
gggcaggggtagcattccaagt

SEQ ID NO: 7752720 - DNA, 18 bp, Homo sapiens
cagagcagaggtggagcg

SEQ ID NO: 7752721 - DNA, 20 bp, Homo sapiens
cagagccaagagcagcatct

SEQ ID NO: 7752722 - DNA, 22 bp, Homo sapiens
cagagccaaacctcagggcccg

SEQ ID NO: 7752723 - DNA, 22 bp, Homo sapiens
cagagcataattgacatgaggt

SEQ ID NO: 7752724 - DNA, 22 bp, Homo sapiens
cagagcatcgcgcagagagcct

SEQ ID NO: 7752725 - DNA, 22 bp, Homo sapiens
cagagcagtggagagtaggtct

SEQ ID NO: 7752726 - DNA, 20 bp, Homo sapiens
cagagcagtgcccaggcggc

SEQ ID NO: 7752727 - DNA, 22 bp, Homo sapiens
gggagctgatcaggtggattca

SEQ ID NO: 7752728 - DNA, 22 bp, Homo sapiens
gggagctgatgatgtaagtccc

SEQ ID NO: 7752729 - DNA, 22 bp, Homo sapiens
gggagctgcacacgccccggaa

SEQ ID NO: 7752730 - DNA, 22 bp, Homo sapiens
gggaggcagtgctggaggctgg

SEQ ID NO: 7752731 - DNA, 22 bp, Homo sapiens
gggaggcacgaggcgcgcagtg

SEQ ID NO: 7752732 - DNA, 22 bp, Homo sapiens
gggagctgctgaacacaagggt

SEQ ID NO: 7752733 - DNA, 22 bp, Homo sapiens
gggagctgcggtcttgcgaaga

SEQ ID NO: 7752734 - DNA, 22 bp, Homo sapiens
gggagctgccttagaccggagg

SEQ ID NO: 7752735 - DNA, 22 bp, Homo sapiens
gggagctgccaccacccctggg

SEQ ID NO: 7752736 - DNA, 20 bp, Homo sapiens
gggagctggaattgtcttag

SEQ ID NO: 7752737 - DNA, 21 bp, Homo sapiens
gggagctggaaactgggtgac

SEQ ID NO: 7752738 - DNA, 22 bp, Homo sapiens
cagaaacacttgtagagaagtt

SEQ ID NO: 7752739 - DNA, 22 bp, Homo sapiens
cagaaaatagagtttctctgag

SEQ ID NO: 7752740 - DNA, 22 bp, Homo sapiens
cagaaacactgtatttagggaa

SEQ ID NO: 7752741 - DNA, 22 bp, Homo sapiens
cagacaaggccatctttcattt

SEQ ID NO: 7752742 - DNA, 22 bp, Homo sapiens
cagacaattaagtaattgaggt

SEQ ID NO: 7752743 - DNA, 22 bp, Homo sapiens
cagaaacagacatgacgcagta

SEQ ID NO: 7752744 - DNA, 22 bp, Homo sapiens
cagaaacaggcaacgtgtgcac

SEQ ID NO: 7752745 - DNA, 22 bp, Homo sapiens
cagaaacagagaaatattggct

SEQ ID NO: 7752746 - DNA, 22 bp, Homo sapiens
ggcaaggggtcaggctgagaca

SEQ ID NO: 7752747 - DNA, 22 bp, Homo sapiens
ggcaagggttgaagataaggta

SEQ ID NO: 7752748 - DNA, 22 bp, Homo sapiens
cacagtacccagcactactgag

SEQ ID NO: 7752749 - DNA, 22 bp, Homo sapiens
cacagtgaagcatgcagacatc

SEQ ID NO: 7752750 - DNA, 21 bp, Homo sapiens
cacaggtgggtcagtgaggcc

SEQ ID NO: 7752751 - DNA, 22 bp, Homo sapiens
cacaggcagccttgtagaagaa

SEQ ID NO: 7752752 - DNA, 22 bp, Homo sapiens
cacatgaattcacatgtatttt

SEQ ID NO: 7752753 - DNA, 22 bp, Homo sapiens
cacatgaataaggctttattgt

SEQ ID NO: 7752754 - DNA, 22 bp, Homo sapiens
cacatgaaggctggggtcgtga

SEQ ID NO: 7752755 - DNA, 22 bp, Homo sapiens
cacatgaaggctggggtcgtga

SEQ ID NO: 7752756 - DNA, 22 bp, Homo sapiens
caccaggaccccacggtgggtt

SEQ ID NO: 7752757 - DNA, 22 bp, Homo sapiens
caccaggaagtattcaaagggt

SEQ ID NO: 7752758 - DNA, 22 bp, Homo sapiens
caccaggagcatctaggaggcg

SEQ ID NO: 7752759 - DNA, 22 bp, Homo sapiens
caccaggagccatcaggagtcc

SEQ ID NO: 7752760 - DNA, 22 bp, Homo sapiens
cacatgtttggcatgtcaccaa

SEQ ID NO: 7752761 - DNA, 22 bp, Homo sapiens
cacatgttcttgaagccaactc

SEQ ID NO: 7752762 - DNA, 17 bp, Homo sapiens
cacatgttcttagagcc

SEQ ID NO: 7752763 - DNA, 20 bp, Homo sapiens
ggctctgcttgtgagcagcc

SEQ ID NO: 7752764 - DNA, 21 bp, Homo sapiens
cacttgaatggtgttttacaa

SEQ ID NO: 7752765 - DNA, 22 bp, Homo sapiens
cacttgaatgagaatttcctgg

SEQ ID NO: 7752766 - DNA, 22 bp, Homo sapiens
cacttgaagtgaattgctcacc

SEQ ID NO: 7752767 - DNA, 22 bp, Homo sapiens
cactcagggtacaatggagggc

SEQ ID NO: 7752768 - DNA, 22 bp, Homo sapiens
cactcagaacatctccctgatg

SEQ ID NO: 7752769 - DNA, 22 bp, Homo sapiens
cactcagaggtttgattgctca

SEQ ID NO: 7752770 - DNA, 22 bp, Homo sapiens
cactagtcctggtttcatgcta

SEQ ID NO: 7752771 - DNA, 19 bp, Homo sapiens
cactagtctagatgggatg

SEQ ID NO: 7752772 - DNA, 22 bp, Homo sapiens
cacggaaacacaggttataaga

SEQ ID NO: 7752773 - DNA, 22 bp, Homo sapiens
cactctcacatgccctgtcagt

SEQ ID NO: 7752774 - DNA, 22 bp, Homo sapiens
cactctcactgagctcatgcca

SEQ ID NO: 7752775 - DNA, 22 bp, Homo sapiens
caccaggctggagtgcagaggt

SEQ ID NO: 7752776 - DNA, 22 bp, Homo sapiens
caccaggaggacaggcccctac

SEQ ID NO: 7752777 - DNA, 22 bp, Homo sapiens
caccaggataaaacctctagat

SEQ ID NO: 7752778 - DNA, 22 bp, Homo sapiens
caccaggatgggcaggtaggtc

SEQ ID NO: 7752779 - DNA, 22 bp, Homo sapiens
caccaggcacatagtaggcact

SEQ ID NO: 7752780 - DNA, 22 bp, Homo sapiens
cacctggcccagctccagtgct

SEQ ID NO: 7752781 - DNA, 22 bp, Homo sapiens
gctggagaaacaggaggaggaa

SEQ ID NO: 7752782 - DNA, 22 bp, Homo sapiens
caagaagcccttcctgggtgga

SEQ ID NO: 7752783 - DNA, 23 bp, Homo sapiens
caagctgcagtttggttggtggg

SEQ ID NO: 7752784 - DNA, 22 bp, Homo sapiens
gctggggagcaagagtagtgag

SEQ ID NO: 7752785 - DNA, 22 bp, Homo sapiens
caagacaagatctaagcatgct

SEQ ID NO: 7752786 - DNA, 17 bp, Homo sapiens
gctggctgacccatgcc

SEQ ID NO: 7752787 - DNA, 22 bp, Homo sapiens
caagccattctcctgcctcagc

SEQ ID NO: 7752788 - DNA, 22 bp, Homo sapiens
caacacagccattcccctagaa

SEQ ID NO: 7752789 - DNA, 22 bp, Homo sapiens
caagaacattgtgatcacttca

SEQ ID NO: 7752790 - DNA, 20 bp, Homo sapiens
ggagagcagggaagacagta

SEQ ID NO: 7752791 - DNA, 22 bp, Homo sapiens
ggagagatggtaaccctggggc

SEQ ID NO: 7752792 - DNA, 22 bp, Homo sapiens
ggagagcagggaggctgctctg

SEQ ID NO: 7752793 - DNA, 22 bp, Homo sapiens
ggagagcagggtcctgagatac

SEQ ID NO: 7752794 - DNA, 22 bp, Homo sapiens
ggagagcattcttagtctgttt

SEQ ID NO: 7752795 - DNA, 22 bp, Homo sapiens
ggagaagggccaattccatgta

SEQ ID NO: 7752796 - DNA, 22 bp, Homo sapiens
ggagaagggcatggtagtttta

SEQ ID NO: 7752797 - DNA, 22 bp, Homo sapiens
ggagaagggacagactcagctt

SEQ ID NO: 7752798 - DNA, 22 bp, Homo sapiens
ggagaagggtatgtgtggcgga

SEQ ID NO: 7752799 - DNA, 22 bp, Homo sapiens
ggagaaggtgctggtcactgtg

SEQ ID NO: 7752800 - DNA, 22 bp, Homo sapiens
cacacagtggagtattactcag

SEQ ID NO: 7752801 - DNA, 22 bp, Homo sapiens
ggagaaggcgaagtcattcttt

SEQ ID NO: 7752802 - DNA, 22 bp, Homo sapiens
ggagaagggaactgagtttttg

SEQ ID NO: 7752803 - DNA, 22 bp, Homo sapiens
cacacagtaggcactcattaat

SEQ ID NO: 7752804 - DNA, 22 bp, Homo sapiens
cacacaggtatatatatgtaca

SEQ ID NO: 7752805 - DNA, 22 bp, Homo sapiens
ggaagctgaacttagcaaggaa

SEQ ID NO: 7752806 - DNA, 22 bp, Homo sapiens
cacaaatggttgtagacattaa

SEQ ID NO: 7752807 - DNA, 22 bp, Homo sapiens
ggaccacaatatttgtgaggtt

SEQ ID NO: 7752808 - DNA, 18 bp, Homo sapiens
ggaccacatcaacttgaa

SEQ ID NO: 7752809 - DNA, 22 bp, Homo sapiens
ggaccacattgagagtcattaa

SEQ ID NO: 7752810 - DNA, 22 bp, Homo sapiens
ggaccacagcacttggcttgag

SEQ ID NO: 7752811 - DNA, 22 bp, Homo sapiens
ggaccacagtgcatggcctgta

SEQ ID NO: 7752812 - DNA, 22 bp, Homo sapiens
caattctttgtagaagctctcc

SEQ ID NO: 7752813 - DNA, 22 bp, Homo sapiens
caattcttggagaagaagcata

SEQ ID NO: 7752814 - DNA, 22 bp, Homo sapiens
caaggctgtgcagggtccatat

SEQ ID NO: 7752815 - DNA, 22 bp, Homo sapiens
caaggcttagtcagagggtgct

SEQ ID NO: 7752816 - DNA, 22 bp, Homo sapiens
caaggcttaggtggctccctgt

SEQ ID NO: 7752817 - DNA, 22 bp, Homo sapiens
gctggggaggcagcagagaaca

SEQ ID NO: 7752818 - DNA, 22 bp, Homo sapiens
tgtaatgagtcacttaccttaa

SEQ ID NO: 7752819 - DNA, 20 bp, Homo sapiens
cctgctgggaaccctctgaa

SEQ ID NO: 7752820 - DNA, 22 bp, Homo sapiens
cctgctggccactgctccacct

SEQ ID NO: 7752821 - DNA, 22 bp, Homo sapiens
cctgagaatgtttaacagagaa

SEQ ID NO: 7752822 - DNA, 22 bp, Homo sapiens
tggggtagggaaaagaagtcga

SEQ ID NO: 7752823 - DNA, 22 bp, Homo sapiens
tggggtaggagtcagcgagaga

SEQ ID NO: 7752824 - DNA, 22 bp, Homo sapiens
cctgccaggagctggtgctgca

SEQ ID NO: 7752825 - DNA, 22 bp, Homo sapiens
cctgccagacgcaccagggggc

SEQ ID NO: 7752826 - DNA, 21 bp, Homo sapiens
tgggccagatctgagtttcta

SEQ ID NO: 7752827 - DNA, 22 bp, Homo sapiens
cctgaatgcctgacatttcact

SEQ ID NO: 7752828 - DNA, 22 bp, Homo sapiens
ccgtgtgcacgcgccggtgctg

SEQ ID NO: 7752829 - DNA, 22 bp, Homo sapiens
cctatttgtaggctgggccagt

SEQ ID NO: 7752830 - DNA, 22 bp, Homo sapiens
ccctgtgctgtcatgctgggcg

SEQ ID NO: 7752831 - DNA, 22 bp, Homo sapiens
ccctgtgcctcagtttcctcat

SEQ ID NO: 7752832 - DNA, 22 bp, Homo sapiens
ccctgtgcctagttggcctaaa

SEQ ID NO: 7752833 - DNA, 22 bp, Homo sapiens
ccctgtgcattggagggtgttt

SEQ ID NO: 7752834 - DNA, 22 bp, Homo sapiens
ccctttcatattttataaatgg

SEQ ID NO: 7752835 - DNA, 22 bp, Homo sapiens
ccctttcattggcagagctctc

SEQ ID NO: 7752836 - DNA, 22 bp, Homo sapiens
ccgcggggcgtgggctcttacc

SEQ ID NO: 7752837 - DNA, 18 bp, Homo sapiens
cctccctcattttcccag

SEQ ID NO: 7752838 - DNA, 22 bp, Homo sapiens
cctccctccattgccatcgtct

SEQ ID NO: 7752839 - DNA, 22 bp, Homo sapiens
cctccctccctgcagaagccac

SEQ ID NO: 7752840 - DNA, 22 bp, Homo sapiens
cctccctctgttagagctgtct

SEQ ID NO: 7752841 - DNA, 22 bp, Homo sapiens
cctccctctttcagtcccacag

SEQ ID NO: 7752842 - DNA, 22 bp, Homo sapiens
cctcactctgcaccctgcagca

SEQ ID NO: 7752843 - DNA, 22 bp, Homo sapiens
cctcactcttgtcctggcaggt

SEQ ID NO: 7752844 - DNA, 22 bp, Homo sapiens
cctcactgaagaggtgacattt

SEQ ID NO: 7752845 - DNA, 19 bp, Homo sapiens
cctcaccctgcagaggagg

SEQ ID NO: 7752846 - DNA, 22 bp, Homo sapiens
cctcactgctatgtgtttgctc

SEQ ID NO: 7752847 - DNA, 22 bp, Homo sapiens
cctcactttcctttctcctggg

SEQ ID NO: 7752848 - DNA, 22 bp, Homo sapiens
tggcctcccctaacagcctctt

SEQ ID NO: 7752849 - DNA, 23 bp, Homo sapiens
cctcagcatggcaggagcccagc

SEQ ID NO: 7752850 - DNA, 22 bp, Homo sapiens
cccgtgtgtgcgaggctcccgc

SEQ ID NO: 7752851 - DNA, 22 bp, Homo sapiens
ccctaagctttcgggctgagag

SEQ ID NO: 7752852 - DNA, 22 bp, Homo sapiens
tgcctcagtttcatctgcagaa

SEQ ID NO: 7752853 - DNA, 22 bp, Homo sapiens
tggacatcttagtcatgtcaat

SEQ ID NO: 7752854 - DNA, 22 bp, Homo sapiens
tgaggcagtattttagtgactt

SEQ ID NO: 7752855 - DNA, 22 bp, Homo sapiens
tgcagaggtttttaatacattt

SEQ ID NO: 7752856 - DNA, 22 bp, Homo sapiens
tgcagaggtttccaggcaagtt

SEQ ID NO: 7752857 - DNA, 22 bp, Homo sapiens
cccacatttttgagtcttcatc

SEQ ID NO: 7752858 - DNA, 22 bp, Homo sapiens
tgcagaggtgttgctgagataa

SEQ ID NO: 7752859 - DNA, 22 bp, Homo sapiens
tgcagaggtgaaagactagcaa

SEQ ID NO: 7752860 - DNA, 22 bp, Homo sapiens
cccacagtgatcgcattcgtac

SEQ ID NO: 7752861 - DNA, 23 bp, Homo sapiens
tgcctcagtggaatgtgagggtg

SEQ ID NO: 7752862 - DNA, 22 bp, Homo sapiens
tgccctctgcaggccgccatgg

SEQ ID NO: 7752863 - DNA, 22 bp, Homo sapiens
cccagcccagcgttcgaggggt

SEQ ID NO: 7752864 - DNA, 22 bp, Homo sapiens
cccaggaattggaggctgcagt

SEQ ID NO: 7752865 - DNA, 22 bp, Homo sapiens
cccaggaaatagccaggaggtg

SEQ ID NO: 7752866 - DNA, 22 bp, Homo sapiens
ccaggctcaggtgcgagagaca

SEQ ID NO: 7752867 - DNA, 22 bp, Homo sapiens
tcttgtttctgtatataatgac

SEQ ID NO: 7752868 - DNA, 22 bp, Homo sapiens
tcttgtttcttctaagcagcag

SEQ ID NO: 7752869 - DNA, 22 bp, Homo sapiens
tcttgttttgaactcatcagga

SEQ ID NO: 7752870 - DNA, 22 bp, Homo sapiens
tcttgtttggattttgggcagt

SEQ ID NO: 7752871 - DNA, 23 bp, Homo sapiens
tcttgtttcctttgcgctatcca

SEQ ID NO: 7752872 - DNA, 22 bp, Homo sapiens
tctgcagacaggaagctgaggc

SEQ ID NO: 7752873 - DNA, 17 bp, Homo sapiens
tgaagatgcatggcagc

SEQ ID NO: 7752874 - DNA, 22 bp, Homo sapiens
tgaagatgtcagcaggggtggt

SEQ ID NO: 7752875 - DNA, 22 bp, Homo sapiens
tgaacagatgccttctcccatg

SEQ ID NO: 7752876 - DNA, 22 bp, Homo sapiens
tgaacagatgtggaggtacctt

SEQ ID NO: 7752877 - DNA, 22 bp, Homo sapiens
tgaacagatggcccagcagagg

SEQ ID NO: 7752878 - DNA, 22 bp, Homo sapiens
tgaacacattttcttcagtaga

SEQ ID NO: 7752879 - DNA, 22 bp, Homo sapiens
tgaacacatttgggaaaatctt

SEQ ID NO: 7752880 - DNA, 22 bp, Homo sapiens
tgaacacatttctggccaattt

SEQ ID NO: 7752881 - DNA, 22 bp, Homo sapiens
tgaacacatctgcgtgtgtctc

SEQ ID NO: 7752882 - DNA, 22 bp, Homo sapiens
ccaggctgctcacaagctgccc

SEQ ID NO: 7752883 - DNA, 18 bp, Homo sapiens
tgaacacagtacaattcc

SEQ ID NO: 7752884 - DNA, 22 bp, Homo sapiens
tgaacacagggccaaacttgag

SEQ ID NO: 7752885 - DNA, 22 bp, Homo sapiens
tgaacacagggaatgggggttt

SEQ ID NO: 7752886 - DNA, 21 bp, Homo sapiens
tgaacacagatttgtctgatt

SEQ ID NO: 7752887 - DNA, 22 bp, Homo sapiens
tgaacacagcatattttgttac

SEQ ID NO: 7752888 - DNA, 22 bp, Homo sapiens
tgaacacagttctgatgagctt

SEQ ID NO: 7752889 - DNA, 22 bp, Homo sapiens
tgaacacataaaagcaaagggt

SEQ ID NO: 7752890 - DNA, 22 bp, Homo sapiens
tgaacacataaggctttcctgt

SEQ ID NO: 7752891 - DNA, 22 bp, Homo sapiens
tgaacacatattaggtgctcat

SEQ ID NO: 7752892 - DNA, 22 bp, Homo sapiens
ccaggctgcagtcaaggggcat

SEQ ID NO: 7752893 - DNA, 22 bp, Homo sapiens
tgaccctctggccccacagcca

SEQ ID NO: 7752894 - DNA, 21 bp, Homo sapiens
tgaccctcccagccctgccaa

SEQ ID NO: 7752895 - DNA, 22 bp, Homo sapiens
tgaccctcttccccatgcgctc

SEQ ID NO: 7752896 - DNA, 22 bp, Homo sapiens
ccagggcccacggccagaatag

SEQ ID NO: 7752897 - DNA, 22 bp, Homo sapiens
tgacccaggtgagctgtgacca

SEQ ID NO: 7752898 - DNA, 22 bp, Homo sapiens
tgagctggcacttttcctggga

SEQ ID NO: 7752899 - DNA, 22 bp, Homo sapiens
tgagcagacttgatgaggcagc

SEQ ID NO: 7752900 - DNA, 22 bp, Homo sapiens
tgagcagagacgggggcctcca

SEQ ID NO: 7752901 - DNA, 22 bp, Homo sapiens
tgagcagactctgcagagccac

SEQ ID NO: 7752902 - DNA, 22 bp, Homo sapiens
tgagcacctggaccagattctg

SEQ ID NO: 7752903 - DNA, 22 bp, Homo sapiens
tgagcagaacacgggatccatg

SEQ ID NO: 7752904 - DNA, 22 bp, Homo sapiens
tgagcagaagccctcctggact

SEQ ID NO: 7752905 - DNA, 22 bp, Homo sapiens
tgaggaatgctgagcagaggaa

SEQ ID NO: 7752906 - DNA, 22 bp, Homo sapiens
tgagaggtcattaggccatgag

SEQ ID NO: 7752907 - DNA, 23 bp, Homo sapiens
tgagcacctacctggagccaagc

SEQ ID NO: 7752908 - DNA, 22 bp, Homo sapiens
tgagcaccctctggaaaatggg

SEQ ID NO: 7752909 - DNA, 22 bp, Homo sapiens
tgagcacctccctgacagtggg

SEQ ID NO: 7752910 - DNA, 22 bp, Homo sapiens
ccaggtaccagtcaaatctgta

SEQ ID NO: 7752911 - DNA, 22 bp, Homo sapiens
ccaggtacttggtatgcattca

SEQ ID NO: 7752912 - DNA, 22 bp, Homo sapiens
ccaggtaaattacctactgaat

SEQ ID NO: 7752913 - DNA, 22 bp, Homo sapiens
ccaggtacatggagaagaacag

SEQ ID NO: 7752914 - DNA, 21 bp, Homo sapiens
ccaggtacatggagaatgtgg

SEQ ID NO: 7752915 - DNA, 22 bp, Homo sapiens
ccaggtaacttgagaacatgag

SEQ ID NO: 7752916 - DNA, 22 bp, Homo sapiens
ccagggtggggcaggcccactg

SEQ ID NO: 7752917 - DNA, 22 bp, Homo sapiens
ccagggtgggaggctgaaggcg

SEQ ID NO: 7752918 - DNA, 22 bp, Homo sapiens
ccagggtggggtccaggaacca

SEQ ID NO: 7752919 - DNA, 22 bp, Homo sapiens
tctcaaatttgttagataaaat

SEQ ID NO: 7752920 - DNA, 22 bp, Homo sapiens
ccagaaaaatcctcccttgtcc

SEQ ID NO: 7752921 - DNA, 22 bp, Homo sapiens
ccagaaaactctacatgcttgt

SEQ ID NO: 7752922 - DNA, 22 bp, Homo sapiens
tctccacaagctttctcctttt

SEQ ID NO: 7752923 - DNA, 22 bp, Homo sapiens
tctccctctcagatttattcac

SEQ ID NO: 7752924 - DNA, 22 bp, Homo sapiens
tcgctcacttacctcgcgccgg

SEQ ID NO: 7752925 - DNA, 22 bp, Homo sapiens
tcgctcacttggttatgaaggt

SEQ ID NO: 7752926 - DNA, 22 bp, Homo sapiens
tcgctgaggctgcacggctgcc

SEQ ID NO: 7752927 - DNA, 22 bp, Homo sapiens
tcgcgggttgcacatggccatc

SEQ ID NO: 7752928 - DNA, 22 bp, Homo sapiens
tcggggatgggagagagctcca

SEQ ID NO: 7752929 - DNA, 22 bp, Homo sapiens
tcggggatggtgtctgagggag

SEQ ID NO: 7752930 - DNA, 22 bp, Homo sapiens
ccacattcactcatttcattgt

SEQ ID NO: 7752931 - DNA, 23 bp, Homo sapiens
tctcctggctgcactgtggccac

SEQ ID NO: 7752932 - DNA, 22 bp, Homo sapiens
ccagcagggcagtgccctggac

SEQ ID NO: 7752933 - DNA, 22 bp, Homo sapiens
tctcttaaatacttcacatctc

SEQ ID NO: 7752934 - DNA, 18 bp, Homo sapiens
ccagcatgccagaggctg

SEQ ID NO: 7752935 - DNA, 19 bp, Homo sapiens
tctgaatgggatgagttgg

SEQ ID NO: 7752936 - DNA, 22 bp, Homo sapiens
tctgaatgtatcgaattgaggc

SEQ ID NO: 7752937 - DNA, 19 bp, Homo sapiens
tctgaatgggatgagttgg

SEQ ID NO: 7752938 - DNA, 22 bp, Homo sapiens
tctgaatgttaggaaactttct

SEQ ID NO: 7752939 - DNA, 22 bp, Homo sapiens
tctgaatgcacttagttaccaa

SEQ ID NO: 7752940 - DNA, 22 bp, Homo sapiens
tctgagagtctctgaggcagat

SEQ ID NO: 7752941 - DNA, 22 bp, Homo sapiens
tctgagagcatcactggggtac

SEQ ID NO: 7752942 - DNA, 22 bp, Homo sapiens
tctgagagcaggaggagctgct

SEQ ID NO: 7752943 - DNA, 22 bp, Homo sapiens
ccagccctgtaaggatgaggca

SEQ ID NO: 7752944 - DNA, 18 bp, Homo sapiens
tcctcagcctcacctagc

SEQ ID NO: 7752945 - DNA, 22 bp, Homo sapiens
tccctcagaaattctctctgaa

SEQ ID NO: 7752946 - DNA, 22 bp, Homo sapiens
catttggattttgaagagagta

SEQ ID NO: 7752947 - DNA, 22 bp, Homo sapiens
tcccagggtcctcttctggaat

SEQ ID NO: 7752948 - DNA, 22 bp, Homo sapiens
cattgaatccttccttcagaag

SEQ ID NO: 7752949 - DNA, 22 bp, Homo sapiens
cattcacaatggattgcttcaa

SEQ ID NO: 7752950 - DNA, 22 bp, Homo sapiens
cattcacatcttgttccatcac

SEQ ID NO: 7752951 - DNA, 21 bp, Homo sapiens
cattcacagtctggctcttga

SEQ ID NO: 7752952 - DNA, 22 bp, Homo sapiens
cattcacattcttcttactgtt

SEQ ID NO: 7752953 - DNA, 22 bp, Homo sapiens
tcatcagtgtccttatcactta

SEQ ID NO: 7752954 - DNA, 22 bp, Homo sapiens
tcattcccccataatggtattt

SEQ ID NO: 7752955 - DNA, 22 bp, Homo sapiens
tcattccctcattgttcactgg

SEQ ID NO: 7752956 - DNA, 22 bp, Homo sapiens
tcattccctccagctgtggcta

SEQ ID NO: 7752957 - DNA, 20 bp, Homo sapiens
tccacatcttttgagatgtg

SEQ ID NO: 7752958 - DNA, 22 bp, Homo sapiens
tccagagacttgcatgtgcttg

SEQ ID NO: 7752959 - DNA, 22 bp, Homo sapiens
tccagcctaatgttcttcccac

SEQ ID NO: 7752960 - DNA, 23 bp, Homo sapiens
tccagcctcttgctctcacatgc

SEQ ID NO: 7752961 - DNA, 22 bp, Homo sapiens
tccagcctcctatttaccctaa

SEQ ID NO: 7752962 - DNA, 22 bp, Homo sapiens
catgtgtgtctccaccagctgc

SEQ ID NO: 7752963 - DNA, 22 bp, Homo sapiens
tccaggcccatggagcagagct

SEQ ID NO: 7752964 - DNA, 22 bp, Homo sapiens
cagttaaacgggccatgtgagt

SEQ ID NO: 7752965 - DNA, 22 bp, Homo sapiens
cagtttatatataagcacattg

SEQ ID NO: 7752966 - DNA, 22 bp, Homo sapiens
cagtttatagctctagcagctt

SEQ ID NO: 7752967 - DNA, 22 bp, Homo sapiens
cagtgtctgaaataacaccgga

SEQ ID NO: 7752968 - DNA, 22 bp, Homo sapiens
cagtgggaagaatgcagcctcc

SEQ ID NO: 7752969 - DNA, 22 bp, Homo sapiens
cagtgggaagggcagaggcttt

SEQ ID NO: 7752970 - DNA, 22 bp, Homo sapiens
cagtgggatatgggggcagcat

SEQ ID NO: 7752971 - DNA, 22 bp, Homo sapiens
cagtggcaggggaagcaggtgt

SEQ ID NO: 7752972 - DNA, 22 bp, Homo sapiens
cagtgccagaggtactagtgga

SEQ ID NO: 7752973 - DNA, 22 bp, Homo sapiens
tcacaaatatagtgagaaccag

SEQ ID NO: 7752974 - DNA, 22 bp, Homo sapiens
tcacaaatattttaacagtagg

SEQ ID NO: 7752975 - DNA, 22 bp, Homo sapiens
cagtgacacgggctggcccacg

SEQ ID NO: 7752976 - DNA, 22 bp, Homo sapiens
cagtgagataccacagagcaaa

SEQ ID NO: 7752977 - DNA, 22 bp, Homo sapiens
tcacagactggtcagtcaactt

SEQ ID NO: 7752978 - DNA, 22 bp, Homo sapiens
tatttccacaccttttgaatct

SEQ ID NO: 7752979 - DNA, 22 bp, Homo sapiens
tatttccacctattattttctg

SEQ ID NO: 7752980 - DNA, 22 bp, Homo sapiens
tatttccagaggagtatagaag

SEQ ID NO: 7752981 - DNA, 21 bp, Homo sapiens
caggtttgctatggagcagcc

SEQ ID NO: 7752982 - DNA, 22 bp, Homo sapiens
tatttcattctttatcaggagc

SEQ ID NO: 7752983 - DNA, 22 bp, Homo sapiens
tatttcatctggaacaaggtaa

SEQ ID NO: 7752984 - DNA, 22 bp, Homo sapiens
tatttcatgtgcaccataattc

SEQ ID NO: 7752985 - DNA, 22 bp, Homo sapiens
caggttgggctgcgaggaggag

SEQ ID NO: 7752986 - DNA, 22 bp, Homo sapiens
tagcattccatcactcagcacc

SEQ ID NO: 7752987 - DNA, 22 bp, Homo sapiens
tagcattatttcctctttttgt

SEQ ID NO: 7752988 - DNA, 22 bp, Homo sapiens
tagcattagtcagatatgtttt

SEQ ID NO: 7752989 - DNA, 22 bp, Homo sapiens
tagcattatctgtcttatcatt

SEQ ID NO: 7752990 - DNA, 22 bp, Homo sapiens
tagcaagatcgtgtctctaaaa

SEQ ID NO: 7752991 - DNA, 22 bp, Homo sapiens
tagcaagatgatgaattattca

SEQ ID NO: 7752992 - DNA, 22 bp, Homo sapiens
tagcaagatgtcactccaagtt

SEQ ID NO: 7752993 - DNA, 22 bp, Homo sapiens
tagcaagagtgggctttgtggg

SEQ ID NO: 7752994 - DNA, 22 bp, Homo sapiens
tagcaagtgtgagttcatttta

SEQ ID NO: 7752995 - DNA, 22 bp, Homo sapiens
caggctggtcccagagcattgc

SEQ ID NO: 7752996 - DNA, 22 bp, Homo sapiens
caggctgggctccggagataaa

SEQ ID NO: 7752997 - DNA, 22 bp, Homo sapiens
caggctggagtgcagtggcgct

SEQ ID NO: 7752998 - DNA, 22 bp, Homo sapiens
caggctgcctggaagaggactg

SEQ ID NO: 7752999 - DNA, 22 bp, Homo sapiens
caggctggagtgcaatgacgcc

SEQ ID NO: 7753000 - DNA, 22 bp, Homo sapiens
caggctggagtgcaatggcaca

SEQ ID NO: 7753001 - DNA, 22 bp, Homo sapiens
caggctggagtgcagtggcgcc

SEQ ID NO: 7753002 - DNA, 22 bp, Homo sapiens
gtgaggggtggctgagcagttt

SEQ ID NO: 7753003 - DNA, 22 bp, Homo sapiens
tagctcaaaggttaagtgtgga

SEQ ID NO: 7753004 - DNA, 22 bp, Homo sapiens
cagggcagagccaggatttcaa

SEQ ID NO: 7753005 - DNA, 22 bp, Homo sapiens
cagggcaggaatttgacattgc

SEQ ID NO: 7753006 - DNA, 22 bp, Homo sapiens
taggaacaaaaggttttcctga

SEQ ID NO: 7753007 - DNA, 22 bp, Homo sapiens
taggaacaaagagcctcacatt

SEQ ID NO: 7753008 - DNA, 22 bp, Homo sapiens
taggaacaaagagcctcacatt

SEQ ID NO: 7753009 - DNA, 22 bp, Homo sapiens
taggaacacacatgtgtagctg

SEQ ID NO: 7753010 - DNA, 22 bp, Homo sapiens
taggaacaagtttccttgctgt

SEQ ID NO: 7753011 - DNA, 22 bp, Homo sapiens
taggaacaactgcaggtacaag

SEQ ID NO: 7753012 - DNA, 22 bp, Homo sapiens
taggaacacatcctcctctagc

SEQ ID NO: 7753013 - DNA, 22 bp, Homo sapiens
taggaacacagggacttgatga

SEQ ID NO: 7753014 - DNA, 22 bp, Homo sapiens
taggaacagtttcaggatgttt

SEQ ID NO: 7753015 - DNA, 22 bp, Homo sapiens
taggaacatatgcagtgctttt

SEQ ID NO: 7753016 - DNA, 22 bp, Homo sapiens
taggaacagtcctagaaatctg

SEQ ID NO: 7753017 - DNA, 22 bp, Homo sapiens
taggaacatgcccttaccttcc

SEQ ID NO: 7753018 - DNA, 18 bp, Homo sapiens
taggaacattgattggag

SEQ ID NO: 7753019 - DNA, 22 bp, Homo sapiens
cagggcctccccggcagtcttt

SEQ ID NO: 7753020 - DNA, 22 bp, Homo sapiens
cagggcctggagctgggcctgc

SEQ ID NO: 7753021 - DNA, 22 bp, Homo sapiens
cagggcctgtacaagtcccacc

SEQ ID NO: 7753022 - DNA, 22 bp, Homo sapiens
cagggcctgtcacgacgctcat

SEQ ID NO: 7753023 - DNA, 22 bp, Homo sapiens
cagggccttatcctgccattga

SEQ ID NO: 7753024 - DNA, 22 bp, Homo sapiens
cagggccttcgtaagtgtccgg

SEQ ID NO: 7753025 - DNA, 22 bp, Homo sapiens
cagggccttgttcaggagtgaa

SEQ ID NO: 7753026 - DNA, 22 bp, Homo sapiens
tagggacaaagagctgaggcct

SEQ ID NO: 7753027 - DNA, 22 bp, Homo sapiens
taggtagctttggcgtttcttg

SEQ ID NO: 7753028 - DNA, 22 bp, Homo sapiens
ctggagaggctgggaacaggtt

SEQ ID NO: 7753029 - DNA, 22 bp, Homo sapiens
ctggagaaaatccatgtgtatg

SEQ ID NO: 7753030 - DNA, 22 bp, Homo sapiens
ctggagaactagttaaacacgt

SEQ ID NO: 7753031 - DNA, 22 bp, Homo sapiens
ctggagaaacatcaggcatagg

SEQ ID NO: 7753032 - DNA, 22 bp, Homo sapiens
ctggagaacagagctgtttaga

SEQ ID NO: 7753033 - DNA, 19 bp, Homo sapiens
ctgctgggtgctgagggag

SEQ ID NO: 7753034 - DNA, 22 bp, Homo sapiens
ctgctgggtttgcctttcacca

SEQ ID NO: 7753035 - DNA, 22 bp, Homo sapiens
ctgctgggaaggtctgctcagt

SEQ ID NO: 7753036 - DNA, 22 bp, Homo sapiens
ctgctgaagttgttggtctttt

SEQ ID NO: 7753037 - DNA, 22 bp, Homo sapiens
ctgctgaaaacaataatgatga

SEQ ID NO: 7753038 - DNA, 22 bp, Homo sapiens
ctgctctgtttcttagctgggt

SEQ ID NO: 7753039 - DNA, 22 bp, Homo sapiens
ctgctctgttaattaaactttg

SEQ ID NO: 7753040 - DNA, 20 bp, Homo sapiens
ctgcgggctcggccgacccc

SEQ ID NO: 7753041 - DNA, 22 bp, Homo sapiens
ctgaggctgcccagggccaggt

SEQ ID NO: 7753042 - DNA, 22 bp, Homo sapiens
ctgaggctggagtgcagtggtg

SEQ ID NO: 7753043 - DNA, 22 bp, Homo sapiens
ctgaggctgaagagggcctacg

SEQ ID NO: 7753044 - DNA, 22 bp, Homo sapiens
ctgaggctccctcgggtctgct

SEQ ID NO: 7753045 - DNA, 18 bp, Homo sapiens
ctgaggctggcaggagcc

SEQ ID NO: 7753046 - DNA, 22 bp, Homo sapiens
ctgagcatttgtgcagcttctc

SEQ ID NO: 7753047 - DNA, 22 bp, Homo sapiens
ctgaggctcaagggcaggtggg

SEQ ID NO: 7753048 - DNA, 22 bp, Homo sapiens
ctgagcagtgctttgcagtggg

SEQ ID NO: 7753049 - DNA, 22 bp, Homo sapiens
ctgagcaggatattcacagcag

SEQ ID NO: 7753050 - DNA, 22 bp, Homo sapiens
ctgcagcctcaacctcctgagc

SEQ ID NO: 7753051 - DNA, 22 bp, Homo sapiens
ctgcaggactgaaagatgaggt

SEQ ID NO: 7753052 - DNA, 22 bp, Homo sapiens
ctgcaggacagggccggaggcc

SEQ ID NO: 7753053 - DNA, 22 bp, Homo sapiens
ctgcaggacagggaggagcaag

SEQ ID NO: 7753054 - DNA, 22 bp, Homo sapiens
ctgcaggaatctgtgctaggtg

SEQ ID NO: 7753055 - DNA, 22 bp, Homo sapiens
ctgcaggaaggggacggagtgg

SEQ ID NO: 7753056 - DNA, 22 bp, Homo sapiens
ctgaggtgagcttccctgggct

SEQ ID NO: 7753057 - DNA, 22 bp, Homo sapiens
ctgaggtggaacagaggtgaag

SEQ ID NO: 7753058 - DNA, 22 bp, Homo sapiens
ctgaggtggggcctgggcatca

SEQ ID NO: 7753059 - DNA, 22 bp, Homo sapiens
ctgaggtggcctctgccgggga

SEQ ID NO: 7753060 - DNA, 22 bp, Homo sapiens
ctgaggtgtgaaatggtggcaa

SEQ ID NO: 7753061 - DNA, 22 bp, Homo sapiens
ctgaggtgtggtctgggagtat

SEQ ID NO: 7753062 - DNA, 22 bp, Homo sapiens
ctgcaggattctcccagttgga

SEQ ID NO: 7753063 - DNA, 22 bp, Homo sapiens
ctgcaggagcaagcctgggaga

SEQ ID NO: 7753064 - DNA, 22 bp, Homo sapiens
ctgcaggaggatcctgagagtg

SEQ ID NO: 7753065 - DNA, 22 bp, Homo sapiens
ctgcaggagtgaaagcaggcct

SEQ ID NO: 7753066 - DNA, 22 bp, Homo sapiens
ctctggctatctgtttctatgt

SEQ ID NO: 7753067 - DNA, 22 bp, Homo sapiens
ctctgtggtaaaatagcagtat

SEQ ID NO: 7753068 - DNA, 22 bp, Homo sapiens
tttgaaaagaaccatcgcctta

SEQ ID NO: 7753069 - DNA, 22 bp, Homo sapiens
tttgaaaacttaatttggtcgt

SEQ ID NO: 7753070 - DNA, 22 bp, Homo sapiens
tttgaaaatttaagtgctacac

SEQ ID NO: 7753071 - DNA, 22 bp, Homo sapiens
tttgaaaattagacacaggcta

SEQ ID NO: 7753072 - DNA, 22 bp, Homo sapiens
tttcattaaagtcaaatctggt

SEQ ID NO: 7753073 - DNA, 22 bp, Homo sapiens
tttcattaaagtcaaatctggt

SEQ ID NO: 7753074 - DNA, 18 bp, Homo sapiens
ctctctggtctggatccc

SEQ ID NO: 7753075 - DNA, 19 bp, Homo sapiens
ctctctggcggtgtctgcg

SEQ ID NO: 7753076 - DNA, 18 bp, Homo sapiens
ctctgaaagacacaccag

SEQ ID NO: 7753077 - DNA, 22 bp, Homo sapiens
tttcacatataggggaagctac

SEQ ID NO: 7753078 - DNA, 22 bp, Homo sapiens
tttcacatatcaactctatcct

SEQ ID NO: 7753079 - DNA, 22 bp, Homo sapiens
ctcctgtgttcaagcgattctc

SEQ ID NO: 7753080 - DNA, 22 bp, Homo sapiens
ctccttcctggttagcacctta

SEQ ID NO: 7753081 - DNA, 22 bp, Homo sapiens
ctccttcctgccccagtgataa

SEQ ID NO: 7753082 - DNA, 22 bp, Homo sapiens
ctccttcccctactcagcatcc

SEQ ID NO: 7753083 - DNA, 22 bp, Homo sapiens
tttattcacttcagtgccaaag

SEQ ID NO: 7753084 - DNA, 22 bp, Homo sapiens
tttattcactggggtctgcccg

SEQ ID NO: 7753085 - DNA, 22 bp, Homo sapiens
tttatgtaagtggaatgatgcc

SEQ ID NO: 7753086 - DNA, 22 bp, Homo sapiens
cgtttattttgaagattccact

SEQ ID NO: 7753087 - DNA, 22 bp, Homo sapiens
ttctgcagtgtgcagggcctgt

SEQ ID NO: 7753088 - DNA, 22 bp, Homo sapiens
ctcagaaaggtgccatttatgt

SEQ ID NO: 7753089 - DNA, 22 bp, Homo sapiens
ctcagagaagatggatgaggta

SEQ ID NO: 7753090 - DNA, 22 bp, Homo sapiens
ttctggattagcatgatcccta

SEQ ID NO: 7753091 - DNA, 22 bp, Homo sapiens
ctcagggcggcgggcagcccag

SEQ ID NO: 7753092 - DNA, 22 bp, Homo sapiens
ctcagggctggaaagccaggaa

SEQ ID NO: 7753093 - DNA, 22 bp, Homo sapiens
ctcaggggacctggctccgagt

SEQ ID NO: 7753094 - DNA, 22 bp, Homo sapiens
ctcagggcttgagtgtccagga

SEQ ID NO: 7753095 - DNA, 22 bp, Homo sapiens
ctcagggggaatcaggtcacag

SEQ ID NO: 7753096 - DNA, 22 bp, Homo sapiens
ctcagccccaatttgccctctt

SEQ ID NO: 7753097 - DNA, 22 bp, Homo sapiens
ctcaggaaaatattgaagaagt

SEQ ID NO: 7753098 - DNA, 22 bp, Homo sapiens
ctcaggaaccgcggcagcagcc

SEQ ID NO: 7753099 - DNA, 22 bp, Homo sapiens
ttgcagaaaacagttttcttgt

SEQ ID NO: 7753100 - DNA, 22 bp, Homo sapiens
cggggcctagctgcacaccctc

SEQ ID NO: 7753101 - DNA, 22 bp, Homo sapiens
cgtgggtcgggactccgcctcg

SEQ ID NO: 7753102 - DNA, 22 bp, Homo sapiens
cggggctggcacaggtgaccac

SEQ ID NO: 7753103 - DNA, 22 bp, Homo sapiens
cgggcaaggcgagactaggccc

SEQ ID NO: 7753104 - DNA, 22 bp, Homo sapiens
cggcacaggccccatcctgact

SEQ ID NO: 7753105 - DNA, 22 bp, Homo sapiens
cggcacagtggctcacgcctgt

SEQ ID NO: 7753106 - DNA, 22 bp, Homo sapiens
ttatttcatataatgttatcaa

SEQ ID NO: 7753107 - DNA, 22 bp, Homo sapiens
ttatttcatgtaaaatttatgt

SEQ ID NO: 7753108 - DNA, 22 bp, Homo sapiens
ttatttcaaaagagcttggggt

SEQ ID NO: 7753109 - DNA, 21 bp, Homo sapiens
ttatttcacatggacttccag

SEQ ID NO: 7753110 - DNA, 20 bp, Homo sapiens
ttatttcagttgctagattg

SEQ ID NO: 7753111 - DNA, 22 bp, Homo sapiens
ccttttctgaaccacttaaata

SEQ ID NO: 7753112 - DNA, 22 bp, Homo sapiens
ttattcagcatttagaggaagg

SEQ ID NO: 7753113 - DNA, 22 bp, Homo sapiens
cgaacacacttgggagttctga

SEQ ID NO: 7753114 - DNA, 22 bp, Homo sapiens
cgaaaatagatctgtttcccag

SEQ ID NO: 7753115 - DNA, 22 bp, Homo sapiens
ccttagcattagaagctgtggg

SEQ ID NO: 7753116 - DNA, 22 bp, Homo sapiens
ccttagcatggctgtgctgtgt

SEQ ID NO: 7753117 - DNA, 22 bp, Homo sapiens
ccttagcaaattggcatcttct

SEQ ID NO: 7753118 - DNA, 22 bp, Homo sapiens
ccttagcagggccgggcctggg

SEQ ID NO: 7753119 - DNA, 22 bp, Homo sapiens
ccttagcagggagtctgtccag

SEQ ID NO: 7753120 - DNA, 22 bp, Homo sapiens
ccttagcaactgtcatagagca

SEQ ID NO: 7753121 - DNA, 22 bp, Homo sapiens
ccttagcaacacttagcaactg

SEQ ID NO: 7753122 - DNA, 23 bp, Homo sapiens
ttaagcactgttagtagaaaagg

SEQ ID NO: 7753123 - DNA, 22 bp, Homo sapiens
ttacataaaagttcacgtaggc

SEQ ID NO: 7753124 - DNA, 22 bp, Homo sapiens
ccttcagcctagaacttgagag

SEQ ID NO: 7753125 - DNA, 22 bp, Homo sapiens
ttagcaccctgatactagaatg

SEQ ID NO: 7753126 - DNA, 22 bp, Homo sapiens
ccttgcctcattgtgcttctcc

SEQ ID NO: 7753127 - DNA, 22 bp, Homo sapiens
ttagtttccaccacacatgttc

SEQ ID NO: 7753128 - DNA, 22 bp, Homo sapiens
ttagtttcctgtggtgtgaagt

SEQ ID NO: 7753129 - DNA, 22 bp, Homo sapiens
gaggctggttctgaagtactgt

SEQ ID NO: 7753130 - DNA, 22 bp, Homo sapiens
gaggctagagcaggggctcaat

SEQ ID NO: 7753131 - DNA, 22 bp, Homo sapiens
gaggcctgtagtcatggatgta

SEQ ID NO: 7753132 - DNA, 22 bp, Homo sapiens
gaggctgtaagtgtggagccta

SEQ ID NO: 7753133 - DNA, 22 bp, Homo sapiens
gaggctgtaacttgggcactgg

SEQ ID NO: 7753134 - DNA, 22 bp, Homo sapiens
gaggctgtctgttagcctggga

SEQ ID NO: 7753135 - DNA, 21 bp, Homo sapiens
gaggctgtctgctgctggcct

SEQ ID NO: 7753136 - DNA, 22 bp, Homo sapiens
gagtaccacttccctacacttt

SEQ ID NO: 7753137 - DNA, 22 bp, Homo sapiens
gaggtcctgtctgagaatggag

SEQ ID NO: 7753138 - DNA, 22 bp, Homo sapiens
gaggtctgccttcaggagagtt

SEQ ID NO: 7753139 - DNA, 22 bp, Homo sapiens
gaggtctgagtgcggaaagcct

SEQ ID NO: 7753140 - DNA, 22 bp, Homo sapiens
gaggtctgggatggggcctgaa

SEQ ID NO: 7753141 - DNA, 22 bp, Homo sapiens
gaggtctgggcttgggcctggt

SEQ ID NO: 7753142 - DNA, 22 bp, Homo sapiens
gagctggtcgaaatgggctgac

SEQ ID NO: 7753143 - DNA, 22 bp, Homo sapiens
gagctggtccacaatctgcagg

SEQ ID NO: 7753144 - DNA, 22 bp, Homo sapiens
gagctggtgatcagctggagga

SEQ ID NO: 7753145 - DNA, 22 bp, Homo sapiens
gagctggtgtgtgcccaagcac

SEQ ID NO: 7753146 - DNA, 22 bp, Homo sapiens
gagctggtggtgagaaagctct

SEQ ID NO: 7753147 - DNA, 22 bp, Homo sapiens
gagctggtgtgtgcccgagcac

SEQ ID NO: 7753148 - DNA, 22 bp, Homo sapiens
gagctggtgctcttgtcaagac

SEQ ID NO: 7753149 - DNA, 22 bp, Homo sapiens
gagctggtgctgtgcctgttct

SEQ ID NO: 7753150 - DNA, 22 bp, Homo sapiens
gagctggtcagtttcagggcca

SEQ ID NO: 7753151 - DNA, 22 bp, Homo sapiens
gagctggtcagtttcaggagag

SEQ ID NO: 7753152 - DNA, 16 bp, Homo sapiens
gagctggtagcagctg

SEQ ID NO: 7753153 - DNA, 22 bp, Homo sapiens
gagctggtattccagtttagtt

SEQ ID NO: 7753154 - DNA, 22 bp, Homo sapiens
gagctggtaaaggatcttgtct

SEQ ID NO: 7753155 - DNA, 20 bp, Homo sapiens
gagctgtgctctcaggagcc

SEQ ID NO: 7753156 - DNA, 22 bp, Homo sapiens
gagctgtgccaatctgtctggg

SEQ ID NO: 7753157 - DNA, 22 bp, Homo sapiens
gagctgtgaaaagtgcctgggg

SEQ ID NO: 7753158 - DNA, 22 bp, Homo sapiens
gagctggttttaggctatgtct

SEQ ID NO: 7753159 - DNA, 16 bp, Homo sapiens
gagctggtgccggagc

SEQ ID NO: 7753160 - DNA, 22 bp, Homo sapiens
gagctggttctgtccagggaat

SEQ ID NO: 7753161 - DNA, 22 bp, Homo sapiens
gagcaggcaactctgcagtgcc

SEQ ID NO: 7753162 - DNA, 22 bp, Homo sapiens
gagcaggccagcaatggaaggg

SEQ ID NO: 7753163 - DNA, 20 bp, Homo sapiens
gaggatgcagacagagggca

SEQ ID NO: 7753164 - DNA, 22 bp, Homo sapiens
gaggactgcagatgggtgcatc

SEQ ID NO: 7753165 - DNA, 22 bp, Homo sapiens
gaggactgaaacttacaggaaa

SEQ ID NO: 7753166 - DNA, 22 bp, Homo sapiens
gaggacctttagtagaagtgca

SEQ ID NO: 7753167 - DNA, 22 bp, Homo sapiens
gaggactctgggcgtgtatggg

SEQ ID NO: 7753168 - DNA, 22 bp, Homo sapiens
gaggacatagtggactagggtt

SEQ ID NO: 7753169 - DNA, 22 bp, Homo sapiens
gaggccagaatgagtctctggg

SEQ ID NO: 7753170 - DNA, 22 bp, Homo sapiens
gaggccagaagtgcctcgggct

SEQ ID NO: 7753171 - DNA, 22 bp, Homo sapiens
gaggatggtatgaggcaagcaa

SEQ ID NO: 7753172 - DNA, 22 bp, Homo sapiens
gaggcatgcagagctggagcag

SEQ ID NO: 7753173 - DNA, 22 bp, Homo sapiens
gaggcatggcctgaggctagga

SEQ ID NO: 7753174 - DNA, 19 bp, Homo sapiens
gagcaacatatgtaaactc

SEQ ID NO: 7753175 - DNA, 22 bp, Homo sapiens
gagcaagaccctgggttctctc

SEQ ID NO: 7753176 - DNA, 22 bp, Homo sapiens
gagcaagagtgttggactttga

SEQ ID NO: 7753177 - DNA, 22 bp, Homo sapiens
gagcaagactcactgcatcttg

SEQ ID NO: 7753178 - DNA, 22 bp, Homo sapiens
gagcaagactacaggcagatga

SEQ ID NO: 7753179 - DNA, 22 bp, Homo sapiens
gagcaagattaaaaggctgggt

SEQ ID NO: 7753180 - DNA, 22 bp, Homo sapiens
gagcaagattttataagttgtg

SEQ ID NO: 7753181 - DNA, 22 bp, Homo sapiens
gagcaatgcccttcaccagccc

SEQ ID NO: 7753182 - DNA, 22 bp, Homo sapiens
gagcacacactttgaaattagg

SEQ ID NO: 7753183 - DNA, 22 bp, Homo sapiens
gagcagcttgcgctgtcttcac

SEQ ID NO: 7753184 - DNA, 18 bp, Homo sapiens
gagcagaggagggttttt

SEQ ID NO: 7753185 - DNA, 22 bp, Homo sapiens
gagcagagcttctcaaagtaaa

SEQ ID NO: 7753186 - DNA, 23 bp, Homo sapiens
gagcagagcgggcgggggtcctg

SEQ ID NO: 7753187 - DNA, 22 bp, Homo sapiens
gagcacccatgcagagggaaca

SEQ ID NO: 7753188 - DNA, 22 bp, Homo sapiens
gagcacccgtcggtggtaggaa

SEQ ID NO: 7753189 - DNA, 22 bp, Homo sapiens
gagcaccgcctccacgatgccc

SEQ ID NO: 7753190 - DNA, 22 bp, Homo sapiens
gagcaccctttgcacatcagtc

SEQ ID NO: 7753191 - DNA, 22 bp, Homo sapiens
gagcacccttgagagactctcg

SEQ ID NO: 7753192 - DNA, 22 bp, Homo sapiens
gagcactgatttatttttgtct

SEQ ID NO: 7753193 - DNA, 22 bp, Homo sapiens
gagcaccctacctgccactgag

SEQ ID NO: 7753194 - DNA, 22 bp, Homo sapiens
gagcacgttgaagcgcactgtc

SEQ ID NO: 7753195 - DNA, 22 bp, Homo sapiens
gagcagagaatccagctaagtg

SEQ ID NO: 7753196 - DNA, 22 bp, Homo sapiens
gagagaatgtacatgctagggg

SEQ ID NO: 7753197 - DNA, 22 bp, Homo sapiens
gagagaagaatgttccgaggcc

SEQ ID NO: 7753198 - DNA, 22 bp, Homo sapiens
gagagaagggacttctacactt

SEQ ID NO: 7753199 - DNA, 22 bp, Homo sapiens
gagaagccgagtcagctgagcc

SEQ ID NO: 7753200 - DNA, 22 bp, Homo sapiens
gagaactttctgtgtttttatc

SEQ ID NO: 7753201 - DNA, 22 bp, Homo sapiens
gagaagaaaattccgtgaacac

SEQ ID NO: 7753202 - DNA, 22 bp, Homo sapiens
gagagcaggaggcagcgggacg

SEQ ID NO: 7753203 - DNA, 22 bp, Homo sapiens
gagagcaggctctcgggggcca

SEQ ID NO: 7753204 - DNA, 22 bp, Homo sapiens
gagagccatggtggagatgggg

SEQ ID NO: 7753205 - DNA, 22 bp, Homo sapiens
gacagctgctcccgtttctgct

SEQ ID NO: 7753206 - DNA, 22 bp, Homo sapiens
gacagctgcatcctcagacaca

SEQ ID NO: 7753207 - DNA, 22 bp, Homo sapiens
gacagccaggcatagggagtat

SEQ ID NO: 7753208 - DNA, 22 bp, Homo sapiens
gacagtcctgcaggttgaactc

SEQ ID NO: 7753209 - DNA, 22 bp, Homo sapiens
gacagtccttgcccagtatcta

SEQ ID NO: 7753210 - DNA, 22 bp, Homo sapiens
gacatcaattcagcattttaag

SEQ ID NO: 7753211 - DNA, 22 bp, Homo sapiens
gacatacatctctggaaaaaaa

SEQ ID NO: 7753212 - DNA, 22 bp, Homo sapiens
gacctgcccactctgaggacat

SEQ ID NO: 7753213 - DNA, 22 bp, Homo sapiens
gacatgaacctaccataatgat

SEQ ID NO: 7753214 - DNA, 22 bp, Homo sapiens
gaccttcttgctgtgtcctaac

SEQ ID NO: 7753215 - DNA, 22 bp, Homo sapiens
gactagtcatttgcattccgtc

SEQ ID NO: 7753216 - DNA, 22 bp, Homo sapiens
gacaaaggatcagaggttggga

SEQ ID NO: 7753217 - DNA, 22 bp, Homo sapiens
gaagaaggtgccagaggcttac

SEQ ID NO: 7753218 - DNA, 22 bp, Homo sapiens
gaagaaggtgctacacagggca

SEQ ID NO: 7753219 - DNA, 22 bp, Homo sapiens
gaagaagggtaaggagtgttga

SEQ ID NO: 7753220 - DNA, 22 bp, Homo sapiens
gaagaagggagtgcgtgtaata

SEQ ID NO: 7753221 - DNA, 22 bp, Homo sapiens
gaagaaggtggcccaggggtag

SEQ ID NO: 7753222 - DNA, 23 bp, Homo sapiens
ctttcctttctttgacacccagc

SEQ ID NO: 7753223 - DNA, 22 bp, Homo sapiens
cttgcttgtttagttcacagat

SEQ ID NO: 7753224 - DNA, 22 bp, Homo sapiens
cttcttcagaggccagcctctg

SEQ ID NO: 7753225 - DNA, 22 bp, Homo sapiens
cttcccttggtgaacagagcat

SEQ ID NO: 7753226 - DNA, 22 bp, Homo sapiens
cttccctttctggtgacttctc

SEQ ID NO: 7753227 - DNA, 22 bp, Homo sapiens
cttccctctgctccttggtcca

SEQ ID NO: 7753228 - DNA, 22 bp, Homo sapiens
cttcacctgtacgctggagcta

SEQ ID NO: 7753229 - DNA, 22 bp, Homo sapiens
cttcactgtttggttcacagca

SEQ ID NO: 7753230 - DNA, 22 bp, Homo sapiens
gaacttgagatatgagtaggta

SEQ ID NO: 7753231 - DNA, 17 bp, Homo sapiens
gaagaaggaatctagaa

SEQ ID NO: 7753232 - DNA, 22 bp, Homo sapiens
gaagaaggaagatcatgcttga

SEQ ID NO: 7753233 - DNA, 22 bp, Homo sapiens
gaaatgttcctgatccctgatt

SEQ ID NO: 7753234 - DNA, 22 bp, Homo sapiens
gaaatattgtactggagatgtt

SEQ ID NO: 7753235 - DNA, 22 bp, Homo sapiens
gaaatattgggactcagagctt

SEQ ID NO: 7753236 - DNA, 22 bp, Homo sapiens
gaaatattcttgtcttgttttc

SEQ ID NO: 7753237 - DNA, 22 bp, Homo sapiens
gaaatattacagtggaggggat

SEQ ID NO: 7753238 - DNA, 22 bp, Homo sapiens
gaaagaatgctatagtgacttc

SEQ ID NO: 7753239 - DNA, 22 bp, Homo sapiens
cttttttcctaaggcaacatga

SEQ ID NO: 7753240 - DNA, 20 bp, Homo sapiens
ctttttctccagctctgagc

SEQ ID NO: 7753241 - DNA, 22 bp, Homo sapiens
ctttttctgatgttccatgatt

SEQ ID NO: 7753242 - DNA, 22 bp, Homo sapiens
ctggggggctactgacagagga

SEQ ID NO: 7753243 - DNA, 22 bp, Homo sapiens
ctggggtgaaggattacctgag

SEQ ID NO: 7753244 - DNA, 22 bp, Homo sapiens
ctggggtccttgccatgtgtca

SEQ ID NO: 7753245 - DNA, 22 bp, Homo sapiens
ctggggtggagattggcaatct

SEQ ID NO: 7753246 - DNA, 22 bp, Homo sapiens
ctggggtggatgggtccaagtt

SEQ ID NO: 7753247 - DNA, 22 bp, Homo sapiens
ctggggtggtgcaggcctcatg

SEQ ID NO: 7753248 - DNA, 22 bp, Homo sapiens
ctggggtgtctcgtctgccatt

SEQ ID NO: 7753249 - DNA, 22 bp, Homo sapiens
ctggtgtttatctgactgccta

SEQ ID NO: 7753250 - DNA, 22 bp, Homo sapiens
ctggtgttgtccgggtgagagt

SEQ ID NO: 7753251 - DNA, 22 bp, Homo sapiens
ctgggagtgttctaggtcacat

SEQ ID NO: 7753252 - DNA, 22 bp, Homo sapiens
ctgggatgcggaggttgcggtg

SEQ ID NO: 7753253 - DNA, 22 bp, Homo sapiens
ctgggcctaggatggaagggcc

SEQ ID NO: 7753254 - DNA, 22 bp, Homo sapiens
ctgggcctagcaacagaggagt

SEQ ID NO: 7753255 - DNA, 22 bp, Homo sapiens
ctgggcctagaggaagctgaca

SEQ ID NO: 7753256 - DNA, 22 bp, Homo sapiens
ctgggcctaacccacagcgttt

SEQ ID NO: 7753257 - DNA, 22 bp, Homo sapiens
ctgggcctcatccccagagttt

SEQ ID NO: 7753258 - DNA, 22 bp, Homo sapiens
ctgggcctcatccagccacaac

SEQ ID NO: 7753259 - DNA, 22 bp, Homo sapiens
ctgggcctcatcctcagagttt

SEQ ID NO: 7753260 - DNA, 22 bp, Homo sapiens
ctgggcctcaatctcagagttt

SEQ ID NO: 7753261 - DNA, 22 bp, Homo sapiens
ctgggcctcatgcacagagatg

SEQ ID NO: 7753262 - DNA, 22 bp, Homo sapiens
ctgggcctccagctctgccagc

SEQ ID NO: 7753263 - DNA, 19 bp, Homo sapiens
ctgtgggtgtgcaagggtg

SEQ ID NO: 7753264 - DNA, 22 bp, Homo sapiens
ctgtgtgatgggaagaatgttt

SEQ ID NO: 7753265 - DNA, 22 bp, Homo sapiens
ctgtgttttgattaaaaagcaa

SEQ ID NO: 7753266 - DNA, 22 bp, Homo sapiens
ctgtgaattgaatatgactatg

SEQ ID NO: 7753267 - DNA, 22 bp, Homo sapiens
ctgtgaatctgggtcagttgta

SEQ ID NO: 7753268 - DNA, 22 bp, Homo sapiens
ctgtgaatgctagtaagagtgc

SEQ ID NO: 7753269 - DNA, 22 bp, Homo sapiens
ctgtgaatgttatatctcaatg

SEQ ID NO: 7753270 - DNA, 22 bp, Homo sapiens
ctgtgaatgttgaataaatcct

SEQ ID NO: 7753271 - DNA, 22 bp, Homo sapiens
ctgtgaatcttgatgttatttc

SEQ ID NO: 7753272 - DNA, 22 bp, Homo sapiens
ctgtgaatcttgatgttatttc

SEQ ID NO: 7753273 - DNA, 22 bp, Homo sapiens
ctgtgaatcatgacctctctgg

SEQ ID NO: 7753274 - DNA, 22 bp, Homo sapiens
ctgtgaattaagtattgttatc

SEQ ID NO: 7753275 - DNA, 22 bp, Homo sapiens
ctgtgaattgcaacaattgcaa

SEQ ID NO: 7753276 - DNA, 22 bp, Homo sapiens
ctgtgaatttaaagcacacatc

SEQ ID NO: 7753277 - DNA, 22 bp, Homo sapiens
ctgtgaattttccaatattccg

SEQ ID NO: 7753278 - DNA, 22 bp, Homo sapiens
ctgtgagaaaggtgatggaggt

SEQ ID NO: 7753279 - DNA, 19 bp, Homo sapiens
gcaccagattgagtgacac

SEQ ID NO: 7753280 - DNA, 22 bp, Homo sapiens
gcacccagaggtcagcagtgct

SEQ ID NO: 7753281 - DNA, 22 bp, Homo sapiens
gcacccagatagcaaggattag

SEQ ID NO: 7753282 - DNA, 22 bp, Homo sapiens
gagtagcagtagtccaagccag

SEQ ID NO: 7753283 - DNA, 22 bp, Homo sapiens
gcaaggagcctggaggtgagtg

SEQ ID NO: 7753284 - DNA, 20 bp, Homo sapiens
gcaaggcaggttgaccaaga

SEQ ID NO: 7753285 - DNA, 20 bp, Homo sapiens
gcaaggcacagtgaggaggg

SEQ ID NO: 7753286 - DNA, 22 bp, Homo sapiens
gcacagaagagctttggaatga

SEQ ID NO: 7753287 - DNA, 22 bp, Homo sapiens
gcacagaagtaaaatacaagtc

SEQ ID NO: 7753288 - DNA, 22 bp, Homo sapiens
gcacagaataacactctgggct

SEQ ID NO: 7753289 - DNA, 22 bp, Homo sapiens
gcacagaacttctcttagtagg

SEQ ID NO: 7753290 - DNA, 22 bp, Homo sapiens
gcacagaaccctatctttcgga

SEQ ID NO: 7753291 - DNA, 22 bp, Homo sapiens
gcacatgttgctagttacttgc

SEQ ID NO: 7753292 - DNA, 22 bp, Homo sapiens
gcacatgtgggtaagcacatgg

SEQ ID NO: 7753293 - DNA, 22 bp, Homo sapiens
gcacatgtgagagtagaggcct

SEQ ID NO: 7753294 - DNA, 22 bp, Homo sapiens
gcacagcaatttctataagctc

SEQ ID NO: 7753295 - DNA, 22 bp, Homo sapiens
gcacagcacagcaacatgtttt

SEQ ID NO: 7753296 - DNA, 22 bp, Homo sapiens
gcagctgtcactttcacaatgc

SEQ ID NO: 7753297 - DNA, 22 bp, Homo sapiens
gcagctgtaaagcagaaatagt

SEQ ID NO: 7753298 - DNA, 21 bp, Homo sapiens
gcaggcatgtctactgcatgt

SEQ ID NO: 7753299 - DNA, 22 bp, Homo sapiens
gcaggccagctgtgcagatggg

SEQ ID NO: 7753300 - DNA, 22 bp, Homo sapiens
gcagggcagctgaagctaggtg

SEQ ID NO: 7753301 - DNA, 22 bp, Homo sapiens
gcagggcagctcactgtggttc

SEQ ID NO: 7753302 - DNA, 22 bp, Homo sapiens
gcaggcctaagagaaggcattg

SEQ ID NO: 7753303 - DNA, 22 bp, Homo sapiens
gcaggcctcccctgctggagct

SEQ ID NO: 7753304 - DNA, 22 bp, Homo sapiens
gcaggccctcctctagcaaggc

SEQ ID NO: 7753305 - DNA, 19 bp, Homo sapiens
gcaggtcattaggctaggt

SEQ ID NO: 7753306 - DNA, 22 bp, Homo sapiens
gcaggtctatcaggctgcaggt

SEQ ID NO: 7753307 - DNA, 22 bp, Homo sapiens
gcaggtctggcatagagcctgc

SEQ ID NO: 7753308 - DNA, 22 bp, Homo sapiens
gcaggtctggagggcactgggg

SEQ ID NO: 7753309 - DNA, 22 bp, Homo sapiens
gcagggcagtaagagctagagt

SEQ ID NO: 7753310 - DNA, 22 bp, Homo sapiens
gcagggcaggatttgaacccag

SEQ ID NO: 7753311 - DNA, 22 bp, Homo sapiens
gcagggcagggcaagaactggg

SEQ ID NO: 7753312 - DNA, 21 bp, Homo sapiens
gcagccagacgggattcagtt

SEQ ID NO: 7753313 - DNA, 21 bp, Homo sapiens
gcagccagccgagaccatgcc

SEQ ID NO: 7753314 - DNA, 22 bp, Homo sapiens
gcagcagcccagggctctcaga

SEQ ID NO: 7753315 - DNA, 22 bp, Homo sapiens
gcagccagaagactcagaacaa

SEQ ID NO: 7753316 - DNA, 22 bp, Homo sapiens
gcagccacctcccatggcgggg

SEQ ID NO: 7753317 - DNA, 22 bp, Homo sapiens
gcagccaccctcaaggctgaat

SEQ ID NO: 7753318 - DNA, 22 bp, Homo sapiens
gcagcactgatcctaaacttag

SEQ ID NO: 7753319 - DNA, 22 bp, Homo sapiens
gcagcagaagtagaagtacagg

SEQ ID NO: 7753320 - DNA, 17 bp, Homo sapiens
gcagccagtgcagcagg

SEQ ID NO: 7753321 - DNA, 22 bp, Homo sapiens
gcagccagtatcctctgagatt

SEQ ID NO: 7753322 - DNA, 22 bp, Homo sapiens
gcagccaggaagcccaggacac

SEQ ID NO: 7753323 - DNA, 22 bp, Homo sapiens
gcagccagtgggatgagaaaga

SEQ ID NO: 7753324 - DNA, 22 bp, Homo sapiens
gcctgagggctcctagcaggct

SEQ ID NO: 7753325 - DNA, 22 bp, Homo sapiens
gcctcccctgcaattgtccttg

SEQ ID NO: 7753326 - DNA, 22 bp, Homo sapiens
gcctccccaggggtgtcatgag

SEQ ID NO: 7753327 - DNA, 19 bp, Homo sapiens
gcctgcagaaaaggcaggg

SEQ ID NO: 7753328 - DNA, 22 bp, Homo sapiens
gcctgcagaactgtgaggcaat

SEQ ID NO: 7753329 - DNA, 22 bp, Homo sapiens
gcctgcaaacaaggacttctga

SEQ ID NO: 7753330 - DNA, 22 bp, Homo sapiens
gcctgcaactggcacagcttgt

SEQ ID NO: 7753331 - DNA, 21 bp, Homo sapiens
gcctgcagaccccaccaggct

SEQ ID NO: 7753332 - DNA, 20 bp, Homo sapiens
gcctgcagagaaggtcagag

SEQ ID NO: 7753333 - DNA, 22 bp, Homo sapiens
gcctgcagaggtgctgctagct

SEQ ID NO: 7753334 - DNA, 22 bp, Homo sapiens
gcctgcagctgcttccacacac

SEQ ID NO: 7753335 - DNA, 22 bp, Homo sapiens
gcctgcagcctcagagaatttt

SEQ ID NO: 7753336 - DNA, 18 bp, Homo sapiens
gcctgcaggcacgggggt

SEQ ID NO: 7753337 - DNA, 22 bp, Homo sapiens
gcctgcagggcctgggcctacc

SEQ ID NO: 7753338 - DNA, 22 bp, Homo sapiens
gcctgcagcccctctgcagtag

SEQ ID NO: 7753339 - DNA, 22 bp, Homo sapiens
gcctgcagcctcaagggctgag

SEQ ID NO: 7753340 - DNA, 22 bp, Homo sapiens
gcctgcagccagggagttctct

SEQ ID NO: 7753341 - DNA, 22 bp, Homo sapiens
gcctgcagatatataggatggt

SEQ ID NO: 7753342 - DNA, 22 bp, Homo sapiens
gcctgcagtgagtgcagaaggt

SEQ ID NO: 7753343 - DNA, 20 bp, Homo sapiens
gcctgcaggttggatgggat

SEQ ID NO: 7753344 - DNA, 22 bp, Homo sapiens
gcctgcagggtgatgggctgcc

SEQ ID NO: 7753345 - DNA, 22 bp, Homo sapiens
gcctgcagttctgtgctaggca

SEQ ID NO: 7753346 - DNA, 21 bp, Homo sapiens
gcctgcagttttgaagccctt

SEQ ID NO: 7753347 - DNA, 22 bp, Homo sapiens
gccctcagaatgggctctaatc

SEQ ID NO: 7753348 - DNA, 22 bp, Homo sapiens
gccctcagaggacagctgactt

SEQ ID NO: 7753349 - DNA, 22 bp, Homo sapiens
gccctcagagttccccacagtg

SEQ ID NO: 7753350 - DNA, 22 bp, Homo sapiens
gcccctgggagcagagccacca

SEQ ID NO: 7753351 - DNA, 22 bp, Homo sapiens
gcccgcgccagcctctccatct

SEQ ID NO: 7753352 - DNA, 17 bp, Homo sapiens
gcccgtgggctacggta

SEQ ID NO: 7753353 - DNA, 22 bp, Homo sapiens
gccccaggtggtaaacctaaga

SEQ ID NO: 7753354 - DNA, 22 bp, Homo sapiens
gccctgcctgtctgctgggagg

SEQ ID NO: 7753355 - DNA, 19 bp, Homo sapiens
gcctcatttccacctcccc

SEQ ID NO: 7753356 - DNA, 22 bp, Homo sapiens
gcctcattacagccaggaagca

SEQ ID NO: 7753357 - DNA, 22 bp, Homo sapiens
gcctcagggggagaggccagct

SEQ ID NO: 7753358 - DNA, 22 bp, Homo sapiens
gcctcaggtgcatctctcattc

SEQ ID NO: 7753359 - DNA, 22 bp, Homo sapiens
gcattaatgtaagacccactcc

SEQ ID NO: 7753360 - DNA, 22 bp, Homo sapiens
gcattgaatcctatcaggcaaa

SEQ ID NO: 7753361 - DNA, 22 bp, Homo sapiens
gcagttaaaaataaaccttcat

SEQ ID NO: 7753362 - DNA, 18 bp, Homo sapiens
gcaggtgccactgctgtt

SEQ ID NO: 7753363 - DNA, 22 bp, Homo sapiens
gcatttaaatttgaacttcaga

SEQ ID NO: 7753364 - DNA, 22 bp, Homo sapiens
gccaggctaagaaaggtgtgat

SEQ ID NO: 7753365 - DNA, 22 bp, Homo sapiens
gccaggaatgcataaatgacct

SEQ ID NO: 7753366 - DNA, 22 bp, Homo sapiens
gccaggaatcactgctgagtaa

SEQ ID NO: 7753367 - DNA, 22 bp, Homo sapiens
gccaggaagtgcagccctgcca

SEQ ID NO: 7753368 - DNA, 22 bp, Homo sapiens
gccaggaagttgggccagtcta

SEQ ID NO: 7753369 - DNA, 22 bp, Homo sapiens
gccaggaagtcagccaagccca

SEQ ID NO: 7753370 - DNA, 22 bp, Homo sapiens
gccaggaaggctgaagccagaa

SEQ ID NO: 7753371 - DNA, 22 bp, Homo sapiens
gccaggaaggctccctggtcac

SEQ ID NO: 7753372 - DNA, 22 bp, Homo sapiens
gccaggaagcagttagatgggt

SEQ ID NO: 7753373 - DNA, 18 bp, Homo sapiens
gccaggaagcatggggac

SEQ ID NO: 7753374 - DNA, 22 bp, Homo sapiens
gccaggaacacaatgccaagct

SEQ ID NO: 7753375 - DNA, 22 bp, Homo sapiens
gccaggaagagagagccctcca

SEQ ID NO: 7753376 - DNA, 18 bp, Homo sapiens
gccaggaagaggaatgtg

SEQ ID NO: 7753377 - DNA, 22 bp, Homo sapiens
gccaggaaattcatgccagatc

SEQ ID NO: 7753378 - DNA, 22 bp, Homo sapiens
gccaggaaagggaattccctga

SEQ ID NO: 7753379 - DNA, 22 bp, Homo sapiens
gccaggaaaaaccggccctgct

SEQ ID NO: 7753380 - DNA, 22 bp, Homo sapiens
gccaggaaaaagggtggccaat

SEQ ID NO: 7753381 - DNA, 22 bp, Homo sapiens
gccaggaaaaacgtggtgggag

SEQ ID NO: 7753382 - DNA, 22 bp, Homo sapiens
gccaggaaagcaaaatcaccca

SEQ ID NO: 7753383 - DNA, 22 bp, Homo sapiens
gccaggaaagccactggcatac

SEQ ID NO: 7753384 - DNA, 22 bp, Homo sapiens
gccaggaaaagaagctggtgct

SEQ ID NO: 7753385 - DNA, 19 bp, Homo sapiens
gccaggaaagaatcaggcg

SEQ ID NO: 7753386 - DNA, 22 bp, Homo sapiens
gccagagaatgaaaatcagatt

SEQ ID NO: 7753387 - DNA, 22 bp, Homo sapiens
gccagaaacatacacatcactt

SEQ ID NO: 7753388 - DNA, 20 bp, Homo sapiens
gctttaagacacagctaaaa

SEQ ID NO: 7753389 - DNA, 22 bp, Homo sapiens
gctttaagtctcagtttgttag

SEQ ID NO: 7753390 - DNA, 22 bp, Homo sapiens
gctgtgtgctctggtctttctt

SEQ ID NO: 7753391 - DNA, 23 bp, Homo sapiens
gcttttaaacctgtgactgccgc

SEQ ID NO: 7753392 - DNA, 22 bp, Homo sapiens
gcttttaattagttgcttccat

SEQ ID NO: 7753393 - DNA, 22 bp, Homo sapiens
gctgtagggctgagctggaccg

SEQ ID NO: 7753394 - DNA, 22 bp, Homo sapiens
gctgtaggtttttccaggagtt

SEQ ID NO: 7753395 - DNA, 22 bp, Homo sapiens
gctggtccacatcctggtacgt

SEQ ID NO: 7753396 - DNA, 22 bp, Homo sapiens
gctggtccaattatgaactgtt

SEQ ID NO: 7753397 - DNA, 22 bp, Homo sapiens
gctggtcccaatgtgtttcctt

SEQ ID NO: 7753398 - DNA, 22 bp, Homo sapiens
gctggtccattggcactgctca

SEQ ID NO: 7753399 - DNA, 22 bp, Homo sapiens
gctggtccagggcctctgtggg

SEQ ID NO: 7753400 - DNA, 22 bp, Homo sapiens
gctggtccactccctggaggct

SEQ ID NO: 7753401 - DNA, 22 bp, Homo sapiens
ggaaggaattccaagactaaag

SEQ ID NO: 7753402 - DNA, 22 bp, Homo sapiens
ggaaggctttgaggggtgctgg

SEQ ID NO: 7753403 - DNA, 22 bp, Homo sapiens
ggacaggggcgtggggattgtt

SEQ ID NO: 7753404 - DNA, 23 bp, Homo sapiens
ggacagggccctgccctatggcc

SEQ ID NO: 7753405 - DNA, 22 bp, Homo sapiens
ggagccagtttagacctcagtt

SEQ ID NO: 7753406 - DNA, 22 bp, Homo sapiens
ggagccagtgccctctggtgga

SEQ ID NO: 7753407 - DNA, 22 bp, Homo sapiens
ggagccagtatttagtggtctt

SEQ ID NO: 7753408 - DNA, 22 bp, Homo sapiens
ggagccaggcatatcggggcac

SEQ ID NO: 7753409 - DNA, 22 bp, Homo sapiens
ggagcctggtatagtgttgcat

SEQ ID NO: 7753410 - DNA, 22 bp, Homo sapiens
ggagcctgggcctcctgccctt

SEQ ID NO: 7753411 - DNA, 22 bp, Homo sapiens
ggagctggctacagagaactcc

SEQ ID NO: 7753412 - DNA, 18 bp, Homo sapiens
ggagctgggccccactcc

SEQ ID NO: 7753413 - DNA, 21 bp, Homo sapiens
ggagctggggagctggcccca

SEQ ID NO: 7753414 - DNA, 18 bp, Homo sapiens
ggagctgggcctggttcc

SEQ ID NO: 7753415 - DNA, 22 bp, Homo sapiens
ggagctgggaccctgtcatctg

SEQ ID NO: 7753416 - DNA, 22 bp, Homo sapiens
ggagctgggaattggatcatct

SEQ ID NO: 7753417 - DNA, 22 bp, Homo sapiens
ggagctgggaactatgtagtat

SEQ ID NO: 7753418 - DNA, 22 bp, Homo sapiens
ggaggaggggtgactgaatgct

SEQ ID NO: 7753419 - DNA, 22 bp, Homo sapiens
ggagctggtcagccttgagcat

SEQ ID NO: 7753420 - DNA, 22 bp, Homo sapiens
ggagctggggttggcatcttcc

SEQ ID NO: 7753421 - DNA, 22 bp, Homo sapiens
gctggagtgctgaggtgcagtg

SEQ ID NO: 7753422 - DNA, 22 bp, Homo sapiens
gctggagtgctggagtgcagtg

SEQ ID NO: 7753423 - DNA, 22 bp, Homo sapiens
gctggaggtagggaggtcctgt

SEQ ID NO: 7753424 - DNA, 22 bp, Homo sapiens
gctggaggtttcacctgagttt

SEQ ID NO: 7753425 - DNA, 22 bp, Homo sapiens
gctggagttggcaaggcatgta

SEQ ID NO: 7753426 - DNA, 22 bp, Homo sapiens
gctggaggggtaataggatggg

SEQ ID NO: 7753427 - DNA, 18 bp, Homo sapiens
gctgctggtggagggagc

SEQ ID NO: 7753428 - DNA, 22 bp, Homo sapiens
gctgagggtaacacttcgggat

SEQ ID NO: 7753429 - DNA, 22 bp, Homo sapiens
gctgagggggaaggaaagctga

SEQ ID NO: 7753430 - DNA, 22 bp, Homo sapiens
gctgagtgaggtccagagcttg

SEQ ID NO: 7753431 - DNA, 22 bp, Homo sapiens
gctgagtgattgatattttagt

SEQ ID NO: 7753432 - DNA, 22 bp, Homo sapiens
gctgagtgattgatattttagt

SEQ ID NO: 7753433 - DNA, 18 bp, Homo sapiens
gctgcaggcgcctgcggt

SEQ ID NO: 7753434 - DNA, 22 bp, Homo sapiens
gctgcaggggggtctggacttg

SEQ ID NO: 7753435 - DNA, 22 bp, Homo sapiens
gctgcaggctctgcaggaattg

SEQ ID NO: 7753436 - DNA, 22 bp, Homo sapiens
gctgcaggctgtggcaggggag

SEQ ID NO: 7753437 - DNA, 22 bp, Homo sapiens
gctccccttggtcctcctggga

SEQ ID NO: 7753438 - DNA, 22 bp, Homo sapiens
gctccctccatgaggcagaccg

SEQ ID NO: 7753439 - DNA, 22 bp, Homo sapiens
gctccctcatctgtgctgtttt

SEQ ID NO: 7753440 - DNA, 22 bp, Homo sapiens
gctccctctgctcaggcacttg

SEQ ID NO: 7753441 - DNA, 22 bp, Homo sapiens
gctagggcgggagtgctggaga

SEQ ID NO: 7753442 - DNA, 22 bp, Homo sapiens
gctaggaatcggacccaggaag

SEQ ID NO: 7753443 - DNA, 20 bp, Homo sapiens
gctaggaaggggaaaaagtg

SEQ ID NO: 7753444 - DNA, 22 bp, Homo sapiens
gcctggcaggcctcatgagggg

SEQ ID NO: 7753445 - DNA, 20 bp, Homo sapiens
gcctggcacccggggctggc

SEQ ID NO: 7753446 - DNA, 22 bp, Homo sapiens
gctcagggcgcgagggacgtgg

SEQ ID NO: 7753447 - DNA, 22 bp, Homo sapiens
gctcagggcctggctgcggact

SEQ ID NO: 7753448 - DNA, 22 bp, Homo sapiens
gctcagggccatggaccagcag

SEQ ID NO: 7753449 - DNA, 22 bp, Homo sapiens
gctcagggaaggccacgtgaga

SEQ ID NO: 7753450 - DNA, 22 bp, Homo sapiens
gctcagggagagagggcagccg

SEQ ID NO: 7753451 - DNA, 18 bp, Homo sapiens
gggctctggcatctgggt

SEQ ID NO: 7753452 - DNA, 22 bp, Homo sapiens
gggcaggtggcaaagccagagg

SEQ ID NO: 7753453 - DNA, 20 bp, Homo sapiens
gggcagagccagccagtccc

SEQ ID NO: 7753454 - DNA, 22 bp, Homo sapiens
gggcagagagctggaactcctt

SEQ ID NO: 7753455 - DNA, 21 bp, Homo sapiens
gggcagaggggcctcctgggt

SEQ ID NO: 7753456 - DNA, 16 bp, Homo sapiens
gggagtgaaggagggt

SEQ ID NO: 7753457 - DNA, 22 bp, Homo sapiens
gggagctgaatggcaatggaga

SEQ ID NO: 7753458 - DNA, 22 bp, Homo sapiens
gggagctgaagtaggggtaaat

SEQ ID NO: 7753459 - DNA, 22 bp, Homo sapiens
gggagctgaaggagccggcggg

SEQ ID NO: 7753460 - DNA, 22 bp, Homo sapiens
gggagctgaactgctgaagttg

SEQ ID NO: 7753461 - DNA, 20 bp, Homo sapiens
gggagtggtggtagcctgtg

SEQ ID NO: 7753462 - DNA, 22 bp, Homo sapiens
gggagtggtcctttcctatctg

SEQ ID NO: 7753463 - DNA, 22 bp, Homo sapiens
ggctggcatttacacaatgcat

SEQ ID NO: 7753464 - DNA, 22 bp, Homo sapiens
ggctggaggtagaagaacactt

SEQ ID NO: 7753465 - DNA, 17 bp, Homo sapiens
ggctggaggggacccgg

SEQ ID NO: 7753466 - DNA, 22 bp, Homo sapiens
ggctggagtgggctccagagtt

SEQ ID NO: 7753467 - DNA, 22 bp, Homo sapiens
ggctggataccaggagacaggg

SEQ ID NO: 7753468 - DNA, 22 bp, Homo sapiens
ggctgcagttgtgtgaaggccg

SEQ ID NO: 7753469 - DNA, 21 bp, Homo sapiens
ggctgcagggagccctggggt

SEQ ID NO: 7753470 - DNA, 22 bp, Homo sapiens
ggctctgcgcggtaaagtgact

SEQ ID NO: 7753471 - DNA, 22 bp, Homo sapiens
ggctgcaggcttccctccagca

SEQ ID NO: 7753472 - DNA, 17 bp, Homo sapiens
ggctgcagtccaggagg

SEQ ID NO: 7753473 - DNA, 22 bp, Homo sapiens
ggctgtggtcattaggaggttg

SEQ ID NO: 7753474 - DNA, 22 bp, Homo sapiens
ggctgtggtctgggtgctcccc

SEQ ID NO: 7753475 - DNA, 22 bp, Homo sapiens
ggctgtggccagcggggctgag

SEQ ID NO: 7753476 - DNA, 22 bp, Homo sapiens
ggctgtgggatgcataggagct

SEQ ID NO: 7753477 - DNA, 22 bp, Homo sapiens
ggctgtgggccagctagaccct

SEQ ID NO: 7753478 - DNA, 22 bp, Homo sapiens
ggctgtggggggagcctgcccg

SEQ ID NO: 7753479 - DNA, 22 bp, Homo sapiens
ggctgtgggtgtgacaggcctc

SEQ ID NO: 7753480 - DNA, 22 bp, Homo sapiens
ggctgtggggccgggtacagtg

SEQ ID NO: 7753481 - DNA, 22 bp, Homo sapiens
ggctgtggcagctggaagtggt

SEQ ID NO: 7753482 - DNA, 22 bp, Homo sapiens
ggctgtggagctgcagagttgg

SEQ ID NO: 7753483 - DNA, 22 bp, Homo sapiens
ggctgtggcattaggtgaggcc

SEQ ID NO: 7753484 - DNA, 22 bp, Homo sapiens
ggctgtggacactgagctcaga

SEQ ID NO: 7753485 - DNA, 21 bp, Homo sapiens
ggctgtggagccatgactcac

SEQ ID NO: 7753486 - DNA, 22 bp, Homo sapiens
gggaagatagtgttgagggccc

SEQ ID NO: 7753487 - DNA, 22 bp, Homo sapiens
gggaaggccggtccagtcaggt

SEQ ID NO: 7753488 - DNA, 22 bp, Homo sapiens
ggcctctgcaggcctcgacaag

SEQ ID NO: 7753489 - DNA, 22 bp, Homo sapiens
ggctctgccacttcttggctgt

SEQ ID NO: 7753490 - DNA, 22 bp, Homo sapiens
ggctctgcccagatgaagagga

SEQ ID NO: 7753491 - DNA, 22 bp, Homo sapiens
ggctctgcccaggtggacagca

SEQ ID NO: 7753492 - DNA, 22 bp, Homo sapiens
ggctctgcctgcccagcagcac

SEQ ID NO: 7753493 - DNA, 22 bp, Homo sapiens
ggcccaggctggagtgcggtgg

SEQ ID NO: 7753494 - DNA, 22 bp, Homo sapiens
ggccacagcaatgctgtgatgt

SEQ ID NO: 7753495 - DNA, 22 bp, Homo sapiens
ggccagagtctatatgcagaca

SEQ ID NO: 7753496 - DNA, 22 bp, Homo sapiens
ggccagagttgatggcatcttg

SEQ ID NO: 7753497 - DNA, 22 bp, Homo sapiens
ggcagggcttgtctctgtgatg

SEQ ID NO: 7753498 - DNA, 20 bp, Homo sapiens
ggcagggcatcaacagctct

SEQ ID NO: 7753499 - DNA, 22 bp, Homo sapiens
ggcagggccctgattcctgggg

SEQ ID NO: 7753500 - DNA, 22 bp, Homo sapiens
ggcagggagagcatgctgataa

SEQ ID NO: 7753501 - DNA, 22 bp, Homo sapiens
ggcagtgcaaggctggcacagt

SEQ ID NO: 7753502 - DNA, 22 bp, Homo sapiens
ggcagtggaggaccctgtgtct

SEQ ID NO: 7753503 - DNA, 22 bp, Homo sapiens
ggaggatgccaagctgtgcaca

SEQ ID NO: 7753504 - DNA, 22 bp, Homo sapiens
ggaggcaccactcatcatcctc

SEQ ID NO: 7753505 - DNA, 22 bp, Homo sapiens
ggaggcaccctatttgaggcct

SEQ ID NO: 7753506 - DNA, 22 bp, Homo sapiens
ggaggcacccttcattgagttt

SEQ ID NO: 7753507 - DNA, 23 bp, Homo sapiens
ggaggcacttaggcagagcagag

SEQ ID NO: 7753508 - DNA, 22 bp, Homo sapiens
ggaggcacacctcagactggga

SEQ ID NO: 7753509 - DNA, 22 bp, Homo sapiens
ggaggatgagctacgaggagct

SEQ ID NO: 7753510 - DNA, 22 bp, Homo sapiens
ggaggcacttcccgtctcagcc

SEQ ID NO: 7753511 - DNA, 22 bp, Homo sapiens
ggaggcacttcatgctgacccg

SEQ ID NO: 7753512 - DNA, 22 bp, Homo sapiens
ggaggcacttgttaaactacta

SEQ ID NO: 7753513 - DNA, 22 bp, Homo sapiens
ggcaccagggaaggaaggctgg

SEQ ID NO: 7753514 - DNA, 22 bp, Homo sapiens
ggcactgaagtgggtgttgggt

SEQ ID NO: 7753515 - DNA, 23 bp, Homo sapiens
ggcactcggccgtgaactcgtgc

SEQ ID NO: 7753516 - DNA, 22 bp, Homo sapiens
ggcagaggtgacagtgtctttt

SEQ ID NO: 7753517 - DNA, 22 bp, Homo sapiens
ggcagaggtgaagttcacaagg

SEQ ID NO: 7753518 - DNA, 22 bp, Homo sapiens
ggcagatggagaagcagcaggt

SEQ ID NO: 7753519 - DNA, 22 bp, Homo sapiens
ggcagcaaccaaccaggcattt

SEQ ID NO: 7753520 - DNA, 22 bp, Homo sapiens
ggcagatgttgcagtgagcaga

SEQ ID NO: 7753521 - DNA, 22 bp, Homo sapiens
ggcagcaattcttcagaatcat

SEQ ID NO: 7753522 - DNA, 22 bp, Homo sapiens
ggcagcaatgctgtgcaggcat

SEQ ID NO: 7753523 - DNA, 22 bp, Homo sapiens
gtcctgggaactggacagctaa

SEQ ID NO: 7753524 - DNA, 20 bp, Homo sapiens
gtccaggacccagcaggagg

SEQ ID NO: 7753525 - DNA, 22 bp, Homo sapiens
gtccaggaagcaataaatagaa

SEQ ID NO: 7753526 - DNA, 21 bp, Homo sapiens
gtcagagatgcccaactgcct

SEQ ID NO: 7753527 - DNA, 22 bp, Homo sapiens
gtcacctgaggggaggtgacag

SEQ ID NO: 7753528 - DNA, 22 bp, Homo sapiens
gtagtcacaaaccattcatatg

SEQ ID NO: 7753529 - DNA, 22 bp, Homo sapiens
gtaggcactctgtaagcatttg

SEQ ID NO: 7753530 - DNA, 22 bp, Homo sapiens
gtaggcactcagataatgaatg

SEQ ID NO: 7753531 - DNA, 22 bp, Homo sapiens
gtcaaacagcctcctgttctaa

SEQ ID NO: 7753532 - DNA, 22 bp, Homo sapiens
gtagtggagtctcctgtcctgg

SEQ ID NO: 7753533 - DNA, 22 bp, Homo sapiens
gtattttatggcctggggccta

SEQ ID NO: 7753534 - DNA, 22 bp, Homo sapiens
gtgcagggtagcgacggcagga

SEQ ID NO: 7753535 - DNA, 22 bp, Homo sapiens
gtgcagggctggcaccggaggc

SEQ ID NO: 7753536 - DNA, 22 bp, Homo sapiens
gtgctgaagtgaaattcatcaa

SEQ ID NO: 7753537 - DNA, 22 bp, Homo sapiens
gtgctgaattgtgctctttaca

SEQ ID NO: 7753538 - DNA, 22 bp, Homo sapiens
gtgctgaatccactcttaggaa

SEQ ID NO: 7753539 - DNA, 22 bp, Homo sapiens
gtctccagcccactctagatat

SEQ ID NO: 7753540 - DNA, 22 bp, Homo sapiens
gtctccagccattctctgatca

SEQ ID NO: 7753541 - DNA, 22 bp, Homo sapiens
gtctccagatatcctacacaac

SEQ ID NO: 7753542 - DNA, 21 bp, Homo sapiens
gtcttttaagtgaagagaggc

SEQ ID NO: 7753543 - DNA, 21 bp, Homo sapiens
gtctttctacctctatgtggc

SEQ ID NO: 7753544 - DNA, 22 bp, Homo sapiens
gtgagcagtttgttccagaatc

SEQ ID NO: 7753545 - DNA, 22 bp, Homo sapiens
gggtgaggcccatttgaggcca

SEQ ID NO: 7753546 - DNA, 22 bp, Homo sapiens
ggggccaggtccagcttccaaa

SEQ ID NO: 7753547 - DNA, 22 bp, Homo sapiens
ggggtggccctaccctctggaa

SEQ ID NO: 7753548 - DNA, 22 bp, Homo sapiens
ggggtggccaaggactctgacc

SEQ ID NO: 7753549 - DNA, 19 bp, Homo sapiens
ggggtgctagggagggatc

SEQ ID NO: 7753550 - DNA, 22 bp, Homo sapiens
gggcttcgagggtcgcgtttgg

SEQ ID NO: 7753551 - DNA, 22 bp, Homo sapiens
gggcttcagctggggatggagc

SEQ ID NO: 7753552 - DNA, 22 bp, Homo sapiens
gggcttcaggagggtcagccca

SEQ ID NO: 7753553 - DNA, 22 bp, Homo sapiens
gggctggtgaggctgccctgca

SEQ ID NO: 7753554 - DNA, 21 bp, Homo sapiens
ggggatgcgaccacaggctcc

SEQ ID NO: 7753555 - DNA, 22 bp, Homo sapiens
ggggaggctgatgtgggcaaag

SEQ ID NO: 7753556 - DNA, 22 bp, Homo sapiens
gggttggggcccagcagtctgc

SEQ ID NO: 7753557 - DNA, 22 bp, Homo sapiens
ggtcccaggaagtgcggcggcg

SEQ ID NO: 7753558 - DNA, 22 bp, Homo sapiens
ggtcccagctggtcactgtcag

SEQ ID NO: 7753559 - DNA, 22 bp, Homo sapiens
gggttgtgggatagagaaggag

SEQ ID NO: 7753560 - DNA, 22 bp, Homo sapiens
ggtccccccatggtgagcactg

SEQ ID NO: 7753561 - DNA, 23 bp, Homo sapiens
ggtccctgacagcgggcaagttg

SEQ ID NO: 7753562 - DNA, 22 bp, Homo sapiens
ggtccctgcccaaagcccttgg

SEQ ID NO: 7753563 - DNA, 22 bp, Homo sapiens
ggtccctgcccacctgggagct

SEQ ID NO: 7753564 - DNA, 20 bp, Homo sapiens
ggtccctgccctctgtcatc

SEQ ID NO: 7753565 - DNA, 22 bp, Homo sapiens
ggtccctgcctgaggctggcct

SEQ ID NO: 7753566 - DNA, 22 bp, Homo sapiens
ggtccctgccctaaaactcgtc

SEQ ID NO: 7753567 - DNA, 22 bp, Homo sapiens
ggtccctgccctacattttctt

SEQ ID NO: 7753568 - DNA, 22 bp, Homo sapiens
ggtccctgaagaggcctggggt

SEQ ID NO: 7753569 - DNA, 22 bp, Homo sapiens
ggtccctgaagatgcctgagga

SEQ ID NO: 7753570 - DNA, 22 bp, Homo sapiens
ggtccccgtggaggctggagcg

SEQ ID NO: 7753571 - DNA, 18 bp, Homo sapiens
ggtgagggagctggaagc

SEQ ID NO: 7753572 - DNA, 21 bp, Homo sapiens
ggtgctcgctgatgaggagtg

SEQ ID NO: 7753573 - DNA, 22 bp, Homo sapiens
ggtccctgctgaagccttggtg

SEQ ID NO: 7753574 - DNA, 22 bp, Homo sapiens
ggtccctggaaggccaagcttg

SEQ ID NO: 7753575 - DNA, 22 bp, Homo sapiens
ggtccctggaaggcactagtga

SEQ ID NO: 7753576 - DNA, 22 bp, Homo sapiens
ggtgaggcaggtggctgctgag

SEQ ID NO: 7753577 - DNA, 22 bp, Homo sapiens
tcctcttcaaaaggatttcctt

SEQ ID NO: 7753578 - DNA, 22 bp, Homo sapiens
tcctcttcaaaatagctctgaa

SEQ ID NO: 7753579 - DNA, 22 bp, Homo sapiens
tcctcttccttctgtccaaatg

SEQ ID NO: 7753580 - DNA, 22 bp, Homo sapiens
tcctcttctaagctcattcagg

SEQ ID NO: 7753581 - DNA, 22 bp, Homo sapiens
tcctcttcagagggacctcggg

SEQ ID NO: 7753582 - DNA, 22 bp, Homo sapiens
tcctcttctgcccatcagaggc

SEQ ID NO: 7753583 - DNA, 22 bp, Homo sapiens
tcctcttctgcctatatctgcc

SEQ ID NO: 7753584 - DNA, 22 bp, Homo sapiens
tcctcttctgtggattccctga

SEQ ID NO: 7753585 - DNA, 22 bp, Homo sapiens
tcctgaggactaacaggaagga

SEQ ID NO: 7753586 - DNA, 22 bp, Homo sapiens
tcctgaggaaagttcatgaatg

SEQ ID NO: 7753587 - DNA, 22 bp, Homo sapiens
tcctgaggagaagagtgctagg

SEQ ID NO: 7753588 - DNA, 22 bp, Homo sapiens
tcctgaggcctctgtgatgtga

SEQ ID NO: 7753589 - DNA, 20 bp, Homo sapiens
tcctgagatttaaggggttc

SEQ ID NO: 7753590 - DNA, 22 bp, Homo sapiens
tcctgagagtcaagaatgcagg

SEQ ID NO: 7753591 - DNA, 23 bp, Homo sapiens
tcctgagatgagacagtgctgcc

SEQ ID NO: 7753592 - DNA, 21 bp, Homo sapiens
tcctgcaggaggcctgagagg

SEQ ID NO: 7753593 - DNA, 22 bp, Homo sapiens
tcctcaggggtttcaggtgtac

SEQ ID NO: 7753594 - DNA, 22 bp, Homo sapiens
tcctcagggcggcctccgtctt

SEQ ID NO: 7753595 - DNA, 22 bp, Homo sapiens
tccctgggaaatgtcagtttca

SEQ ID NO: 7753596 - DNA, 22 bp, Homo sapiens
tcctaaatgattcagaaatttc

SEQ ID NO: 7753597 - DNA, 19 bp, Homo sapiens
tccctccctgtaatctcac

SEQ ID NO: 7753598 - DNA, 18 bp, Homo sapiens
tccctccctgctgtggcc

SEQ ID NO: 7753599 - DNA, 22 bp, Homo sapiens
tccctcaggacccaacttgtaa

SEQ ID NO: 7753600 - DNA, 23 bp, Homo sapiens
tccctcaggccttatctccatct

SEQ ID NO: 7753601 - DNA, 22 bp, Homo sapiens
tccctcagcttgtctccatgca

SEQ ID NO: 7753602 - DNA, 22 bp, Homo sapiens
tccctcagctcatatttatgcc

SEQ ID NO: 7753603 - DNA, 20 bp, Homo sapiens
tccctcaggtcattgggctg

SEQ ID NO: 7753604 - DNA, 22 bp, Homo sapiens
tccctcaggtggttcttgtttc

SEQ ID NO: 7753605 - DNA, 22 bp, Homo sapiens
tccctcagggtgcagttgcttt

SEQ ID NO: 7753606 - DNA, 20 bp, Homo sapiens
tccctcagtcctggctttgt

SEQ ID NO: 7753607 - DNA, 22 bp, Homo sapiens
tccctcagtccctggacaggca

SEQ ID NO: 7753608 - DNA, 20 bp, Homo sapiens
tccctccctccagctctggg

SEQ ID NO: 7753609 - DNA, 22 bp, Homo sapiens
tccctccccacttctgagcttt

SEQ ID NO: 7753610 - DNA, 19 bp, Homo sapiens
tccctcagtctgccaggcc

SEQ ID NO: 7753611 - DNA, 20 bp, Homo sapiens
tccctcagtttccagccctg

SEQ ID NO: 7753612 - DNA, 22 bp, Homo sapiens
tcccctttgtcttcctgtgggt

SEQ ID NO: 7753613 - DNA, 18 bp, Homo sapiens
tccctcagaattatagaa

SEQ ID NO: 7753614 - DNA, 21 bp, Homo sapiens
tccctcagaaggtagccaagc

SEQ ID NO: 7753615 - DNA, 23 bp, Homo sapiens
tcccagggaaggtgagcgaggct

SEQ ID NO: 7753616 - DNA, 22 bp, Homo sapiens
tcccagggactggatgatgcag

SEQ ID NO: 7753617 - DNA, 22 bp, Homo sapiens
tcccagggactctctgccttcc

SEQ ID NO: 7753618 - DNA, 22 bp, Homo sapiens
tcccagggacccagcctgatac

SEQ ID NO: 7753619 - DNA, 22 bp, Homo sapiens
tccctcagatgagctcctagca

SEQ ID NO: 7753620 - DNA, 22 bp, Homo sapiens
tccctcagagggcaagcgcaga

SEQ ID NO: 7753621 - DNA, 22 bp, Homo sapiens
tccctcagagaccgtggtgcag

SEQ ID NO: 7753622 - DNA, 21 bp, Homo sapiens
tccctcagacagggtgcctat

SEQ ID NO: 7753623 - DNA, 22 bp, Homo sapiens
tccctcagacagatgtgttcct

SEQ ID NO: 7753624 - DNA, 15 bp, Homo sapiens
tccctcagctaaaga

SEQ ID NO: 7753625 - DNA, 22 bp, Homo sapiens
tccctcagcaggaatgtggcag

SEQ ID NO: 7753626 - DNA, 22 bp, Homo sapiens
tccctcagcaggaactggcctg

SEQ ID NO: 7753627 - DNA, 22 bp, Homo sapiens
tccctcagattggcaattagat

SEQ ID NO: 7753628 - DNA, 20 bp, Homo sapiens
tccctcagcacttctacctc

SEQ ID NO: 7753629 - DNA, 22 bp, Homo sapiens
tcccagggacaccaagctgttt

SEQ ID NO: 7753630 - DNA, 22 bp, Homo sapiens
tccattatacttctgattcaaa

SEQ ID NO: 7753631 - DNA, 22 bp, Homo sapiens
tccattctttttacctctcaga

SEQ ID NO: 7753632 - DNA, 22 bp, Homo sapiens
tccattctatgcttacatttat

SEQ ID NO: 7753633 - DNA, 22 bp, Homo sapiens
tcccaagatgacacagtggacg

SEQ ID NO: 7753634 - DNA, 22 bp, Homo sapiens
tccaggccttgacaggtcagtt

SEQ ID NO: 7753635 - DNA, 22 bp, Homo sapiens
tcaggagacaaagggtgcggag

SEQ ID NO: 7753636 - DNA, 17 bp, Homo sapiens
tcagcatacacagagaa

SEQ ID NO: 7753637 - DNA, 22 bp, Homo sapiens
tcagccagagggggcaaaggaa

SEQ ID NO: 7753638 - DNA, 22 bp, Homo sapiens
tcagcaggcagtgggtcacaat

SEQ ID NO: 7753639 - DNA, 22 bp, Homo sapiens
tcagcaggcccatcctccaggc

SEQ ID NO: 7753640 - DNA, 22 bp, Homo sapiens
tcagcagggcctccttgtgcag

SEQ ID NO: 7753641 - DNA, 22 bp, Homo sapiens
tcagcagggcatactgagccta

SEQ ID NO: 7753642 - DNA, 17 bp, Homo sapiens
tcagcaggggccaagct

SEQ ID NO: 7753643 - DNA, 22 bp, Homo sapiens
tcaaatgcacgtagagaaaata

SEQ ID NO: 7753644 - DNA, 22 bp, Homo sapiens
tcaagaagataatgtctagggt

SEQ ID NO: 7753645 - DNA, 22 bp, Homo sapiens
tcacagtatcacacaaggatta

SEQ ID NO: 7753646 - DNA, 22 bp, Homo sapiens
tcaagaaactgtgctacagagt

SEQ ID NO: 7753647 - DNA, 22 bp, Homo sapiens
tcagaaaatgaaatggactctc

SEQ ID NO: 7753648 - DNA, 22 bp, Homo sapiens
tcagaaagcttagtgtcttgca

SEQ ID NO: 7753649 - DNA, 22 bp, Homo sapiens
tcagaaaggagttagaggtctc

SEQ ID NO: 7753650 - DNA, 22 bp, Homo sapiens
tcagaaaggttgagtcatgtgc

SEQ ID NO: 7753651 - DNA, 22 bp, Homo sapiens
tcagaatatattcatgttgtca

SEQ ID NO: 7753652 - DNA, 22 bp, Homo sapiens
tcagaatggacccagactatag

SEQ ID NO: 7753653 - DNA, 22 bp, Homo sapiens
tcactgctatattggatactga

SEQ ID NO: 7753654 - DNA, 22 bp, Homo sapiens
tcactgcaacctccacctcctg

SEQ ID NO: 7753655 - DNA, 22 bp, Homo sapiens
tcactgcaacctccacctcccg

SEQ ID NO: 7753656 - DNA, 22 bp, Homo sapiens
tcagggcaggacagtgtaggcc

SEQ ID NO: 7753657 - DNA, 22 bp, Homo sapiens
tcagttaagactgcactggact

SEQ ID NO: 7753658 - DNA, 22 bp, Homo sapiens
tcatttggtcctcccaacaagc

SEQ ID NO: 7753659 - DNA, 22 bp, Homo sapiens
tccaaatagttctggaagactg

SEQ ID NO: 7753660 - DNA, 22 bp, Homo sapiens
tccaaagaagtcacaaacgaag

SEQ ID NO: 7753661 - DNA, 22 bp, Homo sapiens
tccaaaacagaactctgtgaat

SEQ ID NO: 7753662 - DNA, 21 bp, Homo sapiens
tccaaatcccattctgtagtc

SEQ ID NO: 7753663 - DNA, 22 bp, Homo sapiens
tccaagaacccaagcgaatgcc

SEQ ID NO: 7753664 - DNA, 22 bp, Homo sapiens
tccaaattgacagtagtgatta

SEQ ID NO: 7753665 - DNA, 22 bp, Homo sapiens
tccaaatttaccttacagatat

SEQ ID NO: 7753666 - DNA, 22 bp, Homo sapiens
tccaagaagcttacaatctaat

SEQ ID NO: 7753667 - DNA, 22 bp, Homo sapiens
tccaaggggaaaggcgccggcg

SEQ ID NO: 7753668 - DNA, 22 bp, Homo sapiens
tagggcagagtccaggatgggc

SEQ ID NO: 7753669 - DNA, 22 bp, Homo sapiens
tagctgggagtgtctgatgggt

SEQ ID NO: 7753670 - DNA, 22 bp, Homo sapiens
tagtggagaagtggagtctgtg

SEQ ID NO: 7753671 - DNA, 22 bp, Homo sapiens
tagtggagagttgttttgtgca

SEQ ID NO: 7753672 - DNA, 22 bp, Homo sapiens
tagtggaggggatgcaaagctt

SEQ ID NO: 7753673 - DNA, 22 bp, Homo sapiens
tagtggaggcctgttgtgtgca

SEQ ID NO: 7753674 - DNA, 22 bp, Homo sapiens
tagtggagggtgtagctgctgg

SEQ ID NO: 7753675 - DNA, 22 bp, Homo sapiens
tagtggagaggatgtggagaaa

SEQ ID NO: 7753676 - DNA, 22 bp, Homo sapiens
tagtggaggtggtctgtgaact

SEQ ID NO: 7753677 - DNA, 22 bp, Homo sapiens
tagtggagtagaaaccaaagaa

SEQ ID NO: 7753678 - DNA, 22 bp, Homo sapiens
taggggaaagcagaatcctgga

SEQ ID NO: 7753679 - DNA, 23 bp, Homo sapiens
taggggaaaaatcttctgcaatt

SEQ ID NO: 7753680 - DNA, 22 bp, Homo sapiens
tagtttatgctgctgcagtgag

SEQ ID NO: 7753681 - DNA, 22 bp, Homo sapiens
tagatacctgctggacctcatt

SEQ ID NO: 7753682 - DNA, 22 bp, Homo sapiens
tagagaaaagcagggatcagga

SEQ ID NO: 7753683 - DNA, 22 bp, Homo sapiens
tagaagaaaagcacttagagat

SEQ ID NO: 7753684 - DNA, 22 bp, Homo sapiens
tagaagaaagtgaagctgggga

SEQ ID NO: 7753685 - DNA, 22 bp, Homo sapiens
tagcaaagaccaaagctagttg

SEQ ID NO: 7753686 - DNA, 22 bp, Homo sapiens
tagcaagaagggagatggggtt

SEQ ID NO: 7753687 - DNA, 22 bp, Homo sapiens
tagcaagaagctgtcacaggtg

SEQ ID NO: 7753688 - DNA, 22 bp, Homo sapiens
tagctgatgaataattattctt

SEQ ID NO: 7753689 - DNA, 22 bp, Homo sapiens
tagcagcttaagtaattagaat

SEQ ID NO: 7753690 - DNA, 22 bp, Homo sapiens
tatgaaagaatctcagagcaca

SEQ ID NO: 7753691 - DNA, 22 bp, Homo sapiens
tatcagcatctcctcaaagata

SEQ ID NO: 7753692 - DNA, 22 bp, Homo sapiens
tattaataagtgactactagct

SEQ ID NO: 7753693 - DNA, 22 bp, Homo sapiens
tatgtattctgagtacaagttc

SEQ ID NO: 7753694 - DNA, 22 bp, Homo sapiens
tatggacatctgaagttgcaga

SEQ ID NO: 7753695 - DNA, 23 bp, Homo sapiens
tatttgctactggtaattctgga

SEQ ID NO: 7753696 - DNA, 22 bp, Homo sapiens
tatttgatagagataaatgata

SEQ ID NO: 7753697 - DNA, 22 bp, Homo sapiens
tatttggagataagatttttag

SEQ ID NO: 7753698 - DNA, 22 bp, Homo sapiens
tatttggagataagggctttaa

SEQ ID NO: 7753699 - DNA, 22 bp, Homo sapiens
tatttggagcctatccatagat

SEQ ID NO: 7753700 - DNA, 22 bp, Homo sapiens
tatttggacaccaagtagaagt

SEQ ID NO: 7753701 - DNA, 22 bp, Homo sapiens
tatttggagatgggatcttcaa

SEQ ID NO: 7753702 - DNA, 22 bp, Homo sapiens
tatttggaaggtataaacacaa

SEQ ID NO: 7753703 - DNA, 22 bp, Homo sapiens
tatttggaaatagggctttgta

SEQ ID NO: 7753704 - DNA, 22 bp, Homo sapiens
tatttggaatctgccttaggac

SEQ ID NO: 7753705 - DNA, 22 bp, Homo sapiens
tatttggaatagcttgctaatg

SEQ ID NO: 7753706 - DNA, 22 bp, Homo sapiens
tatttggaaatgataaagtact

SEQ ID NO: 7753707 - DNA, 22 bp, Homo sapiens
tatttggaaagtttatctatct

SEQ ID NO: 7753708 - DNA, 23 bp, Homo sapiens
tatttggaaagagggaagaagac

SEQ ID NO: 7753709 - DNA, 22 bp, Homo sapiens
tatttggaaaggacatgtaagt

SEQ ID NO: 7753710 - DNA, 22 bp, Homo sapiens
tatttggaaaagggaagggaca

SEQ ID NO: 7753711 - DNA, 22 bp, Homo sapiens
tatttggaaacaattcacatgc

SEQ ID NO: 7753712 - DNA, 21 bp, Homo sapiens
tattaatttttcttcccacta

SEQ ID NO: 7753713 - DNA, 22 bp, Homo sapiens
tatttaaaataagccccagtgg

SEQ ID NO: 7753714 - DNA, 20 bp, Homo sapiens
tcaaagcaaagggagatgat

SEQ ID NO: 7753715 - DNA, 22 bp, Homo sapiens
tcaaagaagattaccctcccat

SEQ ID NO: 7753716 - DNA, 22 bp, Homo sapiens
tattttgtatttatgcaagaaa

SEQ ID NO: 7753717 - DNA, 22 bp, Homo sapiens
tattttgacgattttatgcaaa

SEQ ID NO: 7753718 - DNA, 22 bp, Homo sapiens
tcaaataccagcaatttcatgt

SEQ ID NO: 7753719 - DNA, 22 bp, Homo sapiens
tactagtcttctgctattccct

SEQ ID NO: 7753720 - DNA, 22 bp, Homo sapiens
taccaggagcccccttctggtc

SEQ ID NO: 7753721 - DNA, 22 bp, Homo sapiens
tacagtaggattttcagggtct

SEQ ID NO: 7753722 - DNA, 22 bp, Homo sapiens
tacagtggaaaactcagtgtgt

SEQ ID NO: 7753723 - DNA, 22 bp, Homo sapiens
tacagtgtctggatatcaaagg

SEQ ID NO: 7753724 - DNA, 22 bp, Homo sapiens
taatgaacaatatatcaatagc

SEQ ID NO: 7753725 - DNA, 22 bp, Homo sapiens
taatttatatggaattgttgct

SEQ ID NO: 7753726 - DNA, 22 bp, Homo sapiens
taatttatgatgcaaagaaaag

SEQ ID NO: 7753727 - DNA, 22 bp, Homo sapiens
taagcttcaaagaacatattgg

SEQ ID NO: 7753728 - DNA, 22 bp, Homo sapiens
taagcattcaatgcttagcact

SEQ ID NO: 7753729 - DNA, 22 bp, Homo sapiens
taatttatttcaactgccaagg

SEQ ID NO: 7753730 - DNA, 22 bp, Homo sapiens
tacaagctcacaaatttttaag

SEQ ID NO: 7753731 - DNA, 22 bp, Homo sapiens
tacaagaatgtcttaaaagctc

SEQ ID NO: 7753732 - DNA, 22 bp, Homo sapiens
tacacagaaattgtgtagggat

SEQ ID NO: 7753733 - DNA, 22 bp, Homo sapiens
tacacagaacctggtgtacagt

SEQ ID NO: 7753734 - DNA, 22 bp, Homo sapiens
tacacacagaggccatgggatt

SEQ ID NO: 7753735 - DNA, 22 bp, Homo sapiens
tacacacatgcatttgccttat

SEQ ID NO: 7753736 - DNA, 22 bp, Homo sapiens
tacagaatgatgtgtttaaata

SEQ ID NO: 7753737 - DNA, 20 bp, Homo sapiens
tacagaatgcaataaaatgg

SEQ ID NO: 7753738 - DNA, 22 bp, Homo sapiens
tacagaattagattattagaga

SEQ ID NO: 7753739 - DNA, 22 bp, Homo sapiens
taaaagattttataggaacaag

SEQ ID NO: 7753740 - DNA, 21 bp, Homo sapiens
taaaagatgacaagacagctc

SEQ ID NO: 7753741 - DNA, 22 bp, Homo sapiens
taaaagagaatggataacagag

SEQ ID NO: 7753742 - DNA, 21 bp, Homo sapiens
gtgctgggacacagccaggct

SEQ ID NO: 7753743 - DNA, 22 bp, Homo sapiens
gttatcttctatttctcatact

SEQ ID NO: 7753744 - DNA, 22 bp, Homo sapiens
gtttgatttgatccggagagat

SEQ ID NO: 7753745 - DNA, 22 bp, Homo sapiens
gtttcacagatggggagacacg

SEQ ID NO: 7753746 - DNA, 22 bp, Homo sapiens
gtttcacacatcctgcacatag

SEQ ID NO: 7753747 - DNA, 22 bp, Homo sapiens
gtttcacaagcaacgggtaagg

SEQ ID NO: 7753748 - DNA, 22 bp, Homo sapiens
gtttcacataattttaaattgt

SEQ ID NO: 7753749 - DNA, 22 bp, Homo sapiens
gtttcacagtctgcagaatttt

SEQ ID NO: 7753750 - DNA, 22 bp, Homo sapiens
gtttcacatgaaacttggggaa

SEQ ID NO: 7753751 - DNA, 22 bp, Homo sapiens
gtttcacagatggtgttcatat

SEQ ID NO: 7753752 - DNA, 22 bp, Homo sapiens
gtttcacagcaaagttccctgt

SEQ ID NO: 7753753 - DNA, 22 bp, Homo sapiens
gtttcacaggttggagccagca

SEQ ID NO: 7753754 - DNA, 22 bp, Homo sapiens
gtttcacagggccatggaggaa

SEQ ID NO: 7753755 - DNA, 22 bp, Homo sapiens
gtttatgaggaaaagttatgat

SEQ ID NO: 7753756 - DNA, 22 bp, Homo sapiens
gtttatgaatgttactatagag

SEQ ID NO: 7753757 - DNA, 22 bp, Homo sapiens
gtttatgaaatttcaggcattt

SEQ ID NO: 7753758 - DNA, 22 bp, Homo sapiens
gtttattaactgtcaagtgatt

SEQ ID NO: 7753759 - DNA, 22 bp, Homo sapiens
gtttattagagttttctgtctg

SEQ ID NO: 7753760 - DNA, 22 bp, Homo sapiens
gtttattatacaacaaaagcta

SEQ ID NO: 7753761 - DNA, 22 bp, Homo sapiens
ttgtgtctatggtttgagcatc

SEQ ID NO: 7753762 - DNA, 22 bp, Homo sapiens
ttgtcacattcaagttttatat

SEQ ID NO: 7753763 - DNA, 22 bp, Homo sapiens
ttgtcacatgtagttcattctc

SEQ ID NO: 7753764 - DNA, 22 bp, Homo sapiens
ttgtaaagggcatttgcacagt

SEQ ID NO: 7753765 - DNA, 22 bp, Homo sapiens
ttggaccatcagctcctcctgg

SEQ ID NO: 7753766 - DNA, 22 bp, Homo sapiens
ttggaccatggtagggaacttg

SEQ ID NO: 7753767 - DNA, 22 bp, Homo sapiens
ttggaccattgacctgatctac

SEQ ID NO: 7753768 - DNA, 22 bp, Homo sapiens
ttggaccaattcctgatatttt

SEQ ID NO: 7753769 - DNA, 23 bp, Homo sapiens
ttggaccactactgttttctctt

SEQ ID NO: 7753770 - DNA, 17 bp, Homo sapiens
ttggaccagattctaaa

SEQ ID NO: 7753771 - DNA, 22 bp, Homo sapiens
ttggaccagtggattatggtgg

SEQ ID NO: 7753772 - DNA, 21 bp, Homo sapiens
ttggaccatacaagttatgca

SEQ ID NO: 7753773 - DNA, 22 bp, Homo sapiens
ttggaccaaattaaaagttggc

SEQ ID NO: 7753774 - DNA, 22 bp, Homo sapiens
ttggaccaaggtctgctctttc

SEQ ID NO: 7753775 - DNA, 22 bp, Homo sapiens
ttggagagatttaggtctcagt

SEQ ID NO: 7753776 - DNA, 22 bp, Homo sapiens
ttggagagattatcagaccagc

SEQ ID NO: 7753777 - DNA, 22 bp, Homo sapiens
ttgcattagtgtcataaggtgg

SEQ ID NO: 7753778 - DNA, 22 bp, Homo sapiens
ttgctgaattgaatcctttggt

SEQ ID NO: 7753779 - DNA, 22 bp, Homo sapiens
ttgctgaagttaatgcttgcaa

SEQ ID NO: 7753780 - DNA, 22 bp, Homo sapiens
ttgctgaagtgaaggtatgttt

SEQ ID NO: 7753781 - DNA, 22 bp, Homo sapiens
ttgctgaagttgctcagctcca

SEQ ID NO: 7753782 - DNA, 22 bp, Homo sapiens
ttgctgaatgcaagttggatag

SEQ ID NO: 7753783 - DNA, 22 bp, Homo sapiens
ttgctgaagctgccaaaccagt

SEQ ID NO: 7753784 - DNA, 22 bp, Homo sapiens
ttgctgaagaaaaaatatgtta

SEQ ID NO: 7753785 - DNA, 19 bp, Homo sapiens
ttgctgaaggaagcctctg

SEQ ID NO: 7753786 - DNA, 22 bp, Homo sapiens
ttgctgaagtatgaaaaagaca

SEQ ID NO: 7753787 - DNA, 22 bp, Homo sapiens
ttgctgaaggcctcttggggtt

SEQ ID NO: 7753788 - DNA, 22 bp, Homo sapiens
ttgctgaagtattgtgaatcct

SEQ ID NO: 7753789 - DNA, 22 bp, Homo sapiens
ttgctgaaaacaggtcatcagg

SEQ ID NO: 7753790 - DNA, 22 bp, Homo sapiens
ttgctgaaaagctggcctttgt

SEQ ID NO: 7753791 - DNA, 22 bp, Homo sapiens
ttgctgaaaacagtgggtattg

SEQ ID NO: 7753792 - DNA, 22 bp, Homo sapiens
ttgctgaaagtggcaagaagta

SEQ ID NO: 7753793 - DNA, 22 bp, Homo sapiens
ttgctgaaaggtagctgtgtgg

SEQ ID NO: 7753794 - DNA, 22 bp, Homo sapiens
ttgctgaaccctgccctctaat

SEQ ID NO: 7753795 - DNA, 22 bp, Homo sapiens
ttgctgaaatctatgacatcct

SEQ ID NO: 7753796 - DNA, 23 bp, Homo sapiens
ttggacaaggccagagccagcac

SEQ ID NO: 7753797 - DNA, 22 bp, Homo sapiens
ttgcaggattttagagatgaca

SEQ ID NO: 7753798 - DNA, 22 bp, Homo sapiens
tttaccaagatagcatctggtt

SEQ ID NO: 7753799 - DNA, 22 bp, Homo sapiens
tttaccaaagtactctgaggca

SEQ ID NO: 7753800 - DNA, 22 bp, Homo sapiens
tttacagtctgtctagcaatgt

SEQ ID NO: 7753801 - DNA, 22 bp, Homo sapiens
tttagagcagggtgtggcacat

SEQ ID NO: 7753802 - DNA, 22 bp, Homo sapiens
tttagaggctgcctatcacaac

SEQ ID NO: 7753803 - DNA, 22 bp, Homo sapiens
tttatcagaagttagagaaaga

SEQ ID NO: 7753804 - DNA, 21 bp, Homo sapiens
tttatcatcacgagcttgagc

SEQ ID NO: 7753805 - DNA, 22 bp, Homo sapiens
tttagcatatcctataaaacta

SEQ ID NO: 7753806 - DNA, 22 bp, Homo sapiens
tttaaggtacagctagcagcat

SEQ ID NO: 7753807 - DNA, 22 bp, Homo sapiens
tttacagtctatgttgaattaa

SEQ ID NO: 7753808 - DNA, 22 bp, Homo sapiens
tttaaagaaattcctcatcttt

SEQ ID NO: 7753809 - DNA, 22 bp, Homo sapiens
tttattgacccaaagcgagagt

SEQ ID NO: 7753810 - DNA, 22 bp, Homo sapiens
tttattgagcacccgttgtgcg

SEQ ID NO: 7753811 - DNA, 22 bp, Homo sapiens
tttattctataggcattaagca

SEQ ID NO: 7753812 - DNA, 21 bp, Homo sapiens
tttattctcagatacagggag

SEQ ID NO: 7753813 - DNA, 22 bp, Homo sapiens
tttattctagctcagaatagtt

SEQ ID NO: 7753814 - DNA, 22 bp, Homo sapiens
tttattcttgagagtgagaaga

SEQ ID NO: 7753815 - DNA, 22 bp, Homo sapiens
tttattgaattgtaaccctatt

SEQ ID NO: 7753816 - DNA, 22 bp, Homo sapiens
tttattctgtgctacatgaaga

SEQ ID NO: 7753817 - DNA, 23 bp, Homo sapiens
tttattctcagatacataggtct

SEQ ID NO: 7753818 - DNA, 22 bp, Homo sapiens
tttattctctagttggtcagat

SEQ ID NO: 7753819 - DNA, 22 bp, Homo sapiens
tttcacaatgcaatcctacttc

SEQ ID NO: 7753820 - DNA, 22 bp, Homo sapiens
tttcacagaaagacaacagata

SEQ ID NO: 7753821 - DNA, 22 bp, Homo sapiens
tttcattatacagcttcataaa

SEQ ID NO: 7753822 - DNA, 22 bp, Homo sapiens
tttcagactgctgtgtgaaact

SEQ ID NO: 7753823 - DNA, 22 bp, Homo sapiens
tttcagactgcccatgtttgcc

SEQ ID NO: 7753824 - DNA, 22 bp, Homo sapiens
tttcagactccaaattcataag

SEQ ID NO: 7753825 - DNA, 19 bp, Homo sapiens
tttcagactcatctccagc

SEQ ID NO: 7753826 - DNA, 22 bp, Homo sapiens
tttcagactgtactttggggtt

SEQ ID NO: 7753827 - DNA, 19 bp, Homo sapiens
tttcagacatttcaaattt

SEQ ID NO: 7753828 - DNA, 21 bp, Homo sapiens
tttcagacctatctttgaagg

SEQ ID NO: 7753829 - DNA, 22 bp, Homo sapiens
tttcagacctgctgtgctatct

SEQ ID NO: 7753830 - DNA, 22 bp, Homo sapiens
tttcagacctggatgtgggggc

SEQ ID NO: 7753831 - DNA, 22 bp, Homo sapiens
tttcagactcagaacttagcaa

SEQ ID NO: 7753832 - DNA, 22 bp, Homo sapiens
tttcagactcatctcaagcttt

SEQ ID NO: 7753833 - DNA, 22 bp, Homo sapiens
tttcagacatagcctgattctg

SEQ ID NO: 7753834 - DNA, 22 bp, Homo sapiens
tttcagacatcacatgggtttg

SEQ ID NO: 7753835 - DNA, 22 bp, Homo sapiens
tttcagacatgggggcaaacag

SEQ ID NO: 7753836 - DNA, 22 bp, Homo sapiens
tttcagacattaagtgatggga

SEQ ID NO: 7753837 - DNA, 22 bp, Homo sapiens
tttcagacaggctcagagccgt

SEQ ID NO: 7753838 - DNA, 22 bp, Homo sapiens
tttcagacagtgggtccatcca

SEQ ID NO: 7753839 - DNA, 22 bp, Homo sapiens
tttcagacataccagttattga

SEQ ID NO: 7753840 - DNA, 22 bp, Homo sapiens
tttcagacagattcttctcagt

SEQ ID NO: 7753841 - DNA, 22 bp, Homo sapiens
tttcagacaggacttcatatgt

SEQ ID NO: 7753842 - DNA, 22 bp, Homo sapiens
tttcacattttatacttaagcc

SEQ ID NO: 7753843 - DNA, 22 bp, Homo sapiens
ttcctgaatataaagacactag

SEQ ID NO: 7753844 - DNA, 22 bp, Homo sapiens
ttcctggcaccaccacttctag

SEQ ID NO: 7753845 - DNA, 22 bp, Homo sapiens
ttcctggcaccctggacccggc

SEQ ID NO: 7753846 - DNA, 22 bp, Homo sapiens
ttcctggcacatagttagtgct

SEQ ID NO: 7753847 - DNA, 22 bp, Homo sapiens
ttcctggcacactcctgaatgt

SEQ ID NO: 7753848 - DNA, 22 bp, Homo sapiens
ttcctggcaaagtgagcatcac

SEQ ID NO: 7753849 - DNA, 22 bp, Homo sapiens
ttcctggcattatgggaggctg

SEQ ID NO: 7753850 - DNA, 22 bp, Homo sapiens
ttcctggcatgaaaaatatcac

SEQ ID NO: 7753851 - DNA, 22 bp, Homo sapiens
ttcctggcatagagagggcaca

SEQ ID NO: 7753852 - DNA, 23 bp, Homo sapiens
ttcctggcaggtacaacttttac

SEQ ID NO: 7753853 - DNA, 22 bp, Homo sapiens
ttcctggcagaggccccgacag

SEQ ID NO: 7753854 - DNA, 22 bp, Homo sapiens
ttcctggcacccttgttagcct

SEQ ID NO: 7753855 - DNA, 22 bp, Homo sapiens
ttcctggcactgcagtggttga

SEQ ID NO: 7753856 - DNA, 22 bp, Homo sapiens
ttcctggccaagcagagtggaa

SEQ ID NO: 7753857 - DNA, 22 bp, Homo sapiens
ttcctggccagctgtggtgagt

SEQ ID NO: 7753858 - DNA, 22 bp, Homo sapiens
ttcctggccccacccctggaga

SEQ ID NO: 7753859 - DNA, 22 bp, Homo sapiens
ttcctggccccatccatcttca

SEQ ID NO: 7753860 - DNA, 22 bp, Homo sapiens
ttcctggcctaaggtaggtgac

SEQ ID NO: 7753861 - DNA, 22 bp, Homo sapiens
ttcctggcctctctctgagcag

SEQ ID NO: 7753862 - DNA, 22 bp, Homo sapiens
ttcctggcgccacggagccggt

SEQ ID NO: 7753863 - DNA, 22 bp, Homo sapiens
ttcctggcctcttccaccacca

SEQ ID NO: 7753864 - DNA, 21 bp, Homo sapiens
ttcctggcggcagaaacgtga

SEQ ID NO: 7753865 - DNA, 22 bp, Homo sapiens
ttcctggctcacagcagtgggg

SEQ ID NO: 7753866 - DNA, 22 bp, Homo sapiens
ttctctaagctggctgaggtct

SEQ ID NO: 7753867 - DNA, 22 bp, Homo sapiens
ttctctggaactgaaacaagat

SEQ ID NO: 7753868 - DNA, 22 bp, Homo sapiens
ttctctgatcttgctagactga

SEQ ID NO: 7753869 - DNA, 22 bp, Homo sapiens
ttcttttcttggcaggagtaga

SEQ ID NO: 7753870 - DNA, 22 bp, Homo sapiens
ttcttcaatgtgccctgttttc

SEQ ID NO: 7753871 - DNA, 22 bp, Homo sapiens
ttcttattcttgaaatgtggga

SEQ ID NO: 7753872 - DNA, 22 bp, Homo sapiens
ttcttagaagaaacatctaaaa

SEQ ID NO: 7753873 - DNA, 20 bp, Homo sapiens
ttcttagtagagcatgtatt

SEQ ID NO: 7753874 - DNA, 20 bp, Homo sapiens
ttagctttggcaatagtgac

SEQ ID NO: 7753875 - DNA, 22 bp, Homo sapiens
ttagctttcttggagaattaca

SEQ ID NO: 7753876 - DNA, 21 bp, Homo sapiens
ttagctttctagaatctttgt

SEQ ID NO: 7753877 - DNA, 22 bp, Homo sapiens
ttagccatttgaggtcttcatt

SEQ ID NO: 7753878 - DNA, 22 bp, Homo sapiens
ttagccttagaagcttagcaaa

SEQ ID NO: 7753879 - DNA, 22 bp, Homo sapiens
ttagccattttattcagcaggt

SEQ ID NO: 7753880 - DNA, 22 bp, Homo sapiens
ttagctgactgtgtgatttggc

SEQ ID NO: 7753881 - DNA, 22 bp, Homo sapiens
ttagcttaattaaataatcagt

SEQ ID NO: 7753882 - DNA, 22 bp, Homo sapiens
ttattatggcagttttctaggt

SEQ ID NO: 7753883 - DNA, 22 bp, Homo sapiens
ttattatgtgctagagaatgta

SEQ ID NO: 7753884 - DNA, 22 bp, Homo sapiens
ttattatgtggatgaaagatgt

SEQ ID NO: 7753885 - DNA, 22 bp, Homo sapiens
ttattagatctgttagggatcc

SEQ ID NO: 7753886 - DNA, 22 bp, Homo sapiens
ttattagctgggcttcagggtg

SEQ ID NO: 7753887 - DNA, 22 bp, Homo sapiens
ttattaggtttacataaaggtt

SEQ ID NO: 7753888 - DNA, 22 bp, Homo sapiens
ttattactgtattaatccagag

SEQ ID NO: 7753889 - DNA, 22 bp, Homo sapiens
ttattagagtgctttgagaaag

SEQ ID NO: 7753890 - DNA, 21 bp, Homo sapiens
ttcataaaccattctcatgca

SEQ ID NO: 7753891 - DNA, 22 bp, Homo sapiens
ttcacagactttccatagattg

SEQ ID NO: 7753892 - DNA, 22 bp, Homo sapiens
ttcagaccttaaattcttctgt

SEQ ID NO: 7753893 - DNA, 18 bp, Homo sapiens
ttcagcagcagacacact

SEQ ID NO: 7753894 - DNA, 22 bp, Homo sapiens
ttcagcactttgttttgctcat

SEQ ID NO: 7753895 - DNA, 22 bp, Homo sapiens
ttcagcactgactgagtggtta

SEQ ID NO: 7753896 - DNA, 22 bp, Homo sapiens
ttcagcacctggaatagcacct

SEQ ID NO: 7753897 - DNA, 22 bp, Homo sapiens
ttcagcactgttatggatttgc

SEQ ID NO: 7753898 - DNA, 22 bp, Homo sapiens
ttcagcactggacagcgagtct

SEQ ID NO: 7753899 - DNA, 22 bp, Homo sapiens
ttcagcacagttcaagatggta

SEQ ID NO: 7753900 - DNA, 22 bp, Homo sapiens
ttcagcacaagactagacaggt

SEQ ID NO: 7753901 - DNA, 22 bp, Homo sapiens
ttcagcacaagactagacaggt

SEQ ID NO: 7753902 - DNA, 22 bp, Homo sapiens
ttcagcaccctctgaggcatcc

SEQ ID NO: 7753903 - DNA, 22 bp, Homo sapiens
ttcagcacagttcaagatggta

SEQ ID NO: 7753904 - DNA, 22 bp, Homo sapiens
ttcagcaccacttccagagaag

SEQ ID NO: 7753905 - DNA, 22 bp, Homo sapiens
ttcagcaccacttccagagaag

SEQ ID NO: 7753906 - DNA, 22 bp, Homo sapiens
ttttaaaggatagctctggttg

SEQ ID NO: 7753907 - DNA, 22 bp, Homo sapiens
ttttcttaggtgctccaagtag

SEQ ID NO: 7753908 - DNA, 22 bp, Homo sapiens
ttttcatttacattagggaaga

SEQ ID NO: 7753909 - DNA, 22 bp, Homo sapiens
ttttctcaagatccaatgcact

SEQ ID NO: 7753910 - DNA, 22 bp, Homo sapiens
ttttctcagctgcactgtatta

SEQ ID NO: 7753911 - DNA, 22 bp, Homo sapiens
ttttatgtcataaggacactca

SEQ ID NO: 7753912 - DNA, 22 bp, Homo sapiens
ttttatgtgtcaaagcagtggt

SEQ ID NO: 7753913 - DNA, 22 bp, Homo sapiens
ttttattagtggctagatgggg

SEQ ID NO: 7753914 - DNA, 22 bp, Homo sapiens
ttttattagtggctagatgggg

SEQ ID NO: 7753915 - DNA, 22 bp, Homo sapiens
ttttattatctttgaatgggac

SEQ ID NO: 7753916 - DNA, 22 bp, Homo sapiens
ttttattggagtgataccaagc

SEQ ID NO: 7753917 - DNA, 22 bp, Homo sapiens
tttgaaaaaggcctttggtatg

SEQ ID NO: 7753918 - DNA, 22 bp, Homo sapiens
tttcctcctagcctccagccgc

SEQ ID NO: 7753919 - DNA, 22 bp, Homo sapiens
tttcccttgaataaagatatct

SEQ ID NO: 7753920 - DNA, 22 bp, Homo sapiens
tttcccttctttcctgagtaat

SEQ ID NO: 7753921 - DNA, 22 bp, Homo sapiens
tttccctttagcctgagaatcc

SEQ ID NO: 7753922 - DNA, 22 bp, Homo sapiens
tttccctttgcactctacaatt

SEQ ID NO: 7753923 - DNA, 22 bp, Homo sapiens
tttgaggttagctagcagatca

SEQ ID NO: 7753924 - DNA, 22 bp, Homo sapiens
aagctgtgtaagttgcttggtt

SEQ ID NO: 7753925 - DNA, 20 bp, Homo sapiens
aagcttcacttcatttgatc

SEQ ID NO: 7753926 - DNA, 22 bp, Homo sapiens
aagcttcaggcccacccatgtc

SEQ ID NO: 7753927 - DNA, 22 bp, Homo sapiens
aagcttcagtggactgtagtgt

SEQ ID NO: 7753928 - DNA, 22 bp, Homo sapiens
aagcttcagtgtgagcatgtaa

SEQ ID NO: 7753929 - DNA, 22 bp, Homo sapiens
aagcttcagttctggggcaatg

SEQ ID NO: 7753930 - DNA, 22 bp, Homo sapiens
aagcttcatatatgtgtgagtc

SEQ ID NO: 7753931 - DNA, 22 bp, Homo sapiens
aagcttcacattgaacttgggt

SEQ ID NO: 7753932 - DNA, 22 bp, Homo sapiens
aagcttcaatgagataattgtt

SEQ ID NO: 7753933 - DNA, 22 bp, Homo sapiens
aagcttacagttccacgtagca

SEQ ID NO: 7753934 - DNA, 22 bp, Homo sapiens
aagcttcatctgatgccgaact

SEQ ID NO: 7753935 - DNA, 22 bp, Homo sapiens
aagcttcatttcaactcagggg

SEQ ID NO: 7753936 - DNA, 22 bp, Homo sapiens
aaggaagatgctggcctgggga

SEQ ID NO: 7753937 - DNA, 22 bp, Homo sapiens
aaggaagaatcatcacgttggg

SEQ ID NO: 7753938 - DNA, 22 bp, Homo sapiens
aaggccagagtactagaggctg

SEQ ID NO: 7753939 - DNA, 22 bp, Homo sapiens
aaggcacatgacctaggcctgg

SEQ ID NO: 7753940 - DNA, 22 bp, Homo sapiens
aaggcacattcctgaaaacaat

SEQ ID NO: 7753941 - DNA, 22 bp, Homo sapiens
aaggcacaacacaagagggtga

SEQ ID NO: 7753942 - DNA, 22 bp, Homo sapiens
aaggcacacagttagatagagc

SEQ ID NO: 7753943 - DNA, 22 bp, Homo sapiens
aaggcacagaggcagggcactt

SEQ ID NO: 7753944 - DNA, 22 bp, Homo sapiens
aaggcacagccacttgatcatc

SEQ ID NO: 7753945 - DNA, 22 bp, Homo sapiens
aaggcacatattttagagtcac

SEQ ID NO: 7753946 - DNA, 17 bp, Homo sapiens
aaggcacagggcactgg

SEQ ID NO: 7753947 - DNA, 22 bp, Homo sapiens
aaggcacatattgcagatcttg

SEQ ID NO: 7753948 - DNA, 18 bp, Homo sapiens
aaggcacaggagaacatt

SEQ ID NO: 7753949 - DNA, 22 bp, Homo sapiens
aagggatgcaggaaagaaggtt

SEQ ID NO: 7753950 - DNA, 22 bp, Homo sapiens
aaggtaatgaaacagcagctaa

SEQ ID NO: 7753951 - DNA, 22 bp, Homo sapiens
aagggtgaagggtggtggccta

SEQ ID NO: 7753952 - DNA, 19 bp, Homo sapiens
aagggtcacaagcagcaga

SEQ ID NO: 7753953 - DNA, 22 bp, Homo sapiens
aagggtggatttctgagctcta

SEQ ID NO: 7753954 - DNA, 22 bp, Homo sapiens
aagggtgggccctggcagccat

SEQ ID NO: 7753955 - DNA, 22 bp, Homo sapiens
aagtccatctctgccccacaca

SEQ ID NO: 7753956 - DNA, 22 bp, Homo sapiens
aagtccgcatttgtgttctctg

SEQ ID NO: 7753957 - DNA, 22 bp, Homo sapiens
aagtccgctttcattctcttca

SEQ ID NO: 7753958 - DNA, 22 bp, Homo sapiens
aagtcctgtgtgcttacacttg

SEQ ID NO: 7753959 - DNA, 19 bp, Homo sapiens
aaggtggtttgtctctgta

SEQ ID NO: 7753960 - DNA, 22 bp, Homo sapiens
aaggtggtttgcagacagaata

SEQ ID NO: 7753961 - DNA, 22 bp, Homo sapiens
acccagggctcaagcgtaggca

SEQ ID NO: 7753962 - DNA, 22 bp, Homo sapiens
acccaggccattggcaagagtc

SEQ ID NO: 7753963 - DNA, 22 bp, Homo sapiens
acccagggcagccagcggggag

SEQ ID NO: 7753964 - DNA, 22 bp, Homo sapiens
aaggtggtcttactgatggtat

SEQ ID NO: 7753965 - DNA, 22 bp, Homo sapiens
aaggtggtgatcatcttgaagg

SEQ ID NO: 7753966 - DNA, 22 bp, Homo sapiens
aaggtggttgcaattaccataa

SEQ ID NO: 7753967 - DNA, 22 bp, Homo sapiens
aaggtggtgcttctgctcctct

SEQ ID NO: 7753968 - DNA, 22 bp, Homo sapiens
aaggtggttgtaggctggtctg

SEQ ID NO: 7753969 - DNA, 22 bp, Homo sapiens
aaggtggtttgattatcccact

SEQ ID NO: 7753970 - DNA, 22 bp, Homo sapiens
acccaggggcgaagctggccac

SEQ ID NO: 7753971 - DNA, 22 bp, Homo sapiens
aagttcctgacattgccatggc

SEQ ID NO: 7753972 - DNA, 22 bp, Homo sapiens
aagttcctgagctcatatagca

SEQ ID NO: 7753973 - DNA, 22 bp, Homo sapiens
aagttcctatatccaaatacag

SEQ ID NO: 7753974 - DNA, 22 bp, Homo sapiens
aagttcctgttactccccagaa

SEQ ID NO: 7753975 - DNA, 22 bp, Homo sapiens
aagttcctgggtgatcctgatg

SEQ ID NO: 7753976 - DNA, 22 bp, Homo sapiens
aagttccttagccttagggctt

SEQ ID NO: 7753977 - DNA, 22 bp, Homo sapiens
aagttccttgaatgaagctagg

SEQ ID NO: 7753978 - DNA, 22 bp, Homo sapiens
actgcaggccttggtgccagca

SEQ ID NO: 7753979 - DNA, 18 bp, Homo sapiens
actgcaggagaggtgagg

SEQ ID NO: 7753980 - DNA, 22 bp, Homo sapiens
aataataagatactaagggagt

SEQ ID NO: 7753981 - DNA, 22 bp, Homo sapiens
aataagctgctaggaacttagt

SEQ ID NO: 7753982 - DNA, 19 bp, Homo sapiens
aataagcttgggtaaaact

SEQ ID NO: 7753983 - DNA, 22 bp, Homo sapiens
aataagctggagctatattgag

SEQ ID NO: 7753984 - DNA, 22 bp, Homo sapiens
agaaggacccggtgggagatga

SEQ ID NO: 7753985 - DNA, 22 bp, Homo sapiens
agaaggactttgtagggttgtt

SEQ ID NO: 7753986 - DNA, 22 bp, Homo sapiens
agaacacacgtcagagtttcct

SEQ ID NO: 7753987 - DNA, 22 bp, Homo sapiens
agaacacactgggggaaacaag

SEQ ID NO: 7753988 - DNA, 22 bp, Homo sapiens
agaagcagctttcaaggtgatt

SEQ ID NO: 7753989 - DNA, 22 bp, Homo sapiens
agaaagggatgaggtagctgct

SEQ ID NO: 7753990 - DNA, 22 bp, Homo sapiens
acttttaaggggccttgattta

SEQ ID NO: 7753991 - DNA, 22 bp, Homo sapiens
acttttaaatgagtttcagttg

SEQ ID NO: 7753992 - DNA, 22 bp, Homo sapiens
aatagccactttagagcaggtg

SEQ ID NO: 7753993 - DNA, 22 bp, Homo sapiens
acagaatattttatttagatca

SEQ ID NO: 7753994 - DNA, 22 bp, Homo sapiens
acagaatattgtaagtgccact

SEQ ID NO: 7753995 - DNA, 22 bp, Homo sapiens
acagaatattggttactgttgc

SEQ ID NO: 7753996 - DNA, 22 bp, Homo sapiens
acagaataggtacagtcagtca

SEQ ID NO: 7753997 - DNA, 22 bp, Homo sapiens
acagaatagtagcttaaagtca

SEQ ID NO: 7753998 - DNA, 23 bp, Homo sapiens
acagaataccattgactaggtgt

SEQ ID NO: 7753999 - DNA, 22 bp, Homo sapiens
acagaataaggtttatctctcc

SEQ ID NO: 7754000 - DNA, 22 bp, Homo sapiens
agctaacacattccagctattt

SEQ ID NO: 7754001 - DNA, 22 bp, Homo sapiens
acagatataaactatagtagtg

SEQ ID NO: 7754002 - DNA, 22 bp, Homo sapiens
acagatatcctcagtctccaac

SEQ ID NO: 7754003 - DNA, 22 bp, Homo sapiens
acagcagaccactactagtagg

SEQ ID NO: 7754004 - DNA, 22 bp, Homo sapiens
acagcagatctggctacaggtt

SEQ ID NO: 7754005 - DNA, 20 bp, Homo sapiens
acagcagataccacaactat

SEQ ID NO: 7754006 - DNA, 20 bp, Homo sapiens
acagcagccttgctagaaac

SEQ ID NO: 7754007 - DNA, 22 bp, Homo sapiens
acagcagcctgcagccctgtgt

SEQ ID NO: 7754008 - DNA, 22 bp, Homo sapiens
acagcagcatcctatttcactc

SEQ ID NO: 7754009 - DNA, 22 bp, Homo sapiens
acagcagccagccactgtgagc

SEQ ID NO: 7754010 - DNA, 22 bp, Homo sapiens
acagcagcataaactgactaag

SEQ ID NO: 7754011 - DNA, 22 bp, Homo sapiens
acagcagcagaccagcatatgt

SEQ ID NO: 7754012 - DNA, 22 bp, Homo sapiens
acagcagcactattgacatttt

SEQ ID NO: 7754013 - DNA, 22 bp, Homo sapiens
acagcagatgacaactatttat

SEQ ID NO: 7754014 - DNA, 21 bp, Homo sapiens
agctgaggtaaggcaagagag

SEQ ID NO: 7754015 - DNA, 22 bp, Homo sapiens
agctgaggttgaagagtgaacg

SEQ ID NO: 7754016 - DNA, 22 bp, Homo sapiens
agctgatgccatgtggaacagt

SEQ ID NO: 7754017 - DNA, 22 bp, Homo sapiens
acagcagcgtgaagtgtgttat

SEQ ID NO: 7754018 - DNA, 22 bp, Homo sapiens
acagcagcgtcaacttaaaatt

SEQ ID NO: 7754019 - DNA, 22 bp, Homo sapiens
agctgagggttcggtgtccaca

SEQ ID NO: 7754020 - DNA, 22 bp, Homo sapiens
acacaagattgtgtattgaatt

SEQ ID NO: 7754021 - DNA, 20 bp, Homo sapiens
acacaagcacttctggtatt

SEQ ID NO: 7754022 - DNA, 22 bp, Homo sapiens
acacacaaatctattagtgaat

SEQ ID NO: 7754023 - DNA, 22 bp, Homo sapiens
acacacaattagttttatgctt

SEQ ID NO: 7754024 - DNA, 22 bp, Homo sapiens
acacagtatcaaatttcatctt

SEQ ID NO: 7754025 - DNA, 22 bp, Homo sapiens
acacagtatgaaaagtctagtt

SEQ ID NO: 7754026 - DNA, 22 bp, Homo sapiens
acacatcatgccaagtttcacc

SEQ ID NO: 7754027 - DNA, 22 bp, Homo sapiens
agcagggaatagcggaaagaat

SEQ ID NO: 7754028 - DNA, 22 bp, Homo sapiens
acacagtttatggtattctgtt

SEQ ID NO: 7754029 - DNA, 22 bp, Homo sapiens
agcaggcttgttatgtctgaga

SEQ ID NO: 7754030 - DNA, 22 bp, Homo sapiens
agcaggctttccacagaaggag

SEQ ID NO: 7754031 - DNA, 19 bp, Homo sapiens
agccagagtggcccagggg

SEQ ID NO: 7754032 - DNA, 22 bp, Homo sapiens
agccagctgtgtggtcaggcaa

SEQ ID NO: 7754033 - DNA, 22 bp, Homo sapiens
agccaggaagagaggcctcacc

SEQ ID NO: 7754034 - DNA, 22 bp, Homo sapiens
agccagagattgagatgcaggc

SEQ ID NO: 7754035 - DNA, 22 bp, Homo sapiens
acaccagggcctagccagggcg

SEQ ID NO: 7754036 - DNA, 22 bp, Homo sapiens
agcaggtggtaggcagtcagca

SEQ ID NO: 7754037 - DNA, 22 bp, Homo sapiens
agccaaggagtgcaggtggctt

SEQ ID NO: 7754038 - DNA, 22 bp, Homo sapiens
agaggacaaaatgagaagtgct

SEQ ID NO: 7754039 - DNA, 22 bp, Homo sapiens
agagcacaaattttaaggaggc

SEQ ID NO: 7754040 - DNA, 22 bp, Homo sapiens
agagcacagaagaataggtgct

SEQ ID NO: 7754041 - DNA, 22 bp, Homo sapiens
agagcacagaagttatatgtta

SEQ ID NO: 7754042 - DNA, 22 bp, Homo sapiens
aattaatatttgtggaattaat

SEQ ID NO: 7754043 - DNA, 22 bp, Homo sapiens
aattaatggaaagtaaggaagg

SEQ ID NO: 7754044 - DNA, 22 bp, Homo sapiens
agacatgtcaccaattcttact

SEQ ID NO: 7754045 - DNA, 22 bp, Homo sapiens
agacatgacagatagttgctag

SEQ ID NO: 7754046 - DNA, 22 bp, Homo sapiens
aatgccttggagagcctagagg

SEQ ID NO: 7754047 - DNA, 22 bp, Homo sapiens
aatgctgaatttagtatttatg

SEQ ID NO: 7754048 - DNA, 22 bp, Homo sapiens
agagaaggggtaaagagtcctg

SEQ ID NO: 7754049 - DNA, 22 bp, Homo sapiens
agagaagggggaaagatctcac

SEQ ID NO: 7754050 - DNA, 22 bp, Homo sapiens
agagaaatggggtaatctttca

SEQ ID NO: 7754051 - DNA, 21 bp, Homo sapiens
agagaagggactcttccagtc

SEQ ID NO: 7754052 - DNA, 22 bp, Homo sapiens
aatgtgtgaacactaatgcaac

SEQ ID NO: 7754053 - DNA, 22 bp, Homo sapiens
agagatctgtggattcattgtc

SEQ ID NO: 7754054 - DNA, 22 bp, Homo sapiens
acaaagtctctaataatcttct

SEQ ID NO: 7754055 - DNA, 22 bp, Homo sapiens
agatgcatgtttatgtctttcc

SEQ ID NO: 7754056 - DNA, 22 bp, Homo sapiens
agatgcatgcttaattagcaca

SEQ ID NO: 7754057 - DNA, 22 bp, Homo sapiens
agcaaatacatttttagcataa

SEQ ID NO: 7754058 - DNA, 19 bp, Homo sapiens
agcaaatataatagtgttc

SEQ ID NO: 7754059 - DNA, 23 bp, Homo sapiens
agcaaataatctgcttgcttttt

SEQ ID NO: 7754060 - DNA, 22 bp, Homo sapiens
agcaaataaagacaattatgtc

SEQ ID NO: 7754061 - DNA, 22 bp, Homo sapiens
agcacacaggacttgattcatg

SEQ ID NO: 7754062 - DNA, 22 bp, Homo sapiens
agcacagaatgaggtggaagtg

SEQ ID NO: 7754063 - DNA, 22 bp, Homo sapiens
agcacagaaagcacatttgaaa

SEQ ID NO: 7754064 - DNA, 22 bp, Homo sapiens
agcacaggtaatacagagtaac

SEQ ID NO: 7754065 - DNA, 21 bp, Homo sapiens
acacaacaggcagtcattttc

SEQ ID NO: 7754066 - DNA, 22 bp, Homo sapiens
acacagctgtgcagttttttca

SEQ ID NO: 7754067 - DNA, 22 bp, Homo sapiens
acacagcaaggtctgactttgg

SEQ ID NO: 7754068 - DNA, 22 bp, Homo sapiens
acacagaagctttttctattcc

SEQ ID NO: 7754069 - DNA, 17 bp, Homo sapiens
acacagagattaacaca

SEQ ID NO: 7754070 - DNA, 22 bp, Homo sapiens
acacagagatgtaaagttaggc

SEQ ID NO: 7754071 - DNA, 22 bp, Homo sapiens
acacacatgcctttcctaagta

SEQ ID NO: 7754072 - DNA, 22 bp, Homo sapiens
acacagcaacttgcagtatgga

SEQ ID NO: 7754073 - DNA, 22 bp, Homo sapiens
acacagagcaaatcatgacaga

SEQ ID NO: 7754074 - DNA, 22 bp, Homo sapiens
acacagagccaaaccatatcac

SEQ ID NO: 7754075 - DNA, 22 bp, Homo sapiens
aagaatatctgttttatttagg

SEQ ID NO: 7754076 - DNA, 22 bp, Homo sapiens
acaaatatttactgaatccact

SEQ ID NO: 7754077 - DNA, 22 bp, Homo sapiens
aagaacaggttctagaaccatt

SEQ ID NO: 7754078 - DNA, 22 bp, Homo sapiens
aagaactcaacatagagtggga

SEQ ID NO: 7754079 - DNA, 19 bp, Homo sapiens
acagacatttgcaattagc

SEQ ID NO: 7754080 - DNA, 19 bp, Homo sapiens
acagacatttgcaattagc

SEQ ID NO: 7754081 - DNA, 22 bp, Homo sapiens
acagacatttaataaatgctga

SEQ ID NO: 7754082 - DNA, 22 bp, Homo sapiens
acagaaataactttttatgttt

SEQ ID NO: 7754083 - DNA, 22 bp, Homo sapiens
acagagatggcacagagaaggt

SEQ ID NO: 7754084 - DNA, 22 bp, Homo sapiens
acacatagaaaataaatagtta

SEQ ID NO: 7754085 - DNA, 22 bp, Homo sapiens
acacataagcctaatcatctcc

SEQ ID NO: 7754086 - DNA, 22 bp, Homo sapiens
aagccctccgtacgtgctagct

SEQ ID NO: 7754087 - DNA, 22 bp, Homo sapiens
aagccctcatccccatgggcgt

SEQ ID NO: 7754088 - DNA, 22 bp, Homo sapiens
acagccaggcccagcacgcagg

SEQ ID NO: 7754089 - DNA, 22 bp, Homo sapiens
acagccaggagccatgggcagg

SEQ ID NO: 7754090 - DNA, 22 bp, Homo sapiens
acagccaggaggaactcagtga

SEQ ID NO: 7754091 - DNA, 21 bp, Homo sapiens
acagccaggaacatgaggggc

SEQ ID NO: 7754092 - DNA, 22 bp, Homo sapiens
acagccagcttgatgggatccg

SEQ ID NO: 7754093 - DNA, 22 bp, Homo sapiens
acagccaggaattctggagaag

SEQ ID NO: 7754094 - DNA, 22 bp, Homo sapiens
acagccaggacttggccctctt

SEQ ID NO: 7754095 - DNA, 22 bp, Homo sapiens
aatatttctggtgcttctcact

SEQ ID NO: 7754096 - DNA, 22 bp, Homo sapiens
aatatttatatttctcttccct

SEQ ID NO: 7754097 - DNA, 22 bp, Homo sapiens
aataatatttgaagcttcaaag

SEQ ID NO: 7754098 - DNA, 22 bp, Homo sapiens
aataatgaacatttaaaacctg

SEQ ID NO: 7754099 - DNA, 22 bp, Homo sapiens
aacttccaacccagaagcctaa

SEQ ID NO: 7754100 - DNA, 22 bp, Homo sapiens
aatgaaatgtagcttatccata

SEQ ID NO: 7754101 - DNA, 21 bp, Homo sapiens
aaggtctgtaaagtgacagga

SEQ ID NO: 7754102 - DNA, 22 bp, Homo sapiens
aaggtctggccaatagacagcc

SEQ ID NO: 7754103 - DNA, 22 bp, Homo sapiens
aagtgctcccatatcctgccct

SEQ ID NO: 7754104 - DNA, 22 bp, Homo sapiens
aaggcccttcggcttcctcagc

SEQ ID NO: 7754105 - DNA, 22 bp, Homo sapiens
aaggccctggccccagcttctt

SEQ ID NO: 7754106 - DNA, 22 bp, Homo sapiens
aaggcccttccaccagtcctcg

SEQ ID NO: 7754107 - DNA, 22 bp, Homo sapiens
aaggccctgtctccaaatacag

SEQ ID NO: 7754108 - DNA, 22 bp, Homo sapiens
aaggccctggatggttttgaga

SEQ ID NO: 7754109 - DNA, 22 bp, Homo sapiens
aaggccctggcaggaagcagga

SEQ ID NO: 7754110 - DNA, 18 bp, Homo sapiens
aaggccctgagcatatgc

SEQ ID NO: 7754111 - DNA, 22 bp, Homo sapiens
aaggccctggagtttctggaca

SEQ ID NO: 7754112 - DNA, 22 bp, Homo sapiens
aaggccctaatagagcacatat

SEQ ID NO: 7754113 - DNA, 22 bp, Homo sapiens
aaggccctagaatctatattgc

SEQ ID NO: 7754114 - DNA, 22 bp, Homo sapiens
aaggccctcatgcgtcagagcc

SEQ ID NO: 7754115 - DNA, 22 bp, Homo sapiens
aaaagcaaggcagtctgtctga

SEQ ID NO: 7754116 - DNA, 22 bp, Homo sapiens
aaaagcaagttgcctaggttga

SEQ ID NO: 7754117 - DNA, 22 bp, Homo sapiens
aaaagcaattgcgggttttgcc

SEQ ID NO: 7754118 - DNA, 22 bp, Homo sapiens
aaaagttccctggttagaaaag

SEQ ID NO: 7754119 - DNA, 22 bp, Homo sapiens
aaagacacatgtctcttagatt

SEQ ID NO: 7754120 - DNA, 17 bp, Homo sapiens
aaacttcattctcagga

SEQ ID NO: 7754121 - DNA, 22 bp, Homo sapiens
aaataaaggtccactttagggc

SEQ ID NO: 7754122 - DNA, 22 bp, Homo sapiens
aaagtacacatttatcccttat

SEQ ID NO: 7754123 - DNA, 22 bp, Homo sapiens
aaagctctctgaacaccagacc

SEQ ID NO: 7754124 - DNA, 22 bp, Homo sapiens
aaagctcacagtaatacaaggc

SEQ ID NO: 7754125 - DNA, 22 bp, Homo sapiens
aaagctcttaatgagattatcc

SEQ ID NO: 7754126 - DNA, 22 bp, Homo sapiens
aaagctcttactgtactagtga

SEQ ID NO: 7754127 - DNA, 22 bp, Homo sapiens
aaagccagggacagtgtgcatg

SEQ ID NO: 7754128 - DNA, 22 bp, Homo sapiens
aacttctgcttttacaggcagt

SEQ ID NO: 7754129 - DNA, 22 bp, Homo sapiens
aacttctgacctcaagaactgt

SEQ ID NO: 7754130 - DNA, 22 bp, Homo sapiens
aacttgaatgagaacttttgcc

SEQ ID NO: 7754131 - DNA, 22 bp, Homo sapiens
aacttgaactgatgagtgttag

SEQ ID NO: 7754132 - DNA, 22 bp, Homo sapiens
aacttgaaactgttccagaaaa

SEQ ID NO: 7754133 - DNA, 22 bp, Homo sapiens
aacttgaaccacagaagctgcc

SEQ ID NO: 7754134 - DNA, 22 bp, Homo sapiens
aacttgaagaggctttttggca

SEQ ID NO: 7754135 - DNA, 22 bp, Homo sapiens
aacttgaaaacctcatgaattg

SEQ ID NO: 7754136 - DNA, 22 bp, Homo sapiens
aacttgaagttgcagaaagtac

SEQ ID NO: 7754137 - DNA, 22 bp, Homo sapiens
aacttccagctttctgtctaat

SEQ ID NO: 7754138 - DNA, 22 bp, Homo sapiens
aacttccaccaaatagtatata

SEQ ID NO: 7754139 - DNA, 22 bp, Homo sapiens
aacttccaggccttgaattatt

SEQ ID NO: 7754140 - DNA, 22 bp, Homo sapiens
aaaggctctaacaaggagagag

SEQ ID NO: 7754141 - DNA, 22 bp, Homo sapiens
aacatgagtgataaaattacct

SEQ ID NO: 7754142 - DNA, 22 bp, Homo sapiens
aaaggctttgagaagtcctgca

SEQ ID NO: 7754143 - DNA, 22 bp, Homo sapiens
aaaggcttggttctttgatgac

SEQ ID NO: 7754144 - DNA, 22 bp, Homo sapiens
aaaggcttgtttgaggactggt

SEQ ID NO: 7754145 - DNA, 22 bp, Homo sapiens
aaaggcttgtacagcagccttc

SEQ ID NO: 7754146 - DNA, 22 bp, Homo sapiens
aaaggcttgactagaagggaga

SEQ ID NO: 7754147 - DNA, 22 bp, Homo sapiens
aaaggcttcggatcagaaggta

SEQ ID NO: 7754148 - DNA, 22 bp, Homo sapiens
aaattgcttataaagatgaatg

SEQ ID NO: 7754149 - DNA, 22 bp, Homo sapiens
aaattgctgacacttgaccatt

SEQ ID NO: 7754150 - DNA, 22 bp, Homo sapiens
aaattgctatatgtgaatgtga

SEQ ID NO: 7754151 - DNA, 22 bp, Homo sapiens
aaagcagcaagtatttgttact

SEQ ID NO: 7754152 - DNA, 22 bp, Homo sapiens
aagaagctgcgtggtatgtgaa

SEQ ID NO: 7754153 - DNA, 22 bp, Homo sapiens
aagaaggcctggtagacgtctt

SEQ ID NO: 7754154 - DNA, 22 bp, Homo sapiens
aagaaggcttcagagcccagga

SEQ ID NO: 7754155 - DNA, 22 bp, Homo sapiens
aagaagctaagactatctgggt

SEQ ID NO: 7754156 - DNA, 22 bp, Homo sapiens
aaatgcaaggccatgtgaagga

SEQ ID NO: 7754157 - DNA, 22 bp, Homo sapiens
aaatatttgtctgaggcggttg

SEQ ID NO: 7754158 - DNA, 22 bp, Homo sapiens
cacagcagccagaacatttttg

SEQ ID NO: 7754159 - DNA, 22 bp, Homo sapiens
cacagcagcatcatttatctgg

SEQ ID NO: 7754160 - DNA, 22 bp, Homo sapiens
cacagaaattattaggatgctt

SEQ ID NO: 7754161 - DNA, 22 bp, Homo sapiens
cacagaaaggctcaaatcccaa

SEQ ID NO: 7754162 - DNA, 22 bp, Homo sapiens
cacagaaatattgtgtcccttg

SEQ ID NO: 7754163 - DNA, 22 bp, Homo sapiens
cacagctgggaaaatttgtaca

SEQ ID NO: 7754164 - DNA, 22 bp, Homo sapiens
cacaggaaagtcagccagaaga

SEQ ID NO: 7754165 - DNA, 22 bp, Homo sapiens
cacaggaaaataaaagatctaa

SEQ ID NO: 7754166 - DNA, 20 bp, Homo sapiens
cacaggaaagctactcagtt

SEQ ID NO: 7754167 - DNA, 22 bp, Homo sapiens
cacaggaagatctcccagaggt

SEQ ID NO: 7754168 - DNA, 22 bp, Homo sapiens
cacaggaagaggtatacaattc

SEQ ID NO: 7754169 - DNA, 22 bp, Homo sapiens
cacaggaacaaagaagacaatt

SEQ ID NO: 7754170 - DNA, 22 bp, Homo sapiens
cacagaaaaaggcttgaaaatc

SEQ ID NO: 7754171 - DNA, 22 bp, Homo sapiens
cacagaaaaaggcttgaaaatc

SEQ ID NO: 7754172 - DNA, 22 bp, Homo sapiens
cacacatgtgtgcagcttagaa

SEQ ID NO: 7754173 - DNA, 22 bp, Homo sapiens
cacacatgacccacttttaccg

SEQ ID NO: 7754174 - DNA, 22 bp, Homo sapiens
caagtctgacctctgggtgaag

SEQ ID NO: 7754175 - DNA, 22 bp, Homo sapiens
caagggagttactgagggcggg

SEQ ID NO: 7754176 - DNA, 22 bp, Homo sapiens
caagggcagatagctggtccaa

SEQ ID NO: 7754177 - DNA, 22 bp, Homo sapiens
caagtccaacagtttttcagac

SEQ ID NO: 7754178 - DNA, 22 bp, Homo sapiens
caaggaaacatgaaatgcattg

SEQ ID NO: 7754179 - DNA, 22 bp, Homo sapiens
caaggaaaagaagtatttcaga

SEQ ID NO: 7754180 - DNA, 22 bp, Homo sapiens
cagaaactgtggattcattaaa

SEQ ID NO: 7754181 - DNA, 22 bp, Homo sapiens
cagaaactgtttgttaatattt

SEQ ID NO: 7754182 - DNA, 22 bp, Homo sapiens
cagaaactttctttactgagca

SEQ ID NO: 7754183 - DNA, 22 bp, Homo sapiens
cagaaacttttgatgagtgtat

SEQ ID NO: 7754184 - DNA, 20 bp, Homo sapiens
cagaaagaaggtagattttt

SEQ ID NO: 7754185 - DNA, 22 bp, Homo sapiens
cactgggctgataccaggcttc

SEQ ID NO: 7754186 - DNA, 22 bp, Homo sapiens
agcattaggtgtgtttcagagg

SEQ ID NO: 7754187 - DNA, 22 bp, Homo sapiens
agcatttatttcttagaaattg

SEQ ID NO: 7754188 - DNA, 22 bp, Homo sapiens
cactgcaacctccacctcctgg

SEQ ID NO: 7754189 - DNA, 22 bp, Homo sapiens
cactgcaacctccagctctcag

SEQ ID NO: 7754190 - DNA, 22 bp, Homo sapiens
cactgcaacctccgcctcctgg

SEQ ID NO: 7754191 - DNA, 22 bp, Homo sapiens
cactgcaacctccgcctaccgg

SEQ ID NO: 7754192 - DNA, 22 bp, Homo sapiens
cactgcaacctctgcctcctgg

SEQ ID NO: 7754193 - DNA, 22 bp, Homo sapiens
cactgcaagctccgcctcctgg

SEQ ID NO: 7754194 - DNA, 22 bp, Homo sapiens
cactgcaagctccgcctcccgg

SEQ ID NO: 7754195 - DNA, 22 bp, Homo sapiens
agcaggctaatcttgctgaaca

SEQ ID NO: 7754196 - DNA, 22 bp, Homo sapiens
cacatgggcttagcaggcaggg

SEQ ID NO: 7754197 - DNA, 22 bp, Homo sapiens
cacatgggtggatggatgcatg

SEQ ID NO: 7754198 - DNA, 22 bp, Homo sapiens
cacatgaagagagtctagtaat

SEQ ID NO: 7754199 - DNA, 22 bp, Homo sapiens
cacaggctctccagggcctgga

SEQ ID NO: 7754200 - DNA, 22 bp, Homo sapiens
cactaagtaagctcctctacaa

SEQ ID NO: 7754201 - DNA, 22 bp, Homo sapiens
cactaagtcaacagcctctctt

SEQ ID NO: 7754202 - DNA, 22 bp, Homo sapiens
cactagaaccaatgacatttct

SEQ ID NO: 7754203 - DNA, 17 bp, Homo sapiens
cacatgtctacatggat

SEQ ID NO: 7754204 - DNA, 22 bp, Homo sapiens
agcgccactgcactccagcctg

SEQ ID NO: 7754205 - DNA, 22 bp, Homo sapiens
agcgccctgtgaggttggcagg

SEQ ID NO: 7754206 - DNA, 22 bp, Homo sapiens
cagcatgggggcaattcaggtg

SEQ ID NO: 7754207 - DNA, 22 bp, Homo sapiens
cagcatggggcttggagtcagc

SEQ ID NO: 7754208 - DNA, 22 bp, Homo sapiens
cagcactgttcccagaccactg

SEQ ID NO: 7754209 - DNA, 22 bp, Homo sapiens
cagcatggggatcactgtaggc

SEQ ID NO: 7754210 - DNA, 22 bp, Homo sapiens
cagcgtctcgttgtgggcctcg

SEQ ID NO: 7754211 - DNA, 22 bp, Homo sapiens
cagcgcaggcgtgtgaaggcgc

SEQ ID NO: 7754212 - DNA, 22 bp, Homo sapiens
cagctgagcatcactagtctgg

SEQ ID NO: 7754213 - DNA, 22 bp, Homo sapiens
agctgaggacgtgaagggcggc

SEQ ID NO: 7754214 - DNA, 23 bp, Homo sapiens
agctgaggcagaggggcattctc

SEQ ID NO: 7754215 - DNA, 21 bp, Homo sapiens
agcccttaggacataagagag

SEQ ID NO: 7754216 - DNA, 22 bp, Homo sapiens
cagatattaggagctcaataat

SEQ ID NO: 7754217 - DNA, 22 bp, Homo sapiens
agcctattccaggatgagctca

SEQ ID NO: 7754218 - DNA, 22 bp, Homo sapiens
cagcactgctgctgtacacaca

SEQ ID NO: 7754219 - DNA, 22 bp, Homo sapiens
cagagccatcccagcctgtggt

SEQ ID NO: 7754220 - DNA, 22 bp, Homo sapiens
cagagccatccaggtgcctgtt

SEQ ID NO: 7754221 - DNA, 22 bp, Homo sapiens
cagagctgttgcggggcttggc

SEQ ID NO: 7754222 - DNA, 20 bp, Homo sapiens
cagagctgttatggatgatg

SEQ ID NO: 7754223 - DNA, 22 bp, Homo sapiens
cagagcagtagaaaacagcctt

SEQ ID NO: 7754224 - DNA, 22 bp, Homo sapiens
cagagcagtaaatctggggcac

SEQ ID NO: 7754225 - DNA, 22 bp, Homo sapiens
cagagcagtctggagatccagc

SEQ ID NO: 7754226 - DNA, 22 bp, Homo sapiens
agccagggatgcagcacagtga

SEQ ID NO: 7754227 - DNA, 23 bp, Homo sapiens
agccagggcactggtggagattg

SEQ ID NO: 7754228 - DNA, 22 bp, Homo sapiens
agccagggctgcgagcagacag

SEQ ID NO: 7754229 - DNA, 22 bp, Homo sapiens
cagagcagggtgcaccttgggc

SEQ ID NO: 7754230 - DNA, 22 bp, Homo sapiens
agccagggaagaggcctacctc

SEQ ID NO: 7754231 - DNA, 22 bp, Homo sapiens
agccagggacgctgcaggctac

SEQ ID NO: 7754232 - DNA, 22 bp, Homo sapiens
agccaggctcaaggcctgctcc

SEQ ID NO: 7754233 - DNA, 22 bp, Homo sapiens
atggacagctgacactcacatt

SEQ ID NO: 7754234 - DNA, 22 bp, Homo sapiens
agagaacatgacgtaatagtgg

SEQ ID NO: 7754235 - DNA, 22 bp, Homo sapiens
agagaacattagcaaaaacagc

SEQ ID NO: 7754236 - DNA, 22 bp, Homo sapiens
agagaagacttacagccacagt

SEQ ID NO: 7754237 - DNA, 22 bp, Homo sapiens
agagaacagcctcctagagaaa

SEQ ID NO: 7754238 - DNA, 22 bp, Homo sapiens
atgggccttgacacatggagtg

SEQ ID NO: 7754239 - DNA, 17 bp, Homo sapiens
agagagaaaagggccat

SEQ ID NO: 7754240 - DNA, 20 bp, Homo sapiens
agagatggggtatcaccgta

SEQ ID NO: 7754241 - DNA, 22 bp, Homo sapiens
atgttacactgtttcacgttcc

SEQ ID NO: 7754242 - DNA, 22 bp, Homo sapiens
agagccagcatttgggccctgc

SEQ ID NO: 7754243 - DNA, 22 bp, Homo sapiens
atgtgcatgtgcacacatgcgt

SEQ ID NO: 7754244 - DNA, 22 bp, Homo sapiens
agagatgttcattcagcatgtt

SEQ ID NO: 7754245 - DNA, 22 bp, Homo sapiens
agagatgtctgaccactagact

SEQ ID NO: 7754246 - DNA, 22 bp, Homo sapiens
agagatgtatgcatttgtcaca

SEQ ID NO: 7754247 - DNA, 21 bp, Homo sapiens
atgtgcagcaagcagcatgct

SEQ ID NO: 7754248 - DNA, 22 bp, Homo sapiens
atgttccttccagagagcagaa

SEQ ID NO: 7754249 - DNA, 22 bp, Homo sapiens
atgctgaactgagatgtaactt

SEQ ID NO: 7754250 - DNA, 22 bp, Homo sapiens
atgctgaactgagatgtaactt

SEQ ID NO: 7754251 - DNA, 22 bp, Homo sapiens
atgctgaaaattggatttgaat

SEQ ID NO: 7754252 - DNA, 22 bp, Homo sapiens
atgctgaagagttcatgattat

SEQ ID NO: 7754253 - DNA, 22 bp, Homo sapiens
atgctgaatgaaagaaattagt

SEQ ID NO: 7754254 - DNA, 22 bp, Homo sapiens
atgctgatctgtaataagattt

SEQ ID NO: 7754255 - DNA, 22 bp, Homo sapiens
atgcttaatgagggtatatatg

SEQ ID NO: 7754256 - DNA, 22 bp, Homo sapiens
atgattgaaaatgacattgcca

SEQ ID NO: 7754257 - DNA, 22 bp, Homo sapiens
atgatatatgtgttgagcttgc

SEQ ID NO: 7754258 - DNA, 22 bp, Homo sapiens
atctgggcagggcagcaaggcg

SEQ ID NO: 7754259 - DNA, 22 bp, Homo sapiens
atcttacacgataactgttagt

SEQ ID NO: 7754260 - DNA, 22 bp, Homo sapiens
atgacccttactgcatcataca

SEQ ID NO: 7754261 - DNA, 22 bp, Homo sapiens
agatttatgtggtcacactcag

SEQ ID NO: 7754262 - DNA, 22 bp, Homo sapiens
atttacaggtagaattttaagt

SEQ ID NO: 7754263 - DNA, 22 bp, Homo sapiens
atttacaggtagaattttaagt

SEQ ID NO: 7754264 - DNA, 23 bp, Homo sapiens
atttacaggttaaatgaaatcag

SEQ ID NO: 7754265 - DNA, 22 bp, Homo sapiens
caaagttctcggctcaagtcct

SEQ ID NO: 7754266 - DNA, 22 bp, Homo sapiens
attttttcccagttagccagga

SEQ ID NO: 7754267 - DNA, 22 bp, Homo sapiens
attttttcagattgagtgttaa

SEQ ID NO: 7754268 - DNA, 22 bp, Homo sapiens
agaggccggccgagcccatggg

SEQ ID NO: 7754269 - DNA, 22 bp, Homo sapiens
attaataaaataccactttgtt

SEQ ID NO: 7754270 - DNA, 22 bp, Homo sapiens
attaatatacactgttagcatg

SEQ ID NO: 7754271 - DNA, 22 bp, Homo sapiens
attctccactgtaaggttatta

SEQ ID NO: 7754272 - DNA, 22 bp, Homo sapiens
attctccagtagtcattctatc

SEQ ID NO: 7754273 - DNA, 22 bp, Homo sapiens
attctccagctcactgtccata

SEQ ID NO: 7754274 - DNA, 19 bp, Homo sapiens
attgagcattacaaataga

SEQ ID NO: 7754275 - DNA, 22 bp, Homo sapiens
attgagcacctacagtattacc

SEQ ID NO: 7754276 - DNA, 18 bp, Homo sapiens
attgagcatgacagacct

SEQ ID NO: 7754277 - DNA, 22 bp, Homo sapiens
attgagcaggcaaagtatcata

SEQ ID NO: 7754278 - DNA, 22 bp, Homo sapiens
attgagaaaattcgagcaagtt

SEQ ID NO: 7754279 - DNA, 22 bp, Homo sapiens
attgagaaaataagtatggata

SEQ ID NO: 7754280 - DNA, 22 bp, Homo sapiens
agatacagcttttttgtcagtc

SEQ ID NO: 7754281 - DNA, 22 bp, Homo sapiens
actcacagggcctcagttttcc

SEQ ID NO: 7754282 - DNA, 22 bp, Homo sapiens
aggtggtgatgacagaagacag

SEQ ID NO: 7754283 - DNA, 22 bp, Homo sapiens
actctgctattgcagtgcaaaa

SEQ ID NO: 7754284 - DNA, 21 bp, Homo sapiens
agtccaggaggaggccaggtt

SEQ ID NO: 7754285 - DNA, 22 bp, Homo sapiens
agtgtctttcatatcctccatc

SEQ ID NO: 7754286 - DNA, 22 bp, Homo sapiens
agtgtcttactccctcaggcac

SEQ ID NO: 7754287 - DNA, 22 bp, Homo sapiens
atagcattatttacaattagta

SEQ ID NO: 7754288 - DNA, 22 bp, Homo sapiens
atagcatttacttttcagaaat

SEQ ID NO: 7754289 - DNA, 22 bp, Homo sapiens
atacacagccattatgaattag

SEQ ID NO: 7754290 - DNA, 22 bp, Homo sapiens
atacacactgctatcctttttt

SEQ ID NO: 7754291 - DNA, 22 bp, Homo sapiens
atacacacatatgtgagttttg

SEQ ID NO: 7754292 - DNA, 22 bp, Homo sapiens
ataagctttgctggagagacct

SEQ ID NO: 7754293 - DNA, 22 bp, Homo sapiens
ataagcttttgattcacttcag

SEQ ID NO: 7754294 - DNA, 22 bp, Homo sapiens
ataagcttttaaagctactttg

SEQ ID NO: 7754295 - DNA, 22 bp, Homo sapiens
ataagcttgatgtaactaacca

SEQ ID NO: 7754296 - DNA, 22 bp, Homo sapiens
ataagcttcctgttagaaaccg

SEQ ID NO: 7754297 - DNA, 22 bp, Homo sapiens
agttgaaattaagagagagttt

SEQ ID NO: 7754298 - DNA, 22 bp, Homo sapiens
agttcacatatctgttttattt

SEQ ID NO: 7754299 - DNA, 22 bp, Homo sapiens
agttcagcttcccaggtcactg

SEQ ID NO: 7754300 - DNA, 22 bp, Homo sapiens
agaaatcagaaccctgaagttc

SEQ ID NO: 7754301 - DNA, 20 bp, Homo sapiens
agaaatcagcatgtcctctg

SEQ ID NO: 7754302 - DNA, 22 bp, Homo sapiens
agaaatcacttagaggaagtga

SEQ ID NO: 7754303 - DNA, 22 bp, Homo sapiens
agaaatcacttaatgaacgtag

SEQ ID NO: 7754304 - DNA, 22 bp, Homo sapiens
agaaatcacaggaggcagaagg

SEQ ID NO: 7754305 - DNA, 22 bp, Homo sapiens
agaaatatgctgattagatgaa

SEQ ID NO: 7754306 - DNA, 22 bp, Homo sapiens
atattacacacggtatcacggg

SEQ ID NO: 7754307 - DNA, 22 bp, Homo sapiens
atcaagctacttgtcttcgttt

SEQ ID NO: 7754308 - DNA, 22 bp, Homo sapiens
atcaagctggcatatgtagttc

SEQ ID NO: 7754309 - DNA, 22 bp, Homo sapiens
agaaatctttgaagtgtaatgt

SEQ ID NO: 7754310 - DNA, 22 bp, Homo sapiens
agaaagaacgttggttatctta

SEQ ID NO: 7754311 - DNA, 17 bp, Homo sapiens
agaaagaggatccacag

SEQ ID NO: 7754312 - DNA, 22 bp, Homo sapiens
agaaacttcagctattcttttg

SEQ ID NO: 7754313 - DNA, 22 bp, Homo sapiens
agaaagaacgcacttgtgctgc

SEQ ID NO: 7754314 - DNA, 22 bp, Homo sapiens
agggccagtaccaggtgggtgg

SEQ ID NO: 7754315 - DNA, 22 bp, Homo sapiens
agggccagtgggttgaaaggca

SEQ ID NO: 7754316 - DNA, 22 bp, Homo sapiens
agggccagcactcctggcagga

SEQ ID NO: 7754317 - DNA, 19 bp, Homo sapiens
agggcacagggacagaagg

SEQ ID NO: 7754318 - DNA, 22 bp, Homo sapiens
agggcacagcctaaagcctatg

SEQ ID NO: 7754319 - DNA, 22 bp, Homo sapiens
agggcaagttgagtgtgcgtgg

SEQ ID NO: 7754320 - DNA, 22 bp, Homo sapiens
agggatgtgacattacagaagc

SEQ ID NO: 7754321 - DNA, 22 bp, Homo sapiens
agggctgaagttatggctgagc

SEQ ID NO: 7754322 - DNA, 22 bp, Homo sapiens
agggctcagcctcctcctcagc

SEQ ID NO: 7754323 - DNA, 22 bp, Homo sapiens
aggggagccgaggggcatctgt

SEQ ID NO: 7754324 - DNA, 22 bp, Homo sapiens
aggggagcaaggccgtggtgta

SEQ ID NO: 7754325 - DNA, 22 bp, Homo sapiens
aggggagcatctgtgatggtta

SEQ ID NO: 7754326 - DNA, 22 bp, Homo sapiens
aggggagcttgcctggtcaccc

SEQ ID NO: 7754327 - DNA, 22 bp, Homo sapiens
aggggagcttgaggcatggcct

SEQ ID NO: 7754328 - DNA, 22 bp, Homo sapiens
aggggagcgacattccgtgccg

SEQ ID NO: 7754329 - DNA, 22 bp, Homo sapiens
aggggagctaacaccagagccc

SEQ ID NO: 7754330 - DNA, 22 bp, Homo sapiens
acctcaggatgtggacacagaa

SEQ ID NO: 7754331 - DNA, 22 bp, Homo sapiens
acctcagaacggcgttcttgaa

SEQ ID NO: 7754332 - DNA, 22 bp, Homo sapiens
aggggcatcagttgcacatttt

SEQ ID NO: 7754333 - DNA, 22 bp, Homo sapiens
aggggtggagagtgttgccagt

SEQ ID NO: 7754334 - DNA, 22 bp, Homo sapiens
acatgtaatacatccagcaata

SEQ ID NO: 7754335 - DNA, 22 bp, Homo sapiens
aggctctggacagtgaggagtt

SEQ ID NO: 7754336 - DNA, 22 bp, Homo sapiens
aggctctggagtgtggtgctgg

SEQ ID NO: 7754337 - DNA, 22 bp, Homo sapiens
aggctctggctactacagagct

SEQ ID NO: 7754338 - DNA, 22 bp, Homo sapiens
aggctctggcaacagctggtgt

SEQ ID NO: 7754339 - DNA, 22 bp, Homo sapiens
aggctctggagttagccaggca

SEQ ID NO: 7754340 - DNA, 22 bp, Homo sapiens
aggctgtgatgagcctcatgga

SEQ ID NO: 7754341 - DNA, 22 bp, Homo sapiens
aggctgtgatggatgtaaagga

SEQ ID NO: 7754342 - DNA, 22 bp, Homo sapiens
aggctgtgattccaccactctc

SEQ ID NO: 7754343 - DNA, 22 bp, Homo sapiens
accagaaaggaataatagaatt

SEQ ID NO: 7754344 - DNA, 22 bp, Homo sapiens
aggctgggaaacctgaagttgt

SEQ ID NO: 7754345 - DNA, 22 bp, Homo sapiens
aggctgggaaatgtattccagc

SEQ ID NO: 7754346 - DNA, 22 bp, Homo sapiens
aggctgggaaatgtagtcttcc

SEQ ID NO: 7754347 - DNA, 22 bp, Homo sapiens
aggctgtgagcaagaacaccta

SEQ ID NO: 7754348 - DNA, 19 bp, Homo sapiens
aggctgtgagggaggactc

SEQ ID NO: 7754349 - DNA, 22 bp, Homo sapiens
aggctgtgagaagtccttcagt

SEQ ID NO: 7754350 - DNA, 22 bp, Homo sapiens
aggctgtgagaggtggctccca

SEQ ID NO: 7754351 - DNA, 19 bp, Homo sapiens
aggctgtgaggggaaggaa

SEQ ID NO: 7754352 - DNA, 22 bp, Homo sapiens
aggctgtgatctcatgatttgt

SEQ ID NO: 7754353 - DNA, 22 bp, Homo sapiens
aggctgtgaggggcccgcatgc

SEQ ID NO: 7754354 - DNA, 22 bp, Homo sapiens
aggctgtgagtagttcttgttg

SEQ ID NO: 7754355 - DNA, 22 bp, Homo sapiens
aggctgtgagttttgtctcaga

SEQ ID NO: 7754356 - DNA, 22 bp, Homo sapiens
aggcagtgtattgctagcggct

SEQ ID NO: 7754357 - DNA, 22 bp, Homo sapiens
aggcaggggagctggaagggta

SEQ ID NO: 7754358 - DNA, 18 bp, Homo sapiens
aggcaggtgctggaagtc

SEQ ID NO: 7754359 - DNA, 22 bp, Homo sapiens
aggcagcaaagaaatgatgctg

SEQ ID NO: 7754360 - DNA, 22 bp, Homo sapiens
aggcagcaagattatttaatcc

SEQ ID NO: 7754361 - DNA, 22 bp, Homo sapiens
aggcaggtgttgggagacacca

SEQ ID NO: 7754362 - DNA, 22 bp, Homo sapiens
aggcagacttaccttctgggga

SEQ ID NO: 7754363 - DNA, 22 bp, Homo sapiens
aggcagagaaaaaccagatatg

SEQ ID NO: 7754364 - DNA, 21 bp, Homo sapiens
aggcagaaagagcccaggctg

SEQ ID NO: 7754365 - DNA, 18 bp, Homo sapiens
aggcagacactagaggtc

SEQ ID NO: 7754366 - DNA, 22 bp, Homo sapiens
aggcactaatccctactatgag

SEQ ID NO: 7754367 - DNA, 22 bp, Homo sapiens
aggcacataatcatcctagcta

SEQ ID NO: 7754368 - DNA, 22 bp, Homo sapiens
aggcacagcacacctggccccc

SEQ ID NO: 7754369 - DNA, 22 bp, Homo sapiens
aggcaccaggatcagttagaga

SEQ ID NO: 7754370 - DNA, 22 bp, Homo sapiens
aggcaccgctcctcagtccaga

SEQ ID NO: 7754371 - DNA, 22 bp, Homo sapiens
aggaggccgatttcagaggtcg

SEQ ID NO: 7754372 - DNA, 23 bp, Homo sapiens
aggactgctcacttgaggcttcc

SEQ ID NO: 7754373 - DNA, 22 bp, Homo sapiens
aggacatgaagaaagggcaagg

SEQ ID NO: 7754374 - DNA, 22 bp, Homo sapiens
acagggccttatatccagaagg

SEQ ID NO: 7754375 - DNA, 22 bp, Homo sapiens
acagggcccttgccagcacaag

SEQ ID NO: 7754376 - DNA, 22 bp, Homo sapiens
aggaaataagggcacttcagat

SEQ ID NO: 7754377 - DNA, 22 bp, Homo sapiens
acagggcatgtgcaagagacat

SEQ ID NO: 7754378 - DNA, 22 bp, Homo sapiens
acaggaacgaatgtacattgtt

SEQ ID NO: 7754379 - DNA, 22 bp, Homo sapiens
acaggaactgttatctcagatg

SEQ ID NO: 7754380 - DNA, 21 bp, Homo sapiens
acagcatgtttgtgtgtttgc

SEQ ID NO: 7754381 - DNA, 22 bp, Homo sapiens
acagcatggataacaaggcact

SEQ ID NO: 7754382 - DNA, 22 bp, Homo sapiens
acagccagaagtcagggtggga

SEQ ID NO: 7754383 - DNA, 22 bp, Homo sapiens
acagccagaggagccaggctgg

SEQ ID NO: 7754384 - DNA, 22 bp, Homo sapiens
acaggacaaggggaagaagata

SEQ ID NO: 7754385 - DNA, 22 bp, Homo sapiens
acaggacatgtaccaggtggtc

SEQ ID NO: 7754386 - DNA, 22 bp, Homo sapiens
agcttccatactaagacaaaag

SEQ ID NO: 7754387 - DNA, 22 bp, Homo sapiens
aggggcgctgcggtcctcagcc

SEQ ID NO: 7754388 - DNA, 22 bp, Homo sapiens
cctccttctggggccttctgct

SEQ ID NO: 7754389 - DNA, 22 bp, Homo sapiens
cctccttcctgggacagagctg

SEQ ID NO: 7754390 - DNA, 22 bp, Homo sapiens
cctcttcagcaaagttcggccc

SEQ ID NO: 7754391 - DNA, 22 bp, Homo sapiens
cctcttcacctcgggcacactg

SEQ ID NO: 7754392 - DNA, 22 bp, Homo sapiens
agggggctggagacacctcctc

SEQ ID NO: 7754393 - DNA, 22 bp, Homo sapiens
aggggtagagattgctggtgta

SEQ ID NO: 7754394 - DNA, 18 bp, Homo sapiens
cctcagggagatccagtg

SEQ ID NO: 7754395 - DNA, 22 bp, Homo sapiens
cctactctgagcgcctccgcat

SEQ ID NO: 7754396 - DNA, 22 bp, Homo sapiens
cctcaggggcttttcgttgttg

SEQ ID NO: 7754397 - DNA, 22 bp, Homo sapiens
cctcaggggtcactgtgaggag

SEQ ID NO: 7754398 - DNA, 22 bp, Homo sapiens
cctcaggggtgcccacagctgc

SEQ ID NO: 7754399 - DNA, 18 bp, Homo sapiens
cctcaggggacctggcag

SEQ ID NO: 7754400 - DNA, 22 bp, Homo sapiens
cctcagggccatctctgtccct

SEQ ID NO: 7754401 - DNA, 22 bp, Homo sapiens
cctcagggaggcctctgtggct

SEQ ID NO: 7754402 - DNA, 23 bp, Homo sapiens
cctcaggggacctgtgagcctga

SEQ ID NO: 7754403 - DNA, 23 bp, Homo sapiens
cctcagggtctagcagagagaag

SEQ ID NO: 7754404 - DNA, 22 bp, Homo sapiens
cctcagggtctctcacagcacc

SEQ ID NO: 7754405 - DNA, 22 bp, Homo sapiens
cctcagggtcatcctagtaata

SEQ ID NO: 7754406 - DNA, 22 bp, Homo sapiens
cctcagggtctgaggagaccgt

SEQ ID NO: 7754407 - DNA, 22 bp, Homo sapiens
cctcagggttcggatgagaaca

SEQ ID NO: 7754408 - DNA, 22 bp, Homo sapiens
cctcagggtggcatcagatctt

SEQ ID NO: 7754409 - DNA, 22 bp, Homo sapiens
ccctggccagggcacagggagg

SEQ ID NO: 7754410 - DNA, 20 bp, Homo sapiens
agggcccaggaagagagtta

SEQ ID NO: 7754411 - DNA, 22 bp, Homo sapiens
agggcccatgtgggagcacttg

SEQ ID NO: 7754412 - DNA, 22 bp, Homo sapiens
agggcctgtgctgagtagacga

SEQ ID NO: 7754413 - DNA, 22 bp, Homo sapiens
agggcctgtgcttcctgagata

SEQ ID NO: 7754414 - DNA, 22 bp, Homo sapiens
cctacagttatattcttgattg

SEQ ID NO: 7754415 - DNA, 22 bp, Homo sapiens
agggcctgtctgtagaactgaa

SEQ ID NO: 7754416 - DNA, 22 bp, Homo sapiens
cccaggccagaacttggttgct

SEQ ID NO: 7754417 - DNA, 22 bp, Homo sapiens
agggagccctgaaccagagggt

SEQ ID NO: 7754418 - DNA, 22 bp, Homo sapiens
cccaggaaatatgtttcttaac

SEQ ID NO: 7754419 - DNA, 22 bp, Homo sapiens
cccaggaaatcaggctttctag

SEQ ID NO: 7754420 - DNA, 22 bp, Homo sapiens
cccaggaacctaccagctcgag

SEQ ID NO: 7754421 - DNA, 22 bp, Homo sapiens
cccaggaactccagagctcctc

SEQ ID NO: 7754422 - DNA, 22 bp, Homo sapiens
cccaggaacagggctcagaccc

SEQ ID NO: 7754423 - DNA, 22 bp, Homo sapiens
cccaggaagaaattctgatttg

SEQ ID NO: 7754424 - DNA, 22 bp, Homo sapiens
cccaggaaatgggctcttgcct

SEQ ID NO: 7754425 - DNA, 22 bp, Homo sapiens
cccaggaaatgaacttctgatt

SEQ ID NO: 7754426 - DNA, 22 bp, Homo sapiens
cccaggaacagcacagaacagc

SEQ ID NO: 7754427 - DNA, 22 bp, Homo sapiens
cccaggaagagtgagtggcatt

SEQ ID NO: 7754428 - DNA, 22 bp, Homo sapiens
cccaggaagaggggtcaggtgt

SEQ ID NO: 7754429 - DNA, 23 bp, Homo sapiens
cccaggaagccaaagaaatatag

SEQ ID NO: 7754430 - DNA, 22 bp, Homo sapiens
cccaggaagcccagaattctgg

SEQ ID NO: 7754431 - DNA, 22 bp, Homo sapiens
cccaggaagcggagattgcaga

SEQ ID NO: 7754432 - DNA, 19 bp, Homo sapiens
cccaggaagcggaggttgc

SEQ ID NO: 7754433 - DNA, 22 bp, Homo sapiens
cccaggaagggatgccaaggaa

SEQ ID NO: 7754434 - DNA, 22 bp, Homo sapiens
cccaggaatgagcaggcagggg

SEQ ID NO: 7754435 - DNA, 22 bp, Homo sapiens
cccaggaagttgatgcagagga

SEQ ID NO: 7754436 - DNA, 22 bp, Homo sapiens
cccaggaaggagctgtgtattt

SEQ ID NO: 7754437 - DNA, 22 bp, Homo sapiens
cccaggaaggtggtctgtggct

SEQ ID NO: 7754438 - DNA, 22 bp, Homo sapiens
cccaggaagtggaggttgcagt

SEQ ID NO: 7754439 - DNA, 22 bp, Homo sapiens
cccaggaagttgagactgcagt

SEQ ID NO: 7754440 - DNA, 22 bp, Homo sapiens
agggaaactagactgcctttct

SEQ ID NO: 7754441 - DNA, 22 bp, Homo sapiens
aggcttggctctcctatgagaa

SEQ ID NO: 7754442 - DNA, 22 bp, Homo sapiens
aggcttggctgcacgcctcgct

SEQ ID NO: 7754443 - DNA, 22 bp, Homo sapiens
aggcttggctggcagccctggg

SEQ ID NO: 7754444 - DNA, 18 bp, Homo sapiens
ccctgaggctagcatgct

SEQ ID NO: 7754445 - DNA, 22 bp, Homo sapiens
ccctgaggcaaaggctagagtt

SEQ ID NO: 7754446 - DNA, 22 bp, Homo sapiens
agggcccaccttggtgctgagg

SEQ ID NO: 7754447 - DNA, 19 bp, Homo sapiens
ccccttaggggttaagcct

SEQ ID NO: 7754448 - DNA, 22 bp, Homo sapiens
cccctgttatagaaccacctca

SEQ ID NO: 7754449 - DNA, 22 bp, Homo sapiens
cccctggggatcagctggaatt

SEQ ID NO: 7754450 - DNA, 22 bp, Homo sapiens
cccctgggtccaggcttctctg

SEQ ID NO: 7754451 - DNA, 22 bp, Homo sapiens
agggcagaccacgtgcaaggat

SEQ ID NO: 7754452 - DNA, 22 bp, Homo sapiens
aggctcagcctgggcctagagc

SEQ ID NO: 7754453 - DNA, 22 bp, Homo sapiens
aggctctgggaagcagtgagtt

SEQ ID NO: 7754454 - DNA, 22 bp, Homo sapiens
aggctctgggaacagacgggtg

SEQ ID NO: 7754455 - DNA, 20 bp, Homo sapiens
ccaggcctgggcctgctcta

SEQ ID NO: 7754456 - DNA, 22 bp, Homo sapiens
ccagtaaaccaagtgtttacta

SEQ ID NO: 7754457 - DNA, 18 bp, Homo sapiens
ccaggtggtgacagagat

SEQ ID NO: 7754458 - DNA, 22 bp, Homo sapiens
ccaggtgtttggcctgcatgat

SEQ ID NO: 7754459 - DNA, 22 bp, Homo sapiens
aggctctgtcaggcggagcagc

SEQ ID NO: 7754460 - DNA, 19 bp, Homo sapiens
aggctctgtaggagagggc

SEQ ID NO: 7754461 - DNA, 22 bp, Homo sapiens
ccattttgtctgacttcttgct

SEQ ID NO: 7754462 - DNA, 22 bp, Homo sapiens
aggctgtgcattttggagggcc

SEQ ID NO: 7754463 - DNA, 22 bp, Homo sapiens
aggctgtgcacagggcacctgc

SEQ ID NO: 7754464 - DNA, 22 bp, Homo sapiens
aggctgtgactacgcagggaag

SEQ ID NO: 7754465 - DNA, 21 bp, Homo sapiens
aggctgtgacttacactatct

SEQ ID NO: 7754466 - DNA, 22 bp, Homo sapiens
aggctgtggtgatgattgggtc

SEQ ID NO: 7754467 - DNA, 22 bp, Homo sapiens
aggctgtgggtgatttactgtg

SEQ ID NO: 7754468 - DNA, 22 bp, Homo sapiens
aggctgtggggttctgctttca

SEQ ID NO: 7754469 - DNA, 22 bp, Homo sapiens
aggctgtggtgctgaaggaggg

SEQ ID NO: 7754470 - DNA, 22 bp, Homo sapiens
aggctgtgggaatggctgcttg

SEQ ID NO: 7754471 - DNA, 22 bp, Homo sapiens
aggctgtgggacagttaggaga

SEQ ID NO: 7754472 - DNA, 22 bp, Homo sapiens
aggctgtgggagttgagagtct

SEQ ID NO: 7754473 - DNA, 22 bp, Homo sapiens
aggctgtggcatcacatcagga

SEQ ID NO: 7754474 - DNA, 22 bp, Homo sapiens
aggctgtggccctggtctagca

SEQ ID NO: 7754475 - DNA, 22 bp, Homo sapiens
aggctgtggcattaaacgtttg

SEQ ID NO: 7754476 - DNA, 22 bp, Homo sapiens
aggctgtgcgaggtctcagagt

SEQ ID NO: 7754477 - DNA, 22 bp, Homo sapiens
aggctgtgctcagccaatggga

SEQ ID NO: 7754478 - DNA, 22 bp, Homo sapiens
aggctgtggatgcttaacaaat

SEQ ID NO: 7754479 - DNA, 22 bp, Homo sapiens
ccaggcaccaaagtatgcttta

SEQ ID NO: 7754480 - DNA, 22 bp, Homo sapiens
aggcctggtgaatgaagtatct

SEQ ID NO: 7754481 - DNA, 22 bp, Homo sapiens
aggcctggtgtgccggatgcag

SEQ ID NO: 7754482 - DNA, 22 bp, Homo sapiens
ccaggaggatgaggggcataga

SEQ ID NO: 7754483 - DNA, 22 bp, Homo sapiens
ccaggaggtctgagtgtggaca

SEQ ID NO: 7754484 - DNA, 22 bp, Homo sapiens
aggccctggacactcaagccgg

SEQ ID NO: 7754485 - DNA, 22 bp, Homo sapiens
aggccctgctttccagagctca

SEQ ID NO: 7754486 - DNA, 22 bp, Homo sapiens
aggcaggtcccctggaaggcac

SEQ ID NO: 7754487 - DNA, 22 bp, Homo sapiens
ccagcagggaaaaacccaccaa

SEQ ID NO: 7754488 - DNA, 22 bp, Homo sapiens
agctttggagactgactccatc

SEQ ID NO: 7754489 - DNA, 22 bp, Homo sapiens
caggctgagctctggcctgggc

SEQ ID NO: 7754490 - DNA, 22 bp, Homo sapiens
caggctgacaactgagcatttt

SEQ ID NO: 7754491 - DNA, 17 bp, Homo sapiens
aggaatacagatcttca

SEQ ID NO: 7754492 - DNA, 22 bp, Homo sapiens
aggaatcagaattcttagaatt

SEQ ID NO: 7754493 - DNA, 22 bp, Homo sapiens
aggaatatagttggaatgtagg

SEQ ID NO: 7754494 - DNA, 22 bp, Homo sapiens
aggacactgctgaggatcagat

SEQ ID NO: 7754495 - DNA, 22 bp, Homo sapiens
cagtaaatgtgatttttcttgt

SEQ ID NO: 7754496 - DNA, 22 bp, Homo sapiens
cagtaaatggtacgtatatttt

SEQ ID NO: 7754497 - DNA, 22 bp, Homo sapiens
cagtaaatgatgatagtgcctt

SEQ ID NO: 7754498 - DNA, 22 bp, Homo sapiens
cagtaaatgcagatatagatac

SEQ ID NO: 7754499 - DNA, 20 bp, Homo sapiens
cagtatctcgctctcccaat

SEQ ID NO: 7754500 - DNA, 21 bp, Homo sapiens
agcttacattaccattgttgc

SEQ ID NO: 7754501 - DNA, 22 bp, Homo sapiens
agctgtattctctttgtattaa

SEQ ID NO: 7754502 - DNA, 22 bp, Homo sapiens
caggcaggtcagtgaagaagga

SEQ ID NO: 7754503 - DNA, 22 bp, Homo sapiens
cagctgttaccaatcttagggc

SEQ ID NO: 7754504 - DNA, 22 bp, Homo sapiens
cagctgttcattgttgccaccc

SEQ ID NO: 7754505 - DNA, 22 bp, Homo sapiens
cagctgttcctggaaggagacc

SEQ ID NO: 7754506 - DNA, 22 bp, Homo sapiens
cagctgttcctggttggtggga

SEQ ID NO: 7754507 - DNA, 22 bp, Homo sapiens
cagctgttcagcaactcgcaga

SEQ ID NO: 7754508 - DNA, 22 bp, Homo sapiens
cagctgttcacatttccaaaac

SEQ ID NO: 7754509 - DNA, 22 bp, Homo sapiens
cagctgttatgaggtgtacatg

SEQ ID NO: 7754510 - DNA, 22 bp, Homo sapiens
cagctgttactctgagtaaatg

SEQ ID NO: 7754511 - DNA, 22 bp, Homo sapiens
cagctgttactgaagtaaaatg

SEQ ID NO: 7754512 - DNA, 22 bp, Homo sapiens
cagctggtactcagttcttgtc

SEQ ID NO: 7754513 - DNA, 22 bp, Homo sapiens
caggactgaagggcacagggaa

SEQ ID NO: 7754514 - DNA, 22 bp, Homo sapiens
caggacgggcaaacaggatggt

SEQ ID NO: 7754515 - DNA, 22 bp, Homo sapiens
cagctgttcttgggacagacag

SEQ ID NO: 7754516 - DNA, 22 bp, Homo sapiens
cagctgttcggggctggcatgt

SEQ ID NO: 7754517 - DNA, 22 bp, Homo sapiens
cagctgttgactggtacatgaa

SEQ ID NO: 7754518 - DNA, 22 bp, Homo sapiens
cagctgttgatctcttaagcct

SEQ ID NO: 7754519 - DNA, 22 bp, Homo sapiens
cagctgttgcagcactgagaga

SEQ ID NO: 7754520 - DNA, 22 bp, Homo sapiens
cagctgttgtcacctcacatcc

SEQ ID NO: 7754521 - DNA, 22 bp, Homo sapiens
caggatggccccggggctgtgc

SEQ ID NO: 7754522 - DNA, 22 bp, Homo sapiens
caggatggagggagggctgtta

SEQ ID NO: 7754523 - DNA, 22 bp, Homo sapiens
caggagcagagggtggtcagca

SEQ ID NO: 7754524 - DNA, 22 bp, Homo sapiens
caggagccagaggcggatggag

SEQ ID NO: 7754525 - DNA, 22 bp, Homo sapiens
caggagcatgctgatgccagaa

SEQ ID NO: 7754526 - DNA, 22 bp, Homo sapiens
caggcacaattatttccctttc

SEQ ID NO: 7754527 - DNA, 22 bp, Homo sapiens
caggcacacagcacatggcctg

SEQ ID NO: 7754528 - DNA, 22 bp, Homo sapiens
caggatgggtgtcggccagcac

SEQ ID NO: 7754529 - DNA, 22 bp, Homo sapiens
caggatgggatgtagtgggccc

SEQ ID NO: 7754530 - DNA, 22 bp, Homo sapiens
caggcacacaggctccctgggc

SEQ ID NO: 7754531 - DNA, 22 bp, Homo sapiens
caggcacacatccgtgagagat

SEQ ID NO: 7754532 - DNA, 22 bp, Homo sapiens
caggcacacagggaatttggct

SEQ ID NO: 7754533 - DNA, 20 bp, Homo sapiens
caggcacactcattcctgct

SEQ ID NO: 7754534 - DNA, 22 bp, Homo sapiens
caggcacacccactggtgcaga

SEQ ID NO: 7754535 - DNA, 20 bp, Homo sapiens
cattggacttggcttcatgg

SEQ ID NO: 7754536 - DNA, 22 bp, Homo sapiens
aggcaaggtgctacagacagtg

SEQ ID NO: 7754537 - DNA, 22 bp, Homo sapiens
aggcaatcccctgaggatactt

SEQ ID NO: 7754538 - DNA, 22 bp, Homo sapiens
aggcaactcatcatgaaagact

SEQ ID NO: 7754539 - DNA, 22 bp, Homo sapiens
ccacagaattctgtctccagga

SEQ ID NO: 7754540 - DNA, 22 bp, Homo sapiens
ccacagaatgatgacacttcag

SEQ ID NO: 7754541 - DNA, 22 bp, Homo sapiens
ccactattactgtgtggcagtc

SEQ ID NO: 7754542 - DNA, 22 bp, Homo sapiens
ccactagtttaataccttcctt

SEQ ID NO: 7754543 - DNA, 22 bp, Homo sapiens
catacagagaaggataataaag

SEQ ID NO: 7754544 - DNA, 22 bp, Homo sapiens
catacagaaaatatattttgat

SEQ ID NO: 7754545 - DNA, 22 bp, Homo sapiens
aggatgtctctggaccaggatg

SEQ ID NO: 7754546 - DNA, 22 bp, Homo sapiens
aggatgtctctccagcctggag

SEQ ID NO: 7754547 - DNA, 22 bp, Homo sapiens
aggaggcaggaagtctatggga

SEQ ID NO: 7754548 - DNA, 22 bp, Homo sapiens
aggagctgtgaatgggaggggt

SEQ ID NO: 7754549 - DNA, 22 bp, Homo sapiens
cagttttattggttgaaatctg

SEQ ID NO: 7754550 - DNA, 22 bp, Homo sapiens
cataagaatcttccagggcatg

SEQ ID NO: 7754551 - DNA, 22 bp, Homo sapiens
cataagaatatttagtggcagc

SEQ ID NO: 7754552 - DNA, 22 bp, Homo sapiens
cagtgttccctgaacatatgtt

SEQ ID NO: 7754553 - DNA, 22 bp, Homo sapiens
aggagccaggaaacctgctctg

SEQ ID NO: 7754554 - DNA, 21 bp, Homo sapiens
aggagccagcctgtcagtcta

SEQ ID NO: 7754555 - DNA, 22 bp, Homo sapiens
aggagccagaatccagactcgg

SEQ ID NO: 7754556 - DNA, 22 bp, Homo sapiens
cctgggctttcaaaaccagcct

SEQ ID NO: 7754557 - DNA, 22 bp, Homo sapiens
cctgggcttctgtctagatgtt

SEQ ID NO: 7754558 - DNA, 22 bp, Homo sapiens
cctgggcttgcatctgtgctgg

SEQ ID NO: 7754559 - DNA, 22 bp, Homo sapiens
cctgtgagtcaacccctccttg

SEQ ID NO: 7754560 - DNA, 22 bp, Homo sapiens
cctgtgccaaaaggctgcttat

SEQ ID NO: 7754561 - DNA, 22 bp, Homo sapiens
aggtggggccaaatgctacagt

SEQ ID NO: 7754562 - DNA, 21 bp, Homo sapiens
aggtggggctgcacctctgct

SEQ ID NO: 7754563 - DNA, 19 bp, Homo sapiens
aggtaggcagtggcatgga

SEQ ID NO: 7754564 - DNA, 22 bp, Homo sapiens
aggtaggcctgacgctggggtg

SEQ ID NO: 7754565 - DNA, 23 bp, Homo sapiens
cctgcagctgccacgccctgctc

SEQ ID NO: 7754566 - DNA, 22 bp, Homo sapiens
cctgccagcccgcgttcatgcc

SEQ ID NO: 7754567 - DNA, 22 bp, Homo sapiens
aggtccctacttatctgaaggc

SEQ ID NO: 7754568 - DNA, 19 bp, Homo sapiens
aggtccctccctcgaggct

SEQ ID NO: 7754569 - DNA, 22 bp, Homo sapiens
aggtccctgagtcagcggcgct

SEQ ID NO: 7754570 - DNA, 21 bp, Homo sapiens
aggtcctctatccaagttaag

SEQ ID NO: 7754571 - DNA, 22 bp, Homo sapiens
aggtcctccaccaggtctcctg

SEQ ID NO: 7754572 - DNA, 22 bp, Homo sapiens
aggtcatgccaggcaggggaca

SEQ ID NO: 7754573 - DNA, 18 bp, Homo sapiens
aggtcatggtcatgggcg

SEQ ID NO: 7754574 - DNA, 23 bp, Homo sapiens
aggtaggttattgctgctacctg

SEQ ID NO: 7754575 - DNA, 22 bp, Homo sapiens
cctgttcccaaaccatctttct

SEQ ID NO: 7754576 - DNA, 22 bp, Homo sapiens
cctgttcctatggatatttgtt

SEQ ID NO: 7754577 - DNA, 15 bp, Homo sapiens
cctgttccttgtgat

SEQ ID NO: 7754578 - DNA, 22 bp, Homo sapiens
cctgttccattcatatcctatt

SEQ ID NO: 7754579 - DNA, 20 bp, Homo sapiens
cctgttccattccctcaacc

SEQ ID NO: 7754580 - DNA, 22 bp, Homo sapiens
cctgttcattttttgactctgc

SEQ ID NO: 7754581 - DNA, 17 bp, Homo sapiens
cgggcatggagggcagg

SEQ ID NO: 7754582 - DNA, 22 bp, Homo sapiens
cgggcgcactccgggcagctgt

SEQ ID NO: 7754583 - DNA, 22 bp, Homo sapiens
agtatttagagacacaagacgg

SEQ ID NO: 7754584 - DNA, 22 bp, Homo sapiens
ctagtcacgtctttcagttacc

SEQ ID NO: 7754585 - DNA, 22 bp, Homo sapiens
ctagtcactgtaataatctgct

SEQ ID NO: 7754586 - DNA, 22 bp, Homo sapiens
ctagtcactcagcactgacaaa

SEQ ID NO: 7754587 - DNA, 22 bp, Homo sapiens
agtcccagctactcaagaggct

SEQ ID NO: 7754588 - DNA, 22 bp, Homo sapiens
ctaggtgatccactgctctctt

SEQ ID NO: 7754589 - DNA, 22 bp, Homo sapiens
ctagtcacacagtaaggacggg

SEQ ID NO: 7754590 - DNA, 22 bp, Homo sapiens
agtccagggcttagtcagcggg

SEQ ID NO: 7754591 - DNA, 22 bp, Homo sapiens
ctccctctcaccggagccctgg

SEQ ID NO: 7754592 - DNA, 22 bp, Homo sapiens
ctccctcctcaaatatctttgt

SEQ ID NO: 7754593 - DNA, 22 bp, Homo sapiens
ctccctccctacgtgagctcac

SEQ ID NO: 7754594 - DNA, 22 bp, Homo sapiens
ctccctccaaataagactcggg

SEQ ID NO: 7754595 - DNA, 22 bp, Homo sapiens
ctccctcaggccttagccctgc

SEQ ID NO: 7754596 - DNA, 22 bp, Homo sapiens
agtcttcactcttcactactat

SEQ ID NO: 7754597 - DNA, 20 bp, Homo sapiens
agtcttcccccagaagaggg

SEQ ID NO: 7754598 - DNA, 22 bp, Homo sapiens
ctccaggctggggtgcaggttg

SEQ ID NO: 7754599 - DNA, 22 bp, Homo sapiens
ctcattccatgtgtattttgag

SEQ ID NO: 7754600 - DNA, 22 bp, Homo sapiens
agtccctggattgtctctgtca

SEQ ID NO: 7754601 - DNA, 22 bp, Homo sapiens
agtccgcgctccatgggagtcc

SEQ ID NO: 7754602 - DNA, 22 bp, Homo sapiens
ctctgggcttcaagtcagattt

SEQ ID NO: 7754603 - DNA, 22 bp, Homo sapiens
ctctggcttggtaaaaacttct

SEQ ID NO: 7754604 - DNA, 22 bp, Homo sapiens
ctctcaggtagagcccaagaat

SEQ ID NO: 7754605 - DNA, 21 bp, Homo sapiens
ctctgcagccctgcttccagg

SEQ ID NO: 7754606 - DNA, 17 bp, Homo sapiens
ctctgcagtgcatggct

SEQ ID NO: 7754607 - DNA, 21 bp, Homo sapiens
ctctgcagtgcccaccttgcc

SEQ ID NO: 7754608 - DNA, 22 bp, Homo sapiens
ctgaggagaggtggcctgtgtt

SEQ ID NO: 7754609 - DNA, 22 bp, Homo sapiens
ctgaatgagtggatttttcatt

SEQ ID NO: 7754610 - DNA, 22 bp, Homo sapiens
ctgaatgagggattctgagggc

SEQ ID NO: 7754611 - DNA, 22 bp, Homo sapiens
ctgaatgaggaaaagagtgagg

SEQ ID NO: 7754612 - DNA, 22 bp, Homo sapiens
ctgaatgactgaagtcacaatt

SEQ ID NO: 7754613 - DNA, 22 bp, Homo sapiens
ctgaatgactgaagtcacaatt

SEQ ID NO: 7754614 - DNA, 22 bp, Homo sapiens
ctgaatgaatggtttgtcttat

SEQ ID NO: 7754615 - DNA, 22 bp, Homo sapiens
ctgaatgaaatcaaggactgag

SEQ ID NO: 7754616 - DNA, 22 bp, Homo sapiens
agtgtctgcctgggaggagcat

SEQ ID NO: 7754617 - DNA, 22 bp, Homo sapiens
ctgacacactgagcatttgata

SEQ ID NO: 7754618 - DNA, 22 bp, Homo sapiens
ctgaatggcgagttagttagtt

SEQ ID NO: 7754619 - DNA, 22 bp, Homo sapiens
ctgaatgatataagatctttct

SEQ ID NO: 7754620 - DNA, 22 bp, Homo sapiens
ctgaatgatataagatctttct

SEQ ID NO: 7754621 - DNA, 22 bp, Homo sapiens
ctgaatgagtggatttttcatt

SEQ ID NO: 7754622 - DNA, 22 bp, Homo sapiens
ctgaatgataatcttttgctgg

SEQ ID NO: 7754623 - DNA, 22 bp, Homo sapiens
ctgaatgataatcttttgctgg

SEQ ID NO: 7754624 - DNA, 22 bp, Homo sapiens
ctgaggagccccctctcagcat

SEQ ID NO: 7754625 - DNA, 22 bp, Homo sapiens
ctgcatgaagtcttttttatag

SEQ ID NO: 7754626 - DNA, 22 bp, Homo sapiens
ctgcagggtttcgccagttgtg

SEQ ID NO: 7754627 - DNA, 22 bp, Homo sapiens
ctgcagggtttttcaaggacaa

SEQ ID NO: 7754628 - DNA, 22 bp, Homo sapiens
ctgcagagacctaggtcaggtt

SEQ ID NO: 7754629 - DNA, 20 bp, Homo sapiens
ctgcagggttagaggctcca

SEQ ID NO: 7754630 - DNA, 22 bp, Homo sapiens
ctgcagggtgacgttgcccacc

SEQ ID NO: 7754631 - DNA, 22 bp, Homo sapiens
ataccaccatctatgaaaggta

SEQ ID NO: 7754632 - DNA, 22 bp, Homo sapiens
ctggagagaatgtggaatgatt

SEQ ID NO: 7754633 - DNA, 22 bp, Homo sapiens
ctggagaagtactgagacattt

SEQ ID NO: 7754634 - DNA, 22 bp, Homo sapiens
ctggagaattctatgaaatatt

SEQ ID NO: 7754635 - DNA, 17 bp, Homo sapiens
ctggagaagcctgtgga

SEQ ID NO: 7754636 - DNA, 22 bp, Homo sapiens
ctggagaagcattcaaataatt

SEQ ID NO: 7754637 - DNA, 22 bp, Homo sapiens
ctggagaagccaaactagtcac

SEQ ID NO: 7754638 - DNA, 22 bp, Homo sapiens
ctggagaagaggtagtatgtag

SEQ ID NO: 7754639 - DNA, 22 bp, Homo sapiens
ctggccccatctggagtctgag

SEQ ID NO: 7754640 - DNA, 22 bp, Homo sapiens
ctggcccccacacctgtcaggg

SEQ ID NO: 7754641 - DNA, 22 bp, Homo sapiens
cttcctcccggcccatgctctg

SEQ ID NO: 7754642 - DNA, 22 bp, Homo sapiens
cttcctcccccacacactcact

SEQ ID NO: 7754643 - DNA, 21 bp, Homo sapiens
atctgaaatgtcaaagcagat

SEQ ID NO: 7754644 - DNA, 22 bp, Homo sapiens
cttcctccgaagaagttgctgg

SEQ ID NO: 7754645 - DNA, 22 bp, Homo sapiens
cttcctcctccatctcgaaggc

SEQ ID NO: 7754646 - DNA, 18 bp, Homo sapiens
atctgatgcaattcaata

SEQ ID NO: 7754647 - DNA, 22 bp, Homo sapiens
cttcttggctgcaagtctctgt

SEQ ID NO: 7754648 - DNA, 22 bp, Homo sapiens
ctgtgtgtcctcggacgagttt

SEQ ID NO: 7754649 - DNA, 22 bp, Homo sapiens
atcagagacaaaaccagcactt

SEQ ID NO: 7754650 - DNA, 22 bp, Homo sapiens
atcagaccatccagcgtggatg

SEQ ID NO: 7754651 - DNA, 23 bp, Homo sapiens
ctgtggccctgcttcatgcagcc

SEQ ID NO: 7754652 - DNA, 22 bp, Homo sapiens
ctgtggctaggaagctgtggga

SEQ ID NO: 7754653 - DNA, 22 bp, Homo sapiens
atattatagacagagtcttctg

SEQ ID NO: 7754654 - DNA, 22 bp, Homo sapiens
ctgggctgagctgtggaaactc

SEQ ID NO: 7754655 - DNA, 22 bp, Homo sapiens
atattagcagtgatcaaaatgg

SEQ ID NO: 7754656 - DNA, 22 bp, Homo sapiens
atatttaactggtcccaatata

SEQ ID NO: 7754657 - DNA, 22 bp, Homo sapiens
atatttaaacagggtaccaata

SEQ ID NO: 7754658 - DNA, 22 bp, Homo sapiens
atcagaaaaacataatgttatt

SEQ ID NO: 7754659 - DNA, 22 bp, Homo sapiens
atcagaaattgcccagctgttt

SEQ ID NO: 7754660 - DNA, 22 bp, Homo sapiens
atcagaaattgctaccagtgga

SEQ ID NO: 7754661 - DNA, 22 bp, Homo sapiens
atcagaaagttcatcatgtttg

SEQ ID NO: 7754662 - DNA, 22 bp, Homo sapiens
atcagaaatagtcatgttactt

SEQ ID NO: 7754663 - DNA, 22 bp, Homo sapiens
atcagaaatctaggattcagaa

SEQ ID NO: 7754664 - DNA, 22 bp, Homo sapiens
gcctaggatcaaccacatgaaa

SEQ ID NO: 7754665 - DNA, 22 bp, Homo sapiens
gccccctctttggagccagcca

SEQ ID NO: 7754666 - DNA, 22 bp, Homo sapiens
gccccctcaaagaggaagctct

SEQ ID NO: 7754667 - DNA, 22 bp, Homo sapiens
gcctgagaaggacacagcaggt

SEQ ID NO: 7754668 - DNA, 19 bp, Homo sapiens
gccaggtcttgggtccagg

SEQ ID NO: 7754669 - DNA, 22 bp, Homo sapiens
gctctttctgtccgcagggcct

SEQ ID NO: 7754670 - DNA, 22 bp, Homo sapiens
attttactttgtgaatattgac

SEQ ID NO: 7754671 - DNA, 22 bp, Homo sapiens
gcattctgtgctacagccattc

SEQ ID NO: 7754672 - DNA, 21 bp, Homo sapiens
gccaagaacaagacagacatg

SEQ ID NO: 7754673 - DNA, 22 bp, Homo sapiens
gccaagaaatgcccctcacaga

SEQ ID NO: 7754674 - DNA, 19 bp, Homo sapiens
gcatcaaagctgactcctg

SEQ ID NO: 7754675 - DNA, 19 bp, Homo sapiens
attcttcagcagtgagacc

SEQ ID NO: 7754676 - DNA, 22 bp, Homo sapiens
gcaggcctgcccagcaggatgg

SEQ ID NO: 7754677 - DNA, 22 bp, Homo sapiens
gcaggcctgtaatgaagggaca

SEQ ID NO: 7754678 - DNA, 22 bp, Homo sapiens
gcagggctgcagagggcactgt

SEQ ID NO: 7754679 - DNA, 22 bp, Homo sapiens
attaggttgaggtactcagagc

SEQ ID NO: 7754680 - DNA, 22 bp, Homo sapiens
attagcttatcccatttctgaa

SEQ ID NO: 7754681 - DNA, 22 bp, Homo sapiens
attagcttcctatagtaagggg

SEQ ID NO: 7754682 - DNA, 22 bp, Homo sapiens
attagcttcaaagccatcaacc

SEQ ID NO: 7754683 - DNA, 22 bp, Homo sapiens
attagcttcaaagccatcaacc

SEQ ID NO: 7754684 - DNA, 21 bp, Homo sapiens
attagcttcaaaagcttgtct

SEQ ID NO: 7754685 - DNA, 22 bp, Homo sapiens
attagcttattgtaaggtgaaa

SEQ ID NO: 7754686 - DNA, 22 bp, Homo sapiens
attagcttctgaagcccttgaa

SEQ ID NO: 7754687 - DNA, 22 bp, Homo sapiens
attagcttcctatagtaagggg

SEQ ID NO: 7754688 - DNA, 22 bp, Homo sapiens
attagcttggtatgccataaag

SEQ ID NO: 7754689 - DNA, 20 bp, Homo sapiens
attagcttggagacagtggc

SEQ ID NO: 7754690 - DNA, 22 bp, Homo sapiens
attagcttctgtgcatggactt

SEQ ID NO: 7754691 - DNA, 22 bp, Homo sapiens
attagcttaggcatgaagagaa

SEQ ID NO: 7754692 - DNA, 22 bp, Homo sapiens
attagcttatcacacaagctgc

SEQ ID NO: 7754693 - DNA, 22 bp, Homo sapiens
attagcttaggcatgaagagaa

SEQ ID NO: 7754694 - DNA, 22 bp, Homo sapiens
attagcttagtgtttccgtaat

SEQ ID NO: 7754695 - DNA, 22 bp, Homo sapiens
attagctttaaaccacagcagt

SEQ ID NO: 7754696 - DNA, 22 bp, Homo sapiens
attagcttggtatgccataaag

SEQ ID NO: 7754697 - DNA, 22 bp, Homo sapiens
attagctttaaagactttgatt

SEQ ID NO: 7754698 - DNA, 22 bp, Homo sapiens
attagctttatttgaaatagga

SEQ ID NO: 7754699 - DNA, 22 bp, Homo sapiens
attagctttatttgaaatagga

SEQ ID NO: 7754700 - DNA, 22 bp, Homo sapiens
attagctttggtggaaaggagt

SEQ ID NO: 7754701 - DNA, 22 bp, Homo sapiens
attagctttggattcagaagat

SEQ ID NO: 7754702 - DNA, 22 bp, Homo sapiens
attagctttggattcagaagat

SEQ ID NO: 7754703 - DNA, 22 bp, Homo sapiens
attagctttggtggaaaggagt

SEQ ID NO: 7754704 - DNA, 22 bp, Homo sapiens
gcagcagagtagacagagccct

SEQ ID NO: 7754705 - DNA, 21 bp, Homo sapiens
gcagcagaggcttgacagaca

SEQ ID NO: 7754706 - DNA, 16 bp, Homo sapiens
gcacgttttcaaggcc

SEQ ID NO: 7754707 - DNA, 22 bp, Homo sapiens
gcactagtctaggtgctaagat

SEQ ID NO: 7754708 - DNA, 22 bp, Homo sapiens
gcactagtcaagtgaacaattt

SEQ ID NO: 7754709 - DNA, 22 bp, Homo sapiens
gcactagtgttcttcagtaata

SEQ ID NO: 7754710 - DNA, 22 bp, Homo sapiens
gcactagttctactgccagcaa

SEQ ID NO: 7754711 - DNA, 22 bp, Homo sapiens
attcacattgagcttcactgtg

SEQ ID NO: 7754712 - DNA, 22 bp, Homo sapiens
attcacattttatttcactgga

SEQ ID NO: 7754713 - DNA, 22 bp, Homo sapiens
atgggacacacaaggaagtaaa

SEQ ID NO: 7754714 - DNA, 22 bp, Homo sapiens
atgggctgtcctagtccagccc

SEQ ID NO: 7754715 - DNA, 22 bp, Homo sapiens
atggggaagagccagtgagctg

SEQ ID NO: 7754716 - DNA, 22 bp, Homo sapiens
atggtgttgagtctctcttcac

SEQ ID NO: 7754717 - DNA, 22 bp, Homo sapiens
gaggcagccagaggttctcatt

SEQ ID NO: 7754718 - DNA, 22 bp, Homo sapiens
gagagcaatggggacgggcagg

SEQ ID NO: 7754719 - DNA, 22 bp, Homo sapiens
gagagcagactctcaaagctgg

SEQ ID NO: 7754720 - DNA, 22 bp, Homo sapiens
gagacagtggttgcagaagctc

SEQ ID NO: 7754721 - DNA, 22 bp, Homo sapiens
gagagagaggtgctgccaggca

SEQ ID NO: 7754722 - DNA, 22 bp, Homo sapiens
gagaggtttatttactccatct

SEQ ID NO: 7754723 - DNA, 22 bp, Homo sapiens
gagaggtttgtacactccgagg

SEQ ID NO: 7754724 - DNA, 22 bp, Homo sapiens
gagttcaatttccagctgttct

SEQ ID NO: 7754725 - DNA, 22 bp, Homo sapiens
gagttccttctgcctcagcttg

SEQ ID NO: 7754726 - DNA, 19 bp, Homo sapiens
gagttcctgcaaggcctcc

SEQ ID NO: 7754727 - DNA, 18 bp, Homo sapiens
gatatggaaggccatgcc

SEQ ID NO: 7754728 - DNA, 22 bp, Homo sapiens
atgttattttggaaaatacaaa

SEQ ID NO: 7754729 - DNA, 22 bp, Homo sapiens
gactgggagggttcagctgggt

SEQ ID NO: 7754730 - DNA, 22 bp, Homo sapiens
gacgccgtgtcccggcactctt

SEQ ID NO: 7754731 - DNA, 22 bp, Homo sapiens
gaccctggcagataccgtcaca

SEQ ID NO: 7754732 - DNA, 22 bp, Homo sapiens
gaccctggagttagtcctgtgt

SEQ ID NO: 7754733 - DNA, 22 bp, Homo sapiens
gaccacactttggaaatcacga

SEQ ID NO: 7754734 - DNA, 19 bp, Homo sapiens
atgcacacattgaagagga

SEQ ID NO: 7754735 - DNA, 22 bp, Homo sapiens
gaaggcttattttctttgtaaa

SEQ ID NO: 7754736 - DNA, 16 bp, Homo sapiens
gaaggcttactgcagg

SEQ ID NO: 7754737 - DNA, 22 bp, Homo sapiens
gaaggctgtcagagaggagggc

SEQ ID NO: 7754738 - DNA, 22 bp, Homo sapiens
gaacaatagtggtaacaaagcc

SEQ ID NO: 7754739 - DNA, 22 bp, Homo sapiens
gaacaatacaggctttattcct

SEQ ID NO: 7754740 - DNA, 22 bp, Homo sapiens
gaaggctggctttctgagagca

SEQ ID NO: 7754741 - DNA, 19 bp, Homo sapiens
gaacaaacttaaacttttc

SEQ ID NO: 7754742 - DNA, 22 bp, Homo sapiens
gaacaaagacatggaggaggat

SEQ ID NO: 7754743 - DNA, 22 bp, Homo sapiens
gaatcacagaggcaaattctga

SEQ ID NO: 7754744 - DNA, 22 bp, Homo sapiens
gaatatttttaaagggactaat

SEQ ID NO: 7754745 - DNA, 22 bp, Homo sapiens
gaattttatcttattacttgca

SEQ ID NO: 7754746 - DNA, 22 bp, Homo sapiens
gaataatattgactttgcaggc

SEQ ID NO: 7754747 - DNA, 22 bp, Homo sapiens
gaataatagcagaaattagcag

SEQ ID NO: 7754748 - DNA, 22 bp, Homo sapiens
gaataatagcagaaattagcag

SEQ ID NO: 7754749 - DNA, 22 bp, Homo sapiens
gaataatagcagaaattagcag

SEQ ID NO: 7754750 - DNA, 22 bp, Homo sapiens
gaataatattgactttgcaggc

SEQ ID NO: 7754751 - DNA, 22 bp, Homo sapiens
ctttcttcaacctcattctgca

SEQ ID NO: 7754752 - DNA, 22 bp, Homo sapiens
atgaaaatgtacatgtgtataa

SEQ ID NO: 7754753 - DNA, 22 bp, Homo sapiens
atctggagtgggacacagaaat

SEQ ID NO: 7754754 - DNA, 22 bp, Homo sapiens
atgacataagtgaaaaacatca

SEQ ID NO: 7754755 - DNA, 22 bp, Homo sapiens
ctttcttcaagctggtctcaat

SEQ ID NO: 7754756 - DNA, 22 bp, Homo sapiens
ctttcttgcataatttgaaacc

SEQ ID NO: 7754757 - DNA, 22 bp, Homo sapiens
gaaagtatttaagtccatattt

SEQ ID NO: 7754758 - DNA, 22 bp, Homo sapiens
gaaagtattagcctagaagtca

SEQ ID NO: 7754759 - DNA, 22 bp, Homo sapiens
atgatatttgcaatgtgcttgc

SEQ ID NO: 7754760 - DNA, 22 bp, Homo sapiens
atgatattattctagcccagag

SEQ ID NO: 7754761 - DNA, 22 bp, Homo sapiens
atgatattttagtaaagtgata

SEQ ID NO: 7754762 - DNA, 22 bp, Homo sapiens
cagagccgggagccagtcacag

SEQ ID NO: 7754763 - DNA, 22 bp, Homo sapiens
cagagcccttggctggagccca

SEQ ID NO: 7754764 - DNA, 22 bp, Homo sapiens
cagagcctccctcctctgccat

SEQ ID NO: 7754765 - DNA, 22 bp, Homo sapiens
gggccagagcttggcagctggg

SEQ ID NO: 7754766 - DNA, 22 bp, Homo sapiens
gggcagtgtcggggcccaggga

SEQ ID NO: 7754767 - DNA, 22 bp, Homo sapiens
gggctgagtcatctggggcctc

SEQ ID NO: 7754768 - DNA, 22 bp, Homo sapiens
cagagctggggactgttggatg

SEQ ID NO: 7754769 - DNA, 22 bp, Homo sapiens
cagagctgggtttgggaaacct

SEQ ID NO: 7754770 - DNA, 23 bp, Homo sapiens
cagagctggcttcatgggtgtgc

SEQ ID NO: 7754771 - DNA, 22 bp, Homo sapiens
cagagcctctgccctgggcact

SEQ ID NO: 7754772 - DNA, 22 bp, Homo sapiens
cagagctggctctgcatgtaca

SEQ ID NO: 7754773 - DNA, 22 bp, Homo sapiens
cagagacagtttcacagggtct

SEQ ID NO: 7754774 - DNA, 22 bp, Homo sapiens
gggcagcatcaggaggggcttt

SEQ ID NO: 7754775 - DNA, 22 bp, Homo sapiens
cagagacaggaatcagctgcag

SEQ ID NO: 7754776 - DNA, 22 bp, Homo sapiens
ggcttagcaactcctgaggctc

SEQ ID NO: 7754777 - DNA, 22 bp, Homo sapiens
ggcttaagtcctgaatttatgc

SEQ ID NO: 7754778 - DNA, 20 bp, Homo sapiens
ggcttaaggaattcttttct

SEQ ID NO: 7754779 - DNA, 17 bp, Homo sapiens
ggcttcagggagctggg

SEQ ID NO: 7754780 - DNA, 22 bp, Homo sapiens
ggcttcagaggggaggtagtgc

SEQ ID NO: 7754781 - DNA, 22 bp, Homo sapiens
cagaccctcgggtgagttggcc

SEQ ID NO: 7754782 - DNA, 22 bp, Homo sapiens
cagacccttttctgagaggacc

SEQ ID NO: 7754783 - DNA, 23 bp, Homo sapiens
cagaccctcaatccacttgtttt

SEQ ID NO: 7754784 - DNA, 21 bp, Homo sapiens
cagaccctctagaggccacct

SEQ ID NO: 7754785 - DNA, 22 bp, Homo sapiens
cagaccctcttctattggtggg

SEQ ID NO: 7754786 - DNA, 22 bp, Homo sapiens
cagaccctgggccacagaggag

SEQ ID NO: 7754787 - DNA, 22 bp, Homo sapiens
cagcaagagttggggttgttgg

SEQ ID NO: 7754788 - DNA, 22 bp, Homo sapiens
cagcaagagactgttctctaag

SEQ ID NO: 7754789 - DNA, 21 bp, Homo sapiens
cagcaaggaagtcgagtaggt

SEQ ID NO: 7754790 - DNA, 22 bp, Homo sapiens
cagcaaatactactagttttta

SEQ ID NO: 7754791 - DNA, 22 bp, Homo sapiens
cagcacatcttctgatcttttg

SEQ ID NO: 7754792 - DNA, 22 bp, Homo sapiens
cagcacatctccaagaatttct

SEQ ID NO: 7754793 - DNA, 22 bp, Homo sapiens
cagcaaggactgggcatgtgaa

SEQ ID NO: 7754794 - DNA, 23 bp, Homo sapiens
cagcacagtacatttcctgtctc

SEQ ID NO: 7754795 - DNA, 22 bp, Homo sapiens
cagcacagtagagtagttgtaa

SEQ ID NO: 7754796 - DNA, 21 bp, Homo sapiens
cagcacagtactgggtcttgc

SEQ ID NO: 7754797 - DNA, 22 bp, Homo sapiens
ggtgctgggaacgaggaattca

SEQ ID NO: 7754798 - DNA, 22 bp, Homo sapiens
ggtgctggacacgtggcactcc

SEQ ID NO: 7754799 - DNA, 22 bp, Homo sapiens
ggtgctgctgctgaacccagct

SEQ ID NO: 7754800 - DNA, 22 bp, Homo sapiens
ggggagcttggttattcatgca

SEQ ID NO: 7754801 - DNA, 22 bp, Homo sapiens
ggggagatgcttaggtccgggg

SEQ ID NO: 7754802 - DNA, 22 bp, Homo sapiens
ggggagcttagggtctctgaat

SEQ ID NO: 7754803 - DNA, 22 bp, Homo sapiens
ggggagcttcaggtggcttaca

SEQ ID NO: 7754804 - DNA, 22 bp, Homo sapiens
ggggagctgggaggtgagttac

SEQ ID NO: 7754805 - DNA, 22 bp, Homo sapiens
ggggagctgagacactgccctc

SEQ ID NO: 7754806 - DNA, 22 bp, Homo sapiens
ggggagctgccacagttctctg

SEQ ID NO: 7754807 - DNA, 22 bp, Homo sapiens
ggggagctgacaaccacatcct

SEQ ID NO: 7754808 - DNA, 22 bp, Homo sapiens
ggggagctcatgatgtctttgt

SEQ ID NO: 7754809 - DNA, 22 bp, Homo sapiens
ggggagcaggctgggctgtctg

SEQ ID NO: 7754810 - DNA, 22 bp, Homo sapiens
cagaggcacagtgcgggccact

SEQ ID NO: 7754811 - DNA, 22 bp, Homo sapiens
cagctactcctcccatgacttc

SEQ ID NO: 7754812 - DNA, 22 bp, Homo sapiens
cagctatggtgacaaggtcagg

SEQ ID NO: 7754813 - DNA, 22 bp, Homo sapiens
gtgctgtgtgatccatgctggc

SEQ ID NO: 7754814 - DNA, 18 bp, Homo sapiens
gtgctgtgggcagtggcc

SEQ ID NO: 7754815 - DNA, 22 bp, Homo sapiens
gtccctgtgcccagagaggcgg

SEQ ID NO: 7754816 - DNA, 22 bp, Homo sapiens
gtccctggggaatcagctggag

SEQ ID NO: 7754817 - DNA, 22 bp, Homo sapiens
gtccctgggcgcctccgtgctc

SEQ ID NO: 7754818 - DNA, 22 bp, Homo sapiens
gtcccagggaagaaggcagcac

SEQ ID NO: 7754819 - DNA, 22 bp, Homo sapiens
gtccctgggaaaggagagggca

SEQ ID NO: 7754820 - DNA, 22 bp, Homo sapiens
gtcccaggcttatgtggagctt

SEQ ID NO: 7754821 - DNA, 22 bp, Homo sapiens
cagccaggcctggtgaccaaag

SEQ ID NO: 7754822 - DNA, 22 bp, Homo sapiens
cagcccctccctcaggcaggtg

SEQ ID NO: 7754823 - DNA, 22 bp, Homo sapiens
cagccagggagggcaaatgaga

SEQ ID NO: 7754824 - DNA, 22 bp, Homo sapiens
gtctgtctccctgtgactgaga

SEQ ID NO: 7754825 - DNA, 22 bp, Homo sapiens
gtctgtgcttattcagcagggg

SEQ ID NO: 7754826 - DNA, 20 bp, Homo sapiens
cagcaggctatggggcaccc

SEQ ID NO: 7754827 - DNA, 22 bp, Homo sapiens
gtcccaggaacattctggctag

SEQ ID NO: 7754828 - DNA, 22 bp, Homo sapiens
gtcccaggagttgctgggcctt

SEQ ID NO: 7754829 - DNA, 22 bp, Homo sapiens
gtcccaggcagagtcaggaggg

SEQ ID NO: 7754830 - DNA, 22 bp, Homo sapiens
gtcccaggcaggccactggcag

SEQ ID NO: 7754831 - DNA, 22 bp, Homo sapiens
gtcccaggctccatggcagcca

SEQ ID NO: 7754832 - DNA, 22 bp, Homo sapiens
cagcagctgcgtgcccaggccg

SEQ ID NO: 7754833 - DNA, 22 bp, Homo sapiens
cagcagctggtgagacacagcc

SEQ ID NO: 7754834 - DNA, 22 bp, Homo sapiens
cagcagctgcaaatggaaacag

SEQ ID NO: 7754835 - DNA, 22 bp, Homo sapiens
cagcactaatcctgcaatttct

SEQ ID NO: 7754836 - DNA, 22 bp, Homo sapiens
cagcactaggatatacatttcc

SEQ ID NO: 7754837 - DNA, 22 bp, Homo sapiens
cagcaccctcggaggctgccgt

SEQ ID NO: 7754838 - DNA, 22 bp, Homo sapiens
cagcaccctttccactgccttg

SEQ ID NO: 7754839 - DNA, 22 bp, Homo sapiens
cagcacccctcctggctatgaa

SEQ ID NO: 7754840 - DNA, 22 bp, Homo sapiens
cagcagcttctgttgatcagaa

SEQ ID NO: 7754841 - DNA, 22 bp, Homo sapiens
cagcagctgtttacggaacacc

SEQ ID NO: 7754842 - DNA, 22 bp, Homo sapiens
cagcagctggtgagacacagcc

SEQ ID NO: 7754843 - DNA, 22 bp, Homo sapiens
ggctgagctcaggggcagcagg

SEQ ID NO: 7754844 - DNA, 22 bp, Homo sapiens
ggctctggtcagtgaggggcct

SEQ ID NO: 7754845 - DNA, 22 bp, Homo sapiens
ggcctgagcagacagcatgatg

SEQ ID NO: 7754846 - DNA, 22 bp, Homo sapiens
ggcctgagctctggggaggcaa

SEQ ID NO: 7754847 - DNA, 22 bp, Homo sapiens
ggcctgagcttgggcagcgtat

SEQ ID NO: 7754848 - DNA, 22 bp, Homo sapiens
ggcctgaggcaatagtcagaca

SEQ ID NO: 7754849 - DNA, 22 bp, Homo sapiens
ggcctgtgcacatgtgcaggaa

SEQ ID NO: 7754850 - DNA, 22 bp, Homo sapiens
ggcctgtgcaagacagcacccc

SEQ ID NO: 7754851 - DNA, 19 bp, Homo sapiens
ggcctgaggccacagatcc

SEQ ID NO: 7754852 - DNA, 22 bp, Homo sapiens
ggctcagggaatgaggaagaat

SEQ ID NO: 7754853 - DNA, 22 bp, Homo sapiens
ggcctgtggtttctagtaggtt

SEQ ID NO: 7754854 - DNA, 22 bp, Homo sapiens
ggcctgtgggaggacagctggg

SEQ ID NO: 7754855 - DNA, 22 bp, Homo sapiens
ggcctgtggatctgatgaacca

SEQ ID NO: 7754856 - DNA, 22 bp, Homo sapiens
ggcctgtggcaaggtgagaatg

SEQ ID NO: 7754857 - DNA, 18 bp, Homo sapiens
cagaaagttatttactct

SEQ ID NO: 7754858 - DNA, 22 bp, Homo sapiens
cagaaagtgatttgctattcca

SEQ ID NO: 7754859 - DNA, 23 bp, Homo sapiens
cagaaataaactggtttgtagat

SEQ ID NO: 7754860 - DNA, 22 bp, Homo sapiens
ggcttaagaaatgtctagtttt

SEQ ID NO: 7754861 - DNA, 22 bp, Homo sapiens
ggcttaagatatttctgattcc

SEQ ID NO: 7754862 - DNA, 22 bp, Homo sapiens
ggcttaagatggtagctttgag

SEQ ID NO: 7754863 - DNA, 22 bp, Homo sapiens
ggctgtgaagtagcaggggcag

SEQ ID NO: 7754864 - DNA, 22 bp, Homo sapiens
ggctgtgaaccctggcagtgtg

SEQ ID NO: 7754865 - DNA, 22 bp, Homo sapiens
ggctgtgaacactcttagcatc

SEQ ID NO: 7754866 - DNA, 22 bp, Homo sapiens
cagaaaagggtgtttgttcagg

SEQ ID NO: 7754867 - DNA, 22 bp, Homo sapiens
cagaaaataaacatttgtggaa

SEQ ID NO: 7754868 - DNA, 22 bp, Homo sapiens
cagaaaataaagtttctacgca

SEQ ID NO: 7754869 - DNA, 22 bp, Homo sapiens
cagaaacatgtataaagttgta

SEQ ID NO: 7754870 - DNA, 22 bp, Homo sapiens
cacatacatacgtatgtataca

SEQ ID NO: 7754871 - DNA, 19 bp, Homo sapiens
cacatacagaaaagagtaa

SEQ ID NO: 7754872 - DNA, 22 bp, Homo sapiens
cacatacattcatgttactcta

SEQ ID NO: 7754873 - DNA, 22 bp, Homo sapiens
cacatacatgcacacctaaata

SEQ ID NO: 7754874 - DNA, 22 bp, Homo sapiens
cacatacaagccatggggggat

SEQ ID NO: 7754875 - DNA, 22 bp, Homo sapiens
cacatacaaggcacactggagg

SEQ ID NO: 7754876 - DNA, 22 bp, Homo sapiens
cacatacaatggtgttatttgg

SEQ ID NO: 7754877 - DNA, 22 bp, Homo sapiens
ggcaggcatcatgtggtcatta

SEQ ID NO: 7754878 - DNA, 22 bp, Homo sapiens
ggcaggcatggggtctgccatt

SEQ ID NO: 7754879 - DNA, 22 bp, Homo sapiens
ggcaggcaggtcttcatggccc

SEQ ID NO: 7754880 - DNA, 22 bp, Homo sapiens
ggcaggcagtgtggtgtgaaac

SEQ ID NO: 7754881 - DNA, 22 bp, Homo sapiens
ggcaggcaggagctctgtctcc

SEQ ID NO: 7754882 - DNA, 22 bp, Homo sapiens
cacattcttgagttacagtcta

SEQ ID NO: 7754883 - DNA, 22 bp, Homo sapiens
ggccaaggatggtggctctggt

SEQ ID NO: 7754884 - DNA, 22 bp, Homo sapiens
ggcagggcaggaaagtcaggaa

SEQ ID NO: 7754885 - DNA, 22 bp, Homo sapiens
ggcaggtgcacctgagccatct

SEQ ID NO: 7754886 - DNA, 22 bp, Homo sapiens
cacgagaacctctcatttgatt

SEQ ID NO: 7754887 - DNA, 22 bp, Homo sapiens
ggccggcctttgcgagcattct

SEQ ID NO: 7754888 - DNA, 22 bp, Homo sapiens
ggaggcaggaaagacaggttca

SEQ ID NO: 7754889 - DNA, 22 bp, Homo sapiens
cacaggaatctgcattttgacc

SEQ ID NO: 7754890 - DNA, 22 bp, Homo sapiens
cacaggaatgaacagggaaaga

SEQ ID NO: 7754891 - DNA, 18 bp, Homo sapiens
cacaggaaggggaatatc

SEQ ID NO: 7754892 - DNA, 22 bp, Homo sapiens
cacaggaatcagcattaatggc

SEQ ID NO: 7754893 - DNA, 22 bp, Homo sapiens
cacaggaatcgtcacttagcgc

SEQ ID NO: 7754894 - DNA, 22 bp, Homo sapiens
ggaggccaaagtgtgggcggct

SEQ ID NO: 7754895 - DNA, 22 bp, Homo sapiens
ggagctggcagcgcaacccaga

SEQ ID NO: 7754896 - DNA, 20 bp, Homo sapiens
ggagctggcatccagcctct

SEQ ID NO: 7754897 - DNA, 22 bp, Homo sapiens
ggagctggagagtacagagttt

SEQ ID NO: 7754898 - DNA, 23 bp, Homo sapiens
ggagctggacccttacacctttc

SEQ ID NO: 7754899 - DNA, 22 bp, Homo sapiens
ggagctggagagctagcctagg

SEQ ID NO: 7754900 - DNA, 22 bp, Homo sapiens
ggagctggaatatattgaaacc

SEQ ID NO: 7754901 - DNA, 22 bp, Homo sapiens
cacagataaggatgttaatttt

SEQ ID NO: 7754902 - DNA, 22 bp, Homo sapiens
cacagatagaccttatgagatt

SEQ ID NO: 7754903 - DNA, 22 bp, Homo sapiens
cacagaattttctctttacaat

SEQ ID NO: 7754904 - DNA, 22 bp, Homo sapiens
cacagaattaagggagaaatat

SEQ ID NO: 7754905 - DNA, 22 bp, Homo sapiens
cacagaatggaccagttttaga

SEQ ID NO: 7754906 - DNA, 22 bp, Homo sapiens
cacagaatcatattgtcagttt

SEQ ID NO: 7754907 - DNA, 21 bp, Homo sapiens
cacagaatatacattttagtt

SEQ ID NO: 7754908 - DNA, 22 bp, Homo sapiens
cacagaagtttcatagtctcga

SEQ ID NO: 7754909 - DNA, 22 bp, Homo sapiens
cacagaagtgtgtataactctt

SEQ ID NO: 7754910 - DNA, 15 bp, Homo sapiens
cacacagacagcttg

SEQ ID NO: 7754911 - DNA, 22 bp, Homo sapiens
cacacagatggtaagggaggga

SEQ ID NO: 7754912 - DNA, 22 bp, Homo sapiens
cacacagacagctctctgaaga

SEQ ID NO: 7754913 - DNA, 21 bp, Homo sapiens
cacacagctgcccttaggtag

SEQ ID NO: 7754914 - DNA, 22 bp, Homo sapiens
cacacagctagtgacaggagaa

SEQ ID NO: 7754915 - DNA, 22 bp, Homo sapiens
cacacagcaacaagaatagcca

SEQ ID NO: 7754916 - DNA, 22 bp, Homo sapiens
cacacagctcaggggcactgcc

SEQ ID NO: 7754917 - DNA, 22 bp, Homo sapiens
gcttgggcttaactgtaggttc

SEQ ID NO: 7754918 - DNA, 22 bp, Homo sapiens
gctttcttcatactcaagcatc

SEQ ID NO: 7754919 - DNA, 22 bp, Homo sapiens
gctttcttggttctgcaggggc

SEQ ID NO: 7754920 - DNA, 22 bp, Homo sapiens
gctttcttgctgcatggtggct

SEQ ID NO: 7754921 - DNA, 22 bp, Homo sapiens
gctttgcactccagctgtggcc

SEQ ID NO: 7754922 - DNA, 22 bp, Homo sapiens
gctttgcattgtgatgggatgc

SEQ ID NO: 7754923 - DNA, 22 bp, Homo sapiens
caaggtgccatgctgggcgggg

SEQ ID NO: 7754924 - DNA, 22 bp, Homo sapiens
caaggtcagcgtgaagttctgt

SEQ ID NO: 7754925 - DNA, 22 bp, Homo sapiens
gctgtggcggcagcagctggtg

SEQ ID NO: 7754926 - DNA, 22 bp, Homo sapiens
gctgttctgcaccagacttcag

SEQ ID NO: 7754927 - DNA, 22 bp, Homo sapiens
gctgttctgtccccatgggtaa

SEQ ID NO: 7754928 - DNA, 22 bp, Homo sapiens
gctgttctctgtaacatgcatt

SEQ ID NO: 7754929 - DNA, 22 bp, Homo sapiens
gctgttctagcttcagtttcgc

SEQ ID NO: 7754930 - DNA, 22 bp, Homo sapiens
caagtttaaggcactgataagt

SEQ ID NO: 7754931 - DNA, 22 bp, Homo sapiens
gctgttctttgcatctctggtg

SEQ ID NO: 7754932 - DNA, 18 bp, Homo sapiens
gctgttcttcgcactggc

SEQ ID NO: 7754933 - DNA, 22 bp, Homo sapiens
gctgttctttcagcccagggct

SEQ ID NO: 7754934 - DNA, 22 bp, Homo sapiens
caagccagtttgtagttctctc

SEQ ID NO: 7754935 - DNA, 22 bp, Homo sapiens
caagccagtgatgtttgctgcc

SEQ ID NO: 7754936 - DNA, 22 bp, Homo sapiens
caagccagtgacagccagggaa

SEQ ID NO: 7754937 - DNA, 22 bp, Homo sapiens
gctggaggatggactggaagaa

SEQ ID NO: 7754938 - DNA, 22 bp, Homo sapiens
caagccagcagtttaatgactc

SEQ ID NO: 7754939 - DNA, 22 bp, Homo sapiens
caagccagagagcaactgttct

SEQ ID NO: 7754940 - DNA, 22 bp, Homo sapiens
caagccagctcctgccacagag

SEQ ID NO: 7754941 - DNA, 22 bp, Homo sapiens
caagccagcttgatgacctgtc

SEQ ID NO: 7754942 - DNA, 22 bp, Homo sapiens
caagccaggaaggatccagcac

SEQ ID NO: 7754943 - DNA, 20 bp, Homo sapiens
caagccaggccctgctgctg

SEQ ID NO: 7754944 - DNA, 22 bp, Homo sapiens
caagccaggtgaacataacaag

SEQ ID NO: 7754945 - DNA, 22 bp, Homo sapiens
caagccagtcagctcagtagat

SEQ ID NO: 7754946 - DNA, 21 bp, Homo sapiens
caagccagaccaatagcagcc

SEQ ID NO: 7754947 - DNA, 22 bp, Homo sapiens
caaggccatgagcagcgagtgt

SEQ ID NO: 7754948 - DNA, 22 bp, Homo sapiens
caaggcttcacgtccccagtgc

SEQ ID NO: 7754949 - DNA, 22 bp, Homo sapiens
caaggcttgaattctgatgggt

SEQ ID NO: 7754950 - DNA, 20 bp, Homo sapiens
caaggcttctttgatggggt

SEQ ID NO: 7754951 - DNA, 20 bp, Homo sapiens
caagggtttgcattggcttt

SEQ ID NO: 7754952 - DNA, 22 bp, Homo sapiens
caagggtggtattgggagcata

SEQ ID NO: 7754953 - DNA, 22 bp, Homo sapiens
caagggtgaaggcagaggacat

SEQ ID NO: 7754954 - DNA, 22 bp, Homo sapiens
caagggtgaaggctcctccagg

SEQ ID NO: 7754955 - DNA, 22 bp, Homo sapiens
caagggtggaaatatttttaag

SEQ ID NO: 7754956 - DNA, 22 bp, Homo sapiens
gctggctggtccagcaggggct

SEQ ID NO: 7754957 - DNA, 22 bp, Homo sapiens
cctcattctcgcgtgtgtttct

SEQ ID NO: 7754958 - DNA, 22 bp, Homo sapiens
cctcattctttcctgggcccct

SEQ ID NO: 7754959 - DNA, 22 bp, Homo sapiens
cctcatgctgcatctctgaggt

SEQ ID NO: 7754960 - DNA, 18 bp, Homo sapiens
cctcagggagagagacgc

SEQ ID NO: 7754961 - DNA, 22 bp, Homo sapiens
cctcagggactccatgctgcag

SEQ ID NO: 7754962 - DNA, 22 bp, Homo sapiens
cctcagggacgggatcacttgg

SEQ ID NO: 7754963 - DNA, 22 bp, Homo sapiens
cctcagggaatgggaggctggg

SEQ ID NO: 7754964 - DNA, 22 bp, Homo sapiens
cctcaggcttcgtcttccaccc

SEQ ID NO: 7754965 - DNA, 22 bp, Homo sapiens
cctaggaaggagtatagtaaat

SEQ ID NO: 7754966 - DNA, 18 bp, Homo sapiens
tggagcaggtaggcatga

SEQ ID NO: 7754967 - DNA, 22 bp, Homo sapiens
tggctgggagctggaactgggc

SEQ ID NO: 7754968 - DNA, 22 bp, Homo sapiens
cctctgtggccttggaccagct

SEQ ID NO: 7754969 - DNA, 22 bp, Homo sapiens
cctctgagtagactggacatga

SEQ ID NO: 7754970 - DNA, 22 bp, Homo sapiens
tgggctgcttcctcagctgaga

SEQ ID NO: 7754971 - DNA, 22 bp, Homo sapiens
tgggctgctgttacaggggctg

SEQ ID NO: 7754972 - DNA, 22 bp, Homo sapiens
tgggctgctgagaatgagagag

SEQ ID NO: 7754973 - DNA, 22 bp, Homo sapiens
tgggctgcggataggcctcgga

SEQ ID NO: 7754974 - DNA, 22 bp, Homo sapiens
cctgagccgagcgctctttctc

SEQ ID NO: 7754975 - DNA, 22 bp, Homo sapiens
tgggccagtttctcattgaaat

SEQ ID NO: 7754976 - DNA, 22 bp, Homo sapiens
cctcttctaggtttcagcctgc

SEQ ID NO: 7754977 - DNA, 22 bp, Homo sapiens
cctcttctgagtgagactccct

SEQ ID NO: 7754978 - DNA, 20 bp, Homo sapiens
cccaggggttgtggtgagga

SEQ ID NO: 7754979 - DNA, 22 bp, Homo sapiens
cccaggggttctgagcagcagc

SEQ ID NO: 7754980 - DNA, 22 bp, Homo sapiens
cccaggggttcaaggctgcagt

SEQ ID NO: 7754981 - DNA, 22 bp, Homo sapiens
cccaggggttctagaccagctt

SEQ ID NO: 7754982 - DNA, 22 bp, Homo sapiens
cccagggttgcctgcctctgct

SEQ ID NO: 7754983 - DNA, 22 bp, Homo sapiens
tgcctgtgtggtctgcgcatta

SEQ ID NO: 7754984 - DNA, 22 bp, Homo sapiens
cccaggctggagtgcaatggca

SEQ ID NO: 7754985 - DNA, 22 bp, Homo sapiens
cccaggctggagggcagtgtca

SEQ ID NO: 7754986 - DNA, 22 bp, Homo sapiens
cccaggctggagtgcaatggtg

SEQ ID NO: 7754987 - DNA, 22 bp, Homo sapiens
tgccaggagtgtagagtggttt

SEQ ID NO: 7754988 - DNA, 22 bp, Homo sapiens
cccctttctcccgcgtctggcc

SEQ ID NO: 7754989 - DNA, 22 bp, Homo sapiens
cccctttctcccgcgactggcc

SEQ ID NO: 7754990 - DNA, 22 bp, Homo sapiens
cccgcagtcggaatttctcagt

SEQ ID NO: 7754991 - DNA, 22 bp, Homo sapiens
cccggacagaggggcagagtgt

SEQ ID NO: 7754992 - DNA, 22 bp, Homo sapiens
tgctggcctgggctgcaccttg

SEQ ID NO: 7754993 - DNA, 22 bp, Homo sapiens
ccccacaactcatgttgaaact

SEQ ID NO: 7754994 - DNA, 22 bp, Homo sapiens
ccctgaggaccaggaaggaggg

SEQ ID NO: 7754995 - DNA, 22 bp, Homo sapiens
ccctcgaggttttctgaggtac

SEQ ID NO: 7754996 - DNA, 22 bp, Homo sapiens
ccctcgggtcgcggactgcgct

SEQ ID NO: 7754997 - DNA, 22 bp, Homo sapiens
ccctcggggcctcagtttccct

SEQ ID NO: 7754998 - DNA, 22 bp, Homo sapiens
ccaggaaggatcgtttgggagt

SEQ ID NO: 7754999 - DNA, 22 bp, Homo sapiens
ccaggacagtgaacatgtaaga

SEQ ID NO: 7755000 - DNA, 22 bp, Homo sapiens
ccaggaccacacgacaggagag

SEQ ID NO: 7755001 - DNA, 22 bp, Homo sapiens
ccaggacactgcttcacagcag

SEQ ID NO: 7755002 - DNA, 18 bp, Homo sapiens
ccaggacaggcaaaaggt

SEQ ID NO: 7755003 - DNA, 22 bp, Homo sapiens
tctggttgtcgaccaccaatgc

SEQ ID NO: 7755004 - DNA, 22 bp, Homo sapiens
ccaggacttcgaggctacagtg

SEQ ID NO: 7755005 - DNA, 22 bp, Homo sapiens
ccaggactttaagtccagcact

SEQ ID NO: 7755006 - DNA, 22 bp, Homo sapiens
ccaggactcaattaacctcact

SEQ ID NO: 7755007 - DNA, 22 bp, Homo sapiens
ccagctgaggcagccacacagg

SEQ ID NO: 7755008 - DNA, 22 bp, Homo sapiens
ccagctgattcggtggtggttg

SEQ ID NO: 7755009 - DNA, 22 bp, Homo sapiens
ccagctgaggttgaagaaagag

SEQ ID NO: 7755010 - DNA, 22 bp, Homo sapiens
tctgctcacatggctccatgca

SEQ ID NO: 7755011 - DNA, 22 bp, Homo sapiens
tctcagaattgtgtccactggg

SEQ ID NO: 7755012 - DNA, 22 bp, Homo sapiens
tctcagaatcaggacctacttc

SEQ ID NO: 7755013 - DNA, 22 bp, Homo sapiens
tctcagaataaattcctaactt

SEQ ID NO: 7755014 - DNA, 22 bp, Homo sapiens
ccaggctctgtctggtcagaag

SEQ ID NO: 7755015 - DNA, 22 bp, Homo sapiens
ccaggctctgtgtgggctagag

SEQ ID NO: 7755016 - DNA, 22 bp, Homo sapiens
ccaggctggagtgcaatggcat

SEQ ID NO: 7755017 - DNA, 22 bp, Homo sapiens
ccaggctgctgttggtgtccgc

SEQ ID NO: 7755018 - DNA, 22 bp, Homo sapiens
ccaggctggagtgcaatggcgt

SEQ ID NO: 7755019 - DNA, 22 bp, Homo sapiens
tctttcttgcaaggatgcagga

SEQ ID NO: 7755020 - DNA, 22 bp, Homo sapiens
tctttcttctttcatagtgtga

SEQ ID NO: 7755021 - DNA, 22 bp, Homo sapiens
tctttcttcctggagcccaaca

SEQ ID NO: 7755022 - DNA, 22 bp, Homo sapiens
tctttcttcagccctgtaagat

SEQ ID NO: 7755023 - DNA, 22 bp, Homo sapiens
tctttcttattatgctcaatgt

SEQ ID NO: 7755024 - DNA, 22 bp, Homo sapiens
tctttcttggtataaagcaggg

SEQ ID NO: 7755025 - DNA, 22 bp, Homo sapiens
tctttcttgtgggtgccctttt

SEQ ID NO: 7755026 - DNA, 22 bp, Homo sapiens
tctttctttatcacctgatatg

SEQ ID NO: 7755027 - DNA, 22 bp, Homo sapiens
tctttcttggtattctgagcta

SEQ ID NO: 7755028 - DNA, 22 bp, Homo sapiens
ccaggcctgcattccctctcag

SEQ ID NO: 7755029 - DNA, 22 bp, Homo sapiens
tctttgaaacaccctaaccttt

SEQ ID NO: 7755030 - DNA, 22 bp, Homo sapiens
tctttgaaagctgttctagagt

SEQ ID NO: 7755031 - DNA, 22 bp, Homo sapiens
tctttgaaaagggagatagaaa

SEQ ID NO: 7755032 - DNA, 22 bp, Homo sapiens
tctttgaaaagatattcctcct

SEQ ID NO: 7755033 - DNA, 22 bp, Homo sapiens
ccaggatagtatgagtagggat

SEQ ID NO: 7755034 - DNA, 22 bp, Homo sapiens
ccaggcaaggacatgaaactga

SEQ ID NO: 7755035 - DNA, 22 bp, Homo sapiens
ccaggcaacggagcccactgcc

SEQ ID NO: 7755036 - DNA, 22 bp, Homo sapiens
ccaggaggttgaggctgcagtg

SEQ ID NO: 7755037 - DNA, 22 bp, Homo sapiens
ccaggcaggctagaatgtaaat

SEQ ID NO: 7755038 - DNA, 19 bp, Homo sapiens
tcttccctggctgtcagtc

SEQ ID NO: 7755039 - DNA, 22 bp, Homo sapiens
tcttcagagtgaaagtctgtga

SEQ ID NO: 7755040 - DNA, 22 bp, Homo sapiens
tgagggcaaagtggtgctgagg

SEQ ID NO: 7755041 - DNA, 22 bp, Homo sapiens
tgagggatccagaggcagtggt

SEQ ID NO: 7755042 - DNA, 22 bp, Homo sapiens
ccatggcctgaaggagtgcatc

SEQ ID NO: 7755043 - DNA, 22 bp, Homo sapiens
tgaggtcagcccttcctatgat

SEQ ID NO: 7755044 - DNA, 22 bp, Homo sapiens
ccatggaactcagtaaattata

SEQ ID NO: 7755045 - DNA, 22 bp, Homo sapiens
ccatgcctcgggaagagtctgt

SEQ ID NO: 7755046 - DNA, 21 bp, Homo sapiens
ccattcttagtcaagtgtctc

SEQ ID NO: 7755047 - DNA, 21 bp, Homo sapiens
tgcaaaggacctgaggtagga

SEQ ID NO: 7755048 - DNA, 18 bp, Homo sapiens
tgcaaaggacactgagat

SEQ ID NO: 7755049 - DNA, 21 bp, Homo sapiens
tgcaaaggtatttagggggta

SEQ ID NO: 7755050 - DNA, 22 bp, Homo sapiens
tgcaaaggtttgtgcttggaaa

SEQ ID NO: 7755051 - DNA, 22 bp, Homo sapiens
ccaggtgctcttgccagggctg

SEQ ID NO: 7755052 - DNA, 22 bp, Homo sapiens
tgagaatcagctgcacagaggt

SEQ ID NO: 7755053 - DNA, 19 bp, Homo sapiens
tgagaaggcagtggggagc

SEQ ID NO: 7755054 - DNA, 22 bp, Homo sapiens
tgaatgcaagaaggaacatgaa

SEQ ID NO: 7755055 - DNA, 22 bp, Homo sapiens
tgaatgatttgggtgcattcag

SEQ ID NO: 7755056 - DNA, 21 bp, Homo sapiens
tgaatgatctggttgcctttt

SEQ ID NO: 7755057 - DNA, 22 bp, Homo sapiens
tgaatgatgaggggagaataat

SEQ ID NO: 7755058 - DNA, 22 bp, Homo sapiens
tgaatgatgcagtataatgata

SEQ ID NO: 7755059 - DNA, 22 bp, Homo sapiens
tgaatgatgcatttgtttccca

SEQ ID NO: 7755060 - DNA, 21 bp, Homo sapiens
tgaatgatgccccagagttgt

SEQ ID NO: 7755061 - DNA, 23 bp, Homo sapiens
tgaatgatggtgctcctcatctt

SEQ ID NO: 7755062 - DNA, 22 bp, Homo sapiens
tgaatgatggtgtgttcttgcc

SEQ ID NO: 7755063 - DNA, 22 bp, Homo sapiens
tgaatgatgtataatattgaga

SEQ ID NO: 7755064 - DNA, 22 bp, Homo sapiens
tgaatgattaaaacccggacta

SEQ ID NO: 7755065 - DNA, 23 bp, Homo sapiens
tgaatgattgtactgagctttta

SEQ ID NO: 7755066 - DNA, 22 bp, Homo sapiens
tgaatgatttcttaggcaattg

SEQ ID NO: 7755067 - DNA, 22 bp, Homo sapiens
tgaagttgttaaggttgccatt

SEQ ID NO: 7755068 - DNA, 22 bp, Homo sapiens
tgaatgatctagttttgtagac

SEQ ID NO: 7755069 - DNA, 22 bp, Homo sapiens
tgaatgatatgtgaaaaggaac

SEQ ID NO: 7755070 - DNA, 22 bp, Homo sapiens
tgaatgatctccgattagtcct

SEQ ID NO: 7755071 - DNA, 22 bp, Homo sapiens
tgaatgatatattgggaataat

SEQ ID NO: 7755072 - DNA, 22 bp, Homo sapiens
tgaatgatacagaattatgtag

SEQ ID NO: 7755073 - DNA, 22 bp, Homo sapiens
ccaggctggagtgcagtggcac

SEQ ID NO: 7755074 - DNA, 22 bp, Homo sapiens
ccaggctggagtgcagtagtgt

SEQ ID NO: 7755075 - DNA, 22 bp, Homo sapiens
ccaggctggagtgcaatggtgc

SEQ ID NO: 7755076 - DNA, 22 bp, Homo sapiens
ccaggctggattttgcagttca

SEQ ID NO: 7755077 - DNA, 22 bp, Homo sapiens
ccaggctggagtgtagtcgcat

SEQ ID NO: 7755078 - DNA, 21 bp, Homo sapiens
ccaggctggccatggtattga

SEQ ID NO: 7755079 - DNA, 22 bp, Homo sapiens
tgacatcagaatggcatagaaa

SEQ ID NO: 7755080 - DNA, 19 bp, Homo sapiens
ccagggctttaagttgagg

SEQ ID NO: 7755081 - DNA, 22 bp, Homo sapiens
ccaggggaaacagggagcactc

SEQ ID NO: 7755082 - DNA, 22 bp, Homo sapiens
tattagttgcaaaacattgact

SEQ ID NO: 7755083 - DNA, 22 bp, Homo sapiens
tattagtctgtaaattgatgct

SEQ ID NO: 7755084 - DNA, 22 bp, Homo sapiens
tattattaaatggcagaatttt

SEQ ID NO: 7755085 - DNA, 22 bp, Homo sapiens
tattaggttagtgcaaaagttt

SEQ ID NO: 7755086 - DNA, 22 bp, Homo sapiens
tattaggttggtgcaaaagtaa

SEQ ID NO: 7755087 - DNA, 22 bp, Homo sapiens
tattaggttggtgcaaaaagta

SEQ ID NO: 7755088 - DNA, 22 bp, Homo sapiens
tattaggttgttgcaaaagtaa

SEQ ID NO: 7755089 - DNA, 22 bp, Homo sapiens
tattaggttggtgcaaaagtca

SEQ ID NO: 7755090 - DNA, 22 bp, Homo sapiens
tattaggttggtgcaaaattaa

SEQ ID NO: 7755091 - DNA, 22 bp, Homo sapiens
tattaggttggtgcaacagtaa

SEQ ID NO: 7755092 - DNA, 22 bp, Homo sapiens
caggtggatctctaaggactga

SEQ ID NO: 7755093 - DNA, 22 bp, Homo sapiens
caggtggagctgactgagggca

SEQ ID NO: 7755094 - DNA, 22 bp, Homo sapiens
caggtacacaggacaaagtact

SEQ ID NO: 7755095 - DNA, 22 bp, Homo sapiens
caggtaactttagtgaaagagc

SEQ ID NO: 7755096 - DNA, 19 bp, Homo sapiens
caggtaacatatgcacaaa

SEQ ID NO: 7755097 - DNA, 22 bp, Homo sapiens
caggtaacatgataaaacttac

SEQ ID NO: 7755098 - DNA, 22 bp, Homo sapiens
caggtgcccaggggacagtggc

SEQ ID NO: 7755099 - DNA, 22 bp, Homo sapiens
caggtgccgggaatgcagcaat

SEQ ID NO: 7755100 - DNA, 22 bp, Homo sapiens
tattttacatgatccagagttg

SEQ ID NO: 7755101 - DNA, 22 bp, Homo sapiens
tattttatctgccagagtggag

SEQ ID NO: 7755102 - DNA, 22 bp, Homo sapiens
cagtcacattgccctgcattta

SEQ ID NO: 7755103 - DNA, 22 bp, Homo sapiens
cagtcaacagagagcccgtcag

SEQ ID NO: 7755104 - DNA, 22 bp, Homo sapiens
cagtcacacaagtggacttggg

SEQ ID NO: 7755105 - DNA, 17 bp, Homo sapiens
cagtcacaggtcttttc

SEQ ID NO: 7755106 - DNA, 22 bp, Homo sapiens
cagtcacataggtatacacata

SEQ ID NO: 7755107 - DNA, 22 bp, Homo sapiens
tagatttcaggagacaaaatgg

SEQ ID NO: 7755108 - DNA, 22 bp, Homo sapiens
cagggagcactgcgagcggcag

SEQ ID NO: 7755109 - DNA, 22 bp, Homo sapiens
cagggagcagcccctagaagta

SEQ ID NO: 7755110 - DNA, 22 bp, Homo sapiens
cagggccagttctcgcagcagt

SEQ ID NO: 7755111 - DNA, 22 bp, Homo sapiens
cagggccagggctccatttcct

SEQ ID NO: 7755112 - DNA, 22 bp, Homo sapiens
cagggcccagtccctgctgtca

SEQ ID NO: 7755113 - DNA, 22 bp, Homo sapiens
cagggcctcatcctcagagatt

SEQ ID NO: 7755114 - DNA, 22 bp, Homo sapiens
cagggcctcatggccggggtgc

SEQ ID NO: 7755115 - DNA, 20 bp, Homo sapiens
cagggcctaagagctgaaaa

SEQ ID NO: 7755116 - DNA, 20 bp, Homo sapiens
cagggcctatgattgagctt

SEQ ID NO: 7755117 - DNA, 22 bp, Homo sapiens
tagcttcagtggccctagacac

SEQ ID NO: 7755118 - DNA, 22 bp, Homo sapiens
tagcttccagaatttaatgtca

SEQ ID NO: 7755119 - DNA, 22 bp, Homo sapiens
tagcttcatgcttcaccacgct

SEQ ID NO: 7755120 - DNA, 19 bp, Homo sapiens
tagcttcacgtggtctaga

SEQ ID NO: 7755121 - DNA, 22 bp, Homo sapiens
tagcttccctagctaaagaggt

SEQ ID NO: 7755122 - DNA, 22 bp, Homo sapiens
cagggctgagaatttagagaca

SEQ ID NO: 7755123 - DNA, 22 bp, Homo sapiens
cagggctggtttgtcgaagaaa

SEQ ID NO: 7755124 - DNA, 22 bp, Homo sapiens
cagggctgtctccaaaggcccc

SEQ ID NO: 7755125 - DNA, 22 bp, Homo sapiens
taggcttggctttagtttctgt

SEQ ID NO: 7755126 - DNA, 22 bp, Homo sapiens
taggcttgctgcagaatctgcc

SEQ ID NO: 7755127 - DNA, 22 bp, Homo sapiens
cagggctgtggaaaactggtgc

SEQ ID NO: 7755128 - DNA, 22 bp, Homo sapiens
cagggtccatctttcatcactg

SEQ ID NO: 7755129 - DNA, 22 bp, Homo sapiens
cagggtcaggctgctagaagct

SEQ ID NO: 7755130 - DNA, 22 bp, Homo sapiens
cagggtcaccagagatctgcat

SEQ ID NO: 7755131 - DNA, 22 bp, Homo sapiens
caggggtggctgcagcagaggt

SEQ ID NO: 7755132 - DNA, 22 bp, Homo sapiens
caggggtattcaaggtagttta

SEQ ID NO: 7755133 - DNA, 22 bp, Homo sapiens
cagggaagagccgatgctgcag

SEQ ID NO: 7755134 - DNA, 22 bp, Homo sapiens
cagggaacaagatgagaatgga

SEQ ID NO: 7755135 - DNA, 22 bp, Homo sapiens
caggcttggttggggcgaggga

SEQ ID NO: 7755136 - DNA, 22 bp, Homo sapiens
cagggacagacagatatatttg

SEQ ID NO: 7755137 - DNA, 22 bp, Homo sapiens
cagggacagcactaaactcttg

SEQ ID NO: 7755138 - DNA, 22 bp, Homo sapiens
cagggacaaggaataagattag

SEQ ID NO: 7755139 - DNA, 22 bp, Homo sapiens
cagggacaaagtgagaaaggaa

SEQ ID NO: 7755140 - DNA, 22 bp, Homo sapiens
tagaaaatggccaagcaggact

SEQ ID NO: 7755141 - DNA, 22 bp, Homo sapiens
tagaaaatccagtgtggggaga

SEQ ID NO: 7755142 - DNA, 22 bp, Homo sapiens
tagaaaatagggcctgtggagc

SEQ ID NO: 7755143 - DNA, 22 bp, Homo sapiens
tagaaaatgttccactgccatt

SEQ ID NO: 7755144 - DNA, 22 bp, Homo sapiens
caggctgccgtggggtccaggc

SEQ ID NO: 7755145 - DNA, 22 bp, Homo sapiens
caggctgccgtgaagcaggcct

SEQ ID NO: 7755146 - DNA, 22 bp, Homo sapiens
caggctgcagtgcagtggctat

SEQ ID NO: 7755147 - DNA, 22 bp, Homo sapiens
caggctgccaaggctggggagg

SEQ ID NO: 7755148 - DNA, 22 bp, Homo sapiens
caggcctgcaggaaaggctccc

SEQ ID NO: 7755149 - DNA, 22 bp, Homo sapiens
caggcctgatacactgaactct

SEQ ID NO: 7755150 - DNA, 22 bp, Homo sapiens
caggcctgagtgtggaagtctt

SEQ ID NO: 7755151 - DNA, 22 bp, Homo sapiens
caggcctgagacatctgagata

SEQ ID NO: 7755152 - DNA, 22 bp, Homo sapiens
caggcctgaccctgagcttcac

SEQ ID NO: 7755153 - DNA, 22 bp, Homo sapiens
caggcctcttccatgcagcagc

SEQ ID NO: 7755154 - DNA, 22 bp, Homo sapiens
taagtccacaggctgacagcgg

SEQ ID NO: 7755155 - DNA, 22 bp, Homo sapiens
caggcaccacactaggggctga

SEQ ID NO: 7755156 - DNA, 22 bp, Homo sapiens
caggcagagttagagcaactgg

SEQ ID NO: 7755157 - DNA, 22 bp, Homo sapiens
caggcagagctgaagatagatg

SEQ ID NO: 7755158 - DNA, 22 bp, Homo sapiens
caggcagatgctgacaagagtt

SEQ ID NO: 7755159 - DNA, 22 bp, Homo sapiens
taatgtaggggtgtaacacaca

SEQ ID NO: 7755160 - DNA, 22 bp, Homo sapiens
taatatttctaccctgctgcct

SEQ ID NO: 7755161 - DNA, 22 bp, Homo sapiens
caggcatggaaaagcccagagg

SEQ ID NO: 7755162 - DNA, 22 bp, Homo sapiens
caggcatggagaggcagagact

SEQ ID NO: 7755163 - DNA, 22 bp, Homo sapiens
caggcagggagctggaaaggat

SEQ ID NO: 7755164 - DNA, 22 bp, Homo sapiens
caggcatggtgagaactcagcc

SEQ ID NO: 7755165 - DNA, 22 bp, Homo sapiens
cagttctggagtttcattcttt

SEQ ID NO: 7755166 - DNA, 21 bp, Homo sapiens
cagttgatagagatcttgagc

SEQ ID NO: 7755167 - DNA, 22 bp, Homo sapiens
cagttgcctactacatggcagg

SEQ ID NO: 7755168 - DNA, 22 bp, Homo sapiens
tcagagagttggaaagaattaa

SEQ ID NO: 7755169 - DNA, 22 bp, Homo sapiens
tcagagagttagtgtcttagct

SEQ ID NO: 7755170 - DNA, 23 bp, Homo sapiens
cataaaatattagtatggtagca

SEQ ID NO: 7755171 - DNA, 22 bp, Homo sapiens
tcagcaggtgaacatcatgcca

SEQ ID NO: 7755172 - DNA, 21 bp, Homo sapiens
tcaggctgtctgctggttcca

SEQ ID NO: 7755173 - DNA, 22 bp, Homo sapiens
catagaaatcaggtgagaatct

SEQ ID NO: 7755174 - DNA, 19 bp, Homo sapiens
tcagggagtttacagcatg

SEQ ID NO: 7755175 - DNA, 22 bp, Homo sapiens
tcagtccaatgattgtaggaca

SEQ ID NO: 7755176 - DNA, 22 bp, Homo sapiens
tcagtcccttaaaggtggcagc

SEQ ID NO: 7755177 - DNA, 22 bp, Homo sapiens
tcagtccctcgcaccctgccat

SEQ ID NO: 7755178 - DNA, 22 bp, Homo sapiens
tcagtgccagtttgctccttct

SEQ ID NO: 7755179 - DNA, 22 bp, Homo sapiens
catgaacattcagaaatacagc

SEQ ID NO: 7755180 - DNA, 22 bp, Homo sapiens
catgaacaccaggcatgaacaa

SEQ ID NO: 7755181 - DNA, 22 bp, Homo sapiens
catgaacagattcttcatttct

SEQ ID NO: 7755182 - DNA, 22 bp, Homo sapiens
catgaacagctaacattttggg

SEQ ID NO: 7755183 - DNA, 22 bp, Homo sapiens
catgaaaataacattgttgtga

SEQ ID NO: 7755184 - DNA, 22 bp, Homo sapiens
catctgggactgtcaggttagc

SEQ ID NO: 7755185 - DNA, 22 bp, Homo sapiens
catctgctgttccttggactca

SEQ ID NO: 7755186 - DNA, 22 bp, Homo sapiens
catctgatgggaatataagagc

SEQ ID NO: 7755187 - DNA, 22 bp, Homo sapiens
catgaaggctgccagcaggcat

SEQ ID NO: 7755188 - DNA, 22 bp, Homo sapiens
catggaactgtgctgaaaagtg

SEQ ID NO: 7755189 - DNA, 22 bp, Homo sapiens
catggaacttcaagaagaaagc

SEQ ID NO: 7755190 - DNA, 22 bp, Homo sapiens
catggcaggaaggacatgcact

SEQ ID NO: 7755191 - DNA, 22 bp, Homo sapiens
tcctttaactagttaccatgtt

SEQ ID NO: 7755192 - DNA, 22 bp, Homo sapiens
tccttccccctcaagagaactt

SEQ ID NO: 7755193 - DNA, 22 bp, Homo sapiens
tccttcagttaaagatctcaca

SEQ ID NO: 7755194 - DNA, 22 bp, Homo sapiens
tccttcagtgtcccgctcaggt

SEQ ID NO: 7755195 - DNA, 22 bp, Homo sapiens
ccagagaattttagacaaaaat

SEQ ID NO: 7755196 - DNA, 22 bp, Homo sapiens
ccagagaaataaggggaaaatg

SEQ ID NO: 7755197 - DNA, 22 bp, Homo sapiens
tcctgggcttaagtgatcctcc

SEQ ID NO: 7755198 - DNA, 22 bp, Homo sapiens
ccacagaagatggggagagtgg

SEQ ID NO: 7755199 - DNA, 22 bp, Homo sapiens
ccacagaacctcagctttgagc

SEQ ID NO: 7755200 - DNA, 22 bp, Homo sapiens
ccacagaaagttgtctagagta

SEQ ID NO: 7755201 - DNA, 22 bp, Homo sapiens
ccacagaaagcctgggaagtgg

SEQ ID NO: 7755202 - DNA, 22 bp, Homo sapiens
ccacagaaaataaagcacgatt

SEQ ID NO: 7755203 - DNA, 22 bp, Homo sapiens
ccacacagtcagtttccaagaa

SEQ ID NO: 7755204 - DNA, 19 bp, Homo sapiens
ccacacagtgtgcaattta

SEQ ID NO: 7755205 - DNA, 22 bp, Homo sapiens
cattagcaggcactaagaaggt

SEQ ID NO: 7755206 - DNA, 22 bp, Homo sapiens
cattctctgatcttcacatacc

SEQ ID NO: 7755207 - DNA, 22 bp, Homo sapiens
tccattttagaagaaaatccac

SEQ ID NO: 7755208 - DNA, 22 bp, Homo sapiens
tccattttagagatgaagaaac

SEQ ID NO: 7755209 - DNA, 22 bp, Homo sapiens
catgggcagaagtggcatcatt

SEQ ID NO: 7755210 - DNA, 22 bp, Homo sapiens
catgggcagttggcagggctca

SEQ ID NO: 7755211 - DNA, 22 bp, Homo sapiens
catgggccatggtgaagccagg

SEQ ID NO: 7755212 - DNA, 22 bp, Homo sapiens
catgggcccgtgagaggcaggg

SEQ ID NO: 7755213 - DNA, 22 bp, Homo sapiens
tccattttcatctcatgtataa

SEQ ID NO: 7755214 - DNA, 22 bp, Homo sapiens
tccattttctaagtatcactta

SEQ ID NO: 7755215 - DNA, 22 bp, Homo sapiens
tccattttgtaggtatgctaca

SEQ ID NO: 7755216 - DNA, 22 bp, Homo sapiens
tccattttctcttccggaggtg

SEQ ID NO: 7755217 - DNA, 22 bp, Homo sapiens
tccattttcttgctctaggtaa

SEQ ID NO: 7755218 - DNA, 22 bp, Homo sapiens
tccatttttcatgactcctcaa

SEQ ID NO: 7755219 - DNA, 22 bp, Homo sapiens
catttaaaggttgtgggtaaaa

SEQ ID NO: 7755220 - DNA, 22 bp, Homo sapiens
catttacacttctaaccacaag

SEQ ID NO: 7755221 - DNA, 22 bp, Homo sapiens
catttacaatgtacaggttgtg

SEQ ID NO: 7755222 - DNA, 21 bp, Homo sapiens
tccctcagaagctcttggtca

SEQ ID NO: 7755223 - DNA, 22 bp, Homo sapiens
tccctggggtatcgctgaggca

SEQ ID NO: 7755224 - DNA, 22 bp, Homo sapiens
tccctctacagggaagcgcttt

SEQ ID NO: 7755225 - DNA, 22 bp, Homo sapiens
ctctttctggaaggcagagtgg

SEQ ID NO: 7755226 - DNA, 18 bp, Homo sapiens
ctctttctttggcacaaa

SEQ ID NO: 7755227 - DNA, 22 bp, Homo sapiens
ctctttctgattcgctgggacc

SEQ ID NO: 7755228 - DNA, 22 bp, Homo sapiens
ctctttctcgccgcccgcagtc

SEQ ID NO: 7755229 - DNA, 22 bp, Homo sapiens
ctctttctcattgtcagcagaa

SEQ ID NO: 7755230 - DNA, 22 bp, Homo sapiens
ctctttccagggtaccccaggt

SEQ ID NO: 7755231 - DNA, 22 bp, Homo sapiens
ctgaatcatggtcattagttta

SEQ ID NO: 7755232 - DNA, 22 bp, Homo sapiens
ctgaccctagcatctctgtgca

SEQ ID NO: 7755233 - DNA, 22 bp, Homo sapiens
ctgacccttaatgagcaagtaa

SEQ ID NO: 7755234 - DNA, 22 bp, Homo sapiens
ctgaccctggaggcatttctct

SEQ ID NO: 7755235 - DNA, 22 bp, Homo sapiens
ctgaccctttagggtatgttta

SEQ ID NO: 7755236 - DNA, 22 bp, Homo sapiens
ctgagccctggctcgcctggag

SEQ ID NO: 7755237 - DNA, 20 bp, Homo sapiens
ctgagcccttcctgtgaacc

SEQ ID NO: 7755238 - DNA, 22 bp, Homo sapiens
ctgagccctgcctcttgtcact

SEQ ID NO: 7755239 - DNA, 17 bp, Homo sapiens
ctgagccccgggcagct

SEQ ID NO: 7755240 - DNA, 22 bp, Homo sapiens
ctgagccctctgttttccctct

SEQ ID NO: 7755241 - DNA, 22 bp, Homo sapiens
ctgagcccttgcttatgcttcc

SEQ ID NO: 7755242 - DNA, 22 bp, Homo sapiens
ctgagcccttgtcttcctggtc

SEQ ID NO: 7755243 - DNA, 22 bp, Homo sapiens
ctgagcccttgaacccaagtcc

SEQ ID NO: 7755244 - DNA, 20 bp, Homo sapiens
ctgagcccccagcctgcagg

SEQ ID NO: 7755245 - DNA, 22 bp, Homo sapiens
ctgagcccctctgacctcagag

SEQ ID NO: 7755246 - DNA, 22 bp, Homo sapiens
ctgagcccgttgtgaatattcc

SEQ ID NO: 7755247 - DNA, 22 bp, Homo sapiens
ctgagcccgggtgctctacccc

SEQ ID NO: 7755248 - DNA, 22 bp, Homo sapiens
ctgagccctcctgcttgctgag

SEQ ID NO: 7755249 - DNA, 22 bp, Homo sapiens
ctgagccccatctgaggtgccc

SEQ ID NO: 7755250 - DNA, 22 bp, Homo sapiens
ctgagcccattgggtgctgtta

SEQ ID NO: 7755251 - DNA, 20 bp, Homo sapiens
ctgagcccagatcccaggtc

SEQ ID NO: 7755252 - DNA, 22 bp, Homo sapiens
ctgagcccaggcgggagctgag

SEQ ID NO: 7755253 - DNA, 22 bp, Homo sapiens
ctgaggcccctctcttgagctt

SEQ ID NO: 7755254 - DNA, 22 bp, Homo sapiens
ctgcaaaggtgggggaggagct

SEQ ID NO: 7755255 - DNA, 22 bp, Homo sapiens
ctgcaaagctgttcacaaattt

SEQ ID NO: 7755256 - DNA, 22 bp, Homo sapiens
ctgcaggcatttattcatgcaa

SEQ ID NO: 7755257 - DNA, 22 bp, Homo sapiens
ctgcagggagcagatggcgtgt

SEQ ID NO: 7755258 - DNA, 22 bp, Homo sapiens
ctgcaggcccccttcctggagt

SEQ ID NO: 7755259 - DNA, 22 bp, Homo sapiens
ctgcaggccgagctccttctcg

SEQ ID NO: 7755260 - DNA, 22 bp, Homo sapiens
ctgcaccgtgtctcgggctgcc

SEQ ID NO: 7755261 - DNA, 22 bp, Homo sapiens
ctgcaccacagcctgaggcagc

SEQ ID NO: 7755262 - DNA, 22 bp, Homo sapiens
ctgcaggggcctcgagcacagg

SEQ ID NO: 7755263 - DNA, 22 bp, Homo sapiens
ctgcagggcccaaggtcaacgg

SEQ ID NO: 7755264 - DNA, 22 bp, Homo sapiens
ctgcagggcccgcctgagccct

SEQ ID NO: 7755265 - DNA, 22 bp, Homo sapiens
ctgcagggatgtgaggcccgtt

SEQ ID NO: 7755266 - DNA, 19 bp, Homo sapiens
ctgcagggatgtgcagagt

SEQ ID NO: 7755267 - DNA, 22 bp, Homo sapiens
ctcttcaggtttctgctctgga

SEQ ID NO: 7755268 - DNA, 22 bp, Homo sapiens
ctcttcaggaatatgtcagtca

SEQ ID NO: 7755269 - DNA, 22 bp, Homo sapiens
ctcttcaggatggcttgtgatg

SEQ ID NO: 7755270 - DNA, 22 bp, Homo sapiens
ctcttcagtaaatgacactgtt

SEQ ID NO: 7755271 - DNA, 22 bp, Homo sapiens
ctcttcagataaaagggatatt

SEQ ID NO: 7755272 - DNA, 22 bp, Homo sapiens
ctcttcagcaatgctttagtcc

SEQ ID NO: 7755273 - DNA, 22 bp, Homo sapiens
ctcttcagcctatttgagtgca

SEQ ID NO: 7755274 - DNA, 21 bp, Homo sapiens
ctcttcagtggtgagctcttc

SEQ ID NO: 7755275 - DNA, 22 bp, Homo sapiens
ctcttcagttcacccctaagca

SEQ ID NO: 7755276 - DNA, 22 bp, Homo sapiens
ctcttcagttgttgcatattct

SEQ ID NO: 7755277 - DNA, 22 bp, Homo sapiens
ctcttcagttggtcactattct

SEQ ID NO: 7755278 - DNA, 22 bp, Homo sapiens
ctcttcagatatacagtactct

SEQ ID NO: 7755279 - DNA, 22 bp, Homo sapiens
ttttaatactgctattgtagga

SEQ ID NO: 7755280 - DNA, 22 bp, Homo sapiens
tttaatatttctttcctgaagc

SEQ ID NO: 7755281 - DNA, 22 bp, Homo sapiens
tttaatattctgcattctcctt

SEQ ID NO: 7755282 - DNA, 15 bp, Homo sapiens
tttaatatggagtta

SEQ ID NO: 7755283 - DNA, 22 bp, Homo sapiens
tttaatagggcccaatgagact

SEQ ID NO: 7755284 - DNA, 22 bp, Homo sapiens
tttaatatccagtggatacaaa

SEQ ID NO: 7755285 - DNA, 22 bp, Homo sapiens
tttaatatctcacacttccatg

SEQ ID NO: 7755286 - DNA, 22 bp, Homo sapiens
ttgtggggccccaatgttgctg

SEQ ID NO: 7755287 - DNA, 22 bp, Homo sapiens
ctccaaatacagtcatcttggg

SEQ ID NO: 7755288 - DNA, 22 bp, Homo sapiens
ctccaaatacaatattgttgtt

SEQ ID NO: 7755289 - DNA, 22 bp, Homo sapiens
ctccaaatataatcacattgga

SEQ ID NO: 7755290 - DNA, 22 bp, Homo sapiens
ctccaaattcagtcacagtctg

SEQ ID NO: 7755291 - DNA, 23 bp, Homo sapiens
ctccaaatactcccaattgtttt

SEQ ID NO: 7755292 - DNA, 19 bp, Homo sapiens
ctccaaatacttttccctt

SEQ ID NO: 7755293 - DNA, 22 bp, Homo sapiens
ttctttcttagcaatctatggt

SEQ ID NO: 7755294 - DNA, 22 bp, Homo sapiens
ttcttttaatttctgtctgcag

SEQ ID NO: 7755295 - DNA, 20 bp, Homo sapiens
ctccaaattcctgaggataa

SEQ ID NO: 7755296 - DNA, 22 bp, Homo sapiens
tttagtagctacagttagaagg

SEQ ID NO: 7755297 - DNA, 22 bp, Homo sapiens
tttagtagaaatatttgggcct

SEQ ID NO: 7755298 - DNA, 22 bp, Homo sapiens
tttagtatcctatctcatttaa

SEQ ID NO: 7755299 - DNA, 22 bp, Homo sapiens
ctcccctccttaggtcttctag

SEQ ID NO: 7755300 - DNA, 20 bp, Homo sapiens
ctcccctctacagagggctg

SEQ ID NO: 7755301 - DNA, 22 bp, Homo sapiens
ctccctcacaaagcattctctt

SEQ ID NO: 7755302 - DNA, 17 bp, Homo sapiens
ctcctggccacccctct

SEQ ID NO: 7755303 - DNA, 22 bp, Homo sapiens
ctcctcccaattgccaagtgct

SEQ ID NO: 7755304 - DNA, 22 bp, Homo sapiens
tttattctaacttgctgctcta

SEQ ID NO: 7755305 - DNA, 22 bp, Homo sapiens
tttattgttatcatgggtgagt

SEQ ID NO: 7755306 - DNA, 22 bp, Homo sapiens
ctcctggccctgagctcccagg

SEQ ID NO: 7755307 - DNA, 22 bp, Homo sapiens
tttcacaacacaatctcgttaa

SEQ ID NO: 7755308 - DNA, 22 bp, Homo sapiens
tttcacaaatgtctttaacttg

SEQ ID NO: 7755309 - DNA, 22 bp, Homo sapiens
tttcacaaagcatagcacttta

SEQ ID NO: 7755310 - DNA, 22 bp, Homo sapiens
tttcacatacagtgtatagtag

SEQ ID NO: 7755311 - DNA, 22 bp, Homo sapiens
tttcacataaatattatgccta

SEQ ID NO: 7755312 - DNA, 22 bp, Homo sapiens
tttcacataaatggagtaaaga

SEQ ID NO: 7755313 - DNA, 22 bp, Homo sapiens
tttcacatagaaagtgatttac

SEQ ID NO: 7755314 - DNA, 22 bp, Homo sapiens
tggggctgtgagactacaggat

SEQ ID NO: 7755315 - DNA, 22 bp, Homo sapiens
tggggcagccacatagacaaca

SEQ ID NO: 7755316 - DNA, 22 bp, Homo sapiens
cctggtgtctgtttacagcagc

SEQ ID NO: 7755317 - DNA, 20 bp, Homo sapiens
cctgtgctgccctcggggcc

SEQ ID NO: 7755318 - DNA, 22 bp, Homo sapiens
cctgtgggtcacatgggtgact

SEQ ID NO: 7755319 - DNA, 22 bp, Homo sapiens
cctgtgggttttctgtagaaat

SEQ ID NO: 7755320 - DNA, 22 bp, Homo sapiens
cctgtgggttttcaagatgcta

SEQ ID NO: 7755321 - DNA, 22 bp, Homo sapiens
ccttctcagccccagctcccgc

SEQ ID NO: 7755322 - DNA, 19 bp, Homo sapiens
ccttccccttcagcctctg

SEQ ID NO: 7755323 - DNA, 22 bp, Homo sapiens
ccttccccagtgattctctcag

SEQ ID NO: 7755324 - DNA, 19 bp, Homo sapiens
ccttcctccccagggccat

SEQ ID NO: 7755325 - DNA, 17 bp, Homo sapiens
ccttcctcatctccttc

SEQ ID NO: 7755326 - DNA, 22 bp, Homo sapiens
ccttcctcatccatttctcttg

SEQ ID NO: 7755327 - DNA, 22 bp, Homo sapiens
ctattacaattctgcaaggagt

SEQ ID NO: 7755328 - DNA, 22 bp, Homo sapiens
ttctctgggaacataaatgaag

SEQ ID NO: 7755329 - DNA, 22 bp, Homo sapiens
ctagcacagcccattcagtcta

SEQ ID NO: 7755330 - DNA, 19 bp, Homo sapiens
ctattagcttgggcatcat

SEQ ID NO: 7755331 - DNA, 22 bp, Homo sapiens
ctcacagatgatgtctatgtgg

SEQ ID NO: 7755332 - DNA, 22 bp, Homo sapiens
ctcacagatgttctcctttagg

SEQ ID NO: 7755333 - DNA, 22 bp, Homo sapiens
ttcctggctgatctaccaaagt

SEQ ID NO: 7755334 - DNA, 22 bp, Homo sapiens
ttcctggctggcggttttggtg

SEQ ID NO: 7755335 - DNA, 22 bp, Homo sapiens
ttcctggctgaactgaactcct

SEQ ID NO: 7755336 - DNA, 19 bp, Homo sapiens
ttcctggctcttctgtttt

SEQ ID NO: 7755337 - DNA, 22 bp, Homo sapiens
ttcctggctctctgttgcacag

SEQ ID NO: 7755338 - DNA, 20 bp, Homo sapiens
ttcctggctctaggaccttg

SEQ ID NO: 7755339 - DNA, 22 bp, Homo sapiens
ttcctggcttgtcacatctacg

SEQ ID NO: 7755340 - DNA, 22 bp, Homo sapiens
ttcctggcttttgggctaattc

SEQ ID NO: 7755341 - DNA, 22 bp, Homo sapiens
ttcctggcttcatactttgtac

SEQ ID NO: 7755342 - DNA, 22 bp, Homo sapiens
ttcctggctgtcatgccctagt

SEQ ID NO: 7755343 - DNA, 22 bp, Homo sapiens
ctacagtagaggttgtcaggga

SEQ ID NO: 7755344 - DNA, 22 bp, Homo sapiens
ctagaaaaatactttattgtga

SEQ ID NO: 7755345 - DNA, 22 bp, Homo sapiens
ctaccgggttctcagccaggca

SEQ ID NO: 7755346 - DNA, 22 bp, Homo sapiens
ttcacacagaatctgaggagct

SEQ ID NO: 7755347 - DNA, 22 bp, Homo sapiens
ttcacacacagcttcctattgt

SEQ ID NO: 7755348 - DNA, 22 bp, Homo sapiens
ttaggcatgcaagattaagctc

SEQ ID NO: 7755349 - DNA, 22 bp, Homo sapiens
cctttcagatgggcatggaccg

SEQ ID NO: 7755350 - DNA, 19 bp, Homo sapiens
cctttcagaacagaagcca

SEQ ID NO: 7755351 - DNA, 22 bp, Homo sapiens
cctttcaggtacaccagggatg

SEQ ID NO: 7755352 - DNA, 22 bp, Homo sapiens
ttcagggcatgagggacacatc

SEQ ID NO: 7755353 - DNA, 22 bp, Homo sapiens
cgtaggtggctcagcacctggg

SEQ ID NO: 7755354 - DNA, 22 bp, Homo sapiens
cggtggtcataagtggctggcg

SEQ ID NO: 7755355 - DNA, 22 bp, Homo sapiens
ttcatgaaaaggtctatttctt

SEQ ID NO: 7755356 - DNA, 22 bp, Homo sapiens
ctgtggctggcctgtctgacat

SEQ ID NO: 7755357 - DNA, 22 bp, Homo sapiens
ctgtggctctcagaggctgctg

SEQ ID NO: 7755358 - DNA, 22 bp, Homo sapiens
ctgtggctccatagaagttgca

SEQ ID NO: 7755359 - DNA, 20 bp, Homo sapiens
ctgttcctgtcccatgaagc

SEQ ID NO: 7755360 - DNA, 22 bp, Homo sapiens
ctgttcctccacctcaacaaac

SEQ ID NO: 7755361 - DNA, 22 bp, Homo sapiens
ctgttcctctggcatatggaga

SEQ ID NO: 7755362 - DNA, 22 bp, Homo sapiens
ctgttcctgtagagtccaagtc

SEQ ID NO: 7755363 - DNA, 22 bp, Homo sapiens
ctgttgtgaaatgtccatcaac

SEQ ID NO: 7755364 - DNA, 22 bp, Homo sapiens
cttattcttgtcttattgtgct

SEQ ID NO: 7755365 - DNA, 22 bp, Homo sapiens
cttattctactccacaagctct

SEQ ID NO: 7755366 - DNA, 18 bp, Homo sapiens
cttcctcttctggagaaa

SEQ ID NO: 7755367 - DNA, 22 bp, Homo sapiens
cttcagtggtcatttgtgataa

SEQ ID NO: 7755368 - DNA, 22 bp, Homo sapiens
cttcagtgtcctctctagtaga

SEQ ID NO: 7755369 - DNA, 23 bp, Homo sapiens
cttcagtgtgggactgcagcgtg

SEQ ID NO: 7755370 - DNA, 19 bp, Homo sapiens
cttcagtgttcacctggcc

SEQ ID NO: 7755371 - DNA, 22 bp, Homo sapiens
cttcagtgttgccagggcctag

SEQ ID NO: 7755372 - DNA, 22 bp, Homo sapiens
cttccctttttatgtcttcagc

SEQ ID NO: 7755373 - DNA, 22 bp, Homo sapiens
cttcagtgttcccatctgtaaa

SEQ ID NO: 7755374 - DNA, 22 bp, Homo sapiens
cttcagctaggatccctgcagc

SEQ ID NO: 7755375 - DNA, 22 bp, Homo sapiens
cttcagtgacattccttccctc

SEQ ID NO: 7755376 - DNA, 22 bp, Homo sapiens
cttcagtgattgcagaaagcct

SEQ ID NO: 7755377 - DNA, 22 bp, Homo sapiens
cttcagtgatataggcttctcc

SEQ ID NO: 7755378 - DNA, 22 bp, Homo sapiens
cttcagtgcatgtttataatca

SEQ ID NO: 7755379 - DNA, 18 bp, Homo sapiens
cttcagtggctgctctgc

SEQ ID NO: 7755380 - DNA, 18 bp, Homo sapiens
cttcagtgacagtctggc

SEQ ID NO: 7755381 - DNA, 22 bp, Homo sapiens
cttcagtgaatgttgagtaagg

SEQ ID NO: 7755382 - DNA, 22 bp, Homo sapiens
cttcagtgacagccacccaggc

SEQ ID NO: 7755383 - DNA, 22 bp, Homo sapiens
cttgtagacccctggactcacg

SEQ ID NO: 7755384 - DNA, 22 bp, Homo sapiens
ctggcctgtcctgacccagcct

SEQ ID NO: 7755385 - DNA, 22 bp, Homo sapiens
ctgggctgcatcaaagaggcat

SEQ ID NO: 7755386 - DNA, 22 bp, Homo sapiens
ctgggctgcaggagtggggcaa

SEQ ID NO: 7755387 - DNA, 22 bp, Homo sapiens
ctgggctgctcagccccctcgc

SEQ ID NO: 7755388 - DNA, 22 bp, Homo sapiens
ctgggctgcggttctctgaagc

SEQ ID NO: 7755389 - DNA, 22 bp, Homo sapiens
ctgggctgcgggcgcccctcca

SEQ ID NO: 7755390 - DNA, 23 bp, Homo sapiens
ctgggctgcttgagtccctggct

SEQ ID NO: 7755391 - DNA, 22 bp, Homo sapiens
ctggggctctctggaatgcttg

SEQ ID NO: 7755392 - DNA, 22 bp, Homo sapiens
ctggggctgcggacgggagccc

SEQ ID NO: 7755393 - DNA, 22 bp, Homo sapiens
ctggggtgtgctcagagcaggg

SEQ ID NO: 7755394 - DNA, 22 bp, Homo sapiens
ctgggccaaaagaagtgttctt

SEQ ID NO: 7755395 - DNA, 23 bp, Homo sapiens
ctgggcatggagcttcagaggct

SEQ ID NO: 7755396 - DNA, 22 bp, Homo sapiens
ctgggcatgaaaaggatgccag

SEQ ID NO: 7755397 - DNA, 22 bp, Homo sapiens
ctgggcatggacagctgcacag

SEQ ID NO: 7755398 - DNA, 22 bp, Homo sapiens
gagccacagtggattgattcca

SEQ ID NO: 7755399 - DNA, 22 bp, Homo sapiens
gagccacagactgtatttggga

SEQ ID NO: 7755400 - DNA, 22 bp, Homo sapiens
gagcagctgttctgacttgtct

SEQ ID NO: 7755401 - DNA, 22 bp, Homo sapiens
gagccagagatccaggatggct

SEQ ID NO: 7755402 - DNA, 22 bp, Homo sapiens
gagccagggctgtgagctgagc

SEQ ID NO: 7755403 - DNA, 22 bp, Homo sapiens
gagccagggtttgaaactagac

SEQ ID NO: 7755404 - DNA, 22 bp, Homo sapiens
gagccaggtcgggccgcggcga

SEQ ID NO: 7755405 - DNA, 22 bp, Homo sapiens
gagccaggttggaggctgcagt

SEQ ID NO: 7755406 - DNA, 22 bp, Homo sapiens
gagaagggcttgggagtcaaca

SEQ ID NO: 7755407 - DNA, 22 bp, Homo sapiens
gagaagggatatggcttcttga

SEQ ID NO: 7755408 - DNA, 22 bp, Homo sapiens
gagaagggatatgccactctcg

SEQ ID NO: 7755409 - DNA, 22 bp, Homo sapiens
gagaagggggctcgagtgtcct

SEQ ID NO: 7755410 - DNA, 18 bp, Homo sapiens
gagaaggccacttgtttt

SEQ ID NO: 7755411 - DNA, 22 bp, Homo sapiens
gagaaggccaggaacccagtgt

SEQ ID NO: 7755412 - DNA, 22 bp, Homo sapiens
gagaaggctgatccttggagtt

SEQ ID NO: 7755413 - DNA, 22 bp, Homo sapiens
gagaaggctggtcttaagtcga

SEQ ID NO: 7755414 - DNA, 22 bp, Homo sapiens
gagaaggcttccaaattctgtg

SEQ ID NO: 7755415 - DNA, 22 bp, Homo sapiens
gagaaggcttcttttcctctga

SEQ ID NO: 7755416 - DNA, 22 bp, Homo sapiens
gagaggcttaagggctgtgaag

SEQ ID NO: 7755417 - DNA, 22 bp, Homo sapiens
gagaggctggtaaagtctgaac

SEQ ID NO: 7755418 - DNA, 22 bp, Homo sapiens
gagaggctgggttggagatcga

SEQ ID NO: 7755419 - DNA, 22 bp, Homo sapiens
gagacacaaacacatttagagg

SEQ ID NO: 7755420 - DNA, 22 bp, Homo sapiens
gagacacaaacatttattccac

SEQ ID NO: 7755421 - DNA, 22 bp, Homo sapiens
gaggaggaagttctctgtaggc

SEQ ID NO: 7755422 - DNA, 22 bp, Homo sapiens
gaggcagaagttgcagtgagca

SEQ ID NO: 7755423 - DNA, 22 bp, Homo sapiens
gaggcagagaccttcaggacct

SEQ ID NO: 7755424 - DNA, 22 bp, Homo sapiens
gaggcacatcacttggtgcatt

SEQ ID NO: 7755425 - DNA, 22 bp, Homo sapiens
gaggcacaatacatgtctcaag

SEQ ID NO: 7755426 - DNA, 22 bp, Homo sapiens
gaggcacatgactcaccaatgg

SEQ ID NO: 7755427 - DNA, 23 bp, Homo sapiens
gaggcactcaggaaatgtgagtg

SEQ ID NO: 7755428 - DNA, 22 bp, Homo sapiens
gaggcactgaccattttcatat

SEQ ID NO: 7755429 - DNA, 22 bp, Homo sapiens
gaggccaggaagcccaagatca

SEQ ID NO: 7755430 - DNA, 22 bp, Homo sapiens
gaggcagaggttgcagtgagct

SEQ ID NO: 7755431 - DNA, 22 bp, Homo sapiens
gaggcagaggaaggtggtctct

SEQ ID NO: 7755432 - DNA, 22 bp, Homo sapiens
gagcctggacatctcaggccca

SEQ ID NO: 7755433 - DNA, 22 bp, Homo sapiens
gagcctgcctctagtctctaga

SEQ ID NO: 7755434 - DNA, 22 bp, Homo sapiens
gagcctgcccctccaccaggat

SEQ ID NO: 7755435 - DNA, 22 bp, Homo sapiens
gagcctgcagctttcacagcat

SEQ ID NO: 7755436 - DNA, 22 bp, Homo sapiens
gagcctggagctggaacgaagc

SEQ ID NO: 7755437 - DNA, 22 bp, Homo sapiens
gagccaggtttgaatctcagtc

SEQ ID NO: 7755438 - DNA, 22 bp, Homo sapiens
gagctcttctggggtaagggac

SEQ ID NO: 7755439 - DNA, 20 bp, Homo sapiens
gagcttcaactcagcaaaca

SEQ ID NO: 7755440 - DNA, 22 bp, Homo sapiens
gagcttcagagaccacttaact

SEQ ID NO: 7755441 - DNA, 22 bp, Homo sapiens
gagcttcagaatttaacagact

SEQ ID NO: 7755442 - DNA, 22 bp, Homo sapiens
gagcttcacgggggacagcatt

SEQ ID NO: 7755443 - DNA, 22 bp, Homo sapiens
gaagacacctactgtcatttct

SEQ ID NO: 7755444 - DNA, 22 bp, Homo sapiens
gaagaccactgtgaaatgccat

SEQ ID NO: 7755445 - DNA, 22 bp, Homo sapiens
gaagagctatgtccagggagca

SEQ ID NO: 7755446 - DNA, 22 bp, Homo sapiens
gaagatttaagcacaatagtct

SEQ ID NO: 7755447 - DNA, 20 bp, Homo sapiens
gaagatgggtagaggcacag

SEQ ID NO: 7755448 - DNA, 22 bp, Homo sapiens
gaagatttgaaacacatagaca

SEQ ID NO: 7755449 - DNA, 22 bp, Homo sapiens
gaagatttggattccatgtcac

SEQ ID NO: 7755450 - DNA, 22 bp, Homo sapiens
gaagccaggggcctgacaggca

SEQ ID NO: 7755451 - DNA, 22 bp, Homo sapiens
gaagccagccttgtctgcctct

SEQ ID NO: 7755452 - DNA, 22 bp, Homo sapiens
gaagccagtactgtgctctgca

SEQ ID NO: 7755453 - DNA, 22 bp, Homo sapiens
gaaatatttctcttgagcccct

SEQ ID NO: 7755454 - DNA, 18 bp, Homo sapiens
ctttatgtgcagagcttt

SEQ ID NO: 7755455 - DNA, 22 bp, Homo sapiens
ctttcagaagaggacctttcca

SEQ ID NO: 7755456 - DNA, 22 bp, Homo sapiens
ctttcagatagtctgagatata

SEQ ID NO: 7755457 - DNA, 22 bp, Homo sapiens
ctttcagaggttactcaggaaa

SEQ ID NO: 7755458 - DNA, 22 bp, Homo sapiens
ctttcagaagccggaagggcag

SEQ ID NO: 7755459 - DNA, 22 bp, Homo sapiens
ctttcagaggggcgtacacagc

SEQ ID NO: 7755460 - DNA, 22 bp, Homo sapiens
ctttcagaagtatattctggaa

SEQ ID NO: 7755461 - DNA, 18 bp, Homo sapiens
ctttcagatggatatgct

SEQ ID NO: 7755462 - DNA, 22 bp, Homo sapiens
gaacagctataatcatctgtcc

SEQ ID NO: 7755463 - DNA, 22 bp, Homo sapiens
gaacagcatgtaagaagctact

SEQ ID NO: 7755464 - DNA, 22 bp, Homo sapiens
gaacagcagtcactcatgttat

SEQ ID NO: 7755465 - DNA, 22 bp, Homo sapiens
gaaatgctcaggggttttccag

SEQ ID NO: 7755466 - DNA, 22 bp, Homo sapiens
gaaatgattttagtttatcatg

SEQ ID NO: 7755467 - DNA, 22 bp, Homo sapiens
gaccctggggaccatctagccc

SEQ ID NO: 7755468 - DNA, 22 bp, Homo sapiens
gaccctgggatgcttgttttac

SEQ ID NO: 7755469 - DNA, 22 bp, Homo sapiens
gaccctggctggagctggcctg

SEQ ID NO: 7755470 - DNA, 22 bp, Homo sapiens
gaccctggtgggcactggcacc

SEQ ID NO: 7755471 - DNA, 22 bp, Homo sapiens
gaccctggtgtccaggtcctgc

SEQ ID NO: 7755472 - DNA, 22 bp, Homo sapiens
gacagtcccccagcagcaaacc

SEQ ID NO: 7755473 - DNA, 22 bp, Homo sapiens
gaccctggcaggtagcctcaca

SEQ ID NO: 7755474 - DNA, 22 bp, Homo sapiens
gaccctggctgccgcggtctgg

SEQ ID NO: 7755475 - DNA, 22 bp, Homo sapiens
gaccctggctagggcttaacct

SEQ ID NO: 7755476 - DNA, 22 bp, Homo sapiens
gacacagaaggtcacatgttca

SEQ ID NO: 7755477 - DNA, 22 bp, Homo sapiens
gacacagaatgggtgctcagta

SEQ ID NO: 7755478 - DNA, 22 bp, Homo sapiens
gacaaggttagggagtgcttag

SEQ ID NO: 7755479 - DNA, 22 bp, Homo sapiens
gacacagagacttgcagttgta

SEQ ID NO: 7755480 - DNA, 22 bp, Homo sapiens
gacacagaccaccaggccctgg

SEQ ID NO: 7755481 - DNA, 22 bp, Homo sapiens
gacacagacagttagaggtaat

SEQ ID NO: 7755482 - DNA, 22 bp, Homo sapiens
gacacagaattcccctccaagt

SEQ ID NO: 7755483 - DNA, 22 bp, Homo sapiens
gacacagaatttactcccgata

SEQ ID NO: 7755484 - DNA, 22 bp, Homo sapiens
gacacagagataggcctgtgtt

SEQ ID NO: 7755485 - DNA, 22 bp, Homo sapiens
gacaggcttcctaagtgccaga

SEQ ID NO: 7755486 - DNA, 22 bp, Homo sapiens
gacaggctttctcaggatgagc

SEQ ID NO: 7755487 - DNA, 22 bp, Homo sapiens
gacaggcttcatcctcagagtt

SEQ ID NO: 7755488 - DNA, 22 bp, Homo sapiens
gacaggcttcatgatggcagga

SEQ ID NO: 7755489 - DNA, 22 bp, Homo sapiens
gacaggcttagggagggtgctc

SEQ ID NO: 7755490 - DNA, 17 bp, Homo sapiens
gacaggctcagtgacga

SEQ ID NO: 7755491 - DNA, 22 bp, Homo sapiens
gacagggctgtgggaggagcag

SEQ ID NO: 7755492 - DNA, 22 bp, Homo sapiens
gaagcttcgtggctcttcaaat

SEQ ID NO: 7755493 - DNA, 22 bp, Homo sapiens
gaatatatttctcttaccttta

SEQ ID NO: 7755494 - DNA, 22 bp, Homo sapiens
gaatatatttctcttaccttta

SEQ ID NO: 7755495 - DNA, 22 bp, Homo sapiens
gaatagatcctcatttattgat

SEQ ID NO: 7755496 - DNA, 22 bp, Homo sapiens
ggcctgagtcccacctggctgt

SEQ ID NO: 7755497 - DNA, 21 bp, Homo sapiens
ggcctgagtataggacaggcc

SEQ ID NO: 7755498 - DNA, 22 bp, Homo sapiens
ggcctgagtcacatcaggagag

SEQ ID NO: 7755499 - DNA, 17 bp, Homo sapiens
ggcctgcacctcctgct

SEQ ID NO: 7755500 - DNA, 20 bp, Homo sapiens
ggcctgcagctcccagcaag

SEQ ID NO: 7755501 - DNA, 22 bp, Homo sapiens
ggcctgcacagaggtggctcta

SEQ ID NO: 7755502 - DNA, 17 bp, Homo sapiens
ggcctgcaagaacgaga

SEQ ID NO: 7755503 - DNA, 18 bp, Homo sapiens
ggcctgcagtgaagcaag

SEQ ID NO: 7755504 - DNA, 22 bp, Homo sapiens
ggcctgagaaccatggggccaa

SEQ ID NO: 7755505 - DNA, 22 bp, Homo sapiens
ggcctgagaatgtaccagatct

SEQ ID NO: 7755506 - DNA, 21 bp, Homo sapiens
ggcctgagcacctgtccacct

SEQ ID NO: 7755507 - DNA, 17 bp, Homo sapiens
ggccttgggctgctctt

SEQ ID NO: 7755508 - DNA, 22 bp, Homo sapiens
ggccttggtaaagggatgcatg

SEQ ID NO: 7755509 - DNA, 22 bp, Homo sapiens
ggccttttgtgtccttgcccgt

SEQ ID NO: 7755510 - DNA, 22 bp, Homo sapiens
ggcctcagtttctccatgggtt

SEQ ID NO: 7755511 - DNA, 22 bp, Homo sapiens
ggcctcagtgggccgctgcagg

SEQ ID NO: 7755512 - DNA, 22 bp, Homo sapiens
ggcctctgttctgcattcctcc

SEQ ID NO: 7755513 - DNA, 22 bp, Homo sapiens
ggcctcagggttgggcccatta

SEQ ID NO: 7755514 - DNA, 22 bp, Homo sapiens
ggcctcagaggaggtgtgagtc

SEQ ID NO: 7755515 - DNA, 22 bp, Homo sapiens
ggcctcagagaaggctgtgcgg

SEQ ID NO: 7755516 - DNA, 19 bp, Homo sapiens
ggccatggcgggggtcaca

SEQ ID NO: 7755517 - DNA, 22 bp, Homo sapiens
ggcatggacgtctctgaggcca

SEQ ID NO: 7755518 - DNA, 22 bp, Homo sapiens
ggcaggtggaagttggcagagc

SEQ ID NO: 7755519 - DNA, 22 bp, Homo sapiens
ggcaggcagaggctgagacagg

SEQ ID NO: 7755520 - DNA, 22 bp, Homo sapiens
ggcatgtttcatcacatcaaga

SEQ ID NO: 7755521 - DNA, 22 bp, Homo sapiens
ggccaggtccagtggaaggccc

SEQ ID NO: 7755522 - DNA, 22 bp, Homo sapiens
ggcagaggaaggatgaattcac

SEQ ID NO: 7755523 - DNA, 22 bp, Homo sapiens
ggcagaggagctggaaacatgg

SEQ ID NO: 7755524 - DNA, 20 bp, Homo sapiens
ggcagagggcctgggagaag

SEQ ID NO: 7755525 - DNA, 22 bp, Homo sapiens
ggcagaggtagctggaaccagg

SEQ ID NO: 7755526 - DNA, 22 bp, Homo sapiens
ggcaggaggtgagtggcgggtg

SEQ ID NO: 7755527 - DNA, 22 bp, Homo sapiens
ggcaggagggcggacaatgacc

SEQ ID NO: 7755528 - DNA, 22 bp, Homo sapiens
ggcaggcaacggaccactagtc

SEQ ID NO: 7755529 - DNA, 22 bp, Homo sapiens
ggcaggcaaggcagcctggtga

SEQ ID NO: 7755530 - DNA, 22 bp, Homo sapiens
ggcaggcaagtctgctctgtga

SEQ ID NO: 7755531 - DNA, 22 bp, Homo sapiens
ggcaggcaatgaggatgggaag

SEQ ID NO: 7755532 - DNA, 22 bp, Homo sapiens
ggcaggcactgtgttttgtgtt

SEQ ID NO: 7755533 - DNA, 22 bp, Homo sapiens
ggcaggcactgtgctaggcgct

SEQ ID NO: 7755534 - DNA, 22 bp, Homo sapiens
ggcaggcaccagctcagcaata

SEQ ID NO: 7755535 - DNA, 22 bp, Homo sapiens
ggcaaaggaaaacgtctcagct

SEQ ID NO: 7755536 - DNA, 22 bp, Homo sapiens
ggcaaactacatttttgaaata

SEQ ID NO: 7755537 - DNA, 22 bp, Homo sapiens
ggagtgcaggtagcacaggaaa

SEQ ID NO: 7755538 - DNA, 23 bp, Homo sapiens
ggagtgcaatggcgccatctcgg

SEQ ID NO: 7755539 - DNA, 22 bp, Homo sapiens
ggagtcagaggaaggcttgctc

SEQ ID NO: 7755540 - DNA, 22 bp, Homo sapiens
ggagtcagaacccaggcttcta

SEQ ID NO: 7755541 - DNA, 17 bp, Homo sapiens
ggagccaggagcccacc

SEQ ID NO: 7755542 - DNA, 23 bp, Homo sapiens
ggagccagcctgtggggagcggg

SEQ ID NO: 7755543 - DNA, 22 bp, Homo sapiens
ggagccagagtttaatgtggag

SEQ ID NO: 7755544 - DNA, 22 bp, Homo sapiens
gggagagaattattgccagacc

SEQ ID NO: 7755545 - DNA, 22 bp, Homo sapiens
gggagactagtgctatgttttc

SEQ ID NO: 7755546 - DNA, 22 bp, Homo sapiens
gggagaggttacccgagcaact

SEQ ID NO: 7755547 - DNA, 22 bp, Homo sapiens
gggagctggcggattccccagg

SEQ ID NO: 7755548 - DNA, 18 bp, Homo sapiens
gggagctgggaagctggt

SEQ ID NO: 7755549 - DNA, 22 bp, Homo sapiens
gggagctgggctggttttgctg

SEQ ID NO: 7755550 - DNA, 22 bp, Homo sapiens
gggagctggggcatttataccc

SEQ ID NO: 7755551 - DNA, 22 bp, Homo sapiens
gggagctggttcctgccctcca

SEQ ID NO: 7755552 - DNA, 22 bp, Homo sapiens
gggagctgtagtccagataccg

SEQ ID NO: 7755553 - DNA, 22 bp, Homo sapiens
gggagctgtaagggacaggtag

SEQ ID NO: 7755554 - DNA, 19 bp, Homo sapiens
gggagctgtctgcccgtgg

SEQ ID NO: 7755555 - DNA, 22 bp, Homo sapiens
gggagctgtcatcagtgttgtc

SEQ ID NO: 7755556 - DNA, 22 bp, Homo sapiens
ggcttgggagcaggcatgtgac

SEQ ID NO: 7755557 - DNA, 22 bp, Homo sapiens
ggcttggcttgggctcagaggc

SEQ ID NO: 7755558 - DNA, 20 bp, Homo sapiens
ggcttggctgcctggggagg

SEQ ID NO: 7755559 - DNA, 22 bp, Homo sapiens
ggctttaaacactgaaattgca

SEQ ID NO: 7755560 - DNA, 22 bp, Homo sapiens
ggctttaacaacagaaatttat

SEQ ID NO: 7755561 - DNA, 16 bp, Homo sapiens
ggctttaatttatccc

SEQ ID NO: 7755562 - DNA, 22 bp, Homo sapiens
ggctttaatagataaggtttct

SEQ ID NO: 7755563 - DNA, 17 bp, Homo sapiens
ggctttagggacaccac

SEQ ID NO: 7755564 - DNA, 22 bp, Homo sapiens
gggacatgcccctcagtgggtg

SEQ ID NO: 7755565 - DNA, 22 bp, Homo sapiens
gggaggaaagagaagtggtcca

SEQ ID NO: 7755566 - DNA, 23 bp, Homo sapiens
gggagctgtggtgaaaagaggtg

SEQ ID NO: 7755567 - DNA, 22 bp, Homo sapiens
gggagctgtgggattggttgag

SEQ ID NO: 7755568 - DNA, 22 bp, Homo sapiens
gggaggaaggcttgggtgagta

SEQ ID NO: 7755569 - DNA, 22 bp, Homo sapiens
gggatggggtcgggaccctgct

SEQ ID NO: 7755570 - DNA, 22 bp, Homo sapiens
gggatgtcgtgggtggcagctg

SEQ ID NO: 7755571 - DNA, 22 bp, Homo sapiens
gggattcatcaactgttttaca

SEQ ID NO: 7755572 - DNA, 22 bp, Homo sapiens
gggcaggatgcagtttcagaga

SEQ ID NO: 7755573 - DNA, 18 bp, Homo sapiens
gggcatggatgcagcatc

SEQ ID NO: 7755574 - DNA, 22 bp, Homo sapiens
ggctctggagacatgtggagag

SEQ ID NO: 7755575 - DNA, 22 bp, Homo sapiens
ggctgggctccgggagcatgcg

SEQ ID NO: 7755576 - DNA, 22 bp, Homo sapiens
ggctgggcaggtctgcacaggg

SEQ ID NO: 7755577 - DNA, 22 bp, Homo sapiens
ggctgggcatccatccatgaga

SEQ ID NO: 7755578 - DNA, 22 bp, Homo sapiens
ggcttctggtgggagcatgact

SEQ ID NO: 7755579 - DNA, 22 bp, Homo sapiens
ggggctgaacctggaggtggtc

SEQ ID NO: 7755580 - DNA, 22 bp, Homo sapiens
ggggctgacgggcatgtggctt

SEQ ID NO: 7755581 - DNA, 22 bp, Homo sapiens
ggggctgagtcagtgggaagag

SEQ ID NO: 7755582 - DNA, 20 bp, Homo sapiens
ggggctgcatgcagagaaga

SEQ ID NO: 7755583 - DNA, 22 bp, Homo sapiens
ggggaagatttttaattagtaa

SEQ ID NO: 7755584 - DNA, 22 bp, Homo sapiens
gggtagtgtggtctctgggctg

SEQ ID NO: 7755585 - DNA, 22 bp, Homo sapiens
gggctgagagctggaatctgag

SEQ ID NO: 7755586 - DNA, 22 bp, Homo sapiens
gggctgagagtgactgttctgt

SEQ ID NO: 7755587 - DNA, 22 bp, Homo sapiens
gggctgagctaagctgggttga

SEQ ID NO: 7755588 - DNA, 22 bp, Homo sapiens
gggctgagctgttctgagttta

SEQ ID NO: 7755589 - DNA, 22 bp, Homo sapiens
gggctgagttcctgcctcactc

SEQ ID NO: 7755590 - DNA, 22 bp, Homo sapiens
gggctgagtgtcccaggccgaa

SEQ ID NO: 7755591 - DNA, 22 bp, Homo sapiens
gggctgaggctaccactggtct

SEQ ID NO: 7755592 - DNA, 22 bp, Homo sapiens
gggctgcatcagcaggacccgg

SEQ ID NO: 7755593 - DNA, 22 bp, Homo sapiens
gggcttgctaagaagagcgcat

SEQ ID NO: 7755594 - DNA, 22 bp, Homo sapiens
ggtctctgaagcttttagtccc

SEQ ID NO: 7755595 - DNA, 22 bp, Homo sapiens
ggtccctggttccctctgagct

SEQ ID NO: 7755596 - DNA, 22 bp, Homo sapiens
ggtccctgggtcttcttacgtc

SEQ ID NO: 7755597 - DNA, 22 bp, Homo sapiens
ggtccctggaagtccctcttct

SEQ ID NO: 7755598 - DNA, 22 bp, Homo sapiens
ggtccctggggaactaggctgt

SEQ ID NO: 7755599 - DNA, 19 bp, Homo sapiens
ggtcagagagatccaggct

SEQ ID NO: 7755600 - DNA, 22 bp, Homo sapiens
ggtcacattctgaggaatcagg

SEQ ID NO: 7755601 - DNA, 22 bp, Homo sapiens
ggtaggggaagacaagtgaaaa

SEQ ID NO: 7755602 - DNA, 22 bp, Homo sapiens
ggtaggggcagggccaagctgt

SEQ ID NO: 7755603 - DNA, 22 bp, Homo sapiens
ggtctggaccatggacgccggg

SEQ ID NO: 7755604 - DNA, 22 bp, Homo sapiens
ggtttattgaaggccaccccac

SEQ ID NO: 7755605 - DNA, 22 bp, Homo sapiens
ggtttattgttaataagtttga

SEQ ID NO: 7755606 - DNA, 22 bp, Homo sapiens
ggtttattaatgtgaactgtat

SEQ ID NO: 7755607 - DNA, 22 bp, Homo sapiens
ggtgtgggggcagctctgatat

SEQ ID NO: 7755608 - DNA, 22 bp, Homo sapiens
gtgcagagtgtctgtggactga

SEQ ID NO: 7755609 - DNA, 20 bp, Homo sapiens
gtgcagaggcagcctgtggg

SEQ ID NO: 7755610 - DNA, 22 bp, Homo sapiens
gtgcagagcaagggctgagggc

SEQ ID NO: 7755611 - DNA, 22 bp, Homo sapiens
gtgagacatcttgggaagtgat

SEQ ID NO: 7755612 - DNA, 22 bp, Homo sapiens
gtgagcagctcagggtggtctc

SEQ ID NO: 7755613 - DNA, 22 bp, Homo sapiens
gtgcacatcgtgcaggtttgtt

SEQ ID NO: 7755614 - DNA, 22 bp, Homo sapiens
gtgcagagaaatgagaagtcga

SEQ ID NO: 7755615 - DNA, 22 bp, Homo sapiens
gtgcagagaaggagcagtagtt

SEQ ID NO: 7755616 - DNA, 22 bp, Homo sapiens
gtccaaatttttcacatgtaga

SEQ ID NO: 7755617 - DNA, 22 bp, Homo sapiens
gtccaaataagttgcaaaatag

SEQ ID NO: 7755618 - DNA, 22 bp, Homo sapiens
gtccaaattccacagatttctc

SEQ ID NO: 7755619 - DNA, 22 bp, Homo sapiens
gtatttcagttcctcttgtgac

SEQ ID NO: 7755620 - DNA, 22 bp, Homo sapiens
gtccctctgtgtccctgcagtc

SEQ ID NO: 7755621 - DNA, 22 bp, Homo sapiens
gtccctcagtagtgcacagtgg

SEQ ID NO: 7755622 - DNA, 22 bp, Homo sapiens
ggttttaactacagaattgcaa

SEQ ID NO: 7755623 - DNA, 22 bp, Homo sapiens
ggttttaactacagaattgcaa

SEQ ID NO: 7755624 - DNA, 22 bp, Homo sapiens
gtattagcaagagttgtgattt

SEQ ID NO: 7755625 - DNA, 22 bp, Homo sapiens
gtattagctgttagctacatca

SEQ ID NO: 7755626 - DNA, 22 bp, Homo sapiens
gtattagctgccttggagctaa

SEQ ID NO: 7755627 - DNA, 22 bp, Homo sapiens
gcaggaacttgggtgaagtcag

SEQ ID NO: 7755628 - DNA, 22 bp, Homo sapiens
gcaggaacttgcaaaatgagca

SEQ ID NO: 7755629 - DNA, 22 bp, Homo sapiens
gcaggaactggagctggatgtt

SEQ ID NO: 7755630 - DNA, 23 bp, Homo sapiens
gcaggaactcagggtaggcagca

SEQ ID NO: 7755631 - DNA, 22 bp, Homo sapiens
gcaggaacctggtaagcttcac

SEQ ID NO: 7755632 - DNA, 21 bp, Homo sapiens
gcaggaacaggtcatgatctg

SEQ ID NO: 7755633 - DNA, 22 bp, Homo sapiens
gcaggaacagggcttcaagctt

SEQ ID NO: 7755634 - DNA, 22 bp, Homo sapiens
gcaggaacccagacaaccaggg

SEQ ID NO: 7755635 - DNA, 22 bp, Homo sapiens
gcaggaaccactgcccccctgt

SEQ ID NO: 7755636 - DNA, 22 bp, Homo sapiens
gcaggaacagtttatctctggc

SEQ ID NO: 7755637 - DNA, 22 bp, Homo sapiens
gcaggaaccccgggaggctggc

SEQ ID NO: 7755638 - DNA, 22 bp, Homo sapiens
gcaggaacccggccgccctggc

SEQ ID NO: 7755639 - DNA, 22 bp, Homo sapiens
gcaggaagatgagctcaggtaa

SEQ ID NO: 7755640 - DNA, 22 bp, Homo sapiens
gcaggacacagatgcaaggcca

SEQ ID NO: 7755641 - DNA, 22 bp, Homo sapiens
gcagcctccgcactgcgagtcc

SEQ ID NO: 7755642 - DNA, 22 bp, Homo sapiens
gcagggaagatcttggagctgc

SEQ ID NO: 7755643 - DNA, 22 bp, Homo sapiens
gcaggacagacccaagcagtct

SEQ ID NO: 7755644 - DNA, 22 bp, Homo sapiens
gcagaggcacagccccagatga

SEQ ID NO: 7755645 - DNA, 22 bp, Homo sapiens
gcagaggatcaggctctggaaa

SEQ ID NO: 7755646 - DNA, 21 bp, Homo sapiens
gcagaggcacggcaccaaggg

SEQ ID NO: 7755647 - DNA, 22 bp, Homo sapiens
gcagagcagtactctcttgact

SEQ ID NO: 7755648 - DNA, 22 bp, Homo sapiens
gcagagcaggaaggaagtcagg

SEQ ID NO: 7755649 - DNA, 18 bp, Homo sapiens
gcagagcagaagctcaag

SEQ ID NO: 7755650 - DNA, 22 bp, Homo sapiens
gcagagcagaggtgcaggttgg

SEQ ID NO: 7755651 - DNA, 22 bp, Homo sapiens
gcagagcagagcctgcattggc

SEQ ID NO: 7755652 - DNA, 22 bp, Homo sapiens
gcacagttctctcagtctccag

SEQ ID NO: 7755653 - DNA, 22 bp, Homo sapiens
gcacagttgacaatgattaaga

SEQ ID NO: 7755654 - DNA, 22 bp, Homo sapiens
gcacagttgccattagccacat

SEQ ID NO: 7755655 - DNA, 22 bp, Homo sapiens
gcagagaaggattgaaaccaga

SEQ ID NO: 7755656 - DNA, 22 bp, Homo sapiens
gcagagaacccagcagattggc

SEQ ID NO: 7755657 - DNA, 22 bp, Homo sapiens
gcagagaagatgcccaggcttc

SEQ ID NO: 7755658 - DNA, 22 bp, Homo sapiens
gcacagaaatgtctacacatgt

SEQ ID NO: 7755659 - DNA, 22 bp, Homo sapiens
gcacagaacactggtgagtccc

SEQ ID NO: 7755660 - DNA, 22 bp, Homo sapiens
gcacagaacagagaaatagcca

SEQ ID NO: 7755661 - DNA, 22 bp, Homo sapiens
gcacagaaccagacatgaggca

SEQ ID NO: 7755662 - DNA, 22 bp, Homo sapiens
gcacaccttagaggggagctgc

SEQ ID NO: 7755663 - DNA, 19 bp, Homo sapiens
gcacacgttgtgcttgagc

SEQ ID NO: 7755664 - DNA, 22 bp, Homo sapiens
gcacacgtagaagaacttgact

SEQ ID NO: 7755665 - DNA, 22 bp, Homo sapiens
gcacaggtcaggagatgagatt

SEQ ID NO: 7755666 - DNA, 22 bp, Homo sapiens
gcacaggttgtacttgggcacc

SEQ ID NO: 7755667 - DNA, 22 bp, Homo sapiens
gcacaggtaatccgaatcattc

SEQ ID NO: 7755668 - DNA, 22 bp, Homo sapiens
gcacacagaatcagtgggcata

SEQ ID NO: 7755669 - DNA, 22 bp, Homo sapiens
gcacacagaacatttggatcct

SEQ ID NO: 7755670 - DNA, 19 bp, Homo sapiens
gcacacagtagggctggca

SEQ ID NO: 7755671 - DNA, 22 bp, Homo sapiens
gcacacagtactatatgctaca

SEQ ID NO: 7755672 - DNA, 22 bp, Homo sapiens
gcacacagtagggattcaatga

SEQ ID NO: 7755673 - DNA, 22 bp, Homo sapiens
gcacacagtatatgctcattaa

SEQ ID NO: 7755674 - DNA, 22 bp, Homo sapiens
gaggcccacagggagtaccaag

SEQ ID NO: 7755675 - DNA, 22 bp, Homo sapiens
gaggcccagagaggttgcatga

SEQ ID NO: 7755676 - DNA, 22 bp, Homo sapiens
gcaaagcagaaccctctctatc

SEQ ID NO: 7755677 - DNA, 22 bp, Homo sapiens
gcaaaggccactggggcgatgg

SEQ ID NO: 7755678 - DNA, 22 bp, Homo sapiens
gcaaagtgcttcagtgggagct

SEQ ID NO: 7755679 - DNA, 22 bp, Homo sapiens
gccaccaggagcccagtccaaa

SEQ ID NO: 7755680 - DNA, 22 bp, Homo sapiens
gcaggggagtggcaggcccgga

SEQ ID NO: 7755681 - DNA, 22 bp, Homo sapiens
gcaggggagtggatgatggatt

SEQ ID NO: 7755682 - DNA, 22 bp, Homo sapiens
gcaggggagtccactctatgca

SEQ ID NO: 7755683 - DNA, 22 bp, Homo sapiens
gccaccccaacctccctaagtt

SEQ ID NO: 7755684 - DNA, 22 bp, Homo sapiens
gccaggcagcagcgaggatggt

SEQ ID NO: 7755685 - DNA, 22 bp, Homo sapiens
gccctgggcaaggttctggcca

SEQ ID NO: 7755686 - DNA, 22 bp, Homo sapiens
gcccaggaagtgactcagatgt

SEQ ID NO: 7755687 - DNA, 22 bp, Homo sapiens
gcccatgggctccagacctggg

SEQ ID NO: 7755688 - DNA, 22 bp, Homo sapiens
gccagggtgagggctgagaggt

SEQ ID NO: 7755689 - DNA, 22 bp, Homo sapiens
gccaggggtgcccacccaagga

SEQ ID NO: 7755690 - DNA, 22 bp, Homo sapiens
gccaggggacgcggagcgacga

SEQ ID NO: 7755691 - DNA, 22 bp, Homo sapiens
gccagggggtcagcaggcactt

SEQ ID NO: 7755692 - DNA, 22 bp, Homo sapiens
gctgagggccgcatagggtcat

SEQ ID NO: 7755693 - DNA, 22 bp, Homo sapiens
gctgagggctgtaacagcagag

SEQ ID NO: 7755694 - DNA, 22 bp, Homo sapiens
gctgcggtcactgcgggggctg

SEQ ID NO: 7755695 - DNA, 22 bp, Homo sapiens
gctgcggtgaacttggatggtg

SEQ ID NO: 7755696 - DNA, 22 bp, Homo sapiens
gctgcggtggctggcgatggga

SEQ ID NO: 7755697 - DNA, 18 bp, Homo sapiens
gctgaatgtctgctttgc

SEQ ID NO: 7755698 - DNA, 23 bp, Homo sapiens
gctgaatgtaatgttctttgggt

SEQ ID NO: 7755699 - DNA, 22 bp, Homo sapiens
gctgaatgaatgtattttaaaa

SEQ ID NO: 7755700 - DNA, 22 bp, Homo sapiens
gctctgggccgggcaccagcct

SEQ ID NO: 7755701 - DNA, 17 bp, Homo sapiens
gctgagaggcagcacag

SEQ ID NO: 7755702 - DNA, 22 bp, Homo sapiens
gctgagagcaaagcatgtctag

SEQ ID NO: 7755703 - DNA, 22 bp, Homo sapiens
gctgagagcggccagctgggaa

SEQ ID NO: 7755704 - DNA, 22 bp, Homo sapiens
gctgagagaaaagtgaggttct

SEQ ID NO: 7755705 - DNA, 22 bp, Homo sapiens
gctgagagatcaaggcaggatt

SEQ ID NO: 7755706 - DNA, 22 bp, Homo sapiens
gctgagggaccatgtttcagga

SEQ ID NO: 7755707 - DNA, 22 bp, Homo sapiens
gctgagggaggctgaactgagt

SEQ ID NO: 7755708 - DNA, 22 bp, Homo sapiens
gctgaggctgggagcagcctgt

SEQ ID NO: 7755709 - DNA, 22 bp, Homo sapiens
gctgagagtgagcactggatat

SEQ ID NO: 7755710 - DNA, 22 bp, Homo sapiens
gcgtgggctggactgggatgaa

SEQ ID NO: 7755711 - DNA, 22 bp, Homo sapiens
ggacacagggctcactctctct

SEQ ID NO: 7755712 - DNA, 22 bp, Homo sapiens
ggaccaggggcgcactccctgc

SEQ ID NO: 7755713 - DNA, 19 bp, Homo sapiens
ggaccaggtcctgggcagc

SEQ ID NO: 7755714 - DNA, 22 bp, Homo sapiens
ggaccaggcaagctgaggcggg

SEQ ID NO: 7755715 - DNA, 22 bp, Homo sapiens
ggaccaggccagcctccctgcg

SEQ ID NO: 7755716 - DNA, 21 bp, Homo sapiens
ggacatgaggcaggagaggct

SEQ ID NO: 7755717 - DNA, 22 bp, Homo sapiens
ggacatgatatttcaggaagac

SEQ ID NO: 7755718 - DNA, 22 bp, Homo sapiens
ggagagaattcagcttaagatt

SEQ ID NO: 7755719 - DNA, 18 bp, Homo sapiens
ggagactaaactgttgac

SEQ ID NO: 7755720 - DNA, 22 bp, Homo sapiens
ggagacagtggtagggcctaag

SEQ ID NO: 7755721 - DNA, 22 bp, Homo sapiens
ggagccagagcactggggagcc

SEQ ID NO: 7755722 - DNA, 22 bp, Homo sapiens
ggaatctttgaaggattttaag

SEQ ID NO: 7755723 - DNA, 22 bp, Homo sapiens
ggaatgatggtgcctagattat

SEQ ID NO: 7755724 - DNA, 22 bp, Homo sapiens
ggaagatgcccaacccagcttt

SEQ ID NO: 7755725 - DNA, 22 bp, Homo sapiens
ggaagcactgaggcagagaggg

SEQ ID NO: 7755726 - DNA, 22 bp, Homo sapiens
ggaagcacagcataaagttact

SEQ ID NO: 7755727 - DNA, 22 bp, Homo sapiens
ggaagaagcagggcatttgaat

SEQ ID NO: 7755728 - DNA, 22 bp, Homo sapiens
ggaagaagggtcattggcagcc

SEQ ID NO: 7755729 - DNA, 22 bp, Homo sapiens
ggaagacaagcagtggctgagc

SEQ ID NO: 7755730 - DNA, 22 bp, Homo sapiens
gctggctgcgtcatcacagggc

SEQ ID NO: 7755731 - DNA, 22 bp, Homo sapiens
gctggagagataggcatggggt

SEQ ID NO: 7755732 - DNA, 22 bp, Homo sapiens
gctggagaacccaggaggaaga

SEQ ID NO: 7755733 - DNA, 22 bp, Homo sapiens
gctggagaaactgcagctgagg

SEQ ID NO: 7755734 - DNA, 22 bp, Homo sapiens
gctgggcttcacctccagagtt

SEQ ID NO: 7755735 - DNA, 22 bp, Homo sapiens
gctgggaacacagccatgagag

SEQ ID NO: 7755736 - DNA, 22 bp, Homo sapiens
gctgtgggacaggtccagccag

SEQ ID NO: 7755737 - DNA, 22 bp, Homo sapiens
gctgtgggccacacggctgagt

SEQ ID NO: 7755738 - DNA, 22 bp, Homo sapiens
gctgtgggtaaacgctgagggt

SEQ ID NO: 7755739 - DNA, 22 bp, Homo sapiens
gctgtgggttcctggcatttga

SEQ ID NO: 7755740 - DNA, 22 bp, Homo sapiens
gctgtgggtgctggctccaccc

SEQ ID NO: 7755741 - DNA, 19 bp, Homo sapiens
gctgtgggacagcagggtg

SEQ ID NO: 7755742 - DNA, 22 bp, Homo sapiens
gctgtggctgtacagagaccat

SEQ ID NO: 7755743 - DNA, 22 bp, Homo sapiens
gctgtggctgacattgcagaca

SEQ ID NO: 7755744 - DNA, 22 bp, Homo sapiens
gctgtggctgaagatgcaggga

SEQ ID NO: 7755745 - DNA, 22 bp, Homo sapiens
gcttgagaacttcaactcagtg

SEQ ID NO: 7755746 - DNA, 23 bp, Homo sapiens
gcttgcctggtgtgtggctgacc

SEQ ID NO: 7755747 - DNA, 22 bp, Homo sapiens
gctgtgtatcagatgccacggg

SEQ ID NO: 7755748 - DNA, 22 bp, Homo sapiens
tccagcagcccgaaggcccatc

SEQ ID NO: 7755749 - DNA, 23 bp, Homo sapiens
tccagcagagccttccaggaggg

SEQ ID NO: 7755750 - DNA, 22 bp, Homo sapiens
tccagaatatttgggaaagatg

SEQ ID NO: 7755751 - DNA, 22 bp, Homo sapiens
tccaggaaacactcaagccatg

SEQ ID NO: 7755752 - DNA, 22 bp, Homo sapiens
tccaggaaaaggcttgcagggg

SEQ ID NO: 7755753 - DNA, 22 bp, Homo sapiens
tccaggaaacagcatctcagca

SEQ ID NO: 7755754 - DNA, 21 bp, Homo sapiens
tccaggaaagttttaagagtg

SEQ ID NO: 7755755 - DNA, 22 bp, Homo sapiens
tccaggaaagcactgggctggg

SEQ ID NO: 7755756 - DNA, 22 bp, Homo sapiens
tccaggaaacatctccgcctaa

SEQ ID NO: 7755757 - DNA, 22 bp, Homo sapiens
tccaggaaagtgggatgtgtgt

SEQ ID NO: 7755758 - DNA, 21 bp, Homo sapiens
tcccacagaaactgcgaaatt

SEQ ID NO: 7755759 - DNA, 23 bp, Homo sapiens
tccatctgtgagcatgccctgga

SEQ ID NO: 7755760 - DNA, 22 bp, Homo sapiens
tccaggcatgtctgagtccttc

SEQ ID NO: 7755761 - DNA, 22 bp, Homo sapiens
tccaggccaatgtagcaggccc

SEQ ID NO: 7755762 - DNA, 22 bp, Homo sapiens
tcccagggttacagccagggca

SEQ ID NO: 7755763 - DNA, 22 bp, Homo sapiens
tcccagggtgcgcctgccctcg

SEQ ID NO: 7755764 - DNA, 21 bp, Homo sapiens
tcccagggtcttatgggatgt

SEQ ID NO: 7755765 - DNA, 22 bp, Homo sapiens
tcccagggtgaaatgcagtagg

SEQ ID NO: 7755766 - DNA, 22 bp, Homo sapiens
tcccagggattaggacatggat

SEQ ID NO: 7755767 - DNA, 22 bp, Homo sapiens
tcccagggatcctccgggtcgc

SEQ ID NO: 7755768 - DNA, 22 bp, Homo sapiens
tcccagggactgggctaggctt

SEQ ID NO: 7755769 - DNA, 22 bp, Homo sapiens
tcagaaaagaccacattattct

SEQ ID NO: 7755770 - DNA, 22 bp, Homo sapiens
tcagaaaagactcaggggctga

SEQ ID NO: 7755771 - DNA, 22 bp, Homo sapiens
tcagaaaagagaaaatcttata

SEQ ID NO: 7755772 - DNA, 22 bp, Homo sapiens
tcagaaaataactgttagtttg

SEQ ID NO: 7755773 - DNA, 22 bp, Homo sapiens
tcagaaaaggtagctgtgacaa

SEQ ID NO: 7755774 - DNA, 20 bp, Homo sapiens
tcagaccctacattcctcag

SEQ ID NO: 7755775 - DNA, 22 bp, Homo sapiens
tcagaccccagaatgaagccag

SEQ ID NO: 7755776 - DNA, 20 bp, Homo sapiens
tcagacccagattagcaggt

SEQ ID NO: 7755777 - DNA, 20 bp, Homo sapiens
tcagacccggggaagggagc

SEQ ID NO: 7755778 - DNA, 22 bp, Homo sapiens
tcagacccaggtgccaagctgt

SEQ ID NO: 7755779 - DNA, 22 bp, Homo sapiens
tcagaccctgcggtgtttggat

SEQ ID NO: 7755780 - DNA, 17 bp, Homo sapiens
tcagaccctgtgtcagg

SEQ ID NO: 7755781 - DNA, 22 bp, Homo sapiens
tcagagccaatcatggtgcatt

SEQ ID NO: 7755782 - DNA, 22 bp, Homo sapiens
tcagagaggttggtgataagaa

SEQ ID NO: 7755783 - DNA, 22 bp, Homo sapiens
tcagcactgtctattagtgaga

SEQ ID NO: 7755784 - DNA, 22 bp, Homo sapiens
tcagcactgtcttttatttgaa

SEQ ID NO: 7755785 - DNA, 22 bp, Homo sapiens
tcagcactgtgtccagtctccc

SEQ ID NO: 7755786 - DNA, 22 bp, Homo sapiens
tcagcacttactagtggccttt

SEQ ID NO: 7755787 - DNA, 22 bp, Homo sapiens
tcagcactgatgtttcagaaga

SEQ ID NO: 7755788 - DNA, 22 bp, Homo sapiens
tcagcactggcgctgggcaggt

SEQ ID NO: 7755789 - DNA, 22 bp, Homo sapiens
tcagcactgaatctggatttgc

SEQ ID NO: 7755790 - DNA, 22 bp, Homo sapiens
tcagcactgatagaagtcaata

SEQ ID NO: 7755791 - DNA, 22 bp, Homo sapiens
tcagcactatacattttgaata

SEQ ID NO: 7755792 - DNA, 22 bp, Homo sapiens
tcagcactcgctacctagtaaa

SEQ ID NO: 7755793 - DNA, 22 bp, Homo sapiens
tcagcactgaaattcttcacat

SEQ ID NO: 7755794 - DNA, 21 bp, Homo sapiens
tcactagtgccttctgtcatt

SEQ ID NO: 7755795 - DNA, 22 bp, Homo sapiens
tcactagtcatcaacttccatt

SEQ ID NO: 7755796 - DNA, 23 bp, Homo sapiens
tcactagtcaagtgcctttgagt

SEQ ID NO: 7755797 - DNA, 22 bp, Homo sapiens
tcactagtcgcggggggaggta

SEQ ID NO: 7755798 - DNA, 22 bp, Homo sapiens
tcactttacagctaaggttgtt

SEQ ID NO: 7755799 - DNA, 22 bp, Homo sapiens
tcactttagaggaaacattgag

SEQ ID NO: 7755800 - DNA, 22 bp, Homo sapiens
tcaagttcacagtctggtcgct

SEQ ID NO: 7755801 - DNA, 22 bp, Homo sapiens
tcaagctggctgttgctatttc

SEQ ID NO: 7755802 - DNA, 22 bp, Homo sapiens
tcacagaataaattgagaagac

SEQ ID NO: 7755803 - DNA, 22 bp, Homo sapiens
tcacagaataaatgtactggcc

SEQ ID NO: 7755804 - DNA, 22 bp, Homo sapiens
tcacagaagttgaatttgcatg

SEQ ID NO: 7755805 - DNA, 22 bp, Homo sapiens
tcacagaagtgtgtttcaggag

SEQ ID NO: 7755806 - DNA, 22 bp, Homo sapiens
tcacagaagtgtagtgaggaaa

SEQ ID NO: 7755807 - DNA, 22 bp, Homo sapiens
tcacagaaggtggccatagctg

SEQ ID NO: 7755808 - DNA, 22 bp, Homo sapiens
tcacagaagggaaagatgccaa

SEQ ID NO: 7755809 - DNA, 22 bp, Homo sapiens
tcacagaaggcatcacagaaga

SEQ ID NO: 7755810 - DNA, 22 bp, Homo sapiens
tcacagaaggagggaagctagt

SEQ ID NO: 7755811 - DNA, 22 bp, Homo sapiens
tcacagaaggaccttgtttcat

SEQ ID NO: 7755812 - DNA, 22 bp, Homo sapiens
tcacagaagccctcgcaaacta

SEQ ID NO: 7755813 - DNA, 22 bp, Homo sapiens
tcacagaagcttgaagattttc

SEQ ID NO: 7755814 - DNA, 22 bp, Homo sapiens
tcacagaagatgctggatgttg

SEQ ID NO: 7755815 - DNA, 22 bp, Homo sapiens
tcacagaagcatcatacccgga

SEQ ID NO: 7755816 - DNA, 22 bp, Homo sapiens
tcacaggcctggggcagagggc

SEQ ID NO: 7755817 - DNA, 22 bp, Homo sapiens
tcacagtactccccaaagtttc

SEQ ID NO: 7755818 - DNA, 22 bp, Homo sapiens
tcacagtagacttctcaagagc

SEQ ID NO: 7755819 - DNA, 22 bp, Homo sapiens
tcacagtaaatccagaagaaat

SEQ ID NO: 7755820 - DNA, 22 bp, Homo sapiens
tcacagaaacagaatggcacag

SEQ ID NO: 7755821 - DNA, 20 bp, Homo sapiens
tcacagaaacaaatagagaa

SEQ ID NO: 7755822 - DNA, 22 bp, Homo sapiens
tcacagaaaagtggagagccta

SEQ ID NO: 7755823 - DNA, 22 bp, Homo sapiens
tcacagaaaagctgagcatcag

SEQ ID NO: 7755824 - DNA, 22 bp, Homo sapiens
tcacagaaataagatagttatt

SEQ ID NO: 7755825 - DNA, 22 bp, Homo sapiens
tcacagaaagctgtgtcctgac

SEQ ID NO: 7755826 - DNA, 22 bp, Homo sapiens
tcacagaaatctgttttttcta

SEQ ID NO: 7755827 - DNA, 22 bp, Homo sapiens
tcacagaagagatattgacaga

SEQ ID NO: 7755828 - DNA, 22 bp, Homo sapiens
tcacagaagagcattaagatga

SEQ ID NO: 7755829 - DNA, 22 bp, Homo sapiens
tcacagaacaatgtttagttct

SEQ ID NO: 7755830 - DNA, 22 bp, Homo sapiens
tcacagaacaagcctggtggag

SEQ ID NO: 7755831 - DNA, 22 bp, Homo sapiens
tcacagaacacaaatgccactt

SEQ ID NO: 7755832 - DNA, 22 bp, Homo sapiens
tcacagaagaagtagattgcat

SEQ ID NO: 7755833 - DNA, 22 bp, Homo sapiens
tcacaaaggatgatgaattctg

SEQ ID NO: 7755834 - DNA, 22 bp, Homo sapiens
tcacaaaaggccatgtggcttc

SEQ ID NO: 7755835 - DNA, 22 bp, Homo sapiens
tcacaaagtgaagtgtgtcatg

SEQ ID NO: 7755836 - DNA, 22 bp, Homo sapiens
tcacaaagggagggatagctgg

SEQ ID NO: 7755837 - DNA, 22 bp, Homo sapiens
tcagcactttttaaagcagcat

SEQ ID NO: 7755838 - DNA, 22 bp, Homo sapiens
tcagcacttggatttcagagat

SEQ ID NO: 7755839 - DNA, 22 bp, Homo sapiens
tcagcactttgaagcagaagga

SEQ ID NO: 7755840 - DNA, 22 bp, Homo sapiens
tcagcacttttactctctttgc

SEQ ID NO: 7755841 - DNA, 22 bp, Homo sapiens
tcagcaggcacaccaaaaactg

SEQ ID NO: 7755842 - DNA, 21 bp, Homo sapiens
tcagcaggcaccagaaggctg

SEQ ID NO: 7755843 - DNA, 22 bp, Homo sapiens
tcagcaggcacggacaggctgc

SEQ ID NO: 7755844 - DNA, 22 bp, Homo sapiens
tcaggaacttctaggaaagctg

SEQ ID NO: 7755845 - DNA, 22 bp, Homo sapiens
tcaggaagaaagaagggagtgt

SEQ ID NO: 7755846 - DNA, 22 bp, Homo sapiens
tcaggaacacaggggcccatgc

SEQ ID NO: 7755847 - DNA, 22 bp, Homo sapiens
tcaggaaccctggtctcctgct

SEQ ID NO: 7755848 - DNA, 22 bp, Homo sapiens
tcaggaacatttaaccacaggg

SEQ ID NO: 7755849 - DNA, 22 bp, Homo sapiens
tcaggaacccccgctgggtgaa

SEQ ID NO: 7755850 - DNA, 22 bp, Homo sapiens
tcaggaacagcagggaggaaag

SEQ ID NO: 7755851 - DNA, 22 bp, Homo sapiens
tcaggaacagaattttctaaaa

SEQ ID NO: 7755852 - DNA, 22 bp, Homo sapiens
tcaggaacataatgtgagtcag

SEQ ID NO: 7755853 - DNA, 22 bp, Homo sapiens
tcaggaagcatcctgaggtgtc

SEQ ID NO: 7755854 - DNA, 22 bp, Homo sapiens
tcaggaggttgaccacggggca

SEQ ID NO: 7755855 - DNA, 22 bp, Homo sapiens
tcaggaaggcacttggtgtgtt

SEQ ID NO: 7755856 - DNA, 22 bp, Homo sapiens
tcaggcattgtgcagagccttg

SEQ ID NO: 7755857 - DNA, 22 bp, Homo sapiens
tcaggctggagtgcagtggcgc

SEQ ID NO: 7755858 - DNA, 22 bp, Homo sapiens
tcatgctgagtcctggctttgt

SEQ ID NO: 7755859 - DNA, 22 bp, Homo sapiens
tcatgctatttcgaatgtaata

SEQ ID NO: 7755860 - DNA, 22 bp, Homo sapiens
tcatggcattgttaagggtttt

SEQ ID NO: 7755861 - DNA, 22 bp, Homo sapiens
tacagcaatgcctgaaatagta

SEQ ID NO: 7755862 - DNA, 22 bp, Homo sapiens
tacagaaattgccaccagctct

SEQ ID NO: 7755863 - DNA, 22 bp, Homo sapiens
tacagaaatcacatcgctttga

SEQ ID NO: 7755864 - DNA, 22 bp, Homo sapiens
tacagaaatacagtcaggccta

SEQ ID NO: 7755865 - DNA, 22 bp, Homo sapiens
tacagaaatactggggggttct

SEQ ID NO: 7755866 - DNA, 22 bp, Homo sapiens
tacaaagtttggggtcctcaaa

SEQ ID NO: 7755867 - DNA, 22 bp, Homo sapiens
tacaaagtgaaataattctgag

SEQ ID NO: 7755868 - DNA, 22 bp, Homo sapiens
tacagaaaaactggcattgaag

SEQ ID NO: 7755869 - DNA, 20 bp, Homo sapiens
tacagaaacaggacttttgg

SEQ ID NO: 7755870 - DNA, 22 bp, Homo sapiens
tacagaaaaacttggaggcttt

SEQ ID NO: 7755871 - DNA, 22 bp, Homo sapiens
tacagaaacagcgtggttagaa

SEQ ID NO: 7755872 - DNA, 22 bp, Homo sapiens
tacagaaagggatgattgatct

SEQ ID NO: 7755873 - DNA, 22 bp, Homo sapiens
tacagaaagacctctcgggaaa

SEQ ID NO: 7755874 - DNA, 22 bp, Homo sapiens
tacagaaaaacatctggagccg

SEQ ID NO: 7755875 - DNA, 22 bp, Homo sapiens
tacattctggaaaggcacagac

SEQ ID NO: 7755876 - DNA, 22 bp, Homo sapiens
tacattctggtggagaaagtaa

SEQ ID NO: 7755877 - DNA, 22 bp, Homo sapiens
tacagggactcccgcagagata

SEQ ID NO: 7755878 - DNA, 22 bp, Homo sapiens
tacagggacatggaacaggctc

SEQ ID NO: 7755879 - DNA, 22 bp, Homo sapiens
tacatacattacctcatttagt

SEQ ID NO: 7755880 - DNA, 22 bp, Homo sapiens
tacaaagagtttggtctctaga

SEQ ID NO: 7755881 - DNA, 22 bp, Homo sapiens
tacaaagtaatgtataatatcg

SEQ ID NO: 7755882 - DNA, 22 bp, Homo sapiens
taataatagcagtagctgccac

SEQ ID NO: 7755883 - DNA, 19 bp, Homo sapiens
taataagcaatatggaagt

SEQ ID NO: 7755884 - DNA, 22 bp, Homo sapiens
taataagcgtagaaggtatatc

SEQ ID NO: 7755885 - DNA, 22 bp, Homo sapiens
taagtacatttgggaccacctg

SEQ ID NO: 7755886 - DNA, 22 bp, Homo sapiens
taagggttcagaatgcagtggt

SEQ ID NO: 7755887 - DNA, 22 bp, Homo sapiens
taaggcttatgatcagaaggtt

SEQ ID NO: 7755888 - DNA, 22 bp, Homo sapiens
taaggcttatatacttagacat

SEQ ID NO: 7755889 - DNA, 22 bp, Homo sapiens
gtttcattacctgacccatgag

SEQ ID NO: 7755890 - DNA, 19 bp, Homo sapiens
gtttcattaagataggaaa

SEQ ID NO: 7755891 - DNA, 23 bp, Homo sapiens
gttgcctttgcatcttcatccat

SEQ ID NO: 7755892 - DNA, 22 bp, Homo sapiens
gttggggtaccttgaggctggg

SEQ ID NO: 7755893 - DNA, 22 bp, Homo sapiens
gttcagcaagtactcagtccac

SEQ ID NO: 7755894 - DNA, 22 bp, Homo sapiens
gttcagcacaggtgctcagaca

SEQ ID NO: 7755895 - DNA, 18 bp, Homo sapiens
gtgtgcagttgcaggggt

SEQ ID NO: 7755896 - DNA, 22 bp, Homo sapiens
gttaataaaggtatagaatcag

SEQ ID NO: 7755897 - DNA, 22 bp, Homo sapiens
gttaatatttacctgtcaagaa

SEQ ID NO: 7755898 - DNA, 22 bp, Homo sapiens
gttaatgtgtctgacacaatgg

SEQ ID NO: 7755899 - DNA, 22 bp, Homo sapiens
gttaatgttatctgaagacagt

SEQ ID NO: 7755900 - DNA, 22 bp, Homo sapiens
gttacaaactcaggtgccaaaa

SEQ ID NO: 7755901 - DNA, 22 bp, Homo sapiens
taactaagtgactcaagtgatc

SEQ ID NO: 7755902 - DNA, 22 bp, Homo sapiens
taaacagaatgcgtaagaagtg

SEQ ID NO: 7755903 - DNA, 22 bp, Homo sapiens
gtttccagctcttagcaaaggc

SEQ ID NO: 7755904 - DNA, 22 bp, Homo sapiens
tatagccaataatagtgtgtga

SEQ ID NO: 7755905 - DNA, 22 bp, Homo sapiens
tatagcatatacagataagctg

SEQ ID NO: 7755906 - DNA, 22 bp, Homo sapiens
tatagtacatggaatcttcata

SEQ ID NO: 7755907 - DNA, 22 bp, Homo sapiens
tatccatggccaatcaaataca

SEQ ID NO: 7755908 - DNA, 22 bp, Homo sapiens
tatctacagttaatatgtcatc

SEQ ID NO: 7755909 - DNA, 22 bp, Homo sapiens
tatctacattcttgtatcttct

SEQ ID NO: 7755910 - DNA, 21 bp, Homo sapiens
tatgagaaaactgaggtgcat

SEQ ID NO: 7755911 - DNA, 22 bp, Homo sapiens
tatgagaaattatacctaggtt

SEQ ID NO: 7755912 - DNA, 22 bp, Homo sapiens
taggtggtgggatatgagcatc

SEQ ID NO: 7755913 - DNA, 22 bp, Homo sapiens
taggtggtgtgcgaagagcgtg

SEQ ID NO: 7755914 - DNA, 22 bp, Homo sapiens
tattgaagagataagtgacaga

SEQ ID NO: 7755915 - DNA, 22 bp, Homo sapiens
tattattatagttattgggaag

SEQ ID NO: 7755916 - DNA, 22 bp, Homo sapiens
tattagcttctggttttgttct

SEQ ID NO: 7755917 - DNA, 22 bp, Homo sapiens
tattagctttagcctttggatg

SEQ ID NO: 7755918 - DNA, 22 bp, Homo sapiens
tattagcttgtttggcaggatg

SEQ ID NO: 7755919 - DNA, 22 bp, Homo sapiens
tatttataatctgccaaagaga

SEQ ID NO: 7755920 - DNA, 22 bp, Homo sapiens
tatgtacatacatgtgcatacg

SEQ ID NO: 7755921 - DNA, 22 bp, Homo sapiens
tatgtacaatcagcagttcata

SEQ ID NO: 7755922 - DNA, 22 bp, Homo sapiens
tattacagaatcaggcataact

SEQ ID NO: 7755923 - DNA, 22 bp, Homo sapiens
tattagagaaaagatggatgtg

SEQ ID NO: 7755924 - DNA, 22 bp, Homo sapiens
tattacgtaactacttaaattg

SEQ ID NO: 7755925 - DNA, 21 bp, Homo sapiens
tattagcttctggtgctgttt

SEQ ID NO: 7755926 - DNA, 22 bp, Homo sapiens
tattagctgtgtaactctggtt

SEQ ID NO: 7755927 - DNA, 22 bp, Homo sapiens
tattagctccagtactgttgcc

SEQ ID NO: 7755928 - DNA, 22 bp, Homo sapiens
tattagctcatgatttcggtgg

SEQ ID NO: 7755929 - DNA, 17 bp, Homo sapiens
tattagctagcttccag

SEQ ID NO: 7755930 - DNA, 22 bp, Homo sapiens
tattagcagcatgagaatgggc

SEQ ID NO: 7755931 - DNA, 22 bp, Homo sapiens
tagaatgacctcctcttagctt

SEQ ID NO: 7755932 - DNA, 22 bp, Homo sapiens
tacattttctaggggaccaaga

SEQ ID NO: 7755933 - DNA, 22 bp, Homo sapiens
tacttttagcctatttgattct

SEQ ID NO: 7755934 - DNA, 22 bp, Homo sapiens
tactttttgtctctttgaatgt

SEQ ID NO: 7755935 - DNA, 22 bp, Homo sapiens
tagaaacagaatatgagtgaga

SEQ ID NO: 7755936 - DNA, 22 bp, Homo sapiens
tagggagaaacaccaatttatt

SEQ ID NO: 7755937 - DNA, 22 bp, Homo sapiens
taggcacaaaatgaaaatggca

SEQ ID NO: 7755938 - DNA, 22 bp, Homo sapiens
taggcacaagaccatgcaaagg

SEQ ID NO: 7755939 - DNA, 22 bp, Homo sapiens
tagctgttttttgtgaggaaat

SEQ ID NO: 7755940 - DNA, 22 bp, Homo sapiens
tagctgaagggcatttaataaa

SEQ ID NO: 7755941 - DNA, 17 bp, Homo sapiens
tagcagcagtaattgtg

SEQ ID NO: 7755942 - DNA, 22 bp, Homo sapiens
tagcagagtgattggccatgag

SEQ ID NO: 7755943 - DNA, 22 bp, Homo sapiens
tagcagcagtggtgtatttaga

SEQ ID NO: 7755944 - DNA, 22 bp, Homo sapiens
tagcagagggtagtgccggggc

SEQ ID NO: 7755945 - DNA, 22 bp, Homo sapiens
tagcagaggtaagtgtggcaat

SEQ ID NO: 7755946 - DNA, 22 bp, Homo sapiens
tagcagcatcctgtggtgatgg

SEQ ID NO: 7755947 - DNA, 22 bp, Homo sapiens
tagcagaggaaatccagagtaa

SEQ ID NO: 7755948 - DNA, 22 bp, Homo sapiens
tagcagagcgggtgcgaggcgg

SEQ ID NO: 7755949 - DNA, 22 bp, Homo sapiens
tagcagaagaacaacatgatct

SEQ ID NO: 7755950 - DNA, 22 bp, Homo sapiens
ttcctcttatatagccttggcc

SEQ ID NO: 7755951 - DNA, 22 bp, Homo sapiens
ttcctcttattttcccagtgat

SEQ ID NO: 7755952 - DNA, 22 bp, Homo sapiens
ttcctcagggaggctagcagta

SEQ ID NO: 7755953 - DNA, 22 bp, Homo sapiens
ttcctcaggctgctttcacata

SEQ ID NO: 7755954 - DNA, 22 bp, Homo sapiens
ttccagaactcaagaaatgccc

SEQ ID NO: 7755955 - DNA, 22 bp, Homo sapiens
ttccagaagatggcagcaaagg

SEQ ID NO: 7755956 - DNA, 22 bp, Homo sapiens
ttctacaaatatttactgttcc

SEQ ID NO: 7755957 - DNA, 22 bp, Homo sapiens
ttcctgtgtgttggtggcagaa

SEQ ID NO: 7755958 - DNA, 22 bp, Homo sapiens
ttcctgtggctgtcactcctgg

SEQ ID NO: 7755959 - DNA, 22 bp, Homo sapiens
ttcctgtggccttacatctgtg

SEQ ID NO: 7755960 - DNA, 22 bp, Homo sapiens
ttcctgtgcctcaggtctcagc

SEQ ID NO: 7755961 - DNA, 22 bp, Homo sapiens
ttcctctttgcatcctcaactc

SEQ ID NO: 7755962 - DNA, 22 bp, Homo sapiens
ttcctcttccatcttcccaggg

SEQ ID NO: 7755963 - DNA, 21 bp, Homo sapiens
ttcctcttgcttccgccttgc

SEQ ID NO: 7755964 - DNA, 22 bp, Homo sapiens
ttcctctttagggctggccagg

SEQ ID NO: 7755965 - DNA, 22 bp, Homo sapiens
ttcctgtgaagatctgggtgct

SEQ ID NO: 7755966 - DNA, 22 bp, Homo sapiens
ttcatgccagccctgtgtggta

SEQ ID NO: 7755967 - DNA, 22 bp, Homo sapiens
ttcatggcgctgttctctccct

SEQ ID NO: 7755968 - DNA, 22 bp, Homo sapiens
ttcacagtggccctctctgagt

SEQ ID NO: 7755969 - DNA, 22 bp, Homo sapiens
ttcacagtggccctctctgagt

SEQ ID NO: 7755970 - DNA, 22 bp, Homo sapiens
ttcagtccatcaggcgtggcat

SEQ ID NO: 7755971 - DNA, 22 bp, Homo sapiens
ttcacagtaagtaggatagttg

SEQ ID NO: 7755972 - DNA, 20 bp, Homo sapiens
ttcacaactcttagaagctg

SEQ ID NO: 7755973 - DNA, 22 bp, Homo sapiens
ttcacaaagctggagcatttcc

SEQ ID NO: 7755974 - DNA, 22 bp, Homo sapiens
ttcacaactgccatagccagtg

SEQ ID NO: 7755975 - DNA, 22 bp, Homo sapiens
ttcacaaaatggtttgttgatg

SEQ ID NO: 7755976 - DNA, 22 bp, Homo sapiens
ttgaatgagaagttattgccat

SEQ ID NO: 7755977 - DNA, 22 bp, Homo sapiens
ttgaatgaatttgagcagagat

SEQ ID NO: 7755978 - DNA, 22 bp, Homo sapiens
ttgaatgaggaagagcactggc

SEQ ID NO: 7755979 - DNA, 22 bp, Homo sapiens
ttgaatgagtgttttactcatg

SEQ ID NO: 7755980 - DNA, 22 bp, Homo sapiens
ttgaatgagtgttttactcatg

SEQ ID NO: 7755981 - DNA, 22 bp, Homo sapiens
ttgaatgaccatgatgcaaggg

SEQ ID NO: 7755982 - DNA, 22 bp, Homo sapiens
ttgaatgatcctatctagcaca

SEQ ID NO: 7755983 - DNA, 22 bp, Homo sapiens
ttgaatgatcctatctagcaca

SEQ ID NO: 7755984 - DNA, 22 bp, Homo sapiens
ttgaatgattaaagtcatctga

SEQ ID NO: 7755985 - DNA, 22 bp, Homo sapiens
ttgaagcatttgctatagcatt

SEQ ID NO: 7755986 - DNA, 20 bp, Homo sapiens
ttgaatgaatgtctggctca

SEQ ID NO: 7755987 - DNA, 20 bp, Homo sapiens
ttgaatgaatgtctggctca

SEQ ID NO: 7755988 - DNA, 22 bp, Homo sapiens
ttgaatgaataaaagagtaagg

SEQ ID NO: 7755989 - DNA, 22 bp, Homo sapiens
ttgagcccaggaggcctgggtg

SEQ ID NO: 7755990 - DNA, 22 bp, Homo sapiens
ttgaggcacacacaggttgcat

SEQ ID NO: 7755991 - DNA, 23 bp, Homo sapiens
ttgaggcaaacatgtaagtagga

SEQ ID NO: 7755992 - DNA, 22 bp, Homo sapiens
ttgagcacttgagcagttgatg

SEQ ID NO: 7755993 - DNA, 22 bp, Homo sapiens
ttgagcacaactcttggagagc

SEQ ID NO: 7755994 - DNA, 22 bp, Homo sapiens
ttgaggcattactgtaatgaga

SEQ ID NO: 7755995 - DNA, 22 bp, Homo sapiens
ttgaggcagggcatggtggccc

SEQ ID NO: 7755996 - DNA, 20 bp, Homo sapiens
ttgaggcatgtctagaagta

SEQ ID NO: 7755997 - DNA, 20 bp, Homo sapiens
ttgcaaagtgaatagcaatt

SEQ ID NO: 7755998 - DNA, 22 bp, Homo sapiens
ttctgggtgactcacgctcccc

SEQ ID NO: 7755999 - DNA, 22 bp, Homo sapiens
ttctgggcccactgtagcatcc

SEQ ID NO: 7756000 - DNA, 19 bp, Homo sapiens
ttcttgaacatgtttctca

SEQ ID NO: 7756001 - DNA, 22 bp, Homo sapiens
ttctttaaatgaattctctgta

SEQ ID NO: 7756002 - DNA, 22 bp, Homo sapiens
ttctgagaagggtgggtctggc

SEQ ID NO: 7756003 - DNA, 22 bp, Homo sapiens
ttctgagagttgtagtgtatcc

SEQ ID NO: 7756004 - DNA, 20 bp, Homo sapiens
ttctgagagttcacagcccc

SEQ ID NO: 7756005 - DNA, 22 bp, Homo sapiens
ttctgagagtgccagaagttct

SEQ ID NO: 7756006 - DNA, 22 bp, Homo sapiens
ttctgagacaattgagagtcta

SEQ ID NO: 7756007 - DNA, 22 bp, Homo sapiens
ttctgagagagcctctcatgtt

SEQ ID NO: 7756008 - DNA, 22 bp, Homo sapiens
ttctgagaggcagagcttgtga

SEQ ID NO: 7756009 - DNA, 22 bp, Homo sapiens
ttctgagagctgaagaaatgtt

SEQ ID NO: 7756010 - DNA, 22 bp, Homo sapiens
tgtgggtggcatcgtcctggcc

SEQ ID NO: 7756011 - DNA, 22 bp, Homo sapiens
tgtggcctgggaaatgagtgtt

SEQ ID NO: 7756012 - DNA, 22 bp, Homo sapiens
tgtggcagtctcactggagggc

SEQ ID NO: 7756013 - DNA, 23 bp, Homo sapiens
tcccctcaggcagccagtgccct

SEQ ID NO: 7756014 - DNA, 22 bp, Homo sapiens
tccccctcattacctcattcaa

SEQ ID NO: 7756015 - DNA, 22 bp, Homo sapiens
tgtggagactatagccataaca

SEQ ID NO: 7756016 - DNA, 22 bp, Homo sapiens
tgttcctgtttctgcgtagttt

SEQ ID NO: 7756017 - DNA, 22 bp, Homo sapiens
tgttcctgtgtggaaaagggcc

SEQ ID NO: 7756018 - DNA, 22 bp, Homo sapiens
tgttcctgtttaatgtgctcat

SEQ ID NO: 7756019 - DNA, 21 bp, Homo sapiens
tgttcctgttctctaggatcc

SEQ ID NO: 7756020 - DNA, 23 bp, Homo sapiens
tgttcctgtcaaattttcttccc

SEQ ID NO: 7756021 - DNA, 22 bp, Homo sapiens
tgttcctggtgagccatttttt

SEQ ID NO: 7756022 - DNA, 22 bp, Homo sapiens
tgttcctgtactgctgtggctt

SEQ ID NO: 7756023 - DNA, 22 bp, Homo sapiens
tgttctaaatttgcatggtcca

SEQ ID NO: 7756024 - DNA, 20 bp, Homo sapiens
tgtttcataagctgtcctat

SEQ ID NO: 7756025 - DNA, 22 bp, Homo sapiens
tgtttcatgattgctgtcattt

SEQ ID NO: 7756026 - DNA, 22 bp, Homo sapiens
tgtttcctaagtgtctctgaag

SEQ ID NO: 7756027 - DNA, 19 bp, Homo sapiens
tgttttcaagtgggattat

SEQ ID NO: 7756028 - DNA, 22 bp, Homo sapiens
tgttttcacaatgatgtcagat

SEQ ID NO: 7756029 - DNA, 22 bp, Homo sapiens
tgttcctgaatgcctggctggc

SEQ ID NO: 7756030 - DNA, 18 bp, Homo sapiens
tgttcctgcctttctctg

SEQ ID NO: 7756031 - DNA, 22 bp, Homo sapiens
tgttcctgacggccaaagaggt

SEQ ID NO: 7756032 - DNA, 22 bp, Homo sapiens
tgttcctgaggcatgtgtcaat

SEQ ID NO: 7756033 - DNA, 22 bp, Homo sapiens
tgttcctggaaagccaggtggg

SEQ ID NO: 7756034 - DNA, 22 bp, Homo sapiens
tgttcctgctatggtttgttgc

SEQ ID NO: 7756035 - DNA, 22 bp, Homo sapiens
tgttcctggggacctgccttcc

SEQ ID NO: 7756036 - DNA, 22 bp, Homo sapiens
tgttcctgcaaggaactggtgc

SEQ ID NO: 7756037 - DNA, 21 bp, Homo sapiens
tgttcctgccccaatccttgg

SEQ ID NO: 7756038 - DNA, 22 bp, Homo sapiens
tgttcctggttcctgcatgatg

SEQ ID NO: 7756039 - DNA, 22 bp, Homo sapiens
ttaacacttgaactctacatgt

SEQ ID NO: 7756040 - DNA, 22 bp, Homo sapiens
ttaaggccttaacccccaatat

SEQ ID NO: 7756041 - DNA, 22 bp, Homo sapiens
ttaaggcattctcctactaata

SEQ ID NO: 7756042 - DNA, 22 bp, Homo sapiens
ttaaggctggtcccctctgcgt

SEQ ID NO: 7756043 - DNA, 22 bp, Homo sapiens
ttaacaaagctctgttcctttt

SEQ ID NO: 7756044 - DNA, 22 bp, Homo sapiens
ttaattttctcatctgtgaaat

SEQ ID NO: 7756045 - DNA, 22 bp, Homo sapiens
ttacaaacaacagacatttatt

SEQ ID NO: 7756046 - DNA, 22 bp, Homo sapiens
ttaatttttatgtatagtgtgt

SEQ ID NO: 7756047 - DNA, 22 bp, Homo sapiens
ttaattttgatgaggttcagtt

SEQ ID NO: 7756048 - DNA, 22 bp, Homo sapiens
ttacacttctaaaaaaagcagg

SEQ ID NO: 7756049 - DNA, 22 bp, Homo sapiens
ttagagcaggagttgacagatt

SEQ ID NO: 7756050 - DNA, 22 bp, Homo sapiens
ttttagtttggatttctaaagc

SEQ ID NO: 7756051 - DNA, 22 bp, Homo sapiens
tttgttttcaatgtgtcattca

SEQ ID NO: 7756052 - DNA, 22 bp, Homo sapiens
tttgttctgcatcacagaaaaa

SEQ ID NO: 7756053 - DNA, 22 bp, Homo sapiens
tttggcacagcttcccagactt

SEQ ID NO: 7756054 - DNA, 22 bp, Homo sapiens
tttgcaggcacggaggcagctg

SEQ ID NO: 7756055 - DNA, 19 bp, Homo sapiens
ttttgaagtatgagacagg

SEQ ID NO: 7756056 - DNA, 22 bp, Homo sapiens
ttttctaactttacactcgaaa

SEQ ID NO: 7756057 - DNA, 22 bp, Homo sapiens
ttttcttctacctgctgtccaa

SEQ ID NO: 7756058 - DNA, 22 bp, Homo sapiens
ttttcttcggtgctgggttgat

SEQ ID NO: 7756059 - DNA, 20 bp, Homo sapiens
tttttccttctctacaggca

SEQ ID NO: 7756060 - DNA, 22 bp, Homo sapiens
tttttgctccacaactttgaag

SEQ ID NO: 7756061 - DNA, 22 bp, Homo sapiens
ttgttttattctgcaatttccc

SEQ ID NO: 7756062 - DNA, 22 bp, Homo sapiens
ttgttttatctttctacagact

SEQ ID NO: 7756063 - DNA, 22 bp, Homo sapiens
ttgttttagtaggtacactgag

SEQ ID NO: 7756064 - DNA, 18 bp, Homo sapiens
ttgttttaagactctgtc

SEQ ID NO: 7756065 - DNA, 22 bp, Homo sapiens
ttgttttaatgagggaggttga

SEQ ID NO: 7756066 - DNA, 22 bp, Homo sapiens
ttgttttaagccagtctgccta

SEQ ID NO: 7756067 - DNA, 22 bp, Homo sapiens
ttgttttaacctagtgtttatg

SEQ ID NO: 7756068 - DNA, 20 bp, Homo sapiens
ttgttttaaatcctggatga

SEQ ID NO: 7756069 - DNA, 22 bp, Homo sapiens
ttgttttaacgactcagcttgt

SEQ ID NO: 7756070 - DNA, 22 bp, Homo sapiens
ttgtgaatgcttaatatgtttc

SEQ ID NO: 7756071 - DNA, 22 bp, Homo sapiens
ttgtctgacttctttagttact

SEQ ID NO: 7756072 - DNA, 22 bp, Homo sapiens
ttggggtggaagtgaggatcat

SEQ ID NO: 7756073 - DNA, 22 bp, Homo sapiens
ttggggtgttggatggagcaag

SEQ ID NO: 7756074 - DNA, 22 bp, Homo sapiens
tttaatttgtatttctagaggg

SEQ ID NO: 7756075 - DNA, 22 bp, Homo sapiens
tttaattagcaagccagagagc

SEQ ID NO: 7756076 - DNA, 22 bp, Homo sapiens
tttactgtctcagagagacaaa

SEQ ID NO: 7756077 - DNA, 22 bp, Homo sapiens
tttagttattgcacagaattag

SEQ ID NO: 7756078 - DNA, 21 bp, Homo sapiens
tttattaacaactgtggacgt

SEQ ID NO: 7756079 - DNA, 22 bp, Homo sapiens
tttatttcttagtttgccacag

SEQ ID NO: 7756080 - DNA, 22 bp, Homo sapiens
tttatttcactctccggatact

SEQ ID NO: 7756081 - DNA, 22 bp, Homo sapiens
tttatttgaatcaggggagaat

SEQ ID NO: 7756082 - DNA, 22 bp, Homo sapiens
tttatttggcatctctgccaag

SEQ ID NO: 7756083 - DNA, 22 bp, Homo sapiens
tttatttggcatccagggagaa

SEQ ID NO: 7756084 - DNA, 22 bp, Homo sapiens
tttattagtgcttgtatcactg

SEQ ID NO: 7756085 - DNA, 22 bp, Homo sapiens
tttattagtgcttgtatcactg

SEQ ID NO: 7756086 - DNA, 22 bp, Homo sapiens
tttattatagtggtggggactg

SEQ ID NO: 7756087 - DNA, 22 bp, Homo sapiens
tttattagattatcaaagaggt

SEQ ID NO: 7756088 - DNA, 22 bp, Homo sapiens
tttattagattatcaaagaggt

SEQ ID NO: 7756089 - DNA, 22 bp, Homo sapiens
tttattattctctggagaatgt

SEQ ID NO: 7756090 - DNA, 22 bp, Homo sapiens
tttcttcagagagagctttccc

SEQ ID NO: 7756091 - DNA, 22 bp, Homo sapiens
tttcttctaggactaataagag

SEQ ID NO: 7756092 - DNA, 22 bp, Homo sapiens
tttctctgttctctaactgtaa

SEQ ID NO: 7756093 - DNA, 19 bp, Homo sapiens
tttctctgtgcaccttttc

SEQ ID NO: 7756094 - DNA, 22 bp, Homo sapiens
tttcagcactttaggcagcagg

SEQ ID NO: 7756095 - DNA, 22 bp, Homo sapiens
tttctaagtaaacacagcatac

SEQ ID NO: 7756096 - DNA, 21 bp, Homo sapiens
tttctaagtaactggcagcat

SEQ ID NO: 7756097 - DNA, 22 bp, Homo sapiens
tttcctgttctagttgttgcca

SEQ ID NO: 7756098 - DNA, 22 bp, Homo sapiens
tttcctgtcctggtacttggca

SEQ ID NO: 7756099 - DNA, 22 bp, Homo sapiens
tttctcatctggaaacagtgct

SEQ ID NO: 7756100 - DNA, 22 bp, Homo sapiens
caaggccttcgtctcctagctt

SEQ ID NO: 7756101 - DNA, 22 bp, Homo sapiens
gctggaggcagttcagacacca

SEQ ID NO: 7756102 - DNA, 22 bp, Homo sapiens
gctggaggatggactggaagaa

SEQ ID NO: 7756103 - DNA, 22 bp, Homo sapiens
ggaaggggagctggaaagggta

SEQ ID NO: 7756104 - DNA, 22 bp, Homo sapiens
ggaaggggagctaaatctactg

SEQ ID NO: 7756105 - DNA, 22 bp, Homo sapiens
ggcagggcaggaaagtcaggaa

SEQ ID NO: 7756106 - DNA, 22 bp, Homo sapiens
ggaggtgacgaaaagaaattgt

SEQ ID NO: 7756107 - DNA, 22 bp, Homo sapiens
cacagtgttccagagcagtggt

SEQ ID NO: 7756108 - DNA, 22 bp, Homo sapiens
gtccagccaccctggaggcacg

SEQ ID NO: 7756109 - DNA, 22 bp, Homo sapiens
cagccctcaggtcctcagcagc

SEQ ID NO: 7756110 - DNA, 22 bp, Homo sapiens
cagcccctccctcaggcaggtg

SEQ ID NO: 7756111 - DNA, 19 bp, Homo sapiens
gtccctgggcagaggcacc

SEQ ID NO: 7756112 - DNA, 22 bp, Homo sapiens
cagcctggattgcagaatgcta

SEQ ID NO: 7756113 - DNA, 23 bp, Homo sapiens
cagccctggagatgtgggaggca

SEQ ID NO: 7756114 - DNA, 22 bp, Homo sapiens
cagccctgcttccccgctagtt

SEQ ID NO: 7756115 - DNA, 22 bp, Homo sapiens
cagccctggaacagctgactca

SEQ ID NO: 7756116 - DNA, 22 bp, Homo sapiens
cagccctgcagccatggcctgt

SEQ ID NO: 7756117 - DNA, 22 bp, Homo sapiens
cagccctgctcttagtgtctcc

SEQ ID NO: 7756118 - DNA, 22 bp, Homo sapiens
cagccctgctgacactgtctga

SEQ ID NO: 7756119 - DNA, 22 bp, Homo sapiens
ggggagcaatagttgaggtgtg

SEQ ID NO: 7756120 - DNA, 22 bp, Homo sapiens
ggggagcagaagcagcaacaac

SEQ ID NO: 7756121 - DNA, 22 bp, Homo sapiens
cagacctgggtccctggcctgt

SEQ ID NO: 7756122 - DNA, 22 bp, Homo sapiens
cagacctggaaaacaggcttgc

SEQ ID NO: 7756123 - DNA, 22 bp, Homo sapiens
cagagcctccctcctctgccat

SEQ ID NO: 7756124 - DNA, 22 bp, Homo sapiens
cagagcctcatcatccactcca

SEQ ID NO: 7756125 - DNA, 22 bp, Homo sapiens
cagagcctaaaacgactccact

SEQ ID NO: 7756126 - DNA, 22 bp, Homo sapiens
atgatgaagagtaacaggctga

SEQ ID NO: 7756127 - DNA, 22 bp, Homo sapiens
atgatgctgtttatcatatact

SEQ ID NO: 7756128 - DNA, 22 bp, Homo sapiens
cttcttgtcaatttgccattgt

SEQ ID NO: 7756129 - DNA, 22 bp, Homo sapiens
atgaaaagttcgatctagaagg

SEQ ID NO: 7756130 - DNA, 22 bp, Homo sapiens
gacacaaagtttgtcagaaatt

SEQ ID NO: 7756131 - DNA, 22 bp, Homo sapiens
gacaccagcaaggctgtgagga

SEQ ID NO: 7756132 - DNA, 22 bp, Homo sapiens
atgttggagtcgtaaggcatgg

SEQ ID NO: 7756133 - DNA, 22 bp, Homo sapiens
atgtagaagctgacagtgctgt

SEQ ID NO: 7756134 - DNA, 22 bp, Homo sapiens
atggagggtggtaagacagaga

SEQ ID NO: 7756135 - DNA, 22 bp, Homo sapiens
atggagggaaaagtggagagcc

SEQ ID NO: 7756136 - DNA, 21 bp, Homo sapiens
atggagggaccagggaagcag

SEQ ID NO: 7756137 - DNA, 22 bp, Homo sapiens
gaggagaagctaagaaacacag

SEQ ID NO: 7756138 - DNA, 22 bp, Homo sapiens
gaggagaaatttggggacctga

SEQ ID NO: 7756139 - DNA, 22 bp, Homo sapiens
gaggagaagctattggaaggac

SEQ ID NO: 7756140 - DNA, 22 bp, Homo sapiens
gaggagaagggcacggagaaaa

SEQ ID NO: 7756141 - DNA, 22 bp, Homo sapiens
gaggagaatgcgcaccacatat

SEQ ID NO: 7756142 - DNA, 22 bp, Homo sapiens
attcataacggcaaatgtcacc

SEQ ID NO: 7756143 - DNA, 22 bp, Homo sapiens
attagtgttcttatcttctagg

SEQ ID NO: 7756144 - DNA, 22 bp, Homo sapiens
attagtgtctgtgaataattct

SEQ ID NO: 7756145 - DNA, 22 bp, Homo sapiens
attagtgtacatctcacacgca

SEQ ID NO: 7756146 - DNA, 22 bp, Homo sapiens
attccttgggctgccttattat

SEQ ID NO: 7756147 - DNA, 22 bp, Homo sapiens
attccttgggaattattgaatg

SEQ ID NO: 7756148 - DNA, 22 bp, Homo sapiens
attccttggcattctggacttg

SEQ ID NO: 7756149 - DNA, 22 bp, Homo sapiens
attccttgtttcactgaaaagg

SEQ ID NO: 7756150 - DNA, 22 bp, Homo sapiens
attccttgtatatctacatgca

SEQ ID NO: 7756151 - DNA, 22 bp, Homo sapiens
attccttgcacatcagatagtt

SEQ ID NO: 7756152 - DNA, 22 bp, Homo sapiens
attccttggaacagatgcgaag

SEQ ID NO: 7756153 - DNA, 22 bp, Homo sapiens
attccttgctctcatcaacctt

SEQ ID NO: 7756154 - DNA, 22 bp, Homo sapiens
gcagtgttacttggagtactaa

SEQ ID NO: 7756155 - DNA, 22 bp, Homo sapiens
gcagtgttaccttgggctggtt

SEQ ID NO: 7756156 - DNA, 22 bp, Homo sapiens
gcagtgttaaacaactgctgct

SEQ ID NO: 7756157 - DNA, 22 bp, Homo sapiens
gcagtgttaatgcgagtgttca

SEQ ID NO: 7756158 - DNA, 22 bp, Homo sapiens
gcagtgttacctcttcagtggg

SEQ ID NO: 7756159 - DNA, 22 bp, Homo sapiens
gcagtgttacttggtttgcaga

SEQ ID NO: 7756160 - DNA, 22 bp, Homo sapiens
gccaagagaatgtgagagaaat

SEQ ID NO: 7756161 - DNA, 22 bp, Homo sapiens
caaatgcatgagaaataagagg

SEQ ID NO: 7756162 - DNA, 22 bp, Homo sapiens
atcagaagcttgtagtctctct

SEQ ID NO: 7756163 - DNA, 22 bp, Homo sapiens
atatttaaacagggtaccaata

SEQ ID NO: 7756164 - DNA, 22 bp, Homo sapiens
atattgtactagggttacatgt

SEQ ID NO: 7756165 - DNA, 22 bp, Homo sapiens
atatttaactggtcccaatata

SEQ ID NO: 7756166 - DNA, 22 bp, Homo sapiens
atattcatcgtgtagaaatact

SEQ ID NO: 7756167 - DNA, 22 bp, Homo sapiens
atcagagattgtagtatgtgca

SEQ ID NO: 7756168 - DNA, 22 bp, Homo sapiens
cttcctcaggcattagctggac

SEQ ID NO: 7756169 - DNA, 22 bp, Homo sapiens
atacagtgaatacttacagtgt

SEQ ID NO: 7756170 - DNA, 22 bp, Homo sapiens
atacagtgccccttttcacatg

SEQ ID NO: 7756171 - DNA, 22 bp, Homo sapiens
atacagtgtactatttagcagt

SEQ ID NO: 7756172 - DNA, 22 bp, Homo sapiens
ctgcatcctaacctccatgcag

SEQ ID NO: 7756173 - DNA, 22 bp, Homo sapiens
ctgcatcctggaaatagctaag

SEQ ID NO: 7756174 - DNA, 22 bp, Homo sapiens
ctgctgcaatctggcttccatg

SEQ ID NO: 7756175 - DNA, 22 bp, Homo sapiens
agttactttctgatcagtgtgt

SEQ ID NO: 7756176 - DNA, 22 bp, Homo sapiens
ctctcagtaaatttctgcccca

SEQ ID NO: 7756177 - DNA, 22 bp, Homo sapiens
ctctcagtcctgcgcgcctctg

SEQ ID NO: 7756178 - DNA, 22 bp, Homo sapiens
ctctcagtgccacacagccatt

SEQ ID NO: 7756179 - DNA, 22 bp, Homo sapiens
ctctcagtgcctgccctaggct

SEQ ID NO: 7756180 - DNA, 22 bp, Homo sapiens
agtcctggacttggagtcaggg

SEQ ID NO: 7756181 - DNA, 18 bp, Homo sapiens
agtcctggagatcaccaa

SEQ ID NO: 7756182 - DNA, 22 bp, Homo sapiens
ctcatggagggagtgctcttcc

SEQ ID NO: 7756183 - DNA, 22 bp, Homo sapiens
agtcctggccccaaggaaggat

SEQ ID NO: 7756184 - DNA, 19 bp, Homo sapiens
agtcctggcctgggggacc

SEQ ID NO: 7756185 - DNA, 22 bp, Homo sapiens
agtccagggctctctgtgggat

SEQ ID NO: 7756186 - DNA, 22 bp, Homo sapiens
agtccagggcttagtcagcggg

SEQ ID NO: 7756187 - DNA, 19 bp, Homo sapiens
agtccatgaatggaggatg

SEQ ID NO: 7756188 - DNA, 20 bp, Homo sapiens
cagtccaggctagaaaacaa

SEQ ID NO: 7756189 - DNA, 22 bp, Homo sapiens
cagtccagctcatcagtggcac

SEQ ID NO: 7756190 - DNA, 22 bp, Homo sapiens
cagtccaggcctggaggagcca

SEQ ID NO: 7756191 - DNA, 22 bp, Homo sapiens
cagtccagccagtagggtgtgg

SEQ ID NO: 7756192 - DNA, 22 bp, Homo sapiens
catgagaatgaagaagacttaa

SEQ ID NO: 7756193 - DNA, 22 bp, Homo sapiens
cagctgttcttgggacagacag

SEQ ID NO: 7756194 - DNA, 22 bp, Homo sapiens
cagctgttcacatttccaaaac

SEQ ID NO: 7756195 - DNA, 22 bp, Homo sapiens
cagctgttcggggctggcatgt

SEQ ID NO: 7756196 - DNA, 22 bp, Homo sapiens
cagctgttactctgagtaaatg

SEQ ID NO: 7756197 - DNA, 22 bp, Homo sapiens
agcttcctgttgagagagggag

SEQ ID NO: 7756198 - DNA, 22 bp, Homo sapiens
agcttcctgatgcaagagggct

SEQ ID NO: 7756199 - DNA, 23 bp, Homo sapiens
aggaagaggcaatttctcttaga

SEQ ID NO: 7756200 - DNA, 18 bp, Homo sapiens
cagggctgtggggtcact

SEQ ID NO: 7756201 - DNA, 22 bp, Homo sapiens
cagggctggctgtggcaatctc

SEQ ID NO: 7756202 - DNA, 22 bp, Homo sapiens
aggaaaggcctcagcagaaacc

SEQ ID NO: 7756203 - DNA, 22 bp, Homo sapiens
aggaagaaaactaattagatgg

SEQ ID NO: 7756204 - DNA, 22 bp, Homo sapiens
ccagccctgattagagaatgtc

SEQ ID NO: 7756205 - DNA, 22 bp, Homo sapiens
ccagccctgaaccctgctgcat

SEQ ID NO: 7756206 - DNA, 22 bp, Homo sapiens
ccagccctcctccatcagagga

SEQ ID NO: 7756207 - DNA, 22 bp, Homo sapiens
ccagctccaggactgggagctg

SEQ ID NO: 7756208 - DNA, 22 bp, Homo sapiens
ccagctccaggtagatgggcag

SEQ ID NO: 7756209 - DNA, 23 bp, Homo sapiens
ccagctcccaggtctgaggactg

SEQ ID NO: 7756210 - DNA, 22 bp, Homo sapiens
ccagctcccctcagcaggtaat

SEQ ID NO: 7756211 - DNA, 22 bp, Homo sapiens
ccaggaggtgctggaagaaagc

SEQ ID NO: 7756212 - DNA, 20 bp, Homo sapiens
ccaggcctgggcctgctcta

SEQ ID NO: 7756213 - DNA, 22 bp, Homo sapiens
ccaggcctgtgcaaggagggag

SEQ ID NO: 7756214 - DNA, 22 bp, Homo sapiens
ccaggcctgtgttgtgtggagg

SEQ ID NO: 7756215 - DNA, 22 bp, Homo sapiens
ccaggccttctgaggacactct

SEQ ID NO: 7756216 - DNA, 22 bp, Homo sapiens
agggcagactaggatggaagtg

SEQ ID NO: 7756217 - DNA, 22 bp, Homo sapiens
agggcagaagtacagacactta

SEQ ID NO: 7756218 - DNA, 22 bp, Homo sapiens
agggggtgatcaaggtgcggcg

SEQ ID NO: 7756219 - DNA, 22 bp, Homo sapiens
agggggtgcatttgtgaatgaa

SEQ ID NO: 7756220 - DNA, 22 bp, Homo sapiens
agggggtgcccagatgaaggat

SEQ ID NO: 7756221 - DNA, 22 bp, Homo sapiens
agggggtgggaagtctagaatc

SEQ ID NO: 7756222 - DNA, 22 bp, Homo sapiens
cctctgtgtcagggaagagact

SEQ ID NO: 7756223 - DNA, 22 bp, Homo sapiens
aggaaaggttcagtgattgaaa

SEQ ID NO: 7756224 - DNA, 20 bp, Homo sapiens
acagtgttaggtttttcctt

SEQ ID NO: 7756225 - DNA, 22 bp, Homo sapiens
acagtgttcactaaggttagct

SEQ ID NO: 7756226 - DNA, 22 bp, Homo sapiens
acagtgttcaaaccactaggct

SEQ ID NO: 7756227 - DNA, 22 bp, Homo sapiens
acagtgttatttctgagtaatg

SEQ ID NO: 7756228 - DNA, 20 bp, Homo sapiens
acagtgttagttatcatctc

SEQ ID NO: 7756229 - DNA, 22 bp, Homo sapiens
acagtgttcctttgttgtgact

SEQ ID NO: 7756230 - DNA, 22 bp, Homo sapiens
acagtgttcacttaacaatgga

SEQ ID NO: 7756231 - DNA, 22 bp, Homo sapiens
acagtgttctcttcctgtatag

SEQ ID NO: 7756232 - DNA, 22 bp, Homo sapiens
acagtgttctgaaagttgaggg

SEQ ID NO: 7756233 - DNA, 22 bp, Homo sapiens
accactgcccatggtgaaaact

SEQ ID NO: 7756234 - DNA, 22 bp, Homo sapiens
acattaacaccataagtgtgtt

SEQ ID NO: 7756235 - DNA, 22 bp, Homo sapiens
acattaacaccgtgagtttggt

SEQ ID NO: 7756236 - DNA, 22 bp, Homo sapiens
acattaacactggtgctggtgt

SEQ ID NO: 7756237 - DNA, 22 bp, Homo sapiens
aggggtgtgcatcctggaggat

SEQ ID NO: 7756238 - DNA, 22 bp, Homo sapiens
acctcagttcaattcagttaga

SEQ ID NO: 7756239 - DNA, 22 bp, Homo sapiens
aggggagccgaggggcatctgt

SEQ ID NO: 7756240 - DNA, 22 bp, Homo sapiens
agggaggagtcctcaaagtcat

SEQ ID NO: 7756241 - DNA, 22 bp, Homo sapiens
agaaaagggcaggagggataca

SEQ ID NO: 7756242 - DNA, 22 bp, Homo sapiens
agaaatctttcctgaagtgttt

SEQ ID NO: 7756243 - DNA, 22 bp, Homo sapiens
agaaatcttggagtctgtggta

SEQ ID NO: 7756244 - DNA, 22 bp, Homo sapiens
atagaagatagcttttgtttct

SEQ ID NO: 7756245 - DNA, 22 bp, Homo sapiens
atagaaatgtattttggactag

SEQ ID NO: 7756246 - DNA, 22 bp, Homo sapiens
ataggagatcaatatgcaattt

SEQ ID NO: 7756247 - DNA, 22 bp, Homo sapiens
atagtgtcagaaaatcataaga

SEQ ID NO: 7756248 - DNA, 22 bp, Homo sapiens
agtgtctttcatatcctccatc

SEQ ID NO: 7756249 - DNA, 22 bp, Homo sapiens
agtgtgtactcatatacttcca

SEQ ID NO: 7756250 - DNA, 22 bp, Homo sapiens
agtgagagtattaatgtgaact

SEQ ID NO: 7756251 - DNA, 21 bp, Homo sapiens
agtccaggaggaggccaggtt

SEQ ID NO: 7756252 - DNA, 22 bp, Homo sapiens
agtccaggagttgggtgacatt

SEQ ID NO: 7756253 - DNA, 22 bp, Homo sapiens
agtcctgggttctggtgttttg

SEQ ID NO: 7756254 - DNA, 22 bp, Homo sapiens
actcagcttcctacagctagaa

SEQ ID NO: 7756255 - DNA, 22 bp, Homo sapiens
actcagctcaggagctggctgg

SEQ ID NO: 7756256 - DNA, 22 bp, Homo sapiens
actcagctgatgaagcacaagt

SEQ ID NO: 7756257 - DNA, 22 bp, Homo sapiens
agcaaggggcagtgaaagtgtg

SEQ ID NO: 7756258 - DNA, 22 bp, Homo sapiens
agatgagaatttttagagtgct

SEQ ID NO: 7756259 - DNA, 22 bp, Homo sapiens
agatgacagctacgggatgaaa

SEQ ID NO: 7756260 - DNA, 22 bp, Homo sapiens
agatgacagccaaggagatgaa

SEQ ID NO: 7756261 - DNA, 22 bp, Homo sapiens
agagattacagcagggtccagc

SEQ ID NO: 7756262 - DNA, 18 bp, Homo sapiens
agagatgggagttggaaa

SEQ ID NO: 7756263 - DNA, 19 bp, Homo sapiens
agcctggagggctggtcac

SEQ ID NO: 7756264 - DNA, 22 bp, Homo sapiens
agccctgggctgtagataagca

SEQ ID NO: 7756265 - DNA, 22 bp, Homo sapiens
cagcgctgtgggaacagggcta

SEQ ID NO: 7756266 - DNA, 22 bp, Homo sapiens
cagcctctgagccttggcagat

SEQ ID NO: 7756267 - DNA, 22 bp, Homo sapiens
cagcactgcttcgcagccaggg

SEQ ID NO: 7756268 - DNA, 22 bp, Homo sapiens
cagccagctggcactgtgagta

SEQ ID NO: 7756269 - DNA, 22 bp, Homo sapiens
cagccctggtgaggttggctat

SEQ ID NO: 7756270 - DNA, 22 bp, Homo sapiens
caaggaaggagagatgatgggt

SEQ ID NO: 7756271 - DNA, 22 bp, Homo sapiens
cacagaaaaaggcttgaaaatc

SEQ ID NO: 7756272 - DNA, 22 bp, Homo sapiens
aaatattggtaggatgcttgtt

SEQ ID NO: 7756273 - DNA, 22 bp, Homo sapiens
aaatgatgattaaaatgaggta

SEQ ID NO: 7756274 - DNA, 22 bp, Homo sapiens
aaatgaaatgagtgcctggagg

SEQ ID NO: 7756275 - DNA, 22 bp, Homo sapiens
aaatgatgttataagaccagga

SEQ ID NO: 7756276 - DNA, 22 bp, Homo sapiens
aagagagaccatgggggacagg

SEQ ID NO: 7756277 - DNA, 22 bp, Homo sapiens
aaattgctctttaaaagtactg

SEQ ID NO: 7756278 - DNA, 22 bp, Homo sapiens
aaaggagataaagggcccttca

SEQ ID NO: 7756279 - DNA, 22 bp, Homo sapiens
aaaggagagtgagtcagatgcc

SEQ ID NO: 7756280 - DNA, 22 bp, Homo sapiens
aaaggagagtaggttactccat

SEQ ID NO: 7756281 - DNA, 22 bp, Homo sapiens
aaaggagacttcagatctcctt

SEQ ID NO: 7756282 - DNA, 22 bp, Homo sapiens
aaaggagacagtcttacctgga

SEQ ID NO: 7756283 - DNA, 22 bp, Homo sapiens
aaaggagaaaacatacaggact

SEQ ID NO: 7756284 - DNA, 19 bp, Homo sapiens
aaagttttattctcatttg

SEQ ID NO: 7756285 - DNA, 22 bp, Homo sapiens
aaatacacgtacatgtgtaaaa

SEQ ID NO: 7756286 - DNA, 22 bp, Homo sapiens
aaaatactgtggagtgttgaaa

SEQ ID NO: 7756287 - DNA, 22 bp, Homo sapiens
aaaatgagccatgaaccaacca

SEQ ID NO: 7756288 - DNA, 22 bp, Homo sapiens
aaaacactgcaaagctgattgg

SEQ ID NO: 7756289 - DNA, 22 bp, Homo sapiens
aaaagatgaaatggtgtcttgg

SEQ ID NO: 7756290 - DNA, 22 bp, Homo sapiens
aaggagaagggtaatcaacaca

SEQ ID NO: 7756291 - DNA, 22 bp, Homo sapiens
aaggagaagtctgttgagattg

SEQ ID NO: 7756292 - DNA, 22 bp, Homo sapiens
aacagtgtcaggattacagata

SEQ ID NO: 7756293 - DNA, 22 bp, Homo sapiens
aacagtgtttttcttcagcact

SEQ ID NO: 7756294 - DNA, 22 bp, Homo sapiens
aatgaaatgaagatatgatcag

SEQ ID NO: 7756295 - DNA, 22 bp, Homo sapiens
aatgcacctaccttgattctgc

SEQ ID NO: 7756296 - DNA, 22 bp, Homo sapiens
aatgaaatagttggctgtagag

SEQ ID NO: 7756297 - DNA, 17 bp, Homo sapiens
aatctcagtggcttaag

SEQ ID NO: 7756298 - DNA, 20 bp, Homo sapiens
aatctcagtatcctatgcaa

SEQ ID NO: 7756299 - DNA, 22 bp, Homo sapiens
aatctcactcaaagaattctct

SEQ ID NO: 7756300 - DNA, 22 bp, Homo sapiens
aatattgagaaccagcatgttt

SEQ ID NO: 7756301 - DNA, 22 bp, Homo sapiens
aagccagtaagtttttgtcatt

SEQ ID NO: 7756302 - DNA, 22 bp, Homo sapiens
agcaaatacttgaataaaaaga

SEQ ID NO: 7756303 - DNA, 22 bp, Homo sapiens
agatgcagatttggattcagga

SEQ ID NO: 7756304 - DNA, 22 bp, Homo sapiens
agagaaatgattcctgggcaga

SEQ ID NO: 7756305 - DNA, 22 bp, Homo sapiens
agagaaggcatagaacttgagt

SEQ ID NO: 7756306 - DNA, 22 bp, Homo sapiens
agagaagggcctgtatgtaatc

SEQ ID NO: 7756307 - DNA, 22 bp, Homo sapiens
agagaaggggtaaagagtcctg

SEQ ID NO: 7756308 - DNA, 22 bp, Homo sapiens
agagcacagaagttatatgtta

SEQ ID NO: 7756309 - DNA, 22 bp, Homo sapiens
aatcaagagttgtgtaatattt

SEQ ID NO: 7756310 - DNA, 22 bp, Homo sapiens
acttttcaaatgggaaactcag

SEQ ID NO: 7756311 - DNA, 22 bp, Homo sapiens
agaaagggagcgtggatcaatt

SEQ ID NO: 7756312 - DNA, 22 bp, Homo sapiens
agaaagggaactggcaaagcca

SEQ ID NO: 7756313 - DNA, 22 bp, Homo sapiens
actgtctcctcatcatgcctgg

SEQ ID NO: 7756314 - DNA, 18 bp, Homo sapiens
actctttctgcccacagg

SEQ ID NO: 7756315 - DNA, 20 bp, Homo sapiens
aagggagaataatgattgta

SEQ ID NO: 7756316 - DNA, 22 bp, Homo sapiens
aagggatgcaggaaagaaggtt

SEQ ID NO: 7756317 - DNA, 22 bp, Homo sapiens
aaggaaggttcatagtcaaaga

SEQ ID NO: 7756318 - DNA, 22 bp, Homo sapiens
aaggaggcctggcagatgaaga

SEQ ID NO: 7756319 - DNA, 22 bp, Homo sapiens
aaggatgattggtaatgacact

SEQ ID NO: 7756320 - DNA, 22 bp, Homo sapiens
aaggatgaacattaatacatca

SEQ ID NO: 7756321 - DNA, 22 bp, Homo sapiens
tagaaacattcagttgcagtcc

SEQ ID NO: 7756322 - DNA, 22 bp, Homo sapiens
tagaattgggcctaacttccat

SEQ ID NO: 7756323 - DNA, 22 bp, Homo sapiens
tagaaaggcaagcgtgaaatat

SEQ ID NO: 7756324 - DNA, 23 bp, Homo sapiens
tatgagaattaagtgcgagtgcc

SEQ ID NO: 7756325 - DNA, 22 bp, Homo sapiens
tatgagaatctgcagtatgctt

SEQ ID NO: 7756326 - DNA, 22 bp, Homo sapiens
tatgagaataatctggtaaata

SEQ ID NO: 7756327 - DNA, 22 bp, Homo sapiens
tatgagaatttgctaattggct

SEQ ID NO: 7756328 - DNA, 22 bp, Homo sapiens
tatgtcctgctactctctcatg

SEQ ID NO: 7756329 - DNA, 22 bp, Homo sapiens
tatgtacataacatgaaatgca

SEQ ID NO: 7756330 - DNA, 22 bp, Homo sapiens
tattcatgagataggcagtttt

SEQ ID NO: 7756331 - DNA, 22 bp, Homo sapiens
tattgaattagaccctaaaatg

SEQ ID NO: 7756332 - DNA, 22 bp, Homo sapiens
tatgagaaattatacctaggtt

SEQ ID NO: 7756333 - DNA, 22 bp, Homo sapiens
tatgagaaagtcgtatgtctcc

SEQ ID NO: 7756334 - DNA, 22 bp, Homo sapiens
tatgagaaaggagaatgacttt

SEQ ID NO: 7756335 - DNA, 21 bp, Homo sapiens
tatgagaaaactgaggtgcat

SEQ ID NO: 7756336 - DNA, 22 bp, Homo sapiens
tatgagaaaataaatatctgtt

SEQ ID NO: 7756337 - DNA, 23 bp, Homo sapiens
tatgagaacccatacgctgtctt

SEQ ID NO: 7756338 - DNA, 22 bp, Homo sapiens
tatgagaacaagaacaatctcc

SEQ ID NO: 7756339 - DNA, 22 bp, Homo sapiens
tatgagaacgggggcgtgtggg

SEQ ID NO: 7756340 - DNA, 22 bp, Homo sapiens
tatgagaaattgctgatatttg

SEQ ID NO: 7756341 - DNA, 22 bp, Homo sapiens
tatgagaaggtatggtgacttg

SEQ ID NO: 7756342 - DNA, 18 bp, Homo sapiens
tatgagaagattagcaat

SEQ ID NO: 7756343 - DNA, 22 bp, Homo sapiens
tatgagaactgacagagtgcca

SEQ ID NO: 7756344 - DNA, 22 bp, Homo sapiens
tatgagaagaacaggtgacttt

SEQ ID NO: 7756345 - DNA, 22 bp, Homo sapiens
taaaatgatctctcatgttctt

SEQ ID NO: 7756346 - DNA, 22 bp, Homo sapiens
taactctgaatcctcacagcag

SEQ ID NO: 7756347 - DNA, 22 bp, Homo sapiens
taactctgcttgttctctgagt

SEQ ID NO: 7756348 - DNA, 23 bp, Homo sapiens
taactctgtgaagggtgactggg

SEQ ID NO: 7756349 - DNA, 22 bp, Homo sapiens
taatagaaaggtattttttgca

SEQ ID NO: 7756350 - DNA, 22 bp, Homo sapiens
tacatttgctttgattttcagc

SEQ ID NO: 7756351 - DNA, 23 bp, Homo sapiens
tcatggaactgggcaatcttgaa

SEQ ID NO: 7756352 - DNA, 22 bp, Homo sapiens
tcagtgttcgctcagggactcc

SEQ ID NO: 7756353 - DNA, 22 bp, Homo sapiens
tcagtgttcagcggtgtgtgca

SEQ ID NO: 7756354 - DNA, 22 bp, Homo sapiens
tcagtgttcagggaccaggtcc

SEQ ID NO: 7756355 - DNA, 16 bp, Homo sapiens
tcagtgttccagaata

SEQ ID NO: 7756356 - DNA, 22 bp, Homo sapiens
tcagtgttattagatgaggttt

SEQ ID NO: 7756357 - DNA, 22 bp, Homo sapiens
tcagtgcagggtgggagagaga

SEQ ID NO: 7756358 - DNA, 22 bp, Homo sapiens
tcagtgttaatcagtggtacct

SEQ ID NO: 7756359 - DNA, 22 bp, Homo sapiens
tcagtgttagacaagtttggaa

SEQ ID NO: 7756360 - DNA, 22 bp, Homo sapiens
tcagtgttacattatatagaac

SEQ ID NO: 7756361 - DNA, 22 bp, Homo sapiens
tcaggccttcagacctggcccg

SEQ ID NO: 7756362 - DNA, 22 bp, Homo sapiens
tcaggcctgcaggcttcctgga

SEQ ID NO: 7756363 - DNA, 22 bp, Homo sapiens
tcagctctcacagatctcaacc

SEQ ID NO: 7756364 - DNA, 22 bp, Homo sapiens
tcagctctctgggctcgaacct

SEQ ID NO: 7756365 - DNA, 22 bp, Homo sapiens
tcagctctacctgggagctgtc

SEQ ID NO: 7756366 - DNA, 22 bp, Homo sapiens
tcagagccctgctcctccccaa

SEQ ID NO: 7756367 - DNA, 22 bp, Homo sapiens
tcagagcccctccgctgtccca

SEQ ID NO: 7756368 - DNA, 23 bp, Homo sapiens
tcagagaactcgggcagatgacc

SEQ ID NO: 7756369 - DNA, 22 bp, Homo sapiens
tcccagtgaggtcctggctgtc

SEQ ID NO: 7756370 - DNA, 22 bp, Homo sapiens
tccagctctggcttggctagct

SEQ ID NO: 7756371 - DNA, 23 bp, Homo sapiens
tccagctcccttcaatggcactg

SEQ ID NO: 7756372 - DNA, 22 bp, Homo sapiens
tccagctcagatgcagggatca

SEQ ID NO: 7756373 - DNA, 22 bp, Homo sapiens
gctgtgctgattcattccctgc

SEQ ID NO: 7756374 - DNA, 20 bp, Homo sapiens
gctttctatgagatggactg

SEQ ID NO: 7756375 - DNA, 22 bp, Homo sapiens
ggagagaattccatggacatgt

SEQ ID NO: 7756376 - DNA, 22 bp, Homo sapiens
ggagacatgcagactgagatac

SEQ ID NO: 7756377 - DNA, 22 bp, Homo sapiens
ggagagaactgacctgaaagga

SEQ ID NO: 7756378 - DNA, 22 bp, Homo sapiens
ggagagaaattgaggtagcaag

SEQ ID NO: 7756379 - DNA, 22 bp, Homo sapiens
gctccagtggactgggggaggc

SEQ ID NO: 7756380 - DNA, 22 bp, Homo sapiens
gctgccttccaaagagttttat

SEQ ID NO: 7756381 - DNA, 22 bp, Homo sapiens
gcccagctgagaagcgcggggc

SEQ ID NO: 7756382 - DNA, 22 bp, Homo sapiens
gcccagctgcaccctggtgggt

SEQ ID NO: 7756383 - DNA, 22 bp, Homo sapiens
gcccagcccctgggtggacgtg

SEQ ID NO: 7756384 - DNA, 22 bp, Homo sapiens
gcccagctgtctggcagggatg

SEQ ID NO: 7756385 - DNA, 22 bp, Homo sapiens
gcccagctttttgaggcaggca

SEQ ID NO: 7756386 - DNA, 22 bp, Homo sapiens
gccaccccaacctccctaagtt

SEQ ID NO: 7756387 - DNA, 22 bp, Homo sapiens
gccacccccaagtaggtggtct

SEQ ID NO: 7756388 - DNA, 22 bp, Homo sapiens
gccaccccataggtgttaggtg

SEQ ID NO: 7756389 - DNA, 21 bp, Homo sapiens
gccacccctggcacaggtgct

SEQ ID NO: 7756390 - DNA, 22 bp, Homo sapiens
gcaggggagtggatgatggatt

SEQ ID NO: 7756391 - DNA, 23 bp, Homo sapiens
gtaaaatacgcagtgcagtgtga

SEQ ID NO: 7756392 - DNA, 17 bp, Homo sapiens
gtcctgggaggagagag

SEQ ID NO: 7756393 - DNA, 22 bp, Homo sapiens
gtcctgggaactggacagctaa

SEQ ID NO: 7756394 - DNA, 22 bp, Homo sapiens
gtgaaggataaggatctaaatt

SEQ ID NO: 7756395 - DNA, 22 bp, Homo sapiens
gtgaaggactgaatgaaaatgt

SEQ ID NO: 7756396 - DNA, 22 bp, Homo sapiens
gtgaaggaggggccacagatat

SEQ ID NO: 7756397 - DNA, 22 bp, Homo sapiens
gtgaaggaccaatatgactcat

SEQ ID NO: 7756398 - DNA, 22 bp, Homo sapiens
ggggaagaatggcagaaaacat

SEQ ID NO: 7756399 - DNA, 22 bp, Homo sapiens
ggggaagaggcgtgatggatcc

SEQ ID NO: 7756400 - DNA, 22 bp, Homo sapiens
ggctgaaaggtgggaggatggc

SEQ ID NO: 7756401 - DNA, 20 bp, Homo sapiens
ggctgaaagtagaaagtatt

SEQ ID NO: 7756402 - DNA, 22 bp, Homo sapiens
gggatggggagctggaaagggg

SEQ ID NO: 7756403 - DNA, 23 bp, Homo sapiens
gggagaatatgaggatgatggtg

SEQ ID NO: 7756404 - DNA, 22 bp, Homo sapiens
gggagaggttacccgagcaact

SEQ ID NO: 7756405 - DNA, 22 bp, Homo sapiens
gggagacacgctgcaggcataa

SEQ ID NO: 7756406 - DNA, 22 bp, Homo sapiens
gggagacaaggagaaccaaaga

SEQ ID NO: 7756407 - DNA, 22 bp, Homo sapiens
gggagagcgcgctagggccgag

SEQ ID NO: 7756408 - DNA, 22 bp, Homo sapiens
ggcaggagggcggacaatgacc

SEQ ID NO: 7756409 - DNA, 18 bp, Homo sapiens
ggcctcagcctggccgga

SEQ ID NO: 7756410 - DNA, 22 bp, Homo sapiens
ggcctcagtttctccatgggtt

SEQ ID NO: 7756411 - DNA, 22 bp, Homo sapiens
ggcctcagtttcttcaactgta

SEQ ID NO: 7756412 - DNA, 22 bp, Homo sapiens
gaaggaagactggtttaaatgt

SEQ ID NO: 7756413 - DNA, 22 bp, Homo sapiens
gaagttctttgctccccagtac

SEQ ID NO: 7756414 - DNA, 23 bp, Homo sapiens
gaagttctttcttctcatgctgt

SEQ ID NO: 7756415 - DNA, 22 bp, Homo sapiens
gaagttctttatagcagtgtga

SEQ ID NO: 7756416 - DNA, 22 bp, Homo sapiens
gaagttctggtgtatgtgataa

SEQ ID NO: 7756417 - DNA, 22 bp, Homo sapiens
gaagttcttagtctcatttgca

SEQ ID NO: 7756418 - DNA, 22 bp, Homo sapiens
gaacagggttgggtgagagagg

SEQ ID NO: 7756419 - DNA, 22 bp, Homo sapiens
gagctgaacatcatggaaaggc

SEQ ID NO: 7756420 - DNA, 22 bp, Homo sapiens
gagctgaatcagagatattatt

SEQ ID NO: 7756421 - DNA, 22 bp, Homo sapiens
gagctgaattgaagcaaggagc

SEQ ID NO: 7756422 - DNA, 22 bp, Homo sapiens
gagacacaaacacatttagagg

SEQ ID NO: 7756423 - DNA, 22 bp, Homo sapiens
gagatgagtgggggatctctca

SEQ ID NO: 7756424 - DNA, 22 bp, Homo sapiens
gagatgaatgtaaacaaaggca

SEQ ID NO: 7756425 - DNA, 22 bp, Homo sapiens
gagaagggcttgggagtcaaca

SEQ ID NO: 7756426 - DNA, 22 bp, Homo sapiens
gagaagggatatggcttcttga

SEQ ID NO: 7756427 - DNA, 22 bp, Homo sapiens
gagaatgggaatgaaagtagca

SEQ ID NO: 7756428 - DNA, 22 bp, Homo sapiens
ctggggtgtgctcagagcaggg

SEQ ID NO: 7756429 - DNA, 22 bp, Homo sapiens
ctggcccagtctcagagtgtca

SEQ ID NO: 7756430 - DNA, 22 bp, Homo sapiens
ttcatgaatgttccatgtgagt

SEQ ID NO: 7756431 - DNA, 22 bp, Homo sapiens
ttcaggcctaatttctagcccc

SEQ ID NO: 7756432 - DNA, 22 bp, Homo sapiens
ccttccttgagaagcaattcct

SEQ ID NO: 7756433 - DNA, 22 bp, Homo sapiens
ccttcctttcagggctatgcct

SEQ ID NO: 7756434 - DNA, 22 bp, Homo sapiens
ttagaaaaatgttcagtagttt

SEQ ID NO: 7756435 - DNA, 22 bp, Homo sapiens
tgtgttctgaaggagaagagtg

SEQ ID NO: 7756436 - DNA, 22 bp, Homo sapiens
tttccttgggtctcttagtggc

SEQ ID NO: 7756437 - DNA, 22 bp, Homo sapiens
tttccttgttattatttgtcct

SEQ ID NO: 7756438 - DNA, 18 bp, Homo sapiens
tttccttgtatgaacata

SEQ ID NO: 7756439 - DNA, 22 bp, Homo sapiens
ctcctcagttgtcccatggaga

SEQ ID NO: 7756440 - DNA, 22 bp, Homo sapiens
tttgggcaggcttttccctaga

SEQ ID NO: 7756441 - DNA, 22 bp, Homo sapiens
ttttcagttactgtttatgtga

SEQ ID NO: 7756442 - DNA, 22 bp, Homo sapiens
ttttcaggtgcagtaatcatat

SEQ ID NO: 7756443 - DNA, 22 bp, Homo sapiens
tttccttgttcatttgccctat

SEQ ID NO: 7756444 - DNA, 22 bp, Homo sapiens
ctgacccttgctcgggccctgt

SEQ ID NO: 7756445 - DNA, 22 bp, Homo sapiens
ctgactctgacaggacttgtgg

SEQ ID NO: 7756446 - DNA, 22 bp, Homo sapiens
catgagaaggggtggagttaga

SEQ ID NO: 7756447 - DNA, 22 bp, Homo sapiens
catgagaaccaggtctgtgttt

SEQ ID NO: 7756448 - DNA, 20 bp, Homo sapiens
catgagaagggcagtgtgag

SEQ ID NO: 7756449 - DNA, 22 bp, Homo sapiens
tcagtgcattcatgggtggctg

SEQ ID NO: 7756450 - DNA, 22 bp, Homo sapiens
tcagtgctaaaagagctggtgt

SEQ ID NO: 7756451 - DNA, 22 bp, Homo sapiens
tcagtgctcaggggagccgagg

SEQ ID NO: 7756452 - DNA, 22 bp, Homo sapiens
tcagtgctcctaaagtgaatgc

SEQ ID NO: 7756453 - DNA, 22 bp, Homo sapiens
catagaaacttgcagcaagcac

SEQ ID NO: 7756454 - DNA, 22 bp, Homo sapiens
tcaggcctccaggttaccattt

SEQ ID NO: 7756455 - DNA, 22 bp, Homo sapiens
tcaggcctcaagctgctttaag

SEQ ID NO: 7756456 - DNA, 22 bp, Homo sapiens
catagaaatcaggtgagaatct

SEQ ID NO: 7756457 - DNA, 22 bp, Homo sapiens
cagttcttaataccatgtggtt

SEQ ID NO: 7756458 - DNA, 22 bp, Homo sapiens
cagttcttatttggccagtgtc

SEQ ID NO: 7756459 - DNA, 20 bp, Homo sapiens
tacaaacctccacactggtg

SEQ ID NO: 7756460 - DNA, 22 bp, Homo sapiens
gtgcttcctctgccaacactct

SEQ ID NO: 7756461 - DNA, 22 bp, Homo sapiens
caggcctgagacatctgagata

SEQ ID NO: 7756462 - DNA, 17 bp, Homo sapiens
cagggctgtctgcctag

SEQ ID NO: 7756463 - DNA, 22 bp, Homo sapiens
cagggctggtttgtcgaagaaa

SEQ ID NO: 7756464 - DNA, 21 bp, Homo sapiens
tgaatgcttcgtcatcctggc

SEQ ID NO: 7756465 - DNA, 21 bp, Homo sapiens
tgagaagtatgtcttcagcca

SEQ ID NO: 7756466 - DNA, 22 bp, Homo sapiens
tgagaatcatccagaggcttct

SEQ ID NO: 7756467 - DNA, 17 bp, Homo sapiens
ccaggtgggaggtgggg

SEQ ID NO: 7756468 - DNA, 22 bp, Homo sapiens
cccacccctggacaggtgagtg

SEQ ID NO: 7756469 - DNA, 22 bp, Homo sapiens
ccatgccctaaaggactggcag

SEQ ID NO: 7756470 - DNA, 22 bp, Homo sapiens
ccagtgtttccccagaagagag

SEQ ID NO: 7756471 - DNA, 22 bp, Homo sapiens
ccagtgtttccgtcagtacacg

SEQ ID NO: 7756472 - DNA, 22 bp, Homo sapiens
ccagtgtttgatgggattttca

SEQ ID NO: 7756473 - DNA, 22 bp, Homo sapiens
ccagtgttttcatcctcccttg

SEQ ID NO: 7756474 - DNA, 22 bp, Homo sapiens
ccagtgttccatggagtgatta

SEQ ID NO: 7756475 - DNA, 22 bp, Homo sapiens
ccagtgttccctcgggttcatg

SEQ ID NO: 7756476 - DNA, 22 bp, Homo sapiens
ccagtgttctggtgttcatttc

SEQ ID NO: 7756477 - DNA, 22 bp, Homo sapiens
ccagtgttgaacagtatttgga

SEQ ID NO: 7756478 - DNA, 22 bp, Homo sapiens
ccagtgtttaggaataaaatgt

SEQ ID NO: 7756479 - DNA, 22 bp, Homo sapiens
ccagtgttgcataggatgggga

SEQ ID NO: 7756480 - DNA, 22 bp, Homo sapiens
ccagtgttggaggatggcttgc

SEQ ID NO: 7756481 - DNA, 22 bp, Homo sapiens
ccagtgtttacagttgaacaaa

SEQ ID NO: 7756482 - DNA, 22 bp, Homo sapiens
ccagtcctagaagaggagtcga

SEQ ID NO: 7756483 - DNA, 22 bp, Homo sapiens
ccagtcctcagatggtctgtgc

SEQ ID NO: 7756484 - DNA, 22 bp, Homo sapiens
ccagtcctgccaccctgtctat

SEQ ID NO: 7756485 - DNA, 22 bp, Homo sapiens
ccaggaggttgaggctgcagtg

SEQ ID NO: 7756486 - DNA, 22 bp, Homo sapiens
ccaggcctgcatctgctgcgca

SEQ ID NO: 7756487 - DNA, 22 bp, Homo sapiens
ccaggcctggccaggggatgcc

SEQ ID NO: 7756488 - DNA, 22 bp, Homo sapiens
ccaggcctggacgggtggcctg

SEQ ID NO: 7756489 - DNA, 22 bp, Homo sapiens
ccaggcctggaccatgccaggg

SEQ ID NO: 7756490 - DNA, 22 bp, Homo sapiens
ccagctctcagcgggagactca

SEQ ID NO: 7756491 - DNA, 22 bp, Homo sapiens
ccagctctctgcagaaaggact

SEQ ID NO: 7756492 - DNA, 22 bp, Homo sapiens
ccagctctgccaagcgtcagct

SEQ ID NO: 7756493 - DNA, 22 bp, Homo sapiens
ccagctctctttgaagcataaa

SEQ ID NO: 7756494 - DNA, 22 bp, Homo sapiens
ccagctctctgcagaaaggact

SEQ ID NO: 7756495 - DNA, 22 bp, Homo sapiens
ccagctctgattttgacctcca

SEQ ID NO: 7756496 - DNA, 22 bp, Homo sapiens
ccagctctgcatgtttcccttg

SEQ ID NO: 7756497 - DNA, 22 bp, Homo sapiens
tctggtgtcagtattctttgaa

SEQ ID NO: 7756498 - DNA, 22 bp, Homo sapiens
cccattccctttactgttgcat

SEQ ID NO: 7756499 - DNA, 22 bp, Homo sapiens
cccctttctcccgcgtctggcc

SEQ ID NO: 7756500 - DNA, 22 bp, Homo sapiens
ccccttctgtgtcctgtcagcc

SEQ ID NO: 7756501 - DNA, 22 bp, Homo sapiens
ccccttctggtcttcaatggtg

SEQ ID NO: 7756502 - DNA, 22 bp, Homo sapiens
ccccttctctgcaagcctgctc

SEQ ID NO: 7756503 - DNA, 22 bp, Homo sapiens
tgccagcttttgactatcttag

SEQ ID NO: 7756504 - DNA, 22 bp, Homo sapiens
tgccatattgcaaagtgtctgc

SEQ ID NO: 7756505 - DNA, 22 bp, Homo sapiens
cctcttctaggacgtccttgtg

SEQ ID NO: 7756506 - DNA, 21 bp, Homo sapiens
cccttcttgggtcaaagtata

SEQ ID NO: 7756507 - DNA, 22 bp, Homo sapiens
cctcaggcttacgggcaatgga

SEQ ID NO: 7756508 - DNA, 22 bp, Homo sapiens
tggcccagagcactgctgggca

SEQ ID NO: 7756509 - DNA, 17 bp, Homo sapiens
cctcagcttctttcctc

SEQ ID NO: 7756510 - DNA, 22 bp, Homo sapiens
cctcagtgcgtactgaacagtg

SEQ ID NO: 7756511 - DNA, 22 bp, Homo sapiens
cctcagtgagtgtttccttctt

SEQ ID NO: 7756512 - DNA, 22 bp, Homo sapiens
cctcagtgtgtttggggtgagg

SEQ ID NO: 7756513 - DNA, 22 bp, Homo sapiens
cctcagtgttaggataagagaa

SEQ ID NO: 7756514 - DNA, 22 bp, Homo sapiens
cctcagtgtgtggatgttagag

SEQ ID NO: 7756515 - DNA, 22 bp, Homo sapiens
cctcagtgtgcagcagcatctg

SEQ ID NO: 7756516 - DNA, 20 bp, Homo sapiens
cctcagtgtcctggactggg

SEQ ID NO: 7756517 - DNA, 22 bp, Homo sapiens
tttctcagttctctgcaaggag

SEQ ID NO: 7756518 - DNA, 19 bp, Homo sapiens
tttcaggagctatgcaggg

SEQ ID NO: 7756519 - DNA, 22 bp, Homo sapiens
tttcaggattagtttaagcagg

SEQ ID NO: 7756520 - DNA, 22 bp, Homo sapiens
tttaaaaaactagtctgagtct

SEQ ID NO: 7756521 - DNA, 22 bp, Homo sapiens
ttgcaagatgttaccattgtta

SEQ ID NO: 7756522 - DNA, 22 bp, Homo sapiens
ttgtttgtaaggctcttagaat

SEQ ID NO: 7756523 - DNA, 22 bp, Homo sapiens
ttgtgtttcccttgcatattcc

SEQ ID NO: 7756524 - DNA, 23 bp, Homo sapiens
ttttcctttggacaggctgtatt

SEQ ID NO: 7756525 - DNA, 22 bp, Homo sapiens
tttgtttgaaagtctctacagc

SEQ ID NO: 7756526 - DNA, 22 bp, Homo sapiens
tgttttgtctaatctaaattct

SEQ ID NO: 7756527 - DNA, 20 bp, Homo sapiens
ttaagaaaagcacatcctgc

SEQ ID NO: 7756528 - DNA, 22 bp, Homo sapiens
ttaagaatgtgccttttggttg

SEQ ID NO: 7756529 - DNA, 21 bp, Homo sapiens
tgtgttcttctaggtcagcta

SEQ ID NO: 7756530 - DNA, 22 bp, Homo sapiens
tgtggaggattctgatgccagc

SEQ ID NO: 7756531 - DNA, 21 bp, Homo sapiens
ttctgccttcccctagctggg

SEQ ID NO: 7756532 - DNA, 22 bp, Homo sapiens
ttgagtctctgccaaaacacaa

SEQ ID NO: 7756533 - DNA, 22 bp, Homo sapiens
ttcatggatcatgccttttgtg

SEQ ID NO: 7756534 - DNA, 22 bp, Homo sapiens
ttcctctgtatgctttgctgct

SEQ ID NO: 7756535 - DNA, 22 bp, Homo sapiens
ttcctctgtagttgctgatgaa

SEQ ID NO: 7756536 - DNA, 22 bp, Homo sapiens
ttcctacatcaccagggggagt

SEQ ID NO: 7756537 - DNA, 22 bp, Homo sapiens
ttcctcagaccctcattgtgag

SEQ ID NO: 7756538 - DNA, 22 bp, Homo sapiens
ttcctcagccaaggctgggatc

SEQ ID NO: 7756539 - DNA, 22 bp, Homo sapiens
ttcctcagagggcgctggggaa

SEQ ID NO: 7756540 - DNA, 22 bp, Homo sapiens
caatcccatcaccatctgctct

SEQ ID NO: 7756541 - DNA, 22 bp, Homo sapiens
ggagagcagggaggctgctctg

SEQ ID NO: 7756542 - DNA, 22 bp, Homo sapiens
cactccctctagttgcattctg

SEQ ID NO: 7756543 - DNA, 22 bp, Homo sapiens
cacagtcctgccagagggcctt

SEQ ID NO: 7756544 - DNA, 22 bp, Homo sapiens
cagagacaccccagaaaataag

SEQ ID NO: 7756545 - DNA, 22 bp, Homo sapiens
cagagacaacctggtagagaaa

SEQ ID NO: 7756546 - DNA, 22 bp, Homo sapiens
gggatgaattgagtcagaaggg

SEQ ID NO: 7756547 - DNA, 19 bp, Homo sapiens
cagatgagaaaagtgaggt

SEQ ID NO: 7756548 - DNA, 22 bp, Homo sapiens
cagatgagagtggccagggttc

SEQ ID NO: 7756549 - DNA, 18 bp, Homo sapiens
cagatgagatgcaatctc

SEQ ID NO: 7756550 - DNA, 23 bp, Homo sapiens
cagatgaggttggcagcatggtc

SEQ ID NO: 7756551 - DNA, 22 bp, Homo sapiens
cagatgaggcaacctcattgct

SEQ ID NO: 7756552 - DNA, 22 bp, Homo sapiens
cagatgagcatgggcacaagca

SEQ ID NO: 7756553 - DNA, 22 bp, Homo sapiens
cagccctcctaccctgccaggc

SEQ ID NO: 7756554 - DNA, 22 bp, Homo sapiens
gtgagagctgctccagatctct

SEQ ID NO: 7756555 - DNA, 22 bp, Homo sapiens
cagccctgtccaatgtctgctc

SEQ ID NO: 7756556 - DNA, 22 bp, Homo sapiens
cagccctgtccagcagagggtg

SEQ ID NO: 7756557 - DNA, 22 bp, Homo sapiens
cagccctggcccaggtgcctta

SEQ ID NO: 7756558 - DNA, 22 bp, Homo sapiens
cagccctgtccctgagggacct

SEQ ID NO: 7756559 - DNA, 22 bp, Homo sapiens
cagccagctggtgcggcagagc

SEQ ID NO: 7756560 - DNA, 22 bp, Homo sapiens
cagccagctgtcccaagtgcct

SEQ ID NO: 7756561 - DNA, 22 bp, Homo sapiens
atggagggtgtcagagagcgaa

SEQ ID NO: 7756562 - DNA, 22 bp, Homo sapiens
atgagagactgtgtgttgggag

SEQ ID NO: 7756563 - DNA, 22 bp, Homo sapiens
atgagacatgacttcaggcctt

SEQ ID NO: 7756564 - DNA, 22 bp, Homo sapiens
atgagaaagagttgtatctaga

SEQ ID NO: 7756565 - DNA, 22 bp, Homo sapiens
ctttgggcaaagggccaattcg

SEQ ID NO: 7756566 - DNA, 22 bp, Homo sapiens
gaagtagaaagcctcgtaaata

SEQ ID NO: 7756567 - DNA, 22 bp, Homo sapiens
gaagagatgacaaaggagcatg

SEQ ID NO: 7756568 - DNA, 22 bp, Homo sapiens
gaaggaggctccccaaagtctg

SEQ ID NO: 7756569 - DNA, 22 bp, Homo sapiens
gaaggaggtctgatacaatatg

SEQ ID NO: 7756570 - DNA, 22 bp, Homo sapiens
attttgataatcatgttagaga

SEQ ID NO: 7756571 - DNA, 22 bp, Homo sapiens
attttgcacactatgcagcttt

SEQ ID NO: 7756572 - DNA, 22 bp, Homo sapiens
caaaagatacttgcatctaact

SEQ ID NO: 7756573 - DNA, 22 bp, Homo sapiens
attttcagttgaaaaagttggt

SEQ ID NO: 7756574 - DNA, 22 bp, Homo sapiens
gcccagtctcttctggccctgt

SEQ ID NO: 7756575 - DNA, 22 bp, Homo sapiens
gatgtgagtggtagctgggatt

SEQ ID NO: 7756576 - DNA, 22 bp, Homo sapiens
gatgtgaggtggtaaacaggga

SEQ ID NO: 7756577 - DNA, 22 bp, Homo sapiens
ctgtatctgtgttggatgagtt

SEQ ID NO: 7756578 - DNA, 22 bp, Homo sapiens
ctggtgggaagatggaaaacat

SEQ ID NO: 7756579 - DNA, 22 bp, Homo sapiens
atagacatatggctttgtttct

SEQ ID NO: 7756580 - DNA, 22 bp, Homo sapiens
atagacatggtcttttgtcatt

SEQ ID NO: 7756581 - DNA, 22 bp, Homo sapiens
atagaaatggcagctggtgcta

SEQ ID NO: 7756582 - DNA, 22 bp, Homo sapiens
agtgttcatttattcattcact

SEQ ID NO: 7756583 - DNA, 22 bp, Homo sapiens
ctgcccgctgctagagaggccg

SEQ ID NO: 7756584 - DNA, 22 bp, Homo sapiens
ctgccctcccagttggtccgtg

SEQ ID NO: 7756585 - DNA, 22 bp, Homo sapiens
ctccagtgcttctagaaaatac

SEQ ID NO: 7756586 - DNA, 22 bp, Homo sapiens
ctccagtgtctcagagcagatg

SEQ ID NO: 7756587 - DNA, 22 bp, Homo sapiens
aggtggagatcagggactaagg

SEQ ID NO: 7756588 - DNA, 22 bp, Homo sapiens
cattaaaatatctcatggtgtt

SEQ ID NO: 7756589 - DNA, 16 bp, Homo sapiens
aggaggggaattagga

SEQ ID NO: 7756590 - DNA, 20 bp, Homo sapiens
aggaggggatagaatcaaag

SEQ ID NO: 7756591 - DNA, 22 bp, Homo sapiens
aggagggatagaaaaatacttg

SEQ ID NO: 7756592 - DNA, 22 bp, Homo sapiens
catgggggtctggacaacaggc

SEQ ID NO: 7756593 - DNA, 19 bp, Homo sapiens
aggagaagtagcagaaatt

SEQ ID NO: 7756594 - DNA, 20 bp, Homo sapiens
caggtgagcagatctgggtg

SEQ ID NO: 7756595 - DNA, 22 bp, Homo sapiens
caggcctggttgagccctgaga

SEQ ID NO: 7756596 - DNA, 20 bp, Homo sapiens
cagctctgggcaggtcgagg

SEQ ID NO: 7756597 - DNA, 22 bp, Homo sapiens
cagctctggggcagagtgacta

SEQ ID NO: 7756598 - DNA, 22 bp, Homo sapiens
cagctctgggtaggaggaatct

SEQ ID NO: 7756599 - DNA, 22 bp, Homo sapiens
cagctctgggtgacaggagggc

SEQ ID NO: 7756600 - DNA, 22 bp, Homo sapiens
cagctctggtccagggagggca

SEQ ID NO: 7756601 - DNA, 22 bp, Homo sapiens
cagctctgtaaattccttcatc

SEQ ID NO: 7756602 - DNA, 22 bp, Homo sapiens
ccagcttttcttatcattataa

SEQ ID NO: 7756603 - DNA, 22 bp, Homo sapiens
ccagccctgccagagagagctg

SEQ ID NO: 7756604 - DNA, 19 bp, Homo sapiens
aggcccagcgctgggggct

SEQ ID NO: 7756605 - DNA, 22 bp, Homo sapiens
aggcccagcccgtcctcgtgct

SEQ ID NO: 7756606 - DNA, 21 bp, Homo sapiens
aggcccagagtcttgggggga

SEQ ID NO: 7756607 - DNA, 22 bp, Homo sapiens
agggagaagagaacaaagccct

SEQ ID NO: 7756608 - DNA, 22 bp, Homo sapiens
agggagtggttaagaaggtgca

SEQ ID NO: 7756609 - DNA, 22 bp, Homo sapiens
agggatgatggaaagaagcagg

SEQ ID NO: 7756610 - DNA, 22 bp, Homo sapiens
aggggagaatttcaactcaggt

SEQ ID NO: 7756611 - DNA, 22 bp, Homo sapiens
aggggagaaaaatgccttctgt

SEQ ID NO: 7756612 - DNA, 22 bp, Homo sapiens
aggggagagaacataaggaagt

SEQ ID NO: 7756613 - DNA, 21 bp, Homo sapiens
aggggacagagtagctccagg

SEQ ID NO: 7756614 - DNA, 22 bp, Homo sapiens
aggggctgggacagagccaagc

SEQ ID NO: 7756615 - DNA, 22 bp, Homo sapiens
aggatgagagatacatggagca

SEQ ID NO: 7756616 - DNA, 22 bp, Homo sapiens
acagtgttacttgatagtgtat

SEQ ID NO: 7756617 - DNA, 22 bp, Homo sapiens
aggaagaatgtttacatatcaa

SEQ ID NO: 7756618 - DNA, 22 bp, Homo sapiens
agctgaagggaggatatgtaca

SEQ ID NO: 7756619 - DNA, 22 bp, Homo sapiens
acaggagaaatctggtcaaaag

SEQ ID NO: 7756620 - DNA, 22 bp, Homo sapiens
aggcctgaggaccttctggagg

SEQ ID NO: 7756621 - DNA, 22 bp, Homo sapiens
agggagagaagttatacaagat

SEQ ID NO: 7756622 - DNA, 22 bp, Homo sapiens
agggggagtttcagttagaaag

SEQ ID NO: 7756623 - DNA, 22 bp, Homo sapiens
atacatgttgagaaaatatctg

SEQ ID NO: 7756624 - DNA, 23 bp, Homo sapiens
agaaagtttgtgccttgtgacac

SEQ ID NO: 7756625 - DNA, 22 bp, Homo sapiens
agaaagggttctctgaggtgct

SEQ ID NO: 7756626 - DNA, 22 bp, Homo sapiens
agaaagggtcactgaaagagga

SEQ ID NO: 7756627 - DNA, 22 bp, Homo sapiens
agaaaataaattgatggtggaa

SEQ ID NO: 7756628 - DNA, 22 bp, Homo sapiens
agtgtttaatgccttttccagc

SEQ ID NO: 7756629 - DNA, 22 bp, Homo sapiens
agtgttcttcttcaaagctctg

SEQ ID NO: 7756630 - DNA, 22 bp, Homo sapiens
agagttggccaaaaggggcatt

SEQ ID NO: 7756631 - DNA, 22 bp, Homo sapiens
agataaaatggttcaaaggcta

SEQ ID NO: 7756632 - DNA, 18 bp, Homo sapiens
agaattgctgcttcttct

SEQ ID NO: 7756633 - DNA, 22 bp, Homo sapiens
atgaaattgatcttgaactttt

SEQ ID NO: 7756634 - DNA, 22 bp, Homo sapiens
agagatggccttaggtgggaat

SEQ ID NO: 7756635 - DNA, 22 bp, Homo sapiens
agagatggagagcactggggct

SEQ ID NO: 7756636 - DNA, 22 bp, Homo sapiens
agagatgaagggcattccccag

SEQ ID NO: 7756637 - DNA, 19 bp, Homo sapiens
agagaccacagagctgcct

SEQ ID NO: 7756638 - DNA, 22 bp, Homo sapiens
agagaaggaaagctgacatggg

SEQ ID NO: 7756639 - DNA, 22 bp, Homo sapiens
agagaagattcttatatgtctt

SEQ ID NO: 7756640 - DNA, 22 bp, Homo sapiens
agagaagagtcttgtcaaatta

SEQ ID NO: 7756641 - DNA, 21 bp, Homo sapiens
agagaagaggactttctcaca

SEQ ID NO: 7756642 - DNA, 22 bp, Homo sapiens
agagaagagcaatgataaattt

SEQ ID NO: 7756643 - DNA, 22 bp, Homo sapiens
agagaagacttacagccacagt

SEQ ID NO: 7756644 - DNA, 22 bp, Homo sapiens
agccacccattcccgagcccta

SEQ ID NO: 7756645 - DNA, 16 bp, Homo sapiens
cagccctgaggaagaa

SEQ ID NO: 7756646 - DNA, 22 bp, Homo sapiens
cagccctgagcaaggcttttaa

SEQ ID NO: 7756647 - DNA, 22 bp, Homo sapiens
cagccctgcagagggcgctcct

SEQ ID NO: 7756648 - DNA, 22 bp, Homo sapiens
cagccctgcacgctgcctccgc

SEQ ID NO: 7756649 - DNA, 23 bp, Homo sapiens
cagccctgaaatcgaggtgacac

SEQ ID NO: 7756650 - DNA, 22 bp, Homo sapiens
agctcctgatacatgcaggaat

SEQ ID NO: 7756651 - DNA, 22 bp, Homo sapiens
cagctctgacacagtacaaaat

SEQ ID NO: 7756652 - DNA, 22 bp, Homo sapiens
agcctctgtagaaagcagtgtg

SEQ ID NO: 7756653 - DNA, 22 bp, Homo sapiens
agcctctgcttatgcaaaggta

SEQ ID NO: 7756654 - DNA, 22 bp, Homo sapiens
agcctctgcacgggcacgggtg

SEQ ID NO: 7756655 - DNA, 22 bp, Homo sapiens
agcacatgcacagtgctacact

SEQ ID NO: 7756656 - DNA, 22 bp, Homo sapiens
caaattaccctcaacatctaga

SEQ ID NO: 7756657 - DNA, 22 bp, Homo sapiens
caaatattccaggtacatccct

SEQ ID NO: 7756658 - DNA, 22 bp, Homo sapiens
cacagtgtttgatttaggggcc

SEQ ID NO: 7756659 - DNA, 22 bp, Homo sapiens
aacaaatgataccagttctcaa

SEQ ID NO: 7756660 - DNA, 22 bp, Homo sapiens
aacttaaacccactcatgtaga

SEQ ID NO: 7756661 - DNA, 22 bp, Homo sapiens
aaccaccattctctcctcttcc

SEQ ID NO: 7756662 - DNA, 22 bp, Homo sapiens
acaaagataagtcagaaagtca

SEQ ID NO: 7756663 - DNA, 22 bp, Homo sapiens
aagcacagggactcaggaccgg

SEQ ID NO: 7756664 - DNA, 22 bp, Homo sapiens
aagaggccttggtctgacctga

SEQ ID NO: 7756665 - DNA, 22 bp, Homo sapiens
aagaggcctcacctcactgccc

SEQ ID NO: 7756666 - DNA, 19 bp, Homo sapiens
aaactctgaaggccactgg

SEQ ID NO: 7756667 - DNA, 22 bp, Homo sapiens
aaacctttaccagactagcaag

SEQ ID NO: 7756668 - DNA, 22 bp, Homo sapiens
aaactctgtatttgctgtgggt

SEQ ID NO: 7756669 - DNA, 22 bp, Homo sapiens
aaactctgttgagataatattt

SEQ ID NO: 7756670 - DNA, 22 bp, Homo sapiens
aaactctggagatgtttatgca

SEQ ID NO: 7756671 - DNA, 22 bp, Homo sapiens
aaactctgatgcttattgggaa

SEQ ID NO: 7756672 - DNA, 22 bp, Homo sapiens
aaactctgcactgcggtaaggt

SEQ ID NO: 7756673 - DNA, 22 bp, Homo sapiens
aaactctgccatttttggcctg

SEQ ID NO: 7756674 - DNA, 22 bp, Homo sapiens
aaactctggattggagtccagc

SEQ ID NO: 7756675 - DNA, 22 bp, Homo sapiens
aaactctgggggtggagcccag

SEQ ID NO: 7756676 - DNA, 22 bp, Homo sapiens
aaactctgtagctaaacataat

SEQ ID NO: 7756677 - DNA, 22 bp, Homo sapiens
aaaaaagattgatggtggatgc

SEQ ID NO: 7756678 - DNA, 22 bp, Homo sapiens
aaattttgtattctagttctag

SEQ ID NO: 7756679 - DNA, 18 bp, Homo sapiens
agaaggagctatgggcag

SEQ ID NO: 7756680 - DNA, 22 bp, Homo sapiens
aatgagaatgtaagtgaagaga

SEQ ID NO: 7756681 - DNA, 22 bp, Homo sapiens
aatgagaagcctaggtgtactg

SEQ ID NO: 7756682 - DNA, 22 bp, Homo sapiens
aatgagaactgggagttggtgg

SEQ ID NO: 7756683 - DNA, 22 bp, Homo sapiens
aatgagaaaacacagaggaggt

SEQ ID NO: 7756684 - DNA, 22 bp, Homo sapiens
aatgagaaccttgaaaggaact

SEQ ID NO: 7756685 - DNA, 22 bp, Homo sapiens
aatccagcacatggacacagtc

SEQ ID NO: 7756686 - DNA, 22 bp, Homo sapiens
aatcataattgtatacattcat

SEQ ID NO: 7756687 - DNA, 21 bp, Homo sapiens
aagtggagaagaaaagctgga

SEQ ID NO: 7756688 - DNA, 22 bp, Homo sapiens
aaggaaaggatgagcatgcatt

SEQ ID NO: 7756689 - DNA, 22 bp, Homo sapiens
acatgtgtggacatgaatctac

SEQ ID NO: 7756690 - DNA, 22 bp, Homo sapiens
acatgtgtctaagaatgaaaga

SEQ ID NO: 7756691 - DNA, 22 bp, Homo sapiens
aaggtagattctggatcgaagg

SEQ ID NO: 7756692 - DNA, 22 bp, Homo sapiens
agagctgggacttggactcaat

SEQ ID NO: 7756693 - DNA, 22 bp, Homo sapiens
agacagggtcttgatcagagct

SEQ ID NO: 7756694 - DNA, 21 bp, Homo sapiens
agaagggattgtggtaaagat

SEQ ID NO: 7756695 - DNA, 22 bp, Homo sapiens
acaatgtttttgttcaaagagt

SEQ ID NO: 7756696 - DNA, 22 bp, Homo sapiens
aattttcacagtgctgtgagat

SEQ ID NO: 7756697 - DNA, 22 bp, Homo sapiens
agagctggggccagagtcaagg

SEQ ID NO: 7756698 - DNA, 22 bp, Homo sapiens
acaaacagagttgaaaaatagg

SEQ ID NO: 7756699 - DNA, 22 bp, Homo sapiens
agctcctgttctgagagcagga

SEQ ID NO: 7756700 - DNA, 19 bp, Homo sapiens
agctcctgttcagcagctc

SEQ ID NO: 7756701 - DNA, 22 bp, Homo sapiens
gttcttcctcattgctttgaag

SEQ ID NO: 7756702 - DNA, 21 bp, Homo sapiens
gtgctgggacacagccaggct

SEQ ID NO: 7756703 - DNA, 21 bp, Homo sapiens
taaaagatgacaagacagctc

SEQ ID NO: 7756704 - DNA, 22 bp, Homo sapiens
taaaagattttataggaacaag

SEQ ID NO: 7756705 - DNA, 22 bp, Homo sapiens
taaaaggaggttgaagctgtca

SEQ ID NO: 7756706 - DNA, 22 bp, Homo sapiens
taaagatggagatgacctagga

SEQ ID NO: 7756707 - DNA, 22 bp, Homo sapiens
taaagatgctatagtgaaggag

SEQ ID NO: 7756708 - DNA, 22 bp, Homo sapiens
taaagatgcccacattgcaggt

SEQ ID NO: 7756709 - DNA, 22 bp, Homo sapiens
taaggagagaatttagaggttt

SEQ ID NO: 7756710 - DNA, 22 bp, Homo sapiens
tacagtgtctggatatcaaagg

SEQ ID NO: 7756711 - DNA, 22 bp, Homo sapiens
tacagtgtgacatttctacaaa

SEQ ID NO: 7756712 - DNA, 22 bp, Homo sapiens
taccaagtgtattatgctttgt

SEQ ID NO: 7756713 - DNA, 22 bp, Homo sapiens
tacagtgtccctttttcagaca

SEQ ID NO: 7756714 - DNA, 22 bp, Homo sapiens
tacagtatggaaaatgtatagt

SEQ ID NO: 7756715 - DNA, 22 bp, Homo sapiens
tcaaagagctattcagttgtgg

SEQ ID NO: 7756716 - DNA, 22 bp, Homo sapiens
tcaaagagctctatcttcaaaa

SEQ ID NO: 7756717 - DNA, 20 bp, Homo sapiens
tatgctttttataagattga

SEQ ID NO: 7756718 - DNA, 22 bp, Homo sapiens
tatgcttttaacctgtaactga

SEQ ID NO: 7756719 - DNA, 22 bp, Homo sapiens
tatgctttggtagagagttgtg

SEQ ID NO: 7756720 - DNA, 22 bp, Homo sapiens
tatgctttacttttcattgtga

SEQ ID NO: 7756721 - DNA, 22 bp, Homo sapiens
tatgctttcattcatatgtgag

SEQ ID NO: 7756722 - DNA, 22 bp, Homo sapiens
tatgaaattgccatttttatgg

SEQ ID NO: 7756723 - DNA, 22 bp, Homo sapiens
tatgaaatttctagttctgctt

SEQ ID NO: 7756724 - DNA, 22 bp, Homo sapiens
tagagacaccagtaccattctg

SEQ ID NO: 7756725 - DNA, 22 bp, Homo sapiens
tagttctactcaaagtgtgatc

SEQ ID NO: 7756726 - DNA, 22 bp, Homo sapiens
tcagtgtttttaaagcaatata

SEQ ID NO: 7756727 - DNA, 22 bp, Homo sapiens
tcagtgtttgaacccagggtta

SEQ ID NO: 7756728 - DNA, 22 bp, Homo sapiens
tcagtgtttggtttcagaattg

SEQ ID NO: 7756729 - DNA, 22 bp, Homo sapiens
tcagtgtttcctgtggtacagc

SEQ ID NO: 7756730 - DNA, 22 bp, Homo sapiens
tcagtgtttcctagagcatata

SEQ ID NO: 7756731 - DNA, 22 bp, Homo sapiens
tcagtgttttaactgtctttta

SEQ ID NO: 7756732 - DNA, 22 bp, Homo sapiens
tcagtgtttgtggcaaatgtta

SEQ ID NO: 7756733 - DNA, 22 bp, Homo sapiens
tcagtgttttccagggtctact

SEQ ID NO: 7756734 - DNA, 22 bp, Homo sapiens
tcataaagcttgcctgcagtgt

SEQ ID NO: 7756735 - DNA, 21 bp, Homo sapiens
tcagtcctgttagcctttggg

SEQ ID NO: 7756736 - DNA, 23 bp, Homo sapiens
tcagtcctgtaggggctccaggt

SEQ ID NO: 7756737 - DNA, 22 bp, Homo sapiens
tcagtcctgatgacaggcccaa

SEQ ID NO: 7756738 - DNA, 22 bp, Homo sapiens
tcagtcctctctgggtttctta

SEQ ID NO: 7756739 - DNA, 22 bp, Homo sapiens
tcagtcctcacttggttctaag

SEQ ID NO: 7756740 - DNA, 22 bp, Homo sapiens
tcagtcctccacacaggcaccc

SEQ ID NO: 7756741 - DNA, 18 bp, Homo sapiens
tcagtcctccatagagct

SEQ ID NO: 7756742 - DNA, 22 bp, Homo sapiens
tcagtcctcctctcatagagag

SEQ ID NO: 7756743 - DNA, 22 bp, Homo sapiens
tcagtgttggtcaagaatcagt

SEQ ID NO: 7756744 - DNA, 22 bp, Homo sapiens
tcagtgttggctacatctgcct

SEQ ID NO: 7756745 - DNA, 22 bp, Homo sapiens
tcagtgtttacatgcatccttg

SEQ ID NO: 7756746 - DNA, 22 bp, Homo sapiens
tcagtgttgtgcacatacaaaa

SEQ ID NO: 7756747 - DNA, 22 bp, Homo sapiens
tcagtgtttaccgtatgttgtt

SEQ ID NO: 7756748 - DNA, 22 bp, Homo sapiens
tcagtgtttattcaatgttatt

SEQ ID NO: 7756749 - DNA, 22 bp, Homo sapiens
tcagtgtttcagtttggaaatg

SEQ ID NO: 7756750 - DNA, 22 bp, Homo sapiens
tcagtgtttattgcggtgtgta

SEQ ID NO: 7756751 - DNA, 22 bp, Homo sapiens
tcagtgttctggatttggggca

SEQ ID NO: 7756752 - DNA, 22 bp, Homo sapiens
tcagtgttcttatttaattagg

SEQ ID NO: 7756753 - DNA, 22 bp, Homo sapiens
tcagtgttgaattttttgcaaa

SEQ ID NO: 7756754 - DNA, 22 bp, Homo sapiens
tcagtgttggcattcagaaatg

SEQ ID NO: 7756755 - DNA, 22 bp, Homo sapiens
tcagtgttggagataattgcac

SEQ ID NO: 7756756 - DNA, 22 bp, Homo sapiens
tcatacattcagcagatatttg

SEQ ID NO: 7756757 - DNA, 22 bp, Homo sapiens
tcagggctgcagaagaggcagg

SEQ ID NO: 7756758 - DNA, 22 bp, Homo sapiens
tcagggctcaccagcctctgcc

SEQ ID NO: 7756759 - DNA, 22 bp, Homo sapiens
tcagaaacactcttcttctgtc

SEQ ID NO: 7756760 - DNA, 22 bp, Homo sapiens
tcagaaaccagctctctcaatt

SEQ ID NO: 7756761 - DNA, 22 bp, Homo sapiens
tcagctctgcctgtggaggcac

SEQ ID NO: 7756762 - DNA, 22 bp, Homo sapiens
tcctcagcaaacacttcactct

SEQ ID NO: 7756763 - DNA, 22 bp, Homo sapiens
tcctcagtaaggcatggctttg

SEQ ID NO: 7756764 - DNA, 22 bp, Homo sapiens
tcctcagtaaggatcgtcagct

SEQ ID NO: 7756765 - DNA, 18 bp, Homo sapiens
ggtgagggagctggaagc

SEQ ID NO: 7756766 - DNA, 22 bp, Homo sapiens
ggtggagagctggatgagaggt

SEQ ID NO: 7756767 - DNA, 19 bp, Homo sapiens
ggggagaactagagacagc

SEQ ID NO: 7756768 - DNA, 22 bp, Homo sapiens
ggggagaattacatggcgtgga

SEQ ID NO: 7756769 - DNA, 22 bp, Homo sapiens
gggctgtgtgcccacttcccat

SEQ ID NO: 7756770 - DNA, 22 bp, Homo sapiens
ggggtgagtgctcagccccgga

SEQ ID NO: 7756771 - DNA, 22 bp, Homo sapiens
gggtgaggcccatttgaggcca

SEQ ID NO: 7756772 - DNA, 22 bp, Homo sapiens
gtgcagggagcccagaaggtcc

SEQ ID NO: 7756773 - DNA, 22 bp, Homo sapiens
gtacaatagcagttttcccttt

SEQ ID NO: 7756774 - DNA, 22 bp, Homo sapiens
gtccagctgcagctgggcagaa

SEQ ID NO: 7756775 - DNA, 22 bp, Homo sapiens
gtccagctccagggaggcaggc

SEQ ID NO: 7756776 - DNA, 22 bp, Homo sapiens
gtcctggaatcctagaacagtg

SEQ ID NO: 7756777 - DNA, 22 bp, Homo sapiens
ggcaggggtcctggtgttgact

SEQ ID NO: 7756778 - DNA, 22 bp, Homo sapiens
ggccacagtgggaaatcctggg

SEQ ID NO: 7756779 - DNA, 22 bp, Homo sapiens
ggccacagagggcgggatgctg

SEQ ID NO: 7756780 - DNA, 22 bp, Homo sapiens
ggccacagtctctggaaggatg

SEQ ID NO: 7756781 - DNA, 20 bp, Homo sapiens
ggccacagggtgctggtgga

SEQ ID NO: 7756782 - DNA, 22 bp, Homo sapiens
ggcccagtgtaccccaggcagt

SEQ ID NO: 7756783 - DNA, 22 bp, Homo sapiens
ggcccagtgttgccagacctga

SEQ ID NO: 7756784 - DNA, 22 bp, Homo sapiens
ggcccagtgtgggtggatgttg

SEQ ID NO: 7756785 - DNA, 20 bp, Homo sapiens
ggcccagtgaaccaggacgg

SEQ ID NO: 7756786 - DNA, 22 bp, Homo sapiens
ggcccagtctggggccctgtga

SEQ ID NO: 7756787 - DNA, 22 bp, Homo sapiens
gggagtaaactatggtgaggat

SEQ ID NO: 7756788 - DNA, 22 bp, Homo sapiens
gggagtggagagcaatggatga

SEQ ID NO: 7756789 - DNA, 22 bp, Homo sapiens
gctcagtgaatttttgcccatg

SEQ ID NO: 7756790 - DNA, 22 bp, Homo sapiens
gctcagtgaagggtgccaagta

SEQ ID NO: 7756791 - DNA, 22 bp, Homo sapiens
gctcagtgagatattgactcca

SEQ ID NO: 7756792 - DNA, 22 bp, Homo sapiens
gctcagtgcatcattccaggct

SEQ ID NO: 7756793 - DNA, 20 bp, Homo sapiens
gctcagtggagaaatgcacc

SEQ ID NO: 7756794 - DNA, 22 bp, Homo sapiens
gctcagtgcagcctttctgtat

SEQ ID NO: 7756795 - DNA, 19 bp, Homo sapiens
gctcagtgatgccagacca

SEQ ID NO: 7756796 - DNA, 22 bp, Homo sapiens
gctcagtgtttctggtagaaaa

SEQ ID NO: 7756797 - DNA, 22 bp, Homo sapiens
gctcagtgttcatctgtatgca

SEQ ID NO: 7756798 - DNA, 22 bp, Homo sapiens
gctcagtgtgttcaagggctca

SEQ ID NO: 7756799 - DNA, 22 bp, Homo sapiens
gctcagtgtgcacgagtactct

SEQ ID NO: 7756800 - DNA, 22 bp, Homo sapiens
gctcagtggtattcggaaactg

SEQ ID NO: 7756801 - DNA, 18 bp, Homo sapiens
gctcagtgtgttaacact

SEQ ID NO: 7756802 - DNA, 22 bp, Homo sapiens
gctcagtgtggtcctcagatgt

SEQ ID NO: 7756803 - DNA, 22 bp, Homo sapiens
gctgcaggctctgcaggaattg

SEQ ID NO: 7756804 - DNA, 21 bp, Homo sapiens
gctgcagggcccagggcaccc

SEQ ID NO: 7756805 - DNA, 22 bp, Homo sapiens
gctggaggggtaataggatggg

SEQ ID NO: 7756806 - DNA, 22 bp, Homo sapiens
gctgctgcttgaaggctcggag

SEQ ID NO: 7756807 - DNA, 22 bp, Homo sapiens
gctggaggtggtgagaaaaggt

SEQ ID NO: 7756808 - DNA, 22 bp, Homo sapiens
ggagctgtgttatccattccca

SEQ ID NO: 7756809 - DNA, 22 bp, Homo sapiens
ggacaggatgctgaagatgaag

SEQ ID NO: 7756810 - DNA, 22 bp, Homo sapiens
ggagaaagctgtagtggaatgt

SEQ ID NO: 7756811 - DNA, 22 bp, Homo sapiens
ggagaaaattgatgaagttggc

SEQ ID NO: 7756812 - DNA, 19 bp, Homo sapiens
ggaaggagagaaatgcatg

SEQ ID NO: 7756813 - DNA, 22 bp, Homo sapiens
ggaaggagcatttgccagttta

SEQ ID NO: 7756814 - DNA, 22 bp, Homo sapiens
ggaaggaggatgctctggcctt

SEQ ID NO: 7756815 - DNA, 22 bp, Homo sapiens
ggaaggagccatatcatatcca

SEQ ID NO: 7756816 - DNA, 22 bp, Homo sapiens
ggaaggagggcggcaatgatga

SEQ ID NO: 7756817 - DNA, 22 bp, Homo sapiens
ggaaggaggggcaaagcagttc

SEQ ID NO: 7756818 - DNA, 18 bp, Homo sapiens
ggaaggagtggaccccag

SEQ ID NO: 7756819 - DNA, 22 bp, Homo sapiens
ggaaggatctggctgaaatcca

SEQ ID NO: 7756820 - DNA, 22 bp, Homo sapiens
ggaaggagtctttaacacccat

SEQ ID NO: 7756821 - DNA, 22 bp, Homo sapiens
gccaggaacacaatgccaagct

SEQ ID NO: 7756822 - DNA, 18 bp, Homo sapiens
gccaggaagaggaatgtg

SEQ ID NO: 7756823 - DNA, 22 bp, Homo sapiens
gccaggaatgcataaatgacct

SEQ ID NO: 7756824 - DNA, 22 bp, Homo sapiens
gcagtgttggtttgctctgcag

SEQ ID NO: 7756825 - DNA, 22 bp, Homo sapiens
gcagtgttggcaggatggggct

SEQ ID NO: 7756826 - DNA, 23 bp, Homo sapiens
gcagtgtttgcttcatcttatcc

SEQ ID NO: 7756827 - DNA, 22 bp, Homo sapiens
gcagtgtttggatccatagcga

SEQ ID NO: 7756828 - DNA, 22 bp, Homo sapiens
gcagtgtttcccagagatggaa

SEQ ID NO: 7756829 - DNA, 22 bp, Homo sapiens
gcagtgtttcagtgctttttct

SEQ ID NO: 7756830 - DNA, 22 bp, Homo sapiens
gcagtgtttcaaatcaaaggca

SEQ ID NO: 7756831 - DNA, 22 bp, Homo sapiens
gcagtgtttacatattagaaac

SEQ ID NO: 7756832 - DNA, 22 bp, Homo sapiens
gcagtgttgtgatccaggtctt

SEQ ID NO: 7756833 - DNA, 22 bp, Homo sapiens
gcagtgttgttaaaagattaga

SEQ ID NO: 7756834 - DNA, 22 bp, Homo sapiens
gcagtgtttgtgttctcacatg

SEQ ID NO: 7756835 - DNA, 22 bp, Homo sapiens
gcagtgttttacagaccagcat

SEQ ID NO: 7756836 - DNA, 22 bp, Homo sapiens
gcagtgtttttcaatgcttcca

SEQ ID NO: 7756837 - DNA, 22 bp, Homo sapiens
gcctcagttgatctgtgtgagc

SEQ ID NO: 7756838 - DNA, 22 bp, Homo sapiens
gcctcagtgtcctcctccatgt

SEQ ID NO: 7756839 - DNA, 22 bp, Homo sapiens
gcctcagtggctttaggagttc

SEQ ID NO: 7756840 - DNA, 22 bp, Homo sapiens
gcctcagtttatacacctgtaa

SEQ ID NO: 7756841 - DNA, 18 bp, Homo sapiens
gcctcagtttcctcacct

SEQ ID NO: 7756842 - DNA, 22 bp, Homo sapiens
gcctcagtctcccgagtagctg

SEQ ID NO: 7756843 - DNA, 22 bp, Homo sapiens
gcctcagtgatatgtgggacaa

SEQ ID NO: 7756844 - DNA, 20 bp, Homo sapiens
gcctcagtcacatggcctac

SEQ ID NO: 7756845 - DNA, 22 bp, Homo sapiens
gcctcagtaaccttaggggata

SEQ ID NO: 7756846 - DNA, 22 bp, Homo sapiens
gccccttccatcatgtgaggac

SEQ ID NO: 7756847 - DNA, 22 bp, Homo sapiens
gccccttcgtggaagtgcattc

SEQ ID NO: 7756848 - DNA, 22 bp, Homo sapiens
ctgtggggaagatagaaccgac

SEQ ID NO: 7756849 - DNA, 22 bp, Homo sapiens
ctggggggctactgacagagga

SEQ ID NO: 7756850 - DNA, 22 bp, Homo sapiens
ctgggggtcttgaaagggagag

SEQ ID NO: 7756851 - DNA, 22 bp, Homo sapiens
ctgggggcagcaagaagccatg

SEQ ID NO: 7756852 - DNA, 22 bp, Homo sapiens
gaaatattacagtggaggggat

SEQ ID NO: 7756853 - DNA, 22 bp, Homo sapiens
gaaatattcttgtcttgttttc

SEQ ID NO: 7756854 - DNA, 22 bp, Homo sapiens
gaaatacaggaatgccacacag

SEQ ID NO: 7756855 - DNA, 22 bp, Homo sapiens
gaaatattgggactcagagctt

SEQ ID NO: 7756856 - DNA, 22 bp, Homo sapiens
gaaatattgtactggagatgtt

SEQ ID NO: 7756857 - DNA, 22 bp, Homo sapiens
gaaatatttctcttgagcccct

SEQ ID NO: 7756858 - DNA, 22 bp, Homo sapiens
gaaatgttgtcctgtctcttga

SEQ ID NO: 7756859 - DNA, 22 bp, Homo sapiens
gaagaagacatggaacaatagt

SEQ ID NO: 7756860 - DNA, 22 bp, Homo sapiens
cttccccaagtagagaggggag

SEQ ID NO: 7756861 - DNA, 22 bp, Homo sapiens
cttcttcctgctgcagcctcca

SEQ ID NO: 7756862 - DNA, 22 bp, Homo sapiens
gagagcaggctctcgggggcca

SEQ ID NO: 7756863 - DNA, 22 bp, Homo sapiens
gagagcaggaggcagcgggacg

SEQ ID NO: 7756864 - DNA, 22 bp, Homo sapiens
gagaggaggtggctatgacagc

SEQ ID NO: 7756865 - DNA, 22 bp, Homo sapiens
gagaaagggaacttacagagtg

SEQ ID NO: 7756866 - DNA, 22 bp, Homo sapiens
gagaacaggctctggagtcaga

SEQ ID NO: 7756867 - DNA, 22 bp, Homo sapiens
gagagaagaaagccatggtcct

SEQ ID NO: 7756868 - DNA, 22 bp, Homo sapiens
gagagaagggacttctacactt

SEQ ID NO: 7756869 - DNA, 22 bp, Homo sapiens
gagcaagactcactgcatcttg

SEQ ID NO: 7756870 - DNA, 22 bp, Homo sapiens
gagaggagtccctatcacagtt

SEQ ID NO: 7756871 - DNA, 22 bp, Homo sapiens
gaggagagaacattcctccata

SEQ ID NO: 7756872 - DNA, 22 bp, Homo sapiens
gagctcattcattcattgcctg

SEQ ID NO: 7756873 - DNA, 22 bp, Homo sapiens
gagggctgataacaggaataca

SEQ ID NO: 7756874 - DNA, 22 bp, Homo sapiens
gagtaaggctgctgatggagtg

SEQ ID NO: 7756875 - DNA, 22 bp, Homo sapiens
gaggttggtgaggggacacggt

SEQ ID NO: 7756876 - DNA, 22 bp, Homo sapiens
gaggtggaaggcaggaacaaat

SEQ ID NO: 7756877 - DNA, 22 bp, Homo sapiens
gaggcctggtttgcatgagaat

SEQ ID NO: 7756878 - DNA, 22 bp, Homo sapiens
ctcagtgcagctaggcatgaga

SEQ ID NO: 7756879 - DNA, 22 bp, Homo sapiens
ctcagtccgtcccgctaggtgc

SEQ ID NO: 7756880 - DNA, 22 bp, Homo sapiens
ctcagtctcttgggctgtgaag

SEQ ID NO: 7756881 - DNA, 22 bp, Homo sapiens
ctcagtctgtcttgtctgtgtt

SEQ ID NO: 7756882 - DNA, 22 bp, Homo sapiens
ctatacatcccaatttcagaga

SEQ ID NO: 7756883 - DNA, 22 bp, Homo sapiens
ctcacccctgtaattccagcac

SEQ ID NO: 7756884 - DNA, 22 bp, Homo sapiens
ctaaaaatccacactaggtgaa

SEQ ID NO: 7756885 - DNA, 22 bp, Homo sapiens
ctctgcaacttctagcagtgtc

SEQ ID NO: 7756886 - DNA, 21 bp, Homo sapiens
ctgcaggatgctgaagccagg

SEQ ID NO: 7756887 - DNA, 22 bp, Homo sapiens
ctgcccccaggctgcatggctg

SEQ ID NO: 7756888 - DNA, 22 bp, Homo sapiens
ctcttcttatggccgtggctga

SEQ ID NO: 7756889 - DNA, 22 bp, Homo sapiens
ctgctctgtggtccatgagaca

SEQ ID NO: 7756890 - DNA, 22 bp, Homo sapiens
ctgctctgtatatgagcaggaa

SEQ ID NO: 7756891 - DNA, 22 bp, Homo sapiens
caggggaagatgccaagggaga

SEQ ID NO: 7756892 - DNA, 22 bp, Homo sapiens
gtgagggcaaattagaatcaaa

SEQ ID NO: 7756893 - DNA, 22 bp, Homo sapiens
tactcaaactcactaagacaga

SEQ ID NO: 7756894 - DNA, 22 bp, Homo sapiens
cagtgtttgtggaattcaggtg

SEQ ID NO: 7756895 - DNA, 22 bp, Homo sapiens
tcagcttttgtcagaaattgta

SEQ ID NO: 7756896 - DNA, 22 bp, Homo sapiens
catgtgttttgtcatttcaata

SEQ ID NO: 7756897 - DNA, 22 bp, Homo sapiens
catgtgttaatctttctgcaaa

SEQ ID NO: 7756898 - DNA, 22 bp, Homo sapiens
cattgaaatatggaaactgatg

SEQ ID NO: 7756899 - DNA, 22 bp, Homo sapiens
tcctcagctttggtttactcat

SEQ ID NO: 7756900 - DNA, 22 bp, Homo sapiens
tcctcagcttttatttcacttg

SEQ ID NO: 7756901 - DNA, 22 bp, Homo sapiens
ccagcccttagataaacctggc

SEQ ID NO: 7756902 - DNA, 22 bp, Homo sapiens
ccagccctgcctctcagggccc

SEQ ID NO: 7756903 - DNA, 22 bp, Homo sapiens
tctccctctttgtctgctttgg

SEQ ID NO: 7756904 - DNA, 22 bp, Homo sapiens
tgaccacagacccaatgactac

SEQ ID NO: 7756905 - DNA, 22 bp, Homo sapiens
tgaaggagaattaataggcatt

SEQ ID NO: 7756906 - DNA, 21 bp, Homo sapiens
tgaaggagaggaccgagtgct

SEQ ID NO: 7756907 - DNA, 22 bp, Homo sapiens
tgaaggagaaatggaaagtggg

SEQ ID NO: 7756908 - DNA, 22 bp, Homo sapiens
ccagcccttgagatggaaggga

SEQ ID NO: 7756909 - DNA, 22 bp, Homo sapiens
ccagcccttgctgaagggtggc

SEQ ID NO: 7756910 - DNA, 22 bp, Homo sapiens
cccagcccagcgttcgaggggt

SEQ ID NO: 7756911 - DNA, 22 bp, Homo sapiens
tgccctcattataagaggctca

SEQ ID NO: 7756912 - DNA, 23 bp, Homo sapiens
tgcctcagtggaatgtgagggtg

SEQ ID NO: 7756913 - DNA, 21 bp, Homo sapiens
cccaccccataaggcagaacc

SEQ ID NO: 7756914 - DNA, 22 bp, Homo sapiens
tgcagcagtcagtcaggcctgg

SEQ ID NO: 7756915 - DNA, 22 bp, Homo sapiens
ccagtgttccagagagctgatg

SEQ ID NO: 7756916 - DNA, 22 bp, Homo sapiens
ccagtgttacggcttgaactat

SEQ ID NO: 7756917 - DNA, 22 bp, Homo sapiens
ccagtgttagagactgatacag

SEQ ID NO: 7756918 - DNA, 22 bp, Homo sapiens
ccagtgttattttagagtgtga

SEQ ID NO: 7756919 - DNA, 22 bp, Homo sapiens
ccagtgttcatcaagaaaatgt

SEQ ID NO: 7756920 - DNA, 22 bp, Homo sapiens
ccagtgttcataattttacact

SEQ ID NO: 7756921 - DNA, 22 bp, Homo sapiens
ccagtgttcagtatgcattaag

SEQ ID NO: 7756922 - DNA, 22 bp, Homo sapiens
ccagtgttcaatacatatttgt

SEQ ID NO: 7756923 - DNA, 17 bp, Homo sapiens
cccgttctcttcgctgg

SEQ ID NO: 7756924 - DNA, 22 bp, Homo sapiens
cctcagctgcttccctggagcc

SEQ ID NO: 7756925 - DNA, 22 bp, Homo sapiens
tggcctcagatttcaggggtgg

SEQ ID NO: 7756926 - DNA, 22 bp, Homo sapiens
tggcctcaccactagctgggtg

SEQ ID NO: 7756927 - DNA, 22 bp, Homo sapiens
tggcctcaagtctgagggcctt

SEQ ID NO: 7756928 - DNA, 22 bp, Homo sapiens
cctcactcttgtcctggcaggt

SEQ ID NO: 7756929 - DNA, 22 bp, Homo sapiens
cctcactctgcaccctgcagca

SEQ ID NO: 7756930 - DNA, 22 bp, Homo sapiens
tttgatagttgattaaattcca

SEQ ID NO: 7756931 - DNA, 22 bp, Homo sapiens
tttgaagagccacagtgaaatt

SEQ ID NO: 7756932 - DNA, 22 bp, Homo sapiens
ttttcatgtcatgtccttgagg

SEQ ID NO: 7756933 - DNA, 22 bp, Homo sapiens
ttcttactacatttgcaggcta

SEQ ID NO: 7756934 - DNA, 22 bp, Homo sapiens
ttccttgaatgagtcatggaaa

SEQ ID NO: 7756935 - DNA, 22 bp, Homo sapiens
ttccttgaaagtttgaactgac

SEQ ID NO: 7756936 - DNA, 22 bp, Homo sapiens
ttccttgaccactgcataatga

SEQ ID NO: 7756937 - DNA, 22 bp, Homo sapiens
ttcctggggtactggagaaaat

SEQ ID NO: 7756938 - DNA, 22 bp, Homo sapiens
tttcatgcacaaatgagcaagg

SEQ ID NO: 7756939 - DNA, 22 bp, Homo sapiens
tttatattgtaaaaatggttct

SEQ ID NO: 7756940 - DNA, 22 bp, Homo sapiens
tttagattgtgacctcccccca

SEQ ID NO: 7756941 - DNA, 22 bp, Homo sapiens
ttggaggactagttaagagacc

SEQ ID NO: 7756942 - DNA, 22 bp, Homo sapiens
ttggcattcatgggacaacaaa

SEQ ID NO: 7756943 - DNA, 22 bp, Homo sapiens
ggagataatccagggagggact

SEQ ID NO: 7756944 - DNA, 22 bp, Homo sapiens
ggacacaaaagtgaataaaata

SEQ ID NO: 7756945 - DNA, 22 bp, Homo sapiens
ggaaggggccttgagcaaactg

SEQ ID NO: 7756946 - DNA, 22 bp, Homo sapiens
ggaggagacagtaaaaagcacg

SEQ ID NO: 7756947 - DNA, 22 bp, Homo sapiens
ggagcagcttgcatgctcaggg

SEQ ID NO: 7756948 - DNA, 22 bp, Homo sapiens
ggaggagagaggttgcaaacac

SEQ ID NO: 7756949 - DNA, 22 bp, Homo sapiens
ggaggagcacttctgagctcag

SEQ ID NO: 7756950 - DNA, 22 bp, Homo sapiens
ggagcagccgcgtctcagggca

SEQ ID NO: 7756951 - DNA, 22 bp, Homo sapiens
ggagcagccacgtctcagggca

SEQ ID NO: 7756952 - DNA, 22 bp, Homo sapiens
ggaggggatttagtagatgcta

SEQ ID NO: 7756953 - DNA, 16 bp, Homo sapiens
gctggagggaggggtt

SEQ ID NO: 7756954 - DNA, 22 bp, Homo sapiens
ggcgcacaatgtgcaggtttgt

SEQ ID NO: 7756955 - DNA, 22 bp, Homo sapiens
gtctttggagaggtgccatttc

SEQ ID NO: 7756956 - DNA, 22 bp, Homo sapiens
gtctcagtttgaagtgatgcca

SEQ ID NO: 7756957 - DNA, 22 bp, Homo sapiens
gtctcagttgtatcacctggtt

SEQ ID NO: 7756958 - DNA, 22 bp, Homo sapiens
gtctcagtgtcacctccagctg

SEQ ID NO: 7756959 - DNA, 22 bp, Homo sapiens
gtctcagttactctccctggta

SEQ ID NO: 7756960 - DNA, 22 bp, Homo sapiens
gtctcagtaagaaaggctcctg

SEQ ID NO: 7756961 - DNA, 22 bp, Homo sapiens
gtctcagtgcccaatgccataa

SEQ ID NO: 7756962 - DNA, 20 bp, Homo sapiens
gtgcagccaagctgagccgc

SEQ ID NO: 7756963 - DNA, 22 bp, Homo sapiens
gtgctgaggtgggtgggcagcc

SEQ ID NO: 7756964 - DNA, 22 bp, Homo sapiens
cagctctgaggaacactccttt

SEQ ID NO: 7756965 - DNA, 22 bp, Homo sapiens
cagctctgagactgaggctatg

SEQ ID NO: 7756966 - DNA, 22 bp, Homo sapiens
cagctcctagatcggcgaagtg

SEQ ID NO: 7756967 - DNA, 22 bp, Homo sapiens
gggggaggtgaatgcaataagg

SEQ ID NO: 7756968 - DNA, 22 bp, Homo sapiens
ggggtgagatcaaggaagccct

SEQ ID NO: 7756969 - DNA, 22 bp, Homo sapiens
gagggaagaaagaattgatgcg

SEQ ID NO: 7756970 - DNA, 22 bp, Homo sapiens
gagggatgtgcctgaaggcagg

SEQ ID NO: 7756971 - DNA, 22 bp, Homo sapiens
gatctctgtggactcttagcac

SEQ ID NO: 7756972 - DNA, 22 bp, Homo sapiens
gatctctgggtcctgttggcct

SEQ ID NO: 7756973 - DNA, 22 bp, Homo sapiens
gatctctgaatctgaagccttc

SEQ ID NO: 7756974 - DNA, 22 bp, Homo sapiens
gagcagctagataaagcccttc

SEQ ID NO: 7756975 - DNA, 22 bp, Homo sapiens
gagcagctaaaattctcatgca

SEQ ID NO: 7756976 - DNA, 22 bp, Homo sapiens
atgtaatttatgttatccataa

SEQ ID NO: 7756977 - DNA, 22 bp, Homo sapiens
atgtacaatctatcacaagaag

SEQ ID NO: 7756978 - DNA, 22 bp, Homo sapiens
atgctttagtgtcaagtttggg

SEQ ID NO: 7756979 - DNA, 22 bp, Homo sapiens
gaccctgataggagtagaagaa

SEQ ID NO: 7756980 - DNA, 22 bp, Homo sapiens
gaccctgaggattccctgctga

SEQ ID NO: 7756981 - DNA, 22 bp, Homo sapiens
gaccctgactctaatgcttggc

SEQ ID NO: 7756982 - DNA, 22 bp, Homo sapiens
gaccctgagcaaaagcagttct

SEQ ID NO: 7756983 - DNA, 22 bp, Homo sapiens
gaccctgaggatgcaccagcag

SEQ ID NO: 7756984 - DNA, 22 bp, Homo sapiens
gaaatgaactgattatcattgc

SEQ ID NO: 7756985 - DNA, 22 bp, Homo sapiens
atgcacaagaggctagaaaaga

SEQ ID NO: 7756986 - DNA, 22 bp, Homo sapiens
caaatgaagaaccttctcacct

SEQ ID NO: 7756987 - DNA, 22 bp, Homo sapiens
caaatgaagtccaaagggctta

SEQ ID NO: 7756988 - DNA, 22 bp, Homo sapiens
caaatgaatatttccatgggtt

SEQ ID NO: 7756989 - DNA, 22 bp, Homo sapiens
caaatctccttaaaggtaaaat

SEQ ID NO: 7756990 - DNA, 22 bp, Homo sapiens
gctcagtctttgtggggtacgg

SEQ ID NO: 7756991 - DNA, 22 bp, Homo sapiens
gctcagtgaaacatcaaatagt

SEQ ID NO: 7756992 - DNA, 19 bp, Homo sapiens
gccctcctcactgagctct

SEQ ID NO: 7756993 - DNA, 19 bp, Homo sapiens
gcagatgatgaggctggtc

SEQ ID NO: 7756994 - DNA, 22 bp, Homo sapiens
gcagatgatgtagacagacagt

SEQ ID NO: 7756995 - DNA, 20 bp, Homo sapiens
gcagatgagactcacagagg

SEQ ID NO: 7756996 - DNA, 22 bp, Homo sapiens
gcagatgaagtttacaggaaac

SEQ ID NO: 7756997 - DNA, 22 bp, Homo sapiens
gcagaaggtcaaagcaagatgt

SEQ ID NO: 7756998 - DNA, 22 bp, Homo sapiens
gcaaaaaatgcttgttgcttag

SEQ ID NO: 7756999 - DNA, 22 bp, Homo sapiens
gccacagtcaggacggggagag

SEQ ID NO: 7757000 - DNA, 22 bp, Homo sapiens
gccacagtgggctggggccaga

SEQ ID NO: 7757001 - DNA, 22 bp, Homo sapiens
gccacagtcactgctgcagggg

SEQ ID NO: 7757002 - DNA, 22 bp, Homo sapiens
gcaggatgaaggcagaggctga

SEQ ID NO: 7757003 - DNA, 22 bp, Homo sapiens
gcaggatggtggaaggcctgct

SEQ ID NO: 7757004 - DNA, 22 bp, Homo sapiens
gcaggatgggtgtagcccagca

SEQ ID NO: 7757005 - DNA, 22 bp, Homo sapiens
ctgggggcaagcagacagctgt

SEQ ID NO: 7757006 - DNA, 22 bp, Homo sapiens
cttccttgtggtccttctcatt

SEQ ID NO: 7757007 - DNA, 22 bp, Homo sapiens
cttccttggcttctggggtgtg

SEQ ID NO: 7757008 - DNA, 21 bp, Homo sapiens
atctcgggcttctcgcccagc

SEQ ID NO: 7757009 - DNA, 22 bp, Homo sapiens
atcatacagcctttgttagtgt

SEQ ID NO: 7757010 - DNA, 22 bp, Homo sapiens
cttccttctgaagcatagaagc

SEQ ID NO: 7757011 - DNA, 22 bp, Homo sapiens
cttccttgctgtctgctccagg

SEQ ID NO: 7757012 - DNA, 19 bp, Homo sapiens
cttccttgctccccatgtg

SEQ ID NO: 7757013 - DNA, 22 bp, Homo sapiens
cttccttgcggcccctgcctag

SEQ ID NO: 7757014 - DNA, 22 bp, Homo sapiens
agttctggcggctgtcggcact

SEQ ID NO: 7757015 - DNA, 22 bp, Homo sapiens
agttctggtggtttggagatct

SEQ ID NO: 7757016 - DNA, 22 bp, Homo sapiens
agttctctttagctcatatggt

SEQ ID NO: 7757017 - DNA, 22 bp, Homo sapiens
agttcttcataaccttactgtg

SEQ ID NO: 7757018 - DNA, 22 bp, Homo sapiens
agttttgtaattctcaaaaata

SEQ ID NO: 7757019 - DNA, 22 bp, Homo sapiens
ataaaaatgagggcggtagcta

SEQ ID NO: 7757020 - DNA, 22 bp, Homo sapiens
ccttctcctgccttgggttcat

SEQ ID NO: 7757021 - DNA, 22 bp, Homo sapiens
agtaaataacagagaaaatggg

SEQ ID NO: 7757022 - DNA, 22 bp, Homo sapiens
cctgggggccaggaaggtgtga

SEQ ID NO: 7757023 - DNA, 22 bp, Homo sapiens
agtgcctggcacatggaaggtg

SEQ ID NO: 7757024 - DNA, 22 bp, Homo sapiens
agtcctgggtctggagaatgga

SEQ ID NO: 7757025 - DNA, 22 bp, Homo sapiens
agtctcagaaaagaagcatgga

SEQ ID NO: 7757026 - DNA, 22 bp, Homo sapiens
agtgaggggattcaggcaaggt

SEQ ID NO: 7757027 - DNA, 22 bp, Homo sapiens
agtgaggggcagctgagtgggc

SEQ ID NO: 7757028 - DNA, 22 bp, Homo sapiens
agtgtctttgacacattcaaag

SEQ ID NO: 7757029 - DNA, 22 bp, Homo sapiens
agtgtctttgtctctcaagcac

SEQ ID NO: 7757030 - DNA, 22 bp, Homo sapiens
agtgtgagaacggactaataaa

SEQ ID NO: 7757031 - DNA, 22 bp, Homo sapiens
agtgtgagatgattgaggagca

SEQ ID NO: 7757032 - DNA, 22 bp, Homo sapiens
aggggatggagctggaaggcag

SEQ ID NO: 7757033 - DNA, 22 bp, Homo sapiens
aggggaggcagcgataaacctg

SEQ ID NO: 7757034 - DNA, 22 bp, Homo sapiens
aggggaggtgtccccaaatctc

SEQ ID NO: 7757035 - DNA, 22 bp, Homo sapiens
aggggagagttaatgtgaatgt

SEQ ID NO: 7757036 - DNA, 22 bp, Homo sapiens
agggctggcaagggattgaaat

SEQ ID NO: 7757037 - DNA, 22 bp, Homo sapiens
ccaggtctgcgggcggcaggca

SEQ ID NO: 7757038 - DNA, 22 bp, Homo sapiens
ccagaaagttcagctgtgaatg

SEQ ID NO: 7757039 - DNA, 22 bp, Homo sapiens
ccagaaagaatgaactgaaccc

SEQ ID NO: 7757040 - DNA, 22 bp, Homo sapiens
aggcccagactcagcggggcgg

SEQ ID NO: 7757041 - DNA, 22 bp, Homo sapiens
ccagctctgtaagctgtgaaat

SEQ ID NO: 7757042 - DNA, 22 bp, Homo sapiens
aggaagggttctttgtgaaaga

SEQ ID NO: 7757043 - DNA, 22 bp, Homo sapiens
caggtcctggcatcaggcaggt

SEQ ID NO: 7757044 - DNA, 22 bp, Homo sapiens
aggcagagctaggaagaattgt

SEQ ID NO: 7757045 - DNA, 22 bp, Homo sapiens
ccaaaccatccatctccaggct

SEQ ID NO: 7757046 - DNA, 22 bp, Homo sapiens
aggagcagattggtaagatcat

SEQ ID NO: 7757047 - DNA, 22 bp, Homo sapiens
agaaggagtgtacaggtcatgc

SEQ ID NO: 7757048 - DNA, 22 bp, Homo sapiens
atctctggccttccttttccaa

SEQ ID NO: 7757049 - DNA, 22 bp, Homo sapiens
atctctggttgttttgctccca

SEQ ID NO: 7757050 - DNA, 19 bp, Homo sapiens
agaaatctcgagatttgtt

SEQ ID NO: 7757051 - DNA, 22 bp, Homo sapiens
agaaatctatgttttggttaga

SEQ ID NO: 7757052 - DNA, 22 bp, Homo sapiens
acttccttttgggaaactgttt

SEQ ID NO: 7757053 - DNA, 22 bp, Homo sapiens
atacatatccacaggagataaa

SEQ ID NO: 7757054 - DNA, 22 bp, Homo sapiens
agtgctgaacatagaatggaca

SEQ ID NO: 7757055 - DNA, 22 bp, Homo sapiens
agtactgtcagcagggtgttga

SEQ ID NO: 7757056 - DNA, 22 bp, Homo sapiens
aggaggggcatagaaatgtaat

SEQ ID NO: 7757057 - DNA, 22 bp, Homo sapiens
aggagacataactatgatgaga

SEQ ID NO: 7757058 - DNA, 22 bp, Homo sapiens
aggagacatactataggaatat

SEQ ID NO: 7757059 - DNA, 22 bp, Homo sapiens
agctccaggtgcaagtcatggt

SEQ ID NO: 7757060 - DNA, 22 bp, Homo sapiens
agctgctggggagggcagacac

SEQ ID NO: 7757061 - DNA, 22 bp, Homo sapiens
agctgctggtttaagggatggg

SEQ ID NO: 7757062 - DNA, 22 bp, Homo sapiens
aggcccagctgggccaggaaca

SEQ ID NO: 7757063 - DNA, 21 bp, Homo sapiens
aggcccagctttcctcttgct

SEQ ID NO: 7757064 - DNA, 22 bp, Homo sapiens
aggcccagggctgctctctgaa

SEQ ID NO: 7757065 - DNA, 22 bp, Homo sapiens
acatgaaaagactatctgatta

SEQ ID NO: 7757066 - DNA, 22 bp, Homo sapiens
aggccagccctgggctgagaga

SEQ ID NO: 7757067 - DNA, 22 bp, Homo sapiens
aggccagccctcacctgtgttc

SEQ ID NO: 7757068 - DNA, 22 bp, Homo sapiens
aggccagcagcatgacggcatc

SEQ ID NO: 7757069 - DNA, 22 bp, Homo sapiens
aggccagcacgacagccgcagg

SEQ ID NO: 7757070 - DNA, 22 bp, Homo sapiens
acattcttggactccactctag

SEQ ID NO: 7757071 - DNA, 22 bp, Homo sapiens
agatggagttagtaccagagtc

SEQ ID NO: 7757072 - DNA, 22 bp, Homo sapiens
agatggagaccttggatgaact

SEQ ID NO: 7757073 - DNA, 22 bp, Homo sapiens
caaagatgctgatgttggatca

SEQ ID NO: 7757074 - DNA, 22 bp, Homo sapiens
caaagatgtcattggtaagaca

SEQ ID NO: 7757075 - DNA, 22 bp, Homo sapiens
attttcagaacattcattcact

SEQ ID NO: 7757076 - DNA, 22 bp, Homo sapiens
agagtgagggggcactgagacg

SEQ ID NO: 7757077 - DNA, 22 bp, Homo sapiens
agacctggatgtgagggaagta

SEQ ID NO: 7757078 - DNA, 22 bp, Homo sapiens
atgcatttttgagtatgaatga

SEQ ID NO: 7757079 - DNA, 22 bp, Homo sapiens
agagagcattgaggaaatcttc

SEQ ID NO: 7757080 - DNA, 22 bp, Homo sapiens
agagacaccgcgcatcatggct

SEQ ID NO: 7757081 - DNA, 20 bp, Homo sapiens
agagaattccctttggagat

SEQ ID NO: 7757082 - DNA, 21 bp, Homo sapiens
agagagggagatgaaacatcc

SEQ ID NO: 7757083 - DNA, 22 bp, Homo sapiens
agagcacaggctctggagtcta

SEQ ID NO: 7757084 - DNA, 22 bp, Homo sapiens
agagattgtgctactcacccaa

SEQ ID NO: 7757085 - DNA, 22 bp, Homo sapiens
caccagctacagactactgtgt

SEQ ID NO: 7757086 - DNA, 19 bp, Homo sapiens
cactgtggtccttcactgc

SEQ ID NO: 7757087 - DNA, 22 bp, Homo sapiens
agcagagcgcctgctcagaggg

SEQ ID NO: 7757088 - DNA, 22 bp, Homo sapiens
cagatgtgcatgatgggaaggg

SEQ ID NO: 7757089 - DNA, 22 bp, Homo sapiens
agctcctggacgaacagggagt

SEQ ID NO: 7757090 - DNA, 22 bp, Homo sapiens
agctcctgcttgacagaagagg

SEQ ID NO: 7757091 - DNA, 22 bp, Homo sapiens
agctcctggcaaggtcatggtg

SEQ ID NO: 7757092 - DNA, 22 bp, Homo sapiens
agctcctggctttcctctcacc

SEQ ID NO: 7757093 - DNA, 22 bp, Homo sapiens
agctcctgtctcaagggagcct

SEQ ID NO: 7757094 - DNA, 22 bp, Homo sapiens
agctcctgtggcagctcttctg

SEQ ID NO: 7757095 - DNA, 22 bp, Homo sapiens
agccctgggatacagtaaaagc

SEQ ID NO: 7757096 - DNA, 22 bp, Homo sapiens
agccctgggcagccaaggaagc

SEQ ID NO: 7757097 - DNA, 22 bp, Homo sapiens
cagagccttagttctcctagaa

SEQ ID NO: 7757098 - DNA, 22 bp, Homo sapiens
aaccaggaattgcagggctgca

SEQ ID NO: 7757099 - DNA, 23 bp, Homo sapiens
aagttcttttagatgtcttcgtg

SEQ ID NO: 7757100 - DNA, 22 bp, Homo sapiens
aagttcttgataagtccactgt

SEQ ID NO: 7757101 - DNA, 22 bp, Homo sapiens
aagttctttctggaaggtctgc

SEQ ID NO: 7757102 - DNA, 22 bp, Homo sapiens
aagttcttggaggatgaagagt

SEQ ID NO: 7757103 - DNA, 22 bp, Homo sapiens
aagttcttgctgtgtgtcagat

SEQ ID NO: 7757104 - DNA, 22 bp, Homo sapiens
aataaaatggtcagttttctca

SEQ ID NO: 7757105 - DNA, 22 bp, Homo sapiens
aagtatgtcaatcatacttcaa

SEQ ID NO: 7757106 - DNA, 22 bp, Homo sapiens
aagggagcttaggagatcaggc

SEQ ID NO: 7757107 - DNA, 22 bp, Homo sapiens
aagggagcaaatggacagacgg

SEQ ID NO: 7757108 - DNA, 22 bp, Homo sapiens
aaggggagttagtgataaaacc

SEQ ID NO: 7757109 - DNA, 22 bp, Homo sapiens
aaggggagatgtcatgggccct

SEQ ID NO: 7757110 - DNA, 22 bp, Homo sapiens
aaggggaagagaccgcagagtc

SEQ ID NO: 7757111 - DNA, 22 bp, Homo sapiens
aaggagaaatggtagatgtgca

SEQ ID NO: 7757112 - DNA, 22 bp, Homo sapiens
aagaattggtttcctctgtcat

SEQ ID NO: 7757113 - DNA, 22 bp, Homo sapiens
acagatgaaaaagcttgtggat

SEQ ID NO: 7757114 - DNA, 22 bp, Homo sapiens
acagatgaatttatggatggaa

SEQ ID NO: 7757115 - DNA, 23 bp, Homo sapiens
acagatgaaagtgtggctcagag

SEQ ID NO: 7757116 - DNA, 22 bp, Homo sapiens
acagatgaattttaattgtgtt

SEQ ID NO: 7757117 - DNA, 22 bp, Homo sapiens
acactagctaaatgctgattaa

SEQ ID NO: 7757118 - DNA, 22 bp, Homo sapiens
aaatagaaaccaacaaggtcag

SEQ ID NO: 7757119 - DNA, 22 bp, Homo sapiens
aaaaatgaattcttcagtggca

SEQ ID NO: 7757120 - DNA, 21 bp, Homo sapiens
aaaaatgaagttgttcaggaa

SEQ ID NO: 7757121 - DNA, 22 bp, Homo sapiens
aaaaagatagcattgtgctcct

SEQ ID NO: 7757122 - DNA, 22 bp, Homo sapiens
aaagatctccccttcaaagagt

SEQ ID NO: 7757123 - DNA, 22 bp, Homo sapiens
aaagatgatctacaagttcatt

SEQ ID NO: 7757124 - DNA, 22 bp, Homo sapiens
aaagatgtcacaagatgtgatg

SEQ ID NO: 7757125 - DNA, 22 bp, Homo sapiens
aaagaaggacctggaggaggat

SEQ ID NO: 7757126 - DNA, 22 bp, Homo sapiens
aacacaaagaagctgcaggatc

SEQ ID NO: 7757127 - DNA, 22 bp, Homo sapiens
aagcagatattgtgggagtggg

SEQ ID NO: 7757128 - DNA, 22 bp, Homo sapiens
aagcagatctgatagggccctg

SEQ ID NO: 7757129 - DNA, 22 bp, Homo sapiens
aagcagatgcgttggagcagtt

SEQ ID NO: 7757130 - DNA, 22 bp, Homo sapiens
aagaaaggtgtgtttgcagatg

SEQ ID NO: 7757131 - DNA, 22 bp, Homo sapiens
aagaaagggctattgttctcca

SEQ ID NO: 7757132 - DNA, 22 bp, Homo sapiens
aagaaagtgctttgtaaattat

SEQ ID NO: 7757133 - DNA, 22 bp, Homo sapiens
aagaaaggatatatgggaggta

SEQ ID NO: 7757134 - DNA, 22 bp, Homo sapiens
aagaaagggagaaggatggtgt

SEQ ID NO: 7757135 - DNA, 22 bp, Homo sapiens
agaaaataatttcttggctggt

SEQ ID NO: 7757136 - DNA, 23 bp, Homo sapiens
actcagtgagggccttgggctgc

SEQ ID NO: 7757137 - DNA, 22 bp, Homo sapiens
actcagtgaattttcatcaaat

SEQ ID NO: 7757138 - DNA, 23 bp, Homo sapiens
actcagtgaagcaaacagatagt

SEQ ID NO: 7757139 - DNA, 22 bp, Homo sapiens
actcagtgggcttgatgtcgaa

SEQ ID NO: 7757140 - DNA, 22 bp, Homo sapiens
actcagtggcactttggaattt

SEQ ID NO: 7757141 - DNA, 20 bp, Homo sapiens
acaggagatctgaggaaagg

SEQ ID NO: 7757142 - DNA, 22 bp, Homo sapiens
acagatgaggaatttatttggt

SEQ ID NO: 7757143 - DNA, 22 bp, Homo sapiens
acagatgaggaaacagggtcag

SEQ ID NO: 7757144 - DNA, 23 bp, Homo sapiens
acattacttagccagagtctcag

SEQ ID NO: 7757145 - DNA, 22 bp, Homo sapiens
acattatccctggcacaactgc

SEQ ID NO: 7757146 - DNA, 22 bp, Homo sapiens
accacccagccagcttctccct

SEQ ID NO: 7757147 - DNA, 22 bp, Homo sapiens
accaccccaaatgaacctctgt

SEQ ID NO: 7757148 - DNA, 22 bp, Homo sapiens
accaccccagaatttttcaagg

SEQ ID NO: 7757149 - DNA, 22 bp, Homo sapiens
accacccccttgggtgtggaag

SEQ ID NO: 7757150 - DNA, 22 bp, Homo sapiens
aatggagaccctaaggaagagg

SEQ ID NO: 7757151 - DNA, 23 bp, Homo sapiens
agagaaagggataacacgttgaa

SEQ ID NO: 7757152 - DNA, 19 bp, Homo sapiens
agagaaagaattgagtcta

SEQ ID NO: 7757153 - DNA, 22 bp, Homo sapiens
agacactgccacttctgttccc

SEQ ID NO: 7757154 - DNA, 22 bp, Homo sapiens
agacactgatgttcagctcaat

SEQ ID NO: 7757155 - DNA, 22 bp, Homo sapiens
agcctgtgtgctttggacaggg

SEQ ID NO: 7757156 - DNA, 22 bp, Homo sapiens
tcaggccttgtcctgacctcct

SEQ ID NO: 7757157 - DNA, 22 bp, Homo sapiens
tcataaagcatttcagcttttg

SEQ ID NO: 7757158 - DNA, 22 bp, Homo sapiens
tcagtgcttttgagaagctcct

SEQ ID NO: 7757159 - DNA, 22 bp, Homo sapiens
tcagtgcttgcctctggaggag

SEQ ID NO: 7757160 - DNA, 22 bp, Homo sapiens
tcagtgcttgacagctctggga

SEQ ID NO: 7757161 - DNA, 22 bp, Homo sapiens
tcagtgcttatattctgagcct

SEQ ID NO: 7757162 - DNA, 22 bp, Homo sapiens
tcaggcctttcttcagagcttc

SEQ ID NO: 7757163 - DNA, 22 bp, Homo sapiens
tcagggctgccgggcagaccgt

SEQ ID NO: 7757164 - DNA, 22 bp, Homo sapiens
tcaggtcttttgtctcctagaa

SEQ ID NO: 7757165 - DNA, 22 bp, Homo sapiens
tccagccctgcttcctgcctca

SEQ ID NO: 7757166 - DNA, 22 bp, Homo sapiens
tccagccccggcttccttacag

SEQ ID NO: 7757167 - DNA, 20 bp, Homo sapiens
tccagcccaggtcctgcctg

SEQ ID NO: 7757168 - DNA, 22 bp, Homo sapiens
tccagcccgactgggcctgccg

SEQ ID NO: 7757169 - DNA, 22 bp, Homo sapiens
tccacccctgggaatgtcaata

SEQ ID NO: 7757170 - DNA, 19 bp, Homo sapiens
tccaccccagccagctctg

SEQ ID NO: 7757171 - DNA, 23 bp, Homo sapiens
tccaccccagctgaggcttagcc

SEQ ID NO: 7757172 - DNA, 22 bp, Homo sapiens
tccacccccagacagctggtga

SEQ ID NO: 7757173 - DNA, 22 bp, Homo sapiens
tccacagcacaaagccagtgtg

SEQ ID NO: 7757174 - DNA, 22 bp, Homo sapiens
tccagtcctatctgcccttgga

SEQ ID NO: 7757175 - DNA, 22 bp, Homo sapiens
tccagtcctagaaactggagag

SEQ ID NO: 7757176 - DNA, 18 bp, Homo sapiens
tccagtcccagctctgcc

SEQ ID NO: 7757177 - DNA, 18 bp, Homo sapiens
tccagtcccaaggccagc

SEQ ID NO: 7757178 - DNA, 22 bp, Homo sapiens
tccagtccagggaatggctgat

SEQ ID NO: 7757179 - DNA, 21 bp, Homo sapiens
tcctcctccactaggctagcc

SEQ ID NO: 7757180 - DNA, 22 bp, Homo sapiens
tcctcctcacgctgttgcttgt

SEQ ID NO: 7757181 - DNA, 19 bp, Homo sapiens
tcctcagtgacaacctcag

SEQ ID NO: 7757182 - DNA, 22 bp, Homo sapiens
tcctcagtctctcaaatgaggc

SEQ ID NO: 7757183 - DNA, 22 bp, Homo sapiens
tcctcagtgctagccaactgcc

SEQ ID NO: 7757184 - DNA, 22 bp, Homo sapiens
tcctcagtggggcattcattat

SEQ ID NO: 7757185 - DNA, 22 bp, Homo sapiens
tcctcagttataaataggaaac

SEQ ID NO: 7757186 - DNA, 22 bp, Homo sapiens
tcctcagttttctagtatggca

SEQ ID NO: 7757187 - DNA, 22 bp, Homo sapiens
tcctcagtcgtttgagccaaaa

SEQ ID NO: 7757188 - DNA, 22 bp, Homo sapiens
tcctcagtctctaaggcctcag

SEQ ID NO: 7757189 - DNA, 22 bp, Homo sapiens
tcctcagtattgtggagcagat

SEQ ID NO: 7757190 - DNA, 22 bp, Homo sapiens
tcctcagtcagctccgttcttg

SEQ ID NO: 7757191 - DNA, 22 bp, Homo sapiens
tcctcagtcacggtagcacatt

SEQ ID NO: 7757192 - DNA, 23 bp, Homo sapiens
tcctcagtatataaaggcagatg

SEQ ID NO: 7757193 - DNA, 22 bp, Homo sapiens
taagaaatttagttatagaatg

SEQ ID NO: 7757194 - DNA, 22 bp, Homo sapiens
gtttatatgaacttcataccca

SEQ ID NO: 7757195 - DNA, 22 bp, Homo sapiens
gttccttggaagaacttgaggt

SEQ ID NO: 7757196 - DNA, 22 bp, Homo sapiens
gttccttgggaacaacgctgaa

SEQ ID NO: 7757197 - DNA, 22 bp, Homo sapiens
gttccttgtaatttgttaagga

SEQ ID NO: 7757198 - DNA, 22 bp, Homo sapiens
gttccttgtatttcagacatga

SEQ ID NO: 7757199 - DNA, 22 bp, Homo sapiens
gttcgcatcttgatcatggact

SEQ ID NO: 7757200 - DNA, 22 bp, Homo sapiens
taatgagaattctttttgggta

SEQ ID NO: 7757201 - DNA, 23 bp, Homo sapiens
taatgagaagctttgtttcctga

SEQ ID NO: 7757202 - DNA, 22 bp, Homo sapiens
taatgagactcaattgtgtgtg

SEQ ID NO: 7757203 - DNA, 22 bp, Homo sapiens
taatgagatcatatcttctgag

SEQ ID NO: 7757204 - DNA, 22 bp, Homo sapiens
taagttctcaatacattgtagc

SEQ ID NO: 7757205 - DNA, 22 bp, Homo sapiens
tacatgtctacatgcatttttg

SEQ ID NO: 7757206 - DNA, 22 bp, Homo sapiens
tattgagttacagaaaatactt

SEQ ID NO: 7757207 - DNA, 22 bp, Homo sapiens
tattttcatcttgtccttggat

SEQ ID NO: 7757208 - DNA, 22 bp, Homo sapiens
tattttcattctgtgtgactgt

SEQ ID NO: 7757209 - DNA, 22 bp, Homo sapiens
tattttcaccttctctggatat

SEQ ID NO: 7757210 - DNA, 22 bp, Homo sapiens
tagtgtttagtacatatgcata

SEQ ID NO: 7757211 - DNA, 22 bp, Homo sapiens
tagttaaagccctaaattgata

SEQ ID NO: 7757212 - DNA, 21 bp, Homo sapiens
gtcctcagctgatgggagctg

SEQ ID NO: 7757213 - DNA, 22 bp, Homo sapiens
gtcctcagggaatgtggcgggt

SEQ ID NO: 7757214 - DNA, 22 bp, Homo sapiens
gtcctcagggagtcccagtcat

SEQ ID NO: 7757215 - DNA, 22 bp, Homo sapiens
gtcctcagagtgggcaggtcct

SEQ ID NO: 7757216 - DNA, 22 bp, Homo sapiens
gtcctcagtcagtttggtgggg

SEQ ID NO: 7757217 - DNA, 22 bp, Homo sapiens
gtgctgggtgctgcagacaggt

SEQ ID NO: 7757218 - DNA, 22 bp, Homo sapiens
gtgctggggagataggaagaga

SEQ ID NO: 7757219 - DNA, 22 bp, Homo sapiens
gtgctgggattacaggtgtgag

SEQ ID NO: 7757220 - DNA, 22 bp, Homo sapiens
gtgctgggccctgagaccaggg

SEQ ID NO: 7757221 - DNA, 22 bp, Homo sapiens
gggggacaggatgaatatctgt

SEQ ID NO: 7757222 - DNA, 22 bp, Homo sapiens
ggctagaataattgacttcatt

SEQ ID NO: 7757223 - DNA, 22 bp, Homo sapiens
ggctagaagtcagaggtcaaga

SEQ ID NO: 7757224 - DNA, 22 bp, Homo sapiens
ggctggaagtccaagatcaaga

SEQ ID NO: 7757225 - DNA, 22 bp, Homo sapiens
ggctggaaggtagaagatgagg

SEQ ID NO: 7757226 - DNA, 22 bp, Homo sapiens
ggctggaagtccaagatcaagg

SEQ ID NO: 7757227 - DNA, 23 bp, Homo sapiens
ggctggaagaaaacagaattgtt

SEQ ID NO: 7757228 - DNA, 22 bp, Homo sapiens
ggctggaaaagacaaagctatt

SEQ ID NO: 7757229 - DNA, 22 bp, Homo sapiens
gggagggacacaaagagttccc

SEQ ID NO: 7757230 - DNA, 22 bp, Homo sapiens
ggatggaggttctcagatgctc

SEQ ID NO: 7757231 - DNA, 23 bp, Homo sapiens
ggatggagccactttgaaaccac

SEQ ID NO: 7757232 - DNA, 22 bp, Homo sapiens
ggatgaggtagatgaacaaggg

SEQ ID NO: 7757233 - DNA, 22 bp, Homo sapiens
ggagcaaatgccaagtgggagg

SEQ ID NO: 7757234 - DNA, 22 bp, Homo sapiens
ggagcaagaggtggtgaaaaat

SEQ ID NO: 7757235 - DNA, 18 bp, Homo sapiens
ggcaggagcaagaatagg

SEQ ID NO: 7757236 - DNA, 22 bp, Homo sapiens
ggcctagttttttctggtaggt

SEQ ID NO: 7757237 - DNA, 19 bp, Homo sapiens
ggcctggatttagggctcc

SEQ ID NO: 7757238 - DNA, 22 bp, Homo sapiens
gcttcctccctgctgctcacta

SEQ ID NO: 7757239 - DNA, 22 bp, Homo sapiens
gcttcctcaccttctcttgcat

SEQ ID NO: 7757240 - DNA, 22 bp, Homo sapiens
gcttcctagcattagccattgc

SEQ ID NO: 7757241 - DNA, 22 bp, Homo sapiens
ggacggggagctggaaagggga

SEQ ID NO: 7757242 - DNA, 20 bp, Homo sapiens
gctgggggtgtgctgagtga

SEQ ID NO: 7757243 - DNA, 22 bp, Homo sapiens
gctctcagatgctccagcagcc

SEQ ID NO: 7757244 - DNA, 22 bp, Homo sapiens
gctgcaggttgggcaacagagt

SEQ ID NO: 7757245 - DNA, 22 bp, Homo sapiens
gcctggggtctctgactcacag

SEQ ID NO: 7757246 - DNA, 22 bp, Homo sapiens
gcccatccatggggtcatggcc

SEQ ID NO: 7757247 - DNA, 22 bp, Homo sapiens
gcagggctattggaaggagatg

SEQ ID NO: 7757248 - DNA, 22 bp, Homo sapiens
gccagcccagctccaggggaaa

SEQ ID NO: 7757249 - DNA, 22 bp, Homo sapiens
tggttcctacgcacattgaatt

SEQ ID NO: 7757250 - DNA, 22 bp, Homo sapiens
cctttgatttcccccgtctcag

SEQ ID NO: 7757251 - DNA, 21 bp, Homo sapiens
ccttctccacagggtctccgg

SEQ ID NO: 7757252 - DNA, 22 bp, Homo sapiens
ctcaggccattcttccagctgc

SEQ ID NO: 7757253 - DNA, 22 bp, Homo sapiens
ctcaggccaggtttctcccaca

SEQ ID NO: 7757254 - DNA, 18 bp, Homo sapiens
ctcaggcctttccctgtg

SEQ ID NO: 7757255 - DNA, 22 bp, Homo sapiens
ctcaggccttgaagtcttttct

SEQ ID NO: 7757256 - DNA, 22 bp, Homo sapiens
ctcaggcctgagtggcagtccc

SEQ ID NO: 7757257 - DNA, 22 bp, Homo sapiens
ctagttctgccattcagtgtca

SEQ ID NO: 7757258 - DNA, 22 bp, Homo sapiens
ttctccttgaaaagctgcatct

SEQ ID NO: 7757259 - DNA, 19 bp, Homo sapiens
ttctcagttcaggagaaga

SEQ ID NO: 7757260 - DNA, 22 bp, Homo sapiens
ttctcagtttcatagctgagca

SEQ ID NO: 7757261 - DNA, 23 bp, Homo sapiens
ttctcagtcctgcccagggaggc

SEQ ID NO: 7757262 - DNA, 22 bp, Homo sapiens
ttctcagtatgtgacgaggacc

SEQ ID NO: 7757263 - DNA, 22 bp, Homo sapiens
ttcctctgaaatggcttggaaa

SEQ ID NO: 7757264 - DNA, 22 bp, Homo sapiens
ttttcagtttgcactgcagtgc

SEQ ID NO: 7757265 - DNA, 18 bp, Homo sapiens
ctgagggcaacagaggct

SEQ ID NO: 7757266 - DNA, 22 bp, Homo sapiens
ctgcccctggtgatggacgcca

SEQ ID NO: 7757267 - DNA, 20 bp, Homo sapiens
ctcctcagttccatgggagg

SEQ ID NO: 7757268 - DNA, 22 bp, Homo sapiens
tttatattacctggaatagctt

SEQ ID NO: 7757269 - DNA, 22 bp, Homo sapiens
ctccctgcttgtttcccttcag

SEQ ID NO: 7757270 - DNA, 22 bp, Homo sapiens
ctcctcagctgggaggagtccc

SEQ ID NO: 7757271 - DNA, 22 bp, Homo sapiens
ctctgaggctccatgcaggctt

SEQ ID NO: 7757272 - DNA, 22 bp, Homo sapiens
ctctgagggctcgagggacgcg

SEQ ID NO: 7757273 - DNA, 22 bp, Homo sapiens
ctctgagggtctaaggagtcac

SEQ ID NO: 7757274 - DNA, 22 bp, Homo sapiens
ctctgaggtcctacagtgaccc

SEQ ID NO: 7757275 - DNA, 22 bp, Homo sapiens
cttccaagttgctctgctgacc

SEQ ID NO: 7757276 - DNA, 22 bp, Homo sapiens
gaaggcaggtttttcaaaactg

SEQ ID NO: 7757277 - DNA, 22 bp, Homo sapiens
gaagggagaaggttgggtgacg

SEQ ID NO: 7757278 - DNA, 16 bp, Homo sapiens
gaaggagattcagaaa

SEQ ID NO: 7757279 - DNA, 20 bp, Homo sapiens
gaagccagaggggaaaggag

SEQ ID NO: 7757280 - DNA, 22 bp, Homo sapiens
gaaggagagggtcaaggataat

SEQ ID NO: 7757281 - DNA, 22 bp, Homo sapiens
gaaggagctaccaagactgaat

SEQ ID NO: 7757282 - DNA, 22 bp, Homo sapiens
gaaaggagggaaacagagcggt

SEQ ID NO: 7757283 - DNA, 22 bp, Homo sapiens
gaatctcagtggaagcaggaag

SEQ ID NO: 7757284 - DNA, 22 bp, Homo sapiens
gaatctcattctaactagtagg

SEQ ID NO: 7757285 - DNA, 22 bp, Homo sapiens
gaatctcaggaagatctctgca

SEQ ID NO: 7757286 - DNA, 22 bp, Homo sapiens
gaatctcaaattaagaatttta

SEQ ID NO: 7757287 - DNA, 18 bp, Homo sapiens
gaagggagctggaatgca

SEQ ID NO: 7757288 - DNA, 22 bp, Homo sapiens
gaaggggactggcagctgcaga

SEQ ID NO: 7757289 - DNA, 19 bp, Homo sapiens
gaaggggaaggtgggtacc

SEQ ID NO: 7757290 - DNA, 22 bp, Homo sapiens
gaaggggaaagttgagcaaata

SEQ ID NO: 7757291 - DNA, 22 bp, Homo sapiens
gaaggtagctgctgagatgaca

SEQ ID NO: 7757292 - DNA, 22 bp, Homo sapiens
gaggagaggggctcccaagagc

SEQ ID NO: 7757293 - DNA, 22 bp, Homo sapiens
gaggagagatggtagattgggt

SEQ ID NO: 7757294 - DNA, 22 bp, Homo sapiens
gaggagaggccatcgttgttat

SEQ ID NO: 7757295 - DNA, 22 bp, Homo sapiens
gaggcagggtgttgattacaga

SEQ ID NO: 7757296 - DNA, 22 bp, Homo sapiens
gagggctgctggaaaaatgcag

SEQ ID NO: 7757297 - DNA, 22 bp, Homo sapiens
gagggctgctgccagatatgcc

SEQ ID NO: 7757298 - DNA, 22 bp, Homo sapiens
gagggctgcaatgagacagaga

SEQ ID NO: 7757299 - DNA, 22 bp, Homo sapiens
tgcttccttgatcattcccaaa

SEQ ID NO: 7757300 - DNA, 22 bp, Homo sapiens
tgcttccttgagctctccaatc

SEQ ID NO: 7757301 - DNA, 22 bp, Homo sapiens
tgcttccttcccgttcttctcc

SEQ ID NO: 7757302 - DNA, 22 bp, Homo sapiens
tgcttcctatccacacaatgcc

SEQ ID NO: 7757303 - DNA, 22 bp, Homo sapiens
tgcttcctgaggccgtcttctc

SEQ ID NO: 7757304 - DNA, 22 bp, Homo sapiens
tgctgcctggagccttttgttt

SEQ ID NO: 7757305 - DNA, 22 bp, Homo sapiens
tgctgcctggtttcttcttgct

SEQ ID NO: 7757306 - DNA, 22 bp, Homo sapiens
cccagtccagaccatgacctca

SEQ ID NO: 7757307 - DNA, 19 bp, Homo sapiens
cccagtccttgtcctgggc

SEQ ID NO: 7757308 - DNA, 16 bp, Homo sapiens
tggaggcatctggccc

SEQ ID NO: 7757309 - DNA, 22 bp, Homo sapiens
tggcagggaatacagatgttta

SEQ ID NO: 7757310 - DNA, 19 bp, Homo sapiens
tggcagggagagtttgaag

SEQ ID NO: 7757311 - DNA, 22 bp, Homo sapiens
cctccagtcacctggatgagaa

SEQ ID NO: 7757312 - DNA, 22 bp, Homo sapiens
cctgccctgtcactggctaggg

SEQ ID NO: 7757313 - DNA, 22 bp, Homo sapiens
tggggagagttacaaggaatct

SEQ ID NO: 7757314 - DNA, 22 bp, Homo sapiens
tggggagcacggtagggaaatg

SEQ ID NO: 7757315 - DNA, 22 bp, Homo sapiens
ccaggcctcctgtgagtggacc

SEQ ID NO: 7757316 - DNA, 19 bp, Homo sapiens
ccaggcctcctgggaggtc

SEQ ID NO: 7757317 - DNA, 21 bp, Homo sapiens
tctgtggcggactctaggccc

SEQ ID NO: 7757318 - DNA, 22 bp, Homo sapiens
ccaggcctctggctgcttagtc

SEQ ID NO: 7757319 - DNA, 23 bp, Homo sapiens
ccaggcctctcagagggtgtgcc

SEQ ID NO: 7757320 - DNA, 19 bp, Homo sapiens
ccaggcctctggggcctgt

SEQ ID NO: 7757321 - DNA, 22 bp, Homo sapiens
ccaggcctgattgggaatcttg

SEQ ID NO: 7757322 - DNA, 22 bp, Homo sapiens
tgcactttgcaggcatggaaac

SEQ ID NO: 7757323 - DNA, 22 bp, Homo sapiens
ccagtgttttccagtttgccca

SEQ ID NO: 7757324 - DNA, 20 bp, Homo sapiens
ccagtccacctgagacatgt

SEQ ID NO: 7757325 - DNA, 22 bp, Homo sapiens
ccagtccacgtcaagaagaggt

SEQ ID NO: 7757326 - DNA, 22 bp, Homo sapiens
cagtgcaggtttagggctgggg

SEQ ID NO: 7757327 - DNA, 22 bp, Homo sapiens
cagtgcagttggtggcaggggt

SEQ ID NO: 7757328 - DNA, 22 bp, Homo sapiens
cagtgcagaggccagggaggat

SEQ ID NO: 7757329 - DNA, 22 bp, Homo sapiens
cagtgcaggtggcagaggacag

SEQ ID NO: 7757330 - DNA, 22 bp, Homo sapiens
cagtgctgttgtaagctcattg

SEQ ID NO: 7757331 - DNA, 22 bp, Homo sapiens
cagggctggatcctccagactc

SEQ ID NO: 7757332 - DNA, 22 bp, Homo sapiens
tagtgttctaagaacatccatg

SEQ ID NO: 7757333 - DNA, 22 bp, Homo sapiens
tatgtacatcgttgaattcaaa

SEQ ID NO: 7757334 - DNA, 22 bp, Homo sapiens
cagtactgcttgtgggagcaga

SEQ ID NO: 7757335 - DNA, 22 bp, Homo sapiens
tacctcaagttccaggaaagcg

SEQ ID NO: 7757336 - DNA, 22 bp, Homo sapiens
tagacattaggtaggttcatgg

SEQ ID NO: 7757337 - DNA, 22 bp, Homo sapiens
tagacatttggagttttatgac

SEQ ID NO: 7757338 - DNA, 22 bp, Homo sapiens
tagacatttggcatggttttca

SEQ ID NO: 7757339 - DNA, 22 bp, Homo sapiens
tagacattatgtattaagttct

SEQ ID NO: 7757340 - DNA, 22 bp, Homo sapiens
tagacattggccattcctgtgg

SEQ ID NO: 7757341 - DNA, 22 bp, Homo sapiens
cagctctgcctctggggctgag

SEQ ID NO: 7757342 - DNA, 19 bp, Homo sapiens
tcctgcccaccagccaggg

SEQ ID NO: 7757343 - DNA, 22 bp, Homo sapiens
tctcagtggcttcctcactttt

SEQ ID NO: 7757344 - DNA, 22 bp, Homo sapiens
tctcagtggtggcattccagac

SEQ ID NO: 7757345 - DNA, 22 bp, Homo sapiens
tctcagtgggttaaaagagaag

SEQ ID NO: 7757346 - DNA, 22 bp, Homo sapiens
tctcagtgggaagggcacagtt

SEQ ID NO: 7757347 - DNA, 22 bp, Homo sapiens
tctcagtgtggtgcttaggata

SEQ ID NO: 7757348 - DNA, 22 bp, Homo sapiens
tctcagtggtgttttgagtcca

SEQ ID NO: 7757349 - DNA, 22 bp, Homo sapiens
tctcagtgtgttgagaggtctg

SEQ ID NO: 7757350 - DNA, 22 bp, Homo sapiens
tctcagtgttatctatctgcct

SEQ ID NO: 7757351 - DNA, 22 bp, Homo sapiens
tctcagtgtgttttctctcaga

SEQ ID NO: 7757352 - DNA, 22 bp, Homo sapiens
tctcagtgttgttctgcagatg

SEQ ID NO: 7757353 - DNA, 22 bp, Homo sapiens
tctcagtgtttaaaaagatttc

SEQ ID NO: 7757354 - DNA, 22 bp, Homo sapiens
tctcagtggatctcagaatttt

SEQ ID NO: 7757355 - DNA, 22 bp, Homo sapiens
tctcagagaagtgatgagcaat

SEQ ID NO: 7757356 - DNA, 22 bp, Homo sapiens
ccaccccaaatgaagacctctc

SEQ ID NO: 7757357 - DNA, 22 bp, Homo sapiens
tcagtgtgaggggctgggtcct

SEQ ID NO: 7757358 - DNA, 22 bp, Homo sapiens
tcagtgtcttgacctgggtgtg

SEQ ID NO: 7757359 - DNA, 22 bp, Homo sapiens
tcagtgtgcacatggtagcagt

SEQ ID NO: 7757360 - DNA, 23 bp, Homo sapiens
tcagtgtgcaagaatggagaagc

SEQ ID NO: 7757361 - DNA, 19 bp, Homo sapiens
tcagtgtgtgggaggtggt

SEQ ID NO: 7757362 - DNA, 22 bp, Homo sapiens
catgctttgggtcagaaatgcc

SEQ ID NO: 7757363 - DNA, 22 bp, Homo sapiens
tttgggctggtttgccatgccc

SEQ ID NO: 7757364 - DNA, 22 bp, Homo sapiens
tttaacagatgtgaaattttca

SEQ ID NO: 7757365 - DNA, 22 bp, Homo sapiens
tttaacttagaagagatatcct

SEQ ID NO: 7757366 - DNA, 22 bp, Homo sapiens
ttgtttaaaagaaatcatagaa

SEQ ID NO: 7757367 - DNA, 22 bp, Homo sapiens
tttccttgcctcctgtccttct

SEQ ID NO: 7757368 - DNA, 22 bp, Homo sapiens
tttccttgcacattggtttcca

SEQ ID NO: 7757369 - DNA, 22 bp, Homo sapiens
ttgcattttggttgtaaatatg

SEQ ID NO: 7757370 - DNA, 22 bp, Homo sapiens
ttggaattcaagttgtagctta

SEQ ID NO: 7757371 - DNA, 22 bp, Homo sapiens
ttatttaaaagtggtaagattc

SEQ ID NO: 7757372 - DNA, 20 bp, Homo sapiens
attattcatacatgtgtgac

SEQ ID NO: 7757373 - DNA, 22 bp, Homo sapiens
attattgtgataggtgtcagtg

SEQ ID NO: 7757374 - DNA, 22 bp, Homo sapiens
attgaagattaaatgcttcctt

SEQ ID NO: 7757375 - DNA, 22 bp, Homo sapiens
attgaaaaatgactattgctta

SEQ ID NO: 7757376 - DNA, 22 bp, Homo sapiens
attggaaatacagtagaaaaat

SEQ ID NO: 7757377 - DNA, 22 bp, Homo sapiens
caaaccttgcagaactgggcag

SEQ ID NO: 7757378 - DNA, 20 bp, Homo sapiens
atgcaaactcacaaaatacc

SEQ ID NO: 7757379 - DNA, 19 bp, Homo sapiens
atgaggaactgaggctcag

SEQ ID NO: 7757380 - DNA, 22 bp, Homo sapiens
atgagtgtgaagttagctcagt

SEQ ID NO: 7757381 - DNA, 22 bp, Homo sapiens
atgaaatgtatgagtctgggtt

SEQ ID NO: 7757382 - DNA, 22 bp, Homo sapiens
atgaaatgctgagaggtgcttc

SEQ ID NO: 7757383 - DNA, 22 bp, Homo sapiens
gaggggagacagggaaatcagt

SEQ ID NO: 7757384 - DNA, 18 bp, Homo sapiens
atgtacatttgctaaagc

SEQ ID NO: 7757385 - DNA, 22 bp, Homo sapiens
ggaaaagacagaattctagaat

SEQ ID NO: 7757386 - DNA, 20 bp, Homo sapiens
gctgccttgtcctgcttggt

SEQ ID NO: 7757387 - DNA, 22 bp, Homo sapiens
gctgccttcccggaatgtcatc

SEQ ID NO: 7757388 - DNA, 22 bp, Homo sapiens
gctgccttcccaggcctttgct

SEQ ID NO: 7757389 - DNA, 22 bp, Homo sapiens
caaggagataaaatgttgagct

SEQ ID NO: 7757390 - DNA, 22 bp, Homo sapiens
caaggagagtaattgaatgaga

SEQ ID NO: 7757391 - DNA, 22 bp, Homo sapiens
caaggagaaaacggcttctgaa

SEQ ID NO: 7757392 - DNA, 22 bp, Homo sapiens
caagatgacaaggctggaggct

SEQ ID NO: 7757393 - DNA, 22 bp, Homo sapiens
cacagtgtctgtgcttcagtgt

SEQ ID NO: 7757394 - DNA, 22 bp, Homo sapiens
cacagtgtgactgaccttcagc

SEQ ID NO: 7757395 - DNA, 22 bp, Homo sapiens
cacagtgtgggcatggtgcctg

SEQ ID NO: 7757396 - DNA, 22 bp, Homo sapiens
cacagtgtagactaataataga

SEQ ID NO: 7757397 - DNA, 22 bp, Homo sapiens
ggagggagggctagaccaaaga

SEQ ID NO: 7757398 - DNA, 22 bp, Homo sapiens
caccccagtctaaaaccagcct

SEQ ID NO: 7757399 - DNA, 22 bp, Homo sapiens
gtaaaattctagcatctgaaag

SEQ ID NO: 7757400 - DNA, 22 bp, Homo sapiens
cagccactggtgccaggctgtt

SEQ ID NO: 7757401 - DNA, 21 bp, Homo sapiens
cagcccagagcagtggggcca

SEQ ID NO: 7757402 - DNA, 22 bp, Homo sapiens
cagcccagcagggtctggccct

SEQ ID NO: 7757403 - DNA, 22 bp, Homo sapiens
gggagcaggacataatagcaat

SEQ ID NO: 7757404 - DNA, 22 bp, Homo sapiens
gggaaaaataatgcacagatat

SEQ ID NO: 7757405 - DNA, 20 bp, Homo sapiens
ggggaagaaaaggatgtgat

SEQ ID NO: 7757406 - DNA, 22 bp, Homo sapiens
ggggaaaggccatggcaagaac

SEQ ID NO: 7757407 - DNA, 22 bp, Homo sapiens
gggcgagggcgaaagcgagagc

SEQ ID NO: 7757408 - DNA, 23 bp, Homo sapiens
atatgtcatgcaccagcacttta

SEQ ID NO: 7757409 - DNA, 22 bp, Homo sapiens
atatgcaagcacatagaatact

SEQ ID NO: 7757410 - DNA, 22 bp, Homo sapiens
atccccaggggcattcaagctt

SEQ ID NO: 7757411 - DNA, 22 bp, Homo sapiens
agttgtcccggtctagccactt

SEQ ID NO: 7757412 - DNA, 22 bp, Homo sapiens
agttggagtgaacatgagattg

SEQ ID NO: 7757413 - DNA, 22 bp, Homo sapiens
agttggagaagaggtcgggaat

SEQ ID NO: 7757414 - DNA, 22 bp, Homo sapiens
ctggagggatgtagggtgtatt

SEQ ID NO: 7757415 - DNA, 22 bp, Homo sapiens
ctggagggagattcaaaggagg

SEQ ID NO: 7757416 - DNA, 20 bp, Homo sapiens
ctgctctgctttgcaggtgg

SEQ ID NO: 7757417 - DNA, 22 bp, Homo sapiens
ctccttctgggcctggcagtgg

SEQ ID NO: 7757418 - DNA, 22 bp, Homo sapiens
agtgctggattacaggcgtgag

SEQ ID NO: 7757419 - DNA, 22 bp, Homo sapiens
agtgctggagggaggcaggttc

SEQ ID NO: 7757420 - DNA, 22 bp, Homo sapiens
agtgctggaaagggacggagga

SEQ ID NO: 7757421 - DNA, 22 bp, Homo sapiens
ctcagctgcagcctggctggca

SEQ ID NO: 7757422 - DNA, 22 bp, Homo sapiens
agtctcagcaagcatggctagt

SEQ ID NO: 7757423 - DNA, 22 bp, Homo sapiens
agtctcagctacttgggaggct

SEQ ID NO: 7757424 - DNA, 22 bp, Homo sapiens
ctcagctctgacaggaggcatc

SEQ ID NO: 7757425 - DNA, 23 bp, Homo sapiens
agtctcagctggaaacatgtgtc

SEQ ID NO: 7757426 - DNA, 20 bp, Homo sapiens
ctcagtgtattctgggtgct

SEQ ID NO: 7757427 - DNA, 22 bp, Homo sapiens
ctcagtgctttggatcctggat

SEQ ID NO: 7757428 - DNA, 22 bp, Homo sapiens
ctcagacccccagagctgctaa

SEQ ID NO: 7757429 - DNA, 22 bp, Homo sapiens
aggtggggctgggaaagattcc

SEQ ID NO: 7757430 - DNA, 22 bp, Homo sapiens
aggtgctggagtagaagaaaaa

SEQ ID NO: 7757431 - DNA, 17 bp, Homo sapiens
aggtgctggagcatcag

SEQ ID NO: 7757432 - DNA, 22 bp, Homo sapiens
cctgcccccgtcagaggtgatg

SEQ ID NO: 7757433 - DNA, 22 bp, Homo sapiens
cccagctctaggagtggtggca

SEQ ID NO: 7757434 - DNA, 22 bp, Homo sapiens
cccagcctgatctcggccagct

SEQ ID NO: 7757435 - DNA, 22 bp, Homo sapiens
cccagctccttacagggccgaa

SEQ ID NO: 7757436 - DNA, 22 bp, Homo sapiens
cccagctccttggatgggcagg

SEQ ID NO: 7757437 - DNA, 22 bp, Homo sapiens
agggagaggttgaaacctcagt

SEQ ID NO: 7757438 - DNA, 22 bp, Homo sapiens
cctcagtgacctattgcattca

SEQ ID NO: 7757439 - DNA, 22 bp, Homo sapiens
cctcagtgagatgctcagcgaa

SEQ ID NO: 7757440 - DNA, 22 bp, Homo sapiens
aggcccagtgtggcttcctgga

SEQ ID NO: 7757441 - DNA, 22 bp, Homo sapiens
aggccagcttccagaggggcag

SEQ ID NO: 7757442 - DNA, 22 bp, Homo sapiens
aggcccagtagtgctgccttta

SEQ ID NO: 7757443 - DNA, 22 bp, Homo sapiens
aggcccagtagtcgacggcgct

SEQ ID NO: 7757444 - DNA, 22 bp, Homo sapiens
aggccagcctcaggcagggacc

SEQ ID NO: 7757445 - DNA, 22 bp, Homo sapiens
ccagtctgctgtggtaggaaga

SEQ ID NO: 7757446 - DNA, 22 bp, Homo sapiens
aggcctcagcctgccaggcctg

SEQ ID NO: 7757447 - DNA, 22 bp, Homo sapiens
ccaggcctagcccctgagggta

SEQ ID NO: 7757448 - DNA, 22 bp, Homo sapiens
cagctctgaagaaaggtgtcta

SEQ ID NO: 7757449 - DNA, 22 bp, Homo sapiens
agctctctgataaattgataaa

SEQ ID NO: 7757450 - DNA, 22 bp, Homo sapiens
agctcctgtgtgaagcctccct

SEQ ID NO: 7757451 - DNA, 22 bp, Homo sapiens
cagctcctgcctgggcagctgt

SEQ ID NO: 7757452 - DNA, 22 bp, Homo sapiens
caggcctggagtgcaatggcac

SEQ ID NO: 7757453 - DNA, 22 bp, Homo sapiens
caggcctggctgcagctcgcct

SEQ ID NO: 7757454 - DNA, 22 bp, Homo sapiens
aggaggcactcactctcagggt

SEQ ID NO: 7757455 - DNA, 22 bp, Homo sapiens
cagtctctctccttgcaggcgt

SEQ ID NO: 7757456 - DNA, 22 bp, Homo sapiens
cagtctctcttgtagtgcagct

SEQ ID NO: 7757457 - DNA, 22 bp, Homo sapiens
aggagacagaatttaaatttgg

SEQ ID NO: 7757458 - DNA, 20 bp, Homo sapiens
cagtcctgcaggcgggagaa

SEQ ID NO: 7757459 - DNA, 22 bp, Homo sapiens
cagtcctgagctcctgggctga

SEQ ID NO: 7757460 - DNA, 22 bp, Homo sapiens
cagtcctgaggaagagctgctg

SEQ ID NO: 7757461 - DNA, 22 bp, Homo sapiens
cagtcctgaatactggacggtg

SEQ ID NO: 7757462 - DNA, 22 bp, Homo sapiens
cagtcctgagccaatcatgatg

SEQ ID NO: 7757463 - DNA, 22 bp, Homo sapiens
cagtcctgcccaggctgacaga

SEQ ID NO: 7757464 - DNA, 22 bp, Homo sapiens
cagtcctgctagtgtgaaaagc

SEQ ID NO: 7757465 - DNA, 20 bp, Homo sapiens
cagtcctgccccttggggac

SEQ ID NO: 7757466 - DNA, 22 bp, Homo sapiens
cagtcctggagcccttcttggc

SEQ ID NO: 7757467 - DNA, 22 bp, Homo sapiens
cagtcctgctggccttccctgg

SEQ ID NO: 7757468 - DNA, 20 bp, Homo sapiens
aggaggcaatgtagataagc

SEQ ID NO: 7757469 - DNA, 22 bp, Homo sapiens
aggagaggggtaggattaattt

SEQ ID NO: 7757470 - DNA, 22 bp, Homo sapiens
aggagaggcatcaagaaaatcg

SEQ ID NO: 7757471 - DNA, 22 bp, Homo sapiens
agatgtgagaatcaagtgacca

SEQ ID NO: 7757472 - DNA, 22 bp, Homo sapiens
agatgacaaatcaggggacggg

SEQ ID NO: 7757473 - DNA, 22 bp, Homo sapiens
agatgaagatatctgcaggggc

SEQ ID NO: 7757474 - DNA, 22 bp, Homo sapiens
agatgaagactcaggagcaggt

SEQ ID NO: 7757475 - DNA, 22 bp, Homo sapiens
agatgaaatttgtgttgagttg

SEQ ID NO: 7757476 - DNA, 23 bp, Homo sapiens
agatgaaagcttcccatcacagt

SEQ ID NO: 7757477 - DNA, 22 bp, Homo sapiens
agatgaaagatttttatagaga

SEQ ID NO: 7757478 - DNA, 22 bp, Homo sapiens
agatgaaaagataagcagcaat

SEQ ID NO: 7757479 - DNA, 22 bp, Homo sapiens
agagggagtgaaatggaataga

SEQ ID NO: 7757480 - DNA, 22 bp, Homo sapiens
agagggatcaccctgtttctgg

SEQ ID NO: 7757481 - DNA, 22 bp, Homo sapiens
attaaagaaacccagcatgtga

SEQ ID NO: 7757482 - DNA, 22 bp, Homo sapiens
attaaagacagcagatggatgg

SEQ ID NO: 7757483 - DNA, 22 bp, Homo sapiens
atggaaatatctttagagctta

SEQ ID NO: 7757484 - DNA, 20 bp, Homo sapiens
atctttgtctctgtagttgt

SEQ ID NO: 7757485 - DNA, 22 bp, Homo sapiens
atctttgtgctaatgtagttct

SEQ ID NO: 7757486 - DNA, 22 bp, Homo sapiens
caatgaaagcaactgcctataa

SEQ ID NO: 7757487 - DNA, 17 bp, Homo sapiens
agcagaagtcagaggga

SEQ ID NO: 7757488 - DNA, 22 bp, Homo sapiens
cacagtcccattcgagagtaat

SEQ ID NO: 7757489 - DNA, 22 bp, Homo sapiens
cacagtccagactcctggagtt

SEQ ID NO: 7757490 - DNA, 22 bp, Homo sapiens
cagccctggcctcttcgctttc

SEQ ID NO: 7757491 - DNA, 22 bp, Homo sapiens
cagccctggccccaggtggtct

SEQ ID NO: 7757492 - DNA, 22 bp, Homo sapiens
cagccctgggagttggggccga

SEQ ID NO: 7757493 - DNA, 22 bp, Homo sapiens
cagccctggctagggcgagggc

SEQ ID NO: 7757494 - DNA, 19 bp, Homo sapiens
agccccttggtactgtcct

SEQ ID NO: 7757495 - DNA, 22 bp, Homo sapiens
agccccttgctgccctctagag

SEQ ID NO: 7757496 - DNA, 22 bp, Homo sapiens
agccccttgcacttccccacgc

SEQ ID NO: 7757497 - DNA, 22 bp, Homo sapiens
atccagctttgtctggtcttcg

SEQ ID NO: 7757498 - DNA, 21 bp, Homo sapiens
agtttcctcaactgcagaagg

SEQ ID NO: 7757499 - DNA, 22 bp, Homo sapiens
agtctctggactgggagatggc

SEQ ID NO: 7757500 - DNA, 22 bp, Homo sapiens
agtctggggtctggtagaacga

SEQ ID NO: 7757501 - DNA, 22 bp, Homo sapiens
agtctgggagaaggtgagatta

SEQ ID NO: 7757502 - DNA, 22 bp, Homo sapiens
acctgtggatcagattcttgta

SEQ ID NO: 7757503 - DNA, 22 bp, Homo sapiens
acatgaaagttattctgagttg

SEQ ID NO: 7757504 - DNA, 22 bp, Homo sapiens
acatgaaagttattctgagttg

SEQ ID NO: 7757505 - DNA, 22 bp, Homo sapiens
aggcagggctgggattagactc

SEQ ID NO: 7757506 - DNA, 20 bp, Homo sapiens
acagtgtttttgagtagagc

SEQ ID NO: 7757507 - DNA, 22 bp, Homo sapiens
acagtgttttgtctggcagggc

SEQ ID NO: 7757508 - DNA, 22 bp, Homo sapiens
acagtgttttcttaaggagaaa

SEQ ID NO: 7757509 - DNA, 22 bp, Homo sapiens
acagtgttttatgagaattgtt

SEQ ID NO: 7757510 - DNA, 22 bp, Homo sapiens
acagtgttcttgatattacagt

SEQ ID NO: 7757511 - DNA, 22 bp, Homo sapiens
acagtgttttagaaaagcttga

SEQ ID NO: 7757512 - DNA, 22 bp, Homo sapiens
acagtgttctgctttttaatcc

SEQ ID NO: 7757513 - DNA, 22 bp, Homo sapiens
acagctctccctcagagaaatg

SEQ ID NO: 7757514 - DNA, 22 bp, Homo sapiens
acagctctgagatattactatt

SEQ ID NO: 7757515 - DNA, 22 bp, Homo sapiens
acagatgagttagaataggcag

SEQ ID NO: 7757516 - DNA, 22 bp, Homo sapiens
acagatgagttaaagcagagtg

SEQ ID NO: 7757517 - DNA, 22 bp, Homo sapiens
acagatgaggctggcgagggca

SEQ ID NO: 7757518 - DNA, 22 bp, Homo sapiens
acagatgaggtgtttggagagc

SEQ ID NO: 7757519 - DNA, 22 bp, Homo sapiens
acagatgatgtgcacagataga

SEQ ID NO: 7757520 - DNA, 22 bp, Homo sapiens
agctcctgcgcacggtgcacac

SEQ ID NO: 7757521 - DNA, 22 bp, Homo sapiens
agctcctgcccaggaaggctct

SEQ ID NO: 7757522 - DNA, 22 bp, Homo sapiens
agctcctgcaccaggggcccct

SEQ ID NO: 7757523 - DNA, 22 bp, Homo sapiens
agcagatgtttcagagcaggct

SEQ ID NO: 7757524 - DNA, 22 bp, Homo sapiens
agcagatggtgtcatgggatgg

SEQ ID NO: 7757525 - DNA, 22 bp, Homo sapiens
agcagatgcgtctgagtgggag

SEQ ID NO: 7757526 - DNA, 22 bp, Homo sapiens
agcagatgaatcccagataaag

SEQ ID NO: 7757527 - DNA, 22 bp, Homo sapiens
agaggccctctctctcctgatg

SEQ ID NO: 7757528 - DNA, 22 bp, Homo sapiens
aatggagacttcaaaatggatt

SEQ ID NO: 7757529 - DNA, 22 bp, Homo sapiens
agagacaggatatctgctcatg

SEQ ID NO: 7757530 - DNA, 22 bp, Homo sapiens
aattaaaaaaggagagcttgct

SEQ ID NO: 7757531 - DNA, 22 bp, Homo sapiens
agagacagatctgagggacctc

SEQ ID NO: 7757532 - DNA, 22 bp, Homo sapiens
agaaatctttgaagtgtaatgt

SEQ ID NO: 7757533 - DNA, 22 bp, Homo sapiens
agaaatgacaagactgatcagg

SEQ ID NO: 7757534 - DNA, 22 bp, Homo sapiens
agaaatgacacacatgagacat

SEQ ID NO: 7757535 - DNA, 22 bp, Homo sapiens
aatcagaaagaggtcatgttgc

SEQ ID NO: 7757536 - DNA, 22 bp, Homo sapiens
aagtctcagaaaactagtgtgg

SEQ ID NO: 7757537 - DNA, 22 bp, Homo sapiens
aaggagacatttgcagagcacc

SEQ ID NO: 7757538 - DNA, 22 bp, Homo sapiens
acagtgtttaaaaatcagatct

SEQ ID NO: 7757539 - DNA, 22 bp, Homo sapiens
acagtgtttaaaataatatgct

SEQ ID NO: 7757540 - DNA, 22 bp, Homo sapiens
acagtgttgtggctcttaatag

SEQ ID NO: 7757541 - DNA, 22 bp, Homo sapiens
acagtgttgaggtgcttgtttc

SEQ ID NO: 7757542 - DNA, 22 bp, Homo sapiens
acagtgttgtatttagtttgat

SEQ ID NO: 7757543 - DNA, 22 bp, Homo sapiens
acagtgttcttggcgctgagtg

SEQ ID NO: 7757544 - DNA, 22 bp, Homo sapiens
acagtgtttggcaatgcatgca

SEQ ID NO: 7757545 - DNA, 22 bp, Homo sapiens
acagtgtttaagagatggcatt

SEQ ID NO: 7757546 - DNA, 22 bp, Homo sapiens
acagtgtttatgtacagattgt

SEQ ID NO: 7757547 - DNA, 22 bp, Homo sapiens
acagtgtttcacttaaccgttt

SEQ ID NO: 7757548 - DNA, 19 bp, Homo sapiens
acatatgtggatatacatg

SEQ ID NO: 7757549 - DNA, 22 bp, Homo sapiens
aagatggcttagagtcctggtg

SEQ ID NO: 7757550 - DNA, 22 bp, Homo sapiens
aagatgaatcagtatgtgtcct

SEQ ID NO: 7757551 - DNA, 22 bp, Homo sapiens
aagacttgaccaggttgaaggc

SEQ ID NO: 7757552 - DNA, 21 bp, Homo sapiens
acacaaacctcctcagcctgg

SEQ ID NO: 7757553 - DNA, 22 bp, Homo sapiens
aagagaaggccctgacccaccc

SEQ ID NO: 7757554 - DNA, 22 bp, Homo sapiens
aattctcaggaatttcatctgt

SEQ ID NO: 7757555 - DNA, 22 bp, Homo sapiens
aagaaatggcttcatctgagta

SEQ ID NO: 7757556 - DNA, 22 bp, Homo sapiens
aaatttcttgaggctctctagc

SEQ ID NO: 7757557 - DNA, 22 bp, Homo sapiens
aaatttctggaagtgtcagagt

SEQ ID NO: 7757558 - DNA, 22 bp, Homo sapiens
aaggcagatataaagactagag

SEQ ID NO: 7757559 - DNA, 22 bp, Homo sapiens
aaggaagacacagatgaagtga

SEQ ID NO: 7757560 - DNA, 22 bp, Homo sapiens
aatgacaagacatagtctctga

SEQ ID NO: 7757561 - DNA, 22 bp, Homo sapiens
aatgacaaatatggaagcctga

SEQ ID NO: 7757562 - DNA, 20 bp, Homo sapiens
aaagagaagcctcaccttgt

SEQ ID NO: 7757563 - DNA, 22 bp, Homo sapiens
aaagagaaaaagatcccggctc

SEQ ID NO: 7757564 - DNA, 22 bp, Homo sapiens
aaatataatttctgcctcaata

SEQ ID NO: 7757565 - DNA, 22 bp, Homo sapiens
aaacagcagctgtttaatttgc

SEQ ID NO: 7757566 - DNA, 22 bp, Homo sapiens
aaaatattttagggccaggaga

SEQ ID NO: 7757567 - DNA, 22 bp, Homo sapiens
aaagagccagctacctcagttt

SEQ ID NO: 7757568 - DNA, 22 bp, Homo sapiens
aaaaagatgtcctgaagtttag

SEQ ID NO: 7757569 - DNA, 22 bp, Homo sapiens
ggtgaggggagagtgaaagaaa

SEQ ID NO: 7757570 - DNA, 22 bp, Homo sapiens
gtaaacattactgtgctgtata

SEQ ID NO: 7757571 - DNA, 22 bp, Homo sapiens
gtcctgtgtcccagagaaagag

SEQ ID NO: 7757572 - DNA, 22 bp, Homo sapiens
gtggcattgacatgtaaacagt

SEQ ID NO: 7757573 - DNA, 22 bp, Homo sapiens
gtgcctggaactgggtaggctg

SEQ ID NO: 7757574 - DNA, 18 bp, Homo sapiens
gtggggtgttgtgaggat

SEQ ID NO: 7757575 - DNA, 22 bp, Homo sapiens
gtggtgagttcaggctggggtg

SEQ ID NO: 7757576 - DNA, 22 bp, Homo sapiens
gtggtgtaggtcacagttagga

SEQ ID NO: 7757577 - DNA, 22 bp, Homo sapiens
gttctctatcattagtgaattt

SEQ ID NO: 7757578 - DNA, 22 bp, Homo sapiens
gggaagaagacatggtgaaggc

SEQ ID NO: 7757579 - DNA, 22 bp, Homo sapiens
ggccccagttcactcctggccg

SEQ ID NO: 7757580 - DNA, 22 bp, Homo sapiens
ggccccagattctgggctgggt

SEQ ID NO: 7757581 - DNA, 16 bp, Homo sapiens
gggggtgagagagagt

SEQ ID NO: 7757582 - DNA, 22 bp, Homo sapiens
gggggtgaggacaggagcactg

SEQ ID NO: 7757583 - DNA, 22 bp, Homo sapiens
gggaggagcttggagattcact

SEQ ID NO: 7757584 - DNA, 22 bp, Homo sapiens
gggcggggggagctggaatgaa

SEQ ID NO: 7757585 - DNA, 22 bp, Homo sapiens
ggaggaggcaagtaccagatgc

SEQ ID NO: 7757586 - DNA, 22 bp, Homo sapiens
ggagctgatggtagaagaatga

SEQ ID NO: 7757587 - DNA, 22 bp, Homo sapiens
ggaagtagaagtaatgaaatca

SEQ ID NO: 7757588 - DNA, 22 bp, Homo sapiens
ggagaaggtggctcagcaaagg

SEQ ID NO: 7757589 - DNA, 22 bp, Homo sapiens
ggagacagcaggaagaaatatc

SEQ ID NO: 7757590 - DNA, 22 bp, Homo sapiens
ggagacactggaaagtattaca

SEQ ID NO: 7757591 - DNA, 22 bp, Homo sapiens
gcttccttattgttgccatagt

SEQ ID NO: 7757592 - DNA, 22 bp, Homo sapiens
gcttccttctaccacatcatgc

SEQ ID NO: 7757593 - DNA, 22 bp, Homo sapiens
ggaagaaagcacacaaacttga

SEQ ID NO: 7757594 - DNA, 22 bp, Homo sapiens
ggaagggagtagttggaatgca

SEQ ID NO: 7757595 - DNA, 22 bp, Homo sapiens
ggaagaaatctggttaagagat

SEQ ID NO: 7757596 - DNA, 22 bp, Homo sapiens
ggcaggcgtggtggcctcagaa

SEQ ID NO: 7757597 - DNA, 21 bp, Homo sapiens
ggagggcagcccagactggct

SEQ ID NO: 7757598 - DNA, 22 bp, Homo sapiens
ggagggcacaggaccagaaatc

SEQ ID NO: 7757599 - DNA, 22 bp, Homo sapiens
ggagggctgccaggtggagcgg

SEQ ID NO: 7757600 - DNA, 22 bp, Homo sapiens
ggagggctgtagaggagacctg

SEQ ID NO: 7757601 - DNA, 22 bp, Homo sapiens
ggaggggtggaaggagtgcctg

SEQ ID NO: 7757602 - DNA, 22 bp, Homo sapiens
ggaggggaggattaatgacaaa

SEQ ID NO: 7757603 - DNA, 22 bp, Homo sapiens
ggaggggagtctcccaaagccg

SEQ ID NO: 7757604 - DNA, 20 bp, Homo sapiens
ggagggtggaagaaagcaag

SEQ ID NO: 7757605 - DNA, 22 bp, Homo sapiens
ggaggtggaggttgcagtgagc

SEQ ID NO: 7757606 - DNA, 22 bp, Homo sapiens
ggagtaaggctcagaggaaatg

SEQ ID NO: 7757607 - DNA, 22 bp, Homo sapiens
gctctgtgttccctccaggctc

SEQ ID NO: 7757608 - DNA, 22 bp, Homo sapiens
gctcttctcagattgtacactc

SEQ ID NO: 7757609 - DNA, 22 bp, Homo sapiens
gcagtgttgctaggtgcggtga

SEQ ID NO: 7757610 - DNA, 22 bp, Homo sapiens
gcagtgttatgttttctataat

SEQ ID NO: 7757611 - DNA, 22 bp, Homo sapiens
gcagtgttcagtgaagcaggag

SEQ ID NO: 7757612 - DNA, 22 bp, Homo sapiens
gcagtgttccttctactggggc

SEQ ID NO: 7757613 - DNA, 22 bp, Homo sapiens
gcagtgttctaaattgggtgtg

SEQ ID NO: 7757614 - DNA, 22 bp, Homo sapiens
gcagtgttcttgttgcttttat

SEQ ID NO: 7757615 - DNA, 22 bp, Homo sapiens
gcagtgttgactatggtatgag

SEQ ID NO: 7757616 - DNA, 22 bp, Homo sapiens
gcagtgttgagccagctggggg

SEQ ID NO: 7757617 - DNA, 22 bp, Homo sapiens
gcagtgttgagtggtggctgaa

SEQ ID NO: 7757618 - DNA, 22 bp, Homo sapiens
gcagtgttaggaataaaaatga

SEQ ID NO: 7757619 - DNA, 22 bp, Homo sapiens
gattttcatttgcactctagaa

SEQ ID NO: 7757620 - DNA, 22 bp, Homo sapiens
gattttcatgataaacttgtga

SEQ ID NO: 7757621 - DNA, 22 bp, Homo sapiens
gatgtagacacttggaggctta

SEQ ID NO: 7757622 - DNA, 21 bp, Homo sapiens
gataaaatgggccttggtcct

SEQ ID NO: 7757623 - DNA, 22 bp, Homo sapiens
gagtgctgaatgcgagaacaga

SEQ ID NO: 7757624 - DNA, 22 bp, Homo sapiens
gagtggagcaaaagaggtagat

SEQ ID NO: 7757625 - DNA, 22 bp, Homo sapiens
gataccagacagggagggagaa

SEQ ID NO: 7757626 - DNA, 22 bp, Homo sapiens
gatgagaaggctcagatccaaa

SEQ ID NO: 7757627 - DNA, 22 bp, Homo sapiens
gatgagaaatggacaggagtgg

SEQ ID NO: 7757628 - DNA, 22 bp, Homo sapiens
gatgagaatgtttatcaaatgc

SEQ ID NO: 7757629 - DNA, 22 bp, Homo sapiens
gatgaagaggcactgacatatt

SEQ ID NO: 7757630 - DNA, 22 bp, Homo sapiens
gatgaaatgctgagcctgagtt

SEQ ID NO: 7757631 - DNA, 22 bp, Homo sapiens
gagggttggtgcaaatgggatg

SEQ ID NO: 7757632 - DNA, 22 bp, Homo sapiens
gaggggaaagtgtgaggctgcg

SEQ ID NO: 7757633 - DNA, 22 bp, Homo sapiens
gagggcagagtctaatgatgca

SEQ ID NO: 7757634 - DNA, 22 bp, Homo sapiens
gaggggcaatgagggaaagagt

SEQ ID NO: 7757635 - DNA, 22 bp, Homo sapiens
gaggggcagaggtagagaacaa

SEQ ID NO: 7757636 - DNA, 22 bp, Homo sapiens
gaggaaggtcccatcagaattt

SEQ ID NO: 7757637 - DNA, 23 bp, Homo sapiens
gaggagggtctgacaagtgtagc

SEQ ID NO: 7757638 - DNA, 22 bp, Homo sapiens
gaaatacaaagccagccatttt

SEQ ID NO: 7757639 - DNA, 22 bp, Homo sapiens
gaaagggagtgaagatggtata

SEQ ID NO: 7757640 - DNA, 22 bp, Homo sapiens
gaaagggcatgggcatgacaac

SEQ ID NO: 7757641 - DNA, 22 bp, Homo sapiens
gaaagggagtggacaacaggca

SEQ ID NO: 7757642 - DNA, 22 bp, Homo sapiens
gaaaaggaaatttatagagatc

SEQ ID NO: 7757643 - DNA, 22 bp, Homo sapiens
gaaaagggcaagagagagggca

SEQ ID NO: 7757644 - DNA, 22 bp, Homo sapiens
gagacacaggtggttcctgtca

SEQ ID NO: 7757645 - DNA, 20 bp, Homo sapiens
gagagctggaaataaagtcc

SEQ ID NO: 7757646 - DNA, 22 bp, Homo sapiens
gagagctgcattctcagacaca

SEQ ID NO: 7757647 - DNA, 22 bp, Homo sapiens
gaaggagaggattgtgaggctg

SEQ ID NO: 7757648 - DNA, 19 bp, Homo sapiens
gaaggagagctgagttagg

SEQ ID NO: 7757649 - DNA, 22 bp, Homo sapiens
gaaggagagagacatcgtccct

SEQ ID NO: 7757650 - DNA, 21 bp, Homo sapiens
gaaggagaaagcaagtgctgc

SEQ ID NO: 7757651 - DNA, 22 bp, Homo sapiens
gaaggagaccctgaagatgctg

SEQ ID NO: 7757652 - DNA, 22 bp, Homo sapiens
gaaggagagaaaggcaattctg

SEQ ID NO: 7757653 - DNA, 22 bp, Homo sapiens
gaagttctcaaggatcacagaa

SEQ ID NO: 7757654 - DNA, 22 bp, Homo sapiens
gaagttctcagctaggtgatgt

SEQ ID NO: 7757655 - DNA, 22 bp, Homo sapiens
tgtggcttttgctagctttgca

SEQ ID NO: 7757656 - DNA, 21 bp, Homo sapiens
tgtctttggcctcattcccag

SEQ ID NO: 7757657 - DNA, 22 bp, Homo sapiens
tgtcatgggtctaaacattgat

SEQ ID NO: 7757658 - DNA, 22 bp, Homo sapiens
tgtcatgggcatttattgaggg

SEQ ID NO: 7757659 - DNA, 22 bp, Homo sapiens
tgtctcatctcttaaccccact

SEQ ID NO: 7757660 - DNA, 20 bp, Homo sapiens
tggcccagtggggcagggtg

SEQ ID NO: 7757661 - DNA, 22 bp, Homo sapiens
ccctcagtctggctgggaagac

SEQ ID NO: 7757662 - DNA, 22 bp, Homo sapiens
ccctcagttttccagtgtgggc

SEQ ID NO: 7757663 - DNA, 22 bp, Homo sapiens
cctagtccccaggaggtcagtg

SEQ ID NO: 7757664 - DNA, 22 bp, Homo sapiens
cccagctctggaaggtggggga

SEQ ID NO: 7757665 - DNA, 22 bp, Homo sapiens
cccagctcttttagcggcatct

SEQ ID NO: 7757666 - DNA, 22 bp, Homo sapiens
cccagctcttcctgggagctaa

SEQ ID NO: 7757667 - DNA, 21 bp, Homo sapiens
tgctcagtaaatgctgagtga

SEQ ID NO: 7757668 - DNA, 22 bp, Homo sapiens
ctggaggggctggcatggtagc

SEQ ID NO: 7757669 - DNA, 22 bp, Homo sapiens
ctggcccagagagcagagctta

SEQ ID NO: 7757670 - DNA, 22 bp, Homo sapiens
ctgcctcagcgttgtggcccta

SEQ ID NO: 7757671 - DNA, 22 bp, Homo sapiens
ctgatcttaagtaacattattt

SEQ ID NO: 7757672 - DNA, 18 bp, Homo sapiens
ctctgggagaggcataca

SEQ ID NO: 7757673 - DNA, 22 bp, Homo sapiens
ttcctttgggaaatcactaagg

SEQ ID NO: 7757674 - DNA, 22 bp, Homo sapiens
cgctgggggaacagcgagggtg

SEQ ID NO: 7757675 - DNA, 22 bp, Homo sapiens
tttacatggaatattgtcttgt

SEQ ID NO: 7757676 - DNA, 22 bp, Homo sapiens
ctcagtgcttctagcttgatga

SEQ ID NO: 7757677 - DNA, 22 bp, Homo sapiens
ttggcattggagatgcaagaac

SEQ ID NO: 7757678 - DNA, 22 bp, Homo sapiens
ttggcattgaagtttcattggt

SEQ ID NO: 7757679 - DNA, 22 bp, Homo sapiens
gttctgtctgagcaccacagga

SEQ ID NO: 7757680 - DNA, 21 bp, Homo sapiens
gttcttagttatattctcaat

SEQ ID NO: 7757681 - DNA, 22 bp, Homo sapiens
gttcttcaccaaggtcagaggc

SEQ ID NO: 7757682 - DNA, 22 bp, Homo sapiens
cagctctgttgccaaagtgggc

SEQ ID NO: 7757683 - DNA, 22 bp, Homo sapiens
cagctctgttgccctggaaacg

SEQ ID NO: 7757684 - DNA, 22 bp, Homo sapiens
cagcccagccgagggcctggct

SEQ ID NO: 7757685 - DNA, 22 bp, Homo sapiens
cagctctgctgggaggatgcag

SEQ ID NO: 7757686 - DNA, 22 bp, Homo sapiens
cagctctggcgtcagggagcga

SEQ ID NO: 7757687 - DNA, 20 bp, Homo sapiens
cagctctgggaaagaggcca

SEQ ID NO: 7757688 - DNA, 22 bp, Homo sapiens
cagctctggctattgaggacca

SEQ ID NO: 7757689 - DNA, 22 bp, Homo sapiens
gtggggcagtggcctgggagca

SEQ ID NO: 7757690 - DNA, 22 bp, Homo sapiens
ccacagtccgggctggcaggac

SEQ ID NO: 7757691 - DNA, 21 bp, Homo sapiens
tctctacaaattatgttaggt

SEQ ID NO: 7757692 - DNA, 22 bp, Homo sapiens
tctctacagacactgttgactt

SEQ ID NO: 7757693 - DNA, 22 bp, Homo sapiens
ccacagctagggcaatctgatt

SEQ ID NO: 7757694 - DNA, 22 bp, Homo sapiens
ccaggaagcggtgagggctgcc

SEQ ID NO: 7757695 - DNA, 22 bp, Homo sapiens
ccagccccgggaacctggccgt

SEQ ID NO: 7757696 - DNA, 21 bp, Homo sapiens
ccagcctcagatcagggagct

SEQ ID NO: 7757697 - DNA, 22 bp, Homo sapiens
ccagcctggagggcagtggtgg

SEQ ID NO: 7757698 - DNA, 23 bp, Homo sapiens
ccagcgctcactcagagcatgtt

SEQ ID NO: 7757699 - DNA, 22 bp, Homo sapiens
ccagcctggggaggcagcttct

SEQ ID NO: 7757700 - DNA, 22 bp, Homo sapiens
ccagcctgggtgttagaagaca

SEQ ID NO: 7757701 - DNA, 22 bp, Homo sapiens
ccagctctaaacggctctgtgg

SEQ ID NO: 7757702 - DNA, 20 bp, Homo sapiens
tccagcccagcagcctgaca

SEQ ID NO: 7757703 - DNA, 22 bp, Homo sapiens
catgagaaggttttggcatata

SEQ ID NO: 7757704 - DNA, 22 bp, Homo sapiens
catgagaagtggccttcaaaaa

SEQ ID NO: 7757705 - DNA, 22 bp, Homo sapiens
tcagctctgttttgagtggaac

SEQ ID NO: 7757706 - DNA, 22 bp, Homo sapiens
tcagccctagcctcagtccagg

SEQ ID NO: 7757707 - DNA, 22 bp, Homo sapiens
cagtgctggagatgggtggaac

SEQ ID NO: 7757708 - DNA, 21 bp, Homo sapiens
cagtgctgcctaatagggagt

SEQ ID NO: 7757709 - DNA, 22 bp, Homo sapiens
cagtgctggaggctggagggaa

SEQ ID NO: 7757710 - DNA, 22 bp, Homo sapiens
cagtgctgggcagaggagagcg

SEQ ID NO: 7757711 - DNA, 22 bp, Homo sapiens
cagtgctggctgttaggacagt

SEQ ID NO: 7757712 - DNA, 22 bp, Homo sapiens
cagtgctgacagggaggaacct

SEQ ID NO: 7757713 - DNA, 22 bp, Homo sapiens
cagtgctgagagcctggccagg

SEQ ID NO: 7757714 - DNA, 22 bp, Homo sapiens
cagtgctgtgctggaagctgtt

SEQ ID NO: 7757715 - DNA, 23 bp, Homo sapiens
cagtgctggttctgcctgtgggg

SEQ ID NO: 7757716 - DNA, 19 bp, Homo sapiens
cagtgctgttcattcagtg

SEQ ID NO: 7757717 - DNA, 22 bp, Homo sapiens
cagtgcagacgtggagggggca

SEQ ID NO: 7757718 - DNA, 22 bp, Homo sapiens
cagtctcaccctggaggcccca

SEQ ID NO: 7757719 - DNA, 22 bp, Homo sapiens
cagtctcagaggtgggagtggg

SEQ ID NO: 7757720 - DNA, 22 bp, Homo sapiens
cagtcctgtctttatgacttca

SEQ ID NO: 7757721 - DNA, 22 bp, Homo sapiens
cagtcctgtgtcccttggtggg

SEQ ID NO: 7757722 - DNA, 22 bp, Homo sapiens
cagtcctgttcctggagtagtt

SEQ ID NO: 7757723 - DNA, 20 bp, Homo sapiens
cagtcctgtccctgctgccc

SEQ ID NO: 7757724 - DNA, 22 bp, Homo sapiens
cagtcctgggtgcagcaggaaa

SEQ ID NO: 7757725 - DNA, 22 bp, Homo sapiens
cagtcctggggaccaggctgag

SEQ ID NO: 7757726 - DNA, 22 bp, Homo sapiens
cagtcctgggcaggtcaggcca

SEQ ID NO: 7757727 - DNA, 22 bp, Homo sapiens
cagtcctgggcacagccctggg

SEQ ID NO: 7757728 - DNA, 22 bp, Homo sapiens
tacatgtgttctgtttcaagtt

SEQ ID NO: 7757729 - DNA, 17 bp, Homo sapiens
caggtctgaggccaggc

SEQ ID NO: 7757730 - DNA, 18 bp, Homo sapiens
caggtctgtctgcctccc

SEQ ID NO: 7757731 - DNA, 22 bp, Homo sapiens
tgtgcacatatactcatattcc

SEQ ID NO: 7757732 - DNA, 22 bp, Homo sapiens
tgtgcacaggaagctattctct

SEQ ID NO: 7757733 - DNA, 22 bp, Homo sapiens
ttaaaaatatgtagggcccgat

SEQ ID NO: 7757734 - DNA, 22 bp, Homo sapiens
ttaaaatttccccaccatgtat

SEQ ID NO: 7757735 - DNA, 22 bp, Homo sapiens
ttaaacacctgtctagtgtagc

SEQ ID NO: 7757736 - DNA, 22 bp, Homo sapiens
tgtgtacatatctatcctagat

SEQ ID NO: 7757737 - DNA, 22 bp, Homo sapiens
ttcaggaaggtcctatagcaga

SEQ ID NO: 7757738 - DNA, 22 bp, Homo sapiens
ttccagctaactcacatccctt

SEQ ID NO: 7757739 - DNA, 23 bp, Homo sapiens
tggtggggtcttggagacagcac

SEQ ID NO: 7757740 - DNA, 22 bp, Homo sapiens
tggtggggtcatcgtcagatgc

SEQ ID NO: 7757741 - DNA, 22 bp, Homo sapiens
tgtatacattctcttgggtttg

SEQ ID NO: 7757742 - DNA, 22 bp, Homo sapiens
tgggggtgctgagaagacagga

SEQ ID NO: 7757743 - DNA, 23 bp, Homo sapiens
tgggggtgcacgggccacatctt

SEQ ID NO: 7757744 - DNA, 22 bp, Homo sapiens
tggggggcacttcagcacaatg

SEQ ID NO: 7757745 - DNA, 22 bp, Homo sapiens
tgggggctgagtaagatgagat

SEQ ID NO: 7757746 - DNA, 22 bp, Homo sapiens
tgggggagctcagtccagccca

SEQ ID NO: 7757747 - DNA, 22 bp, Homo sapiens
tgggggagcgacagacataatt

SEQ ID NO: 7757748 - DNA, 20 bp, Homo sapiens
tgctggggacatacagggtg

SEQ ID NO: 7757749 - DNA, 22 bp, Homo sapiens
tgctggggcagaagagccaaga

SEQ ID NO: 7757750 - DNA, 20 bp, Homo sapiens
tgctgctttgccactagttg

SEQ ID NO: 7757751 - DNA, 22 bp, Homo sapiens
tgctgctttgatgtgtaaatca

SEQ ID NO: 7757752 - DNA, 22 bp, Homo sapiens
tgctttaaaccatggatgtgag

SEQ ID NO: 7757753 - DNA, 22 bp, Homo sapiens
tgcttgcaagagatgcaatgac

SEQ ID NO: 7757754 - DNA, 19 bp, Homo sapiens
tggaaaatggattgaatca

SEQ ID NO: 7757755 - DNA, 22 bp, Homo sapiens
tggaacaaattacaattaactt

SEQ ID NO: 7757756 - DNA, 22 bp, Homo sapiens
tggaacaacatgctggaaaatt

SEQ ID NO: 7757757 - DNA, 19 bp, Homo sapiens
tggaacaaactgcaatgac

SEQ ID NO: 7757758 - DNA, 20 bp, Homo sapiens
tggaggcacctgtggagatc

SEQ ID NO: 7757759 - DNA, 22 bp, Homo sapiens
tggaggcagtaactgagcaaca

SEQ ID NO: 7757760 - DNA, 19 bp, Homo sapiens
tggaggagaggaaaagtca

SEQ ID NO: 7757761 - DNA, 22 bp, Homo sapiens
tggagggctaagctgagggata

SEQ ID NO: 7757762 - DNA, 22 bp, Homo sapiens
tggagggcgcttagatggaggg

SEQ ID NO: 7757763 - DNA, 22 bp, Homo sapiens
tggagggatacaaagatgaaaa

SEQ ID NO: 7757764 - DNA, 22 bp, Homo sapiens
tggagaaagctgcatatggaaa

SEQ ID NO: 7757765 - DNA, 22 bp, Homo sapiens
tggagagcacagttcctgcttc

SEQ ID NO: 7757766 - DNA, 22 bp, Homo sapiens
tggagagctcctatttgctgtc

SEQ ID NO: 7757767 - DNA, 22 bp, Homo sapiens
tggccctgacaggtcctgggca

SEQ ID NO: 7757768 - DNA, 22 bp, Homo sapiens
tggcccaggaggccagagggca

SEQ ID NO: 7757769 - DNA, 22 bp, Homo sapiens
tggcccaggcgaggtgggcaga

SEQ ID NO: 7757770 - DNA, 22 bp, Homo sapiens
tggcccagctcagggtgggcgg

SEQ ID NO: 7757771 - DNA, 22 bp, Homo sapiens
tggcagggtacaccttaacacc

SEQ ID NO: 7757772 - DNA, 22 bp, Homo sapiens
tggcatttagttgcgtattgca

SEQ ID NO: 7757773 - DNA, 22 bp, Homo sapiens
tgggagaagcatggggtgcaga

SEQ ID NO: 7757774 - DNA, 22 bp, Homo sapiens
tgggagaagcagtgggacagta

SEQ ID NO: 7757775 - DNA, 22 bp, Homo sapiens
tgggagaagcagcagccaagtg

SEQ ID NO: 7757776 - DNA, 22 bp, Homo sapiens
tgggagaacccagggtcaggct

SEQ ID NO: 7757777 - DNA, 20 bp, Homo sapiens
tggcggggatgagggagtta

SEQ ID NO: 7757778 - DNA, 22 bp, Homo sapiens
tgaaatgttgccatgaggtctc

SEQ ID NO: 7757779 - DNA, 22 bp, Homo sapiens
tgaatgcttggagtcataaaat

SEQ ID NO: 7757780 - DNA, 22 bp, Homo sapiens
tgacaaaccctgcaaatagctc

SEQ ID NO: 7757781 - DNA, 19 bp, Homo sapiens
tgaaggagggggatggcca

SEQ ID NO: 7757782 - DNA, 22 bp, Homo sapiens
tgaaggagctgatgtaaggggt

SEQ ID NO: 7757783 - DNA, 22 bp, Homo sapiens
tgaaggaggaatgtggcctcca

SEQ ID NO: 7757784 - DNA, 22 bp, Homo sapiens
tgaaggagggaagaaggctctg

SEQ ID NO: 7757785 - DNA, 22 bp, Homo sapiens
tgaaggagctcaggagatagtc

SEQ ID NO: 7757786 - DNA, 22 bp, Homo sapiens
tgaaggagctcaatgatgatgc

SEQ ID NO: 7757787 - DNA, 22 bp, Homo sapiens
tgaaggagatttttagggaggc

SEQ ID NO: 7757788 - DNA, 22 bp, Homo sapiens
tgacctattagatttccttgcc

SEQ ID NO: 7757789 - DNA, 22 bp, Homo sapiens
tgagaagattgggcagagtgga

SEQ ID NO: 7757790 - DNA, 20 bp, Homo sapiens
tgagaaagtagagactcagg

SEQ ID NO: 7757791 - DNA, 22 bp, Homo sapiens
tgagaaaggtatttcatgcact

SEQ ID NO: 7757792 - DNA, 22 bp, Homo sapiens
tgagaaagacagacattcctaa

SEQ ID NO: 7757793 - DNA, 23 bp, Homo sapiens
tgagacactcattcatggagtat

SEQ ID NO: 7757794 - DNA, 22 bp, Homo sapiens
tgagagcagaggtgggcagcct

SEQ ID NO: 7757795 - DNA, 18 bp, Homo sapiens
tgagagcattcgaggcaa

SEQ ID NO: 7757796 - DNA, 22 bp, Homo sapiens
tgagagacacactgtgcatgta

SEQ ID NO: 7757797 - DNA, 22 bp, Homo sapiens
tgagatgaataactcctgctaa

SEQ ID NO: 7757798 - DNA, 22 bp, Homo sapiens
tgagcagagttgtttctcctga

SEQ ID NO: 7757799 - DNA, 22 bp, Homo sapiens
tgaggggcggcctgcagaggcc

SEQ ID NO: 7757800 - DNA, 22 bp, Homo sapiens
tgaggcctcataatgagatttc

SEQ ID NO: 7757801 - DNA, 22 bp, Homo sapiens
tgccctcaagcaacagagagga

SEQ ID NO: 7757802 - DNA, 22 bp, Homo sapiens
tgcccctctcctgtgatccaag

SEQ ID NO: 7757803 - DNA, 22 bp, Homo sapiens
tgcctcaggcacctggcaggtt

SEQ ID NO: 7757804 - DNA, 22 bp, Homo sapiens
tgccatttctttcaatattctt

SEQ ID NO: 7757805 - DNA, 22 bp, Homo sapiens
tgccatccaacagttccatctt

SEQ ID NO: 7757806 - DNA, 22 bp, Homo sapiens
tgccagctcccttttctcctcc

SEQ ID NO: 7757807 - DNA, 23 bp, Homo sapiens
tgcaggggaggcttaaagcaggt

SEQ ID NO: 7757808 - DNA, 22 bp, Homo sapiens
tgcatgttaagaaaatattgag

SEQ ID NO: 7757809 - DNA, 22 bp, Homo sapiens
tgcattcctttgtctgttaaag

SEQ ID NO: 7757810 - DNA, 21 bp, Homo sapiens
tgcaagaatcaggaagctgcc

SEQ ID NO: 7757811 - DNA, 22 bp, Homo sapiens
tgatttaaaagaaacattgtct

SEQ ID NO: 7757812 - DNA, 18 bp, Homo sapiens
tgatctttgagtataatg

SEQ ID NO: 7757813 - DNA, 22 bp, Homo sapiens
tgatagaaaatgctgtcaagct

SEQ ID NO: 7757814 - DNA, 22 bp, Homo sapiens
tgatcccaatctttcctgctcc

SEQ ID NO: 7757815 - DNA, 22 bp, Homo sapiens
tctgaaatactgcaggttctct

SEQ ID NO: 7757816 - DNA, 22 bp, Homo sapiens
tctcttctttggggtgggctca

SEQ ID NO: 7757817 - DNA, 18 bp, Homo sapiens
tctcttcttggcagtcaa

SEQ ID NO: 7757818 - DNA, 22 bp, Homo sapiens
tctcttctaattagggtccatg

SEQ ID NO: 7757819 - DNA, 22 bp, Homo sapiens
tctcttctagcttcttgtggtt

SEQ ID NO: 7757820 - DNA, 19 bp, Homo sapiens
tctcttctccctggtttta

SEQ ID NO: 7757821 - DNA, 22 bp, Homo sapiens
tctctagttgaggactgagcag

SEQ ID NO: 7757822 - DNA, 22 bp, Homo sapiens
tctctgagcccaatgtagcaat

SEQ ID NO: 7757823 - DNA, 22 bp, Homo sapiens
tctccttgctacccagtatgtc

SEQ ID NO: 7757824 - DNA, 20 bp, Homo sapiens
tctcaggccccctccttgct

SEQ ID NO: 7757825 - DNA, 22 bp, Homo sapiens
tctcagctgactgctttcctcg

SEQ ID NO: 7757826 - DNA, 22 bp, Homo sapiens
tctcagagtttagagctgagcc

SEQ ID NO: 7757827 - DNA, 22 bp, Homo sapiens
tctcagagtttacggggctgaa

SEQ ID NO: 7757828 - DNA, 22 bp, Homo sapiens
tctcagaggcccgacgttctcc

SEQ ID NO: 7757829 - DNA, 22 bp, Homo sapiens
tctcagagatctttctgcatgt

SEQ ID NO: 7757830 - DNA, 19 bp, Homo sapiens
tctcagagccctagaggcc

SEQ ID NO: 7757831 - DNA, 23 bp, Homo sapiens
tctcagaggattcctgggccttg

SEQ ID NO: 7757832 - DNA, 22 bp, Homo sapiens
tctcagtgaagagtataacaaa

SEQ ID NO: 7757833 - DNA, 23 bp, Homo sapiens
tctcagtgaatctcagaattcgc

SEQ ID NO: 7757834 - DNA, 22 bp, Homo sapiens
tctcagtgacactcttcataca

SEQ ID NO: 7757835 - DNA, 22 bp, Homo sapiens
tctcagtcagccttgatgtccc

SEQ ID NO: 7757836 - DNA, 22 bp, Homo sapiens
tctcagtcagtttggactgtgt

SEQ ID NO: 7757837 - DNA, 22 bp, Homo sapiens
tctcagtccaaatgagaggttg

SEQ ID NO: 7757838 - DNA, 22 bp, Homo sapiens
tctcagtgagcttttctatgtt

SEQ ID NO: 7757839 - DNA, 22 bp, Homo sapiens
tctcagtgatggcccatttgga

SEQ ID NO: 7757840 - DNA, 22 bp, Homo sapiens
tctcagtgactgctgggtcccc

SEQ ID NO: 7757841 - DNA, 17 bp, Homo sapiens
tctcagtgactgatagc

SEQ ID NO: 7757842 - DNA, 23 bp, Homo sapiens
tctcagtgcacgcaccatgcctg

SEQ ID NO: 7757843 - DNA, 22 bp, Homo sapiens
tctcagtgcagagaggctatct

SEQ ID NO: 7757844 - DNA, 22 bp, Homo sapiens
tctcagtgcagcaaggaattta

SEQ ID NO: 7757845 - DNA, 22 bp, Homo sapiens
tctcagtgctatccatattcca

SEQ ID NO: 7757846 - DNA, 19 bp, Homo sapiens
tctcagtgccgctgaccgc

SEQ ID NO: 7757847 - DNA, 22 bp, Homo sapiens
tctcagtgcagcttgacagaga

SEQ ID NO: 7757848 - DNA, 23 bp, Homo sapiens
tctcagtgccgattgcatacaca

SEQ ID NO: 7757849 - DNA, 22 bp, Homo sapiens
tctcagtggacgtgtctgtctt

SEQ ID NO: 7757850 - DNA, 22 bp, Homo sapiens
tcgaactcatagtcgtagctgt

SEQ ID NO: 7757851 - DNA, 22 bp, Homo sapiens
tccttctttccccctagtcatt

SEQ ID NO: 7757852 - DNA, 22 bp, Homo sapiens
tccttctttgacaagtggcaga

SEQ ID NO: 7757853 - DNA, 22 bp, Homo sapiens
tccttggaggtgttcatctgcc

SEQ ID NO: 7757854 - DNA, 22 bp, Homo sapiens
tccttcaaaagttgagagagcc

SEQ ID NO: 7757855 - DNA, 22 bp, Homo sapiens
tccttcaaagctcctagtgagc

SEQ ID NO: 7757856 - DNA, 22 bp, Homo sapiens
tcctggggtttagagggaagtg

SEQ ID NO: 7757857 - DNA, 22 bp, Homo sapiens
tcctggggctctgagcgagaca

SEQ ID NO: 7757858 - DNA, 22 bp, Homo sapiens
tcttgaaggggggcagtgttga

SEQ ID NO: 7757859 - DNA, 22 bp, Homo sapiens
tcttggaacttattattgtaga

SEQ ID NO: 7757860 - DNA, 22 bp, Homo sapiens
tcttggaatctccatagagtga

SEQ ID NO: 7757861 - DNA, 22 bp, Homo sapiens
tcttctgttttagattgcatac

SEQ ID NO: 7757862 - DNA, 22 bp, Homo sapiens
tctgtccagaggtcctggagac

SEQ ID NO: 7757863 - DNA, 21 bp, Homo sapiens
tctgggggtgagcctagaaat

SEQ ID NO: 7757864 - DNA, 22 bp, Homo sapiens
tctgggggcgaccagggactgc

SEQ ID NO: 7757865 - DNA, 22 bp, Homo sapiens
tctgggggaggaggcatggccc

SEQ ID NO: 7757866 - DNA, 22 bp, Homo sapiens
tctgggggttaagtgaggacaa

SEQ ID NO: 7757867 - DNA, 22 bp, Homo sapiens
tcttaacaagctcctcagtgct

SEQ ID NO: 7757868 - DNA, 22 bp, Homo sapiens
tctgtgtgcccacctgacacct

SEQ ID NO: 7757869 - DNA, 22 bp, Homo sapiens
tctgtgtgccctaaagcctgct

SEQ ID NO: 7757870 - DNA, 19 bp, Homo sapiens
tctgtgctgggaggcagca

SEQ ID NO: 7757871 - DNA, 22 bp, Homo sapiens
tctgtgctgtctcagagaaagc

SEQ ID NO: 7757872 - DNA, 18 bp, Homo sapiens
tctgctgctgcgtcctgc

SEQ ID NO: 7757873 - DNA, 17 bp, Homo sapiens
tctgaggcctctaggag

SEQ ID NO: 7757874 - DNA, 22 bp, Homo sapiens
aagatccatgagggcagagatt

SEQ ID NO: 7757875 - DNA, 22 bp, Homo sapiens
actcacagcagactatgaggga

SEQ ID NO: 7757876 - DNA, 22 bp, Homo sapiens
agaagaaatgtgaaggccactg

SEQ ID NO: 7757877 - DNA, 22 bp, Homo sapiens
cagagctggcggtgagaagaca

SEQ ID NO: 7757878 - DNA, 21 bp, Homo sapiens
aggaagctgcccagatagtag

SEQ ID NO: 7757879 - DNA, 22 bp, Homo sapiens
aggaagctgctggagtagtgtg

SEQ ID NO: 7757880 - DNA, 22 bp, Homo sapiens
aggaagctttatgaccagctaa

SEQ ID NO: 7757881 - DNA, 22 bp, Homo sapiens
aggaagctccatgaaggcagag

SEQ ID NO: 7757882 - DNA, 22 bp, Homo sapiens
aggaagctcctggagagccagt

SEQ ID NO: 7757883 - DNA, 22 bp, Homo sapiens
aggaagctcggagagggcaaat

SEQ ID NO: 7757884 - DNA, 22 bp, Homo sapiens
caggacagacagaatgcctaac

SEQ ID NO: 7757885 - DNA, 22 bp, Homo sapiens
cctttgttctgtgtatctttgt

SEQ ID NO: 7757886 - DNA, 22 bp, Homo sapiens
cctttgttcattgccttcagtc

SEQ ID NO: 7757887 - DNA, 20 bp, Homo sapiens
agtgacagagactgtgtggc

SEQ ID NO: 7757888 - DNA, 22 bp, Homo sapiens
ctctgctgcccaggcctgctag

SEQ ID NO: 7757889 - DNA, 22 bp, Homo sapiens
gggaaaaataatgcacagatat

SEQ ID NO: 7757890 - DNA, 22 bp, Homo sapiens
cagaaggtttgaaagatgtctt

SEQ ID NO: 7757891 - DNA, 22 bp, Homo sapiens
gggacagaggcaaactagcaga

SEQ ID NO: 7757892 - DNA, 22 bp, Homo sapiens
caagctgctataggttgctggg

SEQ ID NO: 7757893 - DNA, 22 bp, Homo sapiens
caagctgcttattctctgctct

SEQ ID NO: 7757894 - DNA, 22 bp, Homo sapiens
gctgccttgaacttggcctggg

SEQ ID NO: 7757895 - DNA, 22 bp, Homo sapiens
cacaagtcattttcagcaggct

SEQ ID NO: 7757896 - DNA, 22 bp, Homo sapiens
gagagctgtggtttgaccaggc

SEQ ID NO: 7757897 - DNA, 22 bp, Homo sapiens
gagaggaactcccagtgcctgg

SEQ ID NO: 7757898 - DNA, 22 bp, Homo sapiens
atgaggaacagacttgctggat

SEQ ID NO: 7757899 - DNA, 22 bp, Homo sapiens
cagtcctgggcaggtcaggcca

SEQ ID NO: 7757900 - DNA, 22 bp, Homo sapiens
cagtcctggggaccaggctgag

SEQ ID NO: 7757901 - DNA, 22 bp, Homo sapiens
catccattcattaattctaaag

SEQ ID NO: 7757902 - DNA, 22 bp, Homo sapiens
tctgcctttgctttggctgtca

SEQ ID NO: 7757903 - DNA, 22 bp, Homo sapiens
ccagaattcagaaagggcataa

SEQ ID NO: 7757904 - DNA, 22 bp, Homo sapiens
ccagaatttgaactcaggcaat

SEQ ID NO: 7757905 - DNA, 22 bp, Homo sapiens
cagctgctgatggcctgacaga

SEQ ID NO: 7757906 - DNA, 22 bp, Homo sapiens
cagctgctgcccttggctgcag

SEQ ID NO: 7757907 - DNA, 22 bp, Homo sapiens
caggaagaggacaggcttcccc

SEQ ID NO: 7757908 - DNA, 22 bp, Homo sapiens
caggacagtataggctttagga

SEQ ID NO: 7757909 - DNA, 22 bp, Homo sapiens
caggacagttggcatctgctgc

SEQ ID NO: 7757910 - DNA, 22 bp, Homo sapiens
ttgactctggaggtcactgaag

SEQ ID NO: 7757911 - DNA, 22 bp, Homo sapiens
ttgaggaaagagtgcaaagagg

SEQ ID NO: 7757912 - DNA, 19 bp, Homo sapiens
gacaggaaggctaccagta

SEQ ID NO: 7757913 - DNA, 22 bp, Homo sapiens
gaaggaagtcattagtgcagac

SEQ ID NO: 7757914 - DNA, 22 bp, Homo sapiens
gagagttccagtaagtggattc

SEQ ID NO: 7757915 - DNA, 22 bp, Homo sapiens
gatgacagttctagcatctgaa

SEQ ID NO: 7757916 - DNA, 19 bp, Homo sapiens
gatagctgatgaccatcat

SEQ ID NO: 7757917 - DNA, 22 bp, Homo sapiens
gattttgaatattaaagaagag

SEQ ID NO: 7757918 - DNA, 22 bp, Homo sapiens
gctgctctgttaattgctgtaa

SEQ ID NO: 7757919 - DNA, 22 bp, Homo sapiens
ggcacacagcggaatttgctct

SEQ ID NO: 7757920 - DNA, 22 bp, Homo sapiens
ggaagaaatgctcttctatgcg

SEQ ID NO: 7757921 - DNA, 22 bp, Homo sapiens
ggaagaaaggtggacaacaggt

SEQ ID NO: 7757922 - DNA, 22 bp, Homo sapiens
ggaagaaagcacacaaacttga

SEQ ID NO: 7757923 - DNA, 22 bp, Homo sapiens
ggaagaaagacatttattttga

SEQ ID NO: 7757924 - DNA, 22 bp, Homo sapiens
ggaagaaatctggttaagagat

SEQ ID NO: 7757925 - DNA, 22 bp, Homo sapiens
ggaagaaagtagaaaaccgtgg

SEQ ID NO: 7757926 - DNA, 22 bp, Homo sapiens
ggaagaaaatgggcaacaggtg

SEQ ID NO: 7757927 - DNA, 18 bp, Homo sapiens
ggaagaaaaggaactcag

SEQ ID NO: 7757928 - DNA, 17 bp, Homo sapiens
ggaagaaaaggatcatc

SEQ ID NO: 7757929 - DNA, 22 bp, Homo sapiens
ggaagaaaagcttccagcgcct

SEQ ID NO: 7757930 - DNA, 22 bp, Homo sapiens
gggaaatctcgtcctctattta

SEQ ID NO: 7757931 - DNA, 22 bp, Homo sapiens
ggctgctgaacaagggaaccct

SEQ ID NO: 7757932 - DNA, 21 bp, Homo sapiens
gtcagctgtgtgtgaggaccc

SEQ ID NO: 7757933 - DNA, 22 bp, Homo sapiens
gtcagctgcagtgggcacagcc

SEQ ID NO: 7757934 - DNA, 20 bp, Homo sapiens
tctgccttatgaccttcgcc

SEQ ID NO: 7757935 - DNA, 22 bp, Homo sapiens
tctggaaggcttcaaggtctaa

SEQ ID NO: 7757936 - DNA, 22 bp, Homo sapiens
tcttccttttgtaccttctgaa

SEQ ID NO: 7757937 - DNA, 22 bp, Homo sapiens
tccttgggaaatcactagcact

SEQ ID NO: 7757938 - DNA, 22 bp, Homo sapiens
tgaggaagggtgtgacggcacc

SEQ ID NO: 7757939 - DNA, 22 bp, Homo sapiens
tgagaagagcaaggaactggtt

SEQ ID NO: 7757940 - DNA, 22 bp, Homo sapiens
tgacttgtctctttgggagaca

SEQ ID NO: 7757941 - DNA, 22 bp, Homo sapiens
tgaagaaaggtgtgggatactc

SEQ ID NO: 7757942 - DNA, 22 bp, Homo sapiens
tgaagaaacgcagagaggtagg

SEQ ID NO: 7757943 - DNA, 22 bp, Homo sapiens
tgaagaaacagaccaagaggat

SEQ ID NO: 7757944 - DNA, 22 bp, Homo sapiens
tgaagaaaatatgattacccca

SEQ ID NO: 7757945 - DNA, 22 bp, Homo sapiens
tctttgtttgcctttatcaaga

SEQ ID NO: 7757946 - DNA, 22 bp, Homo sapiens
tctttgttggagtccaaggata

SEQ ID NO: 7757947 - DNA, 22 bp, Homo sapiens
tggccttggcagtgagaagagt

SEQ ID NO: 7757948 - DNA, 22 bp, Homo sapiens
tgggaagcacgctcagcagaaa

SEQ ID NO: 7757949 - DNA, 22 bp, Homo sapiens
tgggaagagttagagacagctg

SEQ ID NO: 7757950 - DNA, 22 bp, Homo sapiens
tgggacacacaaggtcagctct

SEQ ID NO: 7757951 - DNA, 22 bp, Homo sapiens
tgggacacattagtcaccttac

SEQ ID NO: 7757952 - DNA, 22 bp, Homo sapiens
tgggaagaagcagagaactgga

SEQ ID NO: 7757953 - DNA, 21 bp, Homo sapiens
tggagagtgatttcagtgtgg

SEQ ID NO: 7757954 - DNA, 18 bp, Homo sapiens
tggaagctggcagatttt

SEQ ID NO: 7757955 - DNA, 22 bp, Homo sapiens
tggaagcttttgagattgttgc

SEQ ID NO: 7757956 - DNA, 17 bp, Homo sapiens
tggaagcttcatgttgg

SEQ ID NO: 7757957 - DNA, 22 bp, Homo sapiens
tgctgtgaggttgagaaggaag

SEQ ID NO: 7757958 - DNA, 22 bp, Homo sapiens
tgggcacagtgagttgccttta

SEQ ID NO: 7757959 - DNA, 22 bp, Homo sapiens
tgtgggcaggagcacaagtcag

SEQ ID NO: 7757960 - DNA, 22 bp, Homo sapiens
tgtggaagtgccaatgacaaat

SEQ ID NO: 7757961 - DNA, 22 bp, Homo sapiens
tgtggacaccactgggaggtct

SEQ ID NO: 7757962 - DNA, 22 bp, Homo sapiens
tgtgggaggaacacagccagaa

SEQ ID NO: 7757963 - DNA, 22 bp, Homo sapiens
tgtgggaggaattagaatggga

SEQ ID NO: 7757964 - DNA, 22 bp, Homo sapiens
tgtgtcagaaatcagtgcctcg

SEQ ID NO: 7757965 - DNA, 22 bp, Homo sapiens
tgtctttgttattgtggacagg

SEQ ID NO: 7757966 - DNA, 20 bp, Homo sapiens
agagagttgtcagtagcttc

SEQ ID NO: 7757967 - DNA, 21 bp, Homo sapiens
agagtctgcatttctgacaag

SEQ ID NO: 7757968 - DNA, 22 bp, Homo sapiens
aaagtccaattttgttcaggct

SEQ ID NO: 7757969 - DNA, 22 bp, Homo sapiens
aagagttctcagaaacgtgggt

SEQ ID NO: 7757970 - DNA, 22 bp, Homo sapiens
agagagttctttctagttgaag

SEQ ID NO: 7757971 - DNA, 22 bp, Homo sapiens
atctgctgttcttcacagcttg

SEQ ID NO: 7757972 - DNA, 20 bp, Homo sapiens
atctgctgagaatgaaaggc

SEQ ID NO: 7757973 - DNA, 18 bp, Homo sapiens
atctgctggcaggtctgg

SEQ ID NO: 7757974 - DNA, 22 bp, Homo sapiens
agagtctgaggcagctgcagcc

SEQ ID NO: 7757975 - DNA, 22 bp, Homo sapiens
agagtccaggtgggctggaggc

SEQ ID NO: 7757976 - DNA, 22 bp, Homo sapiens
agagtccagaaaacagtgtgct

SEQ ID NO: 7757977 - DNA, 21 bp, Homo sapiens
agtagtttagcacagggtttg

SEQ ID NO: 7757978 - DNA, 22 bp, Homo sapiens
actttgttcctttcacaaagaa

SEQ ID NO: 7757979 - DNA, 22 bp, Homo sapiens
aggcagcttaagccctggccca

SEQ ID NO: 7757980 - DNA, 22 bp, Homo sapiens
aggaagatgggagagctctgga

SEQ ID NO: 7757981 - DNA, 22 bp, Homo sapiens
atttgccttactgaagaaggag

SEQ ID NO: 7757982 - DNA, 22 bp, Homo sapiens
gaactttgcaaatgtcagaagc

SEQ ID NO: 7757983 - DNA, 22 bp, Homo sapiens
cttgagaatgtgagccacagat

SEQ ID NO: 7757984 - DNA, 22 bp, Homo sapiens
cttgagaaggaggaagggcttt

SEQ ID NO: 7757985 - DNA, 22 bp, Homo sapiens
cagaggacaactggggcaagga

SEQ ID NO: 7757986 - DNA, 19 bp, Homo sapiens
ggacacagaaagctgcatt

SEQ ID NO: 7757987 - DNA, 22 bp, Homo sapiens
ggacacagataatcacacagat

SEQ ID NO: 7757988 - DNA, 22 bp, Homo sapiens
ggacagcatatcagcagggcag

SEQ ID NO: 7757989 - DNA, 22 bp, Homo sapiens
ggacagcattcctagttccaaa

SEQ ID NO: 7757990 - DNA, 19 bp, Homo sapiens
tgggacacgatctgcctgt

SEQ ID NO: 7757991 - DNA, 22 bp, Homo sapiens
gaggaagaattggttattggag

SEQ ID NO: 7757992 - DNA, 22 bp, Homo sapiens
gacagaagaggaacttggacag

SEQ ID NO: 7757993 - DNA, 22 bp, Homo sapiens
gacagcaatgacggggcagctg

SEQ ID NO: 7757994 - DNA, 22 bp, Homo sapiens
ctgctgtgattgggagaaaccg

SEQ ID NO: 7757995 - DNA, 22 bp, Homo sapiens
ctgggaagatggtgacagaatt

SEQ ID NO: 7757996 - DNA, 22 bp, Homo sapiens
gctggtagacctcactgcactc

SEQ ID NO: 7757997 - DNA, 22 bp, Homo sapiens
ggacagagagtgaatatgacat

SEQ ID NO: 7757998 - DNA, 21 bp, Homo sapiens
ggacagaggagaaggcaccct

SEQ ID NO: 7757999 - DNA, 22 bp, Homo sapiens
ggaagctgttgtgagtgcagca

SEQ ID NO: 7758000 - DNA, 21 bp, Homo sapiens
ggaagctgtgtccatgctcct

SEQ ID NO: 7758001 - DNA, 22 bp, Homo sapiens
tcaggaaatggtgatttggttg

SEQ ID NO: 7758002 - DNA, 22 bp, Homo sapiens
tcaggaaatggacatctttgct

SEQ ID NO: 7758003 - DNA, 22 bp, Homo sapiens
ttgtatagcccagagagtgaga

SEQ ID NO: 7758004 - DNA, 23 bp, Homo sapiens
ttgtggaagggagatggcaacag

SEQ ID NO: 7758005 - DNA, 22 bp, Homo sapiens
tttgggaaacttaggggtcaga

SEQ ID NO: 7758006 - DNA, 21 bp, Homo sapiens
tttgagaattggtcagagtgc

SEQ ID NO: 7758007 - DNA, 22 bp, Homo sapiens
tttgtctacaaaaagtgtacag

SEQ ID NO: 7758008 - DNA, 22 bp, Homo sapiens
aagtatgaatcaaagactatct

SEQ ID NO: 7758009 - DNA, 22 bp, Homo sapiens
aagctgcaggttgaatccaggt

SEQ ID NO: 7758010 - DNA, 22 bp, Homo sapiens
actgccttataatatgtcaaca

SEQ ID NO: 7758011 - DNA, 22 bp, Homo sapiens
actgccttagaacaaagcagga

SEQ ID NO: 7758012 - DNA, 22 bp, Homo sapiens
actgccttatatgctgtgtgtg

SEQ ID NO: 7758013 - DNA, 22 bp, Homo sapiens
aaagctgccctacacggaagca

SEQ ID NO: 7758014 - DNA, 22 bp, Homo sapiens
aaagctgcccagctgcctgttt

SEQ ID NO: 7758015 - DNA, 22 bp, Homo sapiens
aaagaaggggtctacatccaat

SEQ ID NO: 7758016 - DNA, 22 bp, Homo sapiens
aagtccaggtccaggaggttcc

SEQ ID NO: 7758017 - DNA, 22 bp, Homo sapiens
aagtccagggatcaaagtaggc

SEQ ID NO: 7758018 - DNA, 17 bp, Homo sapiens
aagtccagagttgagca

SEQ ID NO: 7758019 - DNA, 22 bp, Homo sapiens
cagctcatgacctttgttatct

SEQ ID NO: 7758020 - DNA, 22 bp, Homo sapiens
agagagttgtatgtttctaaaa

SEQ ID NO: 7758021 - DNA, 22 bp, Homo sapiens
agagtttgaattttgaaaagat

SEQ ID NO: 7758022 - DNA, 22 bp, Homo sapiens
agggagacaaaagcagctgcca

SEQ ID NO: 7758023 - DNA, 22 bp, Homo sapiens
aggaagaaactgagctctgaca

SEQ ID NO: 7758024 - DNA, 22 bp, Homo sapiens
aggcagctggaaaactccaggc

SEQ ID NO: 7758025 - DNA, 22 bp, Homo sapiens
agtgacagtctcagagatcagg

SEQ ID NO: 7758026 - DNA, 22 bp, Homo sapiens
agtctgcttcctggagaactca

SEQ ID NO: 7758027 - DNA, 22 bp, Homo sapiens
agtctgcttttgtgaagagctg

SEQ ID NO: 7758028 - DNA, 22 bp, Homo sapiens
ctgtgggagcacatgacagata

SEQ ID NO: 7758029 - DNA, 22 bp, Homo sapiens
gaagtccagaatactgctctga

SEQ ID NO: 7758030 - DNA, 22 bp, Homo sapiens
gacaggaaacaagaaggcagga

SEQ ID NO: 7758031 - DNA, 22 bp, Homo sapiens
ctttggaacaagaagaaatggc

SEQ ID NO: 7758032 - DNA, 22 bp, Homo sapiens
ctttggaaagtaagcagctaga

SEQ ID NO: 7758033 - DNA, 22 bp, Homo sapiens
ctttggaaaaagtgactggctc

SEQ ID NO: 7758034 - DNA, 22 bp, Homo sapiens
ctttggaaaaatacctggcata

SEQ ID NO: 7758035 - DNA, 22 bp, Homo sapiens
ggaagctggtaattgttgggac

SEQ ID NO: 7758036 - DNA, 22 bp, Homo sapiens
caaagtcctagaacagtgcttg

SEQ ID NO: 7758037 - DNA, 22 bp, Homo sapiens
caagaagaggtgattggtaagt

SEQ ID NO: 7758038 - DNA, 22 bp, Homo sapiens
cctgccttcagccctgaagtct

SEQ ID NO: 7758039 - DNA, 22 bp, Homo sapiens
tgacagagacagattgaagctt

SEQ ID NO: 7758040 - DNA, 22 bp, Homo sapiens
tgacagagacttcagagccaaa

SEQ ID NO: 7758041 - DNA, 22 bp, Homo sapiens
tgacagagttcggattgagttt

SEQ ID NO: 7758042 - DNA, 22 bp, Homo sapiens
tgacagagtgacactcttgtct

SEQ ID NO: 7758043 - DNA, 22 bp, Homo sapiens
tgacagaggctgagttagtctg

SEQ ID NO: 7758044 - DNA, 22 bp, Homo sapiens
tgacagagtccagaagtagtgt

SEQ ID NO: 7758045 - DNA, 22 bp, Homo sapiens
tgacagagctggagaataattt

SEQ ID NO: 7758046 - DNA, 22 bp, Homo sapiens
tgacagaggagctggaatgatt

SEQ ID NO: 7758047 - DNA, 22 bp, Homo sapiens
tgacagagagcttttgactgtc

SEQ ID NO: 7758048 - DNA, 22 bp, Homo sapiens
tgagagttctctcttcaggtgg

SEQ ID NO: 7758049 - DNA, 22 bp, Homo sapiens
tgagagttttgacgcttgtaac

SEQ ID NO: 7758050 - DNA, 22 bp, Homo sapiens
tgagagttattctgaatttagc

SEQ ID NO: 7758051 - DNA, 22 bp, Homo sapiens
tgaggacattggtcaggacatg

SEQ ID NO: 7758052 - DNA, 22 bp, Homo sapiens
ctgccttggaaaatgtggtaat

SEQ ID NO: 7758053 - DNA, 18 bp, Homo sapiens
ctgcctgttgctgagagg

SEQ ID NO: 7758054 - DNA, 22 bp, Homo sapiens
ctgaggtttacaagctattgct

SEQ ID NO: 7758055 - DNA, 16 bp, Homo sapiens
ctgaggtttggccaca

SEQ ID NO: 7758056 - DNA, 22 bp, Homo sapiens
ctgaggtttgtccatccttggt

SEQ ID NO: 7758057 - DNA, 22 bp, Homo sapiens
tttgagaagatgtaatgttaag

SEQ ID NO: 7758058 - DNA, 22 bp, Homo sapiens
tttgagaagagtttgaggtatt

SEQ ID NO: 7758059 - DNA, 22 bp, Homo sapiens
gagaagaaatagaatcacattt

SEQ ID NO: 7758060 - DNA, 22 bp, Homo sapiens
ctttggcacagtctcatttgat

SEQ ID NO: 7758061 - DNA, 22 bp, Homo sapiens
ggacagagggttgacagagtat

SEQ ID NO: 7758062 - DNA, 22 bp, Homo sapiens
gtccagctccagggaggcaggc

SEQ ID NO: 7758063 - DNA, 22 bp, Homo sapiens
tcctgagagccttggcttcaga

SEQ ID NO: 7758064 - DNA, 22 bp, Homo sapiens
tcctgagagcagagtccaggtg

SEQ ID NO: 7758065 - DNA, 22 bp, Homo sapiens
tcctgagataggagttgaaggc

SEQ ID NO: 7758066 - DNA, 22 bp, Homo sapiens
tagctgcacaggaagtaagatt

SEQ ID NO: 7758067 - DNA, 22 bp, Homo sapiens
tatttgaccgtgaggaatatga

SEQ ID NO: 7758068 - DNA, 22 bp, Homo sapiens
tatttgactcttaggaagactc

SEQ ID NO: 7758069 - DNA, 22 bp, Homo sapiens
ttgggaagtttaatgacagact

SEQ ID NO: 7758070 - DNA, 22 bp, Homo sapiens
tttggtcatgtcgtcatttggg

SEQ ID NO: 7758071 - DNA, 22 bp, Homo sapiens
aaggaagcagccagagaccctc

SEQ ID NO: 7758072 - DNA, 22 bp, Homo sapiens
aagtccagtttttccaggtggt

SEQ ID NO: 7758073 - DNA, 22 bp, Homo sapiens
aagtccagtgctttagattcca

SEQ ID NO: 7758074 - DNA, 22 bp, Homo sapiens
actttgttttcatgaaacagct

SEQ ID NO: 7758075 - DNA, 22 bp, Homo sapiens
actttgttgaagaatatgttag

SEQ ID NO: 7758076 - DNA, 22 bp, Homo sapiens
actttgttgttccttgtctaaa

SEQ ID NO: 7758077 - DNA, 22 bp, Homo sapiens
actttgttgatgaaatagtttt

SEQ ID NO: 7758078 - DNA, 22 bp, Homo sapiens
agaagaaatgaggccgttctgc

SEQ ID NO: 7758079 - DNA, 22 bp, Homo sapiens
agaagaaagattgaaggttcct

SEQ ID NO: 7758080 - DNA, 22 bp, Homo sapiens
agaagaaactgtcggggatatt

SEQ ID NO: 7758081 - DNA, 22 bp, Homo sapiens
agagctgcccacacagcagatt

SEQ ID NO: 7758082 - DNA, 21 bp, Homo sapiens
agcgtcaatatcgtcaacagg

SEQ ID NO: 7758083 - DNA, 22 bp, Homo sapiens
aagtccagtgaaatagaatgca

SEQ ID NO: 7758084 - DNA, 22 bp, Homo sapiens
aaagtcacttccttctgtcagc

SEQ ID NO: 7758085 - DNA, 22 bp, Homo sapiens
aaagtccaggggctggaggcgg

SEQ ID NO: 7758086 - DNA, 22 bp, Homo sapiens
aaagtccagggaaagagcgtct

SEQ ID NO: 7758087 - DNA, 22 bp, Homo sapiens
caagtccatgttagatgctggc

SEQ ID NO: 7758088 - DNA, 22 bp, Homo sapiens
agtcagtggtatttaggggaat

SEQ ID NO: 7758089 - DNA, 22 bp, Homo sapiens
agtcagtgggcttggcacagaa

SEQ ID NO: 7758090 - DNA, 22 bp, Homo sapiens
agtcagtgggagaagtgtgaag

SEQ ID NO: 7758091 - DNA, 22 bp, Homo sapiens
agtcctgtaattgtgagttaac

SEQ ID NO: 7758092 - DNA, 22 bp, Homo sapiens
agtcctgtgaggggtgcagctt

SEQ ID NO: 7758093 - DNA, 22 bp, Homo sapiens
actcacagtccctgtaggagtg

SEQ ID NO: 7758094 - DNA, 22 bp, Homo sapiens
agttcagccatttgttaactat

SEQ ID NO: 7758095 - DNA, 22 bp, Homo sapiens
cagtccagccagtagggtgtgg

SEQ ID NO: 7758096 - DNA, 22 bp, Homo sapiens
aggcaatcccctgaggatactt

SEQ ID NO: 7758097 - DNA, 22 bp, Homo sapiens
agtccagtcggcctggagaaat

SEQ ID NO: 7758098 - DNA, 22 bp, Homo sapiens
agtccaccggcagagatgctga

SEQ ID NO: 7758099 - DNA, 22 bp, Homo sapiens
ctgtgggagaagctagcacagg

SEQ ID NO: 7758100 - DNA, 22 bp, Homo sapiens
atcaaagagcttgacaatccta

SEQ ID NO: 7758101 - DNA, 22 bp, Homo sapiens
cagagctgggatcccatgggcg

SEQ ID NO: 7758102 - DNA, 22 bp, Homo sapiens
cctcatttatagccaaagtaaa

SEQ ID NO: 7758103 - DNA, 22 bp, Homo sapiens
cagggctgtggctttgtgctgt

SEQ ID NO: 7758104 - DNA, 22 bp, Homo sapiens
tcagagtttgtactgacaggag

SEQ ID NO: 7758105 - DNA, 22 bp, Homo sapiens
tccttggggacgctgacatcgt

SEQ ID NO: 7758106 - DNA, 22 bp, Homo sapiens
tttgggaaggcagacatcccac

SEQ ID NO: 7758107 - DNA, 19 bp, Homo sapiens
tttgggaagcccagagtgt

SEQ ID NO: 7758108 - DNA, 20 bp, Homo sapiens
tttgggaaatgcaggtttca

SEQ ID NO: 7758109 - DNA, 22 bp, Homo sapiens
tttgggaacaatgaggatctga

SEQ ID NO: 7758110 - DNA, 22 bp, Homo sapiens
tttgggaaccagaagttcaaaa

SEQ ID NO: 7758111 - DNA, 22 bp, Homo sapiens
tttgggaaatattgtgttcaag

SEQ ID NO: 7758112 - DNA, 22 bp, Homo sapiens
tttgggaaatagtagaaaatgt

SEQ ID NO: 7758113 - DNA, 22 bp, Homo sapiens
tttgggaaataaacctagagga

SEQ ID NO: 7758114 - DNA, 22 bp, Homo sapiens
gacagtagtaaagctaggacca

SEQ ID NO: 7758115 - DNA, 22 bp, Homo sapiens
gtctgctggcacgtcacagata

SEQ ID NO: 7758116 - DNA, 22 bp, Homo sapiens
gtctgctgtgccttggggaaaa

SEQ ID NO: 7758117 - DNA, 23 bp, Homo sapiens
ggacacaggccttgtctgcgcct

SEQ ID NO: 7758118 - DNA, 22 bp, Homo sapiens
ggacacagtggaagacagcttg

SEQ ID NO: 7758119 - DNA, 22 bp, Homo sapiens
ggacacagctgcagccacaccc

SEQ ID NO: 7758120 - DNA, 22 bp, Homo sapiens
tcagagaagacatcattgtgaa

SEQ ID NO: 7758121 - DNA, 22 bp, Homo sapiens
tcagagctaaggggagagcaaa

SEQ ID NO: 7758122 - DNA, 22 bp, Homo sapiens
tacattctggaaaggcacagac

SEQ ID NO: 7758123 - DNA, 22 bp, Homo sapiens
tatgtcctgctactctctcatg

SEQ ID NO: 7758124 - DNA, 22 bp, Homo sapiens
tgtggacatagaagcatgtgga

SEQ ID NO: 7758125 - DNA, 22 bp, Homo sapiens
tgtggacagagcagaaggtcat

SEQ ID NO: 7758126 - DNA, 20 bp, Homo sapiens
tgtgtcaggccctgattaaa

SEQ ID NO: 7758127 - DNA, 22 bp, Homo sapiens
tgtgtcaggccttatcggtggc

SEQ ID NO: 7758128 - DNA, 22 bp, Homo sapiens
tgttcagaacaaaggtaaatga

SEQ ID NO: 7758129 - DNA, 22 bp, Homo sapiens
tttggaagtaaatgagtgtttt

SEQ ID NO: 7758130 - DNA, 22 bp, Homo sapiens
tttggaacaagacaaaacatta

SEQ ID NO: 7758131 - DNA, 22 bp, Homo sapiens
tttggaagatagttcggcagtt

SEQ ID NO: 7758132 - DNA, 22 bp, Homo sapiens
tttggaagggaaccaaaacatg

SEQ ID NO: 7758133 - DNA, 22 bp, Homo sapiens
ggtcattatagtggggaggtgg

SEQ ID NO: 7758134 - DNA, 22 bp, Homo sapiens
ggtcattttcactttcaagtta

SEQ ID NO: 7758135 - DNA, 22 bp, Homo sapiens
cagcacagtgaccagacccact

SEQ ID NO: 7758136 - DNA, 22 bp, Homo sapiens
gtctggaaggaggagatggagc

SEQ ID NO: 7758137 - DNA, 22 bp, Homo sapiens
cacatacaaggcacactggagg

SEQ ID NO: 7758138 - DNA, 22 bp, Homo sapiens
cacataagaaatgaatatgaga

SEQ ID NO: 7758139 - DNA, 22 bp, Homo sapiens
cacatacattcatgttactcta

SEQ ID NO: 7758140 - DNA, 22 bp, Homo sapiens
cacatactgagaatcacaccca

SEQ ID NO: 7758141 - DNA, 22 bp, Homo sapiens
cacatacatacgtatgtataca

SEQ ID NO: 7758142 - DNA, 22 bp, Homo sapiens
cacatacttgtgtgtacatatg

SEQ ID NO: 7758143 - DNA, 22 bp, Homo sapiens
cagaaagacctgggctcaagag

SEQ ID NO: 7758144 - DNA, 22 bp, Homo sapiens
ggctcacaacagttttctgtaa

SEQ ID NO: 7758145 - DNA, 22 bp, Homo sapiens
cacaattttaatacacagtcaa

SEQ ID NO: 7758146 - DNA, 22 bp, Homo sapiens
cacacagatggtaagggaggga

SEQ ID NO: 7758147 - DNA, 22 bp, Homo sapiens
cacacagacagctctctgaaga

SEQ ID NO: 7758148 - DNA, 15 bp, Homo sapiens
cacacagacagcttg

SEQ ID NO: 7758149 - DNA, 22 bp, Homo sapiens
ggagcctgaaaagtctgcattt

SEQ ID NO: 7758150 - DNA, 22 bp, Homo sapiens
caaatactacgattcttgcagt

SEQ ID NO: 7758151 - DNA, 22 bp, Homo sapiens
gccacaggtactatgggagaga

SEQ ID NO: 7758152 - DNA, 17 bp, Homo sapiens
gcccacccttaggagct

SEQ ID NO: 7758153 - DNA, 22 bp, Homo sapiens
atttccatagagcgtctcacag

SEQ ID NO: 7758154 - DNA, 22 bp, Homo sapiens
atttccatcatcattaggccta

SEQ ID NO: 7758155 - DNA, 22 bp, Homo sapiens
atttccatacacccatttctga

SEQ ID NO: 7758156 - DNA, 22 bp, Homo sapiens
atttccatgaagtttagttata

SEQ ID NO: 7758157 - DNA, 22 bp, Homo sapiens
atttccatgaaggcagatttta

SEQ ID NO: 7758158 - DNA, 22 bp, Homo sapiens
atttccatgaattcccactcat

SEQ ID NO: 7758159 - DNA, 22 bp, Homo sapiens
atttccatgccttagcttaagg

SEQ ID NO: 7758160 - DNA, 22 bp, Homo sapiens
atttccattatcatgacaaatt

SEQ ID NO: 7758161 - DNA, 22 bp, Homo sapiens
atttccattttcagccattact

SEQ ID NO: 7758162 - DNA, 22 bp, Homo sapiens
atttccatgtccaaaaattagt

SEQ ID NO: 7758163 - DNA, 22 bp, Homo sapiens
atttccatgtcggtattttata

SEQ ID NO: 7758164 - DNA, 23 bp, Homo sapiens
gcccaccctcagcgtcctcacgg

SEQ ID NO: 7758165 - DNA, 22 bp, Homo sapiens
gcctggcacagtagggacccaa

SEQ ID NO: 7758166 - DNA, 22 bp, Homo sapiens
gcctggcaatggcctcaggaag

SEQ ID NO: 7758167 - DNA, 22 bp, Homo sapiens
gcctggcacaggaattaggagg

SEQ ID NO: 7758168 - DNA, 22 bp, Homo sapiens
gcctggcaaggccctgttgact

SEQ ID NO: 7758169 - DNA, 17 bp, Homo sapiens
gcatcacagataacacg

SEQ ID NO: 7758170 - DNA, 22 bp, Homo sapiens
attgactccttcaatgatgaca

SEQ ID NO: 7758171 - DNA, 17 bp, Homo sapiens
attgactcatttatcat

SEQ ID NO: 7758172 - DNA, 23 bp, Homo sapiens
attgactctaagagattcttgaa

SEQ ID NO: 7758173 - DNA, 22 bp, Homo sapiens
gaggcacatatatacagagccc

SEQ ID NO: 7758174 - DNA, 22 bp, Homo sapiens
gagatggccagtgccaggacaa

SEQ ID NO: 7758175 - DNA, 22 bp, Homo sapiens
gagacatcataatgaagtttcc

SEQ ID NO: 7758176 - DNA, 22 bp, Homo sapiens
atgttggagtcgtaaggcatgg

SEQ ID NO: 7758177 - DNA, 22 bp, Homo sapiens
gacacatagatctatctcactc

SEQ ID NO: 7758178 - DNA, 22 bp, Homo sapiens
gacacatatgcgtatagtttag

SEQ ID NO: 7758179 - DNA, 18 bp, Homo sapiens
gacacatccccaggcctc

SEQ ID NO: 7758180 - DNA, 22 bp, Homo sapiens
atctggctcacctgggtaaata

SEQ ID NO: 7758181 - DNA, 22 bp, Homo sapiens
atctggctcacttagtctagga

SEQ ID NO: 7758182 - DNA, 22 bp, Homo sapiens
atctggctatttctggtcgggg

SEQ ID NO: 7758183 - DNA, 22 bp, Homo sapiens
atctggctattgacatgttata

SEQ ID NO: 7758184 - DNA, 22 bp, Homo sapiens
atccaggccccaagaccccgac

SEQ ID NO: 7758185 - DNA, 22 bp, Homo sapiens
atccaggcgaatgcagaaggcc

SEQ ID NO: 7758186 - DNA, 22 bp, Homo sapiens
cttcccactagtatcacagagc

SEQ ID NO: 7758187 - DNA, 17 bp, Homo sapiens
cttcccaccatctcctg

SEQ ID NO: 7758188 - DNA, 22 bp, Homo sapiens
cttagaagtaatttaccttctc

SEQ ID NO: 7758189 - DNA, 22 bp, Homo sapiens
cttagaagtgggctataattag

SEQ ID NO: 7758190 - DNA, 22 bp, Homo sapiens
cttagaagaatgcctaggacag

SEQ ID NO: 7758191 - DNA, 22 bp, Homo sapiens
cttagaaggaacagtttagtgc

SEQ ID NO: 7758192 - DNA, 22 bp, Homo sapiens
cttagaaggatgtttgctgttt

SEQ ID NO: 7758193 - DNA, 20 bp, Homo sapiens
cttagaagggacatcctggg

SEQ ID NO: 7758194 - DNA, 22 bp, Homo sapiens
cttcctctagcctagtaatgcc

SEQ ID NO: 7758195 - DNA, 22 bp, Homo sapiens
agttatttactcctttgtctct

SEQ ID NO: 7758196 - DNA, 22 bp, Homo sapiens
atacattcaaaggaaggataga

SEQ ID NO: 7758197 - DNA, 22 bp, Homo sapiens
cgggcaaggcgagactaggccc

SEQ ID NO: 7758198 - DNA, 22 bp, Homo sapiens
aggtagggaagaaggcatgaaa

SEQ ID NO: 7758199 - DNA, 22 bp, Homo sapiens
ctcattagacaggtatacttta

SEQ ID NO: 7758200 - DNA, 22 bp, Homo sapiens
ctccaggctcgtccaagatcga

SEQ ID NO: 7758201 - DNA, 19 bp, Homo sapiens
ctcctggctctgtcatttt

SEQ ID NO: 7758202 - DNA, 18 bp, Homo sapiens
ctcctggctgatggtgag

SEQ ID NO: 7758203 - DNA, 22 bp, Homo sapiens
ctcctggctcgcccccagctga

SEQ ID NO: 7758204 - DNA, 22 bp, Homo sapiens
ctcctggctttcccagaccagg

SEQ ID NO: 7758205 - DNA, 22 bp, Homo sapiens
ctctgagcagaggccgtggcta

SEQ ID NO: 7758206 - DNA, 22 bp, Homo sapiens
ctctggcttggtaaaaacttct

SEQ ID NO: 7758207 - DNA, 22 bp, Homo sapiens
ctctggctttgctcatgcatcc

SEQ ID NO: 7758208 - DNA, 22 bp, Homo sapiens
ctctggctttcccagggaggag

SEQ ID NO: 7758209 - DNA, 22 bp, Homo sapiens
ctctggctttaaggatgccaca

SEQ ID NO: 7758210 - DNA, 22 bp, Homo sapiens
ctctggcttgttaatgcatatt

SEQ ID NO: 7758211 - DNA, 22 bp, Homo sapiens
catttattggttaggccagcag

SEQ ID NO: 7758212 - DNA, 21 bp, Homo sapiens
ccactcatgactccactcacc

SEQ ID NO: 7758213 - DNA, 22 bp, Homo sapiens
ccacatacaaatggggtgctgt

SEQ ID NO: 7758214 - DNA, 22 bp, Homo sapiens
ccacatcatggatacagttatg

SEQ ID NO: 7758215 - DNA, 22 bp, Homo sapiens
ccacagaccttggcttccacct

SEQ ID NO: 7758216 - DNA, 22 bp, Homo sapiens
catgagataatttttctccagt

SEQ ID NO: 7758217 - DNA, 22 bp, Homo sapiens
aggaggctgaactagggtctgg

SEQ ID NO: 7758218 - DNA, 22 bp, Homo sapiens
aggacaagctaaaggacttcct

SEQ ID NO: 7758219 - DNA, 22 bp, Homo sapiens
ccctggcagagggggcaggtgc

SEQ ID NO: 7758220 - DNA, 20 bp, Homo sapiens
agggctgagaagggactagc

SEQ ID NO: 7758221 - DNA, 22 bp, Homo sapiens
cccaggcctggtctgggccagt

SEQ ID NO: 7758222 - DNA, 17 bp, Homo sapiens
cccaggccgccgggagc

SEQ ID NO: 7758223 - DNA, 22 bp, Homo sapiens
agggactccctgggccgacacg

SEQ ID NO: 7758224 - DNA, 22 bp, Homo sapiens
cccaggccagaacttggttgct

SEQ ID NO: 7758225 - DNA, 22 bp, Homo sapiens
cccaccctgggctacacatcca

SEQ ID NO: 7758226 - DNA, 22 bp, Homo sapiens
cccaccctgggaagctaggcag

SEQ ID NO: 7758227 - DNA, 18 bp, Homo sapiens
cccacacagcagtagctc

SEQ ID NO: 7758228 - DNA, 22 bp, Homo sapiens
cccacacatttttcacttaccg

SEQ ID NO: 7758229 - DNA, 20 bp, Homo sapiens
cccacacccttcccacttgg

SEQ ID NO: 7758230 - DNA, 22 bp, Homo sapiens
cccacacactggctgctgccaa

SEQ ID NO: 7758231 - DNA, 22 bp, Homo sapiens
cccacacacatttatgatagga

SEQ ID NO: 7758232 - DNA, 22 bp, Homo sapiens
cccacacaaatcatggggagaa

SEQ ID NO: 7758233 - DNA, 22 bp, Homo sapiens
atacacactgctatcctttttt

SEQ ID NO: 7758234 - DNA, 18 bp, Homo sapiens
agaagcctgcctcaatgc

SEQ ID NO: 7758235 - DNA, 22 bp, Homo sapiens
atcctggcccaggtgtggaggg

SEQ ID NO: 7758236 - DNA, 22 bp, Homo sapiens
agggctgacaaatggcagtgac

SEQ ID NO: 7758237 - DNA, 22 bp, Homo sapiens
agggctgaagggaggtgctcat

SEQ ID NO: 7758238 - DNA, 22 bp, Homo sapiens
aggggtgtgcatcctggaggat

SEQ ID NO: 7758239 - DNA, 22 bp, Homo sapiens
aggcagtgtgtagctggaagag

SEQ ID NO: 7758240 - DNA, 21 bp, Homo sapiens
aggctgctggctcagggtcct

SEQ ID NO: 7758241 - DNA, 22 bp, Homo sapiens
aggctgcttcagctgcagggag

SEQ ID NO: 7758242 - DNA, 22 bp, Homo sapiens
acatctggagactacagtttgg

SEQ ID NO: 7758243 - DNA, 22 bp, Homo sapiens
acatctgaggagaccagcctct

SEQ ID NO: 7758244 - DNA, 22 bp, Homo sapiens
cacacagaaccgctcgccactt

SEQ ID NO: 7758245 - DNA, 22 bp, Homo sapiens
cacacatcttatcccagttatt

SEQ ID NO: 7758246 - DNA, 22 bp, Homo sapiens
cacacatcaacctagacattgt

SEQ ID NO: 7758247 - DNA, 22 bp, Homo sapiens
cagcccaggtctctcttccagt

SEQ ID NO: 7758248 - DNA, 22 bp, Homo sapiens
cagcccaaagccccaggctaga

SEQ ID NO: 7758249 - DNA, 22 bp, Homo sapiens
atgactctaagaattctagatg

SEQ ID NO: 7758250 - DNA, 22 bp, Homo sapiens
atgactgctctgggctcccatg

SEQ ID NO: 7758251 - DNA, 22 bp, Homo sapiens
atgactctgctgaggcacccgg

SEQ ID NO: 7758252 - DNA, 22 bp, Homo sapiens
atgactcttagctaaaggtaag

SEQ ID NO: 7758253 - DNA, 19 bp, Homo sapiens
atgactcttattgtctgaa

SEQ ID NO: 7758254 - DNA, 22 bp, Homo sapiens
atgactctccagagctgcagat

SEQ ID NO: 7758255 - DNA, 22 bp, Homo sapiens
atctggctgactttgtgggaca

SEQ ID NO: 7758256 - DNA, 22 bp, Homo sapiens
atctggctgctgtgcttaagct

SEQ ID NO: 7758257 - DNA, 22 bp, Homo sapiens
atctggctgagcgaggcccaca

SEQ ID NO: 7758258 - DNA, 17 bp, Homo sapiens
atctggctgcttctaga

SEQ ID NO: 7758259 - DNA, 22 bp, Homo sapiens
atctggctggattcttagcgtt

SEQ ID NO: 7758260 - DNA, 22 bp, Homo sapiens
atctggcttacctagggtgcct

SEQ ID NO: 7758261 - DNA, 22 bp, Homo sapiens
atctggcttttaccccacggcc

SEQ ID NO: 7758262 - DNA, 22 bp, Homo sapiens
atctggcttttactgaattgct

SEQ ID NO: 7758263 - DNA, 22 bp, Homo sapiens
atctggctttcttaatgactta

SEQ ID NO: 7758264 - DNA, 22 bp, Homo sapiens
atctggcttgactttgcgactt

SEQ ID NO: 7758265 - DNA, 22 bp, Homo sapiens
atctggcttgggtgtgggtagc

SEQ ID NO: 7758266 - DNA, 22 bp, Homo sapiens
atctggcttacgaagcactggt

SEQ ID NO: 7758267 - DNA, 22 bp, Homo sapiens
attttttagccaagactctgca

SEQ ID NO: 7758268 - DNA, 22 bp, Homo sapiens
attttgttatagaactctgtga

SEQ ID NO: 7758269 - DNA, 22 bp, Homo sapiens
agaggccggccgagcccatggg

SEQ ID NO: 7758270 - DNA, 19 bp, Homo sapiens
agaggcctcagcagctggc

SEQ ID NO: 7758271 - DNA, 22 bp, Homo sapiens
agaggcctccgaaaggtgggct

SEQ ID NO: 7758272 - DNA, 22 bp, Homo sapiens
aagagagagtgcgctcacagaa

SEQ ID NO: 7758273 - DNA, 22 bp, Homo sapiens
aagagagaactcccttcgccag

SEQ ID NO: 7758274 - DNA, 20 bp, Homo sapiens
aaaagagtgcttcaactgct

SEQ ID NO: 7758275 - DNA, 22 bp, Homo sapiens
aaaagagtcttaggcagtcata

SEQ ID NO: 7758276 - DNA, 22 bp, Homo sapiens
aaaagagtgactgataagtata

SEQ ID NO: 7758277 - DNA, 22 bp, Homo sapiens
aagtgccatcatagcatggctg

SEQ ID NO: 7758278 - DNA, 23 bp, Homo sapiens
aatctggctgatgttttttctct

SEQ ID NO: 7758279 - DNA, 22 bp, Homo sapiens
acacatacatggggaagatgag

SEQ ID NO: 7758280 - DNA, 22 bp, Homo sapiens
acacataagcctaatcatctcc

SEQ ID NO: 7758281 - DNA, 22 bp, Homo sapiens
acagactggcctgtctcgcacc

SEQ ID NO: 7758282 - DNA, 22 bp, Homo sapiens
acaaatccagtgaactccagtg

SEQ ID NO: 7758283 - DNA, 22 bp, Homo sapiens
acacagagccaaaccatatcac

SEQ ID NO: 7758284 - DNA, 22 bp, Homo sapiens
acacatcagaaatatgaatgag

SEQ ID NO: 7758285 - DNA, 22 bp, Homo sapiens
acacatcatgccaagtttcacc

SEQ ID NO: 7758286 - DNA, 22 bp, Homo sapiens
acacatctcaggggacactctc

SEQ ID NO: 7758287 - DNA, 22 bp, Homo sapiens
acacacacaagcaggttgtgga

SEQ ID NO: 7758288 - DNA, 18 bp, Homo sapiens
acacacacacctgtgtat

SEQ ID NO: 7758289 - DNA, 22 bp, Homo sapiens
agagcacagaagaataggtgct

SEQ ID NO: 7758290 - DNA, 21 bp, Homo sapiens
agatgctgatgctgcaggtcc

SEQ ID NO: 7758291 - DNA, 22 bp, Homo sapiens
agcacaggaccaaggaagctgt

SEQ ID NO: 7758292 - DNA, 22 bp, Homo sapiens
agcacagggacaatgccaggtg

SEQ ID NO: 7758293 - DNA, 22 bp, Homo sapiens
agcacaggctttggtgtgaggg

SEQ ID NO: 7758294 - DNA, 22 bp, Homo sapiens
agcacaggaacatggagatggg

SEQ ID NO: 7758295 - DNA, 22 bp, Homo sapiens
actctggcttgaggaccaggtc

SEQ ID NO: 7758296 - DNA, 22 bp, Homo sapiens
actcttggtcagaacaattcag

SEQ ID NO: 7758297 - DNA, 22 bp, Homo sapiens
acctgcctatggagccacatgg

SEQ ID NO: 7758298 - DNA, 22 bp, Homo sapiens
acctgcctcagtgcagctggat

SEQ ID NO: 7758299 - DNA, 22 bp, Homo sapiens
acctgcctatcagctgcctgct

SEQ ID NO: 7758300 - DNA, 22 bp, Homo sapiens
acatcccacagaaacatacata

SEQ ID NO: 7758301 - DNA, 22 bp, Homo sapiens
tattagaaagcttaatatcgtg

SEQ ID NO: 7758302 - DNA, 22 bp, Homo sapiens
tattagaaaggctattgcatag

SEQ ID NO: 7758303 - DNA, 22 bp, Homo sapiens
tattacagaatcaggcataact

SEQ ID NO: 7758304 - DNA, 21 bp, Homo sapiens
tatttattaatttgtaaggct

SEQ ID NO: 7758305 - DNA, 22 bp, Homo sapiens
tatttattggacagtgttgctg

SEQ ID NO: 7758306 - DNA, 22 bp, Homo sapiens
tatttattctttgtactgcctt

SEQ ID NO: 7758307 - DNA, 22 bp, Homo sapiens
tatttattcattcagcaagcat

SEQ ID NO: 7758308 - DNA, 22 bp, Homo sapiens
tatcccatgagccagctgcagc

SEQ ID NO: 7758309 - DNA, 22 bp, Homo sapiens
tatcccatgcctcattaaagtt

SEQ ID NO: 7758310 - DNA, 22 bp, Homo sapiens
tagacacatcttcatccacaat

SEQ ID NO: 7758311 - DNA, 22 bp, Homo sapiens
tagcccctgcctttgaacctgg

SEQ ID NO: 7758312 - DNA, 22 bp, Homo sapiens
tacattcctgttagcatctaag

SEQ ID NO: 7758313 - DNA, 23 bp, Homo sapiens
taaattacctttccagtgcaggg

SEQ ID NO: 7758314 - DNA, 22 bp, Homo sapiens
taaagggtaggttttactgtaa

SEQ ID NO: 7758315 - DNA, 22 bp, Homo sapiens
gtttccatgcagtagagcttag

SEQ ID NO: 7758316 - DNA, 22 bp, Homo sapiens
gtttccatctccaggacataat

SEQ ID NO: 7758317 - DNA, 22 bp, Homo sapiens
gtttccatatttttagtgccaa

SEQ ID NO: 7758318 - DNA, 22 bp, Homo sapiens
gtttccatgaaaatgtttctgc

SEQ ID NO: 7758319 - DNA, 22 bp, Homo sapiens
gtttccattgtcctatctatag

SEQ ID NO: 7758320 - DNA, 22 bp, Homo sapiens
gtttccatggtgtttcttgggt

SEQ ID NO: 7758321 - DNA, 22 bp, Homo sapiens
gtttccatggaagcaaaggtgg

SEQ ID NO: 7758322 - DNA, 22 bp, Homo sapiens
gtttccatggctctgttaatgg

SEQ ID NO: 7758323 - DNA, 22 bp, Homo sapiens
gtttccatgggagaagacagtg

SEQ ID NO: 7758324 - DNA, 22 bp, Homo sapiens
gtgtgggaaggctaggatgctg

SEQ ID NO: 7758325 - DNA, 22 bp, Homo sapiens
gttgggaaggtgaacatgatgc

SEQ ID NO: 7758326 - DNA, 22 bp, Homo sapiens
gttgggaaggcaagaagtagaa

SEQ ID NO: 7758327 - DNA, 22 bp, Homo sapiens
tcacacatgctaagccagagat

SEQ ID NO: 7758328 - DNA, 22 bp, Homo sapiens
tcacacatgagtaaatacaggg

SEQ ID NO: 7758329 - DNA, 22 bp, Homo sapiens
tcaggatggagggaagcacaga

SEQ ID NO: 7758330 - DNA, 22 bp, Homo sapiens
tcatggcacttagcacagtcct

SEQ ID NO: 7758331 - DNA, 22 bp, Homo sapiens
tcattagaaatgcagattctca

SEQ ID NO: 7758332 - DNA, 22 bp, Homo sapiens
tcattagataactccaccattt

SEQ ID NO: 7758333 - DNA, 22 bp, Homo sapiens
tccaggctaggtttacaggaca

SEQ ID NO: 7758334 - DNA, 22 bp, Homo sapiens
tccaggctctaggctgctctcc

SEQ ID NO: 7758335 - DNA, 22 bp, Homo sapiens
tcccacacagcccgctcaccgg

SEQ ID NO: 7758336 - DNA, 22 bp, Homo sapiens
tcccacacctgtctattcctag

SEQ ID NO: 7758337 - DNA, 22 bp, Homo sapiens
tcccacactacacggttgttgg

SEQ ID NO: 7758338 - DNA, 22 bp, Homo sapiens
tcccacacttgaaacaaggctg

SEQ ID NO: 7758339 - DNA, 22 bp, Homo sapiens
tcccatacctagggcttttccc

SEQ ID NO: 7758340 - DNA, 22 bp, Homo sapiens
tcccacaggaaagtagacattg

SEQ ID NO: 7758341 - DNA, 22 bp, Homo sapiens
tccccacacagatacagagtag

SEQ ID NO: 7758342 - DNA, 22 bp, Homo sapiens
tccccacactttcactcctggc

SEQ ID NO: 7758343 - DNA, 22 bp, Homo sapiens
tccccacagcagaagatctgag

SEQ ID NO: 7758344 - DNA, 22 bp, Homo sapiens
tccccacatctctgcatcaggc

SEQ ID NO: 7758345 - DNA, 21 bp, Homo sapiens
tccccacatttctaaacagac

SEQ ID NO: 7758346 - DNA, 22 bp, Homo sapiens
tccccacctaagatacccatct

SEQ ID NO: 7758347 - DNA, 22 bp, Homo sapiens
tccccaccccagaactactagg

SEQ ID NO: 7758348 - DNA, 22 bp, Homo sapiens
ggagagaattccatggacatgt

SEQ ID NO: 7758349 - DNA, 22 bp, Homo sapiens
ggagactcgggttctagccttg

SEQ ID NO: 7758350 - DNA, 22 bp, Homo sapiens
gcttctgtcttagctacctccc

SEQ ID NO: 7758351 - DNA, 22 bp, Homo sapiens
gcttctgtatttattgtccttt

SEQ ID NO: 7758352 - DNA, 21 bp, Homo sapiens
gcttctgtatctagcaggaac

SEQ ID NO: 7758353 - DNA, 22 bp, Homo sapiens
gcttctgttaacttatgttccc

SEQ ID NO: 7758354 - DNA, 22 bp, Homo sapiens
gcttctgtgagtgcagatgctg

SEQ ID NO: 7758355 - DNA, 22 bp, Homo sapiens
gcttctgtggattggctggctt

SEQ ID NO: 7758356 - DNA, 22 bp, Homo sapiens
gcttctgtggtgaggtcacctt

SEQ ID NO: 7758357 - DNA, 22 bp, Homo sapiens
gctgcgccggatcccacgttcc

SEQ ID NO: 7758358 - DNA, 22 bp, Homo sapiens
gctgctaagcgtttctgttcca

SEQ ID NO: 7758359 - DNA, 22 bp, Homo sapiens
gctctggcttggggcactcgtc

SEQ ID NO: 7758360 - DNA, 18 bp, Homo sapiens
gctctggctcacctccag

SEQ ID NO: 7758361 - DNA, 22 bp, Homo sapiens
gctctggctagttacctcttac

SEQ ID NO: 7758362 - DNA, 22 bp, Homo sapiens
gctctggctcaaaccaccggct

SEQ ID NO: 7758363 - DNA, 22 bp, Homo sapiens
gctccaggtgtcccaggtaaaa

SEQ ID NO: 7758364 - DNA, 20 bp, Homo sapiens
gctccaggtcagagaggacg

SEQ ID NO: 7758365 - DNA, 22 bp, Homo sapiens
gccacatagaggaggatattaa

SEQ ID NO: 7758366 - DNA, 22 bp, Homo sapiens
gccccaccttgagagcagaaac

SEQ ID NO: 7758367 - DNA, 22 bp, Homo sapiens
gccccacagcctgcggtctcag

SEQ ID NO: 7758368 - DNA, 22 bp, Homo sapiens
gcccagcctccaagctccaagg

SEQ ID NO: 7758369 - DNA, 22 bp, Homo sapiens
gcctccggagttgcagtgtctt

SEQ ID NO: 7758370 - DNA, 22 bp, Homo sapiens
gcctccggagtcacagtgtctt

SEQ ID NO: 7758371 - DNA, 22 bp, Homo sapiens
gcctcctggaagtcacatgttt

SEQ ID NO: 7758372 - DNA, 22 bp, Homo sapiens
gcacacagtatatgctcattaa

SEQ ID NO: 7758373 - DNA, 22 bp, Homo sapiens
gcacacatgcatgcacaggagt

SEQ ID NO: 7758374 - DNA, 22 bp, Homo sapiens
gcacacattcggattcttaacc

SEQ ID NO: 7758375 - DNA, 22 bp, Homo sapiens
gcacacagtagggattcaatga

SEQ ID NO: 7758376 - DNA, 22 bp, Homo sapiens
gcacacactgttttcctcacat

SEQ ID NO: 7758377 - DNA, 22 bp, Homo sapiens
gcacataaagggcatgggaggt

SEQ ID NO: 7758378 - DNA, 22 bp, Homo sapiens
gcacataactgaccacatctaa

SEQ ID NO: 7758379 - DNA, 22 bp, Homo sapiens
gcacatactgcaaagattacta

SEQ ID NO: 7758380 - DNA, 22 bp, Homo sapiens
gcacatacccactgtcaagcac

SEQ ID NO: 7758381 - DNA, 22 bp, Homo sapiens
gcagggacagggcagggccttt

SEQ ID NO: 7758382 - DNA, 22 bp, Homo sapiens
gcagcctcaaactccccagctc

SEQ ID NO: 7758383 - DNA, 22 bp, Homo sapiens
gtgactctgtttctgaaaacag

SEQ ID NO: 7758384 - DNA, 22 bp, Homo sapiens
gtgactcttgagcatgggtggg

SEQ ID NO: 7758385 - DNA, 22 bp, Homo sapiens
gtgactcttacctacccagcct

SEQ ID NO: 7758386 - DNA, 22 bp, Homo sapiens
gtgactcttaaagcaaatcttg

SEQ ID NO: 7758387 - DNA, 22 bp, Homo sapiens
gtgactctccactagtatgaaa

SEQ ID NO: 7758388 - DNA, 21 bp, Homo sapiens
gtgactctggcttcttccagt

SEQ ID NO: 7758389 - DNA, 22 bp, Homo sapiens
gtgactctacttaagattaagc

SEQ ID NO: 7758390 - DNA, 22 bp, Homo sapiens
gtgactctgcattttatggatc

SEQ ID NO: 7758391 - DNA, 22 bp, Homo sapiens
gtgactctcaaaagtgcagtct

SEQ ID NO: 7758392 - DNA, 22 bp, Homo sapiens
gtgactctcactttacctgact

SEQ ID NO: 7758393 - DNA, 22 bp, Homo sapiens
gtccacagagggctgggcaggc

SEQ ID NO: 7758394 - DNA, 22 bp, Homo sapiens
ggggctgagtcagtgggaagag

SEQ ID NO: 7758395 - DNA, 22 bp, Homo sapiens
ggtgttgggctcactggtcctt

SEQ ID NO: 7758396 - DNA, 22 bp, Homo sapiens
ggcctcagagaaggctgtgcgg

SEQ ID NO: 7758397 - DNA, 22 bp, Homo sapiens
ggcagaggtagctggaaccagg

SEQ ID NO: 7758398 - DNA, 22 bp, Homo sapiens
ggcaagagggcagatggagtgc

SEQ ID NO: 7758399 - DNA, 22 bp, Homo sapiens
ggctctggcggctctttcaata

SEQ ID NO: 7758400 - DNA, 22 bp, Homo sapiens
gacccatataggaccctccaaa

SEQ ID NO: 7758401 - DNA, 22 bp, Homo sapiens
gacacagaatttactcccgata

SEQ ID NO: 7758402 - DNA, 22 bp, Homo sapiens
gacacagacagttagaggtaat

SEQ ID NO: 7758403 - DNA, 22 bp, Homo sapiens
gacacagaaggtcacatgttca

SEQ ID NO: 7758404 - DNA, 22 bp, Homo sapiens
gaagagaaaggcaaggagtttt

SEQ ID NO: 7758405 - DNA, 22 bp, Homo sapiens
gagcctgatgaaacaggcagac

SEQ ID NO: 7758406 - DNA, 22 bp, Homo sapiens
gaggagctgttccctcacctct

SEQ ID NO: 7758407 - DNA, 22 bp, Homo sapiens
ctggctcagtgccttcagaagt

SEQ ID NO: 7758408 - DNA, 22 bp, Homo sapiens
ctggcaggagcattcacagagg

SEQ ID NO: 7758409 - DNA, 22 bp, Homo sapiens
cttgtcttgcacacggttgcca

SEQ ID NO: 7758410 - DNA, 22 bp, Homo sapiens
cttgactcttgcttcccatgga

SEQ ID NO: 7758411 - DNA, 22 bp, Homo sapiens
cttgactcaggctatattctag

SEQ ID NO: 7758412 - DNA, 22 bp, Homo sapiens
cttgactctgtgatgaccttga

SEQ ID NO: 7758413 - DNA, 22 bp, Homo sapiens
cttatttaatgagggttagaat

SEQ ID NO: 7758414 - DNA, 22 bp, Homo sapiens
cttatttatgtctgtctctaat

SEQ ID NO: 7758415 - DNA, 22 bp, Homo sapiens
cttatttactgatccacagatg

SEQ ID NO: 7758416 - DNA, 22 bp, Homo sapiens
tttgccattgcctgtcagttgt

SEQ ID NO: 7758417 - DNA, 22 bp, Homo sapiens
ctgactctctgagctcaaggtt

SEQ ID NO: 7758418 - DNA, 22 bp, Homo sapiens
ctgactctcctgagatggggag

SEQ ID NO: 7758419 - DNA, 22 bp, Homo sapiens
ctgactctgacaggacttgtgg

SEQ ID NO: 7758420 - DNA, 22 bp, Homo sapiens
ctgactctgcccttcagggcac

SEQ ID NO: 7758421 - DNA, 20 bp, Homo sapiens
ctgactctccttggcttgga

SEQ ID NO: 7758422 - DNA, 22 bp, Homo sapiens
ctgactctcctcaagcataaat

SEQ ID NO: 7758423 - DNA, 22 bp, Homo sapiens
ctgactctaaagtctttgttct

SEQ ID NO: 7758424 - DNA, 22 bp, Homo sapiens
ctgagccagggccacacatgga

SEQ ID NO: 7758425 - DNA, 18 bp, Homo sapiens
ctcctccacagcccctgc

SEQ ID NO: 7758426 - DNA, 22 bp, Homo sapiens
ctcctggcagttccccttgtca

SEQ ID NO: 7758427 - DNA, 22 bp, Homo sapiens
ctcctggcactgtcttgaccca

SEQ ID NO: 7758428 - DNA, 22 bp, Homo sapiens
ctcctggcaggctgagtgaaat

SEQ ID NO: 7758429 - DNA, 22 bp, Homo sapiens
tttatttaccttatgtcctcca

SEQ ID NO: 7758430 - DNA, 16 bp, Homo sapiens
tttatttactagtgtt

SEQ ID NO: 7758431 - DNA, 22 bp, Homo sapiens
ctcctggcactcagtgtggaag

SEQ ID NO: 7758432 - DNA, 22 bp, Homo sapiens
tttatttaaagtcgtgtgttaa

SEQ ID NO: 7758433 - DNA, 19 bp, Homo sapiens
ccttcctccccagggccat

SEQ ID NO: 7758434 - DNA, 22 bp, Homo sapiens
cgcatacatagaaacacacaga

SEQ ID NO: 7758435 - DNA, 22 bp, Homo sapiens
cgccccggacgtctgaccaaac

SEQ ID NO: 7758436 - DNA, 22 bp, Homo sapiens
ctatgagaagaaaacaagatta

SEQ ID NO: 7758437 - DNA, 22 bp, Homo sapiens
tccttcccaggtgtcgccgcct

SEQ ID NO: 7758438 - DNA, 22 bp, Homo sapiens
ccacacagtcagtttccaagaa

SEQ ID NO: 7758439 - DNA, 22 bp, Homo sapiens
ccacacagggggatgagttatt

SEQ ID NO: 7758440 - DNA, 18 bp, Homo sapiens
tcctggcagtcagagagg

SEQ ID NO: 7758441 - DNA, 19 bp, Homo sapiens
ccacacagtgtgcaattta

SEQ ID NO: 7758442 - DNA, 22 bp, Homo sapiens
ccacactaaactgctcaaacca

SEQ ID NO: 7758443 - DNA, 22 bp, Homo sapiens
tcctggcagcccgcaggtgctg

SEQ ID NO: 7758444 - DNA, 22 bp, Homo sapiens
tcctggcagggtctaggtctag

SEQ ID NO: 7758445 - DNA, 22 bp, Homo sapiens
tcctggcagtaatttgatgttg

SEQ ID NO: 7758446 - DNA, 22 bp, Homo sapiens
tcctggcacccttgggttggag

SEQ ID NO: 7758447 - DNA, 22 bp, Homo sapiens
tcctggcactttgggggctcgc

SEQ ID NO: 7758448 - DNA, 22 bp, Homo sapiens
tcctggcagagggcggcctcga

SEQ ID NO: 7758449 - DNA, 22 bp, Homo sapiens
tcctggcagaaatggggctgtg

SEQ ID NO: 7758450 - DNA, 22 bp, Homo sapiens
catttattcagctcagtcggtt

SEQ ID NO: 7758451 - DNA, 22 bp, Homo sapiens
catttattcatttgctagggct

SEQ ID NO: 7758452 - DNA, 22 bp, Homo sapiens
catttattcatgatctgtagct

SEQ ID NO: 7758453 - DNA, 22 bp, Homo sapiens
catttattgagtggccacagtg

SEQ ID NO: 7758454 - DNA, 22 bp, Homo sapiens
catttattctcagatccttgtc

SEQ ID NO: 7758455 - DNA, 22 bp, Homo sapiens
tccctcctggccgtcaccgctg

SEQ ID NO: 7758456 - DNA, 22 bp, Homo sapiens
tcccaccccctccaaggaggaa

SEQ ID NO: 7758457 - DNA, 22 bp, Homo sapiens
tcccaccccggtcaagggctga

SEQ ID NO: 7758458 - DNA, 22 bp, Homo sapiens
tcccaccccttgactctttaag

SEQ ID NO: 7758459 - DNA, 22 bp, Homo sapiens
tcccacccatcctgcatctctt

SEQ ID NO: 7758460 - DNA, 22 bp, Homo sapiens
tcccaccaggtgaccatttcat

SEQ ID NO: 7758461 - DNA, 22 bp, Homo sapiens
tcccacatgtgaatcctcaggt

SEQ ID NO: 7758462 - DNA, 22 bp, Homo sapiens
tcccacattaccctgactgaca

SEQ ID NO: 7758463 - DNA, 22 bp, Homo sapiens
cattagcacagtttcagtccac

SEQ ID NO: 7758464 - DNA, 22 bp, Homo sapiens
cattagaaaagcagctgggacc

SEQ ID NO: 7758465 - DNA, 22 bp, Homo sapiens
cattagaacctataaaaagcat

SEQ ID NO: 7758466 - DNA, 22 bp, Homo sapiens
cattagaactaagatgtccagg

SEQ ID NO: 7758467 - DNA, 22 bp, Homo sapiens
cattagaagaacagttatatta

SEQ ID NO: 7758468 - DNA, 22 bp, Homo sapiens
cattagaattaggttgtttacc

SEQ ID NO: 7758469 - DNA, 23 bp, Homo sapiens
cattagaaggtagagtggaatga

SEQ ID NO: 7758470 - DNA, 22 bp, Homo sapiens
cattagaaggttttaaaggaat

SEQ ID NO: 7758471 - DNA, 22 bp, Homo sapiens
tcaggccctttgctgctgcccc

SEQ ID NO: 7758472 - DNA, 22 bp, Homo sapiens
tcaggcccttctcccaggactc

SEQ ID NO: 7758473 - DNA, 22 bp, Homo sapiens
tcaggcccagagtcacggatcc

SEQ ID NO: 7758474 - DNA, 19 bp, Homo sapiens
catctggatgattctcctg

SEQ ID NO: 7758475 - DNA, 19 bp, Homo sapiens
tagatttgatcatctggat

SEQ ID NO: 7758476 - DNA, 22 bp, Homo sapiens
cagtcacataggtatacacata

SEQ ID NO: 7758477 - DNA, 22 bp, Homo sapiens
caggtgggtgtatgaatgcaaa

SEQ ID NO: 7758478 - DNA, 22 bp, Homo sapiens
cagggacaatggcagagcctga

SEQ ID NO: 7758479 - DNA, 22 bp, Homo sapiens
tagatacaggctctctgagcct

SEQ ID NO: 7758480 - DNA, 22 bp, Homo sapiens
tacaaaagtaattacggttttt

SEQ ID NO: 7758481 - DNA, 22 bp, Homo sapiens
tacaaaaggaagagggatctta

SEQ ID NO: 7758482 - DNA, 22 bp, Homo sapiens
cccttccttgtgactggtgggg

SEQ ID NO: 7758483 - DNA, 22 bp, Homo sapiens
cccttccttgattttaactgga

SEQ ID NO: 7758484 - DNA, 22 bp, Homo sapiens
cccttcctgggtgtcccggagt

SEQ ID NO: 7758485 - DNA, 22 bp, Homo sapiens
cccttcctcccaggcttctgtg

SEQ ID NO: 7758486 - DNA, 21 bp, Homo sapiens
cctagcctcttacccagcttt

SEQ ID NO: 7758487 - DNA, 18 bp, Homo sapiens
cctagcctccaagctcat

SEQ ID NO: 7758488 - DNA, 22 bp, Homo sapiens
tggcttcagggttgtcttcagc

SEQ ID NO: 7758489 - DNA, 22 bp, Homo sapiens
cccgagtgtctactcactccca

SEQ ID NO: 7758490 - DNA, 20 bp, Homo sapiens
ccccacactattgagcactt

SEQ ID NO: 7758491 - DNA, 22 bp, Homo sapiens
ccccacacctgccgggcagcag

SEQ ID NO: 7758492 - DNA, 22 bp, Homo sapiens
ccccacactctttacattcata

SEQ ID NO: 7758493 - DNA, 22 bp, Homo sapiens
ccccaccctcgctccatttcgg

SEQ ID NO: 7758494 - DNA, 22 bp, Homo sapiens
ccccacccacctaagagaaact

SEQ ID NO: 7758495 - DNA, 22 bp, Homo sapiens
ccctgagcgtgaggaggaagta

SEQ ID NO: 7758496 - DNA, 22 bp, Homo sapiens
ccctgagctcaggcccttgggg

SEQ ID NO: 7758497 - DNA, 22 bp, Homo sapiens
tctggctatatgctggcttcca

SEQ ID NO: 7758498 - DNA, 22 bp, Homo sapiens
tctggcaggccttgtcaatctg

SEQ ID NO: 7758499 - DNA, 22 bp, Homo sapiens
tctggcaggggttctgcacttg

SEQ ID NO: 7758500 - DNA, 22 bp, Homo sapiens
tctggcagctcagttcaggtct

SEQ ID NO: 7758501 - DNA, 22 bp, Homo sapiens
tctggcagctctcctcggcgga

SEQ ID NO: 7758502 - DNA, 21 bp, Homo sapiens
tctggcaggaagacggatggg

SEQ ID NO: 7758503 - DNA, 22 bp, Homo sapiens
tctggcagctatcctctggcca

SEQ ID NO: 7758504 - DNA, 22 bp, Homo sapiens
tctggcagcgaagcgtgtactt

SEQ ID NO: 7758505 - DNA, 21 bp, Homo sapiens
tctggcagcagtttgttgagt

SEQ ID NO: 7758506 - DNA, 22 bp, Homo sapiens
tctggcaggaccatgaagcgta

SEQ ID NO: 7758507 - DNA, 22 bp, Homo sapiens
tctggcaggatatcgaagtgaa

SEQ ID NO: 7758508 - DNA, 22 bp, Homo sapiens
tctggcaggacatgctgaccat

SEQ ID NO: 7758509 - DNA, 22 bp, Homo sapiens
tctggcaggcaatcggctctgg

SEQ ID NO: 7758510 - DNA, 21 bp, Homo sapiens
tctggcaggcacgggcccagc

SEQ ID NO: 7758511 - DNA, 22 bp, Homo sapiens
tctggcagcaagtctgtttctc

SEQ ID NO: 7758512 - DNA, 22 bp, Homo sapiens
tctggcagcagcatcagtggct

SEQ ID NO: 7758513 - DNA, 22 bp, Homo sapiens
ccaggcccagggtactgaccaa

SEQ ID NO: 7758514 - DNA, 22 bp, Homo sapiens
cccaccctcaagggtgtctata

SEQ ID NO: 7758515 - DNA, 22 bp, Homo sapiens
ccattcatacaattttgttcta

SEQ ID NO: 7758516 - DNA, 22 bp, Homo sapiens
ccattagataatgcacaccctc

SEQ ID NO: 7758517 - DNA, 22 bp, Homo sapiens
ccattagaagatgtaatagaga

SEQ ID NO: 7758518 - DNA, 22 bp, Homo sapiens
tttgtttgaaagtctctacagc

SEQ ID NO: 7758519 - DNA, 22 bp, Homo sapiens
ttgtttctttgaagtttctaga

SEQ ID NO: 7758520 - DNA, 21 bp, Homo sapiens
ttgtttcccagagctcgctcc

SEQ ID NO: 7758521 - DNA, 22 bp, Homo sapiens
ttgtctgaattcttctaggcag

SEQ ID NO: 7758522 - DNA, 22 bp, Homo sapiens
tttaatttgtatttctagaggg

SEQ ID NO: 7758523 - DNA, 21 bp, Homo sapiens
tttaatttgcatgtatgacgc

SEQ ID NO: 7758524 - DNA, 22 bp, Homo sapiens
tttaattttctgggcccagcag

SEQ ID NO: 7758525 - DNA, 22 bp, Homo sapiens
tttaattttcctcttcctggag

SEQ ID NO: 7758526 - DNA, 21 bp, Homo sapiens
tttattaacaactgtggacgt

SEQ ID NO: 7758527 - DNA, 22 bp, Homo sapiens
tttattaaaactgttggctctg

SEQ ID NO: 7758528 - DNA, 22 bp, Homo sapiens
tttatataacagagactgctat

SEQ ID NO: 7758529 - DNA, 22 bp, Homo sapiens
tttcatttcatagaattgtgtt

SEQ ID NO: 7758530 - DNA, 22 bp, Homo sapiens
tttcttctcgacaccttatccc

SEQ ID NO: 7758531 - DNA, 22 bp, Homo sapiens
tttctttaggctgtgttgccaa

SEQ ID NO: 7758532 - DNA, 22 bp, Homo sapiens
tttctttaaaggaactctgttt

SEQ ID NO: 7758533 - DNA, 22 bp, Homo sapiens
tgtttgacaacaggctcacaga

SEQ ID NO: 7758534 - DNA, 22 bp, Homo sapiens
tgtttccctaaggtctggctct

SEQ ID NO: 7758535 - DNA, 22 bp, Homo sapiens
tgtttccagaatgtagctgctt

SEQ ID NO: 7758536 - DNA, 22 bp, Homo sapiens
tgtgtctttggcgatgtctgga

SEQ ID NO: 7758537 - DNA, 22 bp, Homo sapiens
ttaactctccctccttacatcc

SEQ ID NO: 7758538 - DNA, 17 bp, Homo sapiens
ttaaggtggatcagcac

SEQ ID NO: 7758539 - DNA, 21 bp, Homo sapiens
ttagaagctaatgcagctggt

SEQ ID NO: 7758540 - DNA, 19 bp, Homo sapiens
ttagaagccataggtacag

SEQ ID NO: 7758541 - DNA, 22 bp, Homo sapiens
ttccacattccttacattcata

SEQ ID NO: 7758542 - DNA, 20 bp, Homo sapiens
ttccacatctttgcacatgc

SEQ ID NO: 7758543 - DNA, 20 bp, Homo sapiens
ttcatgggagcaaagaggcc

SEQ ID NO: 7758544 - DNA, 22 bp, Homo sapiens
ttctttcaatagctggcatatg

SEQ ID NO: 7758545 - DNA, 22 bp, Homo sapiens
ttctgtttctggggtctctgac

SEQ ID NO: 7758546 - DNA, 22 bp, Homo sapiens
ttctgtttgtgaactggctgag

SEQ ID NO: 7758547 - DNA, 22 bp, Homo sapiens
ttctgtttataatttgcagttg

SEQ ID NO: 7758548 - DNA, 17 bp, Homo sapiens
gctctggcacaggattg

SEQ ID NO: 7758549 - DNA, 20 bp, Homo sapiens
cacaactgtccacatgctcc

SEQ ID NO: 7758550 - DNA, 22 bp, Homo sapiens
cacacagtaggcactcattaat

SEQ ID NO: 7758551 - DNA, 21 bp, Homo sapiens
cacacagtgatctatccacat

SEQ ID NO: 7758552 - DNA, 22 bp, Homo sapiens
ggcaaggggtcaggctgagaca

SEQ ID NO: 7758553 - DNA, 22 bp, Homo sapiens
cacattcctggtgctcagcagc

SEQ ID NO: 7758554 - DNA, 22 bp, Homo sapiens
cagccaggatggagaactgttg

SEQ ID NO: 7758555 - DNA, 22 bp, Homo sapiens
gtcacacagggcctccaaatca

SEQ ID NO: 7758556 - DNA, 22 bp, Homo sapiens
gtcacaggcagtaactaggacc

SEQ ID NO: 7758557 - DNA, 22 bp, Homo sapiens
gtcacaggcctggatgaggggc

SEQ ID NO: 7758558 - DNA, 22 bp, Homo sapiens
gtacacactatgtattgtacac

SEQ ID NO: 7758559 - DNA, 22 bp, Homo sapiens
gtacacactatttaaagtgttt

SEQ ID NO: 7758560 - DNA, 22 bp, Homo sapiens
gtacacactgtttgatcatttc

SEQ ID NO: 7758561 - DNA, 19 bp, Homo sapiens
cagccctcttaccactgtg

SEQ ID NO: 7758562 - DNA, 22 bp, Homo sapiens
gggtaattggggccttgcagtg

SEQ ID NO: 7758563 - DNA, 22 bp, Homo sapiens
ctttggctcatggttttatcca

SEQ ID NO: 7758564 - DNA, 22 bp, Homo sapiens
atggcagacctcctggccacaa

SEQ ID NO: 7758565 - DNA, 22 bp, Homo sapiens
atggcagacgaggcagcagggg

SEQ ID NO: 7758566 - DNA, 22 bp, Homo sapiens
gaggcacagtcccgaggcaagg

SEQ ID NO: 7758567 - DNA, 22 bp, Homo sapiens
gatggcaggtagtggtctcatc

SEQ ID NO: 7758568 - DNA, 22 bp, Homo sapiens
gcacacaggcagtttccagcca

SEQ ID NO: 7758569 - DNA, 22 bp, Homo sapiens
gcacacagctagattaccattc

SEQ ID NO: 7758570 - DNA, 22 bp, Homo sapiens
attccacagctacatcaatcta

SEQ ID NO: 7758571 - DNA, 22 bp, Homo sapiens
attccacacagtaatactcaat

SEQ ID NO: 7758572 - DNA, 22 bp, Homo sapiens
gccatcatatcccctgtgacct

SEQ ID NO: 7758573 - DNA, 22 bp, Homo sapiens
ctgtccagcttggctcctgggg

SEQ ID NO: 7758574 - DNA, 22 bp, Homo sapiens
atcattagaccaaactagagct

SEQ ID NO: 7758575 - DNA, 22 bp, Homo sapiens
atcattagcaattttcaataag

SEQ ID NO: 7758576 - DNA, 22 bp, Homo sapiens
atcattagttgtggaattcttg

SEQ ID NO: 7758577 - DNA, 22 bp, Homo sapiens
ctgtttccaccttcatggctaa

SEQ ID NO: 7758578 - DNA, 22 bp, Homo sapiens
ctgtttcctaccgtttttcatt

SEQ ID NO: 7758579 - DNA, 22 bp, Homo sapiens
ctgtttcctgtcttctcactat

SEQ ID NO: 7758580 - DNA, 22 bp, Homo sapiens
atctcccagccacagcattctt

SEQ ID NO: 7758581 - DNA, 22 bp, Homo sapiens
ctggggagtgaaggtaattaca

SEQ ID NO: 7758582 - DNA, 22 bp, Homo sapiens
ctgcctgctgccctccagagcc

SEQ ID NO: 7758583 - DNA, 22 bp, Homo sapiens
ctgcctgcttaccatgcatcag

SEQ ID NO: 7758584 - DNA, 22 bp, Homo sapiens
ctgcctgctctatccaggcctg

SEQ ID NO: 7758585 - DNA, 22 bp, Homo sapiens
atagggcctaaaaagtattgct

SEQ ID NO: 7758586 - DNA, 22 bp, Homo sapiens
ataatttacaactgcttttaat

SEQ ID NO: 7758587 - DNA, 22 bp, Homo sapiens
ataatttaaattagtatgtgat

SEQ ID NO: 7758588 - DNA, 22 bp, Homo sapiens
atacatgactcacacattctgc

SEQ ID NO: 7758589 - DNA, 20 bp, Homo sapiens
agtcattaaaaatggggcag

SEQ ID NO: 7758590 - DNA, 16 bp, Homo sapiens
agtcattaatttggtt

SEQ ID NO: 7758591 - DNA, 22 bp, Homo sapiens
agtcattaattagtaggaaggt

SEQ ID NO: 7758592 - DNA, 22 bp, Homo sapiens
agtcattaagacaactggagta

SEQ ID NO: 7758593 - DNA, 23 bp, Homo sapiens
agtcattaagaagttcaggaact

SEQ ID NO: 7758594 - DNA, 22 bp, Homo sapiens
agtcattaaatgctgtcatggc

SEQ ID NO: 7758595 - DNA, 22 bp, Homo sapiens
agtcattacggactagtactac

SEQ ID NO: 7758596 - DNA, 22 bp, Homo sapiens
agtcattacagcaggcagaagg

SEQ ID NO: 7758597 - DNA, 22 bp, Homo sapiens
agtcattatgggtaaagttttt

SEQ ID NO: 7758598 - DNA, 22 bp, Homo sapiens
agtcattattatttgtcaaagg

SEQ ID NO: 7758599 - DNA, 22 bp, Homo sapiens
ctctctgggcccagttggcacc

SEQ ID NO: 7758600 - DNA, 22 bp, Homo sapiens
ctctctccttagctgcagacca

SEQ ID NO: 7758601 - DNA, 21 bp, Homo sapiens
cctctggcttgtgctgtgccc

SEQ ID NO: 7758602 - DNA, 22 bp, Homo sapiens
cctctggcttactgttgggttt

SEQ ID NO: 7758603 - DNA, 22 bp, Homo sapiens
agggccccatagtcactgcccg

SEQ ID NO: 7758604 - DNA, 22 bp, Homo sapiens
ccagccctgccagagagagctg

SEQ ID NO: 7758605 - DNA, 22 bp, Homo sapiens
aggcaggggagctggaagggta

SEQ ID NO: 7758606 - DNA, 22 bp, Homo sapiens
acagttcccgtcttgcacagct

SEQ ID NO: 7758607 - DNA, 22 bp, Homo sapiens
aggaagaacagataatggacgc

SEQ ID NO: 7758608 - DNA, 22 bp, Homo sapiens
aggaagaacctaagaaagtctc

SEQ ID NO: 7758609 - DNA, 22 bp, Homo sapiens
aggacacacagaatacaaatcc

SEQ ID NO: 7758610 - DNA, 22 bp, Homo sapiens
agggagacacatgaggaagtca

SEQ ID NO: 7758611 - DNA, 22 bp, Homo sapiens
agggctgacagtgaggagtcaa

SEQ ID NO: 7758612 - DNA, 22 bp, Homo sapiens
acatcacagtagttaagccaga

SEQ ID NO: 7758613 - DNA, 22 bp, Homo sapiens
acatcacagagcccagataaag

SEQ ID NO: 7758614 - DNA, 22 bp, Homo sapiens
acatcacacgccttccaggagg

SEQ ID NO: 7758615 - DNA, 22 bp, Homo sapiens
agtgttgggtctttagaattta

SEQ ID NO: 7758616 - DNA, 23 bp, Homo sapiens
agtgttggttgggaagccaagca

SEQ ID NO: 7758617 - DNA, 22 bp, Homo sapiens
actggctttgggttgccgcaga

SEQ ID NO: 7758618 - DNA, 22 bp, Homo sapiens
actggctttggcttcagatgag

SEQ ID NO: 7758619 - DNA, 22 bp, Homo sapiens
actggcttgtgagacaatgcct

SEQ ID NO: 7758620 - DNA, 22 bp, Homo sapiens
ataatggccgggggctgaatgc

SEQ ID NO: 7758621 - DNA, 22 bp, Homo sapiens
agaggcctgtgtgctccagtgg

SEQ ID NO: 7758622 - DNA, 22 bp, Homo sapiens
atggcctgcagtgctgccacag

SEQ ID NO: 7758623 - DNA, 22 bp, Homo sapiens
atggcctgatgcacctgtccca

SEQ ID NO: 7758624 - DNA, 22 bp, Homo sapiens
atggcctggggattcctgagca

SEQ ID NO: 7758625 - DNA, 22 bp, Homo sapiens
cacacactgttaatgtaggagt

SEQ ID NO: 7758626 - DNA, 22 bp, Homo sapiens
cacacactggagcaaggagatg

SEQ ID NO: 7758627 - DNA, 22 bp, Homo sapiens
cacacactgacaccttatcttg

SEQ ID NO: 7758628 - DNA, 22 bp, Homo sapiens
cacacactcttcctggcaccta

SEQ ID NO: 7758629 - DNA, 22 bp, Homo sapiens
cacacacagttttgtattctgt

SEQ ID NO: 7758630 - DNA, 20 bp, Homo sapiens
acaaagactggaaaagcaag

SEQ ID NO: 7758631 - DNA, 22 bp, Homo sapiens
aaagaatcagaagtctcaaaca

SEQ ID NO: 7758632 - DNA, 22 bp, Homo sapiens
aaattacagatcaccaatgcat

SEQ ID NO: 7758633 - DNA, 22 bp, Homo sapiens
aaagagtctggcactgtaccag

SEQ ID NO: 7758634 - DNA, 22 bp, Homo sapiens
aaagagtcaaaggcatgtctct

SEQ ID NO: 7758635 - DNA, 22 bp, Homo sapiens
aaagagtcgtgttccaggtttg

SEQ ID NO: 7758636 - DNA, 22 bp, Homo sapiens
aacaaaagccgaagtaggtgtc

SEQ ID NO: 7758637 - DNA, 22 bp, Homo sapiens
aaagatcaagtaggcatggcct

SEQ ID NO: 7758638 - DNA, 22 bp, Homo sapiens
aaagatcaatagataaagctac

SEQ ID NO: 7758639 - DNA, 22 bp, Homo sapiens
aaagatcacgtcccaggactcg

SEQ ID NO: 7758640 - DNA, 17 bp, Homo sapiens
agcctgccccatgctgc

SEQ ID NO: 7758641 - DNA, 22 bp, Homo sapiens
acagagtcctagctgcaaagaa

SEQ ID NO: 7758642 - DNA, 22 bp, Homo sapiens
acacataagaaactacaaagag

SEQ ID NO: 7758643 - DNA, 22 bp, Homo sapiens
acaattctgatggtttcccagt

SEQ ID NO: 7758644 - DNA, 22 bp, Homo sapiens
acacatttgcataatacctcat

SEQ ID NO: 7758645 - DNA, 19 bp, Homo sapiens
acacatttgcacaatccac

SEQ ID NO: 7758646 - DNA, 23 bp, Homo sapiens
acactgtctcatggatagactgc

SEQ ID NO: 7758647 - DNA, 22 bp, Homo sapiens
acaattctgatggtttcccagt

SEQ ID NO: 7758648 - DNA, 19 bp, Homo sapiens
aatttagttcttgtttaga

SEQ ID NO: 7758649 - DNA, 22 bp, Homo sapiens
aatttagtgtaaagctactgga

SEQ ID NO: 7758650 - DNA, 22 bp, Homo sapiens
tatttaataaaactatggcatg

SEQ ID NO: 7758651 - DNA, 22 bp, Homo sapiens
tattttgtgccatgcactgcct

SEQ ID NO: 7758652 - DNA, 22 bp, Homo sapiens
tattttgtcttctgctcatcac

SEQ ID NO: 7758653 - DNA, 22 bp, Homo sapiens
tatgtaaagtagatggcaggta

SEQ ID NO: 7758654 - DNA, 22 bp, Homo sapiens
tactctggagttgagatgcgag

SEQ ID NO: 7758655 - DNA, 22 bp, Homo sapiens
tactctggccttcctgatttct

SEQ ID NO: 7758656 - DNA, 22 bp, Homo sapiens
tactctggctgaggtttggatc

SEQ ID NO: 7758657 - DNA, 22 bp, Homo sapiens
tactctggaaaacagaaagttg

SEQ ID NO: 7758658 - DNA, 22 bp, Homo sapiens
tactctgggtgatggttaaaag

SEQ ID NO: 7758659 - DNA, 22 bp, Homo sapiens
tactctggtgttagtctttgca

SEQ ID NO: 7758660 - DNA, 22 bp, Homo sapiens
tactctggttctacctccctgt

SEQ ID NO: 7758661 - DNA, 22 bp, Homo sapiens
taatttatatggaattgttgct

SEQ ID NO: 7758662 - DNA, 22 bp, Homo sapiens
taatttatagaatttcttggat

SEQ ID NO: 7758663 - DNA, 22 bp, Homo sapiens
tacacacagaggccatgggatt

SEQ ID NO: 7758664 - DNA, 22 bp, Homo sapiens
tacacacttactggagatgaag

SEQ ID NO: 7758665 - DNA, 22 bp, Homo sapiens
tacacacatgcatttgccttat

SEQ ID NO: 7758666 - DNA, 22 bp, Homo sapiens
tacacaactgacaaccattctg

SEQ ID NO: 7758667 - DNA, 22 bp, Homo sapiens
taatttatggtatgtgtgtaat

SEQ ID NO: 7758668 - DNA, 22 bp, Homo sapiens
gtgttgacacagccatcttgtc

SEQ ID NO: 7758669 - DNA, 22 bp, Homo sapiens
gtgttgactcttggacttcaag

SEQ ID NO: 7758670 - DNA, 22 bp, Homo sapiens
gttatttaactttgtagcatgg

SEQ ID NO: 7758671 - DNA, 22 bp, Homo sapiens
gttatttataaggtgtaactcc

SEQ ID NO: 7758672 - DNA, 22 bp, Homo sapiens
gttgactcttgaactataccta

SEQ ID NO: 7758673 - DNA, 16 bp, Homo sapiens
gttgactctttctctt

SEQ ID NO: 7758674 - DNA, 22 bp, Homo sapiens
gtttgtcttaattaggcatcga

SEQ ID NO: 7758675 - DNA, 22 bp, Homo sapiens
tcctgagcaacacagctaagtg

SEQ ID NO: 7758676 - DNA, 22 bp, Homo sapiens
tcctgagcacagagacaaggaa

SEQ ID NO: 7758677 - DNA, 22 bp, Homo sapiens
tcctgagccctgtaggaccctg

SEQ ID NO: 7758678 - DNA, 22 bp, Homo sapiens
tcctgagcctgacaatcaccat

SEQ ID NO: 7758679 - DNA, 22 bp, Homo sapiens
tcctgagctgccgcatcagcag

SEQ ID NO: 7758680 - DNA, 22 bp, Homo sapiens
tcctgagctacagtagtatgat

SEQ ID NO: 7758681 - DNA, 22 bp, Homo sapiens
tcctgcagccactgcaggcaga

SEQ ID NO: 7758682 - DNA, 22 bp, Homo sapiens
tccctgcctcctggcagtgcca

SEQ ID NO: 7758683 - DNA, 22 bp, Homo sapiens
tccctccccacttctgagcttt

SEQ ID NO: 7758684 - DNA, 20 bp, Homo sapiens
tccctccctccagctctggg

SEQ ID NO: 7758685 - DNA, 22 bp, Homo sapiens
tccaggctaattttgcattgtt

SEQ ID NO: 7758686 - DNA, 22 bp, Homo sapiens
tccaggctttttcatgctgtct

SEQ ID NO: 7758687 - DNA, 22 bp, Homo sapiens
tcccagccttccagtctggttt

SEQ ID NO: 7758688 - DNA, 22 bp, Homo sapiens
tcccagcctggaccctgccagt

SEQ ID NO: 7758689 - DNA, 23 bp, Homo sapiens
tcacataatccttcatccacagg

SEQ ID NO: 7758690 - DNA, 22 bp, Homo sapiens
tcacatacactaggatattttt

SEQ ID NO: 7758691 - DNA, 22 bp, Homo sapiens
tcacataaatttaccagatgat

SEQ ID NO: 7758692 - DNA, 22 bp, Homo sapiens
tcacatactgaaagtccagtga

SEQ ID NO: 7758693 - DNA, 22 bp, Homo sapiens
tcatagaagtagtatccacatt

SEQ ID NO: 7758694 - DNA, 22 bp, Homo sapiens
tccaaggctccggccctggcgt

SEQ ID NO: 7758695 - DNA, 22 bp, Homo sapiens
tcatttatattgtattctgtag

SEQ ID NO: 7758696 - DNA, 22 bp, Homo sapiens
tcatttaatagcttttgtcttt

SEQ ID NO: 7758697 - DNA, 22 bp, Homo sapiens
gtcctctgtagggctgggccac

SEQ ID NO: 7758698 - DNA, 22 bp, Homo sapiens
gtcctctgtccctggggcacgg

SEQ ID NO: 7758699 - DNA, 22 bp, Homo sapiens
gtcctctgggctttgagcagtc

SEQ ID NO: 7758700 - DNA, 22 bp, Homo sapiens
gtcctctggtgaaagcattccc

SEQ ID NO: 7758701 - DNA, 22 bp, Homo sapiens
gtcctggcccactggcaggctg

SEQ ID NO: 7758702 - DNA, 22 bp, Homo sapiens
gtcctggcacctcactggctac

SEQ ID NO: 7758703 - DNA, 22 bp, Homo sapiens
gtcctggctggttctgtggggc

SEQ ID NO: 7758704 - DNA, 19 bp, Homo sapiens
gtcctggcgccgccacacc

SEQ ID NO: 7758705 - DNA, 22 bp, Homo sapiens
gtcctggcccaggagtacacat

SEQ ID NO: 7758706 - DNA, 22 bp, Homo sapiens
gtcctctggaagatgagttctt

SEQ ID NO: 7758707 - DNA, 22 bp, Homo sapiens
gtcctctgcttcatgccctgat

SEQ ID NO: 7758708 - DNA, 22 bp, Homo sapiens
gtcctctgggcagctgccccac

SEQ ID NO: 7758709 - DNA, 22 bp, Homo sapiens
gtcctctgggagccttgagcct

SEQ ID NO: 7758710 - DNA, 22 bp, Homo sapiens
gtcctctggcctttcccaggac

SEQ ID NO: 7758711 - DNA, 22 bp, Homo sapiens
gtcctctggaggtttttaggtg

SEQ ID NO: 7758712 - DNA, 23 bp, Homo sapiens
gtcctctggagagaaaggcagta

SEQ ID NO: 7758713 - DNA, 22 bp, Homo sapiens
gtaatttaattctctgacttga

SEQ ID NO: 7758714 - DNA, 21 bp, Homo sapiens
gggcagaggggcctcctgggt

SEQ ID NO: 7758715 - DNA, 22 bp, Homo sapiens
gggccccttgtatctctggctc

SEQ ID NO: 7758716 - DNA, 22 bp, Homo sapiens
gggccccttgctgctctgctgg

SEQ ID NO: 7758717 - DNA, 22 bp, Homo sapiens
ggcccagcgaggccacctacag

SEQ ID NO: 7758718 - DNA, 22 bp, Homo sapiens
ggcctctctgagagcagacgtt

SEQ ID NO: 7758719 - DNA, 18 bp, Homo sapiens
ggcctctggactggcagc

SEQ ID NO: 7758720 - DNA, 18 bp, Homo sapiens
ggcagggaaaagataggg

SEQ ID NO: 7758721 - DNA, 22 bp, Homo sapiens
ggcagtgagaggtctcctggtc

SEQ ID NO: 7758722 - DNA, 22 bp, Homo sapiens
ggagaagaggagctggaagcct

SEQ ID NO: 7758723 - DNA, 23 bp, Homo sapiens
gctgtttcacaacagccgtgttt

SEQ ID NO: 7758724 - DNA, 22 bp, Homo sapiens
gctgtttccagacaatgtcttt

SEQ ID NO: 7758725 - DNA, 22 bp, Homo sapiens
gctgtttccagttacgtggata

SEQ ID NO: 7758726 - DNA, 22 bp, Homo sapiens
gctgtttccatttaagtgaatc

SEQ ID NO: 7758727 - DNA, 23 bp, Homo sapiens
gctgtttccccatgtgctgaagg

SEQ ID NO: 7758728 - DNA, 22 bp, Homo sapiens
gctgtttccccttcacagtggc

SEQ ID NO: 7758729 - DNA, 22 bp, Homo sapiens
gctgtttcccgtgcgctgcgtc

SEQ ID NO: 7758730 - DNA, 22 bp, Homo sapiens
gctgtttcctacatggtgttat

SEQ ID NO: 7758731 - DNA, 22 bp, Homo sapiens
gctgtttcgggtggaggtggag

SEQ ID NO: 7758732 - DNA, 22 bp, Homo sapiens
gctgtttcggcctcctggggaa

SEQ ID NO: 7758733 - DNA, 22 bp, Homo sapiens
gctgtttctaccagaagaatca

SEQ ID NO: 7758734 - DNA, 17 bp, Homo sapiens
gctgtttctccagaagt

SEQ ID NO: 7758735 - DNA, 22 bp, Homo sapiens
gctgtttctccaggtcaggaag

SEQ ID NO: 7758736 - DNA, 22 bp, Homo sapiens
gctgtttctctcccaccccttc

SEQ ID NO: 7758737 - DNA, 22 bp, Homo sapiens
gctgtttctcttgagtcaaaat

SEQ ID NO: 7758738 - DNA, 22 bp, Homo sapiens
gctgtttctgagtagctaggct

SEQ ID NO: 7758739 - DNA, 22 bp, Homo sapiens
gctgtttctttgatgatggaat

SEQ ID NO: 7758740 - DNA, 22 bp, Homo sapiens
gctgtttctttcctggcacttg

SEQ ID NO: 7758741 - DNA, 22 bp, Homo sapiens
gctgtttcttgaggctactcct

SEQ ID NO: 7758742 - DNA, 22 bp, Homo sapiens
gctgtttctgtggtgtatagcc

SEQ ID NO: 7758743 - DNA, 22 bp, Homo sapiens
gctgtttctggttctgttccta

SEQ ID NO: 7758744 - DNA, 22 bp, Homo sapiens
gctgtttctaagctggttccta

SEQ ID NO: 7758745 - DNA, 22 bp, Homo sapiens
gctgtttctttggcaaactgat

SEQ ID NO: 7758746 - DNA, 22 bp, Homo sapiens
gctggcagggtggttgagagag

SEQ ID NO: 7758747 - DNA, 22 bp, Homo sapiens
gctggcagggttctcactgaaa

SEQ ID NO: 7758748 - DNA, 22 bp, Homo sapiens
gctggcaggtccaagatagagc

SEQ ID NO: 7758749 - DNA, 22 bp, Homo sapiens
gctggcaggtaaagccccgggg

SEQ ID NO: 7758750 - DNA, 22 bp, Homo sapiens
gctggcagtttcctcaccgagg

SEQ ID NO: 7758751 - DNA, 22 bp, Homo sapiens
gctggcagtgtgaatgacaagc

SEQ ID NO: 7758752 - DNA, 22 bp, Homo sapiens
gctggcagtaaagggtttggca

SEQ ID NO: 7758753 - DNA, 22 bp, Homo sapiens
gctggcagtcccatcagctggg

SEQ ID NO: 7758754 - DNA, 22 bp, Homo sapiens
gctggcagtgtattgttagctg

SEQ ID NO: 7758755 - DNA, 22 bp, Homo sapiens
gcctggcactcaatcatctgct

SEQ ID NO: 7758756 - DNA, 22 bp, Homo sapiens
gcccacacaccagctcaggagg

SEQ ID NO: 7758757 - DNA, 22 bp, Homo sapiens
gcccacacagcagatcctttgg

SEQ ID NO: 7758758 - DNA, 22 bp, Homo sapiens
gcccacaccatttattctttgt

SEQ ID NO: 7758759 - DNA, 22 bp, Homo sapiens
gcagtgtttgtgttctcacatg

SEQ ID NO: 7758760 - DNA, 22 bp, Homo sapiens
gcattagaagggacctctgggg

SEQ ID NO: 7758761 - DNA, 22 bp, Homo sapiens
gcattagaaactattgctgcaa

SEQ ID NO: 7758762 - DNA, 22 bp, Homo sapiens
gcattagacccaaggtattttg

SEQ ID NO: 7758763 - DNA, 22 bp, Homo sapiens
gaaagaagctttagatggctat

SEQ ID NO: 7758764 - DNA, 22 bp, Homo sapiens
gaaagacttcctttgagagtac

SEQ ID NO: 7758765 - DNA, 22 bp, Homo sapiens
cttgcctccctcagctcacagc

SEQ ID NO: 7758766 - DNA, 22 bp, Homo sapiens
ctggttcatcgcggccacttat

SEQ ID NO: 7758767 - DNA, 18 bp, Homo sapiens
gacaaaagtacagacaga

SEQ ID NO: 7758768 - DNA, 22 bp, Homo sapiens
gacaaaagtgttttgaacaagg

SEQ ID NO: 7758769 - DNA, 22 bp, Homo sapiens
gacctgcctgagctgcctctgc

SEQ ID NO: 7758770 - DNA, 22 bp, Homo sapiens
gaggactctgggcgtgtatggg

SEQ ID NO: 7758771 - DNA, 22 bp, Homo sapiens
tttgactcttagcccaggactc

SEQ ID NO: 7758772 - DNA, 22 bp, Homo sapiens
tttgactcttctagcaagtgtg

SEQ ID NO: 7758773 - DNA, 22 bp, Homo sapiens
tttgactcttgcccagtttggc

SEQ ID NO: 7758774 - DNA, 22 bp, Homo sapiens
tttgactcttgtctcttgttag

SEQ ID NO: 7758775 - DNA, 22 bp, Homo sapiens
tttgactcttgctttggtggct

SEQ ID NO: 7758776 - DNA, 22 bp, Homo sapiens
tttgactctagtcatagaagtg

SEQ ID NO: 7758777 - DNA, 22 bp, Homo sapiens
tttgactctgggtgctttttcg

SEQ ID NO: 7758778 - DNA, 22 bp, Homo sapiens
tttgactcttaagtggctcaat

SEQ ID NO: 7758779 - DNA, 22 bp, Homo sapiens
tttgactcctgtgtttctggaa

SEQ ID NO: 7758780 - DNA, 22 bp, Homo sapiens
tttgactcctttgtgaaaagag

SEQ ID NO: 7758781 - DNA, 21 bp, Homo sapiens
tttgactcctcatttttatat

SEQ ID NO: 7758782 - DNA, 22 bp, Homo sapiens
tttgactcctgccttctcctgt

SEQ ID NO: 7758783 - DNA, 22 bp, Homo sapiens
tttgactcattgattttctctg

SEQ ID NO: 7758784 - DNA, 22 bp, Homo sapiens
tttgactccactcctaactcct

SEQ ID NO: 7758785 - DNA, 22 bp, Homo sapiens
tttgactccagagcccattttt

SEQ ID NO: 7758786 - DNA, 22 bp, Homo sapiens
tttgactcccaaactgtgattt

SEQ ID NO: 7758787 - DNA, 19 bp, Homo sapiens
tttgactcctcatttttat

SEQ ID NO: 7758788 - DNA, 20 bp, Homo sapiens
tttgactcaggcctttagcc

SEQ ID NO: 7758789 - DNA, 22 bp, Homo sapiens
tttgactcagtggacgtactag

SEQ ID NO: 7758790 - DNA, 22 bp, Homo sapiens
tttgactcattaaagtctccgt

SEQ ID NO: 7758791 - DNA, 22 bp, Homo sapiens
tttgactcaagcctttctttag

SEQ ID NO: 7758792 - DNA, 22 bp, Homo sapiens
tttgactcagcaaattcacagg

SEQ ID NO: 7758793 - DNA, 22 bp, Homo sapiens
tttgactcaagccctcatgtta

SEQ ID NO: 7758794 - DNA, 22 bp, Homo sapiens
ctctgtgcctcagttttcttct

SEQ ID NO: 7758795 - DNA, 22 bp, Homo sapiens
ctctggctatctgtttctatgt

SEQ ID NO: 7758796 - DNA, 22 bp, Homo sapiens
ctctggctatggcacggcgctc

SEQ ID NO: 7758797 - DNA, 22 bp, Homo sapiens
ctctggctccatttccctatgt

SEQ ID NO: 7758798 - DNA, 22 bp, Homo sapiens
ctctggctcccgcagcccccat

SEQ ID NO: 7758799 - DNA, 20 bp, Homo sapiens
ctctggctccgcgtgaccgc

SEQ ID NO: 7758800 - DNA, 17 bp, Homo sapiens
ctctgggtctcctgctt

SEQ ID NO: 7758801 - DNA, 20 bp, Homo sapiens
ctctgggtcgagacagactt

SEQ ID NO: 7758802 - DNA, 22 bp, Homo sapiens
ctctgggtgagacagacctggt

SEQ ID NO: 7758803 - DNA, 22 bp, Homo sapiens
ctctgggtgtgacagcacctgg

SEQ ID NO: 7758804 - DNA, 22 bp, Homo sapiens
ctccaggccatggctgcggagg

SEQ ID NO: 7758805 - DNA, 22 bp, Homo sapiens
tttccaataaagtgtcattgtt

SEQ ID NO: 7758806 - DNA, 22 bp, Homo sapiens
ctgcaggacgaccgcctcatct

SEQ ID NO: 7758807 - DNA, 22 bp, Homo sapiens
ctgcaggagcaaagcctctgct

SEQ ID NO: 7758808 - DNA, 22 bp, Homo sapiens
ctgagcagtggttcttgagcgc

SEQ ID NO: 7758809 - DNA, 22 bp, Homo sapiens
ttctatttcttaatcttggctg

SEQ ID NO: 7758810 - DNA, 22 bp, Homo sapiens
ctcaccccactaccccttggtg

SEQ ID NO: 7758811 - DNA, 22 bp, Homo sapiens
ttctggctcatatgctaagaag

SEQ ID NO: 7758812 - DNA, 18 bp, Homo sapiens
ttctggctcactcatgct

SEQ ID NO: 7758813 - DNA, 22 bp, Homo sapiens
ttctggctaccctcctaatgtt

SEQ ID NO: 7758814 - DNA, 22 bp, Homo sapiens
ttctggctgcagtccctgtaat

SEQ ID NO: 7758815 - DNA, 22 bp, Homo sapiens
ttctggctctcccctgctgggt

SEQ ID NO: 7758816 - DNA, 22 bp, Homo sapiens
ttctggctccgcggggcggccc

SEQ ID NO: 7758817 - DNA, 22 bp, Homo sapiens
ttctggctcgattctctgaccg

SEQ ID NO: 7758818 - DNA, 22 bp, Homo sapiens
ttctggctccagatgcttctgt

SEQ ID NO: 7758819 - DNA, 23 bp, Homo sapiens
ttctggctccgagctccatcttc

SEQ ID NO: 7758820 - DNA, 22 bp, Homo sapiens
ttctggctccactcagccccac

SEQ ID NO: 7758821 - DNA, 22 bp, Homo sapiens
ttctggcttatgagctataatg

SEQ ID NO: 7758822 - DNA, 22 bp, Homo sapiens
ttctggcttgacccctacttcc

SEQ ID NO: 7758823 - DNA, 22 bp, Homo sapiens
ttctggcttcatctgacaagcc

SEQ ID NO: 7758824 - DNA, 22 bp, Homo sapiens
ttctggctttaggcttttcaag

SEQ ID NO: 7758825 - DNA, 22 bp, Homo sapiens
ttctggctttacttcccatcca

SEQ ID NO: 7758826 - DNA, 22 bp, Homo sapiens
ttctggctgaaagtttatttga

SEQ ID NO: 7758827 - DNA, 22 bp, Homo sapiens
ttctggctgtatgatatttaat

SEQ ID NO: 7758828 - DNA, 22 bp, Homo sapiens
ttctggcttacttcactcattt

SEQ ID NO: 7758829 - DNA, 23 bp, Homo sapiens
ttctggctgtgggtggcgtctct

SEQ ID NO: 7758830 - DNA, 22 bp, Homo sapiens
ttctggcttagttgttgtatat

SEQ ID NO: 7758831 - DNA, 22 bp, Homo sapiens
ttctggcttatcctaactctaa

SEQ ID NO: 7758832 - DNA, 22 bp, Homo sapiens
ttagacagtaaggcttcagttg

SEQ ID NO: 7758833 - DNA, 22 bp, Homo sapiens
cgactctgcagggatccgggag

SEQ ID NO: 7758834 - DNA, 22 bp, Homo sapiens
cgctgataaacgtcacgttccc

SEQ ID NO: 7758835 - DNA, 22 bp, Homo sapiens
tgagagtctcagacctcctggt

SEQ ID NO: 7758836 - DNA, 22 bp, Homo sapiens
tgagagtctgttcctcttgcag

SEQ ID NO: 7758837 - DNA, 22 bp, Homo sapiens
ccaggtcctgttttcaccacag

SEQ ID NO: 7758838 - DNA, 22 bp, Homo sapiens
tgaccaggatactgcagggatg

SEQ ID NO: 7758839 - DNA, 22 bp, Homo sapiens
ccagcccttgctgaagggtggc

SEQ ID NO: 7758840 - DNA, 22 bp, Homo sapiens
ccagcctcactggcatcaccta

SEQ ID NO: 7758841 - DNA, 22 bp, Homo sapiens
cccacactctgagaaatgctga

SEQ ID NO: 7758842 - DNA, 22 bp, Homo sapiens
cccagcccacggtcctgggtgg

SEQ ID NO: 7758843 - DNA, 20 bp, Homo sapiens
cccagcccctacctgttgcc

SEQ ID NO: 7758844 - DNA, 22 bp, Homo sapiens
cccagcccccgagtgtctggaa

SEQ ID NO: 7758845 - DNA, 22 bp, Homo sapiens
cccagcccatctcaaaggtcta

SEQ ID NO: 7758846 - DNA, 22 bp, Homo sapiens
cccagcatgcacgctgacactc

SEQ ID NO: 7758847 - DNA, 22 bp, Homo sapiens
cctgccttcagccctgaagtct

SEQ ID NO: 7758848 - DNA, 22 bp, Homo sapiens
cctgcctgtactagagacccag

SEQ ID NO: 7758849 - DNA, 22 bp, Homo sapiens
cctctggctcacagcaccaact

SEQ ID NO: 7758850 - DNA, 22 bp, Homo sapiens
cctctggcctaggccgggagag

SEQ ID NO: 7758851 - DNA, 22 bp, Homo sapiens
cctctggccatcccccattaag

SEQ ID NO: 7758852 - DNA, 22 bp, Homo sapiens
cctctggccattctttgatgga

SEQ ID NO: 7758853 - DNA, 22 bp, Homo sapiens
cctctggccacatgggacatag

SEQ ID NO: 7758854 - DNA, 22 bp, Homo sapiens
cctctggccagagaaaggccag

SEQ ID NO: 7758855 - DNA, 22 bp, Homo sapiens
cctctggcaacttcacagccca

SEQ ID NO: 7758856 - DNA, 22 bp, Homo sapiens
cctctggcatagcaagtggcct

SEQ ID NO: 7758857 - DNA, 22 bp, Homo sapiens
cctctggcaagtgatttatcat

SEQ ID NO: 7758858 - DNA, 16 bp, Homo sapiens
cctctggcaattagat

SEQ ID NO: 7758859 - DNA, 22 bp, Homo sapiens
cctctggcagccagccagttgt

SEQ ID NO: 7758860 - DNA, 22 bp, Homo sapiens
cctgacctatttttctcagctg

SEQ ID NO: 7758861 - DNA, 22 bp, Homo sapiens
tggcctcccctaacagcctctt

SEQ ID NO: 7758862 - DNA, 22 bp, Homo sapiens
cctcagctgcttccctggagcc

SEQ ID NO: 7758863 - DNA, 22 bp, Homo sapiens
cctccccatgacccggtgctgg

SEQ ID NO: 7758864 - DNA, 22 bp, Homo sapiens
tgcctgcctctggcagccctgc

SEQ ID NO: 7758865 - DNA, 22 bp, Homo sapiens
ccctgcctctgaagctgctcag

SEQ ID NO: 7758866 - DNA, 22 bp, Homo sapiens
ccctgccttggggtccacaccg

SEQ ID NO: 7758867 - DNA, 22 bp, Homo sapiens
tctccacactttctctcccagg

SEQ ID NO: 7758868 - DNA, 22 bp, Homo sapiens
tcctctccatgtctcacgccac

SEQ ID NO: 7758869 - DNA, 22 bp, Homo sapiens
ccagcccttagataaacctggc

SEQ ID NO: 7758870 - DNA, 22 bp, Homo sapiens
ccagccctgtcaccaactggag

SEQ ID NO: 7758871 - DNA, 22 bp, Homo sapiens
tcccagccaggctctaccactt

SEQ ID NO: 7758872 - DNA, 22 bp, Homo sapiens
tcccagccacagtttccacctg

SEQ ID NO: 7758873 - DNA, 22 bp, Homo sapiens
tccaggctcccctgcgtgctcc

SEQ ID NO: 7758874 - DNA, 22 bp, Homo sapiens
tccaggctccctcaggatgcac

SEQ ID NO: 7758875 - DNA, 22 bp, Homo sapiens
cagtgggggggccatgctgcag

SEQ ID NO: 7758876 - DNA, 22 bp, Homo sapiens
caggttggtcggcaagtacaca

SEQ ID NO: 7758877 - DNA, 22 bp, Homo sapiens
caggttggggacttaggatgac

SEQ ID NO: 7758878 - DNA, 22 bp, Homo sapiens
caggttggtattcatctccaca

SEQ ID NO: 7758879 - DNA, 22 bp, Homo sapiens
caggctggagtgcaatggcaca

SEQ ID NO: 7758880 - DNA, 22 bp, Homo sapiens
caggctggagtgcaatgacgcc

SEQ ID NO: 7758881 - DNA, 22 bp, Homo sapiens
tagaggagaacacaaattatag

SEQ ID NO: 7758882 - DNA, 22 bp, Homo sapiens
ttgggaagtttaatgacagact

SEQ ID NO: 7758883 - DNA, 22 bp, Homo sapiens
ttgggaagaatggaggtggtta

SEQ ID NO: 7758884 - DNA, 17 bp, Homo sapiens
ttgggagagaaaggtat

SEQ ID NO: 7758885 - DNA, 23 bp, Homo sapiens
ttggagagggtgagtagtgtcag

SEQ ID NO: 7758886 - DNA, 22 bp, Homo sapiens
ttggagagatttaggtctcagt

SEQ ID NO: 7758887 - DNA, 22 bp, Homo sapiens
ttgtaaactgctgcaggagtgc

SEQ ID NO: 7758888 - DNA, 22 bp, Homo sapiens
ttgtcatcatgttttccaaagg

SEQ ID NO: 7758889 - DNA, 22 bp, Homo sapiens
ttggaaagtttttactgaagac

SEQ ID NO: 7758890 - DNA, 20 bp, Homo sapiens
tttagaagaatgagcacttt

SEQ ID NO: 7758891 - DNA, 22 bp, Homo sapiens
tttagaagggctggtcagaaat

SEQ ID NO: 7758892 - DNA, 22 bp, Homo sapiens
tttagaagacagatgcacagcc

SEQ ID NO: 7758893 - DNA, 22 bp, Homo sapiens
tttagaaggactacagtgtgat

SEQ ID NO: 7758894 - DNA, 22 bp, Homo sapiens
tttagaagttcacacatttaaa

SEQ ID NO: 7758895 - DNA, 19 bp, Homo sapiens
tttagaagttgaaactctg

SEQ ID NO: 7758896 - DNA, 22 bp, Homo sapiens
tttatctattgtattgttgatg

SEQ ID NO: 7758897 - DNA, 22 bp, Homo sapiens
ttcctggctcacagcagtgggg

SEQ ID NO: 7758898 - DNA, 22 bp, Homo sapiens
ttcctggcgccacggagccggt

SEQ ID NO: 7758899 - DNA, 22 bp, Homo sapiens
ttcctggcctaaggtaggtgac

SEQ ID NO: 7758900 - DNA, 22 bp, Homo sapiens
ttcctggccccacccctggaga

SEQ ID NO: 7758901 - DNA, 22 bp, Homo sapiens
ttcctggccaagcagagtggaa

SEQ ID NO: 7758902 - DNA, 22 bp, Homo sapiens
ttcctggcagaggccccgacag

SEQ ID NO: 7758903 - DNA, 22 bp, Homo sapiens
ttcctggcatagagagggcaca

SEQ ID NO: 7758904 - DNA, 22 bp, Homo sapiens
ttcctgcccctgagagctccca

SEQ ID NO: 7758905 - DNA, 21 bp, Homo sapiens
ttctctccatatgcccagccc

SEQ ID NO: 7758906 - DNA, 22 bp, Homo sapiens
ttcagttccatttcaggtgggt

SEQ ID NO: 7758907 - DNA, 22 bp, Homo sapiens
ttcattgcagttcttcaggtta

SEQ ID NO: 7758908 - DNA, 22 bp, Homo sapiens
ttccaggcttctctggggcgtc

SEQ ID NO: 7758909 - DNA, 22 bp, Homo sapiens
ttccaggctgatgggccacagg

SEQ ID NO: 7758910 - DNA, 22 bp, Homo sapiens
ttccaggcatgtcagacatagg

SEQ ID NO: 7758911 - DNA, 22 bp, Homo sapiens
ttccaggctatccggtgaaggg

SEQ ID NO: 7758912 - DNA, 22 bp, Homo sapiens
ttccaggctcccttggaggtgt

SEQ ID NO: 7758913 - DNA, 23 bp, Homo sapiens
ttccaggcagagcagggattaga

SEQ ID NO: 7758914 - DNA, 18 bp, Homo sapiens
tcctgcctgtgccccagg

SEQ ID NO: 7758915 - DNA, 19 bp, Homo sapiens
tcctgcctggggccgcctg

SEQ ID NO: 7758916 - DNA, 22 bp, Homo sapiens
tcctgcctgtttacctgtactt

SEQ ID NO: 7758917 - DNA, 22 bp, Homo sapiens
cacagagacagaagcacttatg

SEQ ID NO: 7758918 - DNA, 22 bp, Homo sapiens
gctggcagagctctgggctggg

SEQ ID NO: 7758919 - DNA, 22 bp, Homo sapiens
gctggcagagagctggtgagga

SEQ ID NO: 7758920 - DNA, 20 bp, Homo sapiens
gctggcagatgtcttgagat

SEQ ID NO: 7758921 - DNA, 19 bp, Homo sapiens
gctggcagatgtggccgtg

SEQ ID NO: 7758922 - DNA, 22 bp, Homo sapiens
gctggcagcattagaccctggg

SEQ ID NO: 7758923 - DNA, 22 bp, Homo sapiens
ggagtctgctcccagacatgat

SEQ ID NO: 7758924 - DNA, 22 bp, Homo sapiens
cactgtccaatagatacataat

SEQ ID NO: 7758925 - DNA, 22 bp, Homo sapiens
cactgtccatgcttgctaaccc

SEQ ID NO: 7758926 - DNA, 22 bp, Homo sapiens
cactgtccctgtttcctggaaa

SEQ ID NO: 7758927 - DNA, 22 bp, Homo sapiens
gtcctctgtgtaggctgcagac

SEQ ID NO: 7758928 - DNA, 22 bp, Homo sapiens
gtcctctgtttccatctgactt

SEQ ID NO: 7758929 - DNA, 22 bp, Homo sapiens
gtcctctgttagaaatgtgctt

SEQ ID NO: 7758930 - DNA, 22 bp, Homo sapiens
gacccggctccaggcccagcag

SEQ ID NO: 7758931 - DNA, 22 bp, Homo sapiens
gagaggtggaggttgcagtgag

SEQ ID NO: 7758932 - DNA, 22 bp, Homo sapiens
gagaggctggcagtgccaggtt

SEQ ID NO: 7758933 - DNA, 22 bp, Homo sapiens
gatctggaatctgaaggctgag

SEQ ID NO: 7758934 - DNA, 22 bp, Homo sapiens
gaggctgttaggagggactctg

SEQ ID NO: 7758935 - DNA, 22 bp, Homo sapiens
gaggctgctttgatgacaggag

SEQ ID NO: 7758936 - DNA, 22 bp, Homo sapiens
gcccagccacagtcactttcat

SEQ ID NO: 7758937 - DNA, 22 bp, Homo sapiens
gctccaggcagcatagtggatg

SEQ ID NO: 7758938 - DNA, 22 bp, Homo sapiens
gcattagagcccatcacctgta

SEQ ID NO: 7758939 - DNA, 20 bp, Homo sapiens
gcattagagtactatatgct

SEQ ID NO: 7758940 - DNA, 22 bp, Homo sapiens
gcattagatatccttgaagtta

SEQ ID NO: 7758941 - DNA, 22 bp, Homo sapiens
gcattagatttgcctttgaagc

SEQ ID NO: 7758942 - DNA, 22 bp, Homo sapiens
gcacacaggggagttctcagaa

SEQ ID NO: 7758943 - DNA, 22 bp, Homo sapiens
caggtccctgcgccccggcctc

SEQ ID NO: 7758944 - DNA, 22 bp, Homo sapiens
catcagaacgtgagctccttgt

SEQ ID NO: 7758945 - DNA, 22 bp, Homo sapiens
aggaggctgggcacagtggcct

SEQ ID NO: 7758946 - DNA, 22 bp, Homo sapiens
aggaggctgcaaccctgaggcc

SEQ ID NO: 7758947 - DNA, 22 bp, Homo sapiens
aggccacagtactttgcagacc

SEQ ID NO: 7758948 - DNA, 22 bp, Homo sapiens
ccaggctgggcggggaacctgg

SEQ ID NO: 7758949 - DNA, 22 bp, Homo sapiens
agggtagggcccggagacagac

SEQ ID NO: 7758950 - DNA, 22 bp, Homo sapiens
agtgtggcaggaatgactagaa

SEQ ID NO: 7758951 - DNA, 22 bp, Homo sapiens
agtctagggtggggtccacagg

SEQ ID NO: 7758952 - DNA, 21 bp, Homo sapiens
agtgccagtaggtatggagga

SEQ ID NO: 7758953 - DNA, 22 bp, Homo sapiens
agtgccccatgggtgcctgggg

SEQ ID NO: 7758954 - DNA, 22 bp, Homo sapiens
cctgtttcagaatttttagtga

SEQ ID NO: 7758955 - DNA, 22 bp, Homo sapiens
ccttctctctgaagaccccaaa

SEQ ID NO: 7758956 - DNA, 22 bp, Homo sapiens
agtcacagtttccctgagagag

SEQ ID NO: 7758957 - DNA, 22 bp, Homo sapiens
ctggcagtattaagagaagtga

SEQ ID NO: 7758958 - DNA, 22 bp, Homo sapiens
ctggcaggtttggtgtctggtg

SEQ ID NO: 7758959 - DNA, 22 bp, Homo sapiens
ctggcctcatagccaagctgtg

SEQ ID NO: 7758960 - DNA, 22 bp, Homo sapiens
ctggcctcagagggtcatggtg

SEQ ID NO: 7758961 - DNA, 20 bp, Homo sapiens
atacacatgcagacagatgc

SEQ ID NO: 7758962 - DNA, 22 bp, Homo sapiens
cttcacaacgacatctggttag

SEQ ID NO: 7758963 - DNA, 22 bp, Homo sapiens
cttctgttactgttagctgaag

SEQ ID NO: 7758964 - DNA, 20 bp, Homo sapiens
atctggctcagatcctgcag

SEQ ID NO: 7758965 - DNA, 22 bp, Homo sapiens
atctggctcattcagggaacgg

SEQ ID NO: 7758966 - DNA, 22 bp, Homo sapiens
atctggctcccttggaatccgt

SEQ ID NO: 7758967 - DNA, 22 bp, Homo sapiens
atctggctcctacacttgaaga

SEQ ID NO: 7758968 - DNA, 22 bp, Homo sapiens
atctggctcgctaggctctggg

SEQ ID NO: 7758969 - DNA, 22 bp, Homo sapiens
atctggctcttcctggagttcc

SEQ ID NO: 7758970 - DNA, 22 bp, Homo sapiens
atctggctctctcatttacaaa

SEQ ID NO: 7758971 - DNA, 22 bp, Homo sapiens
atcacaatgtacgttaaaatgt

SEQ ID NO: 7758972 - DNA, 22 bp, Homo sapiens
atcacagagctcccttccactg

SEQ ID NO: 7758973 - DNA, 22 bp, Homo sapiens
atcacagagattgcttttaaaa

SEQ ID NO: 7758974 - DNA, 22 bp, Homo sapiens
atcagcccgtttctgccttcta

SEQ ID NO: 7758975 - DNA, 22 bp, Homo sapiens
atcagcccaccatcttcataac

SEQ ID NO: 7758976 - DNA, 22 bp, Homo sapiens
actgtttctcaaattatgtggt

SEQ ID NO: 7758977 - DNA, 22 bp, Homo sapiens
actgtttcaggcaaggcaggcc

SEQ ID NO: 7758978 - DNA, 22 bp, Homo sapiens
actgtttctgccacaatagccc

SEQ ID NO: 7758979 - DNA, 22 bp, Homo sapiens
actgtttcagtttctgaagttt

SEQ ID NO: 7758980 - DNA, 22 bp, Homo sapiens
atcccacacccctacaacatat

SEQ ID NO: 7758981 - DNA, 22 bp, Homo sapiens
atccccacgatatagccaaagc

SEQ ID NO: 7758982 - DNA, 16 bp, Homo sapiens
acttttccaccttttt

SEQ ID NO: 7758983 - DNA, 22 bp, Homo sapiens
agaaagaggatgcagatctcat

SEQ ID NO: 7758984 - DNA, 22 bp, Homo sapiens
actcctgggtgctgaccagcgt

SEQ ID NO: 7758985 - DNA, 18 bp, Homo sapiens
actctgcggaggccccag

SEQ ID NO: 7758986 - DNA, 22 bp, Homo sapiens
actgagagtcaagatagcatgg

SEQ ID NO: 7758987 - DNA, 22 bp, Homo sapiens
actgccaatggtagtttgatgg

SEQ ID NO: 7758988 - DNA, 22 bp, Homo sapiens
actggcttcaaaccgtttcacc

SEQ ID NO: 7758989 - DNA, 19 bp, Homo sapiens
acattcccatcagcaatgt

SEQ ID NO: 7758990 - DNA, 18 bp, Homo sapiens
accctggcatgctcttcc

SEQ ID NO: 7758991 - DNA, 20 bp, Homo sapiens
accccacagagtccattgca

SEQ ID NO: 7758992 - DNA, 22 bp, Homo sapiens
acccaccctactagcagtgtcc

SEQ ID NO: 7758993 - DNA, 18 bp, Homo sapiens
aggaaagaaaggcaggtg

SEQ ID NO: 7758994 - DNA, 22 bp, Homo sapiens
aggagctgcagattctgccttg

SEQ ID NO: 7758995 - DNA, 22 bp, Homo sapiens
aggaggcttttgcaggtgccac

SEQ ID NO: 7758996 - DNA, 22 bp, Homo sapiens
aggaggctgtggagcactccat

SEQ ID NO: 7758997 - DNA, 21 bp, Homo sapiens
acatacataccttaccacctt

SEQ ID NO: 7758998 - DNA, 23 bp, Homo sapiens
acatacatggagataaagtgatg

SEQ ID NO: 7758999 - DNA, 22 bp, Homo sapiens
acatacacaagcgtacatgaac

SEQ ID NO: 7759000 - DNA, 22 bp, Homo sapiens
acatacacatgaatatattttt

SEQ ID NO: 7759001 - DNA, 22 bp, Homo sapiens
agagtcccagggacactccaga

SEQ ID NO: 7759002 - DNA, 21 bp, Homo sapiens
agagtctgagtgtgcaagggc

SEQ ID NO: 7759003 - DNA, 22 bp, Homo sapiens
agacaagaaactgggagtctct

SEQ ID NO: 7759004 - DNA, 19 bp, Homo sapiens
agactctgccactcttctc

SEQ ID NO: 7759005 - DNA, 22 bp, Homo sapiens
agactctgattccctcatgtca

SEQ ID NO: 7759006 - DNA, 22 bp, Homo sapiens
agactctgcatttctaataagc

SEQ ID NO: 7759007 - DNA, 22 bp, Homo sapiens
agcactgtgatttataacattt

SEQ ID NO: 7759008 - DNA, 22 bp, Homo sapiens
caatactgagtttacattcatc

SEQ ID NO: 7759009 - DNA, 22 bp, Homo sapiens
agcaggttgtgatacactcaga

SEQ ID NO: 7759010 - DNA, 20 bp, Homo sapiens
aagagtctttactgagctaa

SEQ ID NO: 7759011 - DNA, 22 bp, Homo sapiens
acacacagcgcctaccatgtgc

SEQ ID NO: 7759012 - DNA, 22 bp, Homo sapiens
acacacagagtttatacaggca

SEQ ID NO: 7759013 - DNA, 22 bp, Homo sapiens
acacacagaaggaagccccact

SEQ ID NO: 7759014 - DNA, 22 bp, Homo sapiens
aagaggtcataccagataaggg

SEQ ID NO: 7759015 - DNA, 22 bp, Homo sapiens
acacacaggtaaaggagcctgg

SEQ ID NO: 7759016 - DNA, 22 bp, Homo sapiens
acacacatgcatgcttgccatt

SEQ ID NO: 7759017 - DNA, 22 bp, Homo sapiens
aattagaagggagttattgata

SEQ ID NO: 7759018 - DNA, 22 bp, Homo sapiens
aattagaatcttatttggggaa

SEQ ID NO: 7759019 - DNA, 22 bp, Homo sapiens
aactctggttcagtgatttcag

SEQ ID NO: 7759020 - DNA, 22 bp, Homo sapiens
aactctggtttcagactcactt

SEQ ID NO: 7759021 - DNA, 22 bp, Homo sapiens
aactctggagcacgccctggcc

SEQ ID NO: 7759022 - DNA, 22 bp, Homo sapiens
aactctggaaatctacatggcc

SEQ ID NO: 7759023 - DNA, 22 bp, Homo sapiens
aactctggaagggtgaggctgt

SEQ ID NO: 7759024 - DNA, 22 bp, Homo sapiens
aactctggcctcagtcttctgc

SEQ ID NO: 7759025 - DNA, 22 bp, Homo sapiens
aactctggattttagatcaggg

SEQ ID NO: 7759026 - DNA, 22 bp, Homo sapiens
aactctggtccaggctagtgcc

SEQ ID NO: 7759027 - DNA, 22 bp, Homo sapiens
aactctgggtcactgtgcaatt

SEQ ID NO: 7759028 - DNA, 22 bp, Homo sapiens
aactctgggaatgggatttaga

SEQ ID NO: 7759029 - DNA, 23 bp, Homo sapiens
aactctggctagcatagaataga

SEQ ID NO: 7759030 - DNA, 22 bp, Homo sapiens
aactctggctgcttcccaggtc

SEQ ID NO: 7759031 - DNA, 22 bp, Homo sapiens
aattagaagctgttagcaaaat

SEQ ID NO: 7759032 - DNA, 22 bp, Homo sapiens
aattagaaccagaagccatatt

SEQ ID NO: 7759033 - DNA, 22 bp, Homo sapiens
aagagccagctagtgaagaggc

SEQ ID NO: 7759034 - DNA, 21 bp, Homo sapiens
aacacatccagagtatttgac

SEQ ID NO: 7759035 - DNA, 22 bp, Homo sapiens
aacacatatttatatatgcaca

SEQ ID NO: 7759036 - DNA, 22 bp, Homo sapiens
aacacataggcagagcatgaca

SEQ ID NO: 7759037 - DNA, 22 bp, Homo sapiens
agaggcttggaggtgcaaggtt

SEQ ID NO: 7759038 - DNA, 22 bp, Homo sapiens
aatttattatatcctaggggaa

SEQ ID NO: 7759039 - DNA, 22 bp, Homo sapiens
aatttattcccgtctctgggct

SEQ ID NO: 7759040 - DNA, 22 bp, Homo sapiens
aatttatttcctgccagtacac

SEQ ID NO: 7759041 - DNA, 22 bp, Homo sapiens
agactctggggctccctccacc

SEQ ID NO: 7759042 - DNA, 21 bp, Homo sapiens
agactctggggatctctgtcc

SEQ ID NO: 7759043 - DNA, 22 bp, Homo sapiens
agactctgtgctccttgctttc

SEQ ID NO: 7759044 - DNA, 18 bp, Homo sapiens
agactctgtgtgaaagta

SEQ ID NO: 7759045 - DNA, 22 bp, Homo sapiens
agactctggtcctcttgaattt

SEQ ID NO: 7759046 - DNA, 17 bp, Homo sapiens
agactctgtcccatgta

SEQ ID NO: 7759047 - DNA, 22 bp, Homo sapiens
agactctggagtcagctaggat

SEQ ID NO: 7759048 - DNA, 22 bp, Homo sapiens
agactctgctaagaatataatt

SEQ ID NO: 7759049 - DNA, 22 bp, Homo sapiens
agactctggaggggctggtcct

SEQ ID NO: 7759050 - DNA, 22 bp, Homo sapiens
agactctggcatgctaactagt

SEQ ID NO: 7759051 - DNA, 22 bp, Homo sapiens
agactctggccacccccgcagt

SEQ ID NO: 7759052 - DNA, 22 bp, Homo sapiens
agactctgggattttgaaagca

SEQ ID NO: 7759053 - DNA, 22 bp, Homo sapiens
agactctgttgaactattttgg

SEQ ID NO: 7759054 - DNA, 19 bp, Homo sapiens
agactctgtgtgagacttt

SEQ ID NO: 7759055 - DNA, 22 bp, Homo sapiens
agcccaggtctggcccagcctg

SEQ ID NO: 7759056 - DNA, 22 bp, Homo sapiens
acacactggcccccagtactga

SEQ ID NO: 7759057 - DNA, 22 bp, Homo sapiens
acacactttaaattaaacctct

SEQ ID NO: 7759058 - DNA, 22 bp, Homo sapiens
acacactgtaaggactatcact

SEQ ID NO: 7759059 - DNA, 22 bp, Homo sapiens
acacactgttgctcatccaggc

SEQ ID NO: 7759060 - DNA, 22 bp, Homo sapiens
acacacatggtattgttcagaa

SEQ ID NO: 7759061 - DNA, 21 bp, Homo sapiens
acacactctgagtcttctatt

SEQ ID NO: 7759062 - DNA, 22 bp, Homo sapiens
acacactcaattgcataagcac

SEQ ID NO: 7759063 - DNA, 21 bp, Homo sapiens
acacactgagttttccactgt

SEQ ID NO: 7759064 - DNA, 22 bp, Homo sapiens
acacacatgcctttcctaagta

SEQ ID NO: 7759065 - DNA, 22 bp, Homo sapiens
acattagatgactctttctttc

SEQ ID NO: 7759066 - DNA, 22 bp, Homo sapiens
acattagaacattaatattggg

SEQ ID NO: 7759067 - DNA, 22 bp, Homo sapiens
acattagagaagcttggagatg

SEQ ID NO: 7759068 - DNA, 22 bp, Homo sapiens
acattagataactcagaaagga

SEQ ID NO: 7759069 - DNA, 22 bp, Homo sapiens
acattagatgtgtggccacagt

SEQ ID NO: 7759070 - DNA, 22 bp, Homo sapiens
acataatgagctctttataaat

SEQ ID NO: 7759071 - DNA, 22 bp, Homo sapiens
acaggtcctcaagtcagctggg

SEQ ID NO: 7759072 - DNA, 22 bp, Homo sapiens
tcaggagctcttccctggtgtg

SEQ ID NO: 7759073 - DNA, 21 bp, Homo sapiens
tcacgtggtcacatgagcttt

SEQ ID NO: 7759074 - DNA, 16 bp, Homo sapiens
tcacatacttccttgc

SEQ ID NO: 7759075 - DNA, 21 bp, Homo sapiens
tcacacacgtttccaagggca

SEQ ID NO: 7759076 - DNA, 22 bp, Homo sapiens
tcacacacatttgctgtctgat

SEQ ID NO: 7759077 - DNA, 22 bp, Homo sapiens
tcacacacatggatagtatttt

SEQ ID NO: 7759078 - DNA, 22 bp, Homo sapiens
tcacacacataatctaagatta

SEQ ID NO: 7759079 - DNA, 22 bp, Homo sapiens
tcacacagctcctttccttagt

SEQ ID NO: 7759080 - DNA, 22 bp, Homo sapiens
tcacacagctgacagagccttt

SEQ ID NO: 7759081 - DNA, 22 bp, Homo sapiens
tccctgccctcagtgcacccgg

SEQ ID NO: 7759082 - DNA, 22 bp, Homo sapiens
tccaggccattgactgcatcct

SEQ ID NO: 7759083 - DNA, 22 bp, Homo sapiens
tccaggaggaggaaggctgcca

SEQ ID NO: 7759084 - DNA, 22 bp, Homo sapiens
tcccacatatgcaatcctgaat

SEQ ID NO: 7759085 - DNA, 22 bp, Homo sapiens
tcccagcctttcttttctgctg

SEQ ID NO: 7759086 - DNA, 22 bp, Homo sapiens
tccacacacatttctatgtgca

SEQ ID NO: 7759087 - DNA, 21 bp, Homo sapiens
tccaccctctctgctcccagt

SEQ ID NO: 7759088 - DNA, 22 bp, Homo sapiens
tccaccctgctttcttatctcc

SEQ ID NO: 7759089 - DNA, 22 bp, Homo sapiens
tccaccctgcttttgtctttga

SEQ ID NO: 7759090 - DNA, 23 bp, Homo sapiens
tccaggagcatgctggctggcga

SEQ ID NO: 7759091 - DNA, 22 bp, Homo sapiens
tatttgtttctagtggcagcaa

SEQ ID NO: 7759092 - DNA, 22 bp, Homo sapiens
tatttgttgagttgttatgtct

SEQ ID NO: 7759093 - DNA, 22 bp, Homo sapiens
tactgacacaaagccaatccct

SEQ ID NO: 7759094 - DNA, 22 bp, Homo sapiens
taagtttgacttttggctctgc

SEQ ID NO: 7759095 - DNA, 22 bp, Homo sapiens
tacacatccatgttttgacttt

SEQ ID NO: 7759096 - DNA, 22 bp, Homo sapiens
tacacatcccagactcccagga

SEQ ID NO: 7759097 - DNA, 22 bp, Homo sapiens
tacacatctctgtcagtagtga

SEQ ID NO: 7759098 - DNA, 22 bp, Homo sapiens
tacacatcactgtatctttcag

SEQ ID NO: 7759099 - DNA, 22 bp, Homo sapiens
gttaggaacactggagcctaaa

SEQ ID NO: 7759100 - DNA, 23 bp, Homo sapiens
ggacacatttatttcagaattca

SEQ ID NO: 7759101 - DNA, 22 bp, Homo sapiens
ggactctgctggttttgttcac

SEQ ID NO: 7759102 - DNA, 22 bp, Homo sapiens
ggactctggctcagtgttgctt

SEQ ID NO: 7759103 - DNA, 22 bp, Homo sapiens
ggactctggtatttcactcttg

SEQ ID NO: 7759104 - DNA, 22 bp, Homo sapiens
ggactctgtagaggttctcatt

SEQ ID NO: 7759105 - DNA, 22 bp, Homo sapiens
ggactctgttttcctgatcact

SEQ ID NO: 7759106 - DNA, 19 bp, Homo sapiens
gctggcagaattttgaacc

SEQ ID NO: 7759107 - DNA, 22 bp, Homo sapiens
gctggcagaatttcttcttgct

SEQ ID NO: 7759108 - DNA, 22 bp, Homo sapiens
gctggcagaagagctggttcaa

SEQ ID NO: 7759109 - DNA, 22 bp, Homo sapiens
gctggcagactgggggcagaac

SEQ ID NO: 7759110 - DNA, 22 bp, Homo sapiens
gctggcagacttcctctggaac

SEQ ID NO: 7759111 - DNA, 22 bp, Homo sapiens
gctggcagggacagctgcgtgt

SEQ ID NO: 7759112 - DNA, 22 bp, Homo sapiens
gctggcaggatagaagtctaat

SEQ ID NO: 7759113 - DNA, 22 bp, Homo sapiens
gctggcagctggaagttgggct

SEQ ID NO: 7759114 - DNA, 22 bp, Homo sapiens
gctggcagccaagtgaagaggg

SEQ ID NO: 7759115 - DNA, 22 bp, Homo sapiens
gctggcagagacaagaagacta

SEQ ID NO: 7759116 - DNA, 22 bp, Homo sapiens
gctggcaggagaccatacccta

SEQ ID NO: 7759117 - DNA, 22 bp, Homo sapiens
gctggcaggagaaacggggtgc

SEQ ID NO: 7759118 - DNA, 22 bp, Homo sapiens
gctggcaggagcctttcccttt

SEQ ID NO: 7759119 - DNA, 22 bp, Homo sapiens
gctggcaggataacttctaagc

SEQ ID NO: 7759120 - DNA, 22 bp, Homo sapiens
gcctcaggccgccctgctgctc

SEQ ID NO: 7759121 - DNA, 17 bp, Homo sapiens
gccttctctgccctcac

SEQ ID NO: 7759122 - DNA, 22 bp, Homo sapiens
gctctggctactgtggctaccg

SEQ ID NO: 7759123 - DNA, 22 bp, Homo sapiens
gctctggcccaaaccctttcta

SEQ ID NO: 7759124 - DNA, 22 bp, Homo sapiens
gctctggctactccaccctgtt

SEQ ID NO: 7759125 - DNA, 22 bp, Homo sapiens
gctctggccagaccctcagtgg

SEQ ID NO: 7759126 - DNA, 21 bp, Homo sapiens
gctctggcctactgttccctc

SEQ ID NO: 7759127 - DNA, 22 bp, Homo sapiens
gctctggcactggcgcgggatg

SEQ ID NO: 7759128 - DNA, 22 bp, Homo sapiens
gctctggcagctgatattagga

SEQ ID NO: 7759129 - DNA, 23 bp, Homo sapiens
gctctggcagcttgtgtcagcac

SEQ ID NO: 7759130 - DNA, 22 bp, Homo sapiens
gccaggttgctgacgacgatct

SEQ ID NO: 7759131 - DNA, 22 bp, Homo sapiens
gcactctcctggctgccacagt

SEQ ID NO: 7759132 - DNA, 22 bp, Homo sapiens
gcacaggatgatgggttgaggg

SEQ ID NO: 7759133 - DNA, 22 bp, Homo sapiens
gaggggctgggtagggcaaccc

SEQ ID NO: 7759134 - DNA, 21 bp, Homo sapiens
gggagggatggaaatgatgtt

SEQ ID NO: 7759135 - DNA, 19 bp, Homo sapiens
gggagctgaggtctttggt

SEQ ID NO: 7759136 - DNA, 22 bp, Homo sapiens
ggtgccaggctgtagtcagggt

SEQ ID NO: 7759137 - DNA, 22 bp, Homo sapiens
ggtgccagtgggtctcaggata

SEQ ID NO: 7759138 - DNA, 22 bp, Homo sapiens
ggtgccagagtggcccaggggc

SEQ ID NO: 7759139 - DNA, 19 bp, Homo sapiens
gtcctctcaacaacccggg

SEQ ID NO: 7759140 - DNA, 22 bp, Homo sapiens
gtcctctgaagttgtgcaatgc

SEQ ID NO: 7759141 - DNA, 22 bp, Homo sapiens
gtcctctgaaagatgaaccatg

SEQ ID NO: 7759142 - DNA, 22 bp, Homo sapiens
gtcctctgactcagccttggga

SEQ ID NO: 7759143 - DNA, 22 bp, Homo sapiens
gtcctctgcccaggtcaaggtt

SEQ ID NO: 7759144 - DNA, 22 bp, Homo sapiens
gtcctctgagggggctgcacgc

SEQ ID NO: 7759145 - DNA, 22 bp, Homo sapiens
gtcctctgatttctaggtatat

SEQ ID NO: 7759146 - DNA, 22 bp, Homo sapiens
gtcatttattctggtcaattca

SEQ ID NO: 7759147 - DNA, 22 bp, Homo sapiens
cttacacagtctggcacttctt

SEQ ID NO: 7759148 - DNA, 22 bp, Homo sapiens
cttacaaatacacttaggagag

SEQ ID NO: 7759149 - DNA, 22 bp, Homo sapiens
cttttccaaagtccatctggtc

SEQ ID NO: 7759150 - DNA, 22 bp, Homo sapiens
gactctggaactcttggtaaga

SEQ ID NO: 7759151 - DNA, 22 bp, Homo sapiens
gactctggaccatatatttggc

SEQ ID NO: 7759152 - DNA, 22 bp, Homo sapiens
gactctgggaggtggactgagg

SEQ ID NO: 7759153 - DNA, 22 bp, Homo sapiens
gactctggcagcactagggggc

SEQ ID NO: 7759154 - DNA, 22 bp, Homo sapiens
gactctggatgatggctttttt

SEQ ID NO: 7759155 - DNA, 22 bp, Homo sapiens
gactctggcctcatccctgagg

SEQ ID NO: 7759156 - DNA, 22 bp, Homo sapiens
gactctgggagtttatgtgatt

SEQ ID NO: 7759157 - DNA, 22 bp, Homo sapiens
gactctgggctgagccagggcc

SEQ ID NO: 7759158 - DNA, 22 bp, Homo sapiens
gactctgggcctttggtgactc

SEQ ID NO: 7759159 - DNA, 22 bp, Homo sapiens
gactctgggctgagccagggcc

SEQ ID NO: 7759160 - DNA, 22 bp, Homo sapiens
gactctggtgacttgacctgta

SEQ ID NO: 7759161 - DNA, 21 bp, Homo sapiens
gactctggggtcagctcaacc

SEQ ID NO: 7759162 - DNA, 22 bp, Homo sapiens
gactctggtgtcagaagtgccc

SEQ ID NO: 7759163 - DNA, 22 bp, Homo sapiens
gactctggttgcgggttctgct

SEQ ID NO: 7759164 - DNA, 22 bp, Homo sapiens
gagaaagattgtccttcagggg

SEQ ID NO: 7759165 - DNA, 22 bp, Homo sapiens
gagaaagatgtaggctgggagg

SEQ ID NO: 7759166 - DNA, 22 bp, Homo sapiens
gactgcctcagtttccctgcag

SEQ ID NO: 7759167 - DNA, 22 bp, Homo sapiens
gagaaagacgtaggctgggagg

SEQ ID NO: 7759168 - DNA, 22 bp, Homo sapiens
gagaaagatgaagagtggcgtt

SEQ ID NO: 7759169 - DNA, 22 bp, Homo sapiens
gagagaaaagggggaattgatt

SEQ ID NO: 7759170 - DNA, 22 bp, Homo sapiens
gagacctcttggtatcgctagg

SEQ ID NO: 7759171 - DNA, 22 bp, Homo sapiens
gacacttcacctttcccagcct

SEQ ID NO: 7759172 - DNA, 20 bp, Homo sapiens
gaatctggtcaaatgtctat

SEQ ID NO: 7759173 - DNA, 22 bp, Homo sapiens
tttctgttgtatggcttctgca

SEQ ID NO: 7759174 - DNA, 22 bp, Homo sapiens
ctgcctctataggagtccacca

SEQ ID NO: 7759175 - DNA, 22 bp, Homo sapiens
ctgcctgccacgttcagctgta

SEQ ID NO: 7759176 - DNA, 22 bp, Homo sapiens
ctgcctgccttggcctccagga

SEQ ID NO: 7759177 - DNA, 22 bp, Homo sapiens
ctgcctgcaggacacctcgcta

SEQ ID NO: 7759178 - DNA, 20 bp, Homo sapiens
ctgctccacccggctctcag

SEQ ID NO: 7759179 - DNA, 22 bp, Homo sapiens
ctgagagatcaagccacaggat

SEQ ID NO: 7759180 - DNA, 19 bp, Homo sapiens
ctgagagatgcttcacaca

SEQ ID NO: 7759181 - DNA, 22 bp, Homo sapiens
cggctggtgtcgggcacagcaa

SEQ ID NO: 7759182 - DNA, 19 bp, Homo sapiens
ttcagtttcctcatctgga

SEQ ID NO: 7759183 - DNA, 22 bp, Homo sapiens
ctcagccccaattctccccatt

SEQ ID NO: 7759184 - DNA, 22 bp, Homo sapiens
ttgaatctcatcccaatgttgt

SEQ ID NO: 7759185 - DNA, 22 bp, Homo sapiens
ttctgtctctgtgtttacatta

SEQ ID NO: 7759186 - DNA, 22 bp, Homo sapiens
ccttcttctgtgtggcccaaga

SEQ ID NO: 7759187 - DNA, 22 bp, Homo sapiens
tgttggaattaggatacagagg

SEQ ID NO: 7759188 - DNA, 22 bp, Homo sapiens
cctctcccgggtgccgctgggc

SEQ ID NO: 7759189 - DNA, 22 bp, Homo sapiens
tggcttctttctttccatgtgt

SEQ ID NO: 7759190 - DNA, 22 bp, Homo sapiens
cctcctggcttttcccattgaa

SEQ ID NO: 7759191 - DNA, 22 bp, Homo sapiens
tggcagtgtcttatcaggagtg

SEQ ID NO: 7759192 - DNA, 22 bp, Homo sapiens
tggcagtgggaatggacaaaca

SEQ ID NO: 7759193 - DNA, 22 bp, Homo sapiens
tggcagtggtaccggctctcag

SEQ ID NO: 7759194 - DNA, 22 bp, Homo sapiens
cctgcctcccagaggtcctcta

SEQ ID NO: 7759195 - DNA, 21 bp, Homo sapiens
cccttgcctgcactcctcggc

SEQ ID NO: 7759196 - DNA, 22 bp, Homo sapiens
tggcagagaacacacatgattc

SEQ ID NO: 7759197 - DNA, 22 bp, Homo sapiens
tggcacagtcctgggtgcctgc

SEQ ID NO: 7759198 - DNA, 22 bp, Homo sapiens
tgctctggaaataaatgattta

SEQ ID NO: 7759199 - DNA, 22 bp, Homo sapiens
ccagtgcccagctgcccaggca

SEQ ID NO: 7759200 - DNA, 19 bp, Homo sapiens
ccagtcccatacaggagat

SEQ ID NO: 7759201 - DNA, 22 bp, Homo sapiens
ccatacacacaccaaatttgta

SEQ ID NO: 7759202 - DNA, 17 bp, Homo sapiens
ccatactgacatattga

SEQ ID NO: 7759203 - DNA, 22 bp, Homo sapiens
ccatcacagtccccatcgtgat

SEQ ID NO: 7759204 - DNA, 22 bp, Homo sapiens
tgcagagagatcctcagggttt

SEQ ID NO: 7759205 - DNA, 22 bp, Homo sapiens
tgcagagagacccctgggccag

SEQ ID NO: 7759206 - DNA, 22 bp, Homo sapiens
tgcagagaagaggacagttcta

SEQ ID NO: 7759207 - DNA, 22 bp, Homo sapiens
ccaggcctctggctgcttagtc

SEQ ID NO: 7759208 - DNA, 22 bp, Homo sapiens
ccaggctgtaagagtgatgttg

SEQ ID NO: 7759209 - DNA, 22 bp, Homo sapiens
tctgggctctgtcagcacctct

SEQ ID NO: 7759210 - DNA, 22 bp, Homo sapiens
cattacaaccccaaattacaaa

SEQ ID NO: 7759211 - DNA, 22 bp, Homo sapiens
tccaggcttgagaccaggctct

SEQ ID NO: 7759212 - DNA, 22 bp, Homo sapiens
tcatcacatgtgtagtcatccc

SEQ ID NO: 7759213 - DNA, 22 bp, Homo sapiens
tcatcacatatgtcatgatttg

SEQ ID NO: 7759214 - DNA, 22 bp, Homo sapiens
tcatcacaattttatgaccctc

SEQ ID NO: 7759215 - DNA, 22 bp, Homo sapiens
ccaccccaaatgaagacctctc

SEQ ID NO: 7759216 - DNA, 22 bp, Homo sapiens
ccaccctaacaatccttactgt

SEQ ID NO: 7759217 - DNA, 21 bp, Homo sapiens
tcctgccttagtccagagcag

SEQ ID NO: 7759218 - DNA, 22 bp, Homo sapiens
catttattggcatgtagtaggt

SEQ ID NO: 7759219 - DNA, 22 bp, Homo sapiens
tacacagatttcagtatcatca

SEQ ID NO: 7759220 - DNA, 22 bp, Homo sapiens
tacacagaacctggtgtacagt

SEQ ID NO: 7759221 - DNA, 22 bp, Homo sapiens
tacacagatatgtgatcaatca

SEQ ID NO: 7759222 - DNA, 22 bp, Homo sapiens
tacacagactcttcaattcaga

SEQ ID NO: 7759223 - DNA, 20 bp, Homo sapiens
tcacacatggtaagctatga

SEQ ID NO: 7759224 - DNA, 22 bp, Homo sapiens
tcacacatttctcaagtgtagg

SEQ ID NO: 7759225 - DNA, 22 bp, Homo sapiens
cagtcccatgagcccagaacat

SEQ ID NO: 7759226 - DNA, 22 bp, Homo sapiens
tattcccagcctctttctatct

SEQ ID NO: 7759227 - DNA, 22 bp, Homo sapiens
tattcccattccacttatcaag

SEQ ID NO: 7759228 - DNA, 22 bp, Homo sapiens
tttgtctgccttgctggactgt

SEQ ID NO: 7759229 - DNA, 22 bp, Homo sapiens
ttgggaagaaacatgtccatca

SEQ ID NO: 7759230 - DNA, 23 bp, Homo sapiens
ttgggaaatagttaagacatgag

SEQ ID NO: 7759231 - DNA, 22 bp, Homo sapiens
ttggaacatgccggggtccagg

SEQ ID NO: 7759232 - DNA, 22 bp, Homo sapiens
tttccatgatcgttatagaact

SEQ ID NO: 7759233 - DNA, 23 bp, Homo sapiens
tttatttatttaggctgagggat

SEQ ID NO: 7759234 - DNA, 22 bp, Homo sapiens
tttatttatccttctggattgc

SEQ ID NO: 7759235 - DNA, 21 bp, Homo sapiens
tttatttatataggacacatg

SEQ ID NO: 7759236 - DNA, 22 bp, Homo sapiens
tttatttataagccacttgctg

SEQ ID NO: 7759237 - DNA, 22 bp, Homo sapiens
tttatgttgaagagactgtgtt

SEQ ID NO: 7759238 - DNA, 22 bp, Homo sapiens
ttatttaatgtgatctgaagag

SEQ ID NO: 7759239 - DNA, 22 bp, Homo sapiens
ttatttaaaatgtaggttggga

SEQ ID NO: 7759240 - DNA, 22 bp, Homo sapiens
ttatttaattttctcactcaga

SEQ ID NO: 7759241 - DNA, 22 bp, Homo sapiens
ttattttaccttcctctgagct

SEQ ID NO: 7759242 - DNA, 21 bp, Homo sapiens
ttcccatcttttctgagtctg

SEQ ID NO: 7759243 - DNA, 22 bp, Homo sapiens
ttctggctttgaccaagttcaa

SEQ ID NO: 7759244 - DNA, 22 bp, Homo sapiens
ttctggctttcttgtcaggatg

SEQ ID NO: 7759245 - DNA, 22 bp, Homo sapiens
ttctggcttttcatgttccagt

SEQ ID NO: 7759246 - DNA, 22 bp, Homo sapiens
ttctggctttggagaggatagc

SEQ ID NO: 7759247 - DNA, 22 bp, Homo sapiens
ttcttctgtgaggtgtgtgcct

SEQ ID NO: 7759248 - DNA, 22 bp, Homo sapiens
ttcttctgattgccttctgcaa

SEQ ID NO: 7759249 - DNA, 22 bp, Homo sapiens
ttcttctgacactgatgctgta

SEQ ID NO: 7759250 - DNA, 22 bp, Homo sapiens
cttggcagtttcggaaggatga

SEQ ID NO: 7759251 - DNA, 22 bp, Homo sapiens
cttggcagggtggaggatgcag

SEQ ID NO: 7759252 - DNA, 22 bp, Homo sapiens
cttggcagagggctgggctcag

SEQ ID NO: 7759253 - DNA, 22 bp, Homo sapiens
atggcagagggattgaacagct

SEQ ID NO: 7759254 - DNA, 22 bp, Homo sapiens
gaggagctcatgaaagcggtgt

SEQ ID NO: 7759255 - DNA, 22 bp, Homo sapiens
gaggagctgagccacgtcctgg

SEQ ID NO: 7759256 - DNA, 22 bp, Homo sapiens
gaggagctctgctccatccttc

SEQ ID NO: 7759257 - DNA, 22 bp, Homo sapiens
gaggagctgcagggggagtcta

SEQ ID NO: 7759258 - DNA, 22 bp, Homo sapiens
gaggagctggcagcgtctccgc

SEQ ID NO: 7759259 - DNA, 22 bp, Homo sapiens
gaggagctgggaccctgtcatc

SEQ ID NO: 7759260 - DNA, 22 bp, Homo sapiens
gaggctgcggggaggagcctgc

SEQ ID NO: 7759261 - DNA, 18 bp, Homo sapiens
gcctgctctgctctcccc

SEQ ID NO: 7759262 - DNA, 22 bp, Homo sapiens
atttaattgttcttctggctat

SEQ ID NO: 7759263 - DNA, 22 bp, Homo sapiens
atttaatttacatttgacagag

SEQ ID NO: 7759264 - DNA, 22 bp, Homo sapiens
atttaatttgtgtctttagctg

SEQ ID NO: 7759265 - DNA, 22 bp, Homo sapiens
attatttagaaatcgattgaaa

SEQ ID NO: 7759266 - DNA, 22 bp, Homo sapiens
attatttacagtgtgctcgaag

SEQ ID NO: 7759267 - DNA, 22 bp, Homo sapiens
attatttatcctcttggtctat

SEQ ID NO: 7759268 - DNA, 22 bp, Homo sapiens
attagaagaggctgacgaatgt

SEQ ID NO: 7759269 - DNA, 22 bp, Homo sapiens
attagaagcgtgaatcctttca

SEQ ID NO: 7759270 - DNA, 21 bp, Homo sapiens
attagaaggtatttagggcct

SEQ ID NO: 7759271 - DNA, 22 bp, Homo sapiens
attagaagatagtgatttctgc

SEQ ID NO: 7759272 - DNA, 22 bp, Homo sapiens
attaatttccaggcactgtgct

SEQ ID NO: 7759273 - DNA, 22 bp, Homo sapiens
cacaatgtatatgtatatcaaa

SEQ ID NO: 7759274 - DNA, 22 bp, Homo sapiens
cacaactttaggaaccacattc

SEQ ID NO: 7759275 - DNA, 22 bp, Homo sapiens
cacacatttcagatgctacaat

SEQ ID NO: 7759276 - DNA, 22 bp, Homo sapiens
gcttgggaagggccctgtgtac

SEQ ID NO: 7759277 - DNA, 22 bp, Homo sapiens
cacaaaagtaggaggcaggcgg

SEQ ID NO: 7759278 - DNA, 22 bp, Homo sapiens
cacccacatggaaattcacagt

SEQ ID NO: 7759279 - DNA, 22 bp, Homo sapiens
cacccacattccatcactctgc

SEQ ID NO: 7759280 - DNA, 22 bp, Homo sapiens
ggcctctcagggcagagaccct

SEQ ID NO: 7759281 - DNA, 22 bp, Homo sapiens
ggcctctcatgcccagagccaa

SEQ ID NO: 7759282 - DNA, 22 bp, Homo sapiens
cacactgtcaggtaaataacac

SEQ ID NO: 7759283 - DNA, 22 bp, Homo sapiens
ggcacagggggctgaggactag

SEQ ID NO: 7759284 - DNA, 22 bp, Homo sapiens
gggacaatggaggcctctctcc

SEQ ID NO: 7759285 - DNA, 21 bp, Homo sapiens
cagcccagcccattgacagtg

SEQ ID NO: 7759286 - DNA, 22 bp, Homo sapiens
cagccaagaaccacagacccag

SEQ ID NO: 7759287 - DNA, 22 bp, Homo sapiens
ggttccttctgaggtccctgta

SEQ ID NO: 7759288 - DNA, 22 bp, Homo sapiens
ggttcccggatctccgagtccc

SEQ ID NO: 7759289 - DNA, 22 bp, Homo sapiens
ctctgggtcaggacacaaaagt

SEQ ID NO: 7759290 - DNA, 22 bp, Homo sapiens
ctctgtctatcccattctgtgc

SEQ ID NO: 7759291 - DNA, 22 bp, Homo sapiens
ctcctgaggaaaagcttggtca

SEQ ID NO: 7759292 - DNA, 22 bp, Homo sapiens
ctcctgaggacttctattgggt

SEQ ID NO: 7759293 - DNA, 19 bp, Homo sapiens
ccttgcctgtccctgcagc

SEQ ID NO: 7759294 - DNA, 22 bp, Homo sapiens
ccttgctcaagctagtgacggg

SEQ ID NO: 7759295 - DNA, 22 bp, Homo sapiens
cctctgccacctcccacgaggc

SEQ ID NO: 7759296 - DNA, 22 bp, Homo sapiens
cctggctggtggcagcgacaag

SEQ ID NO: 7759297 - DNA, 22 bp, Homo sapiens
cctggcagctgtttggcttggc

SEQ ID NO: 7759298 - DNA, 22 bp, Homo sapiens
cctggcagctccgtggccttcc

SEQ ID NO: 7759299 - DNA, 22 bp, Homo sapiens
cctggcagctaagtgctttgag

SEQ ID NO: 7759300 - DNA, 22 bp, Homo sapiens
cctggcagctcctccccggcgg

SEQ ID NO: 7759301 - DNA, 22 bp, Homo sapiens
cctggcagcgtgccgagctgcg

SEQ ID NO: 7759302 - DNA, 22 bp, Homo sapiens
cctggcagcgccgaagctggcc

SEQ ID NO: 7759303 - DNA, 22 bp, Homo sapiens
cctggcagcccagagcgccgct

SEQ ID NO: 7759304 - DNA, 22 bp, Homo sapiens
cctggcagcctcagccaattct

SEQ ID NO: 7759305 - DNA, 22 bp, Homo sapiens
agttgggagttatagactctat

SEQ ID NO: 7759306 - DNA, 22 bp, Homo sapiens
ctgagggtcaacttgattgtat

SEQ ID NO: 7759307 - DNA, 22 bp, Homo sapiens
atcctctgtggattacacctag

SEQ ID NO: 7759308 - DNA, 22 bp, Homo sapiens
ctgtcttctcctttgtttcagg

SEQ ID NO: 7759309 - DNA, 22 bp, Homo sapiens
ctgtcctccagacgacagtccc

SEQ ID NO: 7759310 - DNA, 22 bp, Homo sapiens
ctgggtcataaacaatgcgtgt

SEQ ID NO: 7759311 - DNA, 22 bp, Homo sapiens
ctgggtcagtggcaagctgggt

SEQ ID NO: 7759312 - DNA, 22 bp, Homo sapiens
ctgggtcaaggaatgctggtgg

SEQ ID NO: 7759313 - DNA, 20 bp, Homo sapiens
ctgggtcacttggctgctct

SEQ ID NO: 7759314 - DNA, 22 bp, Homo sapiens
aggaaagatggaaggaggataa

SEQ ID NO: 7759315 - DNA, 22 bp, Homo sapiens
aggcacaggaggtggtaagaag

SEQ ID NO: 7759316 - DNA, 22 bp, Homo sapiens
cattcccacgtgttctttgctt

SEQ ID NO: 7759317 - DNA, 22 bp, Homo sapiens
ccaggccctgctcctcacacca

SEQ ID NO: 7759318 - DNA, 22 bp, Homo sapiens
aggcctccagccacatgccagt

SEQ ID NO: 7759319 - DNA, 22 bp, Homo sapiens
aggccccaaagcagtgcaagta

SEQ ID NO: 7759320 - DNA, 22 bp, Homo sapiens
aggcagtggagctggaataggc

SEQ ID NO: 7759321 - DNA, 22 bp, Homo sapiens
cctctccttgcacccgtcccgc

SEQ ID NO: 7759322 - DNA, 18 bp, Homo sapiens
aggcttacagcagcaggc

SEQ ID NO: 7759323 - DNA, 22 bp, Homo sapiens
agggaagaagctggtagtaggt

SEQ ID NO: 7759324 - DNA, 22 bp, Homo sapiens
cccagcctctgtttgctcctct

SEQ ID NO: 7759325 - DNA, 22 bp, Homo sapiens
agcccagctttgaaccatatca

SEQ ID NO: 7759326 - DNA, 22 bp, Homo sapiens
cagacagagtcttcccatcagt

SEQ ID NO: 7759327 - DNA, 22 bp, Homo sapiens
cactctggttctgaacaggatc

SEQ ID NO: 7759328 - DNA, 22 bp, Homo sapiens
cacatccctggagttacccagt

SEQ ID NO: 7759329 - DNA, 22 bp, Homo sapiens
caccagggccccaggctgtgcc

SEQ ID NO: 7759330 - DNA, 22 bp, Homo sapiens
cactctggccactgctaaaggc

SEQ ID NO: 7759331 - DNA, 22 bp, Homo sapiens
cactctggggatgcaaggagag

SEQ ID NO: 7759332 - DNA, 22 bp, Homo sapiens
cactctgggctcttgtttcaga

SEQ ID NO: 7759333 - DNA, 22 bp, Homo sapiens
cactctgggggctgccgctgcc

SEQ ID NO: 7759334 - DNA, 22 bp, Homo sapiens
cactctggttagtttaagcatg

SEQ ID NO: 7759335 - DNA, 22 bp, Homo sapiens
agacacataggaccacactgtg

SEQ ID NO: 7759336 - DNA, 22 bp, Homo sapiens
agacacagtctgtctggaggag

SEQ ID NO: 7759337 - DNA, 22 bp, Homo sapiens
agacacagctgcaggaggtggg

SEQ ID NO: 7759338 - DNA, 22 bp, Homo sapiens
agactctgaaatctaggtgcaa

SEQ ID NO: 7759339 - DNA, 22 bp, Homo sapiens
agactctgaagtcattgcatga

SEQ ID NO: 7759340 - DNA, 22 bp, Homo sapiens
agactctgaggagccctgagac

SEQ ID NO: 7759341 - DNA, 22 bp, Homo sapiens
agactctgataagcaactcttg

SEQ ID NO: 7759342 - DNA, 23 bp, Homo sapiens
agactctgagagtgtgctttgca

SEQ ID NO: 7759343 - DNA, 22 bp, Homo sapiens
agactctgagacatgaaccatc

SEQ ID NO: 7759344 - DNA, 22 bp, Homo sapiens
atggcagatggctggagcaggt

SEQ ID NO: 7759345 - DNA, 22 bp, Homo sapiens
agagggtgctggagagacattg

SEQ ID NO: 7759346 - DNA, 22 bp, Homo sapiens
atttcattgaagttaattcttc

SEQ ID NO: 7759347 - DNA, 22 bp, Homo sapiens
atttattgaacactgactatgt

SEQ ID NO: 7759348 - DNA, 22 bp, Homo sapiens
actggcagtttgagaatgcatt

SEQ ID NO: 7759349 - DNA, 19 bp, Homo sapiens
actggcagtttctgcatgg

SEQ ID NO: 7759350 - DNA, 22 bp, Homo sapiens
actggcagtggcagcagaaaga

SEQ ID NO: 7759351 - DNA, 22 bp, Homo sapiens
actggcagtgtcgtttacatga

SEQ ID NO: 7759352 - DNA, 22 bp, Homo sapiens
actggcagtagagggagcgcat

SEQ ID NO: 7759353 - DNA, 19 bp, Homo sapiens
actggcagggctgcggtgg

SEQ ID NO: 7759354 - DNA, 22 bp, Homo sapiens
actggcagggggagccccgaga

SEQ ID NO: 7759355 - DNA, 22 bp, Homo sapiens
actggcaggtccatcgcccttt

SEQ ID NO: 7759356 - DNA, 20 bp, Homo sapiens
actggcagcctgcctgctgt

SEQ ID NO: 7759357 - DNA, 22 bp, Homo sapiens
actggcagctgtaggatgcatg

SEQ ID NO: 7759358 - DNA, 19 bp, Homo sapiens
actggcagctgtagtctgt

SEQ ID NO: 7759359 - DNA, 22 bp, Homo sapiens
actggcaggctgctggccggcg

SEQ ID NO: 7759360 - DNA, 22 bp, Homo sapiens
acctgccttctcaaggacatga

SEQ ID NO: 7759361 - DNA, 22 bp, Homo sapiens
actggcagcagcagcccttggg

SEQ ID NO: 7759362 - DNA, 22 bp, Homo sapiens
actggcagccacaactggcagg

SEQ ID NO: 7759363 - DNA, 22 bp, Homo sapiens
actggcagaggttggacaccat

SEQ ID NO: 7759364 - DNA, 22 bp, Homo sapiens
actggcagagggaaaaccattc

SEQ ID NO: 7759365 - DNA, 22 bp, Homo sapiens
actggcagaggatagcactaat

SEQ ID NO: 7759366 - DNA, 22 bp, Homo sapiens
actggcagagaccctgatggcc

SEQ ID NO: 7759367 - DNA, 22 bp, Homo sapiens
actggcagaactggtgattgtc

SEQ ID NO: 7759368 - DNA, 22 bp, Homo sapiens
actggcagaattgaatagttgt

SEQ ID NO: 7759369 - DNA, 22 bp, Homo sapiens
actggcagaacgtgatgcgggt

SEQ ID NO: 7759370 - DNA, 18 bp, Homo sapiens
acaggctgtgggaatggt

SEQ ID NO: 7759371 - DNA, 22 bp, Homo sapiens
acaggtggccccgagggagtgg

SEQ ID NO: 7759372 - DNA, 22 bp, Homo sapiens
acaggtggcttattggctgatt

SEQ ID NO: 7759373 - DNA, 22 bp, Homo sapiens
acaggtggggcacttggagcct

SEQ ID NO: 7759374 - DNA, 22 bp, Homo sapiens
acaggtggtaaaatggactgtc

SEQ ID NO: 7759375 - DNA, 22 bp, Homo sapiens
acaggtggtagagtggaaagag

SEQ ID NO: 7759376 - DNA, 22 bp, Homo sapiens
acaggtggaggctttaggaggt

SEQ ID NO: 7759377 - DNA, 22 bp, Homo sapiens
acatgacttttctcttccagag

SEQ ID NO: 7759378 - DNA, 22 bp, Homo sapiens
acccacacctccgtatatcact

SEQ ID NO: 7759379 - DNA, 22 bp, Homo sapiens
acccacacatctctaattcagt

SEQ ID NO: 7759380 - DNA, 22 bp, Homo sapiens
aggctggatttatggggacttc

SEQ ID NO: 7759381 - DNA, 22 bp, Homo sapiens
aaatactgctgctattcctttt

SEQ ID NO: 7759382 - DNA, 22 bp, Homo sapiens
aaaaagtctgcaaaggaggttg

SEQ ID NO: 7759383 - DNA, 21 bp, Homo sapiens
aaagagcccgctgagaggttc

SEQ ID NO: 7759384 - DNA, 20 bp, Homo sapiens
aaagagcccttggagcaggc

SEQ ID NO: 7759385 - DNA, 22 bp, Homo sapiens
aacacagatcaaaatatttcct

SEQ ID NO: 7759386 - DNA, 22 bp, Homo sapiens
aagagcactaacagagctgata

SEQ ID NO: 7759387 - DNA, 22 bp, Homo sapiens
acacatcttagactgaaatatg

SEQ ID NO: 7759388 - DNA, 22 bp, Homo sapiens
aagtcgtggcaggcttgcacga

SEQ ID NO: 7759389 - DNA, 23 bp, Homo sapiens
actccccagtctcttcttgccaa

SEQ ID NO: 7759390 - DNA, 22 bp, Homo sapiens
actctggctgccttgtgagcat

SEQ ID NO: 7759391 - DNA, 22 bp, Homo sapiens
actctggcgggcgggcgagcca

SEQ ID NO: 7759392 - DNA, 22 bp, Homo sapiens
actctggctattcactataata

SEQ ID NO: 7759393 - DNA, 22 bp, Homo sapiens
actctggccctcctgctgccag

SEQ ID NO: 7759394 - DNA, 22 bp, Homo sapiens
actctggccccaggatctgtgt

SEQ ID NO: 7759395 - DNA, 22 bp, Homo sapiens
actctggccatcttggaccttg

SEQ ID NO: 7759396 - DNA, 22 bp, Homo sapiens
actctggcaagcttccacttcc

SEQ ID NO: 7759397 - DNA, 22 bp, Homo sapiens
actctggcactgggtacctcag

SEQ ID NO: 7759398 - DNA, 22 bp, Homo sapiens
actctggcagcagaaccagtgt

SEQ ID NO: 7759399 - DNA, 22 bp, Homo sapiens
actctggccaggtgcggtatgt

SEQ ID NO: 7759400 - DNA, 22 bp, Homo sapiens
aatggcagaggcaaagatggta

SEQ ID NO: 7759401 - DNA, 22 bp, Homo sapiens
agaggcttctcggatggggcag

SEQ ID NO: 7759402 - DNA, 20 bp, Homo sapiens
agaggcttccttgggaggag

SEQ ID NO: 7759403 - DNA, 22 bp, Homo sapiens
acaagagcattgcaggtgtgtt

SEQ ID NO: 7759404 - DNA, 22 bp, Homo sapiens
acacagagtttgacacatggga

SEQ ID NO: 7759405 - DNA, 22 bp, Homo sapiens
acacagatgcattacacatcta

SEQ ID NO: 7759406 - DNA, 21 bp, Homo sapiens
acacagaggcatcatcacttt

SEQ ID NO: 7759407 - DNA, 22 bp, Homo sapiens
acactcaccctcccactgcctg

SEQ ID NO: 7759408 - DNA, 22 bp, Homo sapiens
acactctgtaatgtcacactcc

SEQ ID NO: 7759409 - DNA, 22 bp, Homo sapiens
acagattcactgcactggccat

SEQ ID NO: 7759410 - DNA, 22 bp, Homo sapiens
agccagggtctctcgctctgtt

SEQ ID NO: 7759411 - DNA, 22 bp, Homo sapiens
gtcaggactctgacccgtcccg

SEQ ID NO: 7759412 - DNA, 22 bp, Homo sapiens
gtctggctaattttggtaattt

SEQ ID NO: 7759413 - DNA, 22 bp, Homo sapiens
gtctggctagagacaccctccc

SEQ ID NO: 7759414 - DNA, 22 bp, Homo sapiens
gtctggctcagtcctagctgta

SEQ ID NO: 7759415 - DNA, 22 bp, Homo sapiens
gtctggctaggcacgccgtgtt

SEQ ID NO: 7759416 - DNA, 22 bp, Homo sapiens
gtctggctccaggatctcatga

SEQ ID NO: 7759417 - DNA, 22 bp, Homo sapiens
gtctggctcccactcttacaaa

SEQ ID NO: 7759418 - DNA, 22 bp, Homo sapiens
gtctggctgataaaatgctctt

SEQ ID NO: 7759419 - DNA, 22 bp, Homo sapiens
gtctggctgtccagcttatcta

SEQ ID NO: 7759420 - DNA, 20 bp, Homo sapiens
gtctggcttcgtgattctgg

SEQ ID NO: 7759421 - DNA, 22 bp, Homo sapiens
gtctggctctggaaggcaaagg

SEQ ID NO: 7759422 - DNA, 22 bp, Homo sapiens
gtctggctgttcctgcctgtga

SEQ ID NO: 7759423 - DNA, 22 bp, Homo sapiens
gtctggctcgctctcgcccgtc

SEQ ID NO: 7759424 - DNA, 22 bp, Homo sapiens
gtctggctcctggattttccgg

SEQ ID NO: 7759425 - DNA, 22 bp, Homo sapiens
gtctggctccgaggagtggcag

SEQ ID NO: 7759426 - DNA, 22 bp, Homo sapiens
gtctggcttttgccctgtgttt

SEQ ID NO: 7759427 - DNA, 22 bp, Homo sapiens
gtctggctttatatttgctatt

SEQ ID NO: 7759428 - DNA, 22 bp, Homo sapiens
gtctggctttcatggctctgca

SEQ ID NO: 7759429 - DNA, 22 bp, Homo sapiens
gtctggctttgctcagatgctg

SEQ ID NO: 7759430 - DNA, 21 bp, Homo sapiens
gtacacacaggtggatgggct

SEQ ID NO: 7759431 - DNA, 22 bp, Homo sapiens
gtacacacaatctctggtcagt

SEQ ID NO: 7759432 - DNA, 22 bp, Homo sapiens
ggtggcagaggtgcatcagccc

SEQ ID NO: 7759433 - DNA, 22 bp, Homo sapiens
ggtggcataagaacactaaaga

SEQ ID NO: 7759434 - DNA, 22 bp, Homo sapiens
gtggcagtgggatgctatcagg

SEQ ID NO: 7759435 - DNA, 22 bp, Homo sapiens
gtggcagttttgacatcacaaa

SEQ ID NO: 7759436 - DNA, 22 bp, Homo sapiens
gtgggagaaattagctctagtt

SEQ ID NO: 7759437 - DNA, 22 bp, Homo sapiens
ggctgagttgagaggattactt

SEQ ID NO: 7759438 - DNA, 22 bp, Homo sapiens
ggcccagcctcagacatgccct

SEQ ID NO: 7759439 - DNA, 22 bp, Homo sapiens
gcttacaatcatttcagtttag

SEQ ID NO: 7759440 - DNA, 22 bp, Homo sapiens
gcttacaagatcgtgctccagt

SEQ ID NO: 7759441 - DNA, 22 bp, Homo sapiens
ggagctgaggctgaggcctcac

SEQ ID NO: 7759442 - DNA, 22 bp, Homo sapiens
ggagctgagttcttcagccggg

SEQ ID NO: 7759443 - DNA, 22 bp, Homo sapiens
ggagctgaaccccatcgtgctg

SEQ ID NO: 7759444 - DNA, 22 bp, Homo sapiens
ggagctgaaggggtgggctcag

SEQ ID NO: 7759445 - DNA, 22 bp, Homo sapiens
ggaggacactggctctgccttc

SEQ ID NO: 7759446 - DNA, 22 bp, Homo sapiens
ggaggacaggggctgcagcaca

SEQ ID NO: 7759447 - DNA, 22 bp, Homo sapiens
ggcacagagctttgtcccagtt

SEQ ID NO: 7759448 - DNA, 22 bp, Homo sapiens
gctccaggagagggaagcagat

SEQ ID NO: 7759449 - DNA, 22 bp, Homo sapiens
gctccaggaggatgaccttcct

SEQ ID NO: 7759450 - DNA, 22 bp, Homo sapiens
gcctggcaggggcctgggagtg

SEQ ID NO: 7759451 - DNA, 22 bp, Homo sapiens
gcctggcatatagtagttgtgc

SEQ ID NO: 7759452 - DNA, 22 bp, Homo sapiens
gcctggcaggcctgttggggct

SEQ ID NO: 7759453 - DNA, 22 bp, Homo sapiens
gccgggaccaaggccacggagc

SEQ ID NO: 7759454 - DNA, 22 bp, Homo sapiens
gcctcctgttatgccatgtgcc

SEQ ID NO: 7759455 - DNA, 22 bp, Homo sapiens
gccctctcttctgcagcctcca

SEQ ID NO: 7759456 - DNA, 22 bp, Homo sapiens
gcacacacatgtgagtacatgc

SEQ ID NO: 7759457 - DNA, 16 bp, Homo sapiens
gcacacacatcaatga

SEQ ID NO: 7759458 - DNA, 22 bp, Homo sapiens
gatgcctggcacccagcaagga

SEQ ID NO: 7759459 - DNA, 22 bp, Homo sapiens
gatggcctgggtccccttccgg

SEQ ID NO: 7759460 - DNA, 22 bp, Homo sapiens
gatggccttgttttctcccttc

SEQ ID NO: 7759461 - DNA, 22 bp, Homo sapiens
gattagaatgggaagatacaag

SEQ ID NO: 7759462 - DNA, 22 bp, Homo sapiens
gattagaatggatagatcccca

SEQ ID NO: 7759463 - DNA, 22 bp, Homo sapiens
gattagaatatgtcagtcataa

SEQ ID NO: 7759464 - DNA, 22 bp, Homo sapiens
gattagaaatgttaccatacag

SEQ ID NO: 7759465 - DNA, 22 bp, Homo sapiens
gattagaagaacttgttagcct

SEQ ID NO: 7759466 - DNA, 17 bp, Homo sapiens
gattagaaaacacatga

SEQ ID NO: 7759467 - DNA, 22 bp, Homo sapiens
gatttatttttaatcagcaggg

SEQ ID NO: 7759468 - DNA, 22 bp, Homo sapiens
gatttattgtccctgtcctgct

SEQ ID NO: 7759469 - DNA, 22 bp, Homo sapiens
gatttattggtctttcattggt

SEQ ID NO: 7759470 - DNA, 20 bp, Homo sapiens
gatacacagcacagagggcc

SEQ ID NO: 7759471 - DNA, 22 bp, Homo sapiens
gagtctggaaactttgacaaaa

SEQ ID NO: 7759472 - DNA, 22 bp, Homo sapiens
gagggtgtctgcgtaactggca

SEQ ID NO: 7759473 - DNA, 20 bp, Homo sapiens
gagtcacagaagaagctgaa

SEQ ID NO: 7759474 - DNA, 22 bp, Homo sapiens
gaaggccctgttttccctattt

SEQ ID NO: 7759475 - DNA, 22 bp, Homo sapiens
gacacagagggcaccagatatg

SEQ ID NO: 7759476 - DNA, 22 bp, Homo sapiens
gacacagagctcacagtctcct

SEQ ID NO: 7759477 - DNA, 22 bp, Homo sapiens
gacacagatatctctgagatta

SEQ ID NO: 7759478 - DNA, 22 bp, Homo sapiens
gagacacacattctggagagaa

SEQ ID NO: 7759479 - DNA, 22 bp, Homo sapiens
gactgtggggggcggacacaag

SEQ ID NO: 7759480 - DNA, 22 bp, Homo sapiens
gaaaagagtcctgtgtgaggag

SEQ ID NO: 7759481 - DNA, 22 bp, Homo sapiens
cttgggaatgctaacagatgac

SEQ ID NO: 7759482 - DNA, 22 bp, Homo sapiens
cttctcttgggtgtggtgtctt

SEQ ID NO: 7759483 - DNA, 22 bp, Homo sapiens
cttcttttacaggtcttgggtt

SEQ ID NO: 7759484 - DNA, 22 bp, Homo sapiens
ttgactctaaatttacttttcc

SEQ ID NO: 7759485 - DNA, 22 bp, Homo sapiens
ttgactctggaggtcactgaag

SEQ ID NO: 7759486 - DNA, 22 bp, Homo sapiens
ttcccacattctttacattcat

SEQ ID NO: 7759487 - DNA, 22 bp, Homo sapiens
ttcccacagtgttgaatcctct

SEQ ID NO: 7759488 - DNA, 22 bp, Homo sapiens
ttcccacagagattacattgaa

SEQ ID NO: 7759489 - DNA, 22 bp, Homo sapiens
ctcatcaccacatataacaaag

SEQ ID NO: 7759490 - DNA, 22 bp, Homo sapiens
ttgggatctcaaatccagctat

SEQ ID NO: 7759491 - DNA, 22 bp, Homo sapiens
ctccaggcccctggccttctgc

SEQ ID NO: 7759492 - DNA, 22 bp, Homo sapiens
tttaaatttagaagaaacactg

SEQ ID NO: 7759493 - DNA, 22 bp, Homo sapiens
ctcctctgggtcctggtggcca

SEQ ID NO: 7759494 - DNA, 22 bp, Homo sapiens
ctcctctgtattgattgggact

SEQ ID NO: 7759495 - DNA, 22 bp, Homo sapiens
ctctccagaatatgccgccgtg

SEQ ID NO: 7759496 - DNA, 22 bp, Homo sapiens
ctctccagcctttagcccacgc

SEQ ID NO: 7759497 - DNA, 22 bp, Homo sapiens
ctctggcttctaccttgcagtt

SEQ ID NO: 7759498 - DNA, 19 bp, Homo sapiens
ctctggcttccaaagcatc

SEQ ID NO: 7759499 - DNA, 22 bp, Homo sapiens
ctctggcttagtatgctccaaa

SEQ ID NO: 7759500 - DNA, 22 bp, Homo sapiens
ctctggctgtttgcagctcaag

SEQ ID NO: 7759501 - DNA, 22 bp, Homo sapiens
ctctggctgtcccgatgagcag

SEQ ID NO: 7759502 - DNA, 22 bp, Homo sapiens
ctctggctggctgggcctcagt

SEQ ID NO: 7759503 - DNA, 22 bp, Homo sapiens
ctctggctggcattgctggact

SEQ ID NO: 7759504 - DNA, 22 bp, Homo sapiens
ctctggctctgttgagatttgt

SEQ ID NO: 7759505 - DNA, 22 bp, Homo sapiens
ctctggctctgacagttgatcc

SEQ ID NO: 7759506 - DNA, 19 bp, Homo sapiens
ctctggctcctgggctgcc

SEQ ID NO: 7759507 - DNA, 22 bp, Homo sapiens
ctctggctgcctctcaggcctg

SEQ ID NO: 7759508 - DNA, 22 bp, Homo sapiens
ctctggctgcggggcgcgtgga

SEQ ID NO: 7759509 - DNA, 22 bp, Homo sapiens
ctctggctggcacctgatctga

SEQ ID NO: 7759510 - DNA, 22 bp, Homo sapiens
ctctggctcttgggaaacaggt

SEQ ID NO: 7759511 - DNA, 22 bp, Homo sapiens
ctctgggttcagaacagcaagc

SEQ ID NO: 7759512 - DNA, 22 bp, Homo sapiens
ctctgggttttgtcagctgagg

SEQ ID NO: 7759513 - DNA, 22 bp, Homo sapiens
ctggcctctgtgttcaccatag

SEQ ID NO: 7759514 - DNA, 22 bp, Homo sapiens
ctggcctggggggacacatccc

SEQ ID NO: 7759515 - DNA, 22 bp, Homo sapiens
ctggcacgcccacgtaggcact

SEQ ID NO: 7759516 - DNA, 22 bp, Homo sapiens
ctggcatgaaatggcatctcat

SEQ ID NO: 7759517 - DNA, 22 bp, Homo sapiens
ctggcagtttgccaggagctcg

SEQ ID NO: 7759518 - DNA, 22 bp, Homo sapiens
ctggcagttggcattggcatct

SEQ ID NO: 7759519 - DNA, 22 bp, Homo sapiens
ctggcagtctggtggaaggcct

SEQ ID NO: 7759520 - DNA, 22 bp, Homo sapiens
ctgcctgctcaccagggctctg

SEQ ID NO: 7759521 - DNA, 22 bp, Homo sapiens
tgctccagtgcctgccccacag

SEQ ID NO: 7759522 - DNA, 22 bp, Homo sapiens
cccccaaagtttgcacggataa

SEQ ID NO: 7759523 - DNA, 22 bp, Homo sapiens
cccagcctactctgccatagca

SEQ ID NO: 7759524 - DNA, 22 bp, Homo sapiens
cccagcctttgcttcctggttc

SEQ ID NO: 7759525 - DNA, 22 bp, Homo sapiens
cccagccttccaccctggacta

SEQ ID NO: 7759526 - DNA, 22 bp, Homo sapiens
cccagcctgtgacagccgtcct

SEQ ID NO: 7759527 - DNA, 22 bp, Homo sapiens
tggcacagggcttggtcgctca

SEQ ID NO: 7759528 - DNA, 22 bp, Homo sapiens
cctcccttcagtagagcccaat

SEQ ID NO: 7759529 - DNA, 22 bp, Homo sapiens
cctccagcgcgatccactccgg

SEQ ID NO: 7759530 - DNA, 22 bp, Homo sapiens
cctctggctgtaccactggcac

SEQ ID NO: 7759531 - DNA, 22 bp, Homo sapiens
cctctcagcgattcctcttgga

SEQ ID NO: 7759532 - DNA, 22 bp, Homo sapiens
cctggctcctgcctctgcaggg

SEQ ID NO: 7759533 - DNA, 22 bp, Homo sapiens
cctggcagttttgcccaggatt

SEQ ID NO: 7759534 - DNA, 22 bp, Homo sapiens
cctggcagtggtgaagaagagg

SEQ ID NO: 7759535 - DNA, 22 bp, Homo sapiens
cctggcagttcatcaaatggca

SEQ ID NO: 7759536 - DNA, 22 bp, Homo sapiens
cctggcagactgtgagggcagg

SEQ ID NO: 7759537 - DNA, 22 bp, Homo sapiens
tgtcattattagagttgtgctt

SEQ ID NO: 7759538 - DNA, 22 bp, Homo sapiens
tgtcattatttgcctactgact

SEQ ID NO: 7759539 - DNA, 22 bp, Homo sapiens
tgtcattatttgaggatagact

SEQ ID NO: 7759540 - DNA, 22 bp, Homo sapiens
tgtcattatggagcttccactg

SEQ ID NO: 7759541 - DNA, 22 bp, Homo sapiens
tgtcattagtttcagccattct

SEQ ID NO: 7759542 - DNA, 16 bp, Homo sapiens
tgtcattaccacctgt

SEQ ID NO: 7759543 - DNA, 22 bp, Homo sapiens
tgtcattagagaaggaccactc

SEQ ID NO: 7759544 - DNA, 22 bp, Homo sapiens
tgtcattaagtcctttggcgga

SEQ ID NO: 7759545 - DNA, 21 bp, Homo sapiens
tgtcattaatcgctatagaag

SEQ ID NO: 7759546 - DNA, 22 bp, Homo sapiens
tgtcattatgaggattacaata

SEQ ID NO: 7759547 - DNA, 22 bp, Homo sapiens
tgtcattaagtagggatttgtg

SEQ ID NO: 7759548 - DNA, 22 bp, Homo sapiens
tgtcattaaaatgcttctcaaa

SEQ ID NO: 7759549 - DNA, 22 bp, Homo sapiens
cctggcagcattggtagagatt

SEQ ID NO: 7759550 - DNA, 22 bp, Homo sapiens
cctggcagcaggtgggcccgtg

SEQ ID NO: 7759551 - DNA, 18 bp, Homo sapiens
cctggcagccatgcgcgc

SEQ ID NO: 7759552 - DNA, 22 bp, Homo sapiens
cctggcagcagcacatgccttc

SEQ ID NO: 7759553 - DNA, 23 bp, Homo sapiens
cctggcagcaaacgaggaggtta

SEQ ID NO: 7759554 - DNA, 22 bp, Homo sapiens
cctggcaggtggcgccctcggc

SEQ ID NO: 7759555 - DNA, 22 bp, Homo sapiens
cctggcaggttacaaccagtta

SEQ ID NO: 7759556 - DNA, 22 bp, Homo sapiens
cctggcagtcaggggagtcctt

SEQ ID NO: 7759557 - DNA, 22 bp, Homo sapiens
cctggcaggtggaggttgcagt

SEQ ID NO: 7759558 - DNA, 22 bp, Homo sapiens
cctggcaggtagcattgaggag

SEQ ID NO: 7759559 - DNA, 22 bp, Homo sapiens
cctggcagggctgcagtaatgg

SEQ ID NO: 7759560 - DNA, 22 bp, Homo sapiens
cctggcaggcccctcctggatt

SEQ ID NO: 7759561 - DNA, 22 bp, Homo sapiens
cctggcaggcaagaggaaggga

SEQ ID NO: 7759562 - DNA, 22 bp, Homo sapiens
cctggcaggactgttgtaagaa

SEQ ID NO: 7759563 - DNA, 22 bp, Homo sapiens
cctggcaggctggggacagtgc

SEQ ID NO: 7759564 - DNA, 20 bp, Homo sapiens
cctggcaggcgggttactta

SEQ ID NO: 7759565 - DNA, 22 bp, Homo sapiens
cctggcagaaagagttacacct

SEQ ID NO: 7759566 - DNA, 21 bp, Homo sapiens
cctggcagaagcctgatatgc

SEQ ID NO: 7759567 - DNA, 22 bp, Homo sapiens
cctggcagaatattaaagtgca

SEQ ID NO: 7759568 - DNA, 22 bp, Homo sapiens
cctggcagacagcactgaagct

SEQ ID NO: 7759569 - DNA, 22 bp, Homo sapiens
tgtaaacatatgtatgtatgta

SEQ ID NO: 7759570 - DNA, 23 bp, Homo sapiens
tgtaaacatcaccccctggagtt

SEQ ID NO: 7759571 - DNA, 22 bp, Homo sapiens
tgtaaagaaagacgcagagtta

SEQ ID NO: 7759572 - DNA, 22 bp, Homo sapiens
tgtaaacagccccatggagagc

SEQ ID NO: 7759573 - DNA, 22 bp, Homo sapiens
tgtaaacataccagagccaagt

SEQ ID NO: 7759574 - DNA, 22 bp, Homo sapiens
cctgggtcccatcccagagtga

SEQ ID NO: 7759575 - DNA, 22 bp, Homo sapiens
caggacaaagccctttgagaaa

SEQ ID NO: 7759576 - DNA, 22 bp, Homo sapiens
caggagtggtgtgagggactcc

SEQ ID NO: 7759577 - DNA, 22 bp, Homo sapiens
caggagggcccgagactcttcc

SEQ ID NO: 7759578 - DNA, 22 bp, Homo sapiens
caggatggtctcgatctcctga

SEQ ID NO: 7759579 - DNA, 22 bp, Homo sapiens
gttcccattggggatcttgggc

SEQ ID NO: 7759580 - DNA, 22 bp, Homo sapiens
gttgggaagcagatggatgagc

SEQ ID NO: 7759581 - DNA, 22 bp, Homo sapiens
gtggcagtgaaggtcatagcat

SEQ ID NO: 7759582 - DNA, 22 bp, Homo sapiens
gtggcagtcgctgacagataca

SEQ ID NO: 7759583 - DNA, 22 bp, Homo sapiens
cagcccagccttgtctctttat

SEQ ID NO: 7759584 - DNA, 22 bp, Homo sapiens
cagcccaggccgacagttcctc

SEQ ID NO: 7759585 - DNA, 19 bp, Homo sapiens
gtgggacagacattacata

SEQ ID NO: 7759586 - DNA, 22 bp, Homo sapiens
tctcctgggaggacaaggaagg

SEQ ID NO: 7759587 - DNA, 22 bp, Homo sapiens
ccacacagataagtgttttcta

SEQ ID NO: 7759588 - DNA, 22 bp, Homo sapiens
ccacaaaactgtgtgtcaaaga

SEQ ID NO: 7759589 - DNA, 22 bp, Homo sapiens
catttattagttagttcgatgt

SEQ ID NO: 7759590 - DNA, 17 bp, Homo sapiens
tccaggcagcaactgag

SEQ ID NO: 7759591 - DNA, 22 bp, Homo sapiens
tccctgcctgacagcacccacc

SEQ ID NO: 7759592 - DNA, 23 bp, Homo sapiens
tctggctttcacgggtattctta

SEQ ID NO: 7759593 - DNA, 22 bp, Homo sapiens
tctggcttgtgtccttccttgc

SEQ ID NO: 7759594 - DNA, 22 bp, Homo sapiens
tctggctttattccttcactga

SEQ ID NO: 7759595 - DNA, 22 bp, Homo sapiens
tctggctttattttcatcatct

SEQ ID NO: 7759596 - DNA, 22 bp, Homo sapiens
tctggcttggcgctgccctctg

SEQ ID NO: 7759597 - DNA, 22 bp, Homo sapiens
tctggcttggacacaatcttcc

SEQ ID NO: 7759598 - DNA, 22 bp, Homo sapiens
tctggcttggctggcatctctg

SEQ ID NO: 7759599 - DNA, 22 bp, Homo sapiens
tctggcttgctggcttggtccc

SEQ ID NO: 7759600 - DNA, 22 bp, Homo sapiens
tctggcttccctctgttctggg

SEQ ID NO: 7759601 - DNA, 22 bp, Homo sapiens
tctggcttccctacttactatg

SEQ ID NO: 7759602 - DNA, 19 bp, Homo sapiens
ccagcccacagtgactttc

SEQ ID NO: 7759603 - DNA, 21 bp, Homo sapiens
ccagcccagctgtgtcccagc

SEQ ID NO: 7759604 - DNA, 22 bp, Homo sapiens
catgtctgccaatttggaagga

SEQ ID NO: 7759605 - DNA, 22 bp, Homo sapiens
tccaggcaaaaaccaactacag

SEQ ID NO: 7759606 - DNA, 22 bp, Homo sapiens
tccaggcaagggaggagcatgg

SEQ ID NO: 7759607 - DNA, 22 bp, Homo sapiens
catacatttatacacatctatg

SEQ ID NO: 7759608 - DNA, 22 bp, Homo sapiens
catcacaggtcctgatgacatt

SEQ ID NO: 7759609 - DNA, 23 bp, Homo sapiens
catccaggagctgagtctgactg

SEQ ID NO: 7759610 - DNA, 22 bp, Homo sapiens
catcacagaaataaacatacct

SEQ ID NO: 7759611 - DNA, 19 bp, Homo sapiens
tatttacttcttgattgca

SEQ ID NO: 7759612 - DNA, 22 bp, Homo sapiens
tgtcttctgtattcaagtctat

SEQ ID NO: 7759613 - DNA, 22 bp, Homo sapiens
tgtctctgaacagcttactaaa

SEQ ID NO: 7759614 - DNA, 22 bp, Homo sapiens
tgtggggaagagtatgacttgg

SEQ ID NO: 7759615 - DNA, 22 bp, Homo sapiens
tgttgactcaacactgtgggca

SEQ ID NO: 7759616 - DNA, 22 bp, Homo sapiens
tgttgagtatatacctacaagt

SEQ ID NO: 7759617 - DNA, 22 bp, Homo sapiens
tgttgacttgaaccaaagtgtt

SEQ ID NO: 7759618 - DNA, 22 bp, Homo sapiens
ttccagccatggtttccctatg

SEQ ID NO: 7759619 - DNA, 22 bp, Homo sapiens
ttccagcccgcgacttgttcag

SEQ ID NO: 7759620 - DNA, 22 bp, Homo sapiens
ttcattagttctgaagatgtct

SEQ ID NO: 7759621 - DNA, 23 bp, Homo sapiens
ttcattaggagataagggggaca

SEQ ID NO: 7759622 - DNA, 22 bp, Homo sapiens
ttcattagcaaggtcttcaagt

SEQ ID NO: 7759623 - DNA, 22 bp, Homo sapiens
ttcattagagattataaaatga

SEQ ID NO: 7759624 - DNA, 22 bp, Homo sapiens
ttcattagaaaagtaaaaatgc

SEQ ID NO: 7759625 - DNA, 22 bp, Homo sapiens
ttagaagcaggctgtgtcccca

SEQ ID NO: 7759626 - DNA, 22 bp, Homo sapiens
ttagaagcactaattactcaca

SEQ ID NO: 7759627 - DNA, 22 bp, Homo sapiens
tggtaagaacccatcagagaag

SEQ ID NO: 7759628 - DNA, 18 bp, Homo sapiens
tgtagagccaggtttgcc

SEQ ID NO: 7759629 - DNA, 22 bp, Homo sapiens
tggtctctgcaggccaggctca

SEQ ID NO: 7759630 - DNA, 22 bp, Homo sapiens
tggtcctgccccgtgcacagag

SEQ ID NO: 7759631 - DNA, 22 bp, Homo sapiens
tggtcctggaaggtcctgaggg

SEQ ID NO: 7759632 - DNA, 21 bp, Homo sapiens
tggtcattgcggtggaaggag

SEQ ID NO: 7759633 - DNA, 22 bp, Homo sapiens
tggtcattgttaaggtcacaca

SEQ ID NO: 7759634 - DNA, 22 bp, Homo sapiens
tggtcattgtttgctggctctt

SEQ ID NO: 7759635 - DNA, 19 bp, Homo sapiens
tggtcatttctaatggttc

SEQ ID NO: 7759636 - DNA, 22 bp, Homo sapiens
tggtcattctgttctacagtag

SEQ ID NO: 7759637 - DNA, 17 bp, Homo sapiens
tgctggcaacatacaaa

SEQ ID NO: 7759638 - DNA, 22 bp, Homo sapiens
tgctggcacgtggaccaggaga

SEQ ID NO: 7759639 - DNA, 20 bp, Homo sapiens
tgcctggcctttctctgccc

SEQ ID NO: 7759640 - DNA, 22 bp, Homo sapiens
tgctctgtattctatggcagtt

SEQ ID NO: 7759641 - DNA, 21 bp, Homo sapiens
tgctctggtagaaactctttc

SEQ ID NO: 7759642 - DNA, 22 bp, Homo sapiens
tggaaagaggtagaggatctgg

SEQ ID NO: 7759643 - DNA, 22 bp, Homo sapiens
tggaaagaggaagtgcccagca

SEQ ID NO: 7759644 - DNA, 21 bp, Homo sapiens
tggcttcagccattttctctg

SEQ ID NO: 7759645 - DNA, 22 bp, Homo sapiens
tggcttacatgcctttctatct

SEQ ID NO: 7759646 - DNA, 22 bp, Homo sapiens
tgggactcactcttttggccag

SEQ ID NO: 7759647 - DNA, 22 bp, Homo sapiens
tgggagaaactgtctctcccac

SEQ ID NO: 7759648 - DNA, 22 bp, Homo sapiens
tggcgtctctcataagtatgtg

SEQ ID NO: 7759649 - DNA, 22 bp, Homo sapiens
tggcagggtgccagttgcgagt

SEQ ID NO: 7759650 - DNA, 19 bp, Homo sapiens
tggcaggtagtgagcagtc

SEQ ID NO: 7759651 - DNA, 22 bp, Homo sapiens
tggcagtagatccagtctctct

SEQ ID NO: 7759652 - DNA, 22 bp, Homo sapiens
tggcatctccgacagtcttgat

SEQ ID NO: 7759653 - DNA, 22 bp, Homo sapiens
tggcagtggctcagagtgcaga

SEQ ID NO: 7759654 - DNA, 22 bp, Homo sapiens
tggcagtggataggggagcggt

SEQ ID NO: 7759655 - DNA, 22 bp, Homo sapiens
tggcctctgtgggagctgagca

SEQ ID NO: 7759656 - DNA, 20 bp, Homo sapiens
tggcctctgagatgccacgg

SEQ ID NO: 7759657 - DNA, 22 bp, Homo sapiens
tggcctctgggaaagcagattc

SEQ ID NO: 7759658 - DNA, 22 bp, Homo sapiens
tggcctgccactgccacgccac

SEQ ID NO: 7759659 - DNA, 22 bp, Homo sapiens
tggcaggaaagtaacagagcac

SEQ ID NO: 7759660 - DNA, 22 bp, Homo sapiens
tggcagagtcatcacatctgga

SEQ ID NO: 7759661 - DNA, 22 bp, Homo sapiens
tggcagagagagtgcagtcgac

SEQ ID NO: 7759662 - DNA, 22 bp, Homo sapiens
tggcagagcccagactccagtc

SEQ ID NO: 7759663 - DNA, 22 bp, Homo sapiens
tggcagagagactctccttgat

SEQ ID NO: 7759664 - DNA, 22 bp, Homo sapiens
tggcagagaacacggctgatct

SEQ ID NO: 7759665 - DNA, 22 bp, Homo sapiens
tggcactcactctcagagtctg

SEQ ID NO: 7759666 - DNA, 22 bp, Homo sapiens
tctttttctgcacacgtgtccc

SEQ ID NO: 7759667 - DNA, 22 bp, Homo sapiens
tgacttctagcatttagcaacc

SEQ ID NO: 7759668 - DNA, 21 bp, Homo sapiens
tgactgaggcttcttcacaca

SEQ ID NO: 7759669 - DNA, 19 bp, Homo sapiens
tgactctgtggaacagaag

SEQ ID NO: 7759670 - DNA, 22 bp, Homo sapiens
tgactctggggttgaccagatg

SEQ ID NO: 7759671 - DNA, 20 bp, Homo sapiens
tgactctggtcccagtatga

SEQ ID NO: 7759672 - DNA, 22 bp, Homo sapiens
tgactctgtacctgtctgcctt

SEQ ID NO: 7759673 - DNA, 22 bp, Homo sapiens
tgactctgcccagccgcttgtc

SEQ ID NO: 7759674 - DNA, 22 bp, Homo sapiens
tgactctgattgccttagcttg

SEQ ID NO: 7759675 - DNA, 22 bp, Homo sapiens
tgactctggcttcaagtttctt

SEQ ID NO: 7759676 - DNA, 22 bp, Homo sapiens
tgactctgctgtgaaagcattt

SEQ ID NO: 7759677 - DNA, 22 bp, Homo sapiens
tgactctggagatccgaaataa

SEQ ID NO: 7759678 - DNA, 22 bp, Homo sapiens
tgactctgaattgggaaatggg

SEQ ID NO: 7759679 - DNA, 22 bp, Homo sapiens
tgactctgaatttatgaaatgg

SEQ ID NO: 7759680 - DNA, 22 bp, Homo sapiens
tgactctgataagacatatggc

SEQ ID NO: 7759681 - DNA, 20 bp, Homo sapiens
tgactctgcaaccgtctctc

SEQ ID NO: 7759682 - DNA, 22 bp, Homo sapiens
tgacaggaggcttgaggccagg

SEQ ID NO: 7759683 - DNA, 19 bp, Homo sapiens
tgagctctccacaatttcc

SEQ ID NO: 7759684 - DNA, 22 bp, Homo sapiens
tgagtagagaattcagctaagg

SEQ ID NO: 7759685 - DNA, 23 bp, Homo sapiens
tgagggacatggtggcttctgag

SEQ ID NO: 7759686 - DNA, 22 bp, Homo sapiens
tgagggactcccggccctgcca

SEQ ID NO: 7759687 - DNA, 22 bp, Homo sapiens
tgatctggtcctactgtgggca

SEQ ID NO: 7759688 - DNA, 22 bp, Homo sapiens
tgcacaggaggctgtggagaag

SEQ ID NO: 7759689 - DNA, 22 bp, Homo sapiens
tgcacaggtgagactcaggaag

SEQ ID NO: 7759690 - DNA, 22 bp, Homo sapiens
tgcagagaaaactcctgggtac

SEQ ID NO: 7759691 - DNA, 22 bp, Homo sapiens
tgccagccagggaagctcaccc

SEQ ID NO: 7759692 - DNA, 17 bp, Homo sapiens
tgccagcctgtcccagg

SEQ ID NO: 7759693 - DNA, 22 bp, Homo sapiens
tgcctctctaacccatgcccaa

SEQ ID NO: 7759694 - DNA, 22 bp, Homo sapiens
tgcctgactgctgccaccacta

SEQ ID NO: 7759695 - DNA, 22 bp, Homo sapiens
tgcctgccatgcagaaagctga

SEQ ID NO: 7759696 - DNA, 19 bp, Homo sapiens
tgcctggcaccagctccac

SEQ ID NO: 7759697 - DNA, 22 bp, Homo sapiens
tgcctaggctggagtgtagtgg

SEQ ID NO: 7759698 - DNA, 23 bp, Homo sapiens
tccttcctttgagaggctccatc

SEQ ID NO: 7759699 - DNA, 20 bp, Homo sapiens
tctaggctagattttgtcat

SEQ ID NO: 7759700 - DNA, 22 bp, Homo sapiens
tcctgtgccatctctagagact

SEQ ID NO: 7759701 - DNA, 21 bp, Homo sapiens
tcctgtaagcttgggtggctc

SEQ ID NO: 7759702 - DNA, 22 bp, Homo sapiens
tcctggcattgtgcagggtgtg

SEQ ID NO: 7759703 - DNA, 19 bp, Homo sapiens
tcctggcatttgtaggaaa

SEQ ID NO: 7759704 - DNA, 22 bp, Homo sapiens
tcctggcagtgcttgttttgga

SEQ ID NO: 7759705 - DNA, 22 bp, Homo sapiens
tcctggcatccgtgggtctgtg

SEQ ID NO: 7759706 - DNA, 19 bp, Homo sapiens
tcctggcacagtggaacca

SEQ ID NO: 7759707 - DNA, 22 bp, Homo sapiens
tcctggcaaagatgttggtgtt

SEQ ID NO: 7759708 - DNA, 22 bp, Homo sapiens
taagaacagtagaacagtaggt

SEQ ID NO: 7759709 - DNA, 22 bp, Homo sapiens
tctctggcagacacctccctga

SEQ ID NO: 7759710 - DNA, 22 bp, Homo sapiens
tctctggcactcccttatggct

SEQ ID NO: 7759711 - DNA, 22 bp, Homo sapiens
tctctggcacataataaggtct

SEQ ID NO: 7759712 - DNA, 20 bp, Homo sapiens
tctctggcaagaagctgcag

SEQ ID NO: 7759713 - DNA, 22 bp, Homo sapiens
tctctggcagactggctgggct

SEQ ID NO: 7759714 - DNA, 22 bp, Homo sapiens
tctctggcagaggccctatccc

SEQ ID NO: 7759715 - DNA, 22 bp, Homo sapiens
tctctggcagcttgtgctgttg

SEQ ID NO: 7759716 - DNA, 22 bp, Homo sapiens
tctctggcagggatatctggct

SEQ ID NO: 7759717 - DNA, 22 bp, Homo sapiens
tctctggccccatggctgagct

SEQ ID NO: 7759718 - DNA, 20 bp, Homo sapiens
tctctggccagaaacaacag

SEQ ID NO: 7759719 - DNA, 19 bp, Homo sapiens
tctctggcatagactcaat

SEQ ID NO: 7759720 - DNA, 19 bp, Homo sapiens
tctctggcagttcagagca

SEQ ID NO: 7759721 - DNA, 22 bp, Homo sapiens
tctctggccgagagtccctggg

SEQ ID NO: 7759722 - DNA, 23 bp, Homo sapiens
tctctggcctttgatcaggttga

SEQ ID NO: 7759723 - DNA, 21 bp, Homo sapiens
tctctggcggtgtttggctcc

SEQ ID NO: 7759724 - DNA, 22 bp, Homo sapiens
tctctggctcctgccgggtcca

SEQ ID NO: 7759725 - DNA, 22 bp, Homo sapiens
tctctggctgatattcctctgc

SEQ ID NO: 7759726 - DNA, 22 bp, Homo sapiens
tctctggcttaggttgagtgca

SEQ ID NO: 7759727 - DNA, 22 bp, Homo sapiens
tctctggctggcaccccaggga

SEQ ID NO: 7759728 - DNA, 22 bp, Homo sapiens
tctctggccctgttttctatct

SEQ ID NO: 7759729 - DNA, 19 bp, Homo sapiens
tctctggcttgtctgcctg

SEQ ID NO: 7759730 - DNA, 20 bp, Homo sapiens
tcttctgttgccttgttctg

SEQ ID NO: 7759731 - DNA, 22 bp, Homo sapiens
tcttctgttttagattgcatac

SEQ ID NO: 7759732 - DNA, 22 bp, Homo sapiens
tcttctgtggctctcaccaccc

SEQ ID NO: 7759733 - DNA, 22 bp, Homo sapiens
tcttctgtgatctatgtgtttt

SEQ ID NO: 7759734 - DNA, 22 bp, Homo sapiens
tcttgggatagtgtctcatggc

SEQ ID NO: 7759735 - DNA, 22 bp, Homo sapiens
tcttggctcctgttgtcatcag

SEQ ID NO: 7759736 - DNA, 22 bp, Homo sapiens
tcttggctctgccactaattag

SEQ ID NO: 7759737 - DNA, 22 bp, Homo sapiens
tctgtgctttccctgccttctt

SEQ ID NO: 7759738 - DNA, 22 bp, Homo sapiens
tctgtttcttggctagcctctt

SEQ ID NO: 7759739 - DNA, 22 bp, Homo sapiens
tctgtttctccaacattgtgag

SEQ ID NO: 7759740 - DNA, 17 bp, Homo sapiens
tctgtttctcctttctt

SEQ ID NO: 7759741 - DNA, 22 bp, Homo sapiens
tctgtttcttcctagccatgct

SEQ ID NO: 7759742 - DNA, 22 bp, Homo sapiens
tctgtttcttcttctgttatat

SEQ ID NO: 7759743 - DNA, 22 bp, Homo sapiens
tctgtttcacgtcctgaatctc

SEQ ID NO: 7759744 - DNA, 22 bp, Homo sapiens
tctgtttcaagtagggcttata

SEQ ID NO: 7759745 - DNA, 22 bp, Homo sapiens
tctgtttcctcttgtgtaaagt

SEQ ID NO: 7759746 - DNA, 22 bp, Homo sapiens
tctgtttctataaagacaagag

SEQ ID NO: 7759747 - DNA, 22 bp, Homo sapiens
tctgggtctatcccatgccttt

SEQ ID NO: 7759748 - DNA, 22 bp, Homo sapiens
tctgggtctattcctactgtga

SEQ ID NO: 7759749 - DNA, 22 bp, Homo sapiens
tctgggtctatgatctcacttc

SEQ ID NO: 7759750 - DNA, 22 bp, Homo sapiens
tctgggtcttagttttcttgat

SEQ ID NO: 7759751 - DNA, 22 bp, Homo sapiens
tctgggctgcttcagccttcgc

SEQ ID NO: 7759752 - DNA, 22 bp, Homo sapiens
tctgctgtaaagaatttctgcc

SEQ ID NO: 7759753 - DNA, 22 bp, Homo sapiens
tctgctgtcttttctgggtgag

SEQ ID NO: 7759754 - DNA, 22 bp, Homo sapiens
tctggcagtttgagaaaggcta

SEQ ID NO: 7759755 - DNA, 22 bp, Homo sapiens
tctggcagtgatttctgtgatc

SEQ ID NO: 7759756 - DNA, 22 bp, Homo sapiens
tctggcagtggatgagggcagc

SEQ ID NO: 7759757 - DNA, 22 bp, Homo sapiens
tctggcagttgccgcttcagtc

SEQ ID NO: 7759758 - DNA, 21 bp, Homo sapiens
tctggcagtggtctttcaaat

SEQ ID NO: 7759759 - DNA, 22 bp, Homo sapiens
tctggcagttccttgttgatat

SEQ ID NO: 7759760 - DNA, 22 bp, Homo sapiens
tctggcagagatatccatccca

SEQ ID NO: 7759761 - DNA, 22 bp, Homo sapiens
tctggcagaaggcagaaattca

SEQ ID NO: 7759762 - DNA, 22 bp, Homo sapiens
tctggcagaagtgctgtcagta

SEQ ID NO: 7759763 - DNA, 22 bp, Homo sapiens
tctggcagaggaaggaggcctg

SEQ ID NO: 7759764 - DNA, 22 bp, Homo sapiens
tctggcagagtcagtgcacaca

SEQ ID NO: 7759765 - DNA, 22 bp, Homo sapiens
tctggcaggtcaatcattcttt

SEQ ID NO: 7759766 - DNA, 22 bp, Homo sapiens
tctggcagggtgtgtatttaca

SEQ ID NO: 7759767 - DNA, 19 bp, Homo sapiens
tctggcaggtaattaggga

SEQ ID NO: 7759768 - DNA, 22 bp, Homo sapiens
tctggcagagtgataggataag

SEQ ID NO: 7759769 - DNA, 22 bp, Homo sapiens
tctggcagatcttcccacgttt

SEQ ID NO: 7759770 - DNA, 22 bp, Homo sapiens
tctggcagggtcagggcccagg

SEQ ID NO: 7759771 - DNA, 22 bp, Homo sapiens
tctggcagcaagataacaatgg

SEQ ID NO: 7759772 - DNA, 22 bp, Homo sapiens
tctggcagtgagcaacttgaca

SEQ ID NO: 7759773 - DNA, 22 bp, Homo sapiens
tctggcagtgaagtcatgaggt

SEQ ID NO: 7759774 - DNA, 22 bp, Homo sapiens
tctggcagtaataggggagaga

SEQ ID NO: 7759775 - DNA, 22 bp, Homo sapiens
tctggcaggttcccatgttatg

SEQ ID NO: 7759776 - DNA, 20 bp, Homo sapiens
tctggcaggtgaacgagctg

SEQ ID NO: 7759777 - DNA, 18 bp, Homo sapiens
tctggctttgttccttgt

SEQ ID NO: 7759778 - DNA, 22 bp, Homo sapiens
tctggctccactttcttcattt

SEQ ID NO: 7759779 - DNA, 22 bp, Homo sapiens
tctggctctgaattcacttctg

SEQ ID NO: 7759780 - DNA, 22 bp, Homo sapiens
tctggctctccagtgctcttag

SEQ ID NO: 7759781 - DNA, 20 bp, Homo sapiens
tctggctctttgctcctccc

SEQ ID NO: 7759782 - DNA, 22 bp, Homo sapiens
acagattcactgcactggccat

SEQ ID NO: 7759783 - DNA, 22 bp, Homo sapiens
acactctgtaatgtcacactcc

SEQ ID NO: 7759784 - DNA, 22 bp, Homo sapiens
acactcaccctcccactgcctg

SEQ ID NO: 7759785 - DNA, 21 bp, Homo sapiens
acacagaggcatcatcacttt

SEQ ID NO: 7759786 - DNA, 22 bp, Homo sapiens
acacagatgcattacacatcta

SEQ ID NO: 7759787 - DNA, 22 bp, Homo sapiens
acacagagtttgacacatggga

SEQ ID NO: 7759788 - DNA, 22 bp, Homo sapiens
acaacacatgtgtatatgtgtg

SEQ ID NO: 7759789 - DNA, 22 bp, Homo sapiens
aatggcagaggcaaagatggta

SEQ ID NO: 7759790 - DNA, 22 bp, Homo sapiens
aatggcaattcagtgaaattat

SEQ ID NO: 7759791 - DNA, 22 bp, Homo sapiens
actgcactccagcctgggtaac

SEQ ID NO: 7759792 - DNA, 22 bp, Homo sapiens
actttcttaggctgtataaatg

SEQ ID NO: 7759793 - DNA, 22 bp, Homo sapiens
aatatactatactactttctgg

SEQ ID NO: 7759794 - DNA, 22 bp, Homo sapiens
acacatcttagactgaaatatg

SEQ ID NO: 7759795 - DNA, 22 bp, Homo sapiens
aagcacctctatgattgctttt

SEQ ID NO: 7759796 - DNA, 22 bp, Homo sapiens
aacacagatcaaaatatttcct

SEQ ID NO: 7759797 - DNA, 22 bp, Homo sapiens
aaattcacaagagcattgcctg

SEQ ID NO: 7759798 - DNA, 22 bp, Homo sapiens
aatgaacaacactgaaggaaga

SEQ ID NO: 7759799 - DNA, 22 bp, Homo sapiens
aaatactgctgctattcctttt

SEQ ID NO: 7759800 - DNA, 22 bp, Homo sapiens
aaagcagcaaatacttttgcac

SEQ ID NO: 7759801 - DNA, 22 bp, Homo sapiens
acccacacatctctaattcagt

SEQ ID NO: 7759802 - DNA, 22 bp, Homo sapiens
acccacacctccgtatatcact

SEQ ID NO: 7759803 - DNA, 22 bp, Homo sapiens
acatgacttttctcttccagag

SEQ ID NO: 7759804 - DNA, 18 bp, Homo sapiens
atttaatgaactgaaagc

SEQ ID NO: 7759805 - DNA, 23 bp, Homo sapiens
atttaatgctgagttgaatgtta

SEQ ID NO: 7759806 - DNA, 22 bp, Homo sapiens
atggcagatggctggagcaggt

SEQ ID NO: 7759807 - DNA, 22 bp, Homo sapiens
agacacataggaccacactgtg

SEQ ID NO: 7759808 - DNA, 22 bp, Homo sapiens
cacatccctggagttacccagt

SEQ ID NO: 7759809 - DNA, 22 bp, Homo sapiens
cagacagagtcttcccatcagt

SEQ ID NO: 7759810 - DNA, 22 bp, Homo sapiens
agcccagctttgaaccatatca

SEQ ID NO: 7759811 - DNA, 22 bp, Homo sapiens
cattcccacgtgttctttgctt

SEQ ID NO: 7759812 - DNA, 22 bp, Homo sapiens
ctgtcctccagacgacagtccc

SEQ ID NO: 7759813 - DNA, 22 bp, Homo sapiens
atcctctgtggattacacctag

SEQ ID NO: 7759814 - DNA, 22 bp, Homo sapiens
atatggcagaccaattagaagc

SEQ ID NO: 7759815 - DNA, 22 bp, Homo sapiens
ctgagggtcaacttgattgtat

SEQ ID NO: 7759816 - DNA, 22 bp, Homo sapiens
ccttgctcaagctagtgacggg

SEQ ID NO: 7759817 - DNA, 22 bp, Homo sapiens
ctcagaatctgccaagttcagg

SEQ ID NO: 7759818 - DNA, 22 bp, Homo sapiens
cagccaagaaccacagacccag

SEQ ID NO: 7759819 - DNA, 21 bp, Homo sapiens
cagcccagcccattgacagtg

SEQ ID NO: 7759820 - DNA, 22 bp, Homo sapiens
gggacaatggaggcctctctcc

SEQ ID NO: 7759821 - DNA, 22 bp, Homo sapiens
cacactgtcaggtaaataacac

SEQ ID NO: 7759822 - DNA, 22 bp, Homo sapiens
cacccacattccatcactctgc

SEQ ID NO: 7759823 - DNA, 22 bp, Homo sapiens
cacccacatggaaattcacagt

SEQ ID NO: 7759824 - DNA, 22 bp, Homo sapiens
caaggattaatagaatgaatca

SEQ ID NO: 7759825 - DNA, 22 bp, Homo sapiens
cacacatttcagatgctacaat

SEQ ID NO: 7759826 - DNA, 22 bp, Homo sapiens
cacaactttaggaaccacattc

SEQ ID NO: 7759827 - DNA, 22 bp, Homo sapiens
cacaatgtatatgtatatcaaa

SEQ ID NO: 7759828 - DNA, 22 bp, Homo sapiens
gctgcagtgagccaagatcgtg

SEQ ID NO: 7759829 - DNA, 22 bp, Homo sapiens
attaatgagcttctgcactcat

SEQ ID NO: 7759830 - DNA, 22 bp, Homo sapiens
attaatgaaactttggttaagc

SEQ ID NO: 7759831 - DNA, 22 bp, Homo sapiens
atttaatgggtagacattgtta

SEQ ID NO: 7759832 - DNA, 22 bp, Homo sapiens
atggcagagggattgaacagct

SEQ ID NO: 7759833 - DNA, 18 bp, Homo sapiens
cttgttcttctcttggcg

SEQ ID NO: 7759834 - DNA, 22 bp, Homo sapiens
tatttagaatgcgtgtacgtgt

SEQ ID NO: 7759835 - DNA, 22 bp, Homo sapiens
cagtgcaacgttgtgcattcaa

SEQ ID NO: 7759836 - DNA, 22 bp, Homo sapiens
tatggctactacgaataatgct

SEQ ID NO: 7759837 - DNA, 22 bp, Homo sapiens
tatggcaattgtctaagtttta

SEQ ID NO: 7759838 - DNA, 22 bp, Homo sapiens
tatggcaagatgacatgttctc

SEQ ID NO: 7759839 - DNA, 22 bp, Homo sapiens
tatggcaaaactctttatccaa

SEQ ID NO: 7759840 - DNA, 22 bp, Homo sapiens
tatggcaagagaatcaactgaa

SEQ ID NO: 7759841 - DNA, 22 bp, Homo sapiens
tatggcaatatgtatcaagatc

SEQ ID NO: 7759842 - DNA, 22 bp, Homo sapiens
tataatctggttttattaagag

SEQ ID NO: 7759843 - DNA, 22 bp, Homo sapiens
catcacagaaataaacatacct

SEQ ID NO: 7759844 - DNA, 22 bp, Homo sapiens
catcacaggtcctgatgacatt

SEQ ID NO: 7759845 - DNA, 22 bp, Homo sapiens
catacatttatacacatctatg

SEQ ID NO: 7759846 - DNA, 22 bp, Homo sapiens
tcagaagtagctccccttcatt

SEQ ID NO: 7759847 - DNA, 22 bp, Homo sapiens
tcagaagtattatgctaaagga

SEQ ID NO: 7759848 - DNA, 22 bp, Homo sapiens
tcagaagtcccttgcatcttag

SEQ ID NO: 7759849 - DNA, 22 bp, Homo sapiens
tcattttcacacataaatagca

SEQ ID NO: 7759850 - DNA, 21 bp, Homo sapiens
ccagcccagctgtgtcccagc

SEQ ID NO: 7759851 - DNA, 19 bp, Homo sapiens
ccagcccacagtgactttc

SEQ ID NO: 7759852 - DNA, 22 bp, Homo sapiens
ccacacagataagtgttttcta

SEQ ID NO: 7759853 - DNA, 22 bp, Homo sapiens
ccagaatttgaactcaggcaat

SEQ ID NO: 7759854 - DNA, 22 bp, Homo sapiens
ccagaatttggatcatgatttt

SEQ ID NO: 7759855 - DNA, 22 bp, Homo sapiens
ccagaattcagaaagggcataa

SEQ ID NO: 7759856 - DNA, 19 bp, Homo sapiens
gtgggacagacattacata

SEQ ID NO: 7759857 - DNA, 22 bp, Homo sapiens
cagcccaggccgacagttcctc

SEQ ID NO: 7759858 - DNA, 22 bp, Homo sapiens
cagcccagccttgtctctttat

SEQ ID NO: 7759859 - DNA, 22 bp, Homo sapiens
cagctttcttccttctgtctgt

SEQ ID NO: 7759860 - DNA, 22 bp, Homo sapiens
cagctttctttccataaggttt

SEQ ID NO: 7759861 - DNA, 22 bp, Homo sapiens
cagctttccagagacctgcccc

SEQ ID NO: 7759862 - DNA, 22 bp, Homo sapiens
tgtaaacataccagagccaagt

SEQ ID NO: 7759863 - DNA, 22 bp, Homo sapiens
tgtaaacagccccatggagagc

SEQ ID NO: 7759864 - DNA, 22 bp, Homo sapiens
tgtaaagaaagacgcagagtta

SEQ ID NO: 7759865 - DNA, 23 bp, Homo sapiens
tgtaaacatcaccccctggagtt

SEQ ID NO: 7759866 - DNA, 22 bp, Homo sapiens
tgtaaacatatgtatgtatgta

SEQ ID NO: 7759867 - DNA, 22 bp, Homo sapiens
cctggctcctgcctctgcaggg

SEQ ID NO: 7759868 - DNA, 22 bp, Homo sapiens
tggcacagggcttggtcgctca

SEQ ID NO: 7759869 - DNA, 22 bp, Homo sapiens
cccccaaagtttgcacggataa

SEQ ID NO: 7759870 - DNA, 22 bp, Homo sapiens
ctggcaagaaatatatatctta

SEQ ID NO: 7759871 - DNA, 22 bp, Homo sapiens
ctggcctggggggacacatccc

SEQ ID NO: 7759872 - DNA, 22 bp, Homo sapiens
tttgtgaataggttggcttcca

SEQ ID NO: 7759873 - DNA, 22 bp, Homo sapiens
ctcctctgtattgattgggact

SEQ ID NO: 7759874 - DNA, 22 bp, Homo sapiens
ctcctctgggtcctggtggcca

SEQ ID NO: 7759875 - DNA, 22 bp, Homo sapiens
tttaaatttagaagaaacactg

SEQ ID NO: 7759876 - DNA, 22 bp, Homo sapiens
ctcatcaccacatataacaaag

SEQ ID NO: 7759877 - DNA, 22 bp, Homo sapiens
ttcccacagagattacattgaa

SEQ ID NO: 7759878 - DNA, 22 bp, Homo sapiens
ttcccacagtgttgaatcctct

SEQ ID NO: 7759879 - DNA, 22 bp, Homo sapiens
ttcccacattctttacattcat

SEQ ID NO: 7759880 - DNA, 19 bp, Homo sapiens
ttgacgttgtggaattaac

SEQ ID NO: 7759881 - DNA, 22 bp, Homo sapiens
gaaataattctgtgtctgaaca

SEQ ID NO: 7759882 - DNA, 22 bp, Homo sapiens
gaaataatttagaaggtattcc

SEQ ID NO: 7759883 - DNA, 22 bp, Homo sapiens
gacacagatatctctgagatta

SEQ ID NO: 7759884 - DNA, 22 bp, Homo sapiens
gacacagagctcacagtctcct

SEQ ID NO: 7759885 - DNA, 22 bp, Homo sapiens
gacacagagggcaccagatatg

SEQ ID NO: 7759886 - DNA, 22 bp, Homo sapiens
gaattcacttgtcttccatttt

SEQ ID NO: 7759887 - DNA, 20 bp, Homo sapiens
gatacacagcacagagggcc

SEQ ID NO: 7759888 - DNA, 22 bp, Homo sapiens
gattcactcatattttacgttt

SEQ ID NO: 7759889 - DNA, 16 bp, Homo sapiens
gcacacacatcaatga

SEQ ID NO: 7759890 - DNA, 22 bp, Homo sapiens
gcacacacatgtgagtacatgc

SEQ ID NO: 7759891 - DNA, 22 bp, Homo sapiens
gcctgtgtggatgcgccggtgc

SEQ ID NO: 7759892 - DNA, 22 bp, Homo sapiens
gctcagaaaagtgaggctcagt

SEQ ID NO: 7759893 - DNA, 22 bp, Homo sapiens
ggcacagagctttgtcccagtt

SEQ ID NO: 7759894 - DNA, 22 bp, Homo sapiens
ggcccagcctcagacatgccct

SEQ ID NO: 7759895 - DNA, 22 bp, Homo sapiens
gtacacacaatctctggtcagt

SEQ ID NO: 7759896 - DNA, 21 bp, Homo sapiens
gtacacacaggtggatgggct

SEQ ID NO: 7759897 - DNA, 22 bp, Homo sapiens
gtatactcaacctgcctagaat

SEQ ID NO: 7759898 - DNA, 22 bp, Homo sapiens
gtatactcatgtctcagaggac

SEQ ID NO: 7759899 - DNA, 22 bp, Homo sapiens
gtatggcactatcctctctgat

SEQ ID NO: 7759900 - DNA, 21 bp, Homo sapiens
gtatggcattgattagttact

SEQ ID NO: 7759901 - DNA, 22 bp, Homo sapiens
gtatgtctatttcaaatagctg

SEQ ID NO: 7759902 - DNA, 22 bp, Homo sapiens
taaagcaggccacatatgtgat

SEQ ID NO: 7759903 - DNA, 22 bp, Homo sapiens
taaatgagggctgacatgattg

SEQ ID NO: 7759904 - DNA, 22 bp, Homo sapiens
taaatgaagaaatggagattgt

SEQ ID NO: 7759905 - DNA, 19 bp, Homo sapiens
tctttcatttctagctctg

SEQ ID NO: 7759906 - DNA, 22 bp, Homo sapiens
taagaacagtagaacagtaggt

SEQ ID NO: 7759907 - DNA, 21 bp, Homo sapiens
tcctgtaagcttgggtggctc

SEQ ID NO: 7759908 - DNA, 22 bp, Homo sapiens
tcgcaccattgcactccagcca

SEQ ID NO: 7759909 - DNA, 22 bp, Homo sapiens
tgcagagaaaactcctgggtac

SEQ ID NO: 7759910 - DNA, 22 bp, Homo sapiens
tgagtagagaattcagctaagg

SEQ ID NO: 7759911 - DNA, 21 bp, Homo sapiens
tgactgaggcttcttcacaca

SEQ ID NO: 7759912 - DNA, 22 bp, Homo sapiens
tgaaaaaacaagttggcccatt

SEQ ID NO: 7759913 - DNA, 22 bp, Homo sapiens
tgaacatgctgttgatggcctg

SEQ ID NO: 7759914 - DNA, 22 bp, Homo sapiens
tgaaataatatctggatcaatc

SEQ ID NO: 7759915 - DNA, 22 bp, Homo sapiens
tggcagagaacacggctgatct

SEQ ID NO: 7759916 - DNA, 22 bp, Homo sapiens
tggcagagagactctccttgat

SEQ ID NO: 7759917 - DNA, 22 bp, Homo sapiens
tggcagagcccagactccagtc

SEQ ID NO: 7759918 - DNA, 22 bp, Homo sapiens
tggcagagagagtgcagtcgac

SEQ ID NO: 7759919 - DNA, 22 bp, Homo sapiens
tggcagagtcatcacatctgga

SEQ ID NO: 7759920 - DNA, 22 bp, Homo sapiens
tggcgtctctcataagtatgtg

SEQ ID NO: 7759921 - DNA, 21 bp, Homo sapiens
tggctaaaccctagtaaatta

SEQ ID NO: 7759922 - DNA, 22 bp, Homo sapiens
tggctaaaccctagtaaattaa

SEQ ID NO: 7759923 - DNA, 22 bp, Homo sapiens
tggctaaacttgggtcagatgt

SEQ ID NO: 7759924 - DNA, 22 bp, Homo sapiens
tgctctgtattctatggcagtt

SEQ ID NO: 7759925 - DNA, 22 bp, Homo sapiens
tgcttaaacatccagacagtat

SEQ ID NO: 7759926 - DNA, 22 bp, Homo sapiens
tggtcctggaaggtcctgaggg

SEQ ID NO: 7759927 - DNA, 22 bp, Homo sapiens
tggtcctgccccgtgcacagag

SEQ ID NO: 7759928 - DNA, 18 bp, Homo sapiens
tgtagagccaggtttgcc

SEQ ID NO: 7759929 - DNA, 22 bp, Homo sapiens
tgtcacttcagttttgaaacaa

SEQ ID NO: 7759930 - DNA, 23 bp, Homo sapiens
tggtataaaaacagtacctacct

SEQ ID NO: 7759931 - DNA, 22 bp, Homo sapiens
tggtataagctgtgtcagagcc

SEQ ID NO: 7759932 - DNA, 22 bp, Homo sapiens
ttaattaaattcatgagcattg

SEQ ID NO: 7759933 - DNA, 22 bp, Homo sapiens
ttaataaagtatgaattggaaa

SEQ ID NO: 7759934 - DNA, 22 bp, Homo sapiens
ttccagcccgcgacttgttcag

SEQ ID NO: 7759935 - DNA, 22 bp, Homo sapiens
ttccagccatggtttccctatg

SEQ ID NO: 7759936 - DNA, 22 bp, Homo sapiens
tgttaaaaattcagctctagat

SEQ ID NO: 7759937 - DNA, 22 bp, Homo sapiens
acaggtcctcaagtcagctggg

SEQ ID NO: 7759938 - DNA, 22 bp, Homo sapiens
acataatgagctctttataaat

SEQ ID NO: 7759939 - DNA, 22 bp, Homo sapiens
actcatgtcctaggagtaaagc

SEQ ID NO: 7759940 - DNA, 22 bp, Homo sapiens
acacacatgcctttcctaagta

SEQ ID NO: 7759941 - DNA, 21 bp, Homo sapiens
acacactgagttttccactgt

SEQ ID NO: 7759942 - DNA, 22 bp, Homo sapiens
acacactcaattgcataagcac

SEQ ID NO: 7759943 - DNA, 21 bp, Homo sapiens
acacactctgagtcttctatt

SEQ ID NO: 7759944 - DNA, 22 bp, Homo sapiens
acacacatggtattgttcagaa

SEQ ID NO: 7759945 - DNA, 22 bp, Homo sapiens
acacactgttgctcatccaggc

SEQ ID NO: 7759946 - DNA, 22 bp, Homo sapiens
acacactgtaaggactatcact

SEQ ID NO: 7759947 - DNA, 22 bp, Homo sapiens
acacactttaaattaaacctct

SEQ ID NO: 7759948 - DNA, 22 bp, Homo sapiens
acacactggcccccagtactga

SEQ ID NO: 7759949 - DNA, 22 bp, Homo sapiens
agcccaggtctggcccagcctg

SEQ ID NO: 7759950 - DNA, 22 bp, Homo sapiens
aattcactccacttctgtgtct

SEQ ID NO: 7759951 - DNA, 22 bp, Homo sapiens
aattcacttgtgcacgctatgg

SEQ ID NO: 7759952 - DNA, 22 bp, Homo sapiens
aacacataggcagagcatgaca

SEQ ID NO: 7759953 - DNA, 22 bp, Homo sapiens
aacacatatttatatatgcaca

SEQ ID NO: 7759954 - DNA, 21 bp, Homo sapiens
aacacatccagagtatttgac

SEQ ID NO: 7759955 - DNA, 22 bp, Homo sapiens
aacaaatgtgttttgtaattaa

SEQ ID NO: 7759956 - DNA, 22 bp, Homo sapiens
acacacatgcatgcttgccatt

SEQ ID NO: 7759957 - DNA, 22 bp, Homo sapiens
acacacaggtaaaggagcctgg

SEQ ID NO: 7759958 - DNA, 22 bp, Homo sapiens
acacacagaaggaagccccact

SEQ ID NO: 7759959 - DNA, 22 bp, Homo sapiens
acacacagagtttatacaggca

SEQ ID NO: 7759960 - DNA, 22 bp, Homo sapiens
acacacagcgcctaccatgtgc

SEQ ID NO: 7759961 - DNA, 22 bp, Homo sapiens
aactcccactcagcttcttaat

SEQ ID NO: 7759962 - DNA, 22 bp, Homo sapiens
caatactgagtttacattcatc

SEQ ID NO: 7759963 - DNA, 22 bp, Homo sapiens
agcactgtgatttataacattt

SEQ ID NO: 7759964 - DNA, 22 bp, Homo sapiens
agagtcccagggacactccaga

SEQ ID NO: 7759965 - DNA, 22 bp, Homo sapiens
agatcactggttacttaatgaa

SEQ ID NO: 7759966 - DNA, 22 bp, Homo sapiens
acatacacatgaatatattttt

SEQ ID NO: 7759967 - DNA, 22 bp, Homo sapiens
acatacacaagcgtacatgaac

SEQ ID NO: 7759968 - DNA, 23 bp, Homo sapiens
acatacatggagataaagtgatg

SEQ ID NO: 7759969 - DNA, 21 bp, Homo sapiens
acatacataccttaccacctt

SEQ ID NO: 7759970 - DNA, 20 bp, Homo sapiens
accccacagagtccattgca

SEQ ID NO: 7759971 - DNA, 19 bp, Homo sapiens
acattcccatcagcaatgt

SEQ ID NO: 7759972 - DNA, 22 bp, Homo sapiens
actgccaatggtagtttgatgg

SEQ ID NO: 7759973 - DNA, 22 bp, Homo sapiens
actgagagtcaagatagcatgg

SEQ ID NO: 7759974 - DNA, 22 bp, Homo sapiens
actgcactcctgcctgggtaac

SEQ ID NO: 7759975 - DNA, 22 bp, Homo sapiens
atcagtagtgtgaaaacagact

SEQ ID NO: 7759976 - DNA, 22 bp, Homo sapiens
atccccacgatatagccaaagc

SEQ ID NO: 7759977 - DNA, 22 bp, Homo sapiens
atcccacacccctacaacatat

SEQ ID NO: 7759978 - DNA, 21 bp, Homo sapiens
actttaatatacatgaggagg

SEQ ID NO: 7759979 - DNA, 22 bp, Homo sapiens
atcacagagattgcttttaaaa

SEQ ID NO: 7759980 - DNA, 22 bp, Homo sapiens
atcacagagctcccttccactg

SEQ ID NO: 7759981 - DNA, 22 bp, Homo sapiens
atcacaatgtacgttaaaatgt

SEQ ID NO: 7759982 - DNA, 20 bp, Homo sapiens
atacacatgcagacagatgc

SEQ ID NO: 7759983 - DNA, 22 bp, Homo sapiens
ctggcctcagagggtcatggtg

SEQ ID NO: 7759984 - DNA, 22 bp, Homo sapiens
catcagaaggaaggacgattat

SEQ ID NO: 7759985 - DNA, 22 bp, Homo sapiens
catcagaacaaatcggttaaga

SEQ ID NO: 7759986 - DNA, 22 bp, Homo sapiens
gcacacaggggagttctcagaa

SEQ ID NO: 7759987 - DNA, 22 bp, Homo sapiens
gcattcattcattcattaggta

SEQ ID NO: 7759988 - DNA, 22 bp, Homo sapiens
gcattcatcttcctccatgcag

SEQ ID NO: 7759989 - DNA, 22 bp, Homo sapiens
gcattcatcaaaaatgttcctc

SEQ ID NO: 7759990 - DNA, 22 bp, Homo sapiens
attgtaaagtactgtgtacaat

SEQ ID NO: 7759991 - DNA, 22 bp, Homo sapiens
gcccagccacagtcactttcat

SEQ ID NO: 7759992 - DNA, 22 bp, Homo sapiens
gacccggctccaggcccagcag

SEQ ID NO: 7759993 - DNA, 22 bp, Homo sapiens
atgaatgaataccatgcaacta

SEQ ID NO: 7759994 - DNA, 22 bp, Homo sapiens
atgaatgaaatacagagtactt

SEQ ID NO: 7759995 - DNA, 21 bp, Homo sapiens
atgaatgatttctactcttaa

SEQ ID NO: 7759996 - DNA, 22 bp, Homo sapiens
atgaatgatttgtcagtcacag

SEQ ID NO: 7759997 - DNA, 22 bp, Homo sapiens
atgaatgattttatgtaaatga

SEQ ID NO: 7759998 - DNA, 22 bp, Homo sapiens
atgaatgagattaccaatgtga

SEQ ID NO: 7759999 - DNA, 22 bp, Homo sapiens
atgaatgatgcaaaagacactg

SEQ ID NO: 7760000 - DNA, 22 bp, Homo sapiens
atgaatgattaaagagtacagt

SEQ ID NO: 7760001 - DNA, 22 bp, Homo sapiens
gtcctctgttagaaatgtgctt

SEQ ID NO: 7760002 - DNA, 22 bp, Homo sapiens
gtcctctgtttccatctgactt

SEQ ID NO: 7760003 - DNA, 22 bp, Homo sapiens
gtcctctgtgtaggctgcagac

SEQ ID NO: 7760004 - DNA, 22 bp, Homo sapiens
cactgtccctgtttcctggaaa

SEQ ID NO: 7760005 - DNA, 22 bp, Homo sapiens
cactgtccatgcttgctaaccc

SEQ ID NO: 7760006 - DNA, 22 bp, Homo sapiens
cactgtccaatagatacataat

SEQ ID NO: 7760007 - DNA, 22 bp, Homo sapiens
cacagagacagaagcacttatg

SEQ ID NO: 7760008 - DNA, 22 bp, Homo sapiens
tattcccattccacttatcaag

SEQ ID NO: 7760009 - DNA, 22 bp, Homo sapiens
tattcccagcctctttctatct

SEQ ID NO: 7760010 - DNA, 22 bp, Homo sapiens
tattccctatttagtaattctg

SEQ ID NO: 7760011 - DNA, 22 bp, Homo sapiens
cagtcccatgagcccagaacat

SEQ ID NO: 7760012 - DNA, 22 bp, Homo sapiens
tcacacatttctcaagtgtagg

SEQ ID NO: 7760013 - DNA, 20 bp, Homo sapiens
tcacacatggtaagctatga

SEQ ID NO: 7760014 - DNA, 22 bp, Homo sapiens
tacacagactcttcaattcaga

SEQ ID NO: 7760015 - DNA, 22 bp, Homo sapiens
tacacagatatgtgatcaatca

SEQ ID NO: 7760016 - DNA, 22 bp, Homo sapiens
tacacagaacctggtgtacagt

SEQ ID NO: 7760017 - DNA, 22 bp, Homo sapiens
tacacagatttcagtatcatca

SEQ ID NO: 7760018 - DNA, 22 bp, Homo sapiens
ccaccccaaatgaagacctctc

SEQ ID NO: 7760019 - DNA, 22 bp, Homo sapiens
tcatcacaattttatgaccctc

SEQ ID NO: 7760020 - DNA, 22 bp, Homo sapiens
tcatcacatatgtcatgatttg

SEQ ID NO: 7760021 - DNA, 22 bp, Homo sapiens
tcatcacatgtgtagtcatccc

SEQ ID NO: 7760022 - DNA, 22 bp, Homo sapiens
tcacttatatttcaggagatat

SEQ ID NO: 7760023 - DNA, 22 bp, Homo sapiens
cattacaaccccaaattacaaa

SEQ ID NO: 7760024 - DNA, 22 bp, Homo sapiens
tccaagatctacagcagtttag

SEQ ID NO: 7760025 - DNA, 22 bp, Homo sapiens
tgcagagaagaggacagttcta

SEQ ID NO: 7760026 - DNA, 22 bp, Homo sapiens
tgcagagagacccctgggccag

SEQ ID NO: 7760027 - DNA, 22 bp, Homo sapiens
tgcagagagatcctcagggttt

SEQ ID NO: 7760028 - DNA, 22 bp, Homo sapiens
ccatcacagtccccatcgtgat

SEQ ID NO: 7760029 - DNA, 17 bp, Homo sapiens
ccatactgacatattga

SEQ ID NO: 7760030 - DNA, 22 bp, Homo sapiens
ccatacacacaccaaatttgta

SEQ ID NO: 7760031 - DNA, 22 bp, Homo sapiens
tggcacagtcctgggtgcctgc

SEQ ID NO: 7760032 - DNA, 22 bp, Homo sapiens
tggcagagaacacacatgattc

SEQ ID NO: 7760033 - DNA, 22 bp, Homo sapiens
ttaatgaaaggcagtttggaac

SEQ ID NO: 7760034 - DNA, 22 bp, Homo sapiens
ttaatgaatgtgtgctaacgtt

SEQ ID NO: 7760035 - DNA, 22 bp, Homo sapiens
ttaatgaaacattgactatgat

SEQ ID NO: 7760036 - DNA, 22 bp, Homo sapiens
ccttcttctgtgtggcccaaga

SEQ ID NO: 7760037 - DNA, 22 bp, Homo sapiens
cgcaccactgaattccagcctg

SEQ ID NO: 7760038 - DNA, 22 bp, Homo sapiens
ctcagccccaattctccccatt

SEQ ID NO: 7760039 - DNA, 19 bp, Homo sapiens
ctgagagatgcttcacaca

SEQ ID NO: 7760040 - DNA, 22 bp, Homo sapiens
ctgagagatcaagccacaggat

SEQ ID NO: 7760041 - DNA, 22 bp, Homo sapiens
tttgaagggcacgacaatagtt

SEQ ID NO: 7760042 - DNA, 22 bp, Homo sapiens
gacacttcacctttcccagcct

SEQ ID NO: 7760043 - DNA, 22 bp, Homo sapiens
gaatgacgccctgtggtcactt

SEQ ID NO: 7760044 - DNA, 22 bp, Homo sapiens
gagacctcttggtatcgctagg

SEQ ID NO: 7760045 - DNA, 22 bp, Homo sapiens
cttacacagtctggcacttctt

SEQ ID NO: 7760046 - DNA, 22 bp, Homo sapiens
gtcctctgatttctaggtatat

SEQ ID NO: 7760047 - DNA, 22 bp, Homo sapiens
gtcctctgagggggctgcacgc

SEQ ID NO: 7760048 - DNA, 22 bp, Homo sapiens
gtcctctgcccaggtcaaggtt

SEQ ID NO: 7760049 - DNA, 22 bp, Homo sapiens
gtcctctgactcagccttggga

SEQ ID NO: 7760050 - DNA, 22 bp, Homo sapiens
gtcctctgaaagatgaaccatg

SEQ ID NO: 7760051 - DNA, 22 bp, Homo sapiens
gtcctctgaagttgtgcaatgc

SEQ ID NO: 7760052 - DNA, 17 bp, Homo sapiens
gtaaggcttgcagatgc

SEQ ID NO: 7760053 - DNA, 22 bp, Homo sapiens
ggtcagcagtttctttgaattt

SEQ ID NO: 7760054 - DNA, 23 bp, Homo sapiens
ggacacatttatttcagaattca

SEQ ID NO: 7760055 - DNA, 22 bp, Homo sapiens
tacacatcactgtatctttcag

SEQ ID NO: 7760056 - DNA, 22 bp, Homo sapiens
tacacatctctgtcagtagtga

SEQ ID NO: 7760057 - DNA, 22 bp, Homo sapiens
tacacatcccagactcccagga

SEQ ID NO: 7760058 - DNA, 22 bp, Homo sapiens
tacacatccatgttttgacttt

SEQ ID NO: 7760059 - DNA, 22 bp, Homo sapiens
tacacatgctcagattcctgtg

SEQ ID NO: 7760060 - DNA, 22 bp, Homo sapiens
taatgaggaaatagagggaatg

SEQ ID NO: 7760061 - DNA, 22 bp, Homo sapiens
taatgaggcatttgagtcacct

SEQ ID NO: 7760062 - DNA, 22 bp, Homo sapiens
taatgaggcaagagtcatggct

SEQ ID NO: 7760063 - DNA, 22 bp, Homo sapiens
taatgaggtgatgactaaggtc

SEQ ID NO: 7760064 - DNA, 22 bp, Homo sapiens
tactgacacaaagccaatccct

SEQ ID NO: 7760065 - DNA, 19 bp, Homo sapiens
tacattccacacaatctct

SEQ ID NO: 7760066 - DNA, 22 bp, Homo sapiens
tattcactttgggagagccatt

SEQ ID NO: 7760067 - DNA, 22 bp, Homo sapiens
tattcactgtaactcagcaata

SEQ ID NO: 7760068 - DNA, 22 bp, Homo sapiens
tatactctgagaaacgtgtcac

SEQ ID NO: 7760069 - DNA, 22 bp, Homo sapiens
tagcaaaaactgcagttacttt

SEQ ID NO: 7760070 - DNA, 22 bp, Homo sapiens
tccacacacatttctatgtgca

SEQ ID NO: 7760071 - DNA, 22 bp, Homo sapiens
tcccacatatgcaatcctgaat

SEQ ID NO: 7760072 - DNA, 22 bp, Homo sapiens
tcacacagctgacagagccttt

SEQ ID NO: 7760073 - DNA, 22 bp, Homo sapiens
tcacacagctcctttccttagt

SEQ ID NO: 7760074 - DNA, 22 bp, Homo sapiens
tcacacacataatctaagatta

SEQ ID NO: 7760075 - DNA, 22 bp, Homo sapiens
tcacacacatggatagtatttt

SEQ ID NO: 7760076 - DNA, 22 bp, Homo sapiens
tcacacacatttgctgtctgat

SEQ ID NO: 7760077 - DNA, 21 bp, Homo sapiens
tcacacacgtttccaagggca

SEQ ID NO: 7760078 - DNA, 16 bp, Homo sapiens
tcacatacttccttgc

SEQ ID NO: 7760079 - DNA, 22 bp, Homo sapiens
ttccctctgcgcattgaatttc

SEQ ID NO: 7760080 - DNA, 21 bp, Homo sapiens
ttcatcagccagaaatcaagc

SEQ ID NO: 7760081 - DNA, 22 bp, Homo sapiens
ttcatagaagcagaaagtaaac

SEQ ID NO: 7760082 - DNA, 22 bp, Homo sapiens
ttatttaatgtgatctgaagag

SEQ ID NO: 7760083 - DNA, 21 bp, Homo sapiens
tttcagtgtatgacagtgaaa

SEQ ID NO: 7760084 - DNA, 22 bp, Homo sapiens
acaaatgactatttggtacagg

SEQ ID NO: 7760085 - DNA, 22 bp, Homo sapiens
acaaatgactcaaacaccactt

SEQ ID NO: 7760086 - DNA, 19 bp, Homo sapiens
acaaatgatgttgcactga

SEQ ID NO: 7760087 - DNA, 23 bp, Homo sapiens
acactgtctcatggatagactgc

SEQ ID NO: 7760088 - DNA, 19 bp, Homo sapiens
acacatttgcacaatccac

SEQ ID NO: 7760089 - DNA, 22 bp, Homo sapiens
acacatttgcataatacctcat

SEQ ID NO: 7760090 - DNA, 22 bp, Homo sapiens
acaattctgatggtttcccagt

SEQ ID NO: 7760091 - DNA, 22 bp, Homo sapiens
acacataagaaactacaaagag

SEQ ID NO: 7760092 - DNA, 22 bp, Homo sapiens
aatgaacacatgtggtcagttt

SEQ ID NO: 7760093 - DNA, 22 bp, Homo sapiens
aatgaacatcaaatgcctacca

SEQ ID NO: 7760094 - DNA, 22 bp, Homo sapiens
aatgaacatgggagtactaata

SEQ ID NO: 7760095 - DNA, 22 bp, Homo sapiens
aatgaacagatacacataggca

SEQ ID NO: 7760096 - DNA, 22 bp, Homo sapiens
aaattacagatcaccaatgcat

SEQ ID NO: 7760097 - DNA, 22 bp, Homo sapiens
aacaaatggaacacaaatcttt

SEQ ID NO: 7760098 - DNA, 22 bp, Homo sapiens
cacacacagttttgtattctgt

SEQ ID NO: 7760099 - DNA, 22 bp, Homo sapiens
cacacactcttcctggcaccta

SEQ ID NO: 7760100 - DNA, 22 bp, Homo sapiens
cacacactgacaccttatcttg

SEQ ID NO: 7760101 - DNA, 22 bp, Homo sapiens
cacacactggagcaaggagatg

SEQ ID NO: 7760102 - DNA, 22 bp, Homo sapiens
cacacactgttaatgtaggagt

SEQ ID NO: 7760103 - DNA, 22 bp, Homo sapiens
cagaatgtagatcatcatcaag

SEQ ID NO: 7760104 - DNA, 22 bp, Homo sapiens
atgaacaacttgaagctccatg

SEQ ID NO: 7760105 - DNA, 22 bp, Homo sapiens
attcatttagagggattaagca

SEQ ID NO: 7760106 - DNA, 23 bp, Homo sapiens
attattaaggacatggactttgt

SEQ ID NO: 7760107 - DNA, 22 bp, Homo sapiens
ataatggccgggggctgaatgc

SEQ ID NO: 7760108 - DNA, 22 bp, Homo sapiens
actgtattggttttctattgct

SEQ ID NO: 7760109 - DNA, 22 bp, Homo sapiens
actttcatttgtgaagactgta

SEQ ID NO: 7760110 - DNA, 22 bp, Homo sapiens
actttcatgctctgagcactgg

SEQ ID NO: 7760111 - DNA, 22 bp, Homo sapiens
actttcatggatctctgttcag

SEQ ID NO: 7760112 - DNA, 22 bp, Homo sapiens
atatggcaaaggggaattaagg

SEQ ID NO: 7760113 - DNA, 22 bp, Homo sapiens
acatcacacgccttccaggagg

SEQ ID NO: 7760114 - DNA, 22 bp, Homo sapiens
acatcacagagcccagataaag

SEQ ID NO: 7760115 - DNA, 22 bp, Homo sapiens
acatcacagtagttaagccaga

SEQ ID NO: 7760116 - DNA, 22 bp, Homo sapiens
acatgccatcactttcattcct

SEQ ID NO: 7760117 - DNA, 22 bp, Homo sapiens
acatgccaatttggttagttca

SEQ ID NO: 7760118 - DNA, 22 bp, Homo sapiens
aggacacacagaatacaaatcc

SEQ ID NO: 7760119 - DNA, 22 bp, Homo sapiens
acagttcccgtcttgcacagct

SEQ ID NO: 7760120 - DNA, 22 bp, Homo sapiens
cgcgaggtggaggttgcagtga

SEQ ID NO: 7760121 - DNA, 22 bp, Homo sapiens
atacatgactcacacattctgc

SEQ ID NO: 7760122 - DNA, 22 bp, Homo sapiens
atagggcctaaaaagtattgct

SEQ ID NO: 7760123 - DNA, 22 bp, Homo sapiens
atatcagtatctatgtatttgt

SEQ ID NO: 7760124 - DNA, 22 bp, Homo sapiens
atctcccagccacagcattctt

SEQ ID NO: 7760125 - DNA, 22 bp, Homo sapiens
attttcatgactaccttaaata

SEQ ID NO: 7760126 - DNA, 22 bp, Homo sapiens
attccacacagtaatactcaat

SEQ ID NO: 7760127 - DNA, 22 bp, Homo sapiens
attccacagctacatcaatcta

SEQ ID NO: 7760128 - DNA, 22 bp, Homo sapiens
gcacacagctagattaccattc

SEQ ID NO: 7760129 - DNA, 22 bp, Homo sapiens
gcacacaggcagtttccagcca

SEQ ID NO: 7760130 - DNA, 22 bp, Homo sapiens
gatggcaggtagtggtctcatc

SEQ ID NO: 7760131 - DNA, 22 bp, Homo sapiens
atggcagacgaggcagcagggg

SEQ ID NO: 7760132 - DNA, 22 bp, Homo sapiens
atggcagacctcctggccacaa

SEQ ID NO: 7760133 - DNA, 22 bp, Homo sapiens
ctttacttcagcaagctttcct

SEQ ID NO: 7760134 - DNA, 22 bp, Homo sapiens
gggtaaatctcttttcatggct

SEQ ID NO: 7760135 - DNA, 22 bp, Homo sapiens
gtacacactgtttgatcatttc

SEQ ID NO: 7760136 - DNA, 22 bp, Homo sapiens
gtacacactatttaaagtgttt

SEQ ID NO: 7760137 - DNA, 22 bp, Homo sapiens
gtacacactatgtattgtacac

SEQ ID NO: 7760138 - DNA, 22 bp, Homo sapiens
gtagaaaaagcagtaagtctca

SEQ ID NO: 7760139 - DNA, 22 bp, Homo sapiens
gtcacacagggcctccaaatca

SEQ ID NO: 7760140 - DNA, 22 bp, Homo sapiens
cacattcctggtgctcagcagc

SEQ ID NO: 7760141 - DNA, 22 bp, Homo sapiens
cactgcactccagcctgggaga

SEQ ID NO: 7760142 - DNA, 21 bp, Homo sapiens
cactccacttagaacagggtt

SEQ ID NO: 7760143 - DNA, 22 bp, Homo sapiens
cactgcactccagcctgggtca

SEQ ID NO: 7760144 - DNA, 22 bp, Homo sapiens
cactgcactccagcctgggtga

SEQ ID NO: 7760145 - DNA, 21 bp, Homo sapiens
cacacagtgatctatccacat

SEQ ID NO: 7760146 - DNA, 22 bp, Homo sapiens
cacacagtaggcactcattaat

SEQ ID NO: 7760147 - DNA, 20 bp, Homo sapiens
cacaactgtccacatgctcc

SEQ ID NO: 7760148 - DNA, 22 bp, Homo sapiens
tatcagtgtggtttctggactg

SEQ ID NO: 7760149 - DNA, 22 bp, Homo sapiens
tcattcatctggtgttagtcct

SEQ ID NO: 7760150 - DNA, 22 bp, Homo sapiens
cattcatttatgaaatatctat

SEQ ID NO: 7760151 - DNA, 22 bp, Homo sapiens
cattcattcacattttgtctat

SEQ ID NO: 7760152 - DNA, 22 bp, Homo sapiens
cattcattcagcaactgttatt

SEQ ID NO: 7760153 - DNA, 22 bp, Homo sapiens
cattcattctgtaagtaactat

SEQ ID NO: 7760154 - DNA, 22 bp, Homo sapiens
cattcatttactttcaacagct

SEQ ID NO: 7760155 - DNA, 22 bp, Homo sapiens
cattcattagaatagatatgta

SEQ ID NO: 7760156 - DNA, 22 bp, Homo sapiens
cattcattacactcataaggtt

SEQ ID NO: 7760157 - DNA, 22 bp, Homo sapiens
tctccacactttctctcccagg

SEQ ID NO: 7760158 - DNA, 22 bp, Homo sapiens
tgtaagtagtaatggaaggaca

SEQ ID NO: 7760159 - DNA, 22 bp, Homo sapiens
cccagcatgcacgctgacactc

SEQ ID NO: 7760160 - DNA, 22 bp, Homo sapiens
cccagcccccgagtgtctggaa

SEQ ID NO: 7760161 - DNA, 22 bp, Homo sapiens
cccacactctgagaaatgctga

SEQ ID NO: 7760162 - DNA, 22 bp, Homo sapiens
tgagagtctgttcctcttgcag

SEQ ID NO: 7760163 - DNA, 22 bp, Homo sapiens
tgagagtctcagacctcctggt

SEQ ID NO: 7760164 - DNA, 22 bp, Homo sapiens
cgctgataaacgtcacgttccc

SEQ ID NO: 7760165 - DNA, 22 bp, Homo sapiens
ccttttctgaaccacttaaata

SEQ ID NO: 7760166 - DNA, 22 bp, Homo sapiens
ccttttctaatcttaagaatgt

SEQ ID NO: 7760167 - DNA, 22 bp, Homo sapiens
cggaggttgaggctgcagtgag

SEQ ID NO: 7760168 - DNA, 22 bp, Homo sapiens
ttaaattccagcctcataatag

SEQ ID NO: 7760169 - DNA, 22 bp, Homo sapiens
gacaaatgagtctcatacccgg

SEQ ID NO: 7760170 - DNA, 22 bp, Homo sapiens
gacaaatgaagtcactgacctt

SEQ ID NO: 7760171 - DNA, 22 bp, Homo sapiens
gacaaatgaatgatgaacacca

SEQ ID NO: 7760172 - DNA, 22 bp, Homo sapiens
gcccacaccatttattctttgt

SEQ ID NO: 7760173 - DNA, 22 bp, Homo sapiens
gcccacacagcagatcctttgg

SEQ ID NO: 7760174 - DNA, 22 bp, Homo sapiens
gcccacacaccagctcaggagg

SEQ ID NO: 7760175 - DNA, 22 bp, Homo sapiens
ggcagtgagaggtctcctggtc

SEQ ID NO: 7760176 - DNA, 18 bp, Homo sapiens
ggcctctggactggcagc

SEQ ID NO: 7760177 - DNA, 22 bp, Homo sapiens
ggcccagcgaggccacctacag

SEQ ID NO: 7760178 - DNA, 21 bp, Homo sapiens
gggcagaggggcctcctgggt

SEQ ID NO: 7760179 - DNA, 22 bp, Homo sapiens
ggtccccgtggaggctggagcg

SEQ ID NO: 7760180 - DNA, 23 bp, Homo sapiens
gtcctctggagagaaaggcagta

SEQ ID NO: 7760181 - DNA, 22 bp, Homo sapiens
gtcctctggaggtttttaggtg

SEQ ID NO: 7760182 - DNA, 22 bp, Homo sapiens
gtcctctggcctttcccaggac

SEQ ID NO: 7760183 - DNA, 22 bp, Homo sapiens
gtcctctgggagccttgagcct

SEQ ID NO: 7760184 - DNA, 22 bp, Homo sapiens
gtcctctgggcagctgccccac

SEQ ID NO: 7760185 - DNA, 22 bp, Homo sapiens
gtcctctgcttcatgccctgat

SEQ ID NO: 7760186 - DNA, 22 bp, Homo sapiens
gtcctctggaagatgagttctt

SEQ ID NO: 7760187 - DNA, 22 bp, Homo sapiens
gtcctctggtgaaagcattccc

SEQ ID NO: 7760188 - DNA, 22 bp, Homo sapiens
gtcctctgggctttgagcagtc

SEQ ID NO: 7760189 - DNA, 22 bp, Homo sapiens
gtcctctgtccctggggcacgg

SEQ ID NO: 7760190 - DNA, 22 bp, Homo sapiens
gtcctctgtagggctgggccac

SEQ ID NO: 7760191 - DNA, 22 bp, Homo sapiens
gtaggtcagacataagaggaca

SEQ ID NO: 7760192 - DNA, 22 bp, Homo sapiens
gtagttctgcagtgtcacctga

SEQ ID NO: 7760193 - DNA, 22 bp, Homo sapiens
gtgaaaaatgatttgttaactg

SEQ ID NO: 7760194 - DNA, 22 bp, Homo sapiens
tcagtattcctggaaatacaag

SEQ ID NO: 7760195 - DNA, 22 bp, Homo sapiens
tcacatactgaaagtccagtga

SEQ ID NO: 7760196 - DNA, 22 bp, Homo sapiens
tcacataaatttaccagatgat

SEQ ID NO: 7760197 - DNA, 22 bp, Homo sapiens
tcacatacactaggatattttt

SEQ ID NO: 7760198 - DNA, 23 bp, Homo sapiens
tcacataatccttcatccacagg

SEQ ID NO: 7760199 - DNA, 22 bp, Homo sapiens
tcaagaaactgtgctacagagt

SEQ ID NO: 7760200 - DNA, 22 bp, Homo sapiens
tcaaatgagtgactcacacagg

SEQ ID NO: 7760201 - DNA, 22 bp, Homo sapiens
tcaaatgaggctgatgaatgtg

SEQ ID NO: 7760202 - DNA, 22 bp, Homo sapiens
tcactgcaacctccacctcccg

SEQ ID NO: 7760203 - DNA, 22 bp, Homo sapiens
tcactgcaacctccacctcctg

SEQ ID NO: 7760204 - DNA, 22 bp, Homo sapiens
tcagaattggacaatagaagca

SEQ ID NO: 7760205 - DNA, 22 bp, Homo sapiens
tcccagcctggaccctgccagt

SEQ ID NO: 7760206 - DNA, 22 bp, Homo sapiens
tacacaactgacaaccattctg

SEQ ID NO: 7760207 - DNA, 22 bp, Homo sapiens
tacacacatgcatttgccttat

SEQ ID NO: 7760208 - DNA, 22 bp, Homo sapiens
tacacacttactggagatgaag

SEQ ID NO: 7760209 - DNA, 22 bp, Homo sapiens
tacacacagaggccatgggatt

SEQ ID NO: 7760210 - DNA, 22 bp, Homo sapiens
tatgtaaagtagatggcaggta

SEQ ID NO: 7760211 - DNA, 22 bp, Homo sapiens
tcaaatgaagacagttgacttg

SEQ ID NO: 7760212 - DNA, 22 bp, Homo sapiens
ttcattttctttcacgctgctg

SEQ ID NO: 7760213 - DNA, 21 bp, Homo sapiens
ttctctccatatgcccagccc

SEQ ID NO: 7760214 - DNA, 22 bp, Homo sapiens
ttgaaatatttgggagtgtttg

SEQ ID NO: 7760215 - DNA, 22 bp, Homo sapiens
tttaatgatagctgtttcacat

SEQ ID NO: 7760216 - DNA, 23 bp, Homo sapiens
tttaatgaccaatagaaggaaca

SEQ ID NO: 7760217 - DNA, 22 bp, Homo sapiens
ttgtaaactgctgcaggagtgc

SEQ ID NO: 7760218 - DNA, 22 bp, Homo sapiens
acatcccacagaaacatacata

SEQ ID NO: 7760219 - DNA, 20 bp, Homo sapiens
aataaaagaagccttcaccc

SEQ ID NO: 7760220 - DNA, 18 bp, Homo sapiens
acacacacacctgtgtat

SEQ ID NO: 7760221 - DNA, 22 bp, Homo sapiens
acacacacaagcaggttgtgga

SEQ ID NO: 7760222 - DNA, 22 bp, Homo sapiens
acacatctcaggggacactctc

SEQ ID NO: 7760223 - DNA, 22 bp, Homo sapiens
acacatcatgccaagtttcacc

SEQ ID NO: 7760224 - DNA, 22 bp, Homo sapiens
acacatcagaaatatgaatgag

SEQ ID NO: 7760225 - DNA, 22 bp, Homo sapiens
acacagagccaaaccatatcac

SEQ ID NO: 7760226 - DNA, 22 bp, Homo sapiens
acaaatccagtgaactccagtg

SEQ ID NO: 7760227 - DNA, 22 bp, Homo sapiens
acaaatgaacctgaaatctcag

SEQ ID NO: 7760228 - DNA, 22 bp, Homo sapiens
acagactggcctgtctcgcacc

SEQ ID NO: 7760229 - DNA, 22 bp, Homo sapiens
acacataagcctaatcatctcc

SEQ ID NO: 7760230 - DNA, 22 bp, Homo sapiens
acacatacatggggaagatgag

SEQ ID NO: 7760231 - DNA, 21 bp, Homo sapiens
aaagcagcccatggcacagtc

SEQ ID NO: 7760232 - DNA, 22 bp, Homo sapiens
aaagcagcggtgtctttactgc

SEQ ID NO: 7760233 - DNA, 22 bp, Homo sapiens
aaagcagctgatctcagagcct

SEQ ID NO: 7760234 - DNA, 22 bp, Homo sapiens
aaatgaacatcaagaatagcct

SEQ ID NO: 7760235 - DNA, 22 bp, Homo sapiens
aaatgaactcaatgatctccca

SEQ ID NO: 7760236 - DNA, 22 bp, Homo sapiens
aagagagaactcccttcgccag

SEQ ID NO: 7760237 - DNA, 22 bp, Homo sapiens
aagagagagtgcgctcacagaa

SEQ ID NO: 7760238 - DNA, 22 bp, Homo sapiens
aaatgaacagttgcattctctg

SEQ ID NO: 7760239 - DNA, 22 bp, Homo sapiens
aaagcagcaacgtgcatataac

SEQ ID NO: 7760240 - DNA, 22 bp, Homo sapiens
aaagcagcacatggatatcagt

SEQ ID NO: 7760241 - DNA, 22 bp, Homo sapiens
agaggccggccgagcccatggg

SEQ ID NO: 7760242 - DNA, 22 bp, Homo sapiens
attttgttatagaactctgtga

SEQ ID NO: 7760243 - DNA, 22 bp, Homo sapiens
attttgttatcagggctttgca

SEQ ID NO: 7760244 - DNA, 22 bp, Homo sapiens
cagcccaaagccccaggctaga

SEQ ID NO: 7760245 - DNA, 22 bp, Homo sapiens
cagcccaggtctctcttccagt

SEQ ID NO: 7760246 - DNA, 22 bp, Homo sapiens
cacacatcaacctagacattgt

SEQ ID NO: 7760247 - DNA, 22 bp, Homo sapiens
cacacatcttatcccagttatt

SEQ ID NO: 7760248 - DNA, 22 bp, Homo sapiens
cacacagaaccgctcgccactt

SEQ ID NO: 7760249 - DNA, 22 bp, Homo sapiens
cactgcactccagcccgggcaa

SEQ ID NO: 7760250 - DNA, 22 bp, Homo sapiens
cactgcactccatcctgggaaa

SEQ ID NO: 7760251 - DNA, 22 bp, Homo sapiens
cactgcacttcagcctgggtga

SEQ ID NO: 7760252 - DNA, 22 bp, Homo sapiens
acatctgaggagaccagcctct

SEQ ID NO: 7760253 - DNA, 22 bp, Homo sapiens
atacacactgctatcctttttt

SEQ ID NO: 7760254 - DNA, 22 bp, Homo sapiens
agttcactctttatgagaaagt

SEQ ID NO: 7760255 - DNA, 22 bp, Homo sapiens
cccacacaaatcatggggagaa

SEQ ID NO: 7760256 - DNA, 22 bp, Homo sapiens
cccacacacatttatgatagga

SEQ ID NO: 7760257 - DNA, 22 bp, Homo sapiens
cccacacactggctgctgccaa

SEQ ID NO: 7760258 - DNA, 20 bp, Homo sapiens
cccacacccttcccacttgg

SEQ ID NO: 7760259 - DNA, 22 bp, Homo sapiens
cccacacatttttcacttaccg

SEQ ID NO: 7760260 - DNA, 18 bp, Homo sapiens
cccacacagcagtagctc

SEQ ID NO: 7760261 - DNA, 22 bp, Homo sapiens
cccaccctgggctacacatcca

SEQ ID NO: 7760262 - DNA, 22 bp, Homo sapiens
ccacagaccttggcttccacct

SEQ ID NO: 7760263 - DNA, 22 bp, Homo sapiens
ccacatcatggatacagttatg

SEQ ID NO: 7760264 - DNA, 22 bp, Homo sapiens
ccacatacaaatggggtgctgt

SEQ ID NO: 7760265 - DNA, 21 bp, Homo sapiens
ccactcatgactccactcacc

SEQ ID NO: 7760266 - DNA, 22 bp, Homo sapiens
cgcagcttcagggccaggaggg

SEQ ID NO: 7760267 - DNA, 22 bp, Homo sapiens
atacattcaaaggaaggataga

SEQ ID NO: 7760268 - DNA, 22 bp, Homo sapiens
cttcctctagcctagtaatgcc

SEQ ID NO: 7760269 - DNA, 17 bp, Homo sapiens
cttcccaccatctcctg

SEQ ID NO: 7760270 - DNA, 22 bp, Homo sapiens
cttcccactagtatcacagagc

SEQ ID NO: 7760271 - DNA, 22 bp, Homo sapiens
atcagaattagccagtgaggct

SEQ ID NO: 7760272 - DNA, 22 bp, Homo sapiens
atcagaatgcagccagcagtta

SEQ ID NO: 7760273 - DNA, 22 bp, Homo sapiens
atcagaatgattagtaaccaat

SEQ ID NO: 7760274 - DNA, 22 bp, Homo sapiens
atcagaatcttctgaacagtgg

SEQ ID NO: 7760275 - DNA, 22 bp, Homo sapiens
atcagaataattagatttcaga

SEQ ID NO: 7760276 - DNA, 22 bp, Homo sapiens
atcagaatactatcaacagtga

SEQ ID NO: 7760277 - DNA, 22 bp, Homo sapiens
atcagaaatagtcatgttactt

SEQ ID NO: 7760278 - DNA, 22 bp, Homo sapiens
atcagaaagttcatcatgtttg

SEQ ID NO: 7760279 - DNA, 22 bp, Homo sapiens
atcagaaaaacataatgttatt

SEQ ID NO: 7760280 - DNA, 18 bp, Homo sapiens
gacacatccccaggcctc

SEQ ID NO: 7760281 - DNA, 22 bp, Homo sapiens
gacacatatgcgtatagtttag

SEQ ID NO: 7760282 - DNA, 22 bp, Homo sapiens
gacacatagatctatctcactc

SEQ ID NO: 7760283 - DNA, 22 bp, Homo sapiens
atgttggagtcgtaaggcatgg

SEQ ID NO: 7760284 - DNA, 22 bp, Homo sapiens
atgtttaaagggttgagaaata

SEQ ID NO: 7760285 - DNA, 22 bp, Homo sapiens
gataatggggaatgataagtca

SEQ ID NO: 7760286 - DNA, 22 bp, Homo sapiens
gagacatcataatgaagtttcc

SEQ ID NO: 7760287 - DNA, 17 bp, Homo sapiens
gcatcacagataacacg

SEQ ID NO: 7760288 - DNA, 22 bp, Homo sapiens
attcacctttccccaaaatgag

SEQ ID NO: 7760289 - DNA, 22 bp, Homo sapiens
caaatactacgattcttgcagt

SEQ ID NO: 7760290 - DNA, 22 bp, Homo sapiens
attttactttgtgaatattgac

SEQ ID NO: 7760291 - DNA, 22 bp, Homo sapiens
attttgctttatgtaaatatgt

SEQ ID NO: 7760292 - DNA, 15 bp, Homo sapiens
cacacagacagcttg

SEQ ID NO: 7760293 - DNA, 22 bp, Homo sapiens
cacacagacagctctctgaaga

SEQ ID NO: 7760294 - DNA, 22 bp, Homo sapiens
cacacagatggtaagggaggga

SEQ ID NO: 7760295 - DNA, 22 bp, Homo sapiens
cacaattttaatacacagtcaa

SEQ ID NO: 7760296 - DNA, 22 bp, Homo sapiens
caaatgtaattgcggtttttgc

SEQ ID NO: 7760297 - DNA, 22 bp, Homo sapiens
gctttcttttcaagaatgtatt

SEQ ID NO: 7760298 - DNA, 22 bp, Homo sapiens
gctttcttagtgtgttaattgg

SEQ ID NO: 7760299 - DNA, 22 bp, Homo sapiens
cacatacttgtgtgtacatatg

SEQ ID NO: 7760300 - DNA, 22 bp, Homo sapiens
cacatacatacgtatgtataca

SEQ ID NO: 7760301 - DNA, 22 bp, Homo sapiens
cacatactgagaatcacaccca

SEQ ID NO: 7760302 - DNA, 22 bp, Homo sapiens
cacatacattcatgttactcta

SEQ ID NO: 7760303 - DNA, 22 bp, Homo sapiens
cacataagaaatgaatatgaga

SEQ ID NO: 7760304 - DNA, 22 bp, Homo sapiens
cacatacaaggcacactggagg

SEQ ID NO: 7760305 - DNA, 22 bp, Homo sapiens
cagcacagtgaccagacccact

SEQ ID NO: 7760306 - DNA, 22 bp, Homo sapiens
ccccacactctttacattcata

SEQ ID NO: 7760307 - DNA, 22 bp, Homo sapiens
ccccacacctgccgggcagcag

SEQ ID NO: 7760308 - DNA, 20 bp, Homo sapiens
ccccacactattgagcactt

SEQ ID NO: 7760309 - DNA, 22 bp, Homo sapiens
taatgtactgatgggaagtggt

SEQ ID NO: 7760310 - DNA, 22 bp, Homo sapiens
taatgtacctccagatgttgta

SEQ ID NO: 7760311 - DNA, 22 bp, Homo sapiens
tagatacaggctctctgagcct

SEQ ID NO: 7760312 - DNA, 22 bp, Homo sapiens
cagtcacataggtatacacata

SEQ ID NO: 7760313 - DNA, 22 bp, Homo sapiens
cagttttctaaagtctctttaa

SEQ ID NO: 7760314 - DNA, 22 bp, Homo sapiens
cattcatttgcccagtaagtca

SEQ ID NO: 7760315 - DNA, 22 bp, Homo sapiens
tcccacattaccctgactgaca

SEQ ID NO: 7760316 - DNA, 22 bp, Homo sapiens
tcccacatgtgaatcctcaggt

SEQ ID NO: 7760317 - DNA, 22 bp, Homo sapiens
catttaatccatagaggaatgt

SEQ ID NO: 7760318 - DNA, 22 bp, Homo sapiens
ccacactaaactgctcaaacca

SEQ ID NO: 7760319 - DNA, 19 bp, Homo sapiens
ccacacagtgtgcaattta

SEQ ID NO: 7760320 - DNA, 22 bp, Homo sapiens
ccacacagggggatgagttatt

SEQ ID NO: 7760321 - DNA, 22 bp, Homo sapiens
ccacacagtcagtttccaagaa

SEQ ID NO: 7760322 - DNA, 22 bp, Homo sapiens
ctatgagaagaaaacaagatta

SEQ ID NO: 7760323 - DNA, 22 bp, Homo sapiens
ctaaatgacttccagtggttat

SEQ ID NO: 7760324 - DNA, 22 bp, Homo sapiens
cgcatacatagaaacacacaga

SEQ ID NO: 7760325 - DNA, 22 bp, Homo sapiens
ttgaaatagatgcgtcagagat

SEQ ID NO: 7760326 - DNA, 22 bp, Homo sapiens
tttaatagggcccaatgagact

SEQ ID NO: 7760327 - DNA, 22 bp, Homo sapiens
ttttagttactgcagtagcaaa

SEQ ID NO: 7760328 - DNA, 22 bp, Homo sapiens
ctgcatccatgttgctgcaaag

SEQ ID NO: 7760329 - DNA, 22 bp, Homo sapiens
ctttcagttacagttacacaca

SEQ ID NO: 7760330 - DNA, 22 bp, Homo sapiens
gacacagaaggtcacatgttca

SEQ ID NO: 7760331 - DNA, 22 bp, Homo sapiens
gacacagacagttagaggtaat

SEQ ID NO: 7760332 - DNA, 22 bp, Homo sapiens
gacacagaatttactcccgata

SEQ ID NO: 7760333 - DNA, 22 bp, Homo sapiens
gacccatataggaccctccaaa

SEQ ID NO: 7760334 - DNA, 22 bp, Homo sapiens
gtccccgacgtttggcttgatg

SEQ ID NO: 7760335 - DNA, 22 bp, Homo sapiens
gcagctttctgggacagaaagg

SEQ ID NO: 7760336 - DNA, 22 bp, Homo sapiens
gcacatacccactgtcaagcac

SEQ ID NO: 7760337 - DNA, 22 bp, Homo sapiens
gcacatactgcaaagattacta

SEQ ID NO: 7760338 - DNA, 22 bp, Homo sapiens
gcacataactgaccacatctaa

SEQ ID NO: 7760339 - DNA, 22 bp, Homo sapiens
gcacataaagggcatgggaggt

SEQ ID NO: 7760340 - DNA, 22 bp, Homo sapiens
gcagacttataatctgtcccag

SEQ ID NO: 7760341 - DNA, 22 bp, Homo sapiens
gcacacactgttttcctcacat

SEQ ID NO: 7760342 - DNA, 22 bp, Homo sapiens
gcacacagtagggattcaatga

SEQ ID NO: 7760343 - DNA, 22 bp, Homo sapiens
gcacacattcggattcttaacc

SEQ ID NO: 7760344 - DNA, 22 bp, Homo sapiens
gcacacatgcatgcacaggagt

SEQ ID NO: 7760345 - DNA, 22 bp, Homo sapiens
gcacacagtatatgctcattaa

SEQ ID NO: 7760346 - DNA, 22 bp, Homo sapiens
gcccagcctccaagctccaagg

SEQ ID NO: 7760347 - DNA, 22 bp, Homo sapiens
gccccacagcctgcggtctcag

SEQ ID NO: 7760348 - DNA, 22 bp, Homo sapiens
gccacatagaggaggatattaa

SEQ ID NO: 7760349 - DNA, 22 bp, Homo sapiens
gctgctaagcgtttctgttcca

SEQ ID NO: 7760350 - DNA, 22 bp, Homo sapiens
gctttcctggccctgtccctgc

SEQ ID NO: 7760351 - DNA, 22 bp, Homo sapiens
tccccaccccagaactactagg

SEQ ID NO: 7760352 - DNA, 21 bp, Homo sapiens
tccccacatttctaaacagac

SEQ ID NO: 7760353 - DNA, 22 bp, Homo sapiens
tccccacatctctgcatcaggc

SEQ ID NO: 7760354 - DNA, 22 bp, Homo sapiens
tccccacagcagaagatctgag

SEQ ID NO: 7760355 - DNA, 22 bp, Homo sapiens
tccccacactttcactcctggc

SEQ ID NO: 7760356 - DNA, 22 bp, Homo sapiens
tccccacacagatacagagtag

SEQ ID NO: 7760357 - DNA, 22 bp, Homo sapiens
tcccacaggaaagtagacattg

SEQ ID NO: 7760358 - DNA, 22 bp, Homo sapiens
tcccacacttgaaacaaggctg

SEQ ID NO: 7760359 - DNA, 22 bp, Homo sapiens
tcccacactacacggttgttgg

SEQ ID NO: 7760360 - DNA, 22 bp, Homo sapiens
tcccacacctgtctattcctag

SEQ ID NO: 7760361 - DNA, 22 bp, Homo sapiens
tcccacacagcccgctcaccgg

SEQ ID NO: 7760362 - DNA, 22 bp, Homo sapiens
tcatggcacttagcacagtcct

SEQ ID NO: 7760363 - DNA, 22 bp, Homo sapiens
tcacacatgagtaaatacaggg

SEQ ID NO: 7760364 - DNA, 22 bp, Homo sapiens
tcacacatgctaagccagagat

SEQ ID NO: 7760365 - DNA, 22 bp, Homo sapiens
tcactttcctcatcacgactag

SEQ ID NO: 7760366 - DNA, 22 bp, Homo sapiens
taaagggtaggttttactgtaa

SEQ ID NO: 7760367 - DNA, 22 bp, Homo sapiens
taaacagaatgcgtaagaagtg

SEQ ID NO: 7760368 - DNA, 23 bp, Homo sapiens
taaattacctttccagtgcaggg

SEQ ID NO: 7760369 - DNA, 22 bp, Homo sapiens
tacattcctgttagcatctaag

SEQ ID NO: 7760370 - DNA, 22 bp, Homo sapiens
tagacacatcttcatccacaat

SEQ ID NO: 7760371 - DNA, 22 bp, Homo sapiens
tatttataacagtgagaacggg

SEQ ID NO: 7760372 - DNA, 20 bp, Homo sapiens
ttcatgggagcaaagaggcc

SEQ ID NO: 7760373 - DNA, 20 bp, Homo sapiens
ttccacatctttgcacatgc

SEQ ID NO: 7760374 - DNA, 22 bp, Homo sapiens
ttccacattccttacattcata

SEQ ID NO: 7760375 - DNA, 22 bp, Homo sapiens
tgtgtaaaagattagtttacta

SEQ ID NO: 7760376 - DNA, 22 bp, Homo sapiens
tgtggacgtcattaaagcagtg

SEQ ID NO: 7760377 - DNA, 22 bp, Homo sapiens
tgtttaataattctatgatagt

SEQ ID NO: 7760378 - DNA, 22 bp, Homo sapiens
tgtttaatctataaaatggaga

SEQ ID NO: 7760379 - DNA, 22 bp, Homo sapiens
tgtttaattcaccatcatgttc

SEQ ID NO: 7760380 - DNA, 22 bp, Homo sapiens
tgtttaatttcacaaagttgac

SEQ ID NO: 7760381 - DNA, 22 bp, Homo sapiens
tgttatctgagcaacgtcgacg

SEQ ID NO: 7760382 - DNA, 22 bp, Homo sapiens
tttcagtggagtgacatgatct

SEQ ID NO: 7760383 - DNA, 21 bp, Homo sapiens
tttattaacaactgtggacgt

SEQ ID NO: 7760384 - DNA, 22 bp, Homo sapiens
tttattaagatgcgaatgctga

SEQ ID NO: 7760385 - DNA, 22 bp, Homo sapiens
ttgttacaggtcctagtggctg

SEQ ID NO: 7760386 - DNA, 22 bp, Homo sapiens
cagcacagtgaccagacccact

SEQ ID NO: 7760387 - DNA, 22 bp, Homo sapiens
cagcacagtgcagatgctgact

SEQ ID NO: 7760388 - DNA, 22 bp, Homo sapiens
cagcacagtttcccccatgagc

SEQ ID NO: 7760389 - DNA, 22 bp, Homo sapiens
cagcacataagccgaagactgt

SEQ ID NO: 7760390 - DNA, 22 bp, Homo sapiens
ggtgctggacacgtggcactcc

SEQ ID NO: 7760391 - DNA, 22 bp, Homo sapiens
ggtgctgggaacgaggaattca

SEQ ID NO: 7760392 - DNA, 23 bp, Homo sapiens
cagcacagtacatttcctgtctc

SEQ ID NO: 7760393 - DNA, 22 bp, Homo sapiens
ggtgctgacattcagagtctgg

SEQ ID NO: 7760394 - DNA, 22 bp, Homo sapiens
cagcaaatactactagttttta

SEQ ID NO: 7760395 - DNA, 22 bp, Homo sapiens
ggtgacggggcccaggtttcct

SEQ ID NO: 7760396 - DNA, 22 bp, Homo sapiens
ggtgacggggcccaggtttcct

SEQ ID NO: 7760397 - DNA, 22 bp, Homo sapiens
ggtgacgaatccatagcatcga

SEQ ID NO: 7760398 - DNA, 22 bp, Homo sapiens
cagcaagatttttaaagcaagg

SEQ ID NO: 7760399 - DNA, 22 bp, Homo sapiens
cagcaagatggtgaatgagacg

SEQ ID NO: 7760400 - DNA, 22 bp, Homo sapiens
ggtctgctttccttgccactgt

SEQ ID NO: 7760401 - DNA, 22 bp, Homo sapiens
ggtgacctcacctggtcccacc

SEQ ID NO: 7760402 - DNA, 22 bp, Homo sapiens
ggtgacctcacctggtcccacc

SEQ ID NO: 7760403 - DNA, 22 bp, Homo sapiens
ggtctgaggctccaaggaggtg

SEQ ID NO: 7760404 - DNA, 22 bp, Homo sapiens
ggtctgagtagagggctggcga

SEQ ID NO: 7760405 - DNA, 22 bp, Homo sapiens
ggtctgagtagagggctggcga

SEQ ID NO: 7760406 - DNA, 22 bp, Homo sapiens
ggtctgagatatttgttcagct

SEQ ID NO: 7760407 - DNA, 22 bp, Homo sapiens
ggtctgagtgccagggagagaa

SEQ ID NO: 7760408 - DNA, 22 bp, Homo sapiens
ggtcattttcactttcaagtta

SEQ ID NO: 7760409 - DNA, 22 bp, Homo sapiens
ggtccaaggctcggtggcgggg

SEQ ID NO: 7760410 - DNA, 22 bp, Homo sapiens
cagagtcagtattgaattgaaa

SEQ ID NO: 7760411 - DNA, 22 bp, Homo sapiens
cagagtcagtattgaattgaaa

SEQ ID NO: 7760412 - DNA, 22 bp, Homo sapiens
ggtcagtgacttttttctgtgg

SEQ ID NO: 7760413 - DNA, 22 bp, Homo sapiens
ggtcagtgcgatttcccactcc

SEQ ID NO: 7760414 - DNA, 21 bp, Homo sapiens
cagagggtttctcaggtgttt

SEQ ID NO: 7760415 - DNA, 22 bp, Homo sapiens
ggtcacaggggagaagagtgat

SEQ ID NO: 7760416 - DNA, 22 bp, Homo sapiens
ggtcacagggaagggctctcaa

SEQ ID NO: 7760417 - DNA, 22 bp, Homo sapiens
ggggagcaggctgggctgtctg

SEQ ID NO: 7760418 - DNA, 22 bp, Homo sapiens
ggggagcaattgcccccttaga

SEQ ID NO: 7760419 - DNA, 22 bp, Homo sapiens
ggggagcaatagttgaggtgtg

SEQ ID NO: 7760420 - DNA, 22 bp, Homo sapiens
ggggagcaggctgggctgtctg

SEQ ID NO: 7760421 - DNA, 22 bp, Homo sapiens
cagaggcacagtgcgggccact

SEQ ID NO: 7760422 - DNA, 22 bp, Homo sapiens
cagaggcacagtgcgggccact

SEQ ID NO: 7760423 - DNA, 19 bp, Homo sapiens
cagaggcaccaggtataga

SEQ ID NO: 7760424 - DNA, 22 bp, Homo sapiens
cagaggcacaagaaagcaaggc

SEQ ID NO: 7760425 - DNA, 21 bp, Homo sapiens
cagagggccggcatgtggtct

SEQ ID NO: 7760426 - DNA, 22 bp, Homo sapiens
cagagggcgtccgggttaactt

SEQ ID NO: 7760427 - DNA, 22 bp, Homo sapiens
cagagggaaaaggggagtaata

SEQ ID NO: 7760428 - DNA, 22 bp, Homo sapiens
cagagggctcggcggccgctcc

SEQ ID NO: 7760429 - DNA, 22 bp, Homo sapiens
cagagggctgccctgagttcgt

SEQ ID NO: 7760430 - DNA, 22 bp, Homo sapiens
cagagggctgtgtaaggatgtt

SEQ ID NO: 7760431 - DNA, 22 bp, Homo sapiens
cagagggcttcaggttcaggat

SEQ ID NO: 7760432 - DNA, 21 bp, Homo sapiens
cagagggcttttctctgttct

SEQ ID NO: 7760433 - DNA, 21 bp, Homo sapiens
cagagggcttttctctgttct

SEQ ID NO: 7760434 - DNA, 22 bp, Homo sapiens
cagagggtgtgaaggggatgaa

SEQ ID NO: 7760435 - DNA, 23 bp, Homo sapiens
cagagggttccatggagcatggt

SEQ ID NO: 7760436 - DNA, 22 bp, Homo sapiens
cagagggtcaccaggaagtgca

SEQ ID NO: 7760437 - DNA, 22 bp, Homo sapiens
cagagctgggatcccatgggcg

SEQ ID NO: 7760438 - DNA, 22 bp, Homo sapiens
cagagcctccctcctctgccat

SEQ ID NO: 7760439 - DNA, 22 bp, Homo sapiens
cagagctggctctgcatgtaca

SEQ ID NO: 7760440 - DNA, 22 bp, Homo sapiens
cagagctggctctgcatgtaca

SEQ ID NO: 7760441 - DNA, 22 bp, Homo sapiens
cagaggcaaaagaggtggaggt

SEQ ID NO: 7760442 - DNA, 20 bp, Homo sapiens
cagaggcaaggagacttgga

SEQ ID NO: 7760443 - DNA, 22 bp, Homo sapiens
cagaggagaattgcgggatcat

SEQ ID NO: 7760444 - DNA, 22 bp, Homo sapiens
cagaggcaaaagaggtggaggt

SEQ ID NO: 7760445 - DNA, 22 bp, Homo sapiens
cagaggcaaaagaggtggaggt

SEQ ID NO: 7760446 - DNA, 22 bp, Homo sapiens
gggctgacgaaggccatgtgtg

SEQ ID NO: 7760447 - DNA, 22 bp, Homo sapiens
gggcagtgtcgaggtctggtcc

SEQ ID NO: 7760448 - DNA, 22 bp, Homo sapiens
gggcagtgtctgcaaatgaaca

SEQ ID NO: 7760449 - DNA, 22 bp, Homo sapiens
gggcagtgtcggggcccaggga

SEQ ID NO: 7760450 - DNA, 22 bp, Homo sapiens
gggcagtgtggtcgtgcctttg

SEQ ID NO: 7760451 - DNA, 22 bp, Homo sapiens
gggccacctggattccatgtgt

SEQ ID NO: 7760452 - DNA, 22 bp, Homo sapiens
gggccaccccactgcccacgct

SEQ ID NO: 7760453 - DNA, 22 bp, Homo sapiens
gggccagacccttggcgatctg

SEQ ID NO: 7760454 - DNA, 22 bp, Homo sapiens
gggccagagcttggcagctggg

SEQ ID NO: 7760455 - DNA, 22 bp, Homo sapiens
cagactgggctggtggaaagct

SEQ ID NO: 7760456 - DNA, 22 bp, Homo sapiens
gggcagagactcagaaacagaa

SEQ ID NO: 7760457 - DNA, 22 bp, Homo sapiens
ggcttcaatgtattcacattca

SEQ ID NO: 7760458 - DNA, 22 bp, Homo sapiens
cagagacaggaatcagctgcag

SEQ ID NO: 7760459 - DNA, 22 bp, Homo sapiens
gggcagcccagaactgctgcag

SEQ ID NO: 7760460 - DNA, 22 bp, Homo sapiens
gggcagcattctgtgggcaggt

SEQ ID NO: 7760461 - DNA, 22 bp, Homo sapiens
cagagacaggaatcagctgcag

SEQ ID NO: 7760462 - DNA, 22 bp, Homo sapiens
cagagacaggatctcgaagact

SEQ ID NO: 7760463 - DNA, 22 bp, Homo sapiens
cagagacaggagtgctcccagt

SEQ ID NO: 7760464 - DNA, 20 bp, Homo sapiens
gggcagtggcgctatctcag

SEQ ID NO: 7760465 - DNA, 22 bp, Homo sapiens
gggcagtgtcgaggtctggtcc

SEQ ID NO: 7760466 - DNA, 22 bp, Homo sapiens
cagccaggcctggtgaccaaag

SEQ ID NO: 7760467 - DNA, 22 bp, Homo sapiens
cagccaggcctggtgaccaaag

SEQ ID NO: 7760468 - DNA, 22 bp, Homo sapiens
cagccagggagggcaaatgaga

SEQ ID NO: 7760469 - DNA, 22 bp, Homo sapiens
gtctggagccccagtcaatgag

SEQ ID NO: 7760470 - DNA, 22 bp, Homo sapiens
gtccctgggaaaggagagggca

SEQ ID NO: 7760471 - DNA, 19 bp, Homo sapiens
gtccctgggcagaggcacc

SEQ ID NO: 7760472 - DNA, 22 bp, Homo sapiens
gtccctggggaatcagctggag

SEQ ID NO: 7760473 - DNA, 22 bp, Homo sapiens
gtcccaggctccatggcagcca

SEQ ID NO: 7760474 - DNA, 22 bp, Homo sapiens
gtccctgggtctaaggcagtaa

SEQ ID NO: 7760475 - DNA, 22 bp, Homo sapiens
cagcccctcacagagctgtcct

SEQ ID NO: 7760476 - DNA, 22 bp, Homo sapiens
cagccccttcctggcatctgga

SEQ ID NO: 7760477 - DNA, 22 bp, Homo sapiens
cagccaggtatgggcgtgcggg

SEQ ID NO: 7760478 - DNA, 22 bp, Homo sapiens
cagccaggttcaagtccttata

SEQ ID NO: 7760479 - DNA, 22 bp, Homo sapiens
cagccctcatcccgcctgcgtt

SEQ ID NO: 7760480 - DNA, 22 bp, Homo sapiens
gtctgtaattattaaagaaagg

SEQ ID NO: 7760481 - DNA, 22 bp, Homo sapiens
cagccctcaggtcctcagcagc

SEQ ID NO: 7760482 - DNA, 22 bp, Homo sapiens
gtctgtctgttgttgagaagca

SEQ ID NO: 7760483 - DNA, 22 bp, Homo sapiens
gtccagccactcaccttccagc

SEQ ID NO: 7760484 - DNA, 22 bp, Homo sapiens
cagcaggctgtggaaatcctgg

SEQ ID NO: 7760485 - DNA, 22 bp, Homo sapiens
cagcaggctgtggaaatcctgg

SEQ ID NO: 7760486 - DNA, 22 bp, Homo sapiens
cagcaggctgcgattgctcatt

SEQ ID NO: 7760487 - DNA, 22 bp, Homo sapiens
cagcaggctctgagtggctgcc

SEQ ID NO: 7760488 - DNA, 22 bp, Homo sapiens
cagcaggctctgagtggctgcc

SEQ ID NO: 7760489 - DNA, 22 bp, Homo sapiens
gtcccaggcagagtcaggaggg

SEQ ID NO: 7760490 - DNA, 22 bp, Homo sapiens
gtcccaggcagagtcaggaggg

SEQ ID NO: 7760491 - DNA, 22 bp, Homo sapiens
gtcccagcttcccactagcagc

SEQ ID NO: 7760492 - DNA, 20 bp, Homo sapiens
cagcaggctatggggcaccc

SEQ ID NO: 7760493 - DNA, 20 bp, Homo sapiens
cagcaggctatggggcaccc

SEQ ID NO: 7760494 - DNA, 22 bp, Homo sapiens
cagcaggcgttgggagaaagac

SEQ ID NO: 7760495 - DNA, 22 bp, Homo sapiens
cagcaggcgttgggagaaagac

SEQ ID NO: 7760496 - DNA, 22 bp, Homo sapiens
gtcattattctgggattctata

SEQ ID NO: 7760497 - DNA, 18 bp, Homo sapiens
gtcatgggtagtttagta

SEQ ID NO: 7760498 - DNA, 22 bp, Homo sapiens
gtcataggcatggatgtgggtt

SEQ ID NO: 7760499 - DNA, 22 bp, Homo sapiens
gtcataaagacagaaacattcc

SEQ ID NO: 7760500 - DNA, 22 bp, Homo sapiens
gtcatatacactgcatgtaatc

SEQ ID NO: 7760501 - DNA, 22 bp, Homo sapiens
gtcatatacactgcatgtaatc

SEQ ID NO: 7760502 - DNA, 22 bp, Homo sapiens
gtcatataggtaggattcagct

SEQ ID NO: 7760503 - DNA, 22 bp, Homo sapiens
cagcagctggttgaatccttct

SEQ ID NO: 7760504 - DNA, 20 bp, Homo sapiens
cagcaggaaaagtgcctcag

SEQ ID NO: 7760505 - DNA, 22 bp, Homo sapiens
cagcaggacatggaggagtaaa

SEQ ID NO: 7760506 - DNA, 22 bp, Homo sapiens
gtcataaagacagaaacattcc

SEQ ID NO: 7760507 - DNA, 22 bp, Homo sapiens
cagcaggaaggtttcccctgca

SEQ ID NO: 7760508 - DNA, 22 bp, Homo sapiens
cagcacctgttagcattaaata

SEQ ID NO: 7760509 - DNA, 22 bp, Homo sapiens
cagcaccttccttaactccagg

SEQ ID NO: 7760510 - DNA, 23 bp, Homo sapiens
cagcagctgcctggttttttggt

SEQ ID NO: 7760511 - DNA, 22 bp, Homo sapiens
cagccctgctgccttagtgcct

SEQ ID NO: 7760512 - DNA, 22 bp, Homo sapiens
cagccctgctgacactgtctga

SEQ ID NO: 7760513 - DNA, 22 bp, Homo sapiens
cagccctgctgacactgtctga

SEQ ID NO: 7760514 - DNA, 22 bp, Homo sapiens
cagccctgctcttagtgtctcc

SEQ ID NO: 7760515 - DNA, 22 bp, Homo sapiens
cagccctgcttccccgctagtt

SEQ ID NO: 7760516 - DNA, 22 bp, Homo sapiens
cagccctgctggttttgggcaa

SEQ ID NO: 7760517 - DNA, 22 bp, Homo sapiens
cagccctgctggcaatgatgag

SEQ ID NO: 7760518 - DNA, 23 bp, Homo sapiens
cagccctgaaatcgaggtgacac

SEQ ID NO: 7760519 - DNA, 22 bp, Homo sapiens
cagccctgccatggagcctcct

SEQ ID NO: 7760520 - DNA, 22 bp, Homo sapiens
cagccctgccatggagcctcct

SEQ ID NO: 7760521 - DNA, 22 bp, Homo sapiens
cagccctggaacagctgactca

SEQ ID NO: 7760522 - DNA, 22 bp, Homo sapiens
cagccctggaacagctgactca

SEQ ID NO: 7760523 - DNA, 22 bp, Homo sapiens
cagcctgagccttctgtagcaa

SEQ ID NO: 7760524 - DNA, 22 bp, Homo sapiens
cagcctgactatggctgcaggt

SEQ ID NO: 7760525 - DNA, 22 bp, Homo sapiens
cagcctgagccttctgtagcaa

SEQ ID NO: 7760526 - DNA, 22 bp, Homo sapiens
cagcctgactatggctgcaggt

SEQ ID NO: 7760527 - DNA, 22 bp, Homo sapiens
cagcctgactatggctgcaggt

SEQ ID NO: 7760528 - DNA, 22 bp, Homo sapiens
cagcctgacaccagctttgggc

SEQ ID NO: 7760529 - DNA, 22 bp, Homo sapiens
cagcctgcagggctgcctgttg

SEQ ID NO: 7760530 - DNA, 16 bp, Homo sapiens
cagcctgcagtggtca

SEQ ID NO: 7760531 - DNA, 22 bp, Homo sapiens
cagcctggtccccggctcaccc

SEQ ID NO: 7760532 - DNA, 22 bp, Homo sapiens
cagcctgtagaatacagtaaat

SEQ ID NO: 7760533 - DNA, 22 bp, Homo sapiens
cagcctggacagcgaccagagt

SEQ ID NO: 7760534 - DNA, 22 bp, Homo sapiens
cagcctggagccacagcccagg

SEQ ID NO: 7760535 - DNA, 21 bp, Homo sapiens
cagcctgctgctccagggcca

SEQ ID NO: 7760536 - DNA, 22 bp, Homo sapiens
cagcctgctctcagatgttgag

SEQ ID NO: 7760537 - DNA, 22 bp, Homo sapiens
cagctagtacaatgggagagca

SEQ ID NO: 7760538 - DNA, 22 bp, Homo sapiens
gtgcccagtcctgccttgacag

SEQ ID NO: 7760539 - DNA, 22 bp, Homo sapiens
cagctaccatggtttgttccag

SEQ ID NO: 7760540 - DNA, 22 bp, Homo sapiens
gtgcccagttgaggccaggact

SEQ ID NO: 7760541 - DNA, 22 bp, Homo sapiens
gtgcccagtgcaggcccgcagg

SEQ ID NO: 7760542 - DNA, 22 bp, Homo sapiens
cacatacaatggtgttatttgg

SEQ ID NO: 7760543 - DNA, 22 bp, Homo sapiens
cacataaatggtgccatgtttt

SEQ ID NO: 7760544 - DNA, 22 bp, Homo sapiens
cacataaatggtgccatgtttt

SEQ ID NO: 7760545 - DNA, 22 bp, Homo sapiens
cacagttttgcccagggcttct

SEQ ID NO: 7760546 - DNA, 22 bp, Homo sapiens
cacatacatgcacacctaaata

SEQ ID NO: 7760547 - DNA, 22 bp, Homo sapiens
cacatacatacgtatgtataca

SEQ ID NO: 7760548 - DNA, 22 bp, Homo sapiens
cacatacatacgtatgtataca

SEQ ID NO: 7760549 - DNA, 22 bp, Homo sapiens
cacatacaatggtgttatttgg

SEQ ID NO: 7760550 - DNA, 19 bp, Homo sapiens
cacatacagaaaagagtaa

SEQ ID NO: 7760551 - DNA, 22 bp, Homo sapiens
cacagtttggttttgctgtaat

SEQ ID NO: 7760552 - DNA, 22 bp, Homo sapiens
ggaggtggaggttgcagtgagc

SEQ ID NO: 7760553 - DNA, 22 bp, Homo sapiens
ggaggtggaggttgcaatgagc

SEQ ID NO: 7760554 - DNA, 22 bp, Homo sapiens
cacaggcttttttggctgatgt

SEQ ID NO: 7760555 - DNA, 22 bp, Homo sapiens
cacagggaaccaaggctgggcc

SEQ ID NO: 7760556 - DNA, 22 bp, Homo sapiens
cacatagataggcagaagaaca

SEQ ID NO: 7760557 - DNA, 22 bp, Homo sapiens
cacatatacctcttcttgagtt

SEQ ID NO: 7760558 - DNA, 23 bp, Homo sapiens
cacatatagcagccactaaggtc

SEQ ID NO: 7760559 - DNA, 22 bp, Homo sapiens
cacattctttcacagttctgaa

SEQ ID NO: 7760560 - DNA, 22 bp, Homo sapiens
cacatttagaggttagcatggt

SEQ ID NO: 7760561 - DNA, 22 bp, Homo sapiens
ggcaggcaggagcgtgcttggg

SEQ ID NO: 7760562 - DNA, 22 bp, Homo sapiens
ggcaggcagtgtggtgtgaaac

SEQ ID NO: 7760563 - DNA, 22 bp, Homo sapiens
ggcaggcaggtcttcatggccc

SEQ ID NO: 7760564 - DNA, 22 bp, Homo sapiens
ggcaggcaggtcttcatggccc

SEQ ID NO: 7760565 - DNA, 22 bp, Homo sapiens
ggcaggcatggggtctgccatt

SEQ ID NO: 7760566 - DNA, 22 bp, Homo sapiens
ggcaggcatggccactccctag

SEQ ID NO: 7760567 - DNA, 22 bp, Homo sapiens
ggcaggcatcatgtggtcatta

SEQ ID NO: 7760568 - DNA, 22 bp, Homo sapiens
ggcagggaggaggtgaaagtga

SEQ ID NO: 7760569 - DNA, 22 bp, Homo sapiens
ggcagggcaggaaagtcaggaa

SEQ ID NO: 7760570 - DNA, 22 bp, Homo sapiens
ggcagggcaggaaagtcaggaa

SEQ ID NO: 7760571 - DNA, 22 bp, Homo sapiens
ggcagggagtggagactcccta

SEQ ID NO: 7760572 - DNA, 22 bp, Homo sapiens
ggcagggcagcgctgattaggg

SEQ ID NO: 7760573 - DNA, 22 bp, Homo sapiens
ggcaggtgatctagagtcaata

SEQ ID NO: 7760574 - DNA, 22 bp, Homo sapiens
ggcaggtgcacctgagccatct

SEQ ID NO: 7760575 - DNA, 22 bp, Homo sapiens
ggccaaggatggtggctctggt

SEQ ID NO: 7760576 - DNA, 22 bp, Homo sapiens
ggcatttttgacaaagagcaat

SEQ ID NO: 7760577 - DNA, 22 bp, Homo sapiens
ggccaagatcccattatacaaa

SEQ ID NO: 7760578 - DNA, 22 bp, Homo sapiens
ggcattgatgggagatggtgga

SEQ ID NO: 7760579 - DNA, 20 bp, Homo sapiens
ggccggggagctctccaggg

SEQ ID NO: 7760580 - DNA, 21 bp, Homo sapiens
ggccgccgccttgtgctctgc

SEQ ID NO: 7760581 - DNA, 22 bp, Homo sapiens
cacctgggtcattgctggtgtt

SEQ ID NO: 7760582 - DNA, 22 bp, Homo sapiens
cacgcacgctgggtggaggcgc

SEQ ID NO: 7760583 - DNA, 20 bp, Homo sapiens
caccttcaaatttcctggca

SEQ ID NO: 7760584 - DNA, 22 bp, Homo sapiens
ggccactgtttcctgggcagtt

SEQ ID NO: 7760585 - DNA, 22 bp, Homo sapiens
ggccactgctctccagcctggg

SEQ ID NO: 7760586 - DNA, 22 bp, Homo sapiens
ggccactgccctggctacaccg

SEQ ID NO: 7760587 - DNA, 22 bp, Homo sapiens
ggccccaggtagaagatataga

SEQ ID NO: 7760588 - DNA, 18 bp, Homo sapiens
ggctcaggctatcctaac

SEQ ID NO: 7760589 - DNA, 22 bp, Homo sapiens
ggctcagggaatgaggaagaat

SEQ ID NO: 7760590 - DNA, 19 bp, Homo sapiens
ggctcagggcgctgccgcc

SEQ ID NO: 7760591 - DNA, 22 bp, Homo sapiens
ggctcaggggccaggcctgtcc

SEQ ID NO: 7760592 - DNA, 22 bp, Homo sapiens
ggcctgaggccaccagcagccc

SEQ ID NO: 7760593 - DNA, 22 bp, Homo sapiens
ggcctgaggccaccagcagccc

SEQ ID NO: 7760594 - DNA, 22 bp, Homo sapiens
ggcctgaggccaccagcagccc

SEQ ID NO: 7760595 - DNA, 22 bp, Homo sapiens
ggcctgggctccgggagttact

SEQ ID NO: 7760596 - DNA, 22 bp, Homo sapiens
ggcctgtgcacatgtgcaggaa

SEQ ID NO: 7760597 - DNA, 22 bp, Homo sapiens
ggcctgagcttgggcagcgtat

SEQ ID NO: 7760598 - DNA, 22 bp, Homo sapiens
ggcctgagcagacagcatgatg

SEQ ID NO: 7760599 - DNA, 20 bp, Homo sapiens
ggcctgagcatggctggcag

SEQ ID NO: 7760600 - DNA, 22 bp, Homo sapiens
ggctccagggtctctccttgtg

SEQ ID NO: 7760601 - DNA, 22 bp, Homo sapiens
ggctccagggtacccctggatg

SEQ ID NO: 7760602 - DNA, 22 bp, Homo sapiens
ggctccagggtacccctggatg

SEQ ID NO: 7760603 - DNA, 22 bp, Homo sapiens
ggctctggtgccctggctccca

SEQ ID NO: 7760604 - DNA, 22 bp, Homo sapiens
ggctctggtgagggtaggagat

SEQ ID NO: 7760605 - DNA, 22 bp, Homo sapiens
ggctgcctagacttggaatttc

SEQ ID NO: 7760606 - DNA, 22 bp, Homo sapiens
ggctgcctcaaagctcaagctc

SEQ ID NO: 7760607 - DNA, 22 bp, Homo sapiens
ggctgccctcgtctactgccca

SEQ ID NO: 7760608 - DNA, 23 bp, Homo sapiens
cagaaagccctttccccacagta

SEQ ID NO: 7760609 - DNA, 22 bp, Homo sapiens
ggctgccctagagctggcaagg

SEQ ID NO: 7760610 - DNA, 22 bp, Homo sapiens
ggctgccccagtgctcatggct

SEQ ID NO: 7760611 - DNA, 22 bp, Homo sapiens
ggctgccccatgggctgggctg

SEQ ID NO: 7760612 - DNA, 22 bp, Homo sapiens
cagaaaagggtgtttgttcagg

SEQ ID NO: 7760613 - DNA, 22 bp, Homo sapiens
cagaaaaggaagagctatgtaa

SEQ ID NO: 7760614 - DNA, 22 bp, Homo sapiens
cagaaaataaacatttgtggaa

SEQ ID NO: 7760615 - DNA, 22 bp, Homo sapiens
cagaaaataaacatttgtggaa

SEQ ID NO: 7760616 - DNA, 22 bp, Homo sapiens
cagaaaataaagtttctacgca

SEQ ID NO: 7760617 - DNA, 22 bp, Homo sapiens
cagaaaacctgactctagaact

SEQ ID NO: 7760618 - DNA, 22 bp, Homo sapiens
cagaaaacctgactctagaact

SEQ ID NO: 7760619 - DNA, 22 bp, Homo sapiens
cacttttaacaggagaattccc

SEQ ID NO: 7760620 - DNA, 17 bp, Homo sapiens
cactttgttgctgtggg

SEQ ID NO: 7760621 - DNA, 22 bp, Homo sapiens
cactttacccttgttactcatg

SEQ ID NO: 7760622 - DNA, 22 bp, Homo sapiens
ggctgtcttgggagctcccccg

SEQ ID NO: 7760623 - DNA, 22 bp, Homo sapiens
ggctgtcttgggagctcccccg

SEQ ID NO: 7760624 - DNA, 22 bp, Homo sapiens
ggcttaaagttttctagaataa

SEQ ID NO: 7760625 - DNA, 22 bp, Homo sapiens
ggcttaaagaattaacagagat

SEQ ID NO: 7760626 - DNA, 22 bp, Homo sapiens
ggcttaaaactttgaaagtgtt

SEQ ID NO: 7760627 - DNA, 22 bp, Homo sapiens
ggcttaaaaggaaaatgagagt

SEQ ID NO: 7760628 - DNA, 22 bp, Homo sapiens
ggctggtgttacagtcggcagc

SEQ ID NO: 7760629 - DNA, 22 bp, Homo sapiens
ggctgtaggttggtgctggaca

SEQ ID NO: 7760630 - DNA, 22 bp, Homo sapiens
cagaaagtgatttgctattcca

SEQ ID NO: 7760631 - DNA, 22 bp, Homo sapiens
cagaaaggtatgtgtgcctttg

SEQ ID NO: 7760632 - DNA, 18 bp, Homo sapiens
cagaaagttatttactct

SEQ ID NO: 7760633 - DNA, 23 bp, Homo sapiens
cagaaagtttgagaagatacatc

SEQ ID NO: 7760634 - DNA, 23 bp, Homo sapiens
cagaaagtttgagaagatacatc

SEQ ID NO: 7760635 - DNA, 23 bp, Homo sapiens
cagaaataaactggtttgtagat

SEQ ID NO: 7760636 - DNA, 21 bp, Homo sapiens
gctttctgtggactctgcacc

SEQ ID NO: 7760637 - DNA, 22 bp, Homo sapiens
caataactttgatattttgcgg

SEQ ID NO: 7760638 - DNA, 22 bp, Homo sapiens
caataactgctgaggagaagca

SEQ ID NO: 7760639 - DNA, 22 bp, Homo sapiens
caataactgctaaattccctgt

SEQ ID NO: 7760640 - DNA, 22 bp, Homo sapiens
caataactagtaattattccgg

SEQ ID NO: 7760641 - DNA, 22 bp, Homo sapiens
caataaagaagatttttgcaat

SEQ ID NO: 7760642 - DNA, 22 bp, Homo sapiens
gctttcttcatactcaagcatc

SEQ ID NO: 7760643 - DNA, 18 bp, Homo sapiens
gctttgcagaaatacaga

SEQ ID NO: 7760644 - DNA, 22 bp, Homo sapiens
caatgtcaaggagaccaaaacg

SEQ ID NO: 7760645 - DNA, 22 bp, Homo sapiens
caatgtttgtgatctactgact

SEQ ID NO: 7760646 - DNA, 22 bp, Homo sapiens
caagtttacaatgtgtatgtgt

SEQ ID NO: 7760647 - DNA, 22 bp, Homo sapiens
caagtttaaggcactgataagt

SEQ ID NO: 7760648 - DNA, 22 bp, Homo sapiens
caagtcaactcaaattgttatc

SEQ ID NO: 7760649 - DNA, 22 bp, Homo sapiens
caagtcaaagactagaactagt

SEQ ID NO: 7760650 - DNA, 20 bp, Homo sapiens
caagggtttgcattggcttt

SEQ ID NO: 7760651 - DNA, 22 bp, Homo sapiens
caaggtgccatgctgggcgggg

SEQ ID NO: 7760652 - DNA, 22 bp, Homo sapiens
caagtattctgtaaaaagtcaa

SEQ ID NO: 7760653 - DNA, 22 bp, Homo sapiens
caagtaattctgcaagaaacca

SEQ ID NO: 7760654 - DNA, 22 bp, Homo sapiens
caagtacaaaatgatatttagt

SEQ ID NO: 7760655 - DNA, 22 bp, Homo sapiens
caagtaaagaatcacatttctt

SEQ ID NO: 7760656 - DNA, 22 bp, Homo sapiens
caaatgtaataaggagtttccc

SEQ ID NO: 7760657 - DNA, 22 bp, Homo sapiens
caaatgtgtaaggaagtgttag

SEQ ID NO: 7760658 - DNA, 22 bp, Homo sapiens
caagcaggatgaagcccaggga

SEQ ID NO: 7760659 - DNA, 22 bp, Homo sapiens
caagcagccccaacatgaggat

SEQ ID NO: 7760660 - DNA, 22 bp, Homo sapiens
gctggaggatggactggaagaa

SEQ ID NO: 7760661 - DNA, 22 bp, Homo sapiens
gctggaggatcacttgagccca

SEQ ID NO: 7760662 - DNA, 22 bp, Homo sapiens
caagccagtgacagccagggaa

SEQ ID NO: 7760663 - DNA, 22 bp, Homo sapiens
gctggaggaggaagtgtgaggg

SEQ ID NO: 7760664 - DNA, 22 bp, Homo sapiens
caagcatactgtgagagtttta

SEQ ID NO: 7760665 - DNA, 22 bp, Homo sapiens
caagcagggtttatgcatggag

SEQ ID NO: 7760666 - DNA, 22 bp, Homo sapiens
gctggaggcagttcagacacca

SEQ ID NO: 7760667 - DNA, 22 bp, Homo sapiens
gctggaggctggagtgcagtgg

SEQ ID NO: 7760668 - DNA, 22 bp, Homo sapiens
gctggaggctggagtgcagtgg

SEQ ID NO: 7760669 - DNA, 22 bp, Homo sapiens
caaggcagcttaatagaatttg

SEQ ID NO: 7760670 - DNA, 22 bp, Homo sapiens
caaggcaggaagcctgtcttat

SEQ ID NO: 7760671 - DNA, 22 bp, Homo sapiens
caaggccctgcaacctgacttg

SEQ ID NO: 7760672 - DNA, 22 bp, Homo sapiens
gctggctggctgtgcaaaggca

SEQ ID NO: 7760673 - DNA, 22 bp, Homo sapiens
gctggctggctgtgcaaaggca

SEQ ID NO: 7760674 - DNA, 22 bp, Homo sapiens
gctggctgggtccctgagaggc

SEQ ID NO: 7760675 - DNA, 22 bp, Homo sapiens
gctggctgggacagattccatt

SEQ ID NO: 7760676 - DNA, 22 bp, Homo sapiens
gctggctgggtccctgagaggc

SEQ ID NO: 7760677 - DNA, 22 bp, Homo sapiens
gctggctggtccagcaggggct

SEQ ID NO: 7760678 - DNA, 22 bp, Homo sapiens
gctggctgtatcacctggccag

SEQ ID NO: 7760679 - DNA, 22 bp, Homo sapiens
caagggtgaaggctcctccagg

SEQ ID NO: 7760680 - DNA, 20 bp, Homo sapiens
caagggtttgcattggcttt

SEQ ID NO: 7760681 - DNA, 21 bp, Homo sapiens
gctggctgtcccagggaagca

SEQ ID NO: 7760682 - DNA, 21 bp, Homo sapiens
gctggctgtcccagggaagca

SEQ ID NO: 7760683 - DNA, 22 bp, Homo sapiens
gctggctgtatcacctggccag

SEQ ID NO: 7760684 - DNA, 22 bp, Homo sapiens
cacaattttaatacacagtcaa

SEQ ID NO: 7760685 - DNA, 22 bp, Homo sapiens
caatgttttcaactgacaagta

SEQ ID NO: 7760686 - DNA, 22 bp, Homo sapiens
cacacagctcaggggcactgcc

SEQ ID NO: 7760687 - DNA, 22 bp, Homo sapiens
cacacagctcaggggcactgcc

SEQ ID NO: 7760688 - DNA, 21 bp, Homo sapiens
cacacagctgcccttaggtag

SEQ ID NO: 7760689 - DNA, 22 bp, Homo sapiens
cacacaggaaaattggaattaa

SEQ ID NO: 7760690 - DNA, 22 bp, Homo sapiens
ggaagggcctcgggcgtgggac

SEQ ID NO: 7760691 - DNA, 22 bp, Homo sapiens
cacacaggagagtgctggaggt

SEQ ID NO: 7760692 - DNA, 21 bp, Homo sapiens
ggaagggctctgaggacggct

SEQ ID NO: 7760693 - DNA, 22 bp, Homo sapiens
ggaagggcggatagtataagtt

SEQ ID NO: 7760694 - DNA, 20 bp, Homo sapiens
ggaaggggcaaagtgtgtga

SEQ ID NO: 7760695 - DNA, 22 bp, Homo sapiens
ggaaggggagctggaaagggta

SEQ ID NO: 7760696 - DNA, 20 bp, Homo sapiens
cacagactgtatgggcacca

SEQ ID NO: 7760697 - DNA, 22 bp, Homo sapiens
cacagagaccccttctggggcc

SEQ ID NO: 7760698 - DNA, 22 bp, Homo sapiens
ggactgggtaggagcccagggc

SEQ ID NO: 7760699 - DNA, 22 bp, Homo sapiens
cacagagctggaaaggctgggc

SEQ ID NO: 7760700 - DNA, 22 bp, Homo sapiens
cacagagctgaacctgggtcat

SEQ ID NO: 7760701 - DNA, 22 bp, Homo sapiens
cacagaggagtgcacactctct

SEQ ID NO: 7760702 - DNA, 22 bp, Homo sapiens
cacagaggaaaggcagttggta

SEQ ID NO: 7760703 - DNA, 22 bp, Homo sapiens
cacagaggcatgaccctgccct

SEQ ID NO: 7760704 - DNA, 21 bp, Homo sapiens
cacagaggcgctgtatggctg

SEQ ID NO: 7760705 - DNA, 21 bp, Homo sapiens
cacagaggcgctgtatggctg

SEQ ID NO: 7760706 - DNA, 22 bp, Homo sapiens
cacagaggatttttagggcagt

SEQ ID NO: 7760707 - DNA, 22 bp, Homo sapiens
ggagcctgacagtgcccagcat

SEQ ID NO: 7760708 - DNA, 22 bp, Homo sapiens
ggagcctgagcggcccagggcc

SEQ ID NO: 7760709 - DNA, 22 bp, Homo sapiens
ggagcctgacagtgcccagcat

SEQ ID NO: 7760710 - DNA, 22 bp, Homo sapiens
ggagcctgcgggagctcccatt

SEQ ID NO: 7760711 - DNA, 22 bp, Homo sapiens
ggagctgcttcttgctgtgggt

SEQ ID NO: 7760712 - DNA, 22 bp, Homo sapiens
ggagctgctttgatctgaagaa

SEQ ID NO: 7760713 - DNA, 23 bp, Homo sapiens
ggagctgctgttgggggagctgc

SEQ ID NO: 7760714 - DNA, 22 bp, Homo sapiens
ggagctggagagctagcctagg

SEQ ID NO: 7760715 - DNA, 22 bp, Homo sapiens
ggagctggagagtacagagttt

SEQ ID NO: 7760716 - DNA, 22 bp, Homo sapiens
ggagctggcagcgcaacccaga

SEQ ID NO: 7760717 - DNA, 19 bp, Homo sapiens
cacagatgattgacacata

SEQ ID NO: 7760718 - DNA, 22 bp, Homo sapiens
cacagaggtgatagtggtcaag

SEQ ID NO: 7760719 - DNA, 22 bp, Homo sapiens
ggagcccttctattccatggag

SEQ ID NO: 7760720 - DNA, 22 bp, Homo sapiens
ggagccctgccctaggcagctc

SEQ ID NO: 7760721 - DNA, 22 bp, Homo sapiens
ggaggccaaggaggagcttgcc

SEQ ID NO: 7760722 - DNA, 22 bp, Homo sapiens
cacaggcttccagtccccagct

SEQ ID NO: 7760723 - DNA, 22 bp, Homo sapiens
cacaggcttgtcagcatgaggc

SEQ ID NO: 7760724 - DNA, 22 bp, Homo sapiens
cacaggcttgtcagcatgaggc

SEQ ID NO: 7760725 - DNA, 22 bp, Homo sapiens
cacaggaatcagcattaatggc

SEQ ID NO: 7760726 - DNA, 22 bp, Homo sapiens
cacaggaatcagcattaatggc

SEQ ID NO: 7760727 - DNA, 22 bp, Homo sapiens
cacaggaatataagtttgagtt

SEQ ID NO: 7760728 - DNA, 22 bp, Homo sapiens
cacaggaaggccttctcacaat

SEQ ID NO: 7760729 - DNA, 20 bp, Homo sapiens
ggagctggcatccagcctct

SEQ ID NO: 7760730 - DNA, 22 bp, Homo sapiens
attttactttgtgaatattgac

SEQ ID NO: 7760731 - DNA, 22 bp, Homo sapiens
atttttatgacaaaccatcctc

SEQ ID NO: 7760732 - DNA, 22 bp, Homo sapiens
atttttccatgatacttatctg

SEQ ID NO: 7760733 - DNA, 22 bp, Homo sapiens
atttttccatgatacttatctg

SEQ ID NO: 7760734 - DNA, 22 bp, Homo sapiens
atttttcagcttcattgaggca

SEQ ID NO: 7760735 - DNA, 22 bp, Homo sapiens
atttttccaattaggataaaga

SEQ ID NO: 7760736 - DNA, 22 bp, Homo sapiens
atttttccaattaggataaaga

SEQ ID NO: 7760737 - DNA, 22 bp, Homo sapiens
atttttcagcttcattgaggca

SEQ ID NO: 7760738 - DNA, 22 bp, Homo sapiens
atttttcaactttggaaatggc

SEQ ID NO: 7760739 - DNA, 22 bp, Homo sapiens
atttttcagcttcattgaggca

SEQ ID NO: 7760740 - DNA, 22 bp, Homo sapiens
caaaagcagttctatctgagtt

SEQ ID NO: 7760741 - DNA, 22 bp, Homo sapiens
caaaataccacgacttgtttta

SEQ ID NO: 7760742 - DNA, 22 bp, Homo sapiens
caaaagcagttctatctgagtt

SEQ ID NO: 7760743 - DNA, 22 bp, Homo sapiens
atttttctctttccactgagat

SEQ ID NO: 7760744 - DNA, 22 bp, Homo sapiens
atttttctctttccactgagat

SEQ ID NO: 7760745 - DNA, 18 bp, Homo sapiens
atttttcccagatggata

SEQ ID NO: 7760746 - DNA, 22 bp, Homo sapiens
atttttccattctctgttagta

SEQ ID NO: 7760747 - DNA, 22 bp, Homo sapiens
atttttcctgctggatctgctc

SEQ ID NO: 7760748 - DNA, 23 bp, Homo sapiens
atttttcctggaacagtcaccca

SEQ ID NO: 7760749 - DNA, 22 bp, Homo sapiens
atttttcctgggtgctttagtt

SEQ ID NO: 7760750 - DNA, 22 bp, Homo sapiens
atttttctctcacacttaccag

SEQ ID NO: 7760751 - DNA, 22 bp, Homo sapiens
atttttctctccactccattaa

SEQ ID NO: 7760752 - DNA, 22 bp, Homo sapiens
caaacattcagatgcaatggta

SEQ ID NO: 7760753 - DNA, 22 bp, Homo sapiens
caaagcagagccagagcttgtc

SEQ ID NO: 7760754 - DNA, 22 bp, Homo sapiens
caaagcagagaactgtctcatt

SEQ ID NO: 7760755 - DNA, 22 bp, Homo sapiens
caaaattagaaatgcagctgtt

SEQ ID NO: 7760756 - DNA, 22 bp, Homo sapiens
caaaatgttctggcacctttaa

SEQ ID NO: 7760757 - DNA, 22 bp, Homo sapiens
caaaatgcatctgagaccaggc

SEQ ID NO: 7760758 - DNA, 22 bp, Homo sapiens
caaaattagggagtgagctgga

SEQ ID NO: 7760759 - DNA, 22 bp, Homo sapiens
caaaattctgcatttctaataa

SEQ ID NO: 7760760 - DNA, 22 bp, Homo sapiens
caaaattagaaatgcagctgtt

SEQ ID NO: 7760761 - DNA, 22 bp, Homo sapiens
caaacaatttgcatttccttag

SEQ ID NO: 7760762 - DNA, 22 bp, Homo sapiens
caaacatagtgaagcaatgaca

SEQ ID NO: 7760763 - DNA, 22 bp, Homo sapiens
caaacaatttgcatttccttag

SEQ ID NO: 7760764 - DNA, 22 bp, Homo sapiens
caaatactgtactgaacactgt

SEQ ID NO: 7760765 - DNA, 18 bp, Homo sapiens
caaatactgttgtcttat

SEQ ID NO: 7760766 - DNA, 22 bp, Homo sapiens
caaatactttatatacttcaaa

SEQ ID NO: 7760767 - DNA, 21 bp, Homo sapiens
caaatacttagaaacttaaga

SEQ ID NO: 7760768 - DNA, 21 bp, Homo sapiens
caaatacttagaaacttaaga

SEQ ID NO: 7760769 - DNA, 21 bp, Homo sapiens
caaatacttagaaacttaaga

SEQ ID NO: 7760770 - DNA, 22 bp, Homo sapiens
caaaggaaatactaatctggaa

SEQ ID NO: 7760771 - DNA, 22 bp, Homo sapiens
caaaggaaatactaatctggaa

SEQ ID NO: 7760772 - DNA, 22 bp, Homo sapiens
caaaggaagctccttgatggcg

SEQ ID NO: 7760773 - DNA, 22 bp, Homo sapiens
caaagctgtgaattcctacaaa

SEQ ID NO: 7760774 - DNA, 18 bp, Homo sapiens
caaagctcacgttccatc

SEQ ID NO: 7760775 - DNA, 22 bp, Homo sapiens
caaagcctctgatttcacttgt

SEQ ID NO: 7760776 - DNA, 22 bp, Homo sapiens
caaagctcatgctcttagccat

SEQ ID NO: 7760777 - DNA, 22 bp, Homo sapiens
caaagtgctggaattacaggtg

SEQ ID NO: 7760778 - DNA, 22 bp, Homo sapiens
caaatactaaacataagatttt

SEQ ID NO: 7760779 - DNA, 22 bp, Homo sapiens
caaatacaaatacgggcagctt

SEQ ID NO: 7760780 - DNA, 22 bp, Homo sapiens
caaatacaaatacgggcagctt

SEQ ID NO: 7760781 - DNA, 22 bp, Homo sapiens
caaatgcatgagaaataagagg

SEQ ID NO: 7760782 - DNA, 22 bp, Homo sapiens
caaatgctaacttctttccaaa

SEQ ID NO: 7760783 - DNA, 22 bp, Homo sapiens
caaatgccaggaatctctgaag

SEQ ID NO: 7760784 - DNA, 22 bp, Homo sapiens
gctcttggccaagtggaagggt

SEQ ID NO: 7760785 - DNA, 22 bp, Homo sapiens
gctcttggtctcagcctctgaa

SEQ ID NO: 7760786 - DNA, 22 bp, Homo sapiens
gcctgagaaggacacagcaggt

SEQ ID NO: 7760787 - DNA, 22 bp, Homo sapiens
gcctgagagtctccagaccttg

SEQ ID NO: 7760788 - DNA, 22 bp, Homo sapiens
gcctgagagaactgaccaagag

SEQ ID NO: 7760789 - DNA, 22 bp, Homo sapiens
gcctgagatcagccaagcccct

SEQ ID NO: 7760790 - DNA, 22 bp, Homo sapiens
gcccccgtagtagatgaggcgc

SEQ ID NO: 7760791 - DNA, 22 bp, Homo sapiens
gcccccgtagtagatgaggcgc

SEQ ID NO: 7760792 - DNA, 22 bp, Homo sapiens
gcccccagacctcagtgggctg

SEQ ID NO: 7760793 - DNA, 22 bp, Homo sapiens
gcctaggagtggggatggcggt

SEQ ID NO: 7760794 - DNA, 22 bp, Homo sapiens
gcctaggagtacagaatggttt

SEQ ID NO: 7760795 - DNA, 22 bp, Homo sapiens
gcctaggagacaagcgtgaaag

SEQ ID NO: 7760796 - DNA, 22 bp, Homo sapiens
gcctaggtaccagcagagagcc

SEQ ID NO: 7760797 - DNA, 22 bp, Homo sapiens
gcctagtgcactggcagggctc

SEQ ID NO: 7760798 - DNA, 19 bp, Homo sapiens
gcctatgtcttcaaatcat

SEQ ID NO: 7760799 - DNA, 22 bp, Homo sapiens
gcctcttgtttccttacatgga

SEQ ID NO: 7760800 - DNA, 23 bp, Homo sapiens
gcccaccctcagcgtcctcacgg

SEQ ID NO: 7760801 - DNA, 21 bp, Homo sapiens
gcccacagtgaggaggatccc

SEQ ID NO: 7760802 - DNA, 22 bp, Homo sapiens
gcccacagtctatcagtttgcg

SEQ ID NO: 7760803 - DNA, 22 bp, Homo sapiens
atttccattatcatgacaaatt

SEQ ID NO: 7760804 - DNA, 22 bp, Homo sapiens
atttccatgtcggtattttata

SEQ ID NO: 7760805 - DNA, 22 bp, Homo sapiens
atttccatgtccaaaaattagt

SEQ ID NO: 7760806 - DNA, 22 bp, Homo sapiens
atttccatgtcggtattttata

SEQ ID NO: 7760807 - DNA, 22 bp, Homo sapiens
atttcccaatacgctaagtgga

SEQ ID NO: 7760808 - DNA, 22 bp, Homo sapiens
atttccatgccttagcttaagg

SEQ ID NO: 7760809 - DNA, 22 bp, Homo sapiens
atttccatgaagtttagttata

SEQ ID NO: 7760810 - DNA, 22 bp, Homo sapiens
atttccatacacccatttctga

SEQ ID NO: 7760811 - DNA, 17 bp, Homo sapiens
gcccacccttaggagct

SEQ ID NO: 7760812 - DNA, 22 bp, Homo sapiens
atttctgataaacgtaagctgc

SEQ ID NO: 7760813 - DNA, 22 bp, Homo sapiens
atttctcagttcctactgttta

SEQ ID NO: 7760814 - DNA, 22 bp, Homo sapiens
atttctgatacccggtcaccct

SEQ ID NO: 7760815 - DNA, 22 bp, Homo sapiens
atttctcagtgtgatcaggcct

SEQ ID NO: 7760816 - DNA, 22 bp, Homo sapiens
atttctgtagtccacattcttt

SEQ ID NO: 7760817 - DNA, 22 bp, Homo sapiens
atttctgtaacttatgaaagtt

SEQ ID NO: 7760818 - DNA, 22 bp, Homo sapiens
atttctgtaacttatgaaagtt

SEQ ID NO: 7760819 - DNA, 22 bp, Homo sapiens
atttctgttatacctttctcag

SEQ ID NO: 7760820 - DNA, 22 bp, Homo sapiens
atttctgtggcttcattctcct

SEQ ID NO: 7760821 - DNA, 22 bp, Homo sapiens
atttctgtatcctgctgtcaga

SEQ ID NO: 7760822 - DNA, 22 bp, Homo sapiens
atttctgtagtccacattcttt

SEQ ID NO: 7760823 - DNA, 22 bp, Homo sapiens
atttctgtgcagtaaatggtga

SEQ ID NO: 7760824 - DNA, 22 bp, Homo sapiens
atttctgtggcttcattctcct

SEQ ID NO: 7760825 - DNA, 22 bp, Homo sapiens
gccccaggttgcctgtcccagg

SEQ ID NO: 7760826 - DNA, 22 bp, Homo sapiens
atttctgttgcttataaattac

SEQ ID NO: 7760827 - DNA, 19 bp, Homo sapiens
gccaggcctggacctgcag

SEQ ID NO: 7760828 - DNA, 22 bp, Homo sapiens
gccacagtcactgctgcagggg

SEQ ID NO: 7760829 - DNA, 22 bp, Homo sapiens
gccacagtcactgctgcagggg

SEQ ID NO: 7760830 - DNA, 22 bp, Homo sapiens
gccacaggtgggctctgggaaa

SEQ ID NO: 7760831 - DNA, 22 bp, Homo sapiens
gccaggctggccagcaccttct

SEQ ID NO: 7760832 - DNA, 22 bp, Homo sapiens
gccaggctggccagcaccttct

SEQ ID NO: 7760833 - DNA, 22 bp, Homo sapiens
gccaggctggcaaaaggaaacc

SEQ ID NO: 7760834 - DNA, 22 bp, Homo sapiens
gccaggctggaaagaacagaca

SEQ ID NO: 7760835 - DNA, 22 bp, Homo sapiens
gccaggctggaaagaacagaca

SEQ ID NO: 7760836 - DNA, 22 bp, Homo sapiens
gccaggctggtcttgaactcct

SEQ ID NO: 7760837 - DNA, 22 bp, Homo sapiens
gccaggctggtgcaaggatatt

SEQ ID NO: 7760838 - DNA, 22 bp, Homo sapiens
gccaggctggggggagatgtct

SEQ ID NO: 7760839 - DNA, 22 bp, Homo sapiens
atttccagtacccagaacagag

SEQ ID NO: 7760840 - DNA, 22 bp, Homo sapiens
atttccagtactattttctgct

SEQ ID NO: 7760841 - DNA, 22 bp, Homo sapiens
atttcatgttgatctttcgagg

SEQ ID NO: 7760842 - DNA, 22 bp, Homo sapiens
atttcatgtttcatctacctaa

SEQ ID NO: 7760843 - DNA, 22 bp, Homo sapiens
gccaggtggaggttgcagtgag

SEQ ID NO: 7760844 - DNA, 22 bp, Homo sapiens
atttcatgttaactgaacagaa

SEQ ID NO: 7760845 - DNA, 22 bp, Homo sapiens
attcacattttatttcactgga

SEQ ID NO: 7760846 - DNA, 22 bp, Homo sapiens
attcacattttatttcactgga

SEQ ID NO: 7760847 - DNA, 15 bp, Homo sapiens
attcacattgcttca

SEQ ID NO: 7760848 - DNA, 22 bp, Homo sapiens
attcacatttacaaagcactca

SEQ ID NO: 7760849 - DNA, 22 bp, Homo sapiens
attcacatttacaaagcactca

SEQ ID NO: 7760850 - DNA, 22 bp, Homo sapiens
attcacatttagacatcaggta

SEQ ID NO: 7760851 - DNA, 22 bp, Homo sapiens
attcacatttagcctctgacat

SEQ ID NO: 7760852 - DNA, 22 bp, Homo sapiens
attcacatttagcctctgacat

SEQ ID NO: 7760853 - DNA, 22 bp, Homo sapiens
attcacattgagcttcactgtg

SEQ ID NO: 7760854 - DNA, 22 bp, Homo sapiens
attcacattgagcttcactgtg

SEQ ID NO: 7760855 - DNA, 22 bp, Homo sapiens
attcacatgttgaagccctaac

SEQ ID NO: 7760856 - DNA, 22 bp, Homo sapiens
attcacattctagggccctact

SEQ ID NO: 7760857 - DNA, 22 bp, Homo sapiens
attcacatgcccaagcagcacc

SEQ ID NO: 7760858 - DNA, 22 bp, Homo sapiens
attcacatgcccaagcagcacc

SEQ ID NO: 7760859 - DNA, 22 bp, Homo sapiens
attcacatgtgcttcttatcac

SEQ ID NO: 7760860 - DNA, 20 bp, Homo sapiens
attcacatataccagggagg

SEQ ID NO: 7760861 - DNA, 22 bp, Homo sapiens
attcacatgatgtatgtagggc

SEQ ID NO: 7760862 - DNA, 22 bp, Homo sapiens
attcacatgatgtatgtagggc

SEQ ID NO: 7760863 - DNA, 19 bp, Homo sapiens
attcacatccctgggaagg

SEQ ID NO: 7760864 - DNA, 19 bp, Homo sapiens
attcacatccctgggaagg

SEQ ID NO: 7760865 - DNA, 22 bp, Homo sapiens
gcacggctaatttttgtatttt

SEQ ID NO: 7760866 - DNA, 22 bp, Homo sapiens
attcaaggtatttaaaacataa

SEQ ID NO: 7760867 - DNA, 22 bp, Homo sapiens
attcaaggtttattcagtttag

SEQ ID NO: 7760868 - DNA, 22 bp, Homo sapiens
attcaaggttggctcaggaatt

SEQ ID NO: 7760869 - DNA, 22 bp, Homo sapiens
gcacggcaagacggggcctcct

SEQ ID NO: 7760870 - DNA, 22 bp, Homo sapiens
attcatacaggctttgctctta

SEQ ID NO: 7760871 - DNA, 22 bp, Homo sapiens
attcatagctcagtacagactc

SEQ ID NO: 7760872 - DNA, 22 bp, Homo sapiens
attcatatcatagagttattga

SEQ ID NO: 7760873 - DNA, 22 bp, Homo sapiens
attcatctgtacttcaatatct

SEQ ID NO: 7760874 - DNA, 22 bp, Homo sapiens
gcagcagatgtgggcccagagc

SEQ ID NO: 7760875 - DNA, 22 bp, Homo sapiens
attcaactagtgattgtgttat

SEQ ID NO: 7760876 - DNA, 21 bp, Homo sapiens
attcaactagatgattatttc

SEQ ID NO: 7760877 - DNA, 22 bp, Homo sapiens
attcaactatgtatagtcttct

SEQ ID NO: 7760878 - DNA, 22 bp, Homo sapiens
attcaacttataagatattaat

SEQ ID NO: 7760879 - DNA, 22 bp, Homo sapiens
attcaaattaagttaattcagc

SEQ ID NO: 7760880 - DNA, 22 bp, Homo sapiens
attcaaattaagttaattcagc

SEQ ID NO: 7760881 - DNA, 22 bp, Homo sapiens
attcaaattaagttaattcagc

SEQ ID NO: 7760882 - DNA, 22 bp, Homo sapiens
attagtaaaacattgtatatgt

SEQ ID NO: 7760883 - DNA, 22 bp, Homo sapiens
attagtaaaacattgtatatgt

SEQ ID NO: 7760884 - DNA, 22 bp, Homo sapiens
attagtagtagttagcagcctc

SEQ ID NO: 7760885 - DNA, 22 bp, Homo sapiens
attacaatcgagagaaacaaat

SEQ ID NO: 7760886 - DNA, 22 bp, Homo sapiens
attacatgagagaatgtaaata

SEQ ID NO: 7760887 - DNA, 23 bp, Homo sapiens
attaccagcctgacaccaacaaa

SEQ ID NO: 7760888 - DNA, 22 bp, Homo sapiens
attacatgagagaatgtaaata

SEQ ID NO: 7760889 - DNA, 22 bp, Homo sapiens
gcatagctgttaatttggtttc

SEQ ID NO: 7760890 - DNA, 22 bp, Homo sapiens
gcatagctttgatgctgcctta

SEQ ID NO: 7760891 - DNA, 22 bp, Homo sapiens
gcatatgatcacgtgtgtcggt

SEQ ID NO: 7760892 - DNA, 22 bp, Homo sapiens
attgtcattccagtcattgtta

SEQ ID NO: 7760893 - DNA, 22 bp, Homo sapiens
attgtctctttcaataacttgt

SEQ ID NO: 7760894 - DNA, 22 bp, Homo sapiens
attgtcattccagtcattgtta

SEQ ID NO: 7760895 - DNA, 22 bp, Homo sapiens
attgtcattggcttctatgtct

SEQ ID NO: 7760896 - DNA, 22 bp, Homo sapiens
attgtcctatctcagtgccatg

SEQ ID NO: 7760897 - DNA, 22 bp, Homo sapiens
attgtatttgtacaagacatgt

SEQ ID NO: 7760898 - DNA, 22 bp, Homo sapiens
gcagtgctttagtctgtccttt

SEQ ID NO: 7760899 - DNA, 20 bp, Homo sapiens
gcagtgctggtgcctctgct

SEQ ID NO: 7760900 - DNA, 21 bp, Homo sapiens
gccaagaacaagacagacatg

SEQ ID NO: 7760901 - DNA, 22 bp, Homo sapiens
gccacagggcgagcggaggcca

SEQ ID NO: 7760902 - DNA, 22 bp, Homo sapiens
gccacagggcagatgcgcagag

SEQ ID NO: 7760903 - DNA, 22 bp, Homo sapiens
gccaaagcagtcttgcctctgc

SEQ ID NO: 7760904 - DNA, 22 bp, Homo sapiens
attgtgattagagaatatagag

SEQ ID NO: 7760905 - DNA, 22 bp, Homo sapiens
attgtcttctggtcttatcttt

SEQ ID NO: 7760906 - DNA, 22 bp, Homo sapiens
attgtcttctggtcttatcttt

SEQ ID NO: 7760907 - DNA, 22 bp, Homo sapiens
attgtcttggaaccaaggtctt

SEQ ID NO: 7760908 - DNA, 22 bp, Homo sapiens
attgtctttaaaaatatacaac

SEQ ID NO: 7760909 - DNA, 22 bp, Homo sapiens
attgtctttggtgcttccagga

SEQ ID NO: 7760910 - DNA, 22 bp, Homo sapiens
attgtctttggtgcttccagga

SEQ ID NO: 7760911 - DNA, 22 bp, Homo sapiens
gcaggcctgtaatgaagggaca

SEQ ID NO: 7760912 - DNA, 22 bp, Homo sapiens
gcaggccttggcaatgagcctg

SEQ ID NO: 7760913 - DNA, 22 bp, Homo sapiens
gcagggctgcagagggcactgt

SEQ ID NO: 7760914 - DNA, 22 bp, Homo sapiens
attgattctgtaagtcaacaat

SEQ ID NO: 7760915 - DNA, 22 bp, Homo sapiens
attgattctcataggaccatct

SEQ ID NO: 7760916 - DNA, 22 bp, Homo sapiens
attgattctaccagctactttg

SEQ ID NO: 7760917 - DNA, 23 bp, Homo sapiens
attgattccctcttggaagggat

SEQ ID NO: 7760918 - DNA, 22 bp, Homo sapiens
attgatttgaacaaagatatta

SEQ ID NO: 7760919 - DNA, 22 bp, Homo sapiens
gcagctggacccacacggctta

SEQ ID NO: 7760920 - DNA, 22 bp, Homo sapiens
gcagctgctggagggaggcagg

SEQ ID NO: 7760921 - DNA, 22 bp, Homo sapiens
gcagctgccttcagctggatgg

SEQ ID NO: 7760922 - DNA, 22 bp, Homo sapiens
gcagcgctactcacagctctga

SEQ ID NO: 7760923 - DNA, 22 bp, Homo sapiens
gcagctgctggagggaggcagg

SEQ ID NO: 7760924 - DNA, 22 bp, Homo sapiens
gcagctgcgctggtgtggggca

SEQ ID NO: 7760925 - DNA, 22 bp, Homo sapiens
attcttcagtatgtgtggattg

SEQ ID NO: 7760926 - DNA, 22 bp, Homo sapiens
attcttgatatagatagttaat

SEQ ID NO: 7760927 - DNA, 22 bp, Homo sapiens
attctttaattcaattgaagga

SEQ ID NO: 7760928 - DNA, 22 bp, Homo sapiens
attctttacattggcttcttcc

SEQ ID NO: 7760929 - DNA, 22 bp, Homo sapiens
gagagcacggtcttgggcatgg

SEQ ID NO: 7760930 - DNA, 22 bp, Homo sapiens
gagagcaatggggacgggcagg

SEQ ID NO: 7760931 - DNA, 23 bp, Homo sapiens
gagagcaatgagatgtaaacact

SEQ ID NO: 7760932 - DNA, 22 bp, Homo sapiens
gagagaggcctccatgtactga

SEQ ID NO: 7760933 - DNA, 22 bp, Homo sapiens
atggagggtgtcagagagcgaa

SEQ ID NO: 7760934 - DNA, 21 bp, Homo sapiens
gagatggcccagtagcgggcc

SEQ ID NO: 7760935 - DNA, 21 bp, Homo sapiens
atggagggaccagggaagcag

SEQ ID NO: 7760936 - DNA, 22 bp, Homo sapiens
atggagggtggtaagacagaga

SEQ ID NO: 7760937 - DNA, 22 bp, Homo sapiens
atggaggatgtgcagcatgggc

SEQ ID NO: 7760938 - DNA, 18 bp, Homo sapiens
atggaggcagagagctga

SEQ ID NO: 7760939 - DNA, 22 bp, Homo sapiens
atggagggaaaagtggagagcc

SEQ ID NO: 7760940 - DNA, 22 bp, Homo sapiens
atggagggaaaagtggagagcc

SEQ ID NO: 7760941 - DNA, 22 bp, Homo sapiens
atggcattgtttatagattgca

SEQ ID NO: 7760942 - DNA, 22 bp, Homo sapiens
atggtggtagaagcactatgtg

SEQ ID NO: 7760943 - DNA, 22 bp, Homo sapiens
atggtggtgaagagcacagtga

SEQ ID NO: 7760944 - DNA, 22 bp, Homo sapiens
atggtggtttgggagaaaaagc

SEQ ID NO: 7760945 - DNA, 22 bp, Homo sapiens
atggtggatttgtgattcagct

SEQ ID NO: 7760946 - DNA, 22 bp, Homo sapiens
atggtggactcttgattcaggc

SEQ ID NO: 7760947 - DNA, 22 bp, Homo sapiens
gaggcagcattcgcatagacag

SEQ ID NO: 7760948 - DNA, 22 bp, Homo sapiens
atggtggaagagcatcagaaag

SEQ ID NO: 7760949 - DNA, 22 bp, Homo sapiens
atggggaagagccagtgagctg

SEQ ID NO: 7760950 - DNA, 22 bp, Homo sapiens
atgggctgtgggaccctggacc

SEQ ID NO: 7760951 - DNA, 22 bp, Homo sapiens
atggggaagcaattggatttcc

SEQ ID NO: 7760952 - DNA, 22 bp, Homo sapiens
atgggagaaacatcatgaggca

SEQ ID NO: 7760953 - DNA, 22 bp, Homo sapiens
atgggaagctgacctgcatgga

SEQ ID NO: 7760954 - DNA, 22 bp, Homo sapiens
atgggaagctgacctgcatgga

SEQ ID NO: 7760955 - DNA, 22 bp, Homo sapiens
gatacaaaatataaatggagag

SEQ ID NO: 7760956 - DNA, 22 bp, Homo sapiens
gatatcatgggaaggtgtactt

SEQ ID NO: 7760957 - DNA, 22 bp, Homo sapiens
gatacaaattcatgtctgaatt

SEQ ID NO: 7760958 - DNA, 22 bp, Homo sapiens
gatacaaattcatgtctgaatt

SEQ ID NO: 7760959 - DNA, 22 bp, Homo sapiens
gatatattttccatggtctgca

SEQ ID NO: 7760960 - DNA, 22 bp, Homo sapiens
gagttcatattcagagatcgct

SEQ ID NO: 7760961 - DNA, 22 bp, Homo sapiens
atgtttaaaggagtcagagact

SEQ ID NO: 7760962 - DNA, 22 bp, Homo sapiens
atgttctgaataatgtgcatta

SEQ ID NO: 7760963 - DNA, 20 bp, Homo sapiens
atgttcttcatttaatgttc

SEQ ID NO: 7760964 - DNA, 22 bp, Homo sapiens
atgttcttatcattctttcgga

SEQ ID NO: 7760965 - DNA, 22 bp, Homo sapiens
atgttcttggatgttgtgtata

SEQ ID NO: 7760966 - DNA, 22 bp, Homo sapiens
atgttcttgttcaaatgtcagt

SEQ ID NO: 7760967 - DNA, 22 bp, Homo sapiens
atgttctttgaaatattttaga

SEQ ID NO: 7760968 - DNA, 22 bp, Homo sapiens
gaggtggcctcaagcagtcttc

SEQ ID NO: 7760969 - DNA, 22 bp, Homo sapiens
gaggtggctccaggagcaatgc

SEQ ID NO: 7760970 - DNA, 22 bp, Homo sapiens
gaggtggcactgtgaggagcac

SEQ ID NO: 7760971 - DNA, 22 bp, Homo sapiens
gaggtggcactgtgaggagcac

SEQ ID NO: 7760972 - DNA, 22 bp, Homo sapiens
gaggtggcccttgctcagcctt

SEQ ID NO: 7760973 - DNA, 22 bp, Homo sapiens
gaggtggcctcaagcagtcttc

SEQ ID NO: 7760974 - DNA, 22 bp, Homo sapiens
atgtccttgttttggtgacact

SEQ ID NO: 7760975 - DNA, 22 bp, Homo sapiens
atgtctctcaggtttaacttta

SEQ ID NO: 7760976 - DNA, 23 bp, Homo sapiens
atgtctctgggcagtagggcttg

SEQ ID NO: 7760977 - DNA, 19 bp, Homo sapiens
atgtctctgtagcacatac

SEQ ID NO: 7760978 - DNA, 22 bp, Homo sapiens
gagggctctgtctggaagggaa

SEQ ID NO: 7760979 - DNA, 20 bp, Homo sapiens
atgtctgaagtaatccattt

SEQ ID NO: 7760980 - DNA, 22 bp, Homo sapiens
atgtctgataaataatgcataa

SEQ ID NO: 7760981 - DNA, 22 bp, Homo sapiens
atgtctctttagagcaacagta

SEQ ID NO: 7760982 - DNA, 22 bp, Homo sapiens
atgtctctttactcttagaacc

SEQ ID NO: 7760983 - DNA, 22 bp, Homo sapiens
gaggtagggcagaggctgaatg

SEQ ID NO: 7760984 - DNA, 22 bp, Homo sapiens
atgtgactccacagctgtgctg

SEQ ID NO: 7760985 - DNA, 22 bp, Homo sapiens
atgtgactagcccttcatgacc

SEQ ID NO: 7760986 - DNA, 22 bp, Homo sapiens
atgtgactttgtgtcttccatc

SEQ ID NO: 7760987 - DNA, 22 bp, Homo sapiens
atgtgacttcagtcttcttaca

SEQ ID NO: 7760988 - DNA, 22 bp, Homo sapiens
atgtgactccaggcagttttgt

SEQ ID NO: 7760989 - DNA, 22 bp, Homo sapiens
gacacagtttttctcacggtgg

SEQ ID NO: 7760990 - DNA, 22 bp, Homo sapiens
gacaattagatcattcctttga

SEQ ID NO: 7760991 - DNA, 19 bp, Homo sapiens
gacaattagagatcactca

SEQ ID NO: 7760992 - DNA, 22 bp, Homo sapiens
gacaatttctcaatatagaaac

SEQ ID NO: 7760993 - DNA, 22 bp, Homo sapiens
gacatttgttcctctaagtgac

SEQ ID NO: 7760994 - DNA, 22 bp, Homo sapiens
gaccacagaggtgtgggagaga

SEQ ID NO: 7760995 - DNA, 22 bp, Homo sapiens
gaccacagcagtgcaagaggag

SEQ ID NO: 7760996 - DNA, 22 bp, Homo sapiens
gaccacagattcctaagtggca

SEQ ID NO: 7760997 - DNA, 22 bp, Homo sapiens
atgctatgtaactggcagatag

SEQ ID NO: 7760998 - DNA, 22 bp, Homo sapiens
gacactacgtggctcacatttc

SEQ ID NO: 7760999 - DNA, 22 bp, Homo sapiens
gacatacaagctggtacctcct

SEQ ID NO: 7761000 - DNA, 22 bp, Homo sapiens
gacatttatgaaggagatatgc

SEQ ID NO: 7761001 - DNA, 22 bp, Homo sapiens
gacatttattagaaaactatca

SEQ ID NO: 7761002 - DNA, 22 bp, Homo sapiens
gaccttgtgctccgaggcgggc

SEQ ID NO: 7761003 - DNA, 22 bp, Homo sapiens
atgctccaccttttgcaggaac

SEQ ID NO: 7761004 - DNA, 22 bp, Homo sapiens
atgctcctcgagtgtctcacag

SEQ ID NO: 7761005 - DNA, 22 bp, Homo sapiens
atgctcacttcagagaagatga

SEQ ID NO: 7761006 - DNA, 22 bp, Homo sapiens
atgctattccagaatgtaaatt

SEQ ID NO: 7761007 - DNA, 22 bp, Homo sapiens
gaataatattgactttgcaggc

SEQ ID NO: 7761008 - DNA, 22 bp, Homo sapiens
gaataatagcagaaattagcag

SEQ ID NO: 7761009 - DNA, 22 bp, Homo sapiens
gaataatattgactttgcaggc

SEQ ID NO: 7761010 - DNA, 22 bp, Homo sapiens
gaataattgtgatgcttgaagt

SEQ ID NO: 7761011 - DNA, 22 bp, Homo sapiens
gaataattttgatcagaaggga

SEQ ID NO: 7761012 - DNA, 22 bp, Homo sapiens
gaatacaaacttaaggctttac

SEQ ID NO: 7761013 - DNA, 22 bp, Homo sapiens
gacaataaagtgatacatggga

SEQ ID NO: 7761014 - DNA, 22 bp, Homo sapiens
gacaataaagtgatacatggga

SEQ ID NO: 7761015 - DNA, 22 bp, Homo sapiens
gacaataagaaaagaggaggca

SEQ ID NO: 7761016 - DNA, 22 bp, Homo sapiens
gacaataagaacagatactgtg

SEQ ID NO: 7761017 - DNA, 22 bp, Homo sapiens
gaattttatcttattacttgca

SEQ ID NO: 7761018 - DNA, 19 bp, Homo sapiens
gaattttaggacttcagca

SEQ ID NO: 7761019 - DNA, 22 bp, Homo sapiens
gaatatttttaaagggactaat

SEQ ID NO: 7761020 - DNA, 22 bp, Homo sapiens
gaatcacactcgtaagtgagtt

SEQ ID NO: 7761021 - DNA, 22 bp, Homo sapiens
gaatcagaatctctaaggtggg

SEQ ID NO: 7761022 - DNA, 22 bp, Homo sapiens
gaacaaagacatggaggaggat

SEQ ID NO: 7761023 - DNA, 22 bp, Homo sapiens
gaacaaatcccttcctgtctcc

SEQ ID NO: 7761024 - DNA, 22 bp, Homo sapiens
gaacaactccaagggacatcat

SEQ ID NO: 7761025 - DNA, 22 bp, Homo sapiens
gaaggctggctcagctttccag

SEQ ID NO: 7761026 - DNA, 22 bp, Homo sapiens
gaaggctgctgggaagtgtggt

SEQ ID NO: 7761027 - DNA, 22 bp, Homo sapiens
gaacaatacaggctttattcct

SEQ ID NO: 7761028 - DNA, 22 bp, Homo sapiens
gaacaatagtggtaacaaagcc

SEQ ID NO: 7761029 - DNA, 22 bp, Homo sapiens
gaacaatagtggtaacaaagcc

SEQ ID NO: 7761030 - DNA, 22 bp, Homo sapiens
gaacaactttgaaacatgaaga

SEQ ID NO: 7761031 - DNA, 22 bp, Homo sapiens
gaaggctgtcagagaggagggc

SEQ ID NO: 7761032 - DNA, 22 bp, Homo sapiens
gaaggctgtcagagaggagggc

SEQ ID NO: 7761033 - DNA, 22 bp, Homo sapiens
gaaggctgtggctggtctcagt

SEQ ID NO: 7761034 - DNA, 22 bp, Homo sapiens
gaaggctggggccttctcatct

SEQ ID NO: 7761035 - DNA, 22 bp, Homo sapiens
gaaggctggggcatcagtgaaa

SEQ ID NO: 7761036 - DNA, 16 bp, Homo sapiens
gaaggcttactgcagg

SEQ ID NO: 7761037 - DNA, 22 bp, Homo sapiens
gaaggcttagaaacaagggagc

SEQ ID NO: 7761038 - DNA, 22 bp, Homo sapiens
gaaggcttatgtgtgactttcg

SEQ ID NO: 7761039 - DNA, 22 bp, Homo sapiens
atgcacaattaggatatagctt

SEQ ID NO: 7761040 - DNA, 22 bp, Homo sapiens
atctggctattgacatgttata

SEQ ID NO: 7761041 - DNA, 22 bp, Homo sapiens
ctttcaaagaccttggcatggg

SEQ ID NO: 7761042 - DNA, 22 bp, Homo sapiens
ctttccagtttctaagtacagt

SEQ ID NO: 7761043 - DNA, 22 bp, Homo sapiens
ctttcccttttgccttgcgtgg

SEQ ID NO: 7761044 - DNA, 22 bp, Homo sapiens
ctttcccttttgccttgcgtgg

SEQ ID NO: 7761045 - DNA, 22 bp, Homo sapiens
ctttcccttagccccattctat

SEQ ID NO: 7761046 - DNA, 22 bp, Homo sapiens
ctttcccttagccccattctat

SEQ ID NO: 7761047 - DNA, 22 bp, Homo sapiens
ctttccctgcttagaaggattt

SEQ ID NO: 7761048 - DNA, 22 bp, Homo sapiens
ctttccccaagcaccacagtgc

SEQ ID NO: 7761049 - DNA, 22 bp, Homo sapiens
cttcttgtgcactctctatgta

SEQ ID NO: 7761050 - DNA, 18 bp, Homo sapiens
cttcttgtttgatttggg

SEQ ID NO: 7761051 - DNA, 22 bp, Homo sapiens
cttctttaatgtatacaaaaga

SEQ ID NO: 7761052 - DNA, 22 bp, Homo sapiens
cttctttaatgtatacaaaaga

SEQ ID NO: 7761053 - DNA, 22 bp, Homo sapiens
cttctttactttctagaaataa

SEQ ID NO: 7761054 - DNA, 22 bp, Homo sapiens
cttctttactttctagaaataa

SEQ ID NO: 7761055 - DNA, 22 bp, Homo sapiens
cttctttaatgtatacaaaaga

SEQ ID NO: 7761056 - DNA, 22 bp, Homo sapiens
atctggataggttgttttgcat

SEQ ID NO: 7761057 - DNA, 22 bp, Homo sapiens
atgaaaatgtacatgtgtataa

SEQ ID NO: 7761058 - DNA, 22 bp, Homo sapiens
atgaaattaatcaacacataca

SEQ ID NO: 7761059 - DNA, 22 bp, Homo sapiens
atgaacatcctaggaggcattt

SEQ ID NO: 7761060 - DNA, 22 bp, Homo sapiens
atgaaccttgatttgttcatct

SEQ ID NO: 7761061 - DNA, 22 bp, Homo sapiens
atgaacatctctgatccaagca

SEQ ID NO: 7761062 - DNA, 23 bp, Homo sapiens
atgaacattagtttcagatattg

SEQ ID NO: 7761063 - DNA, 22 bp, Homo sapiens
gaaatttattatctacatcatt

SEQ ID NO: 7761064 - DNA, 22 bp, Homo sapiens
atgatatttgcaatgtgcttgc

SEQ ID NO: 7761065 - DNA, 22 bp, Homo sapiens
gaaagtattagcctagaagtca

SEQ ID NO: 7761066 - DNA, 22 bp, Homo sapiens
gaaagtatttacattaacatct

SEQ ID NO: 7761067 - DNA, 22 bp, Homo sapiens
gaaagtatttacattaacatct

SEQ ID NO: 7761068 - DNA, 22 bp, Homo sapiens
gaaagtgcagtcagacaaggca

SEQ ID NO: 7761069 - DNA, 22 bp, Homo sapiens
gaaatacagttgggaggaggta

SEQ ID NO: 7761070 - DNA, 22 bp, Homo sapiens
gaaatagacactttctatgaat

SEQ ID NO: 7761071 - DNA, 22 bp, Homo sapiens
gaaatactgtaaagttattatt

SEQ ID NO: 7761072 - DNA, 22 bp, Homo sapiens
ctttcttgcataatttgaaacc

SEQ ID NO: 7761073 - DNA, 22 bp, Homo sapiens
ctttctttcgaagacgtgatta

SEQ ID NO: 7761074 - DNA, 22 bp, Homo sapiens
ctttctttcgaagacgtgatta

SEQ ID NO: 7761075 - DNA, 22 bp, Homo sapiens
gaaacatacgatttaggagaaa

SEQ ID NO: 7761076 - DNA, 22 bp, Homo sapiens
gaaacagtgagaacttttcctg

SEQ ID NO: 7761077 - DNA, 22 bp, Homo sapiens
gaaacagtcaactttctttccc

SEQ ID NO: 7761078 - DNA, 22 bp, Homo sapiens
gaaacattgagcagaaggagaa

SEQ ID NO: 7761079 - DNA, 22 bp, Homo sapiens
gaaacattcatatgagaaacct

SEQ ID NO: 7761080 - DNA, 20 bp, Homo sapiens
gaaacattggcagcaactga

SEQ ID NO: 7761081 - DNA, 22 bp, Homo sapiens
gaaacattgtgttctacagatt

SEQ ID NO: 7761082 - DNA, 22 bp, Homo sapiens
gaaacattggtctgccccttat

SEQ ID NO: 7761083 - DNA, 22 bp, Homo sapiens
gaaacattcagtcaacagtgtt

SEQ ID NO: 7761084 - DNA, 22 bp, Homo sapiens
gaaacatattaatccagtgaaa

SEQ ID NO: 7761085 - DNA, 22 bp, Homo sapiens
gaaacatagttgagacactgct

SEQ ID NO: 7761086 - DNA, 22 bp, Homo sapiens
atgacagtactggtgacaatac

SEQ ID NO: 7761087 - DNA, 22 bp, Homo sapiens
atgacagtgggtcttgcaaaga

SEQ ID NO: 7761088 - DNA, 22 bp, Homo sapiens
gaaagcataactaatatttatt

SEQ ID NO: 7761089 - DNA, 22 bp, Homo sapiens
gaaaccacagtacccaggaaaa

SEQ ID NO: 7761090 - DNA, 22 bp, Homo sapiens
gaaacatttgttgagtacttgc

SEQ ID NO: 7761091 - DNA, 22 bp, Homo sapiens
atgacagtactggtgacaatac

SEQ ID NO: 7761092 - DNA, 22 bp, Homo sapiens
atgacagcattttcttctaagg

SEQ ID NO: 7761093 - DNA, 22 bp, Homo sapiens
atcagaaaaacataatgttatt

SEQ ID NO: 7761094 - DNA, 22 bp, Homo sapiens
atcacattgccagtgattaccc

SEQ ID NO: 7761095 - DNA, 22 bp, Homo sapiens
atcacattctttcaaagcagtc

SEQ ID NO: 7761096 - DNA, 22 bp, Homo sapiens
atcaacttgtccttgatgttaa

SEQ ID NO: 7761097 - DNA, 21 bp, Homo sapiens
atcaacattgaaagagctgga

SEQ ID NO: 7761098 - DNA, 22 bp, Homo sapiens
atcaaatacaaagggcataagg

SEQ ID NO: 7761099 - DNA, 22 bp, Homo sapiens
atcaaatacaaagggcataagg

SEQ ID NO: 7761100 - DNA, 22 bp, Homo sapiens
atcaaatacaaagggcataagg

SEQ ID NO: 7761101 - DNA, 22 bp, Homo sapiens
atcaaatacaaagggcataagg

SEQ ID NO: 7761102 - DNA, 22 bp, Homo sapiens
atcaaatacaaagggcataagg

SEQ ID NO: 7761103 - DNA, 22 bp, Homo sapiens
atcaaagtttcccagaagttgt

SEQ ID NO: 7761104 - DNA, 22 bp, Homo sapiens
atcaaataaaggtacctagctt

SEQ ID NO: 7761105 - DNA, 22 bp, Homo sapiens
atcaaataaaggtacctagctt

SEQ ID NO: 7761106 - DNA, 22 bp, Homo sapiens
atcaaataaaggtacctagctt

SEQ ID NO: 7761107 - DNA, 22 bp, Homo sapiens
atcaaatataataattttcgct

SEQ ID NO: 7761108 - DNA, 22 bp, Homo sapiens
atcaaatataataattttcgct

SEQ ID NO: 7761109 - DNA, 22 bp, Homo sapiens
atcaaatcattgcattaatgtt

SEQ ID NO: 7761110 - DNA, 22 bp, Homo sapiens
atcaacaggtatggatgagatt

SEQ ID NO: 7761111 - DNA, 22 bp, Homo sapiens
atcaacagagcaaagcctgaac

SEQ ID NO: 7761112 - DNA, 22 bp, Homo sapiens
atcaaattatgtgctacaagaa

SEQ ID NO: 7761113 - DNA, 22 bp, Homo sapiens
atcagaatactatcaacagtga

SEQ ID NO: 7761114 - DNA, 22 bp, Homo sapiens
atcagaataattagatttcaga

SEQ ID NO: 7761115 - DNA, 22 bp, Homo sapiens
atcagaatcatttcatccctat

SEQ ID NO: 7761116 - DNA, 22 bp, Homo sapiens
atcagaatagtgggggacagtc

SEQ ID NO: 7761117 - DNA, 22 bp, Homo sapiens
atcagaatagtgggggacagtc

SEQ ID NO: 7761118 - DNA, 22 bp, Homo sapiens
atcaaagaatgtgactgaaata

SEQ ID NO: 7761119 - DNA, 22 bp, Homo sapiens
atcaaaatgctccagtgatggt

SEQ ID NO: 7761120 - DNA, 22 bp, Homo sapiens
atatttactgctgtggtgaagg

SEQ ID NO: 7761121 - DNA, 22 bp, Homo sapiens
atcaaagtccatcagaaggtag

SEQ ID NO: 7761122 - DNA, 22 bp, Homo sapiens
atcaaagtggttttctgtgctt

SEQ ID NO: 7761123 - DNA, 22 bp, Homo sapiens
atcaaagagtgagatttttact

SEQ ID NO: 7761124 - DNA, 22 bp, Homo sapiens
atcaaagatgtttcagggtgta

SEQ ID NO: 7761125 - DNA, 22 bp, Homo sapiens
atcaaagagcttgacaatccta

SEQ ID NO: 7761126 - DNA, 22 bp, Homo sapiens
atcaaagtatctcaatatggta

SEQ ID NO: 7761127 - DNA, 22 bp, Homo sapiens
atcaaagtaggcatatgttttt

SEQ ID NO: 7761128 - DNA, 22 bp, Homo sapiens
atattgttgactataagagtaa

SEQ ID NO: 7761129 - DNA, 22 bp, Homo sapiens
atattgttgactataagagtaa

SEQ ID NO: 7761130 - DNA, 21 bp, Homo sapiens
atattgtaggtaaagtgcagg

SEQ ID NO: 7761131 - DNA, 22 bp, Homo sapiens
ctgggctgagcctgggctgtgt

SEQ ID NO: 7761132 - DNA, 22 bp, Homo sapiens
atattatagacagagtcttctg

SEQ ID NO: 7761133 - DNA, 22 bp, Homo sapiens
atattagcagtgatcaaaatgg

SEQ ID NO: 7761134 - DNA, 22 bp, Homo sapiens
atattacataaacatgagtgaa

SEQ ID NO: 7761135 - DNA, 22 bp, Homo sapiens
atattagtttggagactacaat

SEQ ID NO: 7761136 - DNA, 22 bp, Homo sapiens
atattataagttatttcaagtt

SEQ ID NO: 7761137 - DNA, 22 bp, Homo sapiens
atatgcattcatacttagtgga

SEQ ID NO: 7761138 - DNA, 22 bp, Homo sapiens
atatgccagctccaagtaagag

SEQ ID NO: 7761139 - DNA, 22 bp, Homo sapiens
atatgcatctgtgtgcgtgtct

SEQ ID NO: 7761140 - DNA, 22 bp, Homo sapiens
atatgcatatgtcaaaacttat

SEQ ID NO: 7761141 - DNA, 20 bp, Homo sapiens
atatgcatgtgttttcactt

SEQ ID NO: 7761142 - DNA, 22 bp, Homo sapiens
atatgcattaacattgtaggag

SEQ ID NO: 7761143 - DNA, 22 bp, Homo sapiens
atatgtttttggaaagaacaca

SEQ ID NO: 7761144 - DNA, 22 bp, Homo sapiens
atattacataaacatgagtgaa

SEQ ID NO: 7761145 - DNA, 22 bp, Homo sapiens
ctggcttctgggccagggcaga

SEQ ID NO: 7761146 - DNA, 20 bp, Homo sapiens
ctggcttcgggaactagttt

SEQ ID NO: 7761147 - DNA, 22 bp, Homo sapiens
atatgcatataaagcttttagt

SEQ ID NO: 7761148 - DNA, 22 bp, Homo sapiens
ctggcttccctgtcttatggaa

SEQ ID NO: 7761149 - DNA, 22 bp, Homo sapiens
ctggcttcctgagtccattacc

SEQ ID NO: 7761150 - DNA, 22 bp, Homo sapiens
ctggcttccaccatggcccctg

SEQ ID NO: 7761151 - DNA, 22 bp, Homo sapiens
ctggctgtgtcttggaggagct

SEQ ID NO: 7761152 - DNA, 22 bp, Homo sapiens
ctggctgtgtcttggaggagct

SEQ ID NO: 7761153 - DNA, 22 bp, Homo sapiens
ctggctgtttcaggcagtgtcc

SEQ ID NO: 7761154 - DNA, 22 bp, Homo sapiens
ctggcttcagctgccatcaatg

SEQ ID NO: 7761155 - DNA, 22 bp, Homo sapiens
ctggctgggagcgagctgctca

SEQ ID NO: 7761156 - DNA, 22 bp, Homo sapiens
ctggctgtggtcacaggtaact

SEQ ID NO: 7761157 - DNA, 22 bp, Homo sapiens
ctggctggccggagcgaggcgg

SEQ ID NO: 7761158 - DNA, 22 bp, Homo sapiens
ctggctggccggaggcatccct

SEQ ID NO: 7761159 - DNA, 22 bp, Homo sapiens
atcagaatgcagccagcagtta

SEQ ID NO: 7761160 - DNA, 22 bp, Homo sapiens
atcagaatgttttggtgtgctc

SEQ ID NO: 7761161 - DNA, 22 bp, Homo sapiens
atcagaatggagcccacatggt

SEQ ID NO: 7761162 - DNA, 22 bp, Homo sapiens
atcagaattagccagtgaggct

SEQ ID NO: 7761163 - DNA, 20 bp, Homo sapiens
atcagacttttaggaacata

SEQ ID NO: 7761164 - DNA, 19 bp, Homo sapiens
ctgtggcctccaggaggga

SEQ ID NO: 7761165 - DNA, 21 bp, Homo sapiens
ctgtgggaccaagcactggga

SEQ ID NO: 7761166 - DNA, 22 bp, Homo sapiens
ctgtgggagaagttgctggagt

SEQ ID NO: 7761167 - DNA, 22 bp, Homo sapiens
ctgtgggagaggtgcctggatt

SEQ ID NO: 7761168 - DNA, 18 bp, Homo sapiens
ctgtgggaaggctttcta

SEQ ID NO: 7761169 - DNA, 18 bp, Homo sapiens
ctgtgggaaggctttcta

SEQ ID NO: 7761170 - DNA, 18 bp, Homo sapiens
ctgtgggaagagtttggg

SEQ ID NO: 7761171 - DNA, 18 bp, Homo sapiens
ctgtgggaagagtttggg

SEQ ID NO: 7761172 - DNA, 22 bp, Homo sapiens
ctgtggctaggaagctgtggga

SEQ ID NO: 7761173 - DNA, 22 bp, Homo sapiens
ctgtggctatggtgtacatact

SEQ ID NO: 7761174 - DNA, 22 bp, Homo sapiens
ctgtggctcaattgcctactga

SEQ ID NO: 7761175 - DNA, 22 bp, Homo sapiens
ctgtggctcaattgcctactga

SEQ ID NO: 7761176 - DNA, 22 bp, Homo sapiens
ctgtgggaaaggatgagattgc

SEQ ID NO: 7761177 - DNA, 22 bp, Homo sapiens
atccaccctgtggtggctttct

SEQ ID NO: 7761178 - DNA, 22 bp, Homo sapiens
atccagtagtgacttttacatt

SEQ ID NO: 7761179 - DNA, 22 bp, Homo sapiens
atccagtcaaaattagtaaggt

SEQ ID NO: 7761180 - DNA, 22 bp, Homo sapiens
atccagtgagtgcagctgttgt

SEQ ID NO: 7761181 - DNA, 22 bp, Homo sapiens
atcctgggcagtgtgtcactct

SEQ ID NO: 7761182 - DNA, 22 bp, Homo sapiens
atcctgggcagttttgagtgct

SEQ ID NO: 7761183 - DNA, 22 bp, Homo sapiens
atcctgggcctcagaggtgtgt

SEQ ID NO: 7761184 - DNA, 22 bp, Homo sapiens
atcctgtcatcatagtacttga

SEQ ID NO: 7761185 - DNA, 22 bp, Homo sapiens
cttcctcccccacacactcact

SEQ ID NO: 7761186 - DNA, 17 bp, Homo sapiens
cttcccaccatctcctg

SEQ ID NO: 7761187 - DNA, 22 bp, Homo sapiens
cttcccaagctttagttatttt

SEQ ID NO: 7761188 - DNA, 22 bp, Homo sapiens
cttcccaagactgtattgcaag

SEQ ID NO: 7761189 - DNA, 22 bp, Homo sapiens
cttagagatgggttttacttag

SEQ ID NO: 7761190 - DNA, 22 bp, Homo sapiens
cttagagatgggttttacttag

SEQ ID NO: 7761191 - DNA, 22 bp, Homo sapiens
cttcattaactattggaatgca

SEQ ID NO: 7761192 - DNA, 22 bp, Homo sapiens
cttcctctagcctagtaatgcc

SEQ ID NO: 7761193 - DNA, 22 bp, Homo sapiens
cttcctccgaagaagttgctgg

SEQ ID NO: 7761194 - DNA, 22 bp, Homo sapiens
cttcctcccggcccatgctctg

SEQ ID NO: 7761195 - DNA, 22 bp, Homo sapiens
atctgaagaatgaatggaatta

SEQ ID NO: 7761196 - DNA, 21 bp, Homo sapiens
atctgaagtttgagaggaaag

SEQ ID NO: 7761197 - DNA, 22 bp, Homo sapiens
atctgaagtccttataatctga

SEQ ID NO: 7761198 - DNA, 22 bp, Homo sapiens
atctgacaacctattgacttga

SEQ ID NO: 7761199 - DNA, 22 bp, Homo sapiens
atctgaagggaagtggaaggca

SEQ ID NO: 7761200 - DNA, 22 bp, Homo sapiens
atctgaagtccttataatctga

SEQ ID NO: 7761201 - DNA, 22 bp, Homo sapiens
cttcttgctgggggcctcagtg

SEQ ID NO: 7761202 - DNA, 22 bp, Homo sapiens
cttcttgcaattttcatcttat

SEQ ID NO: 7761203 - DNA, 22 bp, Homo sapiens
atctgcacttaagcgaggcctg

SEQ ID NO: 7761204 - DNA, 22 bp, Homo sapiens
atctgacatctccctctgacat

SEQ ID NO: 7761205 - DNA, 22 bp, Homo sapiens
atacatagttctgtgaaaagta

SEQ ID NO: 7761206 - DNA, 22 bp, Homo sapiens
ataccaattagagtttgttgca

SEQ ID NO: 7761207 - DNA, 21 bp, Homo sapiens
atacattctattaagcattta

SEQ ID NO: 7761208 - DNA, 22 bp, Homo sapiens
atacattcctactgactagcta

SEQ ID NO: 7761209 - DNA, 22 bp, Homo sapiens
atacattcatcacttttggtcc

SEQ ID NO: 7761210 - DNA, 22 bp, Homo sapiens
atacattcagcagtgctcatga

SEQ ID NO: 7761211 - DNA, 22 bp, Homo sapiens
ataccatttccatgttacatta

SEQ ID NO: 7761212 - DNA, 22 bp, Homo sapiens
ataccctttacaggaacagcaa

SEQ ID NO: 7761213 - DNA, 22 bp, Homo sapiens
atacctatgtgacagtattatt

SEQ ID NO: 7761214 - DNA, 22 bp, Homo sapiens
ataccttttactcattatccat

SEQ ID NO: 7761215 - DNA, 22 bp, Homo sapiens
atacagtataactaataaaccc

SEQ ID NO: 7761216 - DNA, 22 bp, Homo sapiens
atacagtattacctgttcagga

SEQ ID NO: 7761217 - DNA, 22 bp, Homo sapiens
atacagtagggaccatgtctga

SEQ ID NO: 7761218 - DNA, 22 bp, Homo sapiens
atacatacgtacatacgtatgt

SEQ ID NO: 7761219 - DNA, 22 bp, Homo sapiens
atacataattacttccgatgtt

SEQ ID NO: 7761220 - DNA, 17 bp, Homo sapiens
atacagtttattttaca

SEQ ID NO: 7761221 - DNA, 22 bp, Homo sapiens
ctggaatgtctgctcaatgttt

SEQ ID NO: 7761222 - DNA, 22 bp, Homo sapiens
atacagtagggaccatgtctga

SEQ ID NO: 7761223 - DNA, 22 bp, Homo sapiens
ctggaagtttccttcctggtca

SEQ ID NO: 7761224 - DNA, 22 bp, Homo sapiens
ctggaagtggggttggcttgaa

SEQ ID NO: 7761225 - DNA, 18 bp, Homo sapiens
ctggaagttagtctttgg

SEQ ID NO: 7761226 - DNA, 22 bp, Homo sapiens
ctggaatggcaatgggaagtcc

SEQ ID NO: 7761227 - DNA, 22 bp, Homo sapiens
ctggaatgcggagagttggaga

SEQ ID NO: 7761228 - DNA, 20 bp, Homo sapiens
ctggaatgggtgtgggttag

SEQ ID NO: 7761229 - DNA, 22 bp, Homo sapiens
ctggaatgagagcccggggatc

SEQ ID NO: 7761230 - DNA, 22 bp, Homo sapiens
ctggaatgagcagggcttatgg

SEQ ID NO: 7761231 - DNA, 22 bp, Homo sapiens
ctggaatgcctccctgtcagag

SEQ ID NO: 7761232 - DNA, 19 bp, Homo sapiens
ctggaatgagaacatgccc

SEQ ID NO: 7761233 - DNA, 22 bp, Homo sapiens
ctggaatgaagctatgtacatt

SEQ ID NO: 7761234 - DNA, 22 bp, Homo sapiens
ctggcccatggtgagctctggg

SEQ ID NO: 7761235 - DNA, 20 bp, Homo sapiens
ctggcccatctaccgctctg

SEQ ID NO: 7761236 - DNA, 22 bp, Homo sapiens
ctggcccatggtgagctctggg

SEQ ID NO: 7761237 - DNA, 22 bp, Homo sapiens
ctggcccatggtgagctctggg

SEQ ID NO: 7761238 - DNA, 22 bp, Homo sapiens
ctggcccattgccttctctctc

SEQ ID NO: 7761239 - DNA, 22 bp, Homo sapiens
atagcaaaggacaatagtcagt

SEQ ID NO: 7761240 - DNA, 22 bp, Homo sapiens
ctggcccagttctgcgttttgc

SEQ ID NO: 7761241 - DNA, 22 bp, Homo sapiens
atagcaaaggacaatagtcagt

SEQ ID NO: 7761242 - DNA, 22 bp, Homo sapiens
atagcaaaagcatgtgcaatac

SEQ ID NO: 7761243 - DNA, 22 bp, Homo sapiens
atactcaaggttaatgattgaa

SEQ ID NO: 7761244 - DNA, 22 bp, Homo sapiens
atactacatactatgtaaacat

SEQ ID NO: 7761245 - DNA, 22 bp, Homo sapiens
atactaaagtatagaacttagt

SEQ ID NO: 7761246 - DNA, 22 bp, Homo sapiens
atactacaatcataattgtaca

SEQ ID NO: 7761247 - DNA, 22 bp, Homo sapiens
ctggctggcaagtagaacacaa

SEQ ID NO: 7761248 - DNA, 22 bp, Homo sapiens
ctggctggccatgcagcgccag

SEQ ID NO: 7761249 - DNA, 22 bp, Homo sapiens
ctggctggcagatgctcttgct

SEQ ID NO: 7761250 - DNA, 22 bp, Homo sapiens
ctggctggccggagcgaggcgg

SEQ ID NO: 7761251 - DNA, 22 bp, Homo sapiens
atagcaaattctttaggtgctt

SEQ ID NO: 7761252 - DNA, 22 bp, Homo sapiens
atagcaaatattttaatgagca

SEQ ID NO: 7761253 - DNA, 22 bp, Homo sapiens
ctggctcccgaagccctcagtg

SEQ ID NO: 7761254 - DNA, 22 bp, Homo sapiens
ctggctcccagctttcagggag

SEQ ID NO: 7761255 - DNA, 22 bp, Homo sapiens
ctggctcccgaagccctcagtg

SEQ ID NO: 7761256 - DNA, 22 bp, Homo sapiens
ctggctccatcctaggcaaatg

SEQ ID NO: 7761257 - DNA, 22 bp, Homo sapiens
ctggctccatcactgggtgatg

SEQ ID NO: 7761258 - DNA, 22 bp, Homo sapiens
ctggctcacaggtgagatgcat

SEQ ID NO: 7761259 - DNA, 22 bp, Homo sapiens
ctggctccattactcagcatct

SEQ ID NO: 7761260 - DNA, 22 bp, Homo sapiens
ctggctccatccttgagctctg

SEQ ID NO: 7761261 - DNA, 22 bp, Homo sapiens
agttattcatttattctgtaca

SEQ ID NO: 7761262 - DNA, 22 bp, Homo sapiens
agttatgtcctcagcaaatcaa

SEQ ID NO: 7761263 - DNA, 22 bp, Homo sapiens
agttattactctttaacatatt

SEQ ID NO: 7761264 - DNA, 22 bp, Homo sapiens
ctgaggagcaaccccgtgccct

SEQ ID NO: 7761265 - DNA, 22 bp, Homo sapiens
ctgcaaggtcatgactctctgg

SEQ ID NO: 7761266 - DNA, 23 bp, Homo sapiens
ctgcaaggtacaagatgctggat

SEQ ID NO: 7761267 - DNA, 22 bp, Homo sapiens
ctgcaagggatcttcaggtagc

SEQ ID NO: 7761268 - DNA, 22 bp, Homo sapiens
ctgcaatagtttagaataattg

SEQ ID NO: 7761269 - DNA, 22 bp, Homo sapiens
ctgcaatatgatgtctgagaaa

SEQ ID NO: 7761270 - DNA, 22 bp, Homo sapiens
ctgcaaggtccacctgctacat

SEQ ID NO: 7761271 - DNA, 22 bp, Homo sapiens
ctgcaaggctggggtgagctgg

SEQ ID NO: 7761272 - DNA, 22 bp, Homo sapiens
ctgcaagatgttgtcatatgct

SEQ ID NO: 7761273 - DNA, 20 bp, Homo sapiens
ctgcaagcaggttattccag

SEQ ID NO: 7761274 - DNA, 22 bp, Homo sapiens
ctgcaaatgccgtgagagcagg

SEQ ID NO: 7761275 - DNA, 21 bp, Homo sapiens
ctgcaaatgcaaggtgaccag

SEQ ID NO: 7761276 - DNA, 22 bp, Homo sapiens
ctgcaaatgcctcggtgtgcgg

SEQ ID NO: 7761277 - DNA, 22 bp, Homo sapiens
ctgcaaatgggctttaggtggc

SEQ ID NO: 7761278 - DNA, 21 bp, Homo sapiens
ctgcaaatgtaatgagtttgg

SEQ ID NO: 7761279 - DNA, 22 bp, Homo sapiens
ctgcaaattggtggtgaggcaa

SEQ ID NO: 7761280 - DNA, 22 bp, Homo sapiens
ctgcaaatcctcagaaagggtt

SEQ ID NO: 7761281 - DNA, 22 bp, Homo sapiens
ctgcaaatccctactgggcaca

SEQ ID NO: 7761282 - DNA, 22 bp, Homo sapiens
ctgcaaatcaagttcttataat

SEQ ID NO: 7761283 - DNA, 22 bp, Homo sapiens
ctgctgattcttaaatgtggtt

SEQ ID NO: 7761284 - DNA, 22 bp, Homo sapiens
ctgctgaggtccttgctcagac

SEQ ID NO: 7761285 - DNA, 22 bp, Homo sapiens
atacaactgctctcagataagt

SEQ ID NO: 7761286 - DNA, 22 bp, Homo sapiens
ctgctgaggtatactatgtgac

SEQ ID NO: 7761287 - DNA, 22 bp, Homo sapiens
atacaaatttatagatgcattt

SEQ ID NO: 7761288 - DNA, 22 bp, Homo sapiens
atacaaatttatagatgcattt

SEQ ID NO: 7761289 - DNA, 22 bp, Homo sapiens
atacaaagtattaatcctggat

SEQ ID NO: 7761290 - DNA, 22 bp, Homo sapiens
atacaaagtattgatcctgagt

SEQ ID NO: 7761291 - DNA, 22 bp, Homo sapiens
atacaaagctaaatatggtttc

SEQ ID NO: 7761292 - DNA, 22 bp, Homo sapiens
ataagcagggtcaaatgcctac

SEQ ID NO: 7761293 - DNA, 22 bp, Homo sapiens
ataacttaatgggtcatgctct

SEQ ID NO: 7761294 - DNA, 22 bp, Homo sapiens
ataacttagagtaggcaaaagt

SEQ ID NO: 7761295 - DNA, 22 bp, Homo sapiens
ataacttattagattggagctg

SEQ ID NO: 7761296 - DNA, 22 bp, Homo sapiens
ataagaaacattattctttcca

SEQ ID NO: 7761297 - DNA, 22 bp, Homo sapiens
ataacatgagccagattgaaag

SEQ ID NO: 7761298 - DNA, 22 bp, Homo sapiens
ataacatgacctgtgcttcaca

SEQ ID NO: 7761299 - DNA, 22 bp, Homo sapiens
ataacatggagtttgtcattta

SEQ ID NO: 7761300 - DNA, 22 bp, Homo sapiens
ataaccctctggataggacagg

SEQ ID NO: 7761301 - DNA, 22 bp, Homo sapiens
ataaccatgattaatctaagaa

SEQ ID NO: 7761302 - DNA, 22 bp, Homo sapiens
ataaccttggctagtattgtgc

SEQ ID NO: 7761303 - DNA, 22 bp, Homo sapiens
ataaatgattcagcaggaaata

SEQ ID NO: 7761304 - DNA, 22 bp, Homo sapiens
ataaatgcctcagaatcatccc

SEQ ID NO: 7761305 - DNA, 22 bp, Homo sapiens
ctgcctctgcgtcccacagagt

SEQ ID NO: 7761306 - DNA, 22 bp, Homo sapiens
ctgcctctgcgtcccacagagt

SEQ ID NO: 7761307 - DNA, 20 bp, Homo sapiens
ctgccgaccacagccatgga

SEQ ID NO: 7761308 - DNA, 22 bp, Homo sapiens
ctgcctctcagcctgaccgcca

SEQ ID NO: 7761309 - DNA, 22 bp, Homo sapiens
ctgcctctcaggtccctgagat

SEQ ID NO: 7761310 - DNA, 22 bp, Homo sapiens
ctgcctctcaggtccctgagat

SEQ ID NO: 7761311 - DNA, 22 bp, Homo sapiens
ctgcctctcaggtccctgagat

SEQ ID NO: 7761312 - DNA, 22 bp, Homo sapiens
ctgcctctccccagagtggccc

SEQ ID NO: 7761313 - DNA, 22 bp, Homo sapiens
ctgcctctccccagagtggccc

SEQ ID NO: 7761314 - DNA, 22 bp, Homo sapiens
ctgcctctccccagagtggccc

SEQ ID NO: 7761315 - DNA, 22 bp, Homo sapiens
ctgcctctccccagagtggccc

SEQ ID NO: 7761316 - DNA, 19 bp, Homo sapiens
cgcaggagccgaggtgacc

SEQ ID NO: 7761317 - DNA, 22 bp, Homo sapiens
cgcaggcaagagagtacagtta

SEQ ID NO: 7761318 - DNA, 22 bp, Homo sapiens
cgcaggctccggggtgccctgg

SEQ ID NO: 7761319 - DNA, 22 bp, Homo sapiens
cgcaggcacagagtggacagcg

SEQ ID NO: 7761320 - DNA, 22 bp, Homo sapiens
cgaggccatgcatgctgaggac

SEQ ID NO: 7761321 - DNA, 22 bp, Homo sapiens
cctgttctgtggctctcaaagg

SEQ ID NO: 7761322 - DNA, 22 bp, Homo sapiens
cctgttctgttaattaaacttt

SEQ ID NO: 7761323 - DNA, 22 bp, Homo sapiens
agtaaaaagttcagaatggttg

SEQ ID NO: 7761324 - DNA, 22 bp, Homo sapiens
aggtttggtttgacaagactga

SEQ ID NO: 7761325 - DNA, 22 bp, Homo sapiens
aggtttgggttcattgctggct

SEQ ID NO: 7761326 - DNA, 22 bp, Homo sapiens
aggtttgggagtagaaatcaga

SEQ ID NO: 7761327 - DNA, 22 bp, Homo sapiens
cgcaggggaggaaggtacacct

SEQ ID NO: 7761328 - DNA, 22 bp, Homo sapiens
cgcaggctggcgcggagtggca

SEQ ID NO: 7761329 - DNA, 22 bp, Homo sapiens
cgcaggctcggttcacagagca

SEQ ID NO: 7761330 - DNA, 22 bp, Homo sapiens
cgcaggctttagaatctgctac

SEQ ID NO: 7761331 - DNA, 19 bp, Homo sapiens
cgcaggcttcgggtcgctc

SEQ ID NO: 7761332 - DNA, 17 bp, Homo sapiens
cgggcatggagggcagg

SEQ ID NO: 7761333 - DNA, 20 bp, Homo sapiens
agtacaatgtatgattcaga

SEQ ID NO: 7761334 - DNA, 21 bp, Homo sapiens
ctaagcaaggagcaggggtag

SEQ ID NO: 7761335 - DNA, 22 bp, Homo sapiens
ctaagcaagaatgagtgcaaca

SEQ ID NO: 7761336 - DNA, 22 bp, Homo sapiens
ctaagcaagaatgagtgcaaca

SEQ ID NO: 7761337 - DNA, 22 bp, Homo sapiens
agtacagtggtcataatataaa

SEQ ID NO: 7761338 - DNA, 22 bp, Homo sapiens
agtacagatttagacacgatag

SEQ ID NO: 7761339 - DNA, 22 bp, Homo sapiens
agtacaattatatttagatggt

SEQ ID NO: 7761340 - DNA, 22 bp, Homo sapiens
agtacaatttaatgaagatagc

SEQ ID NO: 7761341 - DNA, 22 bp, Homo sapiens
agtacaatttaatgaagatagc

SEQ ID NO: 7761342 - DNA, 22 bp, Homo sapiens
agtccacagagtctctcctgaa

SEQ ID NO: 7761343 - DNA, 22 bp, Homo sapiens
ctagaacagaaagtacaggaaa

SEQ ID NO: 7761344 - DNA, 22 bp, Homo sapiens
agtccatacattgagaataaca

SEQ ID NO: 7761345 - DNA, 22 bp, Homo sapiens
agtccataggcagttcataaca

SEQ ID NO: 7761346 - DNA, 22 bp, Homo sapiens
agtccataggcagttcataaca

SEQ ID NO: 7761347 - DNA, 22 bp, Homo sapiens
agtccatacattgagaataaca

SEQ ID NO: 7761348 - DNA, 22 bp, Homo sapiens
agtccatagaggctgctttcat

SEQ ID NO: 7761349 - DNA, 22 bp, Homo sapiens
agtccagggcttagtcagcggg

SEQ ID NO: 7761350 - DNA, 22 bp, Homo sapiens
agtccatagtttacattacagc

SEQ ID NO: 7761351 - DNA, 22 bp, Homo sapiens
agtcccaacagcttacaaggaa

SEQ ID NO: 7761352 - DNA, 22 bp, Homo sapiens
agtccattaactgtgttaacag

SEQ ID NO: 7761353 - DNA, 22 bp, Homo sapiens
ctagggtcaggggcctgcgtcg

SEQ ID NO: 7761354 - DNA, 22 bp, Homo sapiens
ctagtatttaaaggctatgatt

SEQ ID NO: 7761355 - DNA, 22 bp, Homo sapiens
ctagtaaagtactcaaatagcc

SEQ ID NO: 7761356 - DNA, 22 bp, Homo sapiens
agtcccagctactcaagaggct

SEQ ID NO: 7761357 - DNA, 22 bp, Homo sapiens
agtatttagagacacaagatgg

SEQ ID NO: 7761358 - DNA, 22 bp, Homo sapiens
agtattaccctcagaacttgat

SEQ ID NO: 7761359 - DNA, 22 bp, Homo sapiens
agtatgttgagttttgctttag

SEQ ID NO: 7761360 - DNA, 22 bp, Homo sapiens
agtatgttgacttattcttgga

SEQ ID NO: 7761361 - DNA, 21 bp, Homo sapiens
ctacagaatcgagcattctgg

SEQ ID NO: 7761362 - DNA, 22 bp, Homo sapiens
agtatgtcagagtgaaaatggt

SEQ ID NO: 7761363 - DNA, 22 bp, Homo sapiens
ctagaaatctctgtttacatca

SEQ ID NO: 7761364 - DNA, 22 bp, Homo sapiens
ctagaaatattttacagtcaag

SEQ ID NO: 7761365 - DNA, 22 bp, Homo sapiens
ctacatttttcaccgagcctct

SEQ ID NO: 7761366 - DNA, 22 bp, Homo sapiens
ctacatttggagagtataggaa

SEQ ID NO: 7761367 - DNA, 22 bp, Homo sapiens
ctacatttgttcaaataagctg

SEQ ID NO: 7761368 - DNA, 22 bp, Homo sapiens
ctacatttgttcaaataagctg

SEQ ID NO: 7761369 - DNA, 22 bp, Homo sapiens
ctacatttcccagctgccttcc

SEQ ID NO: 7761370 - DNA, 22 bp, Homo sapiens
ctacatttgttctatagctttt

SEQ ID NO: 7761371 - DNA, 22 bp, Homo sapiens
ctacattttgtgattatgaaat

SEQ ID NO: 7761372 - DNA, 22 bp, Homo sapiens
ctacattttaataagctgctta

SEQ ID NO: 7761373 - DNA, 22 bp, Homo sapiens
aggtagggaagaaggcatgaaa

SEQ ID NO: 7761374 - DNA, 22 bp, Homo sapiens
aggtagggaagaaggcatgaaa

SEQ ID NO: 7761375 - DNA, 22 bp, Homo sapiens
aggtagggttaatggagatata

SEQ ID NO: 7761376 - DNA, 22 bp, Homo sapiens
aggtagggggtttgggaactgc

SEQ ID NO: 7761377 - DNA, 22 bp, Homo sapiens
aggtagggctaggctgcgtctg

SEQ ID NO: 7761378 - DNA, 23 bp, Homo sapiens
aggtaggttattgctgctacctg

SEQ ID NO: 7761379 - DNA, 22 bp, Homo sapiens
aggtaggatgggtggagatgat

SEQ ID NO: 7761380 - DNA, 22 bp, Homo sapiens
aggtaggatagataggaagacc

SEQ ID NO: 7761381 - DNA, 21 bp, Homo sapiens
cctgccaggaaactgagtgtc

SEQ ID NO: 7761382 - DNA, 22 bp, Homo sapiens
cctgccagcccgcgttcatgcc

SEQ ID NO: 7761383 - DNA, 22 bp, Homo sapiens
cctgccagcatggcttatctcc

SEQ ID NO: 7761384 - DNA, 23 bp, Homo sapiens
cctgcagctgccacgccctgctc

SEQ ID NO: 7761385 - DNA, 22 bp, Homo sapiens
cctgcagctccggatttctggg

SEQ ID NO: 7761386 - DNA, 22 bp, Homo sapiens
cctgcagcctcttctgaaaatc

SEQ ID NO: 7761387 - DNA, 22 bp, Homo sapiens
cctgcagccgtcctgtttgtct

SEQ ID NO: 7761388 - DNA, 22 bp, Homo sapiens
cctgccagatcccctgagctga

SEQ ID NO: 7761389 - DNA, 23 bp, Homo sapiens
cctgcagctgctggggctccacc

SEQ ID NO: 7761390 - DNA, 22 bp, Homo sapiens
cctgcagaggtcaggccagaaa

SEQ ID NO: 7761391 - DNA, 22 bp, Homo sapiens
cctgcagcccttcaaaggctga

SEQ ID NO: 7761392 - DNA, 18 bp, Homo sapiens
cctgcagcccaggaggcc

SEQ ID NO: 7761393 - DNA, 22 bp, Homo sapiens
cctgcagcagctgaaatcacag

SEQ ID NO: 7761394 - DNA, 21 bp, Homo sapiens
cctgcagcaccagaaggagat

SEQ ID NO: 7761395 - DNA, 22 bp, Homo sapiens
cctgcagagggactggcaggaa

SEQ ID NO: 7761396 - DNA, 22 bp, Homo sapiens
cctgcagagggactggcaggaa

SEQ ID NO: 7761397 - DNA, 22 bp, Homo sapiens
cctgcagagcaggagaggcatc

SEQ ID NO: 7761398 - DNA, 23 bp, Homo sapiens
cctggagtactaaggggatggaa

SEQ ID NO: 7761399 - DNA, 22 bp, Homo sapiens
cctggagttgaaggaaggtggg

SEQ ID NO: 7761400 - DNA, 22 bp, Homo sapiens
cctggcacagagcggtggtcac

SEQ ID NO: 7761401 - DNA, 22 bp, Homo sapiens
cctggcaagtgggctcccagat

SEQ ID NO: 7761402 - DNA, 22 bp, Homo sapiens
cctggctctgcgtgcagctccg

SEQ ID NO: 7761403 - DNA, 22 bp, Homo sapiens
cctggctctgccacttactgcc

SEQ ID NO: 7761404 - DNA, 22 bp, Homo sapiens
aggtccctcagaggcctcaccg

SEQ ID NO: 7761405 - DNA, 22 bp, Homo sapiens
aggtccagttttctgacaaggg

SEQ ID NO: 7761406 - DNA, 22 bp, Homo sapiens
aggtcccagtctgtgatgactc

SEQ ID NO: 7761407 - DNA, 22 bp, Homo sapiens
cctgtgccaaaatctaggcagt

SEQ ID NO: 7761408 - DNA, 22 bp, Homo sapiens
aggtggggaggagtgtctcttt

SEQ ID NO: 7761409 - DNA, 22 bp, Homo sapiens
aggtgggcacacctcccttctc

SEQ ID NO: 7761410 - DNA, 22 bp, Homo sapiens
cctgtctacataactgtgtgaa

SEQ ID NO: 7761411 - DNA, 22 bp, Homo sapiens
cctgtctaccagtcacttagcg

SEQ ID NO: 7761412 - DNA, 22 bp, Homo sapiens
cctgtctccctggcatggctca

SEQ ID NO: 7761413 - DNA, 22 bp, Homo sapiens
cctgggctcgcgcacttcaccc

SEQ ID NO: 7761414 - DNA, 22 bp, Homo sapiens
cctgggctttcaaaaccagcct

SEQ ID NO: 7761415 - DNA, 22 bp, Homo sapiens
cctgggctttcggcggcttcct

SEQ ID NO: 7761416 - DNA, 22 bp, Homo sapiens
cctgggctttgagggcaggatg

SEQ ID NO: 7761417 - DNA, 22 bp, Homo sapiens
cctgtcagggtttgcctcagaa

SEQ ID NO: 7761418 - DNA, 22 bp, Homo sapiens
cctgggctcaagtgatggtccc

SEQ ID NO: 7761419 - DNA, 22 bp, Homo sapiens
cctggctctggttccctcagct

SEQ ID NO: 7761420 - DNA, 22 bp, Homo sapiens
cctgggcataaatcactccaag

SEQ ID NO: 7761421 - DNA, 22 bp, Homo sapiens
ctctggcttgttaatgcatatt

SEQ ID NO: 7761422 - DNA, 22 bp, Homo sapiens
ctctggcttgttaatgcatatt

SEQ ID NO: 7761423 - DNA, 22 bp, Homo sapiens
ctctggctttgctcatgcatcc

SEQ ID NO: 7761424 - DNA, 22 bp, Homo sapiens
ctctggctttgctcatgcatcc

SEQ ID NO: 7761425 - DNA, 22 bp, Homo sapiens
ctctggctttgctcatgcatcc

SEQ ID NO: 7761426 - DNA, 22 bp, Homo sapiens
ctctgggaagggctgagcactg

SEQ ID NO: 7761427 - DNA, 22 bp, Homo sapiens
ctctgggaccacgtgactctgc

SEQ ID NO: 7761428 - DNA, 22 bp, Homo sapiens
ctctgggaccatggcaagtgcg

SEQ ID NO: 7761429 - DNA, 22 bp, Homo sapiens
ctctggggaagcagccagctgg

SEQ ID NO: 7761430 - DNA, 22 bp, Homo sapiens
ctgaaatgacggtttggggcaa

SEQ ID NO: 7761431 - DNA, 22 bp, Homo sapiens
ctgaaatgggcaaaagtagatt

SEQ ID NO: 7761432 - DNA, 22 bp, Homo sapiens
ctgaaataaagttgctaaaatt

SEQ ID NO: 7761433 - DNA, 23 bp, Homo sapiens
ctgaaataccagaaaatcagtgt

SEQ ID NO: 7761434 - DNA, 22 bp, Homo sapiens
ctctttggttaatcacacagat

SEQ ID NO: 7761435 - DNA, 22 bp, Homo sapiens
ctctttggttaatcacacagat

SEQ ID NO: 7761436 - DNA, 22 bp, Homo sapiens
ctctggattgctgtgagatgct

SEQ ID NO: 7761437 - DNA, 22 bp, Homo sapiens
ctctgctgatctcagctgggct

SEQ ID NO: 7761438 - DNA, 22 bp, Homo sapiens
ctctgctgagccagagtcccca

SEQ ID NO: 7761439 - DNA, 22 bp, Homo sapiens
ctctgcctgtgtcgccaccaca

SEQ ID NO: 7761440 - DNA, 22 bp, Homo sapiens
ctctcagtgcctgccctaggct

SEQ ID NO: 7761441 - DNA, 22 bp, Homo sapiens
ctctcagtttcctcaactgtaa

SEQ ID NO: 7761442 - DNA, 22 bp, Homo sapiens
ctctcagtcctgcgcgcctctg

SEQ ID NO: 7761443 - DNA, 22 bp, Homo sapiens
ctctcagtgccacacagccatt

SEQ ID NO: 7761444 - DNA, 22 bp, Homo sapiens
ctctcagggcaggtggcctttc

SEQ ID NO: 7761445 - DNA, 22 bp, Homo sapiens
ctctcagggacccagccagcct

SEQ ID NO: 7761446 - DNA, 17 bp, Homo sapiens
ctctgcagtgcatggct

SEQ ID NO: 7761447 - DNA, 22 bp, Homo sapiens
ctctgcaggcacccagggtggg

SEQ ID NO: 7761448 - DNA, 22 bp, Homo sapiens
agttataatctgctactgatat

SEQ ID NO: 7761449 - DNA, 22 bp, Homo sapiens
ctgaggagaggtggcctgtgtt

SEQ ID NO: 7761450 - DNA, 22 bp, Homo sapiens
ctgaggagaccatcaactaatt

SEQ ID NO: 7761451 - DNA, 22 bp, Homo sapiens
ctgagcagcagggagactggtg

SEQ ID NO: 7761452 - DNA, 22 bp, Homo sapiens
ctgagcagcaattgctggccca

SEQ ID NO: 7761453 - DNA, 22 bp, Homo sapiens
ctgagcagcacagggcgccagg

SEQ ID NO: 7761454 - DNA, 22 bp, Homo sapiens
ctgaatgtcgatcagcttgggt

SEQ ID NO: 7761455 - DNA, 22 bp, Homo sapiens
ctgagaaaagacatttctagat

SEQ ID NO: 7761456 - DNA, 22 bp, Homo sapiens
ctgactttagaacccaaaaagt

SEQ ID NO: 7761457 - DNA, 22 bp, Homo sapiens
ctgactttgacttggtcattga

SEQ ID NO: 7761458 - DNA, 22 bp, Homo sapiens
ctgactttgctcataggtcaaa

SEQ ID NO: 7761459 - DNA, 22 bp, Homo sapiens
ctgacttttttcagccacagtg

SEQ ID NO: 7761460 - DNA, 22 bp, Homo sapiens
agtgtctgcctgggaggagcat

SEQ ID NO: 7761461 - DNA, 22 bp, Homo sapiens
ctgaaatggttgcctggagaat

SEQ ID NO: 7761462 - DNA, 22 bp, Homo sapiens
ctgaaatgttaaatacttggct

SEQ ID NO: 7761463 - DNA, 22 bp, Homo sapiens
agtgtctgctcagacagctaca

SEQ ID NO: 7761464 - DNA, 22 bp, Homo sapiens
agtgtctgcgggcagaggagcg

SEQ ID NO: 7761465 - DNA, 22 bp, Homo sapiens
ctgaatgaggaaaagagtgagg

SEQ ID NO: 7761466 - DNA, 22 bp, Homo sapiens
agtgtctgctttgagtcaggtg

SEQ ID NO: 7761467 - DNA, 22 bp, Homo sapiens
ctcctggctttcccagaccagg

SEQ ID NO: 7761468 - DNA, 22 bp, Homo sapiens
ctcctgggaaatgaaggggcag

SEQ ID NO: 7761469 - DNA, 22 bp, Homo sapiens
ctcctgggggacagcggcaggg

SEQ ID NO: 7761470 - DNA, 22 bp, Homo sapiens
ctctcagaagtttatgtcagaa

SEQ ID NO: 7761471 - DNA, 22 bp, Homo sapiens
agtggcagagtgcactcaggca

SEQ ID NO: 7761472 - DNA, 22 bp, Homo sapiens
agtggcagagtcagggtttgga

SEQ ID NO: 7761473 - DNA, 20 bp, Homo sapiens
ctcctggtccaggagcctga

SEQ ID NO: 7761474 - DNA, 20 bp, Homo sapiens
ctcctggtccaggagcctga

SEQ ID NO: 7761475 - DNA, 22 bp, Homo sapiens
ctcctggtgactcccagataaa

SEQ ID NO: 7761476 - DNA, 22 bp, Homo sapiens
ctcctggctcgcccccagctga

SEQ ID NO: 7761477 - DNA, 18 bp, Homo sapiens
ctcctggctgatggtgag

SEQ ID NO: 7761478 - DNA, 18 bp, Homo sapiens
ctcctggctgatggtgag

SEQ ID NO: 7761479 - DNA, 22 bp, Homo sapiens
ctcctaggtgctcactggggtc

SEQ ID NO: 7761480 - DNA, 22 bp, Homo sapiens
ctcctagatgtcttcagagaaa

SEQ ID NO: 7761481 - DNA, 22 bp, Homo sapiens
ctccctccaaataagactcggg

SEQ ID NO: 7761482 - DNA, 18 bp, Homo sapiens
ctccagggaactcagtca

SEQ ID NO: 7761483 - DNA, 22 bp, Homo sapiens
ctccctcagaggagcacctgtt

SEQ ID NO: 7761484 - DNA, 22 bp, Homo sapiens
ctccaggctggatccaagtcaa

SEQ ID NO: 7761485 - DNA, 22 bp, Homo sapiens
ctccaggctggggtgcaggttg

SEQ ID NO: 7761486 - DNA, 22 bp, Homo sapiens
agtcttccctgtgccagagtgt

SEQ ID NO: 7761487 - DNA, 21 bp, Homo sapiens
agtcttctccagaggctgggg

SEQ ID NO: 7761488 - DNA, 18 bp, Homo sapiens
agtcttctgatccatttt

SEQ ID NO: 7761489 - DNA, 22 bp, Homo sapiens
agtcttcagcatagcatatggc

SEQ ID NO: 7761490 - DNA, 22 bp, Homo sapiens
agtcttatatcactatgctctg

SEQ ID NO: 7761491 - DNA, 22 bp, Homo sapiens
agtcttatggttaaatagatgc

SEQ ID NO: 7761492 - DNA, 22 bp, Homo sapiens
ctcattctttcacagtctgtgg

SEQ ID NO: 7761493 - DNA, 22 bp, Homo sapiens
ctcattgcccagatccccacag

SEQ ID NO: 7761494 - DNA, 22 bp, Homo sapiens
ctcattgcagctgcattactgt

SEQ ID NO: 7761495 - DNA, 22 bp, Homo sapiens
ctcattgcaacctccgcctccc

SEQ ID NO: 7761496 - DNA, 19 bp, Homo sapiens
agtcctggcctgggggacc

SEQ ID NO: 7761497 - DNA, 22 bp, Homo sapiens
agtcctggccccaaggaaggat

SEQ ID NO: 7761498 - DNA, 22 bp, Homo sapiens
agtcctggccccaaggaaggat

SEQ ID NO: 7761499 - DNA, 18 bp, Homo sapiens
ctcagtgtttgctgaaaa

SEQ ID NO: 7761500 - DNA, 22 bp, Homo sapiens
ctcagtgttggagaccttcagg

SEQ ID NO: 7761501 - DNA, 22 bp, Homo sapiens
agtcctgggtccagcaggtcct

SEQ ID NO: 7761502 - DNA, 22 bp, Homo sapiens
agtcctggacttggagtcaggg

SEQ ID NO: 7761503 - DNA, 22 bp, Homo sapiens
agtcctaggccctgctccagat

SEQ ID NO: 7761504 - DNA, 22 bp, Homo sapiens
agtcctagacttttctgccact

SEQ ID NO: 7761505 - DNA, 22 bp, Homo sapiens
agtcccttgagggagtactgtt

SEQ ID NO: 7761506 - DNA, 22 bp, Homo sapiens
ccactattactgtgtggcagtc

SEQ ID NO: 7761507 - DNA, 22 bp, Homo sapiens
ccactattactgtgtggcagtc

SEQ ID NO: 7761508 - DNA, 22 bp, Homo sapiens
ccacggccacccgctcatgggc

SEQ ID NO: 7761509 - DNA, 22 bp, Homo sapiens
ccacgtccagctaattttcgta

SEQ ID NO: 7761510 - DNA, 22 bp, Homo sapiens
ccacccagccagatgcaggaag

SEQ ID NO: 7761511 - DNA, 22 bp, Homo sapiens
ccaccaggcactcacagggaag

SEQ ID NO: 7761512 - DNA, 22 bp, Homo sapiens
ccaccatgggaagagagactaa

SEQ ID NO: 7761513 - DNA, 22 bp, Homo sapiens
ccacagtgttttgtcacattag

SEQ ID NO: 7761514 - DNA, 23 bp, Homo sapiens
ccacagttcatcgttcactcacc

SEQ ID NO: 7761515 - DNA, 22 bp, Homo sapiens
ccacagtttaggaagtcactct

SEQ ID NO: 7761516 - DNA, 22 bp, Homo sapiens
ccacagtttcttcatctataaa

SEQ ID NO: 7761517 - DNA, 20 bp, Homo sapiens
ccacagtggagactggagac

SEQ ID NO: 7761518 - DNA, 22 bp, Homo sapiens
ccacagtgggcacagcaggact

SEQ ID NO: 7761519 - DNA, 22 bp, Homo sapiens
ccacagtgtggcataaactgta

SEQ ID NO: 7761520 - DNA, 22 bp, Homo sapiens
ccacagtggttctcaaccaggg

SEQ ID NO: 7761521 - DNA, 22 bp, Homo sapiens
ccacagaattctgtctccagga

SEQ ID NO: 7761522 - DNA, 22 bp, Homo sapiens
ccacagagactctgcaggactg

SEQ ID NO: 7761523 - DNA, 22 bp, Homo sapiens
catttctgtgacacttccatct

SEQ ID NO: 7761524 - DNA, 22 bp, Homo sapiens
catttctgttctcttcctgtac

SEQ ID NO: 7761525 - DNA, 22 bp, Homo sapiens
catttctgttctcttcctgtac

SEQ ID NO: 7761526 - DNA, 22 bp, Homo sapiens
ccaatgaaaggtcaattctata

SEQ ID NO: 7761527 - DNA, 22 bp, Homo sapiens
catttctgtcacgttcttttat

SEQ ID NO: 7761528 - DNA, 22 bp, Homo sapiens
catttctgtcacgttcttttat

SEQ ID NO: 7761529 - DNA, 23 bp, Homo sapiens
catttctgggagatttataaaat

SEQ ID NO: 7761530 - DNA, 22 bp, Homo sapiens
aggcaggaaaatcgcttgaacc

SEQ ID NO: 7761531 - DNA, 17 bp, Homo sapiens
aggcaggagattggaga

SEQ ID NO: 7761532 - DNA, 17 bp, Homo sapiens
aggcaggagattggaga

SEQ ID NO: 7761533 - DNA, 22 bp, Homo sapiens
aggcaggagcaagccctacaag

SEQ ID NO: 7761534 - DNA, 23 bp, Homo sapiens
ccacaggcacagaggcttgcatc

SEQ ID NO: 7761535 - DNA, 18 bp, Homo sapiens
aggcaggatcctggcctc

SEQ ID NO: 7761536 - DNA, 22 bp, Homo sapiens
aggcaggaggatcatggatgca

SEQ ID NO: 7761537 - DNA, 22 bp, Homo sapiens
aggcaggaggatcatggatgca

SEQ ID NO: 7761538 - DNA, 22 bp, Homo sapiens
aggcaggagtgaccctgacagg

SEQ ID NO: 7761539 - DNA, 22 bp, Homo sapiens
catttattggttaggccagcag

SEQ ID NO: 7761540 - DNA, 22 bp, Homo sapiens
catttcaagcattgacttctat

SEQ ID NO: 7761541 - DNA, 22 bp, Homo sapiens
catttctgcagaattgctcttc

SEQ ID NO: 7761542 - DNA, 22 bp, Homo sapiens
catttcaatgccttcaacatag

SEQ ID NO: 7761543 - DNA, 22 bp, Homo sapiens
cattggaatgatcgttttgctg

SEQ ID NO: 7761544 - DNA, 22 bp, Homo sapiens
cattggccttttatcctagagg

SEQ ID NO: 7761545 - DNA, 22 bp, Homo sapiens
cattgtaagaggctttgcagca

SEQ ID NO: 7761546 - DNA, 21 bp, Homo sapiens
aggcacttaaccaatgttagc

SEQ ID NO: 7761547 - DNA, 22 bp, Homo sapiens
cattgtaagctgttgaatcctc

SEQ ID NO: 7761548 - DNA, 22 bp, Homo sapiens
aggcacttaataaggattcaat

SEQ ID NO: 7761549 - DNA, 22 bp, Homo sapiens
aggcacttaacctactaactga

SEQ ID NO: 7761550 - DNA, 22 bp, Homo sapiens
aggcacttgtaattgcagtcat

SEQ ID NO: 7761551 - DNA, 22 bp, Homo sapiens
aggcactttacaatgtgtgaca

SEQ ID NO: 7761552 - DNA, 22 bp, Homo sapiens
aggcactttaggatcaggttga

SEQ ID NO: 7761553 - DNA, 22 bp, Homo sapiens
aggcactttaggatcaggttga

SEQ ID NO: 7761554 - DNA, 22 bp, Homo sapiens
aggcaaggtgctacagacagtg

SEQ ID NO: 7761555 - DNA, 22 bp, Homo sapiens
aggcaaggtgctacagacagtg

SEQ ID NO: 7761556 - DNA, 22 bp, Homo sapiens
aggcaagtgcattagaagagca

SEQ ID NO: 7761557 - DNA, 22 bp, Homo sapiens
cattgctttgtgcatatttaaa

SEQ ID NO: 7761558 - DNA, 22 bp, Homo sapiens
aggcaagaccagaaagggctga

SEQ ID NO: 7761559 - DNA, 23 bp, Homo sapiens
aggcaagggtgtaaaggaaatga

SEQ ID NO: 7761560 - DNA, 23 bp, Homo sapiens
aggcaagggtgtaaaggaaatga

SEQ ID NO: 7761561 - DNA, 22 bp, Homo sapiens
aggcaagattaggaccagaaga

SEQ ID NO: 7761562 - DNA, 22 bp, Homo sapiens
aggcaagcagtcagtctatgag

SEQ ID NO: 7761563 - DNA, 22 bp, Homo sapiens
aggcaagcccccagtgaggctc

SEQ ID NO: 7761564 - DNA, 22 bp, Homo sapiens
aggaggctgaactagggtctgg

SEQ ID NO: 7761565 - DNA, 22 bp, Homo sapiens
catacaaatgtgtccaggctct

SEQ ID NO: 7761566 - DNA, 22 bp, Homo sapiens
catacaaatgtgtccaggctct

SEQ ID NO: 7761567 - DNA, 22 bp, Homo sapiens
aggaggcctgtgtttgtctgta

SEQ ID NO: 7761568 - DNA, 22 bp, Homo sapiens
catacagagaaggataataaag

SEQ ID NO: 7761569 - DNA, 22 bp, Homo sapiens
catacagagaaggataataaag

SEQ ID NO: 7761570 - DNA, 22 bp, Homo sapiens
catacagttttccctagatgtg

SEQ ID NO: 7761571 - DNA, 22 bp, Homo sapiens
catacaatcaagttctttatta

SEQ ID NO: 7761572 - DNA, 22 bp, Homo sapiens
catacaagcgttcaatagatgt

SEQ ID NO: 7761573 - DNA, 22 bp, Homo sapiens
catacaaatgtgtccaggctct

SEQ ID NO: 7761574 - DNA, 22 bp, Homo sapiens
catctcctttggtctacttcca

SEQ ID NO: 7761575 - DNA, 22 bp, Homo sapiens
catcttaatttctaacaggcac

SEQ ID NO: 7761576 - DNA, 22 bp, Homo sapiens
catcttcacatatttccaatga

SEQ ID NO: 7761577 - DNA, 22 bp, Homo sapiens
catgagataatttttctccagt

SEQ ID NO: 7761578 - DNA, 22 bp, Homo sapiens
catgagatttgggaggggccag

SEQ ID NO: 7761579 - DNA, 22 bp, Homo sapiens
catgaggtcagggggagccggt

SEQ ID NO: 7761580 - DNA, 22 bp, Homo sapiens
catgaggtgataaagctgggat

SEQ ID NO: 7761581 - DNA, 22 bp, Homo sapiens
catgagatttgggaggggccag

SEQ ID NO: 7761582 - DNA, 22 bp, Homo sapiens
catgagcattttggtctagttt

SEQ ID NO: 7761583 - DNA, 22 bp, Homo sapiens
catgagctgctgggagcctgtc

SEQ ID NO: 7761584 - DNA, 22 bp, Homo sapiens
aggatggcttgcaggaggctgt

SEQ ID NO: 7761585 - DNA, 22 bp, Homo sapiens
catcttcaggttcatggtcata

SEQ ID NO: 7761586 - DNA, 22 bp, Homo sapiens
cagtccagccccctgctaaaag

SEQ ID NO: 7761587 - DNA, 22 bp, Homo sapiens
cagtccagccccctgctaaaag

SEQ ID NO: 7761588 - DNA, 20 bp, Homo sapiens
cagtccaggctagaaaacaa

SEQ ID NO: 7761589 - DNA, 22 bp, Homo sapiens
cagtccagtccaatcctcaatg

SEQ ID NO: 7761590 - DNA, 22 bp, Homo sapiens
cagtgtggagggagagagcctg

SEQ ID NO: 7761591 - DNA, 22 bp, Homo sapiens
aggagccagaatccagactcgg

SEQ ID NO: 7761592 - DNA, 22 bp, Homo sapiens
aggagccagcgttcctcaggat

SEQ ID NO: 7761593 - DNA, 22 bp, Homo sapiens
aggagccaggaaacctgctctg

SEQ ID NO: 7761594 - DNA, 22 bp, Homo sapiens
aggagccaggccccatggggct

SEQ ID NO: 7761595 - DNA, 22 bp, Homo sapiens
aggagccaggaaacctgctctg

SEQ ID NO: 7761596 - DNA, 22 bp, Homo sapiens
cagtgttccctgaacatatgtt

SEQ ID NO: 7761597 - DNA, 22 bp, Homo sapiens
cagtgtgtggatcctcccagga

SEQ ID NO: 7761598 - DNA, 22 bp, Homo sapiens
cagtgtttagatcaagaaggcc

SEQ ID NO: 7761599 - DNA, 17 bp, Homo sapiens
aggagctgggggtggtg

SEQ ID NO: 7761600 - DNA, 22 bp, Homo sapiens
cataacattgagcagcattcct

SEQ ID NO: 7761601 - DNA, 22 bp, Homo sapiens
aggagccatgagcaggaggcaa

SEQ ID NO: 7761602 - DNA, 22 bp, Homo sapiens
cataacatgtacatataaatgc

SEQ ID NO: 7761603 - DNA, 22 bp, Homo sapiens
cataacatgtacatataaatgc

SEQ ID NO: 7761604 - DNA, 22 bp, Homo sapiens
cataacattaagcctctatttc

SEQ ID NO: 7761605 - DNA, 22 bp, Homo sapiens
cataacatgtacatataaatgc

SEQ ID NO: 7761606 - DNA, 22 bp, Homo sapiens
aggagctgtgaatgggaggggt

SEQ ID NO: 7761607 - DNA, 22 bp, Homo sapiens
aggaggcaggaagtctatggga

SEQ ID NO: 7761608 - DNA, 22 bp, Homo sapiens
aggaggccgctgatgggctccc

SEQ ID NO: 7761609 - DNA, 22 bp, Homo sapiens
aggaggccgctgatgggctccc

SEQ ID NO: 7761610 - DNA, 22 bp, Homo sapiens
aggaggcctacgcacatgtcta

SEQ ID NO: 7761611 - DNA, 23 bp, Homo sapiens
aggaggcctgaaactgaggctga

SEQ ID NO: 7761612 - DNA, 22 bp, Homo sapiens
aggagctgtcagagtgccagag

SEQ ID NO: 7761613 - DNA, 22 bp, Homo sapiens
aggagctgtcagagtgccagag

SEQ ID NO: 7761614 - DNA, 16 bp, Homo sapiens
aggagctgggtaggag

SEQ ID NO: 7761615 - DNA, 22 bp, Homo sapiens
aggagctgggttcctttggtgg

SEQ ID NO: 7761616 - DNA, 22 bp, Homo sapiens
aggagctggtagtctcattggg

SEQ ID NO: 7761617 - DNA, 22 bp, Homo sapiens
aggaatcccgcaccagctgctg

SEQ ID NO: 7761618 - DNA, 22 bp, Homo sapiens
aggacacttggctattgttcca

SEQ ID NO: 7761619 - DNA, 22 bp, Homo sapiens
aggacagacctaggactggagc

SEQ ID NO: 7761620 - DNA, 22 bp, Homo sapiens
aggacagagcctgtgcagaccg

SEQ ID NO: 7761621 - DNA, 22 bp, Homo sapiens
caggtgtcaaaatactaagtgg

SEQ ID NO: 7761622 - DNA, 22 bp, Homo sapiens
cagtaatagcagagtcttccat

SEQ ID NO: 7761623 - DNA, 22 bp, Homo sapiens
cagtaactgatgtgatcaaacg

SEQ ID NO: 7761624 - DNA, 22 bp, Homo sapiens
cagtaaggatgcacataactag

SEQ ID NO: 7761625 - DNA, 22 bp, Homo sapiens
cagtaagtattcgagtctccat

SEQ ID NO: 7761626 - DNA, 22 bp, Homo sapiens
cagtattcatctaaggagcttg

SEQ ID NO: 7761627 - DNA, 22 bp, Homo sapiens
cagtaaatgcagatatagatac

SEQ ID NO: 7761628 - DNA, 22 bp, Homo sapiens
cagtaacatgaagagacatgga

SEQ ID NO: 7761629 - DNA, 22 bp, Homo sapiens
cagtaaacactagcattcttgg

SEQ ID NO: 7761630 - DNA, 22 bp, Homo sapiens
aggacagagggaccagagccca

SEQ ID NO: 7761631 - DNA, 22 bp, Homo sapiens
aggacagagggaccagagccca

SEQ ID NO: 7761632 - DNA, 22 bp, Homo sapiens
aggaaaggcctcagcagaaacc

SEQ ID NO: 7761633 - DNA, 22 bp, Homo sapiens
cagggctgttagctgctgctct

SEQ ID NO: 7761634 - DNA, 22 bp, Homo sapiens
aggaagagggtggcagataatc

SEQ ID NO: 7761635 - DNA, 18 bp, Homo sapiens
cagggctgtggggtcact

SEQ ID NO: 7761636 - DNA, 22 bp, Homo sapiens
aggaagagggtggcagataatc

SEQ ID NO: 7761637 - DNA, 23 bp, Homo sapiens
aggaagaggcaatttctcttaga

SEQ ID NO: 7761638 - DNA, 22 bp, Homo sapiens
aggaagagctggaccagaggac

SEQ ID NO: 7761639 - DNA, 22 bp, Homo sapiens
aggaagagctggaccagaggac

SEQ ID NO: 7761640 - DNA, 22 bp, Homo sapiens
aggaagagctggaccagaggac

SEQ ID NO: 7761641 - DNA, 22 bp, Homo sapiens
aggaagagctggaccagaggac

SEQ ID NO: 7761642 - DNA, 22 bp, Homo sapiens
aggaagagcccgggtgacataa

SEQ ID NO: 7761643 - DNA, 22 bp, Homo sapiens
aggaagagcattcacatggtag

SEQ ID NO: 7761644 - DNA, 22 bp, Homo sapiens
caggctcttttggtggcaagga

SEQ ID NO: 7761645 - DNA, 22 bp, Homo sapiens
caggctcttttggtggcaagga

SEQ ID NO: 7761646 - DNA, 22 bp, Homo sapiens
caggctcttttggtggcaagga

SEQ ID NO: 7761647 - DNA, 22 bp, Homo sapiens
cagggcaggatgctgtgattat

SEQ ID NO: 7761648 - DNA, 22 bp, Homo sapiens
cagggcagggatgttgcggcag

SEQ ID NO: 7761649 - DNA, 22 bp, Homo sapiens
cagggcagggccacaccccctg

SEQ ID NO: 7761650 - DNA, 22 bp, Homo sapiens
cagggcagggccacaccccctg

SEQ ID NO: 7761651 - DNA, 22 bp, Homo sapiens
cagggcagtaacgggaacatct

SEQ ID NO: 7761652 - DNA, 22 bp, Homo sapiens
cagggcagtaacgggaacatct

SEQ ID NO: 7761653 - DNA, 22 bp, Homo sapiens
agctttgcttctgggagccaag

SEQ ID NO: 7761654 - DNA, 23 bp, Homo sapiens
agctttgaggactttaaaagata

SEQ ID NO: 7761655 - DNA, 22 bp, Homo sapiens
agctttgatagtacaggggctt

SEQ ID NO: 7761656 - DNA, 22 bp, Homo sapiens
agctttgcactgagacagctca

SEQ ID NO: 7761657 - DNA, 22 bp, Homo sapiens
agctttgcaacctgaggccagt

SEQ ID NO: 7761658 - DNA, 22 bp, Homo sapiens
agctttgcacaacagagaggtg

SEQ ID NO: 7761659 - DNA, 22 bp, Homo sapiens
agctttgaaaatccaaattaca

SEQ ID NO: 7761660 - DNA, 22 bp, Homo sapiens
agctttctgtcacctgtgcttg

SEQ ID NO: 7761661 - DNA, 22 bp, Homo sapiens
agctttcttctagttgtacagt

SEQ ID NO: 7761662 - DNA, 20 bp, Homo sapiens
cagggctctgggcctggcct

SEQ ID NO: 7761663 - DNA, 22 bp, Homo sapiens
cagggctggatttcatttctag

SEQ ID NO: 7761664 - DNA, 22 bp, Homo sapiens
agcttccttgaattctgtagaa

SEQ ID NO: 7761665 - DNA, 23 bp, Homo sapiens
agcttcctagtgacctggagtct

SEQ ID NO: 7761666 - DNA, 21 bp, Homo sapiens
caggctctgctagaggagcct

SEQ ID NO: 7761667 - DNA, 22 bp, Homo sapiens
agcttctcaggagtctgaggca

SEQ ID NO: 7761668 - DNA, 21 bp, Homo sapiens
caggctctgctagaggagcct

SEQ ID NO: 7761669 - DNA, 21 bp, Homo sapiens
caggctctgctgggtgctggg

SEQ ID NO: 7761670 - DNA, 22 bp, Homo sapiens
agcttagaagtgtgctgagagg

SEQ ID NO: 7761671 - DNA, 22 bp, Homo sapiens
caggcccattctaggcttgcta

SEQ ID NO: 7761672 - DNA, 22 bp, Homo sapiens
caggcccattctaggcttgcta

SEQ ID NO: 7761673 - DNA, 22 bp, Homo sapiens
caggcccatgagggcagccaca

SEQ ID NO: 7761674 - DNA, 22 bp, Homo sapiens
caggcccatctgctcccaggct

SEQ ID NO: 7761675 - DNA, 22 bp, Homo sapiens
agctgtctgtctcctgaggaga

SEQ ID NO: 7761676 - DNA, 22 bp, Homo sapiens
agctgtctttctgcctcctgat

SEQ ID NO: 7761677 - DNA, 22 bp, Homo sapiens
caggcccagggttattgggaaa

SEQ ID NO: 7761678 - DNA, 22 bp, Homo sapiens
caggcccaggggtctggcccac

SEQ ID NO: 7761679 - DNA, 22 bp, Homo sapiens
caggcccaggtgtcgatgttcc

SEQ ID NO: 7761680 - DNA, 22 bp, Homo sapiens
caggcccagtgatcagggctct

SEQ ID NO: 7761681 - DNA, 22 bp, Homo sapiens
caggcaggtcagtgaagaagga

SEQ ID NO: 7761682 - DNA, 22 bp, Homo sapiens
caggcagggagctggaaaggat

SEQ ID NO: 7761683 - DNA, 22 bp, Homo sapiens
caggcagggagctggaaaggat

SEQ ID NO: 7761684 - DNA, 22 bp, Homo sapiens
caggcagcctgcggtctgcaca

SEQ ID NO: 7761685 - DNA, 22 bp, Homo sapiens
caggcagccttctcgtctcaca

SEQ ID NO: 7761686 - DNA, 22 bp, Homo sapiens
caggcagcgctcgtggcctggc

SEQ ID NO: 7761687 - DNA, 22 bp, Homo sapiens
agctgtaatataagcaatgaaa

SEQ ID NO: 7761688 - DNA, 22 bp, Homo sapiens
agctgtatgcccaagatgctat

SEQ ID NO: 7761689 - DNA, 22 bp, Homo sapiens
agctgtcctggctcaggctgtg

SEQ ID NO: 7761690 - DNA, 22 bp, Homo sapiens
caggcagtgtcccaggaagcca

SEQ ID NO: 7761691 - DNA, 22 bp, Homo sapiens
caggcagtgtgacgctagggtt

SEQ ID NO: 7761692 - DNA, 22 bp, Homo sapiens
caggcagtggccatgttgggag

SEQ ID NO: 7761693 - DNA, 22 bp, Homo sapiens
caggcaggtgcagattcctctt

SEQ ID NO: 7761694 - DNA, 22 bp, Homo sapiens
caggcagtggctcacagcaacc

SEQ ID NO: 7761695 - DNA, 22 bp, Homo sapiens
caggcaggtgcagattcctctt

SEQ ID NO: 7761696 - DNA, 22 bp, Homo sapiens
cagctgtgtctaattatggctg

SEQ ID NO: 7761697 - DNA, 22 bp, Homo sapiens
cagctgtccaaacacattaact

SEQ ID NO: 7761698 - DNA, 22 bp, Homo sapiens
cagctgtcagccggtgcaggct

SEQ ID NO: 7761699 - DNA, 22 bp, Homo sapiens
cagctgtccttcctggtgggcg

SEQ ID NO: 7761700 - DNA, 22 bp, Homo sapiens
cagctgttcacatttccaaaac

SEQ ID NO: 7761701 - DNA, 22 bp, Homo sapiens
cagctgggtttagtggggtgtg

SEQ ID NO: 7761702 - DNA, 22 bp, Homo sapiens
cagctgggtttagtggggtgtg

SEQ ID NO: 7761703 - DNA, 23 bp, Homo sapiens
cagctggttgtgggagtggctgc

SEQ ID NO: 7761704 - DNA, 22 bp, Homo sapiens
cagctggttatcagagaggcct

SEQ ID NO: 7761705 - DNA, 22 bp, Homo sapiens
caggacagagcccagactgtgt

SEQ ID NO: 7761706 - DNA, 20 bp, Homo sapiens
caggacagcgcaatcggagg

SEQ ID NO: 7761707 - DNA, 22 bp, Homo sapiens
caggactgatgttcctccagcc

SEQ ID NO: 7761708 - DNA, 22 bp, Homo sapiens
caggactggaagtctcaagaga

SEQ ID NO: 7761709 - DNA, 22 bp, Homo sapiens
caggactgtatccttggagaaa

SEQ ID NO: 7761710 - DNA, 22 bp, Homo sapiens
caggcacacccactggtgcaga

SEQ ID NO: 7761711 - DNA, 20 bp, Homo sapiens
caggcacactcattcctgct

SEQ ID NO: 7761712 - DNA, 22 bp, Homo sapiens
caggcagagtgaggtggtctaa

SEQ ID NO: 7761713 - DNA, 22 bp, Homo sapiens
caggcacacatccgtgagagat

SEQ ID NO: 7761714 - DNA, 22 bp, Homo sapiens
caggcacacaggctccctgggc

SEQ ID NO: 7761715 - DNA, 22 bp, Homo sapiens
caggcacacagggaatttggct

SEQ ID NO: 7761716 - DNA, 22 bp, Homo sapiens
caggatgggatgtagtgggccc

SEQ ID NO: 7761717 - DNA, 22 bp, Homo sapiens
caggatgggtgtcggccagcac

SEQ ID NO: 7761718 - DNA, 22 bp, Homo sapiens
caggatgggtgtcggccagcac

SEQ ID NO: 7761719 - DNA, 22 bp, Homo sapiens
caggatggtctcgatctcctga

SEQ ID NO: 7761720 - DNA, 22 bp, Homo sapiens
caggcacacagcacatggcctg

SEQ ID NO: 7761721 - DNA, 22 bp, Homo sapiens
caggagccacattccaccttga

SEQ ID NO: 7761722 - DNA, 22 bp, Homo sapiens
caggagccagaggcggatggag

SEQ ID NO: 7761723 - DNA, 22 bp, Homo sapiens
caggagcatgctgatgccagaa

SEQ ID NO: 7761724 - DNA, 22 bp, Homo sapiens
caggagcagagggtggtcagca

SEQ ID NO: 7761725 - DNA, 22 bp, Homo sapiens
caggagtgaaatgaggcccagg

SEQ ID NO: 7761726 - DNA, 22 bp, Homo sapiens
cccaccctgggctacacatcca

SEQ ID NO: 7761727 - DNA, 22 bp, Homo sapiens
cccaccctgggaagctaggcag

SEQ ID NO: 7761728 - DNA, 22 bp, Homo sapiens
cccaccctgggaagctaggcag

SEQ ID NO: 7761729 - DNA, 18 bp, Homo sapiens
cccaccctggctcttagt

SEQ ID NO: 7761730 - DNA, 22 bp, Homo sapiens
cccacgtcgaacttgctccaga

SEQ ID NO: 7761731 - DNA, 22 bp, Homo sapiens
aggctgtgcacagggcacctgc

SEQ ID NO: 7761732 - DNA, 22 bp, Homo sapiens
aggctgtgcattttggagggcc

SEQ ID NO: 7761733 - DNA, 22 bp, Homo sapiens
cccactctggctcccttctagt

SEQ ID NO: 7761734 - DNA, 22 bp, Homo sapiens
cccactgctgcgccgggcgccg

SEQ ID NO: 7761735 - DNA, 22 bp, Homo sapiens
aggctgtgacagggtcatggag

SEQ ID NO: 7761736 - DNA, 22 bp, Homo sapiens
aggctgtgcgaggtctcagagt

SEQ ID NO: 7761737 - DNA, 22 bp, Homo sapiens
aggctgtggccctggtctagca

SEQ ID NO: 7761738 - DNA, 22 bp, Homo sapiens
aggctgtgggagttgagagtct

SEQ ID NO: 7761739 - DNA, 22 bp, Homo sapiens
aggctgtgggaatggctgcttg

SEQ ID NO: 7761740 - DNA, 22 bp, Homo sapiens
aggctgtggccctggtctagca

SEQ ID NO: 7761741 - DNA, 22 bp, Homo sapiens
aggctgtggtgctgaaggaggg

SEQ ID NO: 7761742 - DNA, 22 bp, Homo sapiens
aggctgtgggtgatttactgtg

SEQ ID NO: 7761743 - DNA, 22 bp, Homo sapiens
cccagaggtgcttcagaggtgc

SEQ ID NO: 7761744 - DNA, 22 bp, Homo sapiens
ccagtgtctgtggtatagaaag

SEQ ID NO: 7761745 - DNA, 22 bp, Homo sapiens
ccagtgtctagtcacaggtact

SEQ ID NO: 7761746 - DNA, 19 bp, Homo sapiens
ccagtgtctagcgcacagc

SEQ ID NO: 7761747 - DNA, 22 bp, Homo sapiens
ccagtgtcttcagagtaaatct

SEQ ID NO: 7761748 - DNA, 22 bp, Homo sapiens
ccagtgtctactgtggcatatc

SEQ ID NO: 7761749 - DNA, 22 bp, Homo sapiens
ccagtgtctagcagatgacagg

SEQ ID NO: 7761750 - DNA, 22 bp, Homo sapiens
ccagtgtccttcctttccatgg

SEQ ID NO: 7761751 - DNA, 22 bp, Homo sapiens
ccagtgtcagaaagattatcct

SEQ ID NO: 7761752 - DNA, 22 bp, Homo sapiens
ccagtgtatttttgggacctgc

SEQ ID NO: 7761753 - DNA, 22 bp, Homo sapiens
aggctgcagtgcaggtaggatt

SEQ ID NO: 7761754 - DNA, 22 bp, Homo sapiens
ccagtgggagggagctaggcca

SEQ ID NO: 7761755 - DNA, 22 bp, Homo sapiens
ccagtgtattatttgagaaatt

SEQ ID NO: 7761756 - DNA, 22 bp, Homo sapiens
ccagtgggtaggccatggtgag

SEQ ID NO: 7761757 - DNA, 19 bp, Homo sapiens
aggctgcccagtctctgcc

SEQ ID NO: 7761758 - DNA, 19 bp, Homo sapiens
aggctgcccagtctctgcc

SEQ ID NO: 7761759 - DNA, 22 bp, Homo sapiens
aggctgccctgccgccagtggg

SEQ ID NO: 7761760 - DNA, 22 bp, Homo sapiens
aggctgccctgccgccagtggg

SEQ ID NO: 7761761 - DNA, 22 bp, Homo sapiens
ccaggccttctgaggacactct

SEQ ID NO: 7761762 - DNA, 22 bp, Homo sapiens
ccaggccttctgaggacactct

SEQ ID NO: 7761763 - DNA, 22 bp, Homo sapiens
ccaggcctttcttcttggtctg

SEQ ID NO: 7761764 - DNA, 22 bp, Homo sapiens
ccaggcgtggcttcagcagccc

SEQ ID NO: 7761765 - DNA, 22 bp, Homo sapiens
ccaggccttccagtacgcagaa

SEQ ID NO: 7761766 - DNA, 22 bp, Homo sapiens
ccaggcctgtgttgtgtggagg

SEQ ID NO: 7761767 - DNA, 22 bp, Homo sapiens
ccaggcctgtgcaaggagggag

SEQ ID NO: 7761768 - DNA, 22 bp, Homo sapiens
ccaggcctcacctgcccaccta

SEQ ID NO: 7761769 - DNA, 22 bp, Homo sapiens
ccaggcctcccttttccagcca

SEQ ID NO: 7761770 - DNA, 22 bp, Homo sapiens
aggctctgcttttctggatata

SEQ ID NO: 7761771 - DNA, 22 bp, Homo sapiens
aggctctgcttttctggatata

SEQ ID NO: 7761772 - DNA, 22 bp, Homo sapiens
aggctctgggaagcagtgagtt

SEQ ID NO: 7761773 - DNA, 22 bp, Homo sapiens
aggctctgggaagcagtgagtt

SEQ ID NO: 7761774 - DNA, 22 bp, Homo sapiens
aggctcagcccaaggtggagag

SEQ ID NO: 7761775 - DNA, 22 bp, Homo sapiens
aggctcagattcacatttggtt

SEQ ID NO: 7761776 - DNA, 22 bp, Homo sapiens
ccagggcagcagaattggggca

SEQ ID NO: 7761777 - DNA, 22 bp, Homo sapiens
ccagggcagaaaaagagggaat

SEQ ID NO: 7761778 - DNA, 22 bp, Homo sapiens
ccaggtgcctccagtcacagtg

SEQ ID NO: 7761779 - DNA, 16 bp, Homo sapiens
ccaggtggggctgtga

SEQ ID NO: 7761780 - DNA, 23 bp, Homo sapiens
ccagtaaacccttcctcagtgtc

SEQ ID NO: 7761781 - DNA, 22 bp, Homo sapiens
ccagtaaaaagcgacaggaagt

SEQ ID NO: 7761782 - DNA, 22 bp, Homo sapiens
ccaggttcaaatagctgtgtga

SEQ ID NO: 7761783 - DNA, 22 bp, Homo sapiens
ccagtaaattacttgatgtcat

SEQ ID NO: 7761784 - DNA, 22 bp, Homo sapiens
ccaggaggtggagattgcagtg

SEQ ID NO: 7761785 - DNA, 22 bp, Homo sapiens
ccaggaggtggaggttgcggtg

SEQ ID NO: 7761786 - DNA, 22 bp, Homo sapiens
aggcctgggacgggagccgtga

SEQ ID NO: 7761787 - DNA, 22 bp, Homo sapiens
ccaggaggtctgagtgtggaca

SEQ ID NO: 7761788 - DNA, 22 bp, Homo sapiens
ccaggaggatgaggggcataga

SEQ ID NO: 7761789 - DNA, 22 bp, Homo sapiens
ccaggaggggtctctgtctccc

SEQ ID NO: 7761790 - DNA, 21 bp, Homo sapiens
aggccctggaggtcagagaaa

SEQ ID NO: 7761791 - DNA, 22 bp, Homo sapiens
aggccctgctgaggcctccctc

SEQ ID NO: 7761792 - DNA, 22 bp, Homo sapiens
aggccctggacactcaagccgg

SEQ ID NO: 7761793 - DNA, 22 bp, Homo sapiens
aggcctggtgtgccggatgcag

SEQ ID NO: 7761794 - DNA, 22 bp, Homo sapiens
aggcctggtgtgccggatgcag

SEQ ID NO: 7761795 - DNA, 22 bp, Homo sapiens
aggcctggtgaatgaagtatct

SEQ ID NO: 7761796 - DNA, 22 bp, Homo sapiens
aggcctggtgaatgaagtatct

SEQ ID NO: 7761797 - DNA, 22 bp, Homo sapiens
aggcctgggtctcgtgcctacc

SEQ ID NO: 7761798 - DNA, 19 bp, Homo sapiens
aggcctggggttttgcact

SEQ ID NO: 7761799 - DNA, 22 bp, Homo sapiens
ccaggcactcacggggcactgg

SEQ ID NO: 7761800 - DNA, 22 bp, Homo sapiens
ccaggcactcagagactgggac

SEQ ID NO: 7761801 - DNA, 20 bp, Homo sapiens
ccaggcactgtcccatgcag

SEQ ID NO: 7761802 - DNA, 22 bp, Homo sapiens
ccaggcactgctcgaggtgcta

SEQ ID NO: 7761803 - DNA, 22 bp, Homo sapiens
ccaggcacaggtgggcctcaga

SEQ ID NO: 7761804 - DNA, 20 bp, Homo sapiens
aggctcagagcagtagtaca

SEQ ID NO: 7761805 - DNA, 23 bp, Homo sapiens
ccagccctccaccagctctaggc

SEQ ID NO: 7761806 - DNA, 22 bp, Homo sapiens
ccagccctgaaccctgctgcat

SEQ ID NO: 7761807 - DNA, 22 bp, Homo sapiens
ccagccctcggtagtcccatag

SEQ ID NO: 7761808 - DNA, 18 bp, Homo sapiens
ccagccctgcagcacctg

SEQ ID NO: 7761809 - DNA, 22 bp, Homo sapiens
aggccctgcccagagctcctcg

SEQ ID NO: 7761810 - DNA, 22 bp, Homo sapiens
aggccctgacctgggagatcta

SEQ ID NO: 7761811 - DNA, 22 bp, Homo sapiens
aggccctgcccagtgccacaag

SEQ ID NO: 7761812 - DNA, 22 bp, Homo sapiens
ccagccactgggccactgccag

SEQ ID NO: 7761813 - DNA, 22 bp, Homo sapiens
ccagccagatgataagctctat

SEQ ID NO: 7761814 - DNA, 22 bp, Homo sapiens
ccagccagcaagctcccagttc

SEQ ID NO: 7761815 - DNA, 22 bp, Homo sapiens
ccagcagggaaaaacccaccaa

SEQ ID NO: 7761816 - DNA, 22 bp, Homo sapiens
ccagccagctggttggacgcct

SEQ ID NO: 7761817 - DNA, 22 bp, Homo sapiens
ccagccagccttgatctgagta

SEQ ID NO: 7761818 - DNA, 22 bp, Homo sapiens
ccagccagtatattccaaagcc

SEQ ID NO: 7761819 - DNA, 22 bp, Homo sapiens
aggcaggtcccctggaaggcac

SEQ ID NO: 7761820 - DNA, 22 bp, Homo sapiens
aggcaggtagaaggatctttat

SEQ ID NO: 7761821 - DNA, 22 bp, Homo sapiens
ccagaggatgctggtcagcctc

SEQ ID NO: 7761822 - DNA, 22 bp, Homo sapiens
ccagaggttccaggctagggag

SEQ ID NO: 7761823 - DNA, 19 bp, Homo sapiens
ccagaggtttgctgggcct

SEQ ID NO: 7761824 - DNA, 19 bp, Homo sapiens
ccagaggtttgctgggcct

SEQ ID NO: 7761825 - DNA, 22 bp, Homo sapiens
cccaggcatcccattaaggagc

SEQ ID NO: 7761826 - DNA, 22 bp, Homo sapiens
agggactatttacccatctcac

SEQ ID NO: 7761827 - DNA, 22 bp, Homo sapiens
agggacccatagagagaccagt

SEQ ID NO: 7761828 - DNA, 22 bp, Homo sapiens
agggaccaggggtagctgagat

SEQ ID NO: 7761829 - DNA, 22 bp, Homo sapiens
agggaccaggggtagctgagat

SEQ ID NO: 7761830 - DNA, 22 bp, Homo sapiens
agggaccaatcaccgacaggct

SEQ ID NO: 7761831 - DNA, 22 bp, Homo sapiens
agggaccagcctgcccagggct

SEQ ID NO: 7761832 - DNA, 22 bp, Homo sapiens
agggaccacatcccctctgtgg

SEQ ID NO: 7761833 - DNA, 22 bp, Homo sapiens
agggaccagcgtgagtctgagg

SEQ ID NO: 7761834 - DNA, 22 bp, Homo sapiens
cccaggccctggcagagcttgt

SEQ ID NO: 7761835 - DNA, 22 bp, Homo sapiens
cccaggccccagggcttgtcag

SEQ ID NO: 7761836 - DNA, 22 bp, Homo sapiens
cccaggcctggtctgggccagt

SEQ ID NO: 7761837 - DNA, 22 bp, Homo sapiens
agggagccttcctggctgtggt

SEQ ID NO: 7761838 - DNA, 22 bp, Homo sapiens
aggcttggctggcagccctggg

SEQ ID NO: 7761839 - DNA, 22 bp, Homo sapiens
aggcttggctggcagccctggg

SEQ ID NO: 7761840 - DNA, 22 bp, Homo sapiens
aggcttggctctcctatgagaa

SEQ ID NO: 7761841 - DNA, 22 bp, Homo sapiens
aggcttggctctcctatgagaa

SEQ ID NO: 7761842 - DNA, 22 bp, Homo sapiens
aggctttgcaaaaaagctcata

SEQ ID NO: 7761843 - DNA, 22 bp, Homo sapiens
agggaaaggtagtgaggtcaca

SEQ ID NO: 7761844 - DNA, 22 bp, Homo sapiens
agggcagaccacgtgcaaggat

SEQ ID NO: 7761845 - DNA, 22 bp, Homo sapiens
agggcagactaggatggaagtg

SEQ ID NO: 7761846 - DNA, 22 bp, Homo sapiens
cccctgccatagtcaaatctaa

SEQ ID NO: 7761847 - DNA, 21 bp, Homo sapiens
cccctgggagccctgtcagta

SEQ ID NO: 7761848 - DNA, 22 bp, Homo sapiens
cccctgccagctatccctgaac

SEQ ID NO: 7761849 - DNA, 22 bp, Homo sapiens
cccctgccagctatccctgaac

SEQ ID NO: 7761850 - DNA, 22 bp, Homo sapiens
cccctgaagacaatggagaggt

SEQ ID NO: 7761851 - DNA, 22 bp, Homo sapiens
cccctgaagacaatggagaggt

SEQ ID NO: 7761852 - DNA, 22 bp, Homo sapiens
agggcagagaaatgtagttgag

SEQ ID NO: 7761853 - DNA, 21 bp, Homo sapiens
agggagctttaggtagaagtt

SEQ ID NO: 7761854 - DNA, 22 bp, Homo sapiens
cccaggtgctgaaggaggccgc

SEQ ID NO: 7761855 - DNA, 22 bp, Homo sapiens
cccaggtggcagaagctgcagt

SEQ ID NO: 7761856 - DNA, 22 bp, Homo sapiens
cccaggtgtttgtggcagaggt

SEQ ID NO: 7761857 - DNA, 22 bp, Homo sapiens
cccctgggtccaggcttctctg

SEQ ID NO: 7761858 - DNA, 22 bp, Homo sapiens
cccctgggtccaggcttctctg

SEQ ID NO: 7761859 - DNA, 21 bp, Homo sapiens
cccctgggagccctgtcagta

SEQ ID NO: 7761860 - DNA, 22 bp, Homo sapiens
ccctgaggatagggcaggaccc

SEQ ID NO: 7761861 - DNA, 22 bp, Homo sapiens
agggccaccagggagtctcagg

SEQ ID NO: 7761862 - DNA, 22 bp, Homo sapiens
agggccaagtccaggacctcgg

SEQ ID NO: 7761863 - DNA, 20 bp, Homo sapiens
agggcccaggaagagagtta

SEQ ID NO: 7761864 - DNA, 23 bp, Homo sapiens
agggccaggtgcggaaacagctc

SEQ ID NO: 7761865 - DNA, 23 bp, Homo sapiens
agggcccaagcctggacagcagg

SEQ ID NO: 7761866 - DNA, 22 bp, Homo sapiens
ccctgaggcaaaggctagagtt

SEQ ID NO: 7761867 - DNA, 22 bp, Homo sapiens
ccctgaggcacaggccacgtat

SEQ ID NO: 7761868 - DNA, 18 bp, Homo sapiens
ccctgaggctagcatgct

SEQ ID NO: 7761869 - DNA, 22 bp, Homo sapiens
ccctgaggctgaggataggtgg

SEQ ID NO: 7761870 - DNA, 22 bp, Homo sapiens
ccctgaggggagtggtgaggtg

SEQ ID NO: 7761871 - DNA, 18 bp, Homo sapiens
cctcagggagatccagtg

SEQ ID NO: 7761872 - DNA, 22 bp, Homo sapiens
cctaccagtaggaggccagaga

SEQ ID NO: 7761873 - DNA, 22 bp, Homo sapiens
cctacataacactgccaaactg

SEQ ID NO: 7761874 - DNA, 22 bp, Homo sapiens
cctacagttatattcttgattg

SEQ ID NO: 7761875 - DNA, 22 bp, Homo sapiens
cctacagttatattcttgattg

SEQ ID NO: 7761876 - DNA, 22 bp, Homo sapiens
cctcagggtggcatcagatctt

SEQ ID NO: 7761877 - DNA, 22 bp, Homo sapiens
cctcagggttcggatgagaaca

SEQ ID NO: 7761878 - DNA, 22 bp, Homo sapiens
cctcagggtctgaggagaccgt

SEQ ID NO: 7761879 - DNA, 22 bp, Homo sapiens
cctcagggtcatcctagtaata

SEQ ID NO: 7761880 - DNA, 22 bp, Homo sapiens
cctcagggtctctcacagcacc

SEQ ID NO: 7761881 - DNA, 23 bp, Homo sapiens
cctcagggtctagcagagagaag

SEQ ID NO: 7761882 - DNA, 22 bp, Homo sapiens
cctcagggccatctctgtccct

SEQ ID NO: 7761883 - DNA, 22 bp, Homo sapiens
cctcagggaggcctctgtggct

SEQ ID NO: 7761884 - DNA, 18 bp, Homo sapiens
cctcaggggacctggcag

SEQ ID NO: 7761885 - DNA, 22 bp, Homo sapiens
cctcaggggtgcccacagctgc

SEQ ID NO: 7761886 - DNA, 22 bp, Homo sapiens
cctcaggggtcactgtgaggag

SEQ ID NO: 7761887 - DNA, 22 bp, Homo sapiens
cctcaggggcttttcgttgttg

SEQ ID NO: 7761888 - DNA, 23 bp, Homo sapiens
cctcaggggacctgtgagcctga

SEQ ID NO: 7761889 - DNA, 22 bp, Homo sapiens
cctcaggtgtgggccagctgtc

SEQ ID NO: 7761890 - DNA, 19 bp, Homo sapiens
ccctggcaggcaagcctgg

SEQ ID NO: 7761891 - DNA, 22 bp, Homo sapiens
ccctggccagctcatgtctgag

SEQ ID NO: 7761892 - DNA, 22 bp, Homo sapiens
ccctggccagggcacagggagg

SEQ ID NO: 7761893 - DNA, 22 bp, Homo sapiens
agggcccatgtgggagcacttg

SEQ ID NO: 7761894 - DNA, 22 bp, Homo sapiens
agggcccatgtgggagcacttg

SEQ ID NO: 7761895 - DNA, 22 bp, Homo sapiens
agggcctgtctgtagaactgaa

SEQ ID NO: 7761896 - DNA, 22 bp, Homo sapiens
cctacagagcagcaggaccaga

SEQ ID NO: 7761897 - DNA, 22 bp, Homo sapiens
cctacagacaaaccagtgacta

SEQ ID NO: 7761898 - DNA, 18 bp, Homo sapiens
cctaatatgaggggtcct

SEQ ID NO: 7761899 - DNA, 22 bp, Homo sapiens
cctctgtgtcctggtcattgaa

SEQ ID NO: 7761900 - DNA, 22 bp, Homo sapiens
cctcttaattgtactccttcag

SEQ ID NO: 7761901 - DNA, 22 bp, Homo sapiens
agggggtgaatgtctgtctaca

SEQ ID NO: 7761902 - DNA, 22 bp, Homo sapiens
agggggctgccaaggaatgtaa

SEQ ID NO: 7761903 - DNA, 22 bp, Homo sapiens
agggggtgcccagatgaaggat

SEQ ID NO: 7761904 - DNA, 22 bp, Homo sapiens
cctgagtcccctcattcactct

SEQ ID NO: 7761905 - DNA, 22 bp, Homo sapiens
cctgagtctgtgttttcctaag

SEQ ID NO: 7761906 - DNA, 22 bp, Homo sapiens
aggggtgaaagagggccctcaa

SEQ ID NO: 7761907 - DNA, 22 bp, Homo sapiens
cctccttcctgggacagagctg

SEQ ID NO: 7761908 - DNA, 22 bp, Homo sapiens
cctcgacctccccaggctcagg

SEQ ID NO: 7761909 - DNA, 22 bp, Homo sapiens
cctcctggttgcaatgaaatgg

SEQ ID NO: 7761910 - DNA, 22 bp, Homo sapiens
cctcctggtgggcgcttctggc

SEQ ID NO: 7761911 - DNA, 22 bp, Homo sapiens
cctcctggtgacaaggcaaagc

SEQ ID NO: 7761912 - DNA, 22 bp, Homo sapiens
cctcctggtccagcatctcttt

SEQ ID NO: 7761913 - DNA, 22 bp, Homo sapiens
aggggaaatctctcgccatctg

SEQ ID NO: 7761914 - DNA, 22 bp, Homo sapiens
aggggaaatgccttggtggtac

SEQ ID NO: 7761915 - DNA, 22 bp, Homo sapiens
agttcagtagtccttcattgta

SEQ ID NO: 7761916 - DNA, 22 bp, Homo sapiens
agttgaaattagagtcctggct

SEQ ID NO: 7761917 - DNA, 22 bp, Homo sapiens
agttcttttgtgaacatatgct

SEQ ID NO: 7761918 - DNA, 22 bp, Homo sapiens
ataacactaaatgtatgtaaca

SEQ ID NO: 7761919 - DNA, 22 bp, Homo sapiens
ataacagactgatttttaaatg

SEQ ID NO: 7761920 - DNA, 22 bp, Homo sapiens
ataaattttcttgctgtactta

SEQ ID NO: 7761921 - DNA, 22 bp, Homo sapiens
ataacaatagtggtagtgctgg

SEQ ID NO: 7761922 - DNA, 19 bp, Homo sapiens
ataaataaaaagtgggaga

SEQ ID NO: 7761923 - DNA, 22 bp, Homo sapiens
agttgcagccttcaggagaccc

SEQ ID NO: 7761924 - DNA, 22 bp, Homo sapiens
ataaattctctgatgtatagta

SEQ ID NO: 7761925 - DNA, 22 bp, Homo sapiens
ataaattcaaagcatttaggac

SEQ ID NO: 7761926 - DNA, 22 bp, Homo sapiens
ataaattctctgatgtatagta

SEQ ID NO: 7761927 - DNA, 19 bp, Homo sapiens
atacactaatataaaccac

SEQ ID NO: 7761928 - DNA, 22 bp, Homo sapiens
atacaatgggtgcaaagatgtg

SEQ ID NO: 7761929 - DNA, 22 bp, Homo sapiens
atacaatagtgtttgttttgag

SEQ ID NO: 7761930 - DNA, 22 bp, Homo sapiens
atacaatcatcattatattccc

SEQ ID NO: 7761931 - DNA, 22 bp, Homo sapiens
ataaggaaaattggagaaattg

SEQ ID NO: 7761932 - DNA, 22 bp, Homo sapiens
ataaggaaaattggagaaattg

SEQ ID NO: 7761933 - DNA, 22 bp, Homo sapiens
ataaggaacctgggcttaagag

SEQ ID NO: 7761934 - DNA, 22 bp, Homo sapiens
ataaggacacccttctctttac

SEQ ID NO: 7761935 - DNA, 22 bp, Homo sapiens
ataaggaagttgcagaagtgga

SEQ ID NO: 7761936 - DNA, 22 bp, Homo sapiens
ataaggcttaaaccttgttgcc

SEQ ID NO: 7761937 - DNA, 22 bp, Homo sapiens
atacaagttgtgataatgtaaa

SEQ ID NO: 7761938 - DNA, 22 bp, Homo sapiens
atacaagttgtgataatgtaaa

SEQ ID NO: 7761939 - DNA, 17 bp, Homo sapiens
atacaaagccataaacc

SEQ ID NO: 7761940 - DNA, 22 bp, Homo sapiens
atacaaagacaaatctcaatct

SEQ ID NO: 7761941 - DNA, 20 bp, Homo sapiens
atacaaagagattgatgtat

SEQ ID NO: 7761942 - DNA, 22 bp, Homo sapiens
ataggacagcagacaattagta

SEQ ID NO: 7761943 - DNA, 22 bp, Homo sapiens
atagtgttgatagcagtggagt

SEQ ID NO: 7761944 - DNA, 22 bp, Homo sapiens
atagtgttacccttcttaaagt

SEQ ID NO: 7761945 - DNA, 22 bp, Homo sapiens
atagccttggtccttgctccac

SEQ ID NO: 7761946 - DNA, 22 bp, Homo sapiens
ataggaaagaaaattatgtagg

SEQ ID NO: 7761947 - DNA, 22 bp, Homo sapiens
atagctttttgtcatagagtct

SEQ ID NO: 7761948 - DNA, 22 bp, Homo sapiens
atagctttcttaaatatataaa

SEQ ID NO: 7761949 - DNA, 22 bp, Homo sapiens
atagctttcttaaatatataaa

SEQ ID NO: 7761950 - DNA, 23 bp, Homo sapiens
agaaaagcttggacacatggcct

SEQ ID NO: 7761951 - DNA, 22 bp, Homo sapiens
agaaaaggattgatggatcaga

SEQ ID NO: 7761952 - DNA, 22 bp, Homo sapiens
agaaaagggcaggagggataca

SEQ ID NO: 7761953 - DNA, 17 bp, Homo sapiens
agaaaagagaccagcag

SEQ ID NO: 7761954 - DNA, 22 bp, Homo sapiens
agaaaagaggctttctaagcat

SEQ ID NO: 7761955 - DNA, 22 bp, Homo sapiens
agaaaagcggtcaggaccctca

SEQ ID NO: 7761956 - DNA, 22 bp, Homo sapiens
agaaaacttgctcgagcctgtt

SEQ ID NO: 7761957 - DNA, 22 bp, Homo sapiens
agaaaactgggaggagagcttc

SEQ ID NO: 7761958 - DNA, 22 bp, Homo sapiens
agaaaacttgtcacagctctca

SEQ ID NO: 7761959 - DNA, 22 bp, Homo sapiens
atacacttccaaatattgatta

SEQ ID NO: 7761960 - DNA, 20 bp, Homo sapiens
actttacagagaagactgac

SEQ ID NO: 7761961 - DNA, 22 bp, Homo sapiens
atagaatagcatagaaaattga

SEQ ID NO: 7761962 - DNA, 22 bp, Homo sapiens
atcctgggaagctgacattgaa

SEQ ID NO: 7761963 - DNA, 19 bp, Homo sapiens
agaagcccagatcccagcc

SEQ ID NO: 7761964 - DNA, 22 bp, Homo sapiens
agaagccattgaagcagacctc

SEQ ID NO: 7761965 - DNA, 22 bp, Homo sapiens
agaagccattccctgtaggctc

SEQ ID NO: 7761966 - DNA, 22 bp, Homo sapiens
agaagctgacagatgcagcagg

SEQ ID NO: 7761967 - DNA, 22 bp, Homo sapiens
agaagctaggctagacaagtga

SEQ ID NO: 7761968 - DNA, 21 bp, Homo sapiens
agaagctagtcactaaatcca

SEQ ID NO: 7761969 - DNA, 22 bp, Homo sapiens
agaagctataacaacaattata

SEQ ID NO: 7761970 - DNA, 22 bp, Homo sapiens
atctggaaaacacagtgtagac

SEQ ID NO: 7761971 - DNA, 23 bp, Homo sapiens
agaagctgggagcctggggatgg

SEQ ID NO: 7761972 - DNA, 22 bp, Homo sapiens
agaaatgtcaggaaagaagtcc

SEQ ID NO: 7761973 - DNA, 22 bp, Homo sapiens
agaaatgtcaggaaagaagtcc

SEQ ID NO: 7761974 - DNA, 22 bp, Homo sapiens
agaaatgtattctgtatgtttt

SEQ ID NO: 7761975 - DNA, 22 bp, Homo sapiens
agaaatgtattctgtatgtttt

SEQ ID NO: 7761976 - DNA, 22 bp, Homo sapiens
agaaatgtggatcgttttaaaa

SEQ ID NO: 7761977 - DNA, 22 bp, Homo sapiens
agaaatgttgaatacacaaaat

SEQ ID NO: 7761978 - DNA, 22 bp, Homo sapiens
agaaatgttgaatacacaaaat

SEQ ID NO: 7761979 - DNA, 22 bp, Homo sapiens
agaaatgttcttcatttgccat

SEQ ID NO: 7761980 - DNA, 22 bp, Homo sapiens
agaagcagttattttttgcaca

SEQ ID NO: 7761981 - DNA, 22 bp, Homo sapiens
agaagcagggcagggaaaagca

SEQ ID NO: 7761982 - DNA, 22 bp, Homo sapiens
agaagcaggcctcacagatctg

SEQ ID NO: 7761983 - DNA, 22 bp, Homo sapiens
agaaatgttgaatacatcagga

SEQ ID NO: 7761984 - DNA, 22 bp, Homo sapiens
agaaattaggaaagtaacactt

SEQ ID NO: 7761985 - DNA, 22 bp, Homo sapiens
atcaattttgaggatacaagaa

SEQ ID NO: 7761986 - DNA, 22 bp, Homo sapiens
atcaagcagtgaaaaatgctag

SEQ ID NO: 7761987 - DNA, 22 bp, Homo sapiens
atcaagaattgggagctattga

SEQ ID NO: 7761988 - DNA, 22 bp, Homo sapiens
atattaattatttacacatgag

SEQ ID NO: 7761989 - DNA, 22 bp, Homo sapiens
agaaatatgctgattagatgaa

SEQ ID NO: 7761990 - DNA, 19 bp, Homo sapiens
agaaatagccttccttgtc

SEQ ID NO: 7761991 - DNA, 19 bp, Homo sapiens
agaaatagccttccttgtc

SEQ ID NO: 7761992 - DNA, 22 bp, Homo sapiens
agaaatatgctgattagatgaa

SEQ ID NO: 7761993 - DNA, 22 bp, Homo sapiens
agaaatatgctgattagatgaa

SEQ ID NO: 7761994 - DNA, 22 bp, Homo sapiens
agaaatcacttagaggaagtga

SEQ ID NO: 7761995 - DNA, 22 bp, Homo sapiens
agaaatcagaaccctgaagttc

SEQ ID NO: 7761996 - DNA, 20 bp, Homo sapiens
agaaatattgagttcagagg

SEQ ID NO: 7761997 - DNA, 22 bp, Homo sapiens
agaaatcaatatctatatgttg

SEQ ID NO: 7761998 - DNA, 22 bp, Homo sapiens
agaaatcaatatctatatgttg

SEQ ID NO: 7761999 - DNA, 22 bp, Homo sapiens
atatagaaggtgctatttacat

SEQ ID NO: 7762000 - DNA, 19 bp, Homo sapiens
atatagcattattcaattt

SEQ ID NO: 7762001 - DNA, 22 bp, Homo sapiens
atatagtttaagaaagtacagt

SEQ ID NO: 7762002 - DNA, 22 bp, Homo sapiens
atatagttgggtttcattctac

SEQ ID NO: 7762003 - DNA, 20 bp, Homo sapiens
agaaacatttcttgagaact

SEQ ID NO: 7762004 - DNA, 22 bp, Homo sapiens
atatagtttaggttcgaatggg

SEQ ID NO: 7762005 - DNA, 22 bp, Homo sapiens
agaaagacgtgatgaagaagta

SEQ ID NO: 7762006 - DNA, 22 bp, Homo sapiens
agaaagagctcgggattaacag

SEQ ID NO: 7762007 - DNA, 22 bp, Homo sapiens
atattaatgagcaagtaagtga

SEQ ID NO: 7762008 - DNA, 22 bp, Homo sapiens
atattaagatgctattggtttt

SEQ ID NO: 7762009 - DNA, 22 bp, Homo sapiens
atattaatgggatttagtcagg

SEQ ID NO: 7762010 - DNA, 22 bp, Homo sapiens
actcagagcctcgagggactgc

SEQ ID NO: 7762011 - DNA, 22 bp, Homo sapiens
aggtggtgatgacagaagacag

SEQ ID NO: 7762012 - DNA, 22 bp, Homo sapiens
aggtggtgtttggttacatgag

SEQ ID NO: 7762013 - DNA, 22 bp, Homo sapiens
aggtggagacccagagaaggcg

SEQ ID NO: 7762014 - DNA, 22 bp, Homo sapiens
aggtggagacccagagaaggcg

SEQ ID NO: 7762015 - DNA, 22 bp, Homo sapiens
aggtggagaagagatgggcagt

SEQ ID NO: 7762016 - DNA, 22 bp, Homo sapiens
agggtgagggtctggccttgag

SEQ ID NO: 7762017 - DNA, 22 bp, Homo sapiens
agggtcccgtccctctgcaccc

SEQ ID NO: 7762018 - DNA, 22 bp, Homo sapiens
agggtgcaaaagcaaggacagt

SEQ ID NO: 7762019 - DNA, 22 bp, Homo sapiens
agggtgcagtcacaggaaatgt

SEQ ID NO: 7762020 - DNA, 19 bp, Homo sapiens
agggtccaggccctgtgga

SEQ ID NO: 7762021 - DNA, 22 bp, Homo sapiens
agggtccatcaaggactgcaca

SEQ ID NO: 7762022 - DNA, 19 bp, Homo sapiens
agggtccagggagcggctc

SEQ ID NO: 7762023 - DNA, 22 bp, Homo sapiens
agggtccattctttgccttttc

SEQ ID NO: 7762024 - DNA, 22 bp, Homo sapiens
agggtcccgaaggagacagcaa

SEQ ID NO: 7762025 - DNA, 22 bp, Homo sapiens
agggtgcatgtttgcaagagtg

SEQ ID NO: 7762026 - DNA, 22 bp, Homo sapiens
agggtgcagtcacaggaaatgt

SEQ ID NO: 7762027 - DNA, 22 bp, Homo sapiens
aggtggaaatggctttcctagg

SEQ ID NO: 7762028 - DNA, 22 bp, Homo sapiens
aggtgccagatgcacagctgaa

SEQ ID NO: 7762029 - DNA, 22 bp, Homo sapiens
aggtgccaattttcagtgaaca

SEQ ID NO: 7762030 - DNA, 21 bp, Homo sapiens
aggtgccaaggagaagcaggc

SEQ ID NO: 7762031 - DNA, 21 bp, Homo sapiens
aggtgccaaggagaagcaggc

SEQ ID NO: 7762032 - DNA, 22 bp, Homo sapiens
aggtgccaagatgtcacagaca

SEQ ID NO: 7762033 - DNA, 22 bp, Homo sapiens
agtcctgtgaggggtgcagctt

SEQ ID NO: 7762034 - DNA, 22 bp, Homo sapiens
agtcctgtgagtttttctagtt

SEQ ID NO: 7762035 - DNA, 22 bp, Homo sapiens
agtcctgtgcaaatgcatctga

SEQ ID NO: 7762036 - DNA, 22 bp, Homo sapiens
agtcctgtatctgagctgagtc

SEQ ID NO: 7762037 - DNA, 21 bp, Homo sapiens
agtccaggaggaggccaggtt

SEQ ID NO: 7762038 - DNA, 22 bp, Homo sapiens
agtccagaccccggcagctggt

SEQ ID NO: 7762039 - DNA, 22 bp, Homo sapiens
agtccaggaagcatcatggtct

SEQ ID NO: 7762040 - DNA, 22 bp, Homo sapiens
agtcagtcaccatttaagaaca

SEQ ID NO: 7762041 - DNA, 22 bp, Homo sapiens
agtcagtcaccatttaagaaca

SEQ ID NO: 7762042 - DNA, 22 bp, Homo sapiens
agtcagtagatccaaacttttg

SEQ ID NO: 7762043 - DNA, 22 bp, Homo sapiens
agtaagtgagtcactgtgctgg

SEQ ID NO: 7762044 - DNA, 22 bp, Homo sapiens
actcagagttttacccagagac

SEQ ID NO: 7762045 - DNA, 22 bp, Homo sapiens
actcagagtagaaaataggttc

SEQ ID NO: 7762046 - DNA, 22 bp, Homo sapiens
actcagaggaaagttgagattg

SEQ ID NO: 7762047 - DNA, 23 bp, Homo sapiens
agtaacatgcaaataacagtctg

SEQ ID NO: 7762048 - DNA, 23 bp, Homo sapiens
agtaacatgcaaataacagtctg

SEQ ID NO: 7762049 - DNA, 22 bp, Homo sapiens
agtaaggcaatgccactaagat

SEQ ID NO: 7762050 - DNA, 22 bp, Homo sapiens
agtgagatgtgtaatcaggggt

SEQ ID NO: 7762051 - DNA, 22 bp, Homo sapiens
agtgcaaaattcagaagcaatt

SEQ ID NO: 7762052 - DNA, 22 bp, Homo sapiens
agtgcaaactttattgtgacct

SEQ ID NO: 7762053 - DNA, 22 bp, Homo sapiens
agtggctggaattgcaggtgcg

SEQ ID NO: 7762054 - DNA, 20 bp, Homo sapiens
agtgggagagggcagactgc

SEQ ID NO: 7762055 - DNA, 22 bp, Homo sapiens
agtgggagccagcagcttgggg

SEQ ID NO: 7762056 - DNA, 22 bp, Homo sapiens
agtgggagataacttaacagct

SEQ ID NO: 7762057 - DNA, 20 bp, Homo sapiens
agtgggagagggcagactgc

SEQ ID NO: 7762058 - DNA, 22 bp, Homo sapiens
agtgggaggaagtggtgatatt

SEQ ID NO: 7762059 - DNA, 22 bp, Homo sapiens
agtgggagcggcagtcggggac

SEQ ID NO: 7762060 - DNA, 22 bp, Homo sapiens
agtgggagcggcagtcggggac

SEQ ID NO: 7762061 - DNA, 22 bp, Homo sapiens
agtgggaggcggctgacgggcg

SEQ ID NO: 7762062 - DNA, 16 bp, Homo sapiens
agtgggaggagaaaga

SEQ ID NO: 7762063 - DNA, 22 bp, Homo sapiens
agtggcagagaccccagccagc

SEQ ID NO: 7762064 - DNA, 22 bp, Homo sapiens
agtggcagagaccccagccagc

SEQ ID NO: 7762065 - DNA, 22 bp, Homo sapiens
agtggcagacacaatgtgggca

SEQ ID NO: 7762066 - DNA, 22 bp, Homo sapiens
agtgcttctggtgggcgtgagg

SEQ ID NO: 7762067 - DNA, 22 bp, Homo sapiens
agtgtcttagtccatttgggct

SEQ ID NO: 7762068 - DNA, 22 bp, Homo sapiens
agtgggggccaacgagggcagc

SEQ ID NO: 7762069 - DNA, 22 bp, Homo sapiens
agtgtctggtgagggctctctc

SEQ ID NO: 7762070 - DNA, 22 bp, Homo sapiens
agtgtctgtgatgaggtcagga

SEQ ID NO: 7762071 - DNA, 22 bp, Homo sapiens
agtgtctgttgagtttcaaaag

SEQ ID NO: 7762072 - DNA, 21 bp, Homo sapiens
agttacatgtatagataaagt

SEQ ID NO: 7762073 - DNA, 22 bp, Homo sapiens
agttcaaactctataagaactt

SEQ ID NO: 7762074 - DNA, 22 bp, Homo sapiens
agttcaaaaaggtaaagtttat

SEQ ID NO: 7762075 - DNA, 22 bp, Homo sapiens
agttcaatagaaaaatatatta

SEQ ID NO: 7762076 - DNA, 22 bp, Homo sapiens
agttcaaagtcaaggaaactgt

SEQ ID NO: 7762077 - DNA, 22 bp, Homo sapiens
agttattttggaaaatgagtca

SEQ ID NO: 7762078 - DNA, 22 bp, Homo sapiens
agttatttggctatagatggta

SEQ ID NO: 7762079 - DNA, 22 bp, Homo sapiens
actggggtttaggcctgggcaa

SEQ ID NO: 7762080 - DNA, 22 bp, Homo sapiens
actggggtgaaattggagtgtc

SEQ ID NO: 7762081 - DNA, 22 bp, Homo sapiens
agttaataatggaaagacacat

SEQ ID NO: 7762082 - DNA, 22 bp, Homo sapiens
actggttgaagaaaagctagta

SEQ ID NO: 7762083 - DNA, 22 bp, Homo sapiens
acatatattactagtaaagaca

SEQ ID NO: 7762084 - DNA, 22 bp, Homo sapiens
acatatatgtaaagtactttgt

SEQ ID NO: 7762085 - DNA, 22 bp, Homo sapiens
acatataagggatcagtgacag

SEQ ID NO: 7762086 - DNA, 22 bp, Homo sapiens
acatatatgtaaagtactttgt

SEQ ID NO: 7762087 - DNA, 23 bp, Homo sapiens
aggcagtggtggtaacatgtcaa

SEQ ID NO: 7762088 - DNA, 20 bp, Homo sapiens
aggcagtgtagagatgagta

SEQ ID NO: 7762089 - DNA, 22 bp, Homo sapiens
aggcagtggtgtttgctggtgg

SEQ ID NO: 7762090 - DNA, 22 bp, Homo sapiens
aggcagtgtattgctagcggct

SEQ ID NO: 7762091 - DNA, 20 bp, Homo sapiens
aggcagtgtagagatgagta

SEQ ID NO: 7762092 - DNA, 20 bp, Homo sapiens
aggcagtgtagagatgagta

SEQ ID NO: 7762093 - DNA, 22 bp, Homo sapiens
aggcagtgtggagggctgttgc

SEQ ID NO: 7762094 - DNA, 23 bp, Homo sapiens
aggcagtgtctcttatcctgtcc

SEQ ID NO: 7762095 - DNA, 22 bp, Homo sapiens
aggcagtgtgggccaagcttcc

SEQ ID NO: 7762096 - DNA, 21 bp, Homo sapiens
aggcagaaagagcccaggctg

SEQ ID NO: 7762097 - DNA, 22 bp, Homo sapiens
aggcagaaccagctgggacttt

SEQ ID NO: 7762098 - DNA, 22 bp, Homo sapiens
aggcagaagccagccagggtcc

SEQ ID NO: 7762099 - DNA, 22 bp, Homo sapiens
aggcagaagccagccagggtcc

SEQ ID NO: 7762100 - DNA, 22 bp, Homo sapiens
aggcagaatgttggaaaggaag

SEQ ID NO: 7762101 - DNA, 22 bp, Homo sapiens
aggcagagaaaaaccagatatg

SEQ ID NO: 7762102 - DNA, 22 bp, Homo sapiens
aggcagatatttcagttcacat

SEQ ID NO: 7762103 - DNA, 22 bp, Homo sapiens
aggcagatcagtacagggttaa

SEQ ID NO: 7762104 - DNA, 22 bp, Homo sapiens
aggcagatcacttgaggccagg

SEQ ID NO: 7762105 - DNA, 22 bp, Homo sapiens
aggcagattacttgaggccagg

SEQ ID NO: 7762106 - DNA, 22 bp, Homo sapiens
acatagttagcttagagatact

SEQ ID NO: 7762107 - DNA, 22 bp, Homo sapiens
acatagttcagagcagcagacc

SEQ ID NO: 7762108 - DNA, 22 bp, Homo sapiens
aggcagattttctttactcagt

SEQ ID NO: 7762109 - DNA, 18 bp, Homo sapiens
aggcaggtgctggaagtc

SEQ ID NO: 7762110 - DNA, 22 bp, Homo sapiens
aggcaggggagctggaagggta

SEQ ID NO: 7762111 - DNA, 22 bp, Homo sapiens
aggcaggggagctggaagggta

SEQ ID NO: 7762112 - DNA, 22 bp, Homo sapiens
aggcaggggagctggaagggta

SEQ ID NO: 7762113 - DNA, 22 bp, Homo sapiens
aggcagaaaatagtcatccaaa

SEQ ID NO: 7762114 - DNA, 22 bp, Homo sapiens
acagtgttcacttaacaatgga

SEQ ID NO: 7762115 - DNA, 22 bp, Homo sapiens
aggcacagcacacctggccccc

SEQ ID NO: 7762116 - DNA, 17 bp, Homo sapiens
aggaggccctggcgttt

SEQ ID NO: 7762117 - DNA, 19 bp, Homo sapiens
aggaggccatgccactaga

SEQ ID NO: 7762118 - DNA, 22 bp, Homo sapiens
aggaggcccctcctgggttgct

SEQ ID NO: 7762119 - DNA, 22 bp, Homo sapiens
aggaggccctagagctctagag

SEQ ID NO: 7762120 - DNA, 22 bp, Homo sapiens
aggaggccaggccctcaagcct

SEQ ID NO: 7762121 - DNA, 22 bp, Homo sapiens
acagtgaatccaaattcctacc

SEQ ID NO: 7762122 - DNA, 22 bp, Homo sapiens
acagtgaatgagaatggagaaa

SEQ ID NO: 7762123 - DNA, 22 bp, Homo sapiens
acagtgaatgcccaagaaaagt

SEQ ID NO: 7762124 - DNA, 22 bp, Homo sapiens
acagtgacgtttatttgagacg

SEQ ID NO: 7762125 - DNA, 19 bp, Homo sapiens
aggaaaggtggccttagca

SEQ ID NO: 7762126 - DNA, 22 bp, Homo sapiens
aggaaaggtgagagcggccgcg

SEQ ID NO: 7762127 - DNA, 22 bp, Homo sapiens
aggaaaggggtaggtgtggacg

SEQ ID NO: 7762128 - DNA, 22 bp, Homo sapiens
aggaaaggggtaggtgtggacg

SEQ ID NO: 7762129 - DNA, 22 bp, Homo sapiens
aggaaaggtagcgtgccagcag

SEQ ID NO: 7762130 - DNA, 22 bp, Homo sapiens
aggaaataagggcacttcagat

SEQ ID NO: 7762131 - DNA, 22 bp, Homo sapiens
aggaaagtggtgggaaatcagg

SEQ ID NO: 7762132 - DNA, 22 bp, Homo sapiens
acagggcatgtgcaagagacat

SEQ ID NO: 7762133 - DNA, 23 bp, Homo sapiens
acagggcattgctggcctcgagg

SEQ ID NO: 7762134 - DNA, 21 bp, Homo sapiens
acaggctctggggatgctggg

SEQ ID NO: 7762135 - DNA, 22 bp, Homo sapiens
acaggctctcagccagttggca

SEQ ID NO: 7762136 - DNA, 22 bp, Homo sapiens
acaggctctctattgagtgcag

SEQ ID NO: 7762137 - DNA, 22 bp, Homo sapiens
acaggctctctattgagtgcag

SEQ ID NO: 7762138 - DNA, 22 bp, Homo sapiens
acagggcctcagccagggcaga

SEQ ID NO: 7762139 - DNA, 22 bp, Homo sapiens
acagggcctcagccagggcaga

SEQ ID NO: 7762140 - DNA, 22 bp, Homo sapiens
acagggccaggtgagaggtgct

SEQ ID NO: 7762141 - DNA, 22 bp, Homo sapiens
acagggccttatatccagaagg

SEQ ID NO: 7762142 - DNA, 22 bp, Homo sapiens
aggacagggattcaaactccca

SEQ ID NO: 7762143 - DNA, 22 bp, Homo sapiens
aggacaggattgagctgaactg

SEQ ID NO: 7762144 - DNA, 22 bp, Homo sapiens
aggacagttaaaaatagatggc

SEQ ID NO: 7762145 - DNA, 22 bp, Homo sapiens
aggacagtgtggaagagggtgc

SEQ ID NO: 7762146 - DNA, 22 bp, Homo sapiens
aggacagtggacactagtccct

SEQ ID NO: 7762147 - DNA, 22 bp, Homo sapiens
aggacaggtgtagtgggctctg

SEQ ID NO: 7762148 - DNA, 22 bp, Homo sapiens
aggacagtccggggtcctccac

SEQ ID NO: 7762149 - DNA, 22 bp, Homo sapiens
aggactggcagtgtgaggggtc

SEQ ID NO: 7762150 - DNA, 22 bp, Homo sapiens
aggactgttttttcttctaggg

SEQ ID NO: 7762151 - DNA, 22 bp, Homo sapiens
aggactggtgtgtgatcagcat

SEQ ID NO: 7762152 - DNA, 22 bp, Homo sapiens
aggactggtgccagacaaggta

SEQ ID NO: 7762153 - DNA, 22 bp, Homo sapiens
aggactgggtgcagagggcatc

SEQ ID NO: 7762154 - DNA, 22 bp, Homo sapiens
agcttcttgaccaagcctgtaa

SEQ ID NO: 7762155 - DNA, 22 bp, Homo sapiens
acaggacatgtaccaggtggtc

SEQ ID NO: 7762156 - DNA, 22 bp, Homo sapiens
acaggactgtggaaggatctct

SEQ ID NO: 7762157 - DNA, 22 bp, Homo sapiens
acaggacatggcttctgtgacg

SEQ ID NO: 7762158 - DNA, 22 bp, Homo sapiens
acaggacaggctgggctagact

SEQ ID NO: 7762159 - DNA, 22 bp, Homo sapiens
acaggacaggtaggattcgcag

SEQ ID NO: 7762160 - DNA, 22 bp, Homo sapiens
acaggacagggaattcgaaatt

SEQ ID NO: 7762161 - DNA, 22 bp, Homo sapiens
acaggacagggaattcgaaatt

SEQ ID NO: 7762162 - DNA, 22 bp, Homo sapiens
acaggacagtctagtaacagta

SEQ ID NO: 7762163 - DNA, 22 bp, Homo sapiens
acaggcaaggccagtgagaaat

SEQ ID NO: 7762164 - DNA, 22 bp, Homo sapiens
acaggcaacttcaaatctcact

SEQ ID NO: 7762165 - DNA, 22 bp, Homo sapiens
acaggcaagtcacacaacttgt

SEQ ID NO: 7762166 - DNA, 22 bp, Homo sapiens
agcttcttgtagaactcaaaag

SEQ ID NO: 7762167 - DNA, 22 bp, Homo sapiens
acaggatgagaatatcatattt

SEQ ID NO: 7762168 - DNA, 22 bp, Homo sapiens
acaggatgggcgcacagagcta

SEQ ID NO: 7762169 - DNA, 22 bp, Homo sapiens
acaggatggccagctgatattg

SEQ ID NO: 7762170 - DNA, 20 bp, Homo sapiens
acaggatgcctgccatttca

SEQ ID NO: 7762171 - DNA, 22 bp, Homo sapiens
acagcattcaataaataataac

SEQ ID NO: 7762172 - DNA, 22 bp, Homo sapiens
acagcatttaaagaaaatgaac

SEQ ID NO: 7762173 - DNA, 22 bp, Homo sapiens
acaggaacgaatgtacattgtt

SEQ ID NO: 7762174 - DNA, 22 bp, Homo sapiens
acaggaagaaagtgcagtagat

SEQ ID NO: 7762175 - DNA, 22 bp, Homo sapiens
acaggacaatttataatgggca

SEQ ID NO: 7762176 - DNA, 22 bp, Homo sapiens
acaggacaaggggaagaagata

SEQ ID NO: 7762177 - DNA, 22 bp, Homo sapiens
acaggacaaaaatctggatggc

SEQ ID NO: 7762178 - DNA, 22 bp, Homo sapiens
acaggacaactcagcagccagc

SEQ ID NO: 7762179 - DNA, 22 bp, Homo sapiens
aggctgctggcaggcgtggacg

SEQ ID NO: 7762180 - DNA, 23 bp, Homo sapiens
aggctgcagaagaatagggtcat

SEQ ID NO: 7762181 - DNA, 22 bp, Homo sapiens
aggctctggctactacagagct

SEQ ID NO: 7762182 - DNA, 22 bp, Homo sapiens
aggctctggcaacagctggtgt

SEQ ID NO: 7762183 - DNA, 22 bp, Homo sapiens
acatttctcaggtaagtcattt

SEQ ID NO: 7762184 - DNA, 22 bp, Homo sapiens
acatttctccctgcatgcctgc

SEQ ID NO: 7762185 - DNA, 22 bp, Homo sapiens
aggctggccagtgctgcagtgg

SEQ ID NO: 7762186 - DNA, 23 bp, Homo sapiens
aggctggcttcaggagcctctcc

SEQ ID NO: 7762187 - DNA, 22 bp, Homo sapiens
aggctggcttggctctcctgtg

SEQ ID NO: 7762188 - DNA, 22 bp, Homo sapiens
aggctggcttcccaagcgtcct

SEQ ID NO: 7762189 - DNA, 22 bp, Homo sapiens
aggctggcttcccaagcgtcct

SEQ ID NO: 7762190 - DNA, 21 bp, Homo sapiens
accactgcctccaaggttcag

SEQ ID NO: 7762191 - DNA, 22 bp, Homo sapiens
aggctgtgatgagcctcatgga

SEQ ID NO: 7762192 - DNA, 22 bp, Homo sapiens
accagaaaggaataatagaatt

SEQ ID NO: 7762193 - DNA, 22 bp, Homo sapiens
accagaaggaccagaggcaagg

SEQ ID NO: 7762194 - DNA, 22 bp, Homo sapiens
accagacactgtgaagacaggc

SEQ ID NO: 7762195 - DNA, 22 bp, Homo sapiens
aggctgtgagtagttcttgttg

SEQ ID NO: 7762196 - DNA, 22 bp, Homo sapiens
aggctgtgagaagtccttcagt

SEQ ID NO: 7762197 - DNA, 22 bp, Homo sapiens
aggctgtgagaggtggctccca

SEQ ID NO: 7762198 - DNA, 22 bp, Homo sapiens
aggctgtgagaggtggctccca

SEQ ID NO: 7762199 - DNA, 22 bp, Homo sapiens
aggctgggaaatgtagtcttcc

SEQ ID NO: 7762200 - DNA, 22 bp, Homo sapiens
aggctgggaaacctgaagttgt

SEQ ID NO: 7762201 - DNA, 22 bp, Homo sapiens
aggctgggaaacctgaagttgt

SEQ ID NO: 7762202 - DNA, 22 bp, Homo sapiens
aggctggctttggtagcatggt

SEQ ID NO: 7762203 - DNA, 22 bp, Homo sapiens
aggctggctttggtagcatggt

SEQ ID NO: 7762204 - DNA, 22 bp, Homo sapiens
aggcagtgtgtagctggaagag

SEQ ID NO: 7762205 - DNA, 22 bp, Homo sapiens
acatgtaaaaggaacatgcatg

SEQ ID NO: 7762206 - DNA, 22 bp, Homo sapiens
acatgtatacaatgtgtaatga

SEQ ID NO: 7762207 - DNA, 22 bp, Homo sapiens
acatgtatgctttatgaagtag

SEQ ID NO: 7762208 - DNA, 22 bp, Homo sapiens
acatgtatgctttatgaagtag

SEQ ID NO: 7762209 - DNA, 22 bp, Homo sapiens
acatgtctacacattctgcaat

SEQ ID NO: 7762210 - DNA, 22 bp, Homo sapiens
acatgtcttttaaagtctaata

SEQ ID NO: 7762211 - DNA, 22 bp, Homo sapiens
acatgtgctcttgctgtacagc

SEQ ID NO: 7762212 - DNA, 22 bp, Homo sapiens
aggctcaagcactgatattttt

SEQ ID NO: 7762213 - DNA, 20 bp, Homo sapiens
aggctcactcaccttgtgga

SEQ ID NO: 7762214 - DNA, 22 bp, Homo sapiens
aggctctataccgctgggagtt

SEQ ID NO: 7762215 - DNA, 22 bp, Homo sapiens
acattaaatttcatagtgatta

SEQ ID NO: 7762216 - DNA, 22 bp, Homo sapiens
acatgttttgtgccttgactag

SEQ ID NO: 7762217 - DNA, 19 bp, Homo sapiens
acatgttttgcagaacagc

SEQ ID NO: 7762218 - DNA, 22 bp, Homo sapiens
aggctctggacagtgaggagtt

SEQ ID NO: 7762219 - DNA, 22 bp, Homo sapiens
aggctctggagtgtggtgctgg

SEQ ID NO: 7762220 - DNA, 22 bp, Homo sapiens
aggctctggagtgtggtgctgg

SEQ ID NO: 7762221 - DNA, 22 bp, Homo sapiens
aggctctggagtgtggtgctgg

SEQ ID NO: 7762222 - DNA, 22 bp, Homo sapiens
aggggtgatttgggacaggaca

SEQ ID NO: 7762223 - DNA, 20 bp, Homo sapiens
aggggtgatcgggtgacact

SEQ ID NO: 7762224 - DNA, 16 bp, Homo sapiens
acctccagtcaagggt

SEQ ID NO: 7762225 - DNA, 22 bp, Homo sapiens
acctcccagctctgagcttggg

SEQ ID NO: 7762226 - DNA, 22 bp, Homo sapiens
acctcaggatgtggacacagaa

SEQ ID NO: 7762227 - DNA, 22 bp, Homo sapiens
acctcagagggatgttacaggc

SEQ ID NO: 7762228 - DNA, 22 bp, Homo sapiens
acctcagagacctctcaggtgc

SEQ ID NO: 7762229 - DNA, 22 bp, Homo sapiens
accctttgtccaatagaaatga

SEQ ID NO: 7762230 - DNA, 21 bp, Homo sapiens
acctcaagcaacaaccaaggt

SEQ ID NO: 7762231 - DNA, 22 bp, Homo sapiens
aggggcatcagttgcacatttt

SEQ ID NO: 7762232 - DNA, 22 bp, Homo sapiens
aggggccacctgtggcaccctg

SEQ ID NO: 7762233 - DNA, 22 bp, Homo sapiens
aggggagcgacattccgtgccg

SEQ ID NO: 7762234 - DNA, 22 bp, Homo sapiens
aggggagccgaggggcatctgt

SEQ ID NO: 7762235 - DNA, 22 bp, Homo sapiens
aggggagcccctggtcctggtg

SEQ ID NO: 7762236 - DNA, 22 bp, Homo sapiens
aggggagccagggctgcgagtt

SEQ ID NO: 7762237 - DNA, 22 bp, Homo sapiens
aggggagcatctgtgatggtta

SEQ ID NO: 7762238 - DNA, 22 bp, Homo sapiens
aggggagcaaggccgtggtgta

SEQ ID NO: 7762239 - DNA, 22 bp, Homo sapiens
aggggagcttgcctggtcaccc

SEQ ID NO: 7762240 - DNA, 22 bp, Homo sapiens
aggggagcttgcctggtcaccc

SEQ ID NO: 7762241 - DNA, 22 bp, Homo sapiens
agggaggcaggaaagttgtctg

SEQ ID NO: 7762242 - DNA, 22 bp, Homo sapiens
accagagagcctaggctgggca

SEQ ID NO: 7762243 - DNA, 22 bp, Homo sapiens
accagagaggctgcagtgtgtg

SEQ ID NO: 7762244 - DNA, 22 bp, Homo sapiens
accagagagagacagggttgtg

SEQ ID NO: 7762245 - DNA, 20 bp, Homo sapiens
accagagatagcaatagtgc

SEQ ID NO: 7762246 - DNA, 20 bp, Homo sapiens
accagagactggggacaagt

SEQ ID NO: 7762247 - DNA, 22 bp, Homo sapiens
accagagaaaacacagcaggct

SEQ ID NO: 7762248 - DNA, 22 bp, Homo sapiens
agggatgtgggaactgcaggtt

SEQ ID NO: 7762249 - DNA, 22 bp, Homo sapiens
agggatgttagttgtgagctca

SEQ ID NO: 7762250 - DNA, 21 bp, Homo sapiens
agggcacccccgctgcctacc

SEQ ID NO: 7762251 - DNA, 22 bp, Homo sapiens
agggaggcattagctactgcga

SEQ ID NO: 7762252 - DNA, 22 bp, Homo sapiens
agggccagcccataatgccaaa

SEQ ID NO: 7762253 - DNA, 22 bp, Homo sapiens
agggccagcccataatgccaaa

SEQ ID NO: 7762254 - DNA, 22 bp, Homo sapiens
agggccagttcagaggacatgg

SEQ ID NO: 7762255 - DNA, 22 bp, Homo sapiens
agggccagtaaatgtttcctca

SEQ ID NO: 7762256 - DNA, 22 bp, Homo sapiens
cactgcacttcagcctgggtga

SEQ ID NO: 7762257 - DNA, 22 bp, Homo sapiens
cactgcactccatcctgggaaa

SEQ ID NO: 7762258 - DNA, 22 bp, Homo sapiens
cactgcactccatcctgggaaa

SEQ ID NO: 7762259 - DNA, 22 bp, Homo sapiens
cactgcactccagcccgggcaa

SEQ ID NO: 7762260 - DNA, 22 bp, Homo sapiens
cactgcacaatgtagcaaagaa

SEQ ID NO: 7762261 - DNA, 22 bp, Homo sapiens
agcattttctgagagtatagat

SEQ ID NO: 7762262 - DNA, 23 bp, Homo sapiens
cactgggggctgctacagagagg

SEQ ID NO: 7762263 - DNA, 22 bp, Homo sapiens
cactgggtcaggatagagccca

SEQ ID NO: 7762264 - DNA, 22 bp, Homo sapiens
cagaaacttctggtgtcaaata

SEQ ID NO: 7762265 - DNA, 22 bp, Homo sapiens
cagaaacttctggtgtcaaata

SEQ ID NO: 7762266 - DNA, 22 bp, Homo sapiens
cagaaactgtttgttaatattt

SEQ ID NO: 7762267 - DNA, 22 bp, Homo sapiens
cagaaactgtggattcattaaa

SEQ ID NO: 7762268 - DNA, 22 bp, Homo sapiens
cagaaacctgtctggagtggga

SEQ ID NO: 7762269 - DNA, 22 bp, Homo sapiens
cagaaacctccctgaatatttt

SEQ ID NO: 7762270 - DNA, 22 bp, Homo sapiens
cagaaaccaaatgggatgggga

SEQ ID NO: 7762271 - DNA, 22 bp, Homo sapiens
cagaaactagatttagacacaa

SEQ ID NO: 7762272 - DNA, 22 bp, Homo sapiens
cagaaactagatttagacacaa

SEQ ID NO: 7762273 - DNA, 22 bp, Homo sapiens
cagaaactgcttgtggtcatct

SEQ ID NO: 7762274 - DNA, 22 bp, Homo sapiens
cagaaactatgtaagaaagtga

SEQ ID NO: 7762275 - DNA, 22 bp, Homo sapiens
agccaaatacaaactggggtgg

SEQ ID NO: 7762276 - DNA, 22 bp, Homo sapiens
agccaacagccagcatcaacca

SEQ ID NO: 7762277 - DNA, 22 bp, Homo sapiens
agccaactaattaaacaacttt

SEQ ID NO: 7762278 - DNA, 22 bp, Homo sapiens
cacattggcaaacggggttgca

SEQ ID NO: 7762279 - DNA, 22 bp, Homo sapiens
cacctgagtgtcagtattctca

SEQ ID NO: 7762280 - DNA, 22 bp, Homo sapiens
cacctgcagggggagtcaagag

SEQ ID NO: 7762281 - DNA, 22 bp, Homo sapiens
agcaggtgggatcaagctggca

SEQ ID NO: 7762282 - DNA, 22 bp, Homo sapiens
cacaggctcttctcacttgatt

SEQ ID NO: 7762283 - DNA, 22 bp, Homo sapiens
cacaggctgcccgcagctggga

SEQ ID NO: 7762284 - DNA, 22 bp, Homo sapiens
cacaggctgcccgcagctggga

SEQ ID NO: 7762285 - DNA, 22 bp, Homo sapiens
cacaggctgcccgcagctggga

SEQ ID NO: 7762286 - DNA, 22 bp, Homo sapiens
cacatgggtgtgcctggaggaa

SEQ ID NO: 7762287 - DNA, 22 bp, Homo sapiens
agcaggctaatcttgctgaaca

SEQ ID NO: 7762288 - DNA, 22 bp, Homo sapiens
agcaggctactcctgtgttcgt

SEQ ID NO: 7762289 - DNA, 22 bp, Homo sapiens
agcaggctaatcttgctgaaca

SEQ ID NO: 7762290 - DNA, 22 bp, Homo sapiens
agcaggctaaataataatacat

SEQ ID NO: 7762291 - DNA, 22 bp, Homo sapiens
agcaggctaagggacctgttta

SEQ ID NO: 7762292 - DNA, 20 bp, Homo sapiens
agcaggccttggggagagga

SEQ ID NO: 7762293 - DNA, 18 bp, Homo sapiens
agcaggcgttgcctggga

SEQ ID NO: 7762294 - DNA, 19 bp, Homo sapiens
agcaggccaggcaggtggc

SEQ ID NO: 7762295 - DNA, 20 bp, Homo sapiens
cacaggctatatgagagcca

SEQ ID NO: 7762296 - DNA, 22 bp, Homo sapiens
agcaggctaggaacctcactgc

SEQ ID NO: 7762297 - DNA, 22 bp, Homo sapiens
agcaggctaggaacctcactgc

SEQ ID NO: 7762298 - DNA, 19 bp, Homo sapiens
agcaggctaggctgcctct

SEQ ID NO: 7762299 - DNA, 19 bp, Homo sapiens
agcaggctaggctgcctct

SEQ ID NO: 7762300 - DNA, 18 bp, Homo sapiens
cacaggctcccagtgagg

SEQ ID NO: 7762301 - DNA, 22 bp, Homo sapiens
cacaggctccggccttgcagcc

SEQ ID NO: 7762302 - DNA, 22 bp, Homo sapiens
cacaggctccggccttgcagcc

SEQ ID NO: 7762303 - DNA, 22 bp, Homo sapiens
cacacatcaacctagacattgt

SEQ ID NO: 7762304 - DNA, 22 bp, Homo sapiens
caatttttgtacttatagtact

SEQ ID NO: 7762305 - DNA, 22 bp, Homo sapiens
caattttattggtccaaataca

SEQ ID NO: 7762306 - DNA, 18 bp, Homo sapiens
caattttacccagtccct

SEQ ID NO: 7762307 - DNA, 22 bp, Homo sapiens
caattttactcttcctcttcca

SEQ ID NO: 7762308 - DNA, 18 bp, Homo sapiens
caattttacccagtccct

SEQ ID NO: 7762309 - DNA, 22 bp, Homo sapiens
cacagaaaaaggcttgaaaatc

SEQ ID NO: 7762310 - DNA, 22 bp, Homo sapiens
cacacatgtctctccatgctct

SEQ ID NO: 7762311 - DNA, 22 bp, Homo sapiens
cacacttgtgaccgatataatg

SEQ ID NO: 7762312 - DNA, 22 bp, Homo sapiens
cacacatggtagcaggtacaag

SEQ ID NO: 7762313 - DNA, 22 bp, Homo sapiens
cacacatgtctctccatgctct

SEQ ID NO: 7762314 - DNA, 22 bp, Homo sapiens
cacaggaaatgattctgcagca

SEQ ID NO: 7762315 - DNA, 22 bp, Homo sapiens
agcaggcaggcccagcggctgg

SEQ ID NO: 7762316 - DNA, 22 bp, Homo sapiens
cacaggaagcaagcctggggcc

SEQ ID NO: 7762317 - DNA, 22 bp, Homo sapiens
agcaggcaggcccagcggctgg

SEQ ID NO: 7762318 - DNA, 20 bp, Homo sapiens
cacaggaaagctactcagtt

SEQ ID NO: 7762319 - DNA, 20 bp, Homo sapiens
cacagaacaaattgcaggac

SEQ ID NO: 7762320 - DNA, 22 bp, Homo sapiens
cacagaacaccaaagaaccttc

SEQ ID NO: 7762321 - DNA, 22 bp, Homo sapiens
cacagctgccctactccatgtg

SEQ ID NO: 7762322 - DNA, 22 bp, Homo sapiens
cacagctgccatggctgcactt

SEQ ID NO: 7762323 - DNA, 22 bp, Homo sapiens
caagtccatcagataagcaaga

SEQ ID NO: 7762324 - DNA, 22 bp, Homo sapiens
caagtccaggtgggcaaataaa

SEQ ID NO: 7762325 - DNA, 22 bp, Homo sapiens
caagtccaagatcaagaagcca

SEQ ID NO: 7762326 - DNA, 22 bp, Homo sapiens
caagtccaggtcaatttaaagc

SEQ ID NO: 7762327 - DNA, 22 bp, Homo sapiens
caagtcattgtttagtcatgtt

SEQ ID NO: 7762328 - DNA, 22 bp, Homo sapiens
caagtcatcatagaagttcccc

SEQ ID NO: 7762329 - DNA, 23 bp, Homo sapiens
caagtcatggattggagtttcag

SEQ ID NO: 7762330 - DNA, 22 bp, Homo sapiens
caagtcattactgaaatgtcac

SEQ ID NO: 7762331 - DNA, 22 bp, Homo sapiens
caagtccttttcttggctcagg

SEQ ID NO: 7762332 - DNA, 22 bp, Homo sapiens
caatgatagattttacaaatta

SEQ ID NO: 7762333 - DNA, 21 bp, Homo sapiens
caattacagatggctcagggg

SEQ ID NO: 7762334 - DNA, 22 bp, Homo sapiens
caattatatttagaatgataca

SEQ ID NO: 7762335 - DNA, 22 bp, Homo sapiens
caattatatttagaatgataca

SEQ ID NO: 7762336 - DNA, 22 bp, Homo sapiens
caattatatttagaatgataca

SEQ ID NO: 7762337 - DNA, 22 bp, Homo sapiens
caattacttttgcaccaatata

SEQ ID NO: 7762338 - DNA, 22 bp, Homo sapiens
caaggaaggagagatgatgggt

SEQ ID NO: 7762339 - DNA, 22 bp, Homo sapiens
agcagagaagacacaggcttca

SEQ ID NO: 7762340 - DNA, 22 bp, Homo sapiens
caaggaaaagaagtatttcaga

SEQ ID NO: 7762341 - DNA, 22 bp, Homo sapiens
caaggaaaacagatgatcaaca

SEQ ID NO: 7762342 - DNA, 22 bp, Homo sapiens
caaggaaacatgaaatgcattg

SEQ ID NO: 7762343 - DNA, 22 bp, Homo sapiens
caaggaaaaagcgagctcgggg

SEQ ID NO: 7762344 - DNA, 22 bp, Homo sapiens
caagctttatccgccatgtagg

SEQ ID NO: 7762345 - DNA, 22 bp, Homo sapiens
caagctttccattacacacatt

SEQ ID NO: 7762346 - DNA, 22 bp, Homo sapiens
caagctggaggttggagctact

SEQ ID NO: 7762347 - DNA, 22 bp, Homo sapiens
caagcagatattttagtcaaga

SEQ ID NO: 7762348 - DNA, 22 bp, Homo sapiens
caagcagagaggttagaacaca

SEQ ID NO: 7762349 - DNA, 22 bp, Homo sapiens
caagctggctgggagaggcacg

SEQ ID NO: 7762350 - DNA, 22 bp, Homo sapiens
cagcccagtgcacgcccgtttc

SEQ ID NO: 7762351 - DNA, 22 bp, Homo sapiens
cagcccagtaccaagcagttgg

SEQ ID NO: 7762352 - DNA, 22 bp, Homo sapiens
cagcccagtaccaagcagttgg

SEQ ID NO: 7762353 - DNA, 22 bp, Homo sapiens
cagcctcctgggacactcaccg

SEQ ID NO: 7762354 - DNA, 22 bp, Homo sapiens
cagcctctaagcacagcctctc

SEQ ID NO: 7762355 - DNA, 22 bp, Homo sapiens
cagcctctctgtatctcaggat

SEQ ID NO: 7762356 - DNA, 22 bp, Homo sapiens
cagcccacgtcagggccactca

SEQ ID NO: 7762357 - DNA, 22 bp, Homo sapiens
cagcccagacaccatcattcta

SEQ ID NO: 7762358 - DNA, 22 bp, Homo sapiens
cagcccacttcccagcacctac

SEQ ID NO: 7762359 - DNA, 22 bp, Homo sapiens
cagcactgtgataactgagcca

SEQ ID NO: 7762360 - DNA, 22 bp, Homo sapiens
cagcactggggccactggagtt

SEQ ID NO: 7762361 - DNA, 22 bp, Homo sapiens
cagcactgttcccagaccactg

SEQ ID NO: 7762362 - DNA, 22 bp, Homo sapiens
cagcatggagacaaagtgggca

SEQ ID NO: 7762363 - DNA, 22 bp, Homo sapiens
cagcatggacccatcgctgagt

SEQ ID NO: 7762364 - DNA, 22 bp, Homo sapiens
cagcatggacaggggtggcgtt

SEQ ID NO: 7762365 - DNA, 22 bp, Homo sapiens
cagcatggggcttggagtcagc

SEQ ID NO: 7762366 - DNA, 22 bp, Homo sapiens
cagcatgggttccgggggcctg

SEQ ID NO: 7762367 - DNA, 22 bp, Homo sapiens
cagcatggttgggttctgggga

SEQ ID NO: 7762368 - DNA, 22 bp, Homo sapiens
agcgccgcccctgctggtgttg

SEQ ID NO: 7762369 - DNA, 22 bp, Homo sapiens
agcgccactgcactccagcctg

SEQ ID NO: 7762370 - DNA, 22 bp, Homo sapiens
agcgcaggaacacgtctgcctt

SEQ ID NO: 7762371 - DNA, 22 bp, Homo sapiens
agcgccactgcactccagcctg

SEQ ID NO: 7762372 - DNA, 22 bp, Homo sapiens
cagcctctgagccttggcagat

SEQ ID NO: 7762373 - DNA, 22 bp, Homo sapiens
cagcctctgtggctgccacacc

SEQ ID NO: 7762374 - DNA, 18 bp, Homo sapiens
cagcctctgattggttgc

SEQ ID NO: 7762375 - DNA, 22 bp, Homo sapiens
cagcctctgacaccacagtcgt

SEQ ID NO: 7762376 - DNA, 22 bp, Homo sapiens
cagcctctgacaccacagtcgt

SEQ ID NO: 7762377 - DNA, 22 bp, Homo sapiens
cagcctcttgcactttgaaggc

SEQ ID NO: 7762378 - DNA, 22 bp, Homo sapiens
cagcctttctgtttcctaaggt

SEQ ID NO: 7762379 - DNA, 22 bp, Homo sapiens
cagcctttatggaaaggcctgg

SEQ ID NO: 7762380 - DNA, 22 bp, Homo sapiens
cagcgtctcgttgtgggcctcg

SEQ ID NO: 7762381 - DNA, 22 bp, Homo sapiens
cagctgagcatcactagtctgg

SEQ ID NO: 7762382 - DNA, 22 bp, Homo sapiens
cagctgcccaggccacctggag

SEQ ID NO: 7762383 - DNA, 22 bp, Homo sapiens
cagctgctttcagcaggaggga

SEQ ID NO: 7762384 - DNA, 22 bp, Homo sapiens
cagctgggtgatcttgggcagg

SEQ ID NO: 7762385 - DNA, 22 bp, Homo sapiens
cagctggcagccctggccctgc

SEQ ID NO: 7762386 - DNA, 22 bp, Homo sapiens
cagctggcagccctggccctgc

SEQ ID NO: 7762387 - DNA, 22 bp, Homo sapiens
cagctggcaagtggagcagggt

SEQ ID NO: 7762388 - DNA, 22 bp, Homo sapiens
cagctggcaagtggagcagggt

SEQ ID NO: 7762389 - DNA, 22 bp, Homo sapiens
cagctggcaagtggagcagggt

SEQ ID NO: 7762390 - DNA, 22 bp, Homo sapiens
cagctggcagaacctgcatcca

SEQ ID NO: 7762391 - DNA, 22 bp, Homo sapiens
cagctggcaagtggagcagggt

SEQ ID NO: 7762392 - DNA, 22 bp, Homo sapiens
agctgagctcaggctgatgtaa

SEQ ID NO: 7762393 - DNA, 21 bp, Homo sapiens
agctgagcccagaagactggt

SEQ ID NO: 7762394 - DNA, 22 bp, Homo sapiens
agctgagctgcagatgactgta

SEQ ID NO: 7762395 - DNA, 22 bp, Homo sapiens
agctgagccagcagcaacagga

SEQ ID NO: 7762396 - DNA, 22 bp, Homo sapiens
agctgagccagcagcaacagga

SEQ ID NO: 7762397 - DNA, 22 bp, Homo sapiens
agctgagcatttgatccacctc

SEQ ID NO: 7762398 - DNA, 22 bp, Homo sapiens
agctgagcatttgatccacctc

SEQ ID NO: 7762399 - DNA, 22 bp, Homo sapiens
agccctgaagctggccatgtcc

SEQ ID NO: 7762400 - DNA, 22 bp, Homo sapiens
cagagtggagatgtgtgtggaa

SEQ ID NO: 7762401 - DNA, 22 bp, Homo sapiens
cagagtggcgaccccctcagct

SEQ ID NO: 7762402 - DNA, 22 bp, Homo sapiens
agccctcctggggccacgctgg

SEQ ID NO: 7762403 - DNA, 22 bp, Homo sapiens
agccctcctttgttcatgctgc

SEQ ID NO: 7762404 - DNA, 22 bp, Homo sapiens
agcctgagtgcttaggactgtt

SEQ ID NO: 7762405 - DNA, 22 bp, Homo sapiens
agcctgcttgagagtcctggct

SEQ ID NO: 7762406 - DNA, 22 bp, Homo sapiens
agcctattcatctgatcttgaa

SEQ ID NO: 7762407 - DNA, 22 bp, Homo sapiens
agcctattccaggatgagctca

SEQ ID NO: 7762408 - DNA, 22 bp, Homo sapiens
cagatatgtggattctattagc

SEQ ID NO: 7762409 - DNA, 22 bp, Homo sapiens
agcctattccaggatgagctca

SEQ ID NO: 7762410 - DNA, 22 bp, Homo sapiens
agcctagggggtcctgggccac

SEQ ID NO: 7762411 - DNA, 22 bp, Homo sapiens
agccctttccaatttgatttat

SEQ ID NO: 7762412 - DNA, 22 bp, Homo sapiens
agccaggctcaaggcctgctcc

SEQ ID NO: 7762413 - DNA, 22 bp, Homo sapiens
agccaagaggagcctaaagcga

SEQ ID NO: 7762414 - DNA, 22 bp, Homo sapiens
agccaacttggaaagtcagatt

SEQ ID NO: 7762415 - DNA, 22 bp, Homo sapiens
agccaacttagaagaaatttga

SEQ ID NO: 7762416 - DNA, 22 bp, Homo sapiens
agccaagaatcatgagctaata

SEQ ID NO: 7762417 - DNA, 22 bp, Homo sapiens
agccaagagatgaggctgcagg

SEQ ID NO: 7762418 - DNA, 22 bp, Homo sapiens
agccaagacatttagaaaagct

SEQ ID NO: 7762419 - DNA, 22 bp, Homo sapiens
agccagggacgctgcaggctac

SEQ ID NO: 7762420 - DNA, 22 bp, Homo sapiens
agccagggacgctgcaggctac

SEQ ID NO: 7762421 - DNA, 22 bp, Homo sapiens
agccagggaagaggcctacctc

SEQ ID NO: 7762422 - DNA, 16 bp, Homo sapiens
agccaggctgcctcgg

SEQ ID NO: 7762423 - DNA, 22 bp, Homo sapiens
agccaggctgcagttggctggc

SEQ ID NO: 7762424 - DNA, 22 bp, Homo sapiens
agccagggctgcgagcagacag

SEQ ID NO: 7762425 - DNA, 22 bp, Homo sapiens
agccaggggagtcagctgctgg

SEQ ID NO: 7762426 - DNA, 23 bp, Homo sapiens
agccagggcactggtggagattg

SEQ ID NO: 7762427 - DNA, 22 bp, Homo sapiens
agccagggctctccttcgcgtg

SEQ ID NO: 7762428 - DNA, 22 bp, Homo sapiens
agccagggatggcagtgcccag

SEQ ID NO: 7762429 - DNA, 22 bp, Homo sapiens
agccagggatgcagcacagtga

SEQ ID NO: 7762430 - DNA, 22 bp, Homo sapiens
agccagggacgctgcaggctac

SEQ ID NO: 7762431 - DNA, 22 bp, Homo sapiens
cagagccaggcctgccctcttt

SEQ ID NO: 7762432 - DNA, 22 bp, Homo sapiens
cagagccaggtctaggagtctc

SEQ ID NO: 7762433 - DNA, 22 bp, Homo sapiens
cagagcagtaaatctggggcac

SEQ ID NO: 7762434 - DNA, 18 bp, Homo sapiens
cagagcagtatgaatgtt

SEQ ID NO: 7762435 - DNA, 22 bp, Homo sapiens
cagagctgttgcggggcttggc

SEQ ID NO: 7762436 - DNA, 22 bp, Homo sapiens
cagagccataaaggtgaaagag

SEQ ID NO: 7762437 - DNA, 22 bp, Homo sapiens
attttgttgaggtaattgtcaa

SEQ ID NO: 7762438 - DNA, 22 bp, Homo sapiens
attttgttatagaactctgtga

SEQ ID NO: 7762439 - DNA, 22 bp, Homo sapiens
attttgtgggttctgctgatgt

SEQ ID NO: 7762440 - DNA, 21 bp, Homo sapiens
attttgtacatagaatttgtc

SEQ ID NO: 7762441 - DNA, 22 bp, Homo sapiens
attttgtggcagatgcagaacc

SEQ ID NO: 7762442 - DNA, 22 bp, Homo sapiens
attttttagccaagactctgca

SEQ ID NO: 7762443 - DNA, 22 bp, Homo sapiens
attttttatataccaaggtggg

SEQ ID NO: 7762444 - DNA, 22 bp, Homo sapiens
agcaataacagaaaactttcct

SEQ ID NO: 7762445 - DNA, 22 bp, Homo sapiens
agcaaggctaaatttcagttat

SEQ ID NO: 7762446 - DNA, 22 bp, Homo sapiens
caaagtggctggccgggagatc

SEQ ID NO: 7762447 - DNA, 22 bp, Homo sapiens
caaagtggaggctctggggcca

SEQ ID NO: 7762448 - DNA, 22 bp, Homo sapiens
caaagtggagagcctgtggttg

SEQ ID NO: 7762449 - DNA, 22 bp, Homo sapiens
caaagtgggtgccctgatgctc

SEQ ID NO: 7762450 - DNA, 22 bp, Homo sapiens
caaagttttagtaaacatatat

SEQ ID NO: 7762451 - DNA, 22 bp, Homo sapiens
agcaatgactttgaaatcatga

SEQ ID NO: 7762452 - DNA, 22 bp, Homo sapiens
agcaatgaccagtgatcttgta

SEQ ID NO: 7762453 - DNA, 22 bp, Homo sapiens
caaacattgggggcttcaacac

SEQ ID NO: 7762454 - DNA, 22 bp, Homo sapiens
caaacatttgacttctctcagg

SEQ ID NO: 7762455 - DNA, 22 bp, Homo sapiens
caaacattgcactttctgctat

SEQ ID NO: 7762456 - DNA, 22 bp, Homo sapiens
agcaataatttaggcctttcct

SEQ ID NO: 7762457 - DNA, 22 bp, Homo sapiens
caaacatttgttggaacccctg

SEQ ID NO: 7762458 - DNA, 22 bp, Homo sapiens
caaacattttctacttccagga

SEQ ID NO: 7762459 - DNA, 22 bp, Homo sapiens
caaagtgctgggattacaggct

SEQ ID NO: 7762460 - DNA, 22 bp, Homo sapiens
caaagtgctgggattacaggtg

SEQ ID NO: 7762461 - DNA, 22 bp, Homo sapiens
agatgacatgggagcaagcact

SEQ ID NO: 7762462 - DNA, 22 bp, Homo sapiens
atttctttctggccacggtttt

SEQ ID NO: 7762463 - DNA, 22 bp, Homo sapiens
atttcttgcccctgctccctga

SEQ ID NO: 7762464 - DNA, 22 bp, Homo sapiens
atttcttttcaagagggtgctt

SEQ ID NO: 7762465 - DNA, 22 bp, Homo sapiens
atttcttttcaagagggtgctt

SEQ ID NO: 7762466 - DNA, 22 bp, Homo sapiens
atttcttttcaagagggtgctt

SEQ ID NO: 7762467 - DNA, 22 bp, Homo sapiens
atttctttctggccacggtttt

SEQ ID NO: 7762468 - DNA, 22 bp, Homo sapiens
atttacaggacagcttggcatt

SEQ ID NO: 7762469 - DNA, 22 bp, Homo sapiens
atttacagccttgaaaacagca

SEQ ID NO: 7762470 - DNA, 22 bp, Homo sapiens
agatttatgtggtcacactcag

SEQ ID NO: 7762471 - DNA, 22 bp, Homo sapiens
agatttatgtggtcacactcag

SEQ ID NO: 7762472 - DNA, 22 bp, Homo sapiens
agatttcaatggatattgcaag

SEQ ID NO: 7762473 - DNA, 21 bp, Homo sapiens
attttgtacatagaatttgtc

SEQ ID NO: 7762474 - DNA, 21 bp, Homo sapiens
attttgtacatagaatttgtc

SEQ ID NO: 7762475 - DNA, 22 bp, Homo sapiens
attttggcaacagccatgagcc

SEQ ID NO: 7762476 - DNA, 22 bp, Homo sapiens
attttgctttatgtaaatatgt

SEQ ID NO: 7762477 - DNA, 22 bp, Homo sapiens
agattctactctagatccatgg

SEQ ID NO: 7762478 - DNA, 22 bp, Homo sapiens
agattccaggcctggggccaag

SEQ ID NO: 7762479 - DNA, 22 bp, Homo sapiens
agaggccggccgagcccatggg

SEQ ID NO: 7762480 - DNA, 22 bp, Homo sapiens
agaggccggccgagcccatggg

SEQ ID NO: 7762481 - DNA, 22 bp, Homo sapiens
agaggccctgggctggtgtgct

SEQ ID NO: 7762482 - DNA, 22 bp, Homo sapiens
agaggccctggctagagcagct

SEQ ID NO: 7762483 - DNA, 22 bp, Homo sapiens
agaggcctaaccaagatgtcct

SEQ ID NO: 7762484 - DNA, 22 bp, Homo sapiens
attatttctcactcacataata

SEQ ID NO: 7762485 - DNA, 22 bp, Homo sapiens
attatttgacttgagaacaggt

SEQ ID NO: 7762486 - DNA, 22 bp, Homo sapiens
attattttatgtgcggcctgat

SEQ ID NO: 7762487 - DNA, 22 bp, Homo sapiens
agagcttcactggagagcacat

SEQ ID NO: 7762488 - DNA, 22 bp, Homo sapiens
attaataaaataccactttgtt

SEQ ID NO: 7762489 - DNA, 22 bp, Homo sapiens
attaataaaataccactttgtt

SEQ ID NO: 7762490 - DNA, 22 bp, Homo sapiens
attaataaaataccactttgtt

SEQ ID NO: 7762491 - DNA, 22 bp, Homo sapiens
agagcttgtaattgagtcaggt

SEQ ID NO: 7762492 - DNA, 23 bp, Homo sapiens
agagctttctaaaatgtaaatct

SEQ ID NO: 7762493 - DNA, 22 bp, Homo sapiens
agaggccctctctgctcagtct

SEQ ID NO: 7762494 - DNA, 22 bp, Homo sapiens
agaggccagggacactgctcaa

SEQ ID NO: 7762495 - DNA, 22 bp, Homo sapiens
agaggaagattttattaaccag

SEQ ID NO: 7762496 - DNA, 21 bp, Homo sapiens
agaggaagaagagtgtattat

SEQ ID NO: 7762497 - DNA, 22 bp, Homo sapiens
agaggaaacataggtttttaaa

SEQ ID NO: 7762498 - DNA, 22 bp, Homo sapiens
attctacaatcatgtagatcct

SEQ ID NO: 7762499 - DNA, 20 bp, Homo sapiens
attctacaagaataagcatg

SEQ ID NO: 7762500 - DNA, 22 bp, Homo sapiens
attcttctgcctactttcatcc

SEQ ID NO: 7762501 - DNA, 22 bp, Homo sapiens
attcttctgcctactttcatcc

SEQ ID NO: 7762502 - DNA, 20 bp, Homo sapiens
attctaaagctctgctcttt

SEQ ID NO: 7762503 - DNA, 22 bp, Homo sapiens
attctaaatcagagagctctgt

SEQ ID NO: 7762504 - DNA, 22 bp, Homo sapiens
attctaagtcttgttcacattc

SEQ ID NO: 7762505 - DNA, 22 bp, Homo sapiens
attctacaaaagaactggatct

SEQ ID NO: 7762506 - DNA, 22 bp, Homo sapiens
attctacaacccaataataatt

SEQ ID NO: 7762507 - DNA, 22 bp, Homo sapiens
attcaaaagaccatgcagactc

SEQ ID NO: 7762508 - DNA, 22 bp, Homo sapiens
attcaaaagaccatgcagactc

SEQ ID NO: 7762509 - DNA, 22 bp, Homo sapiens
attcccagatttatattgatag

SEQ ID NO: 7762510 - DNA, 22 bp, Homo sapiens
agatacaactgtttaaacatta

SEQ ID NO: 7762511 - DNA, 22 bp, Homo sapiens
agatacaactgtttaaacatta

SEQ ID NO: 7762512 - DNA, 22 bp, Homo sapiens
agataaattcctaagatttcag

SEQ ID NO: 7762513 - DNA, 22 bp, Homo sapiens
agatacaactgtttaaacatta

SEQ ID NO: 7762514 - DNA, 22 bp, Homo sapiens
agatacaaaggcctacagagca

SEQ ID NO: 7762515 - DNA, 22 bp, Homo sapiens
attgtggtgtcagttataggca

SEQ ID NO: 7762516 - DNA, 22 bp, Homo sapiens
attgttaaactgaagcattact

SEQ ID NO: 7762517 - DNA, 22 bp, Homo sapiens
attgtatttccagcttgaatgt

SEQ ID NO: 7762518 - DNA, 22 bp, Homo sapiens
attgtatttgtacaagacatgt

SEQ ID NO: 7762519 - DNA, 22 bp, Homo sapiens
attgtattagcacaatacaatt

SEQ ID NO: 7762520 - DNA, 22 bp, Homo sapiens
attgtattagcacaatacaatt

SEQ ID NO: 7762521 - DNA, 22 bp, Homo sapiens
attgtattagcacaatacaatt

SEQ ID NO: 7762522 - DNA, 22 bp, Homo sapiens
attgagaaaattcgagcaagtt

SEQ ID NO: 7762523 - DNA, 22 bp, Homo sapiens
attgagaaaggcttatgtttgc

SEQ ID NO: 7762524 - DNA, 22 bp, Homo sapiens
attgagaaaataagtatggata

SEQ ID NO: 7762525 - DNA, 22 bp, Homo sapiens
attgagaagaaaatctaatata

SEQ ID NO: 7762526 - DNA, 22 bp, Homo sapiens
attgagaaatataatctggaaa

SEQ ID NO: 7762527 - DNA, 22 bp, Homo sapiens
attgagaagcttgcagattttt

SEQ ID NO: 7762528 - DNA, 22 bp, Homo sapiens
attgagaaggagattggcatct

SEQ ID NO: 7762529 - DNA, 22 bp, Homo sapiens
attgaaaaatgactattgctta

SEQ ID NO: 7762530 - DNA, 22 bp, Homo sapiens
attgaaaataaggccagaaaca

SEQ ID NO: 7762531 - DNA, 22 bp, Homo sapiens
attgaaaataaggccagaaaca

SEQ ID NO: 7762532 - DNA, 22 bp, Homo sapiens
attgagaattgtgagtttggag

SEQ ID NO: 7762533 - DNA, 22 bp, Homo sapiens
attgagaatgcaatctactatg

SEQ ID NO: 7762534 - DNA, 22 bp, Homo sapiens
attgagaatctgagagcctagg

SEQ ID NO: 7762535 - DNA, 22 bp, Homo sapiens
attgagaatgaagggacatttt

SEQ ID NO: 7762536 - DNA, 22 bp, Homo sapiens
attgagaatccatttgagatga

SEQ ID NO: 7762537 - DNA, 22 bp, Homo sapiens
attgagaatattgtgacagtgt

SEQ ID NO: 7762538 - DNA, 22 bp, Homo sapiens
attgagaatatgatttagtata

SEQ ID NO: 7762539 - DNA, 23 bp, Homo sapiens
attgagaaggatacattgttctc

SEQ ID NO: 7762540 - DNA, 22 bp, Homo sapiens
attgtattagcacaatacaatt

SEQ ID NO: 7762541 - DNA, 22 bp, Homo sapiens
attgtataagtctatttacaat

SEQ ID NO: 7762542 - DNA, 22 bp, Homo sapiens
attgtataagtctatttacaat

SEQ ID NO: 7762543 - DNA, 22 bp, Homo sapiens
attgtataagtctatttacaat

SEQ ID NO: 7762544 - DNA, 22 bp, Homo sapiens
atctggcttacgaagcactggt

SEQ ID NO: 7762545 - DNA, 22 bp, Homo sapiens
atctgggagacccttgcgggaa

SEQ ID NO: 7762546 - DNA, 21 bp, Homo sapiens
atcttaaaaggtcttaacttt

SEQ ID NO: 7762547 - DNA, 22 bp, Homo sapiens
atcttaaacagaggaatgactt

SEQ ID NO: 7762548 - DNA, 22 bp, Homo sapiens
atgactctccagagctgcagat

SEQ ID NO: 7762549 - DNA, 19 bp, Homo sapiens
atgactcttattgtctgaa

SEQ ID NO: 7762550 - DNA, 22 bp, Homo sapiens
atgactgctctgggctcccatg

SEQ ID NO: 7762551 - DNA, 22 bp, Homo sapiens
atgactctaagaattctagatg

SEQ ID NO: 7762552 - DNA, 22 bp, Homo sapiens
atgactcagaagatattttcca

SEQ ID NO: 7762553 - DNA, 22 bp, Homo sapiens
atgactcaaaattattgttttg

SEQ ID NO: 7762554 - DNA, 22 bp, Homo sapiens
atcttacacgataactgttagt

SEQ ID NO: 7762555 - DNA, 22 bp, Homo sapiens
atcttacaattacaagacactc

SEQ ID NO: 7762556 - DNA, 19 bp, Homo sapiens
atcttacagagcagagtac

SEQ ID NO: 7762557 - DNA, 22 bp, Homo sapiens
atcttacagcagcaaggaagta

SEQ ID NO: 7762558 - DNA, 22 bp, Homo sapiens
atgacaatacttcaataagctg

SEQ ID NO: 7762559 - DNA, 22 bp, Homo sapiens
atcttacattccctcaccattt

SEQ ID NO: 7762560 - DNA, 20 bp, Homo sapiens
atgattcatgatgatgtctc

SEQ ID NO: 7762561 - DNA, 20 bp, Homo sapiens
atgattcatgatgatgtctc

SEQ ID NO: 7762562 - DNA, 22 bp, Homo sapiens
atgattgaaaatgacattgcca

SEQ ID NO: 7762563 - DNA, 22 bp, Homo sapiens
atgatttaaagtcattgtgaac

SEQ ID NO: 7762564 - DNA, 22 bp, Homo sapiens
atgatttccagttgttgctaag

SEQ ID NO: 7762565 - DNA, 22 bp, Homo sapiens
atgcaaattcttaggctccatc

SEQ ID NO: 7762566 - DNA, 22 bp, Homo sapiens
atgcaaatgtttaagttactat

SEQ ID NO: 7762567 - DNA, 22 bp, Homo sapiens
atgcaaattaacatatagtaga

SEQ ID NO: 7762568 - DNA, 22 bp, Homo sapiens
atgcaaatgtcaccacttctaa

SEQ ID NO: 7762569 - DNA, 22 bp, Homo sapiens
atgcaaatggcaatgagtgacc

SEQ ID NO: 7762570 - DNA, 22 bp, Homo sapiens
atgaggaggccagtaagagcct

SEQ ID NO: 7762571 - DNA, 22 bp, Homo sapiens
atgactttcctggcaaaagttg

SEQ ID NO: 7762572 - DNA, 22 bp, Homo sapiens
atgactttgttgttttccagcg

SEQ ID NO: 7762573 - DNA, 22 bp, Homo sapiens
atgctgagataaggctttagtc

SEQ ID NO: 7762574 - DNA, 22 bp, Homo sapiens
agagaacaaattaaaggtggtt

SEQ ID NO: 7762575 - DNA, 22 bp, Homo sapiens
agagaacagcattgcagctttg

SEQ ID NO: 7762576 - DNA, 22 bp, Homo sapiens
atgcttcttgtatttggctgac

SEQ ID NO: 7762577 - DNA, 22 bp, Homo sapiens
atgcttctgttgcttaggaggt

SEQ ID NO: 7762578 - DNA, 22 bp, Homo sapiens
atgcttctgtgtatgtttcagg

SEQ ID NO: 7762579 - DNA, 22 bp, Homo sapiens
atgcttctgtgtatgtttcagg

SEQ ID NO: 7762580 - DNA, 22 bp, Homo sapiens
atgcttctgtaatgtgggaatg

SEQ ID NO: 7762581 - DNA, 22 bp, Homo sapiens
atgcttctggtataagaaaaat

SEQ ID NO: 7762582 - DNA, 22 bp, Homo sapiens
atgcttcagtgctaccttcaaa

SEQ ID NO: 7762583 - DNA, 22 bp, Homo sapiens
atgcttctgaagaagaaaagac

SEQ ID NO: 7762584 - DNA, 22 bp, Homo sapiens
atgcttctcctgaacatccctg

SEQ ID NO: 7762585 - DNA, 18 bp, Homo sapiens
atgcttctgatagaagca

SEQ ID NO: 7762586 - DNA, 22 bp, Homo sapiens
atgcttctgctcatatttcatt

SEQ ID NO: 7762587 - DNA, 22 bp, Homo sapiens
atgcttctgctcatatttcatt

SEQ ID NO: 7762588 - DNA, 22 bp, Homo sapiens
atgccaggtacaggggtagggt

SEQ ID NO: 7762589 - DNA, 22 bp, Homo sapiens
agacagtgtggttggtggttcc

SEQ ID NO: 7762590 - DNA, 22 bp, Homo sapiens
atgcaacaggtcagccaggaag

SEQ ID NO: 7762591 - DNA, 22 bp, Homo sapiens
atgcaacagggttgggaggcgg

SEQ ID NO: 7762592 - DNA, 22 bp, Homo sapiens
atgcaacagctgggaatatgta

SEQ ID NO: 7762593 - DNA, 22 bp, Homo sapiens
atgcaacagtcagtacatccgg

SEQ ID NO: 7762594 - DNA, 22 bp, Homo sapiens
atgcaacagttcatagttttat

SEQ ID NO: 7762595 - DNA, 22 bp, Homo sapiens
atgcaacagaaaattgcctggg

SEQ ID NO: 7762596 - DNA, 22 bp, Homo sapiens
atgcaacagagaaaatattgag

SEQ ID NO: 7762597 - DNA, 22 bp, Homo sapiens
atgcaacacccctatggatgga

SEQ ID NO: 7762598 - DNA, 22 bp, Homo sapiens
atgcaacaatgtatttatgtat

SEQ ID NO: 7762599 - DNA, 22 bp, Homo sapiens
atgcaacacatttgatgagcga

SEQ ID NO: 7762600 - DNA, 19 bp, Homo sapiens
atgcaacaaaagtgtaaga

SEQ ID NO: 7762601 - DNA, 22 bp, Homo sapiens
atgcaaattctttgcttcttct

SEQ ID NO: 7762602 - DNA, 22 bp, Homo sapiens
atgcaaattgccataaagtggg

SEQ ID NO: 7762603 - DNA, 19 bp, Homo sapiens
atgcaacaaaagtgtaaga

SEQ ID NO: 7762604 - DNA, 22 bp, Homo sapiens
atgcaacaaatgctacgaatcg

SEQ ID NO: 7762605 - DNA, 22 bp, Homo sapiens
atgcaacaaattgtgtgcaata

SEQ ID NO: 7762606 - DNA, 22 bp, Homo sapiens
agagatggtagaacagtcataa

SEQ ID NO: 7762607 - DNA, 17 bp, Homo sapiens
atgtatattaactctga

SEQ ID NO: 7762608 - DNA, 17 bp, Homo sapiens
atgtatattaactctga

SEQ ID NO: 7762609 - DNA, 22 bp, Homo sapiens
atgtatatgtgaaagatgttta

SEQ ID NO: 7762610 - DNA, 21 bp, Homo sapiens
atgtagggtttgccttctcta

SEQ ID NO: 7762611 - DNA, 22 bp, Homo sapiens
atgtatatgaagctagtatttt

SEQ ID NO: 7762612 - DNA, 22 bp, Homo sapiens
atgtacatactgcattttcaaa

SEQ ID NO: 7762613 - DNA, 22 bp, Homo sapiens
agagaagacttacagccacagt

SEQ ID NO: 7762614 - DNA, 22 bp, Homo sapiens
agagaacatgacgtaatagtgg

SEQ ID NO: 7762615 - DNA, 22 bp, Homo sapiens
atggacagctggcctcaaggga

SEQ ID NO: 7762616 - DNA, 22 bp, Homo sapiens
atggacaatgccaatacagttt

SEQ ID NO: 7762617 - DNA, 22 bp, Homo sapiens
atgggcagtaacagtggcagtc

SEQ ID NO: 7762618 - DNA, 22 bp, Homo sapiens
atgggcagtgtattggaaggaa

SEQ ID NO: 7762619 - DNA, 22 bp, Homo sapiens
atgggcagttaggaggccagga

SEQ ID NO: 7762620 - DNA, 21 bp, Homo sapiens
atgtgattatatgacttttac

SEQ ID NO: 7762621 - DNA, 22 bp, Homo sapiens
atgtgcaaagggacttgcacat

SEQ ID NO: 7762622 - DNA, 22 bp, Homo sapiens
agagccagccttctcagcttac

SEQ ID NO: 7762623 - DNA, 22 bp, Homo sapiens
atgttattttggaaaatacaaa

SEQ ID NO: 7762624 - DNA, 22 bp, Homo sapiens
atgttacagaaagcaaagatga

SEQ ID NO: 7762625 - DNA, 22 bp, Homo sapiens
atgttacagaaagcaaagatga

SEQ ID NO: 7762626 - DNA, 22 bp, Homo sapiens
atgttccttccagagagcagaa

SEQ ID NO: 7762627 - DNA, 22 bp, Homo sapiens
agagcctgttttgtgggagatg

SEQ ID NO: 7762628 - DNA, 22 bp, Homo sapiens
agagcctgttttgtgggagatg

SEQ ID NO: 7762629 - DNA, 22 bp, Homo sapiens
atgttcccaagggatagaaaga

SEQ ID NO: 7762630 - DNA, 18 bp, Homo sapiens
atgttcctgaggagaggt

SEQ ID NO: 7762631 - DNA, 22 bp, Homo sapiens
agagctcaagacgctcacagta

SEQ ID NO: 7762632 - DNA, 22 bp, Homo sapiens
attaaggtgtcaatgtatttgg

SEQ ID NO: 7762633 - DNA, 22 bp, Homo sapiens
attaaggaagcctattctctcc

SEQ ID NO: 7762634 - DNA, 22 bp, Homo sapiens
aaagcaggttatgaccatggcc

SEQ ID NO: 7762635 - DNA, 22 bp, Homo sapiens
aaagcaggttgcaattacagtg

SEQ ID NO: 7762636 - DNA, 22 bp, Homo sapiens
aaagcagtctgttttaacctga

SEQ ID NO: 7762637 - DNA, 22 bp, Homo sapiens
aaagcagcaagtatttgttact

SEQ ID NO: 7762638 - DNA, 22 bp, Homo sapiens
aaattgtaggatcacatgacct

SEQ ID NO: 7762639 - DNA, 22 bp, Homo sapiens
aaattgtaatgacttcacttga

SEQ ID NO: 7762640 - DNA, 22 bp, Homo sapiens
aaattccattatgataatttcg

SEQ ID NO: 7762641 - DNA, 22 bp, Homo sapiens
aaattccattatgataatttcg

SEQ ID NO: 7762642 - DNA, 22 bp, Homo sapiens
aaattccagaaactcagtatat

SEQ ID NO: 7762643 - DNA, 22 bp, Homo sapiens
aaattccagttcttttacctgc

SEQ ID NO: 7762644 - DNA, 22 bp, Homo sapiens
aaattccaccagaatcagtaat

SEQ ID NO: 7762645 - DNA, 22 bp, Homo sapiens
aaattccaccagaatcagtaat

SEQ ID NO: 7762646 - DNA, 22 bp, Homo sapiens
aaattcagttttaataatcact

SEQ ID NO: 7762647 - DNA, 22 bp, Homo sapiens
aaattcatatgttgaaatgcta

SEQ ID NO: 7762648 - DNA, 22 bp, Homo sapiens
aaattcatatgttgaaatgcta

SEQ ID NO: 7762649 - DNA, 22 bp, Homo sapiens
aaattcatatgttgaaatgcta

SEQ ID NO: 7762650 - DNA, 22 bp, Homo sapiens
aaaggcagagtgctcagctggc

SEQ ID NO: 7762651 - DNA, 22 bp, Homo sapiens
aacatgaaacccaaacagaata

SEQ ID NO: 7762652 - DNA, 22 bp, Homo sapiens
aaaggcagagtgctcagctggc

SEQ ID NO: 7762653 - DNA, 22 bp, Homo sapiens
aaaggataaggttatcaatttt

SEQ ID NO: 7762654 - DNA, 22 bp, Homo sapiens
aaaggaggccacatggctagga

SEQ ID NO: 7762655 - DNA, 20 bp, Homo sapiens
aaaggaatatatgaagtata

SEQ ID NO: 7762656 - DNA, 22 bp, Homo sapiens
aaaggattctcttgatttcagt

SEQ ID NO: 7762657 - DNA, 22 bp, Homo sapiens
aaaggcaaaattcttagcagga

SEQ ID NO: 7762658 - DNA, 22 bp, Homo sapiens
aaaggcaagcatttatatagga

SEQ ID NO: 7762659 - DNA, 22 bp, Homo sapiens
aaaggcaagcatttatatagga

SEQ ID NO: 7762660 - DNA, 22 bp, Homo sapiens
aaagcatttcatgtctagaaag

SEQ ID NO: 7762661 - DNA, 22 bp, Homo sapiens
aaagcattgtttcaagattaac

SEQ ID NO: 7762662 - DNA, 22 bp, Homo sapiens
aaagccaaatgaaagatggttc

SEQ ID NO: 7762663 - DNA, 22 bp, Homo sapiens
aaagcagtgctgtgagaacact

SEQ ID NO: 7762664 - DNA, 22 bp, Homo sapiens
aacttcctgacttctaatgagt

SEQ ID NO: 7762665 - DNA, 22 bp, Homo sapiens
aacttccttgggtatgaaaaca

SEQ ID NO: 7762666 - DNA, 22 bp, Homo sapiens
aacttccttctagttcatatgt

SEQ ID NO: 7762667 - DNA, 22 bp, Homo sapiens
aaagtcttcacggcactagtgt

SEQ ID NO: 7762668 - DNA, 22 bp, Homo sapiens
aaagtctgaaagataagagtga

SEQ ID NO: 7762669 - DNA, 22 bp, Homo sapiens
aaagttctatgtaatgtttttt

SEQ ID NO: 7762670 - DNA, 22 bp, Homo sapiens
aaagttctgagaagcagtttac

SEQ ID NO: 7762671 - DNA, 22 bp, Homo sapiens
aaagttctggagaaaataatga

SEQ ID NO: 7762672 - DNA, 22 bp, Homo sapiens
aacttcttggtcctgagctgtt

SEQ ID NO: 7762673 - DNA, 22 bp, Homo sapiens
aacttgaatgagaacttttgcc

SEQ ID NO: 7762674 - DNA, 22 bp, Homo sapiens
aaagttacacatctagtaagtg

SEQ ID NO: 7762675 - DNA, 22 bp, Homo sapiens
aacttctgacctcaagaactgt

SEQ ID NO: 7762676 - DNA, 22 bp, Homo sapiens
aacttctaatctgtacagtttt

SEQ ID NO: 7762677 - DNA, 22 bp, Homo sapiens
aacttctggatgtttcaaatgt

SEQ ID NO: 7762678 - DNA, 22 bp, Homo sapiens
aacttctgccaaacagctgtta

SEQ ID NO: 7762679 - DNA, 22 bp, Homo sapiens
aaaggcttctttgctccatgtc

SEQ ID NO: 7762680 - DNA, 22 bp, Homo sapiens
aaaggcttttggtatataggag

SEQ ID NO: 7762681 - DNA, 22 bp, Homo sapiens
aacatgcaaagctatgatgtat

SEQ ID NO: 7762682 - DNA, 22 bp, Homo sapiens
aaaggcatgcatggtctgctcc

SEQ ID NO: 7762683 - DNA, 22 bp, Homo sapiens
aacatgagtgataaaattacct

SEQ ID NO: 7762684 - DNA, 22 bp, Homo sapiens
aacatgagtgataaaattacct

SEQ ID NO: 7762685 - DNA, 22 bp, Homo sapiens
aaaggctccttctcccatgacc

SEQ ID NO: 7762686 - DNA, 22 bp, Homo sapiens
aaaggctccttctcccatgacc

SEQ ID NO: 7762687 - DNA, 22 bp, Homo sapiens
aaaggctcatgaaccaggctcg

SEQ ID NO: 7762688 - DNA, 22 bp, Homo sapiens
aaaggctctaacaaggagagag

SEQ ID NO: 7762689 - DNA, 22 bp, Homo sapiens
aaaggctctaacaaggagagag

SEQ ID NO: 7762690 - DNA, 22 bp, Homo sapiens
aaaggctcacgcagttagtgat

SEQ ID NO: 7762691 - DNA, 22 bp, Homo sapiens
aaaggctcagaatcggcagacc

SEQ ID NO: 7762692 - DNA, 22 bp, Homo sapiens
aaaggctcagatgaggccctgg

SEQ ID NO: 7762693 - DNA, 22 bp, Homo sapiens
aaatcagacttgaattttcatc

SEQ ID NO: 7762694 - DNA, 22 bp, Homo sapiens
aaatcagacacagtgaaagtta

SEQ ID NO: 7762695 - DNA, 19 bp, Homo sapiens
aaatcagaatctgcatttt

SEQ ID NO: 7762696 - DNA, 22 bp, Homo sapiens
aaatcagacacagtgaaagtta

SEQ ID NO: 7762697 - DNA, 22 bp, Homo sapiens
aaatgactaatgatcctgggca

SEQ ID NO: 7762698 - DNA, 22 bp, Homo sapiens
aaatattggtaggatgcttgtt

SEQ ID NO: 7762699 - DNA, 22 bp, Homo sapiens
aaatattgttttggtaagcttc

SEQ ID NO: 7762700 - DNA, 23 bp, Homo sapiens
aaatattcttttttagtaagtgc

SEQ ID NO: 7762701 - DNA, 23 bp, Homo sapiens
aaatattcttttttagtaagtgc

SEQ ID NO: 7762702 - DNA, 23 bp, Homo sapiens
aaatattcttttttagtaagtgc

SEQ ID NO: 7762703 - DNA, 22 bp, Homo sapiens
aaatatttgtctgaggcggttg

SEQ ID NO: 7762704 - DNA, 22 bp, Homo sapiens
aaatcaaaagacatgtgtttta

SEQ ID NO: 7762705 - DNA, 22 bp, Homo sapiens
aaatatttgtctgaggcggttg

SEQ ID NO: 7762706 - DNA, 22 bp, Homo sapiens
aaatatttgtctgaggcggttg

SEQ ID NO: 7762707 - DNA, 22 bp, Homo sapiens
aaatcaaaagacatgtgtttta

SEQ ID NO: 7762708 - DNA, 22 bp, Homo sapiens
aaatcagaaaatatggagagga

SEQ ID NO: 7762709 - DNA, 22 bp, Homo sapiens
aaatcactgattaaagttagaa

SEQ ID NO: 7762710 - DNA, 22 bp, Homo sapiens
aaatcacagggtctctaagtat

SEQ ID NO: 7762711 - DNA, 22 bp, Homo sapiens
aaatcacagggtctctaagtat

SEQ ID NO: 7762712 - DNA, 22 bp, Homo sapiens
aaatcaaggagggattatattt

SEQ ID NO: 7762713 - DNA, 22 bp, Homo sapiens
aaatgccaaggagagactgtta

SEQ ID NO: 7762714 - DNA, 22 bp, Homo sapiens
aaatgccagcacacgtctgtgg

SEQ ID NO: 7762715 - DNA, 22 bp, Homo sapiens
aaatgctgtagatcagtgagtt

SEQ ID NO: 7762716 - DNA, 22 bp, Homo sapiens
aaatgctgtaactgatattctg

SEQ ID NO: 7762717 - DNA, 22 bp, Homo sapiens
aaatgccaggattattagaggc

SEQ ID NO: 7762718 - DNA, 23 bp, Homo sapiens
aaatgccagggagacaggaacca

SEQ ID NO: 7762719 - DNA, 22 bp, Homo sapiens
aaatgctgcagctagtgtgttt

SEQ ID NO: 7762720 - DNA, 22 bp, Homo sapiens
aaatgcttcacctcattaaact

SEQ ID NO: 7762721 - DNA, 22 bp, Homo sapiens
aaatgcttagaggtgttcaaat

SEQ ID NO: 7762722 - DNA, 22 bp, Homo sapiens
aaatgcttgctcttgattattt

SEQ ID NO: 7762723 - DNA, 20 bp, Homo sapiens
aaatgcttttgacacatatt

SEQ ID NO: 7762724 - DNA, 22 bp, Homo sapiens
aagagagagcattcttctgtta

SEQ ID NO: 7762725 - DNA, 22 bp, Homo sapiens
aagagagagcattcttctgtta

SEQ ID NO: 7762726 - DNA, 22 bp, Homo sapiens
aagagagacaataggtagcatt

SEQ ID NO: 7762727 - DNA, 22 bp, Homo sapiens
aagagagaagtctctctggttc

SEQ ID NO: 7762728 - DNA, 22 bp, Homo sapiens
aaatatactagatgatgaccca

SEQ ID NO: 7762729 - DNA, 22 bp, Homo sapiens
aaatatacggtccctaacagtc

SEQ ID NO: 7762730 - DNA, 22 bp, Homo sapiens
aaatatagtaaatgcatagttc

SEQ ID NO: 7762731 - DNA, 22 bp, Homo sapiens
aaatatagcaattatgcctact

SEQ ID NO: 7762732 - DNA, 22 bp, Homo sapiens
aaatatagcaattatgcctact

SEQ ID NO: 7762733 - DNA, 22 bp, Homo sapiens
aaatatagcaattatgcctact

SEQ ID NO: 7762734 - DNA, 22 bp, Homo sapiens
aaatataccagttgcctgcatc

SEQ ID NO: 7762735 - DNA, 22 bp, Homo sapiens
aaatatacggtccctaacagtc

SEQ ID NO: 7762736 - DNA, 22 bp, Homo sapiens
aaatagtcctgggaatagtact

SEQ ID NO: 7762737 - DNA, 22 bp, Homo sapiens
aaatagtaaagtggtagccatc

SEQ ID NO: 7762738 - DNA, 22 bp, Homo sapiens
aagagtttgtcagatctgcacg

SEQ ID NO: 7762739 - DNA, 22 bp, Homo sapiens
aagagtttttggagtgtgagtt

SEQ ID NO: 7762740 - DNA, 22 bp, Homo sapiens
aagagtttttaatgggtactgg

SEQ ID NO: 7762741 - DNA, 22 bp, Homo sapiens
aagagtttccatgctctgtgct

SEQ ID NO: 7762742 - DNA, 22 bp, Homo sapiens
aaatatagtgacacttatagtc

SEQ ID NO: 7762743 - DNA, 22 bp, Homo sapiens
aaatatagtaaatgcatagttc

SEQ ID NO: 7762744 - DNA, 22 bp, Homo sapiens
aaatatagtgacacttatagtc

SEQ ID NO: 7762745 - DNA, 22 bp, Homo sapiens
aaatacattagacggagagtta

SEQ ID NO: 7762746 - DNA, 22 bp, Homo sapiens
aaatacatacactgtacgtggc

SEQ ID NO: 7762747 - DNA, 22 bp, Homo sapiens
aaatacagtgtgtgttctttga

SEQ ID NO: 7762748 - DNA, 22 bp, Homo sapiens
aaatacaaaaattagccaggca

SEQ ID NO: 7762749 - DNA, 22 bp, Homo sapiens
aaatacaaaaattagccaggca

SEQ ID NO: 7762750 - DNA, 19 bp, Homo sapiens
aaatacagcagctgtttcc

SEQ ID NO: 7762751 - DNA, 22 bp, Homo sapiens
aagaagcatggctgtagattcc

SEQ ID NO: 7762752 - DNA, 22 bp, Homo sapiens
aagaagcaggtcacagacaggg

SEQ ID NO: 7762753 - DNA, 22 bp, Homo sapiens
aagaagcagctgccaggccagt

SEQ ID NO: 7762754 - DNA, 22 bp, Homo sapiens
aagaagcagagctgtgggtgtt

SEQ ID NO: 7762755 - DNA, 22 bp, Homo sapiens
aaagttgagtgctgatctgatt

SEQ ID NO: 7762756 - DNA, 19 bp, Homo sapiens
aaagttgagaaacaatgga

SEQ ID NO: 7762757 - DNA, 22 bp, Homo sapiens
aaagttctttgcatctttgctc

SEQ ID NO: 7762758 - DNA, 21 bp, Homo sapiens
aaatgaatgtggtagtgcaag

SEQ ID NO: 7762759 - DNA, 22 bp, Homo sapiens
aaatgacactaggctttttgca

SEQ ID NO: 7762760 - DNA, 22 bp, Homo sapiens
aaatgacactcattcagtgtca

SEQ ID NO: 7762761 - DNA, 22 bp, Homo sapiens
aaataacagtcagggacaacat

SEQ ID NO: 7762762 - DNA, 22 bp, Homo sapiens
aaatacaatttcaggctgtaat

SEQ ID NO: 7762763 - DNA, 22 bp, Homo sapiens
aaataaaggtccactttagggc

SEQ ID NO: 7762764 - DNA, 22 bp, Homo sapiens
aaataaaggaactgttttccca

SEQ ID NO: 7762765 - DNA, 22 bp, Homo sapiens
aaataaaggaactgttttccca

SEQ ID NO: 7762766 - DNA, 22 bp, Homo sapiens
aaataaaggaactgttttccca

SEQ ID NO: 7762767 - DNA, 22 bp, Homo sapiens
aaataaactgaagcacagagag

SEQ ID NO: 7762768 - DNA, 22 bp, Homo sapiens
aaataaaggtccactttagggc

SEQ ID NO: 7762769 - DNA, 22 bp, Homo sapiens
aaataacagtcagggacaacat

SEQ ID NO: 7762770 - DNA, 22 bp, Homo sapiens
aaatacagagttgcttaaaagc

SEQ ID NO: 7762771 - DNA, 22 bp, Homo sapiens
aaacttcatggataatataaag

SEQ ID NO: 7762772 - DNA, 22 bp, Homo sapiens
aaacttcatggataatataaag

SEQ ID NO: 7762773 - DNA, 22 bp, Homo sapiens
aaacttcagggaataaaagagt

SEQ ID NO: 7762774 - DNA, 22 bp, Homo sapiens
aaacttcaaggatttgcaaatc

SEQ ID NO: 7762775 - DNA, 22 bp, Homo sapiens
aaacttcaaggatttgcaaatc

SEQ ID NO: 7762776 - DNA, 22 bp, Homo sapiens
aaatgtctgtatgagaaagaga

SEQ ID NO: 7762777 - DNA, 22 bp, Homo sapiens
aaatgtctgttagtcatatcat

SEQ ID NO: 7762778 - DNA, 22 bp, Homo sapiens
aaatgtctgtatgagaaagaga

SEQ ID NO: 7762779 - DNA, 22 bp, Homo sapiens
aaatgtctgtaggggctgcagg

SEQ ID NO: 7762780 - DNA, 22 bp, Homo sapiens
aaatgtctgagacttctgaact

SEQ ID NO: 7762781 - DNA, 22 bp, Homo sapiens
aaagacatatttctaagtttat

SEQ ID NO: 7762782 - DNA, 22 bp, Homo sapiens
aaatgtctttatctcatgtaac

SEQ ID NO: 7762783 - DNA, 22 bp, Homo sapiens
aaatgtctttcaatagagaaat

SEQ ID NO: 7762784 - DNA, 22 bp, Homo sapiens
aaatgtctttgagtatttctgc

SEQ ID NO: 7762785 - DNA, 22 bp, Homo sapiens
aaatgtctttgagtatttctgc

SEQ ID NO: 7762786 - DNA, 22 bp, Homo sapiens
aaagtcacttccttctgtcagc

SEQ ID NO: 7762787 - DNA, 22 bp, Homo sapiens
aaagtcatcagaaccttccaga

SEQ ID NO: 7762788 - DNA, 22 bp, Homo sapiens
aaagtcagttggccagatcact

SEQ ID NO: 7762789 - DNA, 22 bp, Homo sapiens
aaagtcatacatggtgcttact

SEQ ID NO: 7762790 - DNA, 22 bp, Homo sapiens
aaagtacatgagattcaagggg

SEQ ID NO: 7762791 - DNA, 22 bp, Homo sapiens
aaagtacatagcatattccaac

SEQ ID NO: 7762792 - DNA, 22 bp, Homo sapiens
aaagtacatagcatattccaac

SEQ ID NO: 7762793 - DNA, 22 bp, Homo sapiens
aaagtacatgcaattcttctga

SEQ ID NO: 7762794 - DNA, 22 bp, Homo sapiens
aaagtacatgcaattcttctga

SEQ ID NO: 7762795 - DNA, 22 bp, Homo sapiens
aaagtacagccacatccaagta

SEQ ID NO: 7762796 - DNA, 22 bp, Homo sapiens
aaagtacaggaaagcctagcca

SEQ ID NO: 7762797 - DNA, 22 bp, Homo sapiens
aaagtacagccacatccaagta

SEQ ID NO: 7762798 - DNA, 22 bp, Homo sapiens
aaagtacagccacatccaagta

SEQ ID NO: 7762799 - DNA, 22 bp, Homo sapiens
aaagtacacacagagccaagaa

SEQ ID NO: 7762800 - DNA, 22 bp, Homo sapiens
aaagttctaaaactctttgtga

SEQ ID NO: 7762801 - DNA, 22 bp, Homo sapiens
aaataaactgaagcacagagag

SEQ ID NO: 7762802 - DNA, 22 bp, Homo sapiens
aaataaactgaagcacagagag

SEQ ID NO: 7762803 - DNA, 22 bp, Homo sapiens
aaataaactgaagcacagagag

SEQ ID NO: 7762804 - DNA, 22 bp, Homo sapiens
aaataaactgaagcacagagag

SEQ ID NO: 7762805 - DNA, 22 bp, Homo sapiens
aaagttttctgccttcattaga

SEQ ID NO: 7762806 - DNA, 22 bp, Homo sapiens
aaagtcattgtaatatatgcta

SEQ ID NO: 7762807 - DNA, 22 bp, Homo sapiens
aaagtcattggaatattaatga

SEQ ID NO: 7762808 - DNA, 22 bp, Homo sapiens
aaagtcattgctgttatcaatg

SEQ ID NO: 7762809 - DNA, 22 bp, Homo sapiens
aaagtcatctaggagcagattt

SEQ ID NO: 7762810 - DNA, 22 bp, Homo sapiens
aaagtcatcatttcttttcaaa

SEQ ID NO: 7762811 - DNA, 22 bp, Homo sapiens
aaagtcatctaggagcagattt

SEQ ID NO: 7762812 - DNA, 22 bp, Homo sapiens
aaagtcatggaaaatcttggaa

SEQ ID NO: 7762813 - DNA, 22 bp, Homo sapiens
aaagtcatgcagttgaactttt

SEQ ID NO: 7762814 - DNA, 22 bp, Homo sapiens
aaagtcatctgtcctaggctct

SEQ ID NO: 7762815 - DNA, 22 bp, Homo sapiens
aaaggaatgagcttctgttagg

SEQ ID NO: 7762816 - DNA, 22 bp, Homo sapiens
aaaggacatgtcaatatcaggc

SEQ ID NO: 7762817 - DNA, 22 bp, Homo sapiens
aaagctcacagtaatacaaggc

SEQ ID NO: 7762818 - DNA, 22 bp, Homo sapiens
aaagctctcccactgtatgaag

SEQ ID NO: 7762819 - DNA, 22 bp, Homo sapiens
aaagctctgggaatgcttatct

SEQ ID NO: 7762820 - DNA, 22 bp, Homo sapiens
aaagccagggacagtgtgcatg

SEQ ID NO: 7762821 - DNA, 22 bp, Homo sapiens
aaaattttgccctatccttcat

SEQ ID NO: 7762822 - DNA, 22 bp, Homo sapiens
aaagctatagggtcaagcattt

SEQ ID NO: 7762823 - DNA, 22 bp, Homo sapiens
aaaattgtgaaggtttctgaaa

SEQ ID NO: 7762824 - DNA, 22 bp, Homo sapiens
aaaattgtcgaacagtagtaac

SEQ ID NO: 7762825 - DNA, 22 bp, Homo sapiens
aaaattgtcagaagttgatctt

SEQ ID NO: 7762826 - DNA, 22 bp, Homo sapiens
aaaattttactggtgtttcctt

SEQ ID NO: 7762827 - DNA, 22 bp, Homo sapiens
aaaattttactggtgtttcctt

SEQ ID NO: 7762828 - DNA, 22 bp, Homo sapiens
aaaattttcagcttgacttgat

SEQ ID NO: 7762829 - DNA, 22 bp, Homo sapiens
aaaattttcagcttgacttgat

SEQ ID NO: 7762830 - DNA, 22 bp, Homo sapiens
aaaattttcagcttgacttgat

SEQ ID NO: 7762831 - DNA, 22 bp, Homo sapiens
aaagcagctgtttgactttcca

SEQ ID NO: 7762832 - DNA, 22 bp, Homo sapiens
aaagcagctgctctggccttga

SEQ ID NO: 7762833 - DNA, 22 bp, Homo sapiens
aaagcaggcagcaggctggatt

SEQ ID NO: 7762834 - DNA, 22 bp, Homo sapiens
aaagcagggatgaggctagagg

SEQ ID NO: 7762835 - DNA, 22 bp, Homo sapiens
aaagcagggatgaggctagagg

SEQ ID NO: 7762836 - DNA, 22 bp, Homo sapiens
aaagcagggtccaaggagatgt

SEQ ID NO: 7762837 - DNA, 22 bp, Homo sapiens
aaagcaatggatgagaatctgt

SEQ ID NO: 7762838 - DNA, 21 bp, Homo sapiens
aaaatgtgagcgtgatgctta

SEQ ID NO: 7762839 - DNA, 22 bp, Homo sapiens
aaaatgaggaacggatcatggc

SEQ ID NO: 7762840 - DNA, 22 bp, Homo sapiens
aaaatgaggtcaatatcctttt

SEQ ID NO: 7762841 - DNA, 22 bp, Homo sapiens
aaaatgatgctgtaatttggca

SEQ ID NO: 7762842 - DNA, 20 bp, Homo sapiens
aaaatgatgggcagggcagg

SEQ ID NO: 7762843 - DNA, 18 bp, Homo sapiens
aaaatgcaggcgacatgg

SEQ ID NO: 7762844 - DNA, 22 bp, Homo sapiens
aaaatgggtttcttcaacctca

SEQ ID NO: 7762845 - DNA, 22 bp, Homo sapiens
aaaatgtaaagcttgagtgtag

SEQ ID NO: 7762846 - DNA, 22 bp, Homo sapiens
aaaatgtaaagcttgagtgtag

SEQ ID NO: 7762847 - DNA, 22 bp, Homo sapiens
aaaatactgtggagtgttgaaa

SEQ ID NO: 7762848 - DNA, 22 bp, Homo sapiens
aaaatactgtggagtgttgaaa

SEQ ID NO: 7762849 - DNA, 22 bp, Homo sapiens
aaaatactactgtcttcttccc

SEQ ID NO: 7762850 - DNA, 22 bp, Homo sapiens
aaaatactactgtcttcttccc

SEQ ID NO: 7762851 - DNA, 22 bp, Homo sapiens
aaaatgagacacatgtgactcc

SEQ ID NO: 7762852 - DNA, 22 bp, Homo sapiens
aaaatgagcatattgatccttt

SEQ ID NO: 7762853 - DNA, 22 bp, Homo sapiens
aaaatctggcaacactaagttt

SEQ ID NO: 7762854 - DNA, 22 bp, Homo sapiens
aaaataacttctactatttgca

SEQ ID NO: 7762855 - DNA, 22 bp, Homo sapiens
aaaatacacatactaggggaaa

SEQ ID NO: 7762856 - DNA, 22 bp, Homo sapiens
aaaagtttgtgcaaacactcag

SEQ ID NO: 7762857 - DNA, 22 bp, Homo sapiens
aaaagtttgtgcaaacactcag

SEQ ID NO: 7762858 - DNA, 21 bp, Homo sapiens
aaaagtttgacaggaaaggga

SEQ ID NO: 7762859 - DNA, 22 bp, Homo sapiens
aaaagttccctggttagaaaag

SEQ ID NO: 7762860 - DNA, 22 bp, Homo sapiens
aaaagtttaagactcattctag

SEQ ID NO: 7762861 - DNA, 22 bp, Homo sapiens
aaaagtttaagactcattctag

SEQ ID NO: 7762862 - DNA, 22 bp, Homo sapiens
aaaagttcattagtgagcttct

SEQ ID NO: 7762863 - DNA, 22 bp, Homo sapiens
aaaagttacctctgtaatataa

SEQ ID NO: 7762864 - DNA, 22 bp, Homo sapiens
aaaagtgtccagattatgaaga

SEQ ID NO: 7762865 - DNA, 19 bp, Homo sapiens
aaaaggaatattctttggg

SEQ ID NO: 7762866 - DNA, 19 bp, Homo sapiens
aaaaggaatattctttggg

SEQ ID NO: 7762867 - DNA, 22 bp, Homo sapiens
aaaagctctttctgctgtagat

SEQ ID NO: 7762868 - DNA, 19 bp, Homo sapiens
aaaaggaatattctttggg

SEQ ID NO: 7762869 - DNA, 19 bp, Homo sapiens
aaaaggaatattctttggg

SEQ ID NO: 7762870 - DNA, 21 bp, Homo sapiens
aaaaggaaggtctgtttgggg

SEQ ID NO: 7762871 - DNA, 22 bp, Homo sapiens
aaaagagtcttaggcagtcata

SEQ ID NO: 7762872 - DNA, 22 bp, Homo sapiens
aaaacattgaattgcacactat

SEQ ID NO: 7762873 - DNA, 22 bp, Homo sapiens
aaaacattttactgccatctca

SEQ ID NO: 7762874 - DNA, 22 bp, Homo sapiens
aaaacattgaattgcacactat

SEQ ID NO: 7762875 - DNA, 22 bp, Homo sapiens
aaaacattctgtgaactctcaa

SEQ ID NO: 7762876 - DNA, 22 bp, Homo sapiens
aaaacatgtccatacagaaact

SEQ ID NO: 7762877 - DNA, 20 bp, Homo sapiens
aaaagagtgcttcaactgct

SEQ ID NO: 7762878 - DNA, 22 bp, Homo sapiens
aaaagcaaggcagtctgtctga

SEQ ID NO: 7762879 - DNA, 22 bp, Homo sapiens
aaaagcaagttgcctaggttga

SEQ ID NO: 7762880 - DNA, 22 bp, Homo sapiens
aaaagcaagaggctggattaaa

SEQ ID NO: 7762881 - DNA, 22 bp, Homo sapiens
aaaaatttatggttcttctctg

SEQ ID NO: 7762882 - DNA, 22 bp, Homo sapiens
aaaacacaagaagcagggtaca

SEQ ID NO: 7762883 - DNA, 22 bp, Homo sapiens
aaaaatttatggttcttctctg

SEQ ID NO: 7762884 - DNA, 22 bp, Homo sapiens
aaaaatgtgaccacagggtgtt

SEQ ID NO: 7762885 - DNA, 22 bp, Homo sapiens
aaaaatgttatctactgtccga

SEQ ID NO: 7762886 - DNA, 22 bp, Homo sapiens
aaaacactgcaaagctgattgg

SEQ ID NO: 7762887 - DNA, 22 bp, Homo sapiens
aaaacactgcaaagctgattgg

SEQ ID NO: 7762888 - DNA, 22 bp, Homo sapiens
aaaacagacagccagtgtagag

SEQ ID NO: 7762889 - DNA, 22 bp, Homo sapiens
aaaacagtttaggcatcacagt

SEQ ID NO: 7762890 - DNA, 22 bp, Homo sapiens
aaaacagttataaacagagtca

SEQ ID NO: 7762891 - DNA, 22 bp, Homo sapiens
aaaacagttataaacagagtca

SEQ ID NO: 7762892 - DNA, 22 bp, Homo sapiens
aaaagcaattgcgggttttgcc

SEQ ID NO: 7762893 - DNA, 22 bp, Homo sapiens
aaaagcaattgcagttcttgcc

SEQ ID NO: 7762894 - DNA, 22 bp, Homo sapiens
aaaagcaagttgcctaggttga

SEQ ID NO: 7762895 - DNA, 22 bp, Homo sapiens
aaaagcagaccacgctttgtgg

SEQ ID NO: 7762896 - DNA, 22 bp, Homo sapiens
aaaagcactacaatttcgcttc

SEQ ID NO: 7762897 - DNA, 22 bp, Homo sapiens
aaaagcagagactctggagcta

SEQ ID NO: 7762898 - DNA, 22 bp, Homo sapiens
aaaagccaaggtcctcttcaga

SEQ ID NO: 7762899 - DNA, 22 bp, Homo sapiens
aaaagccatgcatacctaagag

SEQ ID NO: 7762900 - DNA, 22 bp, Homo sapiens
aaaagccaaggtcctcttcaga

SEQ ID NO: 7762901 - DNA, 20 bp, Homo sapiens
aaaagcagccagagatggta

SEQ ID NO: 7762902 - DNA, 22 bp, Homo sapiens
aaaagcaggtactcagcttggg

SEQ ID NO: 7762903 - DNA, 22 bp, Homo sapiens
aaaagcaggtactcagcttggg

SEQ ID NO: 7762904 - DNA, 22 bp, Homo sapiens
acacatacatggggaagatgag

SEQ ID NO: 7762905 - DNA, 22 bp, Homo sapiens
acacatatatacatatttgtgc

SEQ ID NO: 7762906 - DNA, 20 bp, Homo sapiens
acacatatagcagcataaac

SEQ ID NO: 7762907 - DNA, 22 bp, Homo sapiens
acacataagcctaatcatctcc

SEQ ID NO: 7762908 - DNA, 22 bp, Homo sapiens
acacataagcctaatcatctcc

SEQ ID NO: 7762909 - DNA, 22 bp, Homo sapiens
aagatacatatttgttctagtg

SEQ ID NO: 7762910 - DNA, 22 bp, Homo sapiens
aagatacacgttgtattgaata

SEQ ID NO: 7762911 - DNA, 20 bp, Homo sapiens
acacttgacaccagaaatgg

SEQ ID NO: 7762912 - DNA, 22 bp, Homo sapiens
acacttgaggaatgtggtgatt

SEQ ID NO: 7762913 - DNA, 22 bp, Homo sapiens
acacttgaggtttttaggtgcg

SEQ ID NO: 7762914 - DNA, 22 bp, Homo sapiens
acacttgataggtcaaatcagt

SEQ ID NO: 7762915 - DNA, 22 bp, Homo sapiens
acacttggagcaacacttatgg

SEQ ID NO: 7762916 - DNA, 22 bp, Homo sapiens
acacttctctttgaagaacaat

SEQ ID NO: 7762917 - DNA, 23 bp, Homo sapiens
acagaaatcatttgtaaggtacc

SEQ ID NO: 7762918 - DNA, 22 bp, Homo sapiens
acagaaatgatgtttggcaata

SEQ ID NO: 7762919 - DNA, 23 bp, Homo sapiens
acagacaacactgatgagagaaa

SEQ ID NO: 7762920 - DNA, 22 bp, Homo sapiens
aagccaggttccatggaggagc

SEQ ID NO: 7762921 - DNA, 22 bp, Homo sapiens
acagcaggttacagtggcacag

SEQ ID NO: 7762922 - DNA, 20 bp, Homo sapiens
aagcccattaccatgcttgg

SEQ ID NO: 7762923 - DNA, 22 bp, Homo sapiens
acagctgctttctcttactatg

SEQ ID NO: 7762924 - DNA, 22 bp, Homo sapiens
acagctgctctatatctcagcc

SEQ ID NO: 7762925 - DNA, 22 bp, Homo sapiens
acagctgctgtggaggttttca

SEQ ID NO: 7762926 - DNA, 22 bp, Homo sapiens
acagcaggaagctggagggaaa

SEQ ID NO: 7762927 - DNA, 22 bp, Homo sapiens
aagcagtgcgctcatctaaggg

SEQ ID NO: 7762928 - DNA, 22 bp, Homo sapiens
aagcagtgttcccagctggccc

SEQ ID NO: 7762929 - DNA, 22 bp, Homo sapiens
acagcagggggagctgttggac

SEQ ID NO: 7762930 - DNA, 22 bp, Homo sapiens
acagcaggggtggaataaacgt

SEQ ID NO: 7762931 - DNA, 22 bp, Homo sapiens
acagcagggtcacattccctct

SEQ ID NO: 7762932 - DNA, 19 bp, Homo sapiens
acagcaggtgtggggataa

SEQ ID NO: 7762933 - DNA, 22 bp, Homo sapiens
acagcaggtagctttgtgcctc

SEQ ID NO: 7762934 - DNA, 18 bp, Homo sapiens
aagcagggtccattgtgc

SEQ ID NO: 7762935 - DNA, 22 bp, Homo sapiens
aagcagggtcttcctcagttgg

SEQ ID NO: 7762936 - DNA, 22 bp, Homo sapiens
aagcagggctagaccaagaaga

SEQ ID NO: 7762937 - DNA, 22 bp, Homo sapiens
aagcaggttacatacattatct

SEQ ID NO: 7762938 - DNA, 22 bp, Homo sapiens
aagcaggttatgaaatatagaa

SEQ ID NO: 7762939 - DNA, 23 bp, Homo sapiens
aagcagggagattcttagctgag

SEQ ID NO: 7762940 - DNA, 21 bp, Homo sapiens
aagcagggactgcccaggtcc

SEQ ID NO: 7762941 - DNA, 22 bp, Homo sapiens
aagcaggctcacgccaggcagt

SEQ ID NO: 7762942 - DNA, 22 bp, Homo sapiens
aagcaggcttggtgtggccgct

SEQ ID NO: 7762943 - DNA, 21 bp, Homo sapiens
aagcaggctgtaatcatgtgg

SEQ ID NO: 7762944 - DNA, 22 bp, Homo sapiens
aagcaggcttggtgtggccgct

SEQ ID NO: 7762945 - DNA, 22 bp, Homo sapiens
aagcaggctagattgaagggct

SEQ ID NO: 7762946 - DNA, 22 bp, Homo sapiens
acaaatccagtgaactccagtg

SEQ ID NO: 7762947 - DNA, 22 bp, Homo sapiens
acaaatctgttttatagacttt

SEQ ID NO: 7762948 - DNA, 22 bp, Homo sapiens
acaaatatttactgaatccact

SEQ ID NO: 7762949 - DNA, 22 bp, Homo sapiens
acaaagctctggaaggctcgtc

SEQ ID NO: 7762950 - DNA, 22 bp, Homo sapiens
acaaagctagagaagagaattg

SEQ ID NO: 7762951 - DNA, 22 bp, Homo sapiens
acaaatatttactgaatccact

SEQ ID NO: 7762952 - DNA, 22 bp, Homo sapiens
acaaagctagagaagagaattg

SEQ ID NO: 7762953 - DNA, 22 bp, Homo sapiens
aagaatatagattttttgaagt

SEQ ID NO: 7762954 - DNA, 22 bp, Homo sapiens
acaaaagtgagtgtgtctcaga

SEQ ID NO: 7762955 - DNA, 22 bp, Homo sapiens
acaaaaccagaaaatctctacc

SEQ ID NO: 7762956 - DNA, 19 bp, Homo sapiens
aagaactatgtgattacag

SEQ ID NO: 7762957 - DNA, 22 bp, Homo sapiens
aagaactatctctggctgtagg

SEQ ID NO: 7762958 - DNA, 22 bp, Homo sapiens
aagaactagtcttacagcctca

SEQ ID NO: 7762959 - DNA, 22 bp, Homo sapiens
aagaacattgatattgtctatg

SEQ ID NO: 7762960 - DNA, 22 bp, Homo sapiens
aagaacattttgtagaatgaca

SEQ ID NO: 7762961 - DNA, 22 bp, Homo sapiens
aatgtacaataagacaaagagg

SEQ ID NO: 7762962 - DNA, 22 bp, Homo sapiens
aatgtacaataagacaaagagg

SEQ ID NO: 7762963 - DNA, 22 bp, Homo sapiens
aatgtacaagggttccagtttt

SEQ ID NO: 7762964 - DNA, 22 bp, Homo sapiens
aatgtacaagggttccagtttt

SEQ ID NO: 7762965 - DNA, 22 bp, Homo sapiens
aagaacatgttaaaagattcac

SEQ ID NO: 7762966 - DNA, 22 bp, Homo sapiens
aagaagatggttaactttcagt

SEQ ID NO: 7762967 - DNA, 22 bp, Homo sapiens
aattttatctctaagcaggctt

SEQ ID NO: 7762968 - DNA, 19 bp, Homo sapiens
aagaagcaataagctgtga

SEQ ID NO: 7762969 - DNA, 22 bp, Homo sapiens
acaaaaattagctgggcatggt

SEQ ID NO: 7762970 - DNA, 22 bp, Homo sapiens
acaaaaagggagatgaggtaga

SEQ ID NO: 7762971 - DNA, 22 bp, Homo sapiens
aattttatctctaagcaggctt

SEQ ID NO: 7762972 - DNA, 22 bp, Homo sapiens
aagaactttgatttcattgcat

SEQ ID NO: 7762973 - DNA, 22 bp, Homo sapiens
aagaacttgggctgagtgaaag

SEQ ID NO: 7762974 - DNA, 22 bp, Homo sapiens
aagaagaagtgttatttttaga

SEQ ID NO: 7762975 - DNA, 23 bp, Homo sapiens
aagaactttggtcctgcagagtc

SEQ ID NO: 7762976 - DNA, 22 bp, Homo sapiens
aagaacttttggcaagtgttat

SEQ ID NO: 7762977 - DNA, 22 bp, Homo sapiens
acacagagccagggaatacagt

SEQ ID NO: 7762978 - DNA, 22 bp, Homo sapiens
acacagagcaaatcatgacaga

SEQ ID NO: 7762979 - DNA, 22 bp, Homo sapiens
acacagagctggaactgcttca

SEQ ID NO: 7762980 - DNA, 22 bp, Homo sapiens
acacagagctggaactgcttca

SEQ ID NO: 7762981 - DNA, 22 bp, Homo sapiens
acacagaagctttttctattcc

SEQ ID NO: 7762982 - DNA, 22 bp, Homo sapiens
acacacatgcctttcctaagta

SEQ ID NO: 7762983 - DNA, 22 bp, Homo sapiens
acacagcaaggtctgactttgg

SEQ ID NO: 7762984 - DNA, 22 bp, Homo sapiens
acacagcaaggtctgactttgg

SEQ ID NO: 7762985 - DNA, 22 bp, Homo sapiens
aagataatgtgtctgtctttgc

SEQ ID NO: 7762986 - DNA, 22 bp, Homo sapiens
aagataatgttctagctgtcag

SEQ ID NO: 7762987 - DNA, 22 bp, Homo sapiens
aagatacacggtcaactctcaa

SEQ ID NO: 7762988 - DNA, 22 bp, Homo sapiens
aagataatattcattaactaga

SEQ ID NO: 7762989 - DNA, 22 bp, Homo sapiens
aagagtttccagttgtggctca

SEQ ID NO: 7762990 - DNA, 22 bp, Homo sapiens
acaatatttgggggcagtttgt

SEQ ID NO: 7762991 - DNA, 22 bp, Homo sapiens
acaatcacacatgcaattatac

SEQ ID NO: 7762992 - DNA, 22 bp, Homo sapiens
acaatatagtccatgagcatgc

SEQ ID NO: 7762993 - DNA, 22 bp, Homo sapiens
acaatgttctacatatacataa

SEQ ID NO: 7762994 - DNA, 22 bp, Homo sapiens
acaatgtaggatatgtacttgt

SEQ ID NO: 7762995 - DNA, 22 bp, Homo sapiens
acaatgtcaaaataggaaacat

SEQ ID NO: 7762996 - DNA, 22 bp, Homo sapiens
acaatgtaggctgaaaaagctt

SEQ ID NO: 7762997 - DNA, 22 bp, Homo sapiens
acaaatttggtgagagtaaata

SEQ ID NO: 7762998 - DNA, 22 bp, Homo sapiens
acaaatttgaatcctgacttct

SEQ ID NO: 7762999 - DNA, 22 bp, Homo sapiens
acaaatttgtgtagttatggca

SEQ ID NO: 7763000 - DNA, 22 bp, Homo sapiens
acaaatttgtgtagttatggca

SEQ ID NO: 7763001 - DNA, 22 bp, Homo sapiens
acaaatttcataggcaaatttt

SEQ ID NO: 7763002 - DNA, 22 bp, Homo sapiens
acaaattgttgggactcagccc

SEQ ID NO: 7763003 - DNA, 22 bp, Homo sapiens
acaaatttattgaagggcatat

SEQ ID NO: 7763004 - DNA, 22 bp, Homo sapiens
acaatagagttctcataggaca

SEQ ID NO: 7763005 - DNA, 22 bp, Homo sapiens
acaatatacacatcctaatggg

SEQ ID NO: 7763006 - DNA, 22 bp, Homo sapiens
acaatagtaaggtatattgtca

SEQ ID NO: 7763007 - DNA, 22 bp, Homo sapiens
aatctggaatatttgcattgta

SEQ ID NO: 7763008 - DNA, 22 bp, Homo sapiens
aatctggacacagttctcatgc

SEQ ID NO: 7763009 - DNA, 22 bp, Homo sapiens
aatctggacttgtctgtgaaga

SEQ ID NO: 7763010 - DNA, 22 bp, Homo sapiens
aatctggagagtcatctctgac

SEQ ID NO: 7763011 - DNA, 22 bp, Homo sapiens
aatgaaatagttggctgtagag

SEQ ID NO: 7763012 - DNA, 22 bp, Homo sapiens
aatgcacatgtcttggcctcac

SEQ ID NO: 7763013 - DNA, 22 bp, Homo sapiens
aatgcagaccagtatgaaaaac

SEQ ID NO: 7763014 - DNA, 18 bp, Homo sapiens
aatgcacacatttactcc

SEQ ID NO: 7763015 - DNA, 22 bp, Homo sapiens
aatgaaatgaagatatgatcag

SEQ ID NO: 7763016 - DNA, 18 bp, Homo sapiens
aatgaaatgtacaccttt

SEQ ID NO: 7763017 - DNA, 18 bp, Homo sapiens
aatgaaatgtacaccttt

SEQ ID NO: 7763018 - DNA, 22 bp, Homo sapiens
aatgaaatgtagcttatccata

SEQ ID NO: 7763019 - DNA, 22 bp, Homo sapiens
aatgaaatgtagcttatccata

SEQ ID NO: 7763020 - DNA, 22 bp, Homo sapiens
aacttcatttataatgtcatta

SEQ ID NO: 7763021 - DNA, 22 bp, Homo sapiens
aatgcttattattaatagaatg

SEQ ID NO: 7763022 - DNA, 19 bp, Homo sapiens
aatgcttaggacagtgcct

SEQ ID NO: 7763023 - DNA, 22 bp, Homo sapiens
aatgcagttgaatttgggtatg

SEQ ID NO: 7763024 - DNA, 22 bp, Homo sapiens
aatgtacaaaccttctttgtag

SEQ ID NO: 7763025 - DNA, 22 bp, Homo sapiens
aacttgttagaaatgcagaatc

SEQ ID NO: 7763026 - DNA, 22 bp, Homo sapiens
aacttgtttcttccattcaaca

SEQ ID NO: 7763027 - DNA, 20 bp, Homo sapiens
aacttgttttgttttctaat

SEQ ID NO: 7763028 - DNA, 20 bp, Homo sapiens
aacttgttttgttttctaat

SEQ ID NO: 7763029 - DNA, 22 bp, Homo sapiens
aactttaaggctataaattatg

SEQ ID NO: 7763030 - DNA, 22 bp, Homo sapiens
aatatcttctaaggatagaact

SEQ ID NO: 7763031 - DNA, 22 bp, Homo sapiens
aatattgagaaccagcatgttt

SEQ ID NO: 7763032 - DNA, 22 bp, Homo sapiens
aatatttctgtagctatgttct

SEQ ID NO: 7763033 - DNA, 22 bp, Homo sapiens
aatatttctgtagctatgttct

SEQ ID NO: 7763034 - DNA, 22 bp, Homo sapiens
aatatttctgtagctatgttct

SEQ ID NO: 7763035 - DNA, 22 bp, Homo sapiens
aatatttctgtagctatgttct

SEQ ID NO: 7763036 - DNA, 22 bp, Homo sapiens
aatccagatgagcaatcatact

SEQ ID NO: 7763037 - DNA, 22 bp, Homo sapiens
aatatttccaaggcctgtcagg

SEQ ID NO: 7763038 - DNA, 22 bp, Homo sapiens
aatatttcaaaaggaaacacag

SEQ ID NO: 7763039 - DNA, 22 bp, Homo sapiens
aatatttctggtgcttctcact

SEQ ID NO: 7763040 - DNA, 22 bp, Homo sapiens
aatatttctggtgcttctcact

SEQ ID NO: 7763041 - DNA, 22 bp, Homo sapiens
aatatttctgcagaatggtttt

SEQ ID NO: 7763042 - DNA, 22 bp, Homo sapiens
aatataattttattcctagagt

SEQ ID NO: 7763043 - DNA, 22 bp, Homo sapiens
aatacatatggaattccatgtt

SEQ ID NO: 7763044 - DNA, 22 bp, Homo sapiens
aatatctggagatgctttttgt

SEQ ID NO: 7763045 - DNA, 22 bp, Homo sapiens
aatatcctttccagagtacagt

SEQ ID NO: 7763046 - DNA, 22 bp, Homo sapiens
aatacataataagttttgtctg

SEQ ID NO: 7763047 - DNA, 22 bp, Homo sapiens
aatacataataagttttgtctg

SEQ ID NO: 7763048 - DNA, 19 bp, Homo sapiens
aatacagtgttatagaatt

SEQ ID NO: 7763049 - DNA, 21 bp, Homo sapiens
aatacagtgaagaatttcttt

SEQ ID NO: 7763050 - DNA, 22 bp, Homo sapiens
aataatgagacagcttatttaa

SEQ ID NO: 7763051 - DNA, 22 bp, Homo sapiens
aataatatttgaagcttcaaag

SEQ ID NO: 7763052 - DNA, 22 bp, Homo sapiens
aataatatttgaagcttcaaag

SEQ ID NO: 7763053 - DNA, 22 bp, Homo sapiens
aataatgtacatacatatttcg

SEQ ID NO: 7763054 - DNA, 22 bp, Homo sapiens
aataatgtaggatgataaatga

SEQ ID NO: 7763055 - DNA, 22 bp, Homo sapiens
aataatgtctttggcttgacca

SEQ ID NO: 7763056 - DNA, 22 bp, Homo sapiens
aataatgtctgctattttaaaa

SEQ ID NO: 7763057 - DNA, 22 bp, Homo sapiens
aatacagaggggtcacaattca

SEQ ID NO: 7763058 - DNA, 22 bp, Homo sapiens
aagttacagttattatttaaaa

SEQ ID NO: 7763059 - DNA, 22 bp, Homo sapiens
aagttacagtcagaggttaaca

SEQ ID NO: 7763060 - DNA, 22 bp, Homo sapiens
aacagttgatgtagctttggag

SEQ ID NO: 7763061 - DNA, 22 bp, Homo sapiens
aagtgaaacatgtatctcttta

SEQ ID NO: 7763062 - DNA, 22 bp, Homo sapiens
aagtctttttgaatctataact

SEQ ID NO: 7763063 - DNA, 22 bp, Homo sapiens
aagtgcatggtatggtctccat

SEQ ID NO: 7763064 - DNA, 22 bp, Homo sapiens
aagtgcattagatagaatgatg

SEQ ID NO: 7763065 - DNA, 22 bp, Homo sapiens
aagtgcatcactactcattaca

SEQ ID NO: 7763066 - DNA, 22 bp, Homo sapiens
aagtctttcataagtctcttat

SEQ ID NO: 7763067 - DNA, 22 bp, Homo sapiens
aacagtgatatcaagacagaca

SEQ ID NO: 7763068 - DNA, 17 bp, Homo sapiens
aacagtaagccctgttt

SEQ ID NO: 7763069 - DNA, 22 bp, Homo sapiens
aacagtaacgagatgtcctaac

SEQ ID NO: 7763070 - DNA, 22 bp, Homo sapiens
aacagtaagagatgttttatct

SEQ ID NO: 7763071 - DNA, 22 bp, Homo sapiens
aagtaacatctgaacatgatgt

SEQ ID NO: 7763072 - DNA, 22 bp, Homo sapiens
aagtaaggccttcttgagcatg

SEQ ID NO: 7763073 - DNA, 22 bp, Homo sapiens
aagtaaggcagtgaatgagatt

SEQ ID NO: 7763074 - DNA, 21 bp, Homo sapiens
aaggtctgtaaagtgacagga

SEQ ID NO: 7763075 - DNA, 22 bp, Homo sapiens
aagggcaggtgggcatttctgg

SEQ ID NO: 7763076 - DNA, 22 bp, Homo sapiens
aagggcagggagtttgtgtcta

SEQ ID NO: 7763077 - DNA, 22 bp, Homo sapiens
aagggcagggagtttgtgtcta

SEQ ID NO: 7763078 - DNA, 22 bp, Homo sapiens
aaggagaagggtaatcaacaca

SEQ ID NO: 7763079 - DNA, 22 bp, Homo sapiens
aaatggatgttgagttaaatgt

SEQ ID NO: 7763080 - DNA, 22 bp, Homo sapiens
aaatggatctttttataatgca

SEQ ID NO: 7763081 - DNA, 22 bp, Homo sapiens
aaggatatttggctacagaagc

SEQ ID NO: 7763082 - DNA, 22 bp, Homo sapiens
aaggccctagaatctatattgc

SEQ ID NO: 7763083 - DNA, 22 bp, Homo sapiens
aaggcccagggattggaggtca

SEQ ID NO: 7763084 - DNA, 22 bp, Homo sapiens
aaggcccaggctgccctgggca

SEQ ID NO: 7763085 - DNA, 22 bp, Homo sapiens
aaggcccagcctggagcttgtt

SEQ ID NO: 7763086 - DNA, 22 bp, Homo sapiens
aaggccctgtctccaaatacag

SEQ ID NO: 7763087 - DNA, 22 bp, Homo sapiens
aaggcccacagaactgtctcca

SEQ ID NO: 7763088 - DNA, 23 bp, Homo sapiens
aaggccagagagaggctagtgtc

SEQ ID NO: 7763089 - DNA, 22 bp, Homo sapiens
aaggccaggtccctgcagtgca

SEQ ID NO: 7763090 - DNA, 22 bp, Homo sapiens
aaggctgacgtttgtgtttatt

SEQ ID NO: 7763091 - DNA, 22 bp, Homo sapiens
aagggcaggagaagacggatat

SEQ ID NO: 7763092 - DNA, 22 bp, Homo sapiens
aagggcaggcagagatcatata

SEQ ID NO: 7763093 - DNA, 22 bp, Homo sapiens
acacatcatgccaagtttcacc

SEQ ID NO: 7763094 - DNA, 22 bp, Homo sapiens
acacatctatctctacacaagg

SEQ ID NO: 7763095 - DNA, 22 bp, Homo sapiens
acacatctatattgcatctgca

SEQ ID NO: 7763096 - DNA, 22 bp, Homo sapiens
agcaggtgagcacagccaggct

SEQ ID NO: 7763097 - DNA, 22 bp, Homo sapiens
agcaggtgagcacagccaggct

SEQ ID NO: 7763098 - DNA, 19 bp, Homo sapiens
agcagggacatggaacttt

SEQ ID NO: 7763099 - DNA, 22 bp, Homo sapiens
agcagggactgagccagtggga

SEQ ID NO: 7763100 - DNA, 22 bp, Homo sapiens
acacatatgtcattgaaaaatc

SEQ ID NO: 7763101 - DNA, 22 bp, Homo sapiens
agcagggactgagccagtggga

SEQ ID NO: 7763102 - DNA, 22 bp, Homo sapiens
agcaggctttccacagaaggag

SEQ ID NO: 7763103 - DNA, 22 bp, Homo sapiens
agcaggctttcaagagtcttct

SEQ ID NO: 7763104 - DNA, 21 bp, Homo sapiens
agcaggctttggagtggggct

SEQ ID NO: 7763105 - DNA, 22 bp, Homo sapiens
agcagggaagcctccagaacct

SEQ ID NO: 7763106 - DNA, 22 bp, Homo sapiens
agcaggcttgttatgtctgaga

SEQ ID NO: 7763107 - DNA, 22 bp, Homo sapiens
agcaggcttggtccccagcctc

SEQ ID NO: 7763108 - DNA, 22 bp, Homo sapiens
agcaggcttggtccccagcctc

SEQ ID NO: 7763109 - DNA, 19 bp, Homo sapiens
agcaggccacagggccagc

SEQ ID NO: 7763110 - DNA, 19 bp, Homo sapiens
agcaggccacagggccagc

SEQ ID NO: 7763111 - DNA, 22 bp, Homo sapiens
acacataagaaactacaaagag

SEQ ID NO: 7763112 - DNA, 22 bp, Homo sapiens
acacagtttatggtattctgtt

SEQ ID NO: 7763113 - DNA, 22 bp, Homo sapiens
acacagttggtggctcagtctg

SEQ ID NO: 7763114 - DNA, 22 bp, Homo sapiens
acacagttctttcactgttggt

SEQ ID NO: 7763115 - DNA, 22 bp, Homo sapiens
acacagttcgtgcttttctatt

SEQ ID NO: 7763116 - DNA, 22 bp, Homo sapiens
acacagttcgttgttttctact

SEQ ID NO: 7763117 - DNA, 22 bp, Homo sapiens
acacagtatgcatctagaaatt

SEQ ID NO: 7763118 - DNA, 22 bp, Homo sapiens
acacagtggtgagtctggacct

SEQ ID NO: 7763119 - DNA, 20 bp, Homo sapiens
acacagtgacaggaaagaga

SEQ ID NO: 7763120 - DNA, 22 bp, Homo sapiens
acacagtattgtgactataact

SEQ ID NO: 7763121 - DNA, 22 bp, Homo sapiens
acacagtggtgtttacaaaatt

SEQ ID NO: 7763122 - DNA, 22 bp, Homo sapiens
acacagtgtgtgcagtcggacg

SEQ ID NO: 7763123 - DNA, 22 bp, Homo sapiens
acacagttcaggatcaaatagc

SEQ ID NO: 7763124 - DNA, 22 bp, Homo sapiens
acacacaactcattgtgtaata

SEQ ID NO: 7763125 - DNA, 22 bp, Homo sapiens
acacaatttcctgtccatatgt

SEQ ID NO: 7763126 - DNA, 22 bp, Homo sapiens
acacaatttcataaacaccatg

SEQ ID NO: 7763127 - DNA, 22 bp, Homo sapiens
acacaataaatttatcctttga

SEQ ID NO: 7763128 - DNA, 22 bp, Homo sapiens
agccaaggcagctagagctctg

SEQ ID NO: 7763129 - DNA, 22 bp, Homo sapiens
agccaaggtatcatgagaggca

SEQ ID NO: 7763130 - DNA, 22 bp, Homo sapiens
agccaagggtcagctgcacaga

SEQ ID NO: 7763131 - DNA, 22 bp, Homo sapiens
agccaaggtatcatgagaggca

SEQ ID NO: 7763132 - DNA, 22 bp, Homo sapiens
agccaataaatttacaactaga

SEQ ID NO: 7763133 - DNA, 22 bp, Homo sapiens
agccaatacactgaagatctaa

SEQ ID NO: 7763134 - DNA, 20 bp, Homo sapiens
agccaatacagcaaaatttg

SEQ ID NO: 7763135 - DNA, 22 bp, Homo sapiens
agccaaggtcgccccagggcaa

SEQ ID NO: 7763136 - DNA, 22 bp, Homo sapiens
agccaatgcgtaaaaagatcta

SEQ ID NO: 7763137 - DNA, 22 bp, Homo sapiens
agcaggtggtaggcagtcagca

SEQ ID NO: 7763138 - DNA, 21 bp, Homo sapiens
agcaggtgtaaaggaggaaat

SEQ ID NO: 7763139 - DNA, 22 bp, Homo sapiens
acacccagattatgcacacaaa

SEQ ID NO: 7763140 - DNA, 22 bp, Homo sapiens
acaccatactcatgttggttcc

SEQ ID NO: 7763141 - DNA, 22 bp, Homo sapiens
acaccaggtcccgtctgtacct

SEQ ID NO: 7763142 - DNA, 22 bp, Homo sapiens
agccagagattgagatgcaggc

SEQ ID NO: 7763143 - DNA, 23 bp, Homo sapiens
acacttcacccattgtgatagga

SEQ ID NO: 7763144 - DNA, 22 bp, Homo sapiens
agccagagattgagatgcaggc

SEQ ID NO: 7763145 - DNA, 22 bp, Homo sapiens
acacttaacttctgagaataaa

SEQ ID NO: 7763146 - DNA, 22 bp, Homo sapiens
acacttaagcatgaagtataaa

SEQ ID NO: 7763147 - DNA, 22 bp, Homo sapiens
acacttaagcatgaagtataaa

SEQ ID NO: 7763148 - DNA, 22 bp, Homo sapiens
acacttaatcttactgaggatc

SEQ ID NO: 7763149 - DNA, 22 bp, Homo sapiens
acactgttccacactaagaagg

SEQ ID NO: 7763150 - DNA, 22 bp, Homo sapiens
acactgttgctggcacagacag

SEQ ID NO: 7763151 - DNA, 22 bp, Homo sapiens
agccagcttctttacggtggca

SEQ ID NO: 7763152 - DNA, 22 bp, Homo sapiens
agccagctttcacaaatgaaga

SEQ ID NO: 7763153 - DNA, 22 bp, Homo sapiens
agccagctgttctggggcagca

SEQ ID NO: 7763154 - DNA, 22 bp, Homo sapiens
agccagctggtgggtcagctgg

SEQ ID NO: 7763155 - DNA, 22 bp, Homo sapiens
agccagctgtactgcctgctca

SEQ ID NO: 7763156 - DNA, 22 bp, Homo sapiens
agccagctgtcctccctttcct

SEQ ID NO: 7763157 - DNA, 22 bp, Homo sapiens
agccagctgtggctatggctcc

SEQ ID NO: 7763158 - DNA, 19 bp, Homo sapiens
agccagagtggcccagggg

SEQ ID NO: 7763159 - DNA, 22 bp, Homo sapiens
agccagctggagaccactgttt

SEQ ID NO: 7763160 - DNA, 22 bp, Homo sapiens
agccagctgctcgggggaaaca

SEQ ID NO: 7763161 - DNA, 22 bp, Homo sapiens
agccagaggtcatgagcacagg

SEQ ID NO: 7763162 - DNA, 22 bp, Homo sapiens
agccagaggtcatgagcacagg

SEQ ID NO: 7763163 - DNA, 22 bp, Homo sapiens
agcgtggatgtggggcgcggct

SEQ ID NO: 7763164 - DNA, 22 bp, Homo sapiens
acagataattagcataaatgct

SEQ ID NO: 7763165 - DNA, 22 bp, Homo sapiens
acagaggccccgtgggagagcc

SEQ ID NO: 7763166 - DNA, 22 bp, Homo sapiens
acagaggcctcggcctgcccag

SEQ ID NO: 7763167 - DNA, 22 bp, Homo sapiens
acagaggcctcgtaggtacaac

SEQ ID NO: 7763168 - DNA, 23 bp, Homo sapiens
acagaggcttaaatgagtggcag

SEQ ID NO: 7763169 - DNA, 23 bp, Homo sapiens
acagaggcttaaatgagtggcag

SEQ ID NO: 7763170 - DNA, 23 bp, Homo sapiens
acagaggcttaaatgagtggcag

SEQ ID NO: 7763171 - DNA, 22 bp, Homo sapiens
acagaggcctcgtaggtacaac

SEQ ID NO: 7763172 - DNA, 22 bp, Homo sapiens
acagaggctgcgcttgggaacg

SEQ ID NO: 7763173 - DNA, 22 bp, Homo sapiens
acagaggctgcgcttgggaacg

SEQ ID NO: 7763174 - DNA, 22 bp, Homo sapiens
acagaagtgtgtgtgtaggaat

SEQ ID NO: 7763175 - DNA, 22 bp, Homo sapiens
acagaagttggaattagatact

SEQ ID NO: 7763176 - DNA, 21 bp, Homo sapiens
acagaagtggcttggtctcag

SEQ ID NO: 7763177 - DNA, 22 bp, Homo sapiens
acagaagtggcttcaaagagca

SEQ ID NO: 7763178 - DNA, 19 bp, Homo sapiens
acagaagcatagaaaagga

SEQ ID NO: 7763179 - DNA, 23 bp, Homo sapiens
acagaagccaggagccgctgggc

SEQ ID NO: 7763180 - DNA, 22 bp, Homo sapiens
acagaagtccccatgaagaagc

SEQ ID NO: 7763181 - DNA, 17 bp, Homo sapiens
acagaggcaggagtgga

SEQ ID NO: 7763182 - DNA, 17 bp, Homo sapiens
acagaggcaggagtgga

SEQ ID NO: 7763183 - DNA, 22 bp, Homo sapiens
acagaggccatgagctgccacc

SEQ ID NO: 7763184 - DNA, 22 bp, Homo sapiens
acagaggccatgagctgccacc

SEQ ID NO: 7763185 - DNA, 22 bp, Homo sapiens
acagaggccatgagctgccacc

SEQ ID NO: 7763186 - DNA, 22 bp, Homo sapiens
acagaattaacatttgatgaat

SEQ ID NO: 7763187 - DNA, 21 bp, Homo sapiens
agctgaggtaaggcaagagag

SEQ ID NO: 7763188 - DNA, 22 bp, Homo sapiens
acagcagcgtcaacttaaaatt

SEQ ID NO: 7763189 - DNA, 22 bp, Homo sapiens
agctgagcacattcaaacaggt

SEQ ID NO: 7763190 - DNA, 22 bp, Homo sapiens
agctgagttaattcatcactta

SEQ ID NO: 7763191 - DNA, 17 bp, Homo sapiens
acagcaggcccggaggg

SEQ ID NO: 7763192 - DNA, 22 bp, Homo sapiens
acagcaggcccatactggaagg

SEQ ID NO: 7763193 - DNA, 19 bp, Homo sapiens
acagcagggatttttggag

SEQ ID NO: 7763194 - DNA, 22 bp, Homo sapiens
acagcagggaatatgggaattg

SEQ ID NO: 7763195 - DNA, 17 bp, Homo sapiens
acagcagggaagtgttg

SEQ ID NO: 7763196 - DNA, 18 bp, Homo sapiens
acagcaggtttcattctt

SEQ ID NO: 7763197 - DNA, 21 bp, Homo sapiens
acagcagggctggcatgacag

SEQ ID NO: 7763198 - DNA, 22 bp, Homo sapiens
acagcaggttattgttatggca

SEQ ID NO: 7763199 - DNA, 22 bp, Homo sapiens
acagcaggttttaactttgaag

SEQ ID NO: 7763200 - DNA, 22 bp, Homo sapiens
acagcagtggattagaggatgg

SEQ ID NO: 7763201 - DNA, 22 bp, Homo sapiens
acagatattatggtttctcctt

SEQ ID NO: 7763202 - DNA, 22 bp, Homo sapiens
agcaaggccgagaggatgctat

SEQ ID NO: 7763203 - DNA, 22 bp, Homo sapiens
agcacagggcccagcctaggcc

SEQ ID NO: 7763204 - DNA, 22 bp, Homo sapiens
agcacaggaccaaggaagctgt

SEQ ID NO: 7763205 - DNA, 21 bp, Homo sapiens
acacaacaggcagtcattttc

SEQ ID NO: 7763206 - DNA, 22 bp, Homo sapiens
agcacagggcccagcctaggcc

SEQ ID NO: 7763207 - DNA, 22 bp, Homo sapiens
acacaaattgtaggataattgc

SEQ ID NO: 7763208 - DNA, 19 bp, Homo sapiens
agcaaatataatagtgttc

SEQ ID NO: 7763209 - DNA, 22 bp, Homo sapiens
agcaaatacttgaataaaaaga

SEQ ID NO: 7763210 - DNA, 19 bp, Homo sapiens
agcaaatataatagtgttc

SEQ ID NO: 7763211 - DNA, 22 bp, Homo sapiens
acaagtttcattgtttagaacc

SEQ ID NO: 7763212 - DNA, 22 bp, Homo sapiens
agcaaatattttgttgaagtgc

SEQ ID NO: 7763213 - DNA, 22 bp, Homo sapiens
acaataacttctgtttccttgc

SEQ ID NO: 7763214 - DNA, 19 bp, Homo sapiens
acaataactcattgattgc

SEQ ID NO: 7763215 - DNA, 22 bp, Homo sapiens
acaatacaggcttctggactta

SEQ ID NO: 7763216 - DNA, 22 bp, Homo sapiens
acaatactattttcagtatcct

SEQ ID NO: 7763217 - DNA, 20 bp, Homo sapiens
acaatacaggttgtgtctga

SEQ ID NO: 7763218 - DNA, 22 bp, Homo sapiens
acaatacttaccaatgtttttg

SEQ ID NO: 7763219 - DNA, 22 bp, Homo sapiens
acaatactcatgctctttttct

SEQ ID NO: 7763220 - DNA, 22 bp, Homo sapiens
acaatagaaggaaactgacata

SEQ ID NO: 7763221 - DNA, 22 bp, Homo sapiens
agcaaataaagacaattatgtc

SEQ ID NO: 7763222 - DNA, 22 bp, Homo sapiens
agcaaataattgtctttgaggg

SEQ ID NO: 7763223 - DNA, 21 bp, Homo sapiens
agcaaaggcaggagaggtttc

SEQ ID NO: 7763224 - DNA, 22 bp, Homo sapiens
acaacagtccagtatagactgt

SEQ ID NO: 7763225 - DNA, 22 bp, Homo sapiens
acaacagtttaggtatttgtag

SEQ ID NO: 7763226 - DNA, 22 bp, Homo sapiens
acaacattatacatagaaagct

SEQ ID NO: 7763227 - DNA, 22 bp, Homo sapiens
acaacattatacatagaaagct

SEQ ID NO: 7763228 - DNA, 22 bp, Homo sapiens
acaacatcagctgagaccttca

SEQ ID NO: 7763229 - DNA, 22 bp, Homo sapiens
acaacattcttaaatacactga

SEQ ID NO: 7763230 - DNA, 22 bp, Homo sapiens
agatgctgaattattgtgcttt

SEQ ID NO: 7763231 - DNA, 22 bp, Homo sapiens
agatgctggatggaaaatgatc

SEQ ID NO: 7763232 - DNA, 22 bp, Homo sapiens
acaacagtagcctttacaaggc

SEQ ID NO: 7763233 - DNA, 22 bp, Homo sapiens
acaacagtaggaaaacatgtct

SEQ ID NO: 7763234 - DNA, 22 bp, Homo sapiens
acaacagtaggaaaacatgtct

SEQ ID NO: 7763235 - DNA, 22 bp, Homo sapiens
agatgcagtggttaacaataca

SEQ ID NO: 7763236 - DNA, 22 bp, Homo sapiens
agagttctctctcatttgagct

SEQ ID NO: 7763237 - DNA, 22 bp, Homo sapiens
acaaagtcctggtgtatggcca

SEQ ID NO: 7763238 - DNA, 22 bp, Homo sapiens
acaaagtatttttaggtttgta

SEQ ID NO: 7763239 - DNA, 22 bp, Homo sapiens
acaaatagaaaatctggattgg

SEQ ID NO: 7763240 - DNA, 16 bp, Homo sapiens
acaaatacaactgctg

SEQ ID NO: 7763241 - DNA, 22 bp, Homo sapiens
acaaataggtagatttgcaaca

SEQ ID NO: 7763242 - DNA, 22 bp, Homo sapiens
aatttgattcagcaaatgttca

SEQ ID NO: 7763243 - DNA, 22 bp, Homo sapiens
aatttgacccatcttggaattt

SEQ ID NO: 7763244 - DNA, 22 bp, Homo sapiens
aatttgattccctgcacctgtt

SEQ ID NO: 7763245 - DNA, 22 bp, Homo sapiens
aatttcttcagctctaaaatgg

SEQ ID NO: 7763246 - DNA, 22 bp, Homo sapiens
aatttcttcagctctaaaatgg

SEQ ID NO: 7763247 - DNA, 22 bp, Homo sapiens
aatttctgtatgaatagagaaa

SEQ ID NO: 7763248 - DNA, 22 bp, Homo sapiens
agagtgtaccaaatatcctaca

SEQ ID NO: 7763249 - DNA, 22 bp, Homo sapiens
aattaatatttgtggaattaat

SEQ ID NO: 7763250 - DNA, 23 bp, Homo sapiens
aattacaaccaagaactggaagg

SEQ ID NO: 7763251 - DNA, 22 bp, Homo sapiens
aattacaaatgtagactctcat

SEQ ID NO: 7763252 - DNA, 22 bp, Homo sapiens
agagctgcgtctattcacaatc

SEQ ID NO: 7763253 - DNA, 22 bp, Homo sapiens
agagctggaagctgctcttaga

SEQ ID NO: 7763254 - DNA, 22 bp, Homo sapiens
aattcatatggatatgctagta

SEQ ID NO: 7763255 - DNA, 22 bp, Homo sapiens
aattcatagcaacaaagaccca

SEQ ID NO: 7763256 - DNA, 22 bp, Homo sapiens
aattcattgccagaatctatga

SEQ ID NO: 7763257 - DNA, 22 bp, Homo sapiens
agaggaggtccttttctgatgt

SEQ ID NO: 7763258 - DNA, 22 bp, Homo sapiens
agaggatgattttaaggacact

SEQ ID NO: 7763259 - DNA, 18 bp, Homo sapiens
aatttccatatgaattgc

SEQ ID NO: 7763260 - DNA, 22 bp, Homo sapiens
agaggaagtaatcaggacctgc

SEQ ID NO: 7763261 - DNA, 22 bp, Homo sapiens
agaggaagtaatcaggacctgc

SEQ ID NO: 7763262 - DNA, 21 bp, Homo sapiens
agaggaagtgattggtctggc

SEQ ID NO: 7763263 - DNA, 22 bp, Homo sapiens
agaggaaggatgcatatccaaa

SEQ ID NO: 7763264 - DNA, 22 bp, Homo sapiens
agaggaaggatgcatatccaaa

SEQ ID NO: 7763265 - DNA, 22 bp, Homo sapiens
agagaagggcctgtatgtaatc

SEQ ID NO: 7763266 - DNA, 22 bp, Homo sapiens
agagaaatttccctgccttctg

SEQ ID NO: 7763267 - DNA, 22 bp, Homo sapiens
aatgtgtcccttatttcacagg

SEQ ID NO: 7763268 - DNA, 22 bp, Homo sapiens
agagcaagtgacagaaacaggg

SEQ ID NO: 7763269 - DNA, 23 bp, Homo sapiens
agagcaaggaaatgaggtgtgat

SEQ ID NO: 7763270 - DNA, 22 bp, Homo sapiens
agagcaattagcttaggtaaaa

SEQ ID NO: 7763271 - DNA, 23 bp, Homo sapiens
agagcaaggaaatgaggtgtgat

SEQ ID NO: 7763272 - DNA, 22 bp, Homo sapiens
aatgctctctgccatagctaac

SEQ ID NO: 7763273 - DNA, 22 bp, Homo sapiens
aatgctctgtctctgacagtgg

SEQ ID NO: 7763274 - DNA, 22 bp, Homo sapiens
aatgctctttaacctattctga

SEQ ID NO: 7763275 - DNA, 22 bp, Homo sapiens
aatgccttgcctgctacaactt

SEQ ID NO: 7763276 - DNA, 22 bp, Homo sapiens
agacatcatgttacagattaag

SEQ ID NO: 7763277 - DNA, 22 bp, Homo sapiens
aatgtataaccataggaaattt

SEQ ID NO: 7763278 - DNA, 22 bp, Homo sapiens
aatgtataaccataggaaattt

SEQ ID NO: 7763279 - DNA, 22 bp, Homo sapiens
agacatttatgtttctctagga

SEQ ID NO: 7763280 - DNA, 22 bp, Homo sapiens
aatgtatgtgcatcatttacat

SEQ ID NO: 7763281 - DNA, 21 bp, Homo sapiens
aatgtatgtttatctcacagt

SEQ ID NO: 7763282 - DNA, 22 bp, Homo sapiens
aatgtattatacataatttgtg

SEQ ID NO: 7763283 - DNA, 20 bp, Homo sapiens
aataaaagaagccttcaccc

SEQ ID NO: 7763284 - DNA, 21 bp, Homo sapiens
aataaaacagttggtgtcaat

SEQ ID NO: 7763285 - DNA, 22 bp, Homo sapiens
aataaaatgaactggtagagtt

SEQ ID NO: 7763286 - DNA, 22 bp, Homo sapiens
actgggaggcatctggagctga

SEQ ID NO: 7763287 - DNA, 22 bp, Homo sapiens
actggctgagtttatgttcaca

SEQ ID NO: 7763288 - DNA, 22 bp, Homo sapiens
actggctgatatggctaggaag

SEQ ID NO: 7763289 - DNA, 22 bp, Homo sapiens
actggctgagtttatgttcaca

SEQ ID NO: 7763290 - DNA, 22 bp, Homo sapiens
actggctgatatggctaggaag

SEQ ID NO: 7763291 - DNA, 22 bp, Homo sapiens
actgggagttctccatgtccct

SEQ ID NO: 7763292 - DNA, 22 bp, Homo sapiens
actgggagtcatgaggaaggag

SEQ ID NO: 7763293 - DNA, 22 bp, Homo sapiens
actgggagggtcttgaagaggg

SEQ ID NO: 7763294 - DNA, 23 bp, Homo sapiens
aataaggccaaactatctggtct

SEQ ID NO: 7763295 - DNA, 23 bp, Homo sapiens
aataaggccaaactatctggtct

SEQ ID NO: 7763296 - DNA, 22 bp, Homo sapiens
aataataagatactaagggagt

SEQ ID NO: 7763297 - DNA, 22 bp, Homo sapiens
aataatacatgagattaatgtt

SEQ ID NO: 7763298 - DNA, 22 bp, Homo sapiens
aataatacatgagattaatgtt

SEQ ID NO: 7763299 - DNA, 22 bp, Homo sapiens
aataatacatgagattaatgtt

SEQ ID NO: 7763300 - DNA, 22 bp, Homo sapiens
aataatacatgagattaatgtt

SEQ ID NO: 7763301 - DNA, 22 bp, Homo sapiens
aataatagcagagtttacaatc

SEQ ID NO: 7763302 - DNA, 22 bp, Homo sapiens
aataatagcagagtttacaatc

SEQ ID NO: 7763303 - DNA, 22 bp, Homo sapiens
aataatacttcgtaaagttgtt

SEQ ID NO: 7763304 - DNA, 22 bp, Homo sapiens
aatagaatgtaatctaatacat

SEQ ID NO: 7763305 - DNA, 22 bp, Homo sapiens
actgtctcctcatcatgcctgg

SEQ ID NO: 7763306 - DNA, 22 bp, Homo sapiens
aatagcaaagttatcaaattaa

SEQ ID NO: 7763307 - DNA, 22 bp, Homo sapiens
aatagcaattacccttcaactc

SEQ ID NO: 7763308 - DNA, 22 bp, Homo sapiens
aatagcacctgaggtagtttgt

SEQ ID NO: 7763309 - DNA, 22 bp, Homo sapiens
aatagcacttcctgaacacatt

SEQ ID NO: 7763310 - DNA, 22 bp, Homo sapiens
acctgcctctaagcagcaggtg

SEQ ID NO: 7763311 - DNA, 22 bp, Homo sapiens
acctgcctctaagcagcaggtg

SEQ ID NO: 7763312 - DNA, 22 bp, Homo sapiens
aagtgggtcagggacagatctt

SEQ ID NO: 7763313 - DNA, 22 bp, Homo sapiens
acctgcctcagtgcagctggat

SEQ ID NO: 7763314 - DNA, 22 bp, Homo sapiens
acctgcctcagtgcagctggat

SEQ ID NO: 7763315 - DNA, 22 bp, Homo sapiens
aagtgtcttctgatggggtgtg

SEQ ID NO: 7763316 - DNA, 22 bp, Homo sapiens
acctgcctctaagcagcaggtg

SEQ ID NO: 7763317 - DNA, 22 bp, Homo sapiens
aagtgtgggactagggctccag

SEQ ID NO: 7763318 - DNA, 20 bp, Homo sapiens
actcttgagaaattctctgt

SEQ ID NO: 7763319 - DNA, 22 bp, Homo sapiens
actcttggccactcttggtgtc

SEQ ID NO: 7763320 - DNA, 22 bp, Homo sapiens
actcttgattgatttagtcttt

SEQ ID NO: 7763321 - DNA, 22 bp, Homo sapiens
aagtgtttacttaaagtcatgg

SEQ ID NO: 7763322 - DNA, 22 bp, Homo sapiens
aagtgtttacttaaagtcatgg

SEQ ID NO: 7763323 - DNA, 22 bp, Homo sapiens
actgaaaaagtatgattcactg

SEQ ID NO: 7763324 - DNA, 22 bp, Homo sapiens
aagttcacagaagattccaatt

SEQ ID NO: 7763325 - DNA, 22 bp, Homo sapiens
aagttcaatcagatgaaaaagc

SEQ ID NO: 7763326 - DNA, 22 bp, Homo sapiens
actgcagctggtggtggctctg

SEQ ID NO: 7763327 - DNA, 22 bp, Homo sapiens
actgcagcctttgggctcataa

SEQ ID NO: 7763328 - DNA, 22 bp, Homo sapiens
actgcactccagcctgggtgac

SEQ ID NO: 7763329 - DNA, 22 bp, Homo sapiens
actgcagccttgaactctgggc

SEQ ID NO: 7763330 - DNA, 22 bp, Homo sapiens
agaacttaggaacaacagctta

SEQ ID NO: 7763331 - DNA, 22 bp, Homo sapiens
agaacttacattatagagctgt

SEQ ID NO: 7763332 - DNA, 22 bp, Homo sapiens
agaactatacattactcattga

SEQ ID NO: 7763333 - DNA, 22 bp, Homo sapiens
agaagcagctttcaaggtgatt

SEQ ID NO: 7763334 - DNA, 22 bp, Homo sapiens
agaagccactggaggttgagat

SEQ ID NO: 7763335 - DNA, 22 bp, Homo sapiens
agaaggaaggaagcattctgtt

SEQ ID NO: 7763336 - DNA, 22 bp, Homo sapiens
agaaggaagccaggagggtgca

SEQ ID NO: 7763337 - DNA, 22 bp, Homo sapiens
agaagccagcttcagctgcccg

SEQ ID NO: 7763338 - DNA, 22 bp, Homo sapiens
agaagccagccttgcctccttt

SEQ ID NO: 7763339 - DNA, 22 bp, Homo sapiens
aatgccaatgggcagaactaga

SEQ ID NO: 7763340 - DNA, 22 bp, Homo sapiens
aatgccagtgtgttgattccag

SEQ ID NO: 7763341 - DNA, 22 bp, Homo sapiens
aatgccaatattcatttgtgtt

SEQ ID NO: 7763342 - DNA, 22 bp, Homo sapiens
aatgccaacttggatatacatt

SEQ ID NO: 7763343 - DNA, 22 bp, Homo sapiens
actttgttttcatgaaacagct

SEQ ID NO: 7763344 - DNA, 22 bp, Homo sapiens
actttgtttggctattagagtc

SEQ ID NO: 7763345 - DNA, 22 bp, Homo sapiens
aatcaagagttgtgtaatattt

SEQ ID NO: 7763346 - DNA, 22 bp, Homo sapiens
aatcaagtattttccagtggca

SEQ ID NO: 7763347 - DNA, 22 bp, Homo sapiens
aatcaagtcaaccatcatgtgc

SEQ ID NO: 7763348 - DNA, 22 bp, Homo sapiens
acttttaaggggccttgattta

SEQ ID NO: 7763349 - DNA, 22 bp, Homo sapiens
acttttatgataatcaatgttc

SEQ ID NO: 7763350 - DNA, 22 bp, Homo sapiens
acttttatgataatcaatgttc

SEQ ID NO: 7763351 - DNA, 22 bp, Homo sapiens
aatagcttatgggatagatgtt

SEQ ID NO: 7763352 - DNA, 22 bp, Homo sapiens
aatagcttagtcctgattctgt

SEQ ID NO: 7763353 - DNA, 22 bp, Homo sapiens
aatagcatgttcatgataaaat

SEQ ID NO: 7763354 - DNA, 22 bp, Homo sapiens
aatagctcactgatttctcttt

SEQ ID NO: 7763355 - DNA, 22 bp, Homo sapiens
aatagtacaatctacagacata

SEQ ID NO: 7763356 - DNA, 22 bp, Homo sapiens
aatagtacaatctacagacata

SEQ ID NO: 7763357 - DNA, 22 bp, Homo sapiens
aatagtaaaagatacagctaat

SEQ ID NO: 7763358 - DNA, 22 bp, Homo sapiens
aataggaagcaccaaattctcc

SEQ ID NO: 7763359 - DNA, 22 bp, Homo sapiens
aataggactttggtcctagctc

SEQ ID NO: 7763360 - DNA, 22 bp, Homo sapiens
aatctaacttcatagctgattt

SEQ ID NO: 7763361 - DNA, 22 bp, Homo sapiens
aatctacatgcaatatttttag

SEQ ID NO: 7763362 - DNA, 22 bp, Homo sapiens
aatctacatagagatcaaatga

SEQ ID NO: 7763363 - DNA, 22 bp, Homo sapiens
aatctaagccaccagtagtttc

SEQ ID NO: 7763364 - DNA, 22 bp, Homo sapiens
aatctaaggacttagcattgct

SEQ ID NO: 7763365 - DNA, 22 bp, Homo sapiens
aatctagagtgctaggtctgtg

SEQ ID NO: 7763366 - DNA, 22 bp, Homo sapiens
aatctagattcggatcaaaggg

SEQ ID NO: 7763367 - DNA, 22 bp, Homo sapiens
aatcacaaatttagacagagct

SEQ ID NO: 7763368 - DNA, 22 bp, Homo sapiens
aatcacaattacttttgcacca

SEQ ID NO: 7763369 - DNA, 22 bp, Homo sapiens
aatcacagagtccagcagatga

SEQ ID NO: 7763370 - DNA, 22 bp, Homo sapiens
aatcacagccacaacctggggg

SEQ ID NO: 7763371 - DNA, 20 bp, Homo sapiens
aatcacagttaactctttct

SEQ ID NO: 7763372 - DNA, 22 bp, Homo sapiens
aatcacagtgggtactagattg

SEQ ID NO: 7763373 - DNA, 22 bp, Homo sapiens
aatcacatcactgagaatgagg

SEQ ID NO: 7763374 - DNA, 22 bp, Homo sapiens
agaaagctggagtcaagcagag

SEQ ID NO: 7763375 - DNA, 22 bp, Homo sapiens
aatcacatctcattcaacagcc

SEQ ID NO: 7763376 - DNA, 22 bp, Homo sapiens
agaaactgacaggaaatgaatt

SEQ ID NO: 7763377 - DNA, 22 bp, Homo sapiens
agaaaggaggaagaatgacctc

SEQ ID NO: 7763378 - DNA, 22 bp, Homo sapiens
acatccattttgttcaaaagca

SEQ ID NO: 7763379 - DNA, 22 bp, Homo sapiens
aaggccagccctaatgatgctc

SEQ ID NO: 7763380 - DNA, 22 bp, Homo sapiens
aaggccagattcactttacaat

SEQ ID NO: 7763381 - DNA, 22 bp, Homo sapiens
aaggccagagttgaactgctcc

SEQ ID NO: 7763382 - DNA, 22 bp, Homo sapiens
aaggccagattctctctagggg

SEQ ID NO: 7763383 - DNA, 22 bp, Homo sapiens
aaggcacatgacctaggcctgg

SEQ ID NO: 7763384 - DNA, 22 bp, Homo sapiens
aaggcaccataggcaaatccag

SEQ ID NO: 7763385 - DNA, 22 bp, Homo sapiens
aaggcattgagcagttacagta

SEQ ID NO: 7763386 - DNA, 22 bp, Homo sapiens
aaggccagagcgtgtcctgcct

SEQ ID NO: 7763387 - DNA, 22 bp, Homo sapiens
aaggccagagtactagaggctg

SEQ ID NO: 7763388 - DNA, 18 bp, Homo sapiens
aaggcacaggagaacatt

SEQ ID NO: 7763389 - DNA, 22 bp, Homo sapiens
aaggcacagccacttgatcatc

SEQ ID NO: 7763390 - DNA, 17 bp, Homo sapiens
aaggcacagggcactgg

SEQ ID NO: 7763391 - DNA, 22 bp, Homo sapiens
aaggcacagaggcagggcactt

SEQ ID NO: 7763392 - DNA, 22 bp, Homo sapiens
aaggcacagaggcagggcactt

SEQ ID NO: 7763393 - DNA, 22 bp, Homo sapiens
aaggcacacagttagatagagc

SEQ ID NO: 7763394 - DNA, 22 bp, Homo sapiens
aaggcaatgttagcaacataat

SEQ ID NO: 7763395 - DNA, 22 bp, Homo sapiens
aaggcaaggcttccagctcccc

SEQ ID NO: 7763396 - DNA, 22 bp, Homo sapiens
aaggcaagttttagttttctgg

SEQ ID NO: 7763397 - DNA, 22 bp, Homo sapiens
acatgaatgaagactttacaat

SEQ ID NO: 7763398 - DNA, 22 bp, Homo sapiens
acatctcaaattccaggctcca

SEQ ID NO: 7763399 - DNA, 22 bp, Homo sapiens
acatcctcccgatctactggct

SEQ ID NO: 7763400 - DNA, 22 bp, Homo sapiens
acatcctcccgatctactggct

SEQ ID NO: 7763401 - DNA, 21 bp, Homo sapiens
acatgcatagagagatttctg

SEQ ID NO: 7763402 - DNA, 22 bp, Homo sapiens
acatgcatggagggaaaatgtc

SEQ ID NO: 7763403 - DNA, 22 bp, Homo sapiens
acatgacatagtagaaaagccc

SEQ ID NO: 7763404 - DNA, 22 bp, Homo sapiens
acatgacagtgcttagcaaact

SEQ ID NO: 7763405 - DNA, 22 bp, Homo sapiens
acatgacagtgactttataaga

SEQ ID NO: 7763406 - DNA, 22 bp, Homo sapiens
acatgacaaaatgcacaggatt

SEQ ID NO: 7763407 - DNA, 22 bp, Homo sapiens
aaggaagcagcaatgcatgatt

SEQ ID NO: 7763408 - DNA, 22 bp, Homo sapiens
aaggaagggaaatagtgatgtc

SEQ ID NO: 7763409 - DNA, 22 bp, Homo sapiens
aaggaaggaattgatcatgcgc

SEQ ID NO: 7763410 - DNA, 22 bp, Homo sapiens
aaggaaggtactcagtgattct

SEQ ID NO: 7763411 - DNA, 22 bp, Homo sapiens
aaggaaggtactcagtgattct

SEQ ID NO: 7763412 - DNA, 22 bp, Homo sapiens
aaggaaggttcatagtcaaaga

SEQ ID NO: 7763413 - DNA, 22 bp, Homo sapiens
aaggaaggttcatagtcaaaga

SEQ ID NO: 7763414 - DNA, 22 bp, Homo sapiens
aaggacaaagcagagctggatg

SEQ ID NO: 7763415 - DNA, 19 bp, Homo sapiens
aaggaatggctttaagtag

SEQ ID NO: 7763416 - DNA, 22 bp, Homo sapiens
aaggaatcacttctttaaatga

SEQ ID NO: 7763417 - DNA, 22 bp, Homo sapiens
aaggacagagagccattccaga

SEQ ID NO: 7763418 - DNA, 22 bp, Homo sapiens
aaggacagaaacagattgctgg

SEQ ID NO: 7763419 - DNA, 22 bp, Homo sapiens
aaggacaggagaaaacgggatc

SEQ ID NO: 7763420 - DNA, 22 bp, Homo sapiens
aagcttcttagaatgcatgtgc

SEQ ID NO: 7763421 - DNA, 22 bp, Homo sapiens
aagctgtttttaggtggaggta

SEQ ID NO: 7763422 - DNA, 22 bp, Homo sapiens
aagcttcaatgagataattgtt

SEQ ID NO: 7763423 - DNA, 22 bp, Homo sapiens
aagctgttatcttctggcggac

SEQ ID NO: 7763424 - DNA, 22 bp, Homo sapiens
aagctgttagggagtggtaggt

SEQ ID NO: 7763425 - DNA, 22 bp, Homo sapiens
aagctgttctccagtgactcag

SEQ ID NO: 7763426 - DNA, 22 bp, Homo sapiens
aagctgtgtgcagatgatctca

SEQ ID NO: 7763427 - DNA, 21 bp, Homo sapiens
aagctgtgttccactgatagc

SEQ ID NO: 7763428 - DNA, 22 bp, Homo sapiens
aagctggagagtttcacagatg

SEQ ID NO: 7763429 - DNA, 22 bp, Homo sapiens
acagctggaggccccattgtcc

SEQ ID NO: 7763430 - DNA, 22 bp, Homo sapiens
acagctggaggtctgtgagcac

SEQ ID NO: 7763431 - DNA, 22 bp, Homo sapiens
acctgcctatggagccacatgg

SEQ ID NO: 7763432 - DNA, 22 bp, Homo sapiens
acctgcctatggagccacatgg

SEQ ID NO: 7763433 - DNA, 22 bp, Homo sapiens
acctgcctatcagctgcctgct

SEQ ID NO: 7763434 - DNA, 22 bp, Homo sapiens
acctgcctatcagctgcctgct

SEQ ID NO: 7763435 - DNA, 22 bp, Homo sapiens
acctgcctagttggttctgccc

SEQ ID NO: 7763436 - DNA, 22 bp, Homo sapiens
acctgcctagttggttctgccc

SEQ ID NO: 7763437 - DNA, 22 bp, Homo sapiens
aagtcctgttcctcatacttcc

SEQ ID NO: 7763438 - DNA, 18 bp, Homo sapiens
aagtccttcctttgcttt

SEQ ID NO: 7763439 - DNA, 22 bp, Homo sapiens
aagtcctgtgtgcttacacttg

SEQ ID NO: 7763440 - DNA, 22 bp, Homo sapiens
aagtcctgtgctagagacacct

SEQ ID NO: 7763441 - DNA, 22 bp, Homo sapiens
aagtcctgggtgagaactgtcc

SEQ ID NO: 7763442 - DNA, 22 bp, Homo sapiens
aagtcctgggcatttgaacagg

SEQ ID NO: 7763443 - DNA, 22 bp, Homo sapiens
aagtcctggatattaaattgat

SEQ ID NO: 7763444 - DNA, 22 bp, Homo sapiens
aagtcctgccagcaaatgtata

SEQ ID NO: 7763445 - DNA, 22 bp, Homo sapiens
aagtcctgccacctataagcct

SEQ ID NO: 7763446 - DNA, 22 bp, Homo sapiens
aagtcctgagaccagaaaatgg

SEQ ID NO: 7763447 - DNA, 22 bp, Homo sapiens
aagtcctgaaacttctttctga

SEQ ID NO: 7763448 - DNA, 20 bp, Homo sapiens
aagtcctgacctagtctaaa

SEQ ID NO: 7763449 - DNA, 22 bp, Homo sapiens
aagtcctgaagacacagaaaag

SEQ ID NO: 7763450 - DNA, 17 bp, Homo sapiens
aagtcccagctaacaca

SEQ ID NO: 7763451 - DNA, 22 bp, Homo sapiens
aagtcatagtctaacccagcca

SEQ ID NO: 7763452 - DNA, 22 bp, Homo sapiens
aagtccatgatcaagatgtggc

SEQ ID NO: 7763453 - DNA, 22 bp, Homo sapiens
aagtcatagtcgggaaagacat

SEQ ID NO: 7763454 - DNA, 22 bp, Homo sapiens
aagtcatagtcgggaaagacat

SEQ ID NO: 7763455 - DNA, 22 bp, Homo sapiens
acccagggtagaacctcagagc

SEQ ID NO: 7763456 - DNA, 22 bp, Homo sapiens
acccaggccattggcaagagtc

SEQ ID NO: 7763457 - DNA, 22 bp, Homo sapiens
acccaggccattggcaagagtc

SEQ ID NO: 7763458 - DNA, 22 bp, Homo sapiens
acccagggctcaagcgtaggca

SEQ ID NO: 7763459 - DNA, 21 bp, Homo sapiens
acccaggggaagcagaaactg

SEQ ID NO: 7763460 - DNA, 20 bp, Homo sapiens
acctcctggaagcaggtgcc

SEQ ID NO: 7763461 - DNA, 22 bp, Homo sapiens
acctcctggcttatcatggaca

SEQ ID NO: 7763462 - DNA, 22 bp, Homo sapiens
acctcctggtgcccaagtgttt

SEQ ID NO: 7763463 - DNA, 22 bp, Homo sapiens
acctctcaggtcttcctcatat

SEQ ID NO: 7763464 - DNA, 22 bp, Homo sapiens
acctcctggctgctcatggaac

SEQ ID NO: 7763465 - DNA, 22 bp, Homo sapiens
acctctggacactgcatccttc

SEQ ID NO: 7763466 - DNA, 22 bp, Homo sapiens
aagggcagaatagagaagatgg

SEQ ID NO: 7763467 - DNA, 20 bp, Homo sapiens
aagggagaataatgattgta

SEQ ID NO: 7763468 - DNA, 22 bp, Homo sapiens
acatttcagatgtaatgtgatg

SEQ ID NO: 7763469 - DNA, 20 bp, Homo sapiens
aagggcagagggaacagact

SEQ ID NO: 7763470 - DNA, 22 bp, Homo sapiens
acatttcagcgtgcatgacatg

SEQ ID NO: 7763471 - DNA, 22 bp, Homo sapiens
acatttcagtgagctattgaag

SEQ ID NO: 7763472 - DNA, 22 bp, Homo sapiens
aagggtcttagaggttcatttt

SEQ ID NO: 7763473 - DNA, 22 bp, Homo sapiens
acccaggcagcaggagctaaag

SEQ ID NO: 7763474 - DNA, 22 bp, Homo sapiens
aaggtaatccataatagttact

SEQ ID NO: 7763475 - DNA, 22 bp, Homo sapiens
aagggggcacagtcactgtaat

SEQ ID NO: 7763476 - DNA, 22 bp, Homo sapiens
aagggggcccagcactaagttg

SEQ ID NO: 7763477 - DNA, 22 bp, Homo sapiens
aagggggccacacctggtgtga

SEQ ID NO: 7763478 - DNA, 22 bp, Homo sapiens
aagggggcggcagccagtggaa

SEQ ID NO: 7763479 - DNA, 22 bp, Homo sapiens
aagggggcgaagacgtgattga

SEQ ID NO: 7763480 - DNA, 22 bp, Homo sapiens
tattgacagtgactattggtag

SEQ ID NO: 7763481 - DNA, 22 bp, Homo sapiens
tattgacatttttatagcttga

SEQ ID NO: 7763482 - DNA, 21 bp, Homo sapiens
tatttattaatttgtaaggct

SEQ ID NO: 7763483 - DNA, 22 bp, Homo sapiens
tatttattcattcagcaagcat

SEQ ID NO: 7763484 - DNA, 22 bp, Homo sapiens
tatttattcattcagcaagcat

SEQ ID NO: 7763485 - DNA, 22 bp, Homo sapiens
tatttattctttgtactgcctt

SEQ ID NO: 7763486 - DNA, 22 bp, Homo sapiens
tatttattggacagtgttgctg

SEQ ID NO: 7763487 - DNA, 22 bp, Homo sapiens
tatttattggacagtgttgctg

SEQ ID NO: 7763488 - DNA, 22 bp, Homo sapiens
tatttattggacagtgttgctg

SEQ ID NO: 7763489 - DNA, 22 bp, Homo sapiens
tatttctcttcaaaattgatgt

SEQ ID NO: 7763490 - DNA, 22 bp, Homo sapiens
tatttctgagaaccaacttacc

SEQ ID NO: 7763491 - DNA, 22 bp, Homo sapiens
tatttctgaatccaaaaggtca

SEQ ID NO: 7763492 - DNA, 22 bp, Homo sapiens
tatttctctttgtagggatata

SEQ ID NO: 7763493 - DNA, 22 bp, Homo sapiens
tatttctattccccaggcaagt

SEQ ID NO: 7763494 - DNA, 22 bp, Homo sapiens
tattcttgactgcttactatgt

SEQ ID NO: 7763495 - DNA, 22 bp, Homo sapiens
tattcttactctcgactgcatt

SEQ ID NO: 7763496 - DNA, 22 bp, Homo sapiens
tattctgtgtgatatgtaaatg

SEQ ID NO: 7763497 - DNA, 22 bp, Homo sapiens
tattcaaagtaccttcattgcc

SEQ ID NO: 7763498 - DNA, 22 bp, Homo sapiens
tattcaaagtaccttcattgcc

SEQ ID NO: 7763499 - DNA, 22 bp, Homo sapiens
tattccaaaatcccaaactgcc

SEQ ID NO: 7763500 - DNA, 22 bp, Homo sapiens
tattccttggcaaaaaatatat

SEQ ID NO: 7763501 - DNA, 22 bp, Homo sapiens
tattattatagttattgggaag

SEQ ID NO: 7763502 - DNA, 22 bp, Homo sapiens
tattattaaatggcagaatttt

SEQ ID NO: 7763503 - DNA, 22 bp, Homo sapiens
tattattaaatggcagaatttt

SEQ ID NO: 7763504 - DNA, 22 bp, Homo sapiens
tattattgaatcagttctttga

SEQ ID NO: 7763505 - DNA, 22 bp, Homo sapiens
tattattgacatttacttggtg

SEQ ID NO: 7763506 - DNA, 22 bp, Homo sapiens
tattattgactattcagaatgt

SEQ ID NO: 7763507 - DNA, 22 bp, Homo sapiens
tattattgcaagtatataaagt

SEQ ID NO: 7763508 - DNA, 22 bp, Homo sapiens
tattacatccacttttattgca

SEQ ID NO: 7763509 - DNA, 22 bp, Homo sapiens
tattagaaagcttaatatcgtg

SEQ ID NO: 7763510 - DNA, 22 bp, Homo sapiens
tattagatttgtttctgtagat

SEQ ID NO: 7763511 - DNA, 22 bp, Homo sapiens
tatgtgaccttctgaatgagta

SEQ ID NO: 7763512 - DNA, 22 bp, Homo sapiens
tatgtacataacatgaaatgca

SEQ ID NO: 7763513 - DNA, 22 bp, Homo sapiens
tatgtacagtccttaacttaaa

SEQ ID NO: 7763514 - DNA, 22 bp, Homo sapiens
tatgtacacatacacttgtaat

SEQ ID NO: 7763515 - DNA, 22 bp, Homo sapiens
tatgagatactacagattgtga

SEQ ID NO: 7763516 - DNA, 22 bp, Homo sapiens
tatgagataaatggtgccccct

SEQ ID NO: 7763517 - DNA, 22 bp, Homo sapiens
tatgagaatctgcagtatgctt

SEQ ID NO: 7763518 - DNA, 22 bp, Homo sapiens
tatgagatttggattcagtgaa

SEQ ID NO: 7763519 - DNA, 22 bp, Homo sapiens
tatgagatcccttttcctagag

SEQ ID NO: 7763520 - DNA, 20 bp, Homo sapiens
tatgagatttgacctcaaca

SEQ ID NO: 7763521 - DNA, 21 bp, Homo sapiens
tatgagatatacttattcttt

SEQ ID NO: 7763522 - DNA, 22 bp, Homo sapiens
tatgagatattcccagcgtcta

SEQ ID NO: 7763523 - DNA, 19 bp, Homo sapiens
tatgagctgacaaaggcct

SEQ ID NO: 7763524 - DNA, 19 bp, Homo sapiens
tatgacaagtactagttct

SEQ ID NO: 7763525 - DNA, 19 bp, Homo sapiens
tatgacaagtactagttct

SEQ ID NO: 7763526 - DNA, 19 bp, Homo sapiens
tatgacaagtactagttct

SEQ ID NO: 7763527 - DNA, 22 bp, Homo sapiens
tatgagaagaacaggtgacttt

SEQ ID NO: 7763528 - DNA, 22 bp, Homo sapiens
tatgagaactgacagagtgcca

SEQ ID NO: 7763529 - DNA, 22 bp, Homo sapiens
tatgagaaggtatggtgacttg

SEQ ID NO: 7763530 - DNA, 22 bp, Homo sapiens
tatgagaaattgctgatatttg

SEQ ID NO: 7763531 - DNA, 22 bp, Homo sapiens
tatgagaaaggagaatgacttt

SEQ ID NO: 7763532 - DNA, 22 bp, Homo sapiens
tatgacttatttcatcagttct

SEQ ID NO: 7763533 - DNA, 22 bp, Homo sapiens
tatgacatttctctgatttgtg

SEQ ID NO: 7763534 - DNA, 22 bp, Homo sapiens
tatccatagtttatagatcaag

SEQ ID NO: 7763535 - DNA, 22 bp, Homo sapiens
tatccaaagtggcatattatag

SEQ ID NO: 7763536 - DNA, 22 bp, Homo sapiens
tatatctaggaaccctgagatt

SEQ ID NO: 7763537 - DNA, 22 bp, Homo sapiens
tatatattcttaagtagtgtag

SEQ ID NO: 7763538 - DNA, 21 bp, Homo sapiens
tatagtcacttgagcattatc

SEQ ID NO: 7763539 - DNA, 22 bp, Homo sapiens
tatatatatgcacacacaccta

SEQ ID NO: 7763540 - DNA, 22 bp, Homo sapiens
tatagcaattcagaatacatgt

SEQ ID NO: 7763541 - DNA, 22 bp, Homo sapiens
tatagcaattcagaatacatgt

SEQ ID NO: 7763542 - DNA, 22 bp, Homo sapiens
taggggtgaggccaggcatcag

SEQ ID NO: 7763543 - DNA, 22 bp, Homo sapiens
taggggtgtttcgagagaggtt

SEQ ID NO: 7763544 - DNA, 22 bp, Homo sapiens
tataacactcagaaagaatcat

SEQ ID NO: 7763545 - DNA, 22 bp, Homo sapiens
tataacactcagaaagaatcat

SEQ ID NO: 7763546 - DNA, 22 bp, Homo sapiens
tataacaccatgttctacagat

SEQ ID NO: 7763547 - DNA, 22 bp, Homo sapiens
tataacaccatgttctacagat

SEQ ID NO: 7763548 - DNA, 18 bp, Homo sapiens
tataacctgttttgatgg

SEQ ID NO: 7763549 - DNA, 22 bp, Homo sapiens
tataactaatactggccatgag

SEQ ID NO: 7763550 - DNA, 20 bp, Homo sapiens
tataaattcagagctttggt

SEQ ID NO: 7763551 - DNA, 22 bp, Homo sapiens
tataaatgcacttttgaaatat

SEQ ID NO: 7763552 - DNA, 22 bp, Homo sapiens
tataaagtttcgaaagatgtat

SEQ ID NO: 7763553 - DNA, 22 bp, Homo sapiens
tatacacatcctccaaagatag

SEQ ID NO: 7763554 - DNA, 22 bp, Homo sapiens
tatacacatatcttctaggcct

SEQ ID NO: 7763555 - DNA, 22 bp, Homo sapiens
tatacacatcctccaaagatag

SEQ ID NO: 7763556 - DNA, 22 bp, Homo sapiens
tatacacaggaatctgtgaaaa

SEQ ID NO: 7763557 - DNA, 17 bp, Homo sapiens
tatacacagacagactg

SEQ ID NO: 7763558 - DNA, 17 bp, Homo sapiens
tatacacagacagactg

SEQ ID NO: 7763559 - DNA, 23 bp, Homo sapiens
tatacacatgtggcagtatagtg

SEQ ID NO: 7763560 - DNA, 22 bp, Homo sapiens
tatacagaaagaattcaagtct

SEQ ID NO: 7763561 - DNA, 22 bp, Homo sapiens
tatacagaacattaagaactgt

SEQ ID NO: 7763562 - DNA, 22 bp, Homo sapiens
tatacacatttttacctatagt

SEQ ID NO: 7763563 - DNA, 22 bp, Homo sapiens
tatacacatttttacctatagt

SEQ ID NO: 7763564 - DNA, 22 bp, Homo sapiens
tatacaagtaatgctgaatgat

SEQ ID NO: 7763565 - DNA, 22 bp, Homo sapiens
tatacaatgagtacattctggg

SEQ ID NO: 7763566 - DNA, 22 bp, Homo sapiens
tatacaatgagtacattctggg

SEQ ID NO: 7763567 - DNA, 22 bp, Homo sapiens
tataatttatcatgtcacagtt

SEQ ID NO: 7763568 - DNA, 22 bp, Homo sapiens
tataattttaagtggtaaatta

SEQ ID NO: 7763569 - DNA, 22 bp, Homo sapiens
tatacacacctccaaagcagga

SEQ ID NO: 7763570 - DNA, 22 bp, Homo sapiens
tatacacacctccaaagcagga

SEQ ID NO: 7763571 - DNA, 22 bp, Homo sapiens
tatacacaaggtgtgcatttgt

SEQ ID NO: 7763572 - DNA, 22 bp, Homo sapiens
tatacaatggctgaatcatcca

SEQ ID NO: 7763573 - DNA, 22 bp, Homo sapiens
tatacaatggctgaatcatcca

SEQ ID NO: 7763574 - DNA, 22 bp, Homo sapiens
tatacaatggctgaatcatcca

SEQ ID NO: 7763575 - DNA, 21 bp, Homo sapiens
tagaggcaggagggactgcag

SEQ ID NO: 7763576 - DNA, 22 bp, Homo sapiens
tagagggaaggaagaatggatt

SEQ ID NO: 7763577 - DNA, 22 bp, Homo sapiens
tagaggcctgaaagaatgatca

SEQ ID NO: 7763578 - DNA, 22 bp, Homo sapiens
tagaggcataagagggaagcag

SEQ ID NO: 7763579 - DNA, 22 bp, Homo sapiens
tagacacatcaaggatcagttt

SEQ ID NO: 7763580 - DNA, 22 bp, Homo sapiens
tagacaatatttgaaagtagtg

SEQ ID NO: 7763581 - DNA, 22 bp, Homo sapiens
tagaaatggagaacagattaat

SEQ ID NO: 7763582 - DNA, 22 bp, Homo sapiens
tagaatgtagtgcttcaagatt

SEQ ID NO: 7763583 - DNA, 22 bp, Homo sapiens
tagaatgtggaggtaacagact

SEQ ID NO: 7763584 - DNA, 22 bp, Homo sapiens
tagaatgtgcctggaatacagt

SEQ ID NO: 7763585 - DNA, 22 bp, Homo sapiens
tagaaaggagcattttagacta

SEQ ID NO: 7763586 - DNA, 22 bp, Homo sapiens
tagaaagaacttcatgtaaaac

SEQ ID NO: 7763587 - DNA, 21 bp, Homo sapiens
tagaaagtcaaagctatcagc

SEQ ID NO: 7763588 - DNA, 22 bp, Homo sapiens
tagaaagtcatgaattacacca

SEQ ID NO: 7763589 - DNA, 22 bp, Homo sapiens
tagaaagtgaaggttaattaat

SEQ ID NO: 7763590 - DNA, 22 bp, Homo sapiens
tagaaagtcaaaacactgtgtt

SEQ ID NO: 7763591 - DNA, 22 bp, Homo sapiens
tagaaagtagggaaggtaggat

SEQ ID NO: 7763592 - DNA, 22 bp, Homo sapiens
tagaaagtaaatcagttttatt

SEQ ID NO: 7763593 - DNA, 22 bp, Homo sapiens
tagaaagtaaacacgaagtctc

SEQ ID NO: 7763594 - DNA, 22 bp, Homo sapiens
tagaaagtaaatcagttttatt

SEQ ID NO: 7763595 - DNA, 22 bp, Homo sapiens
tagaaagtactaaatttaactg

SEQ ID NO: 7763596 - DNA, 22 bp, Homo sapiens
tagaaagtagccacttacagag

SEQ ID NO: 7763597 - DNA, 22 bp, Homo sapiens
tagaaagtactaaatttaactg

SEQ ID NO: 7763598 - DNA, 22 bp, Homo sapiens
tagaaatgattggttgagctct

SEQ ID NO: 7763599 - DNA, 22 bp, Homo sapiens
tagaaatgattgagctgtaata

SEQ ID NO: 7763600 - DNA, 22 bp, Homo sapiens
tagaaatgaatgtttaaaagtc

SEQ ID NO: 7763601 - DNA, 22 bp, Homo sapiens
tagaaagtggttgagagtttag

SEQ ID NO: 7763602 - DNA, 22 bp, Homo sapiens
tagaaacattcagttgcagtcc

SEQ ID NO: 7763603 - DNA, 22 bp, Homo sapiens
tagaaacatgttctgttctgtt

SEQ ID NO: 7763604 - DNA, 22 bp, Homo sapiens
tagaaacatatgtttgagacat

SEQ ID NO: 7763605 - DNA, 22 bp, Homo sapiens
tagaaacatatgtttgagacat

SEQ ID NO: 7763606 - DNA, 22 bp, Homo sapiens
tagaaacatgagagaaactctt

SEQ ID NO: 7763607 - DNA, 22 bp, Homo sapiens
tagaaacatcagctaaccaaaa

SEQ ID NO: 7763608 - DNA, 22 bp, Homo sapiens
tagaaacctcagggaaatcttt

SEQ ID NO: 7763609 - DNA, 22 bp, Homo sapiens
tagaaaccctgccttagtagct

SEQ ID NO: 7763610 - DNA, 22 bp, Homo sapiens
tagaaacccatgtttattcagt

SEQ ID NO: 7763611 - DNA, 22 bp, Homo sapiens
tagaaacattcagttgcagtcc

SEQ ID NO: 7763612 - DNA, 22 bp, Homo sapiens
tagaaacattcagttgcagtcc

SEQ ID NO: 7763613 - DNA, 22 bp, Homo sapiens
tagaaaccatctcactgctcag

SEQ ID NO: 7763614 - DNA, 22 bp, Homo sapiens
tagaaacccaggatttgtattt

SEQ ID NO: 7763615 - DNA, 22 bp, Homo sapiens
tagaaacagaatatgagtgaga

SEQ ID NO: 7763616 - DNA, 22 bp, Homo sapiens
tagaaacacagatctggtgtca

SEQ ID NO: 7763617 - DNA, 22 bp, Homo sapiens
tagaaacaatgacatgcttgta

SEQ ID NO: 7763618 - DNA, 22 bp, Homo sapiens
tagaaaagccccagctggaggg

SEQ ID NO: 7763619 - DNA, 22 bp, Homo sapiens
tagaaacaagtttctctttggg

SEQ ID NO: 7763620 - DNA, 22 bp, Homo sapiens
tagaaacagcatatattagccc

SEQ ID NO: 7763621 - DNA, 22 bp, Homo sapiens
tagaaacagcatatattagccc

SEQ ID NO: 7763622 - DNA, 22 bp, Homo sapiens
tagaaacagatgtttttgaaga

SEQ ID NO: 7763623 - DNA, 22 bp, Homo sapiens
tactttttgtctctttgaatgt

SEQ ID NO: 7763624 - DNA, 19 bp, Homo sapiens
tactttttcaggacagagt

SEQ ID NO: 7763625 - DNA, 22 bp, Homo sapiens
tagaaaactaatacatgcttga

SEQ ID NO: 7763626 - DNA, 22 bp, Homo sapiens
tagaaaagataacattctgtgc

SEQ ID NO: 7763627 - DNA, 22 bp, Homo sapiens
tagaaaagaagtctggccggga

SEQ ID NO: 7763628 - DNA, 22 bp, Homo sapiens
tagaaaagaattttatttgata

SEQ ID NO: 7763629 - DNA, 22 bp, Homo sapiens
tactttttatgataagaactga

SEQ ID NO: 7763630 - DNA, 22 bp, Homo sapiens
tacttttcataatgaagcagca

SEQ ID NO: 7763631 - DNA, 22 bp, Homo sapiens
tacttttaaaattcacaggtat

SEQ ID NO: 7763632 - DNA, 22 bp, Homo sapiens
tacttttaaaattcacaggtat

SEQ ID NO: 7763633 - DNA, 22 bp, Homo sapiens
tacttttaaaattcacaggtat

SEQ ID NO: 7763634 - DNA, 22 bp, Homo sapiens
tactttggggacaatatggaat

SEQ ID NO: 7763635 - DNA, 22 bp, Homo sapiens
tacattttctaggggaccaaga

SEQ ID NO: 7763636 - DNA, 22 bp, Homo sapiens
taccaaaaagtgagccccagag

SEQ ID NO: 7763637 - DNA, 22 bp, Homo sapiens
taccaaaagcttgtttcataca

SEQ ID NO: 7763638 - DNA, 22 bp, Homo sapiens
taccaaaagcttgtttcataca

SEQ ID NO: 7763639 - DNA, 22 bp, Homo sapiens
tactttgataaggttcttctat

SEQ ID NO: 7763640 - DNA, 22 bp, Homo sapiens
tactttgagatgatgctgatcg

SEQ ID NO: 7763641 - DNA, 22 bp, Homo sapiens
tactttgaattaaatatttcag

SEQ ID NO: 7763642 - DNA, 19 bp, Homo sapiens
tagccctggccatcatgag

SEQ ID NO: 7763643 - DNA, 22 bp, Homo sapiens
tagctctagcactggataatcc

SEQ ID NO: 7763644 - DNA, 22 bp, Homo sapiens
tagcctctctcctccacaacct

SEQ ID NO: 7763645 - DNA, 22 bp, Homo sapiens
tagccgggtgttgtgtcatgca

SEQ ID NO: 7763646 - DNA, 22 bp, Homo sapiens
tagcagagcagggatcagagcc

SEQ ID NO: 7763647 - DNA, 22 bp, Homo sapiens
tagcagagcagggatcagagcc

SEQ ID NO: 7763648 - DNA, 22 bp, Homo sapiens
tagcagaggaaaagagaacatt

SEQ ID NO: 7763649 - DNA, 23 bp, Homo sapiens
tagcagcatttttagcctctgtc

SEQ ID NO: 7763650 - DNA, 22 bp, Homo sapiens
taggatttattctacaatattg

SEQ ID NO: 7763651 - DNA, 22 bp, Homo sapiens
taggcaagtggaccagaggttt

SEQ ID NO: 7763652 - DNA, 22 bp, Homo sapiens
tagggagaggaagcaggccgct

SEQ ID NO: 7763653 - DNA, 22 bp, Homo sapiens
tagggagatgcaagggacggag

SEQ ID NO: 7763654 - DNA, 22 bp, Homo sapiens
taggctgggcattctggccagg

SEQ ID NO: 7763655 - DNA, 22 bp, Homo sapiens
taggctgggcattctggccagg

SEQ ID NO: 7763656 - DNA, 22 bp, Homo sapiens
taggcagaaaggaaggcaagtt

SEQ ID NO: 7763657 - DNA, 22 bp, Homo sapiens
tagggaggagggttttcaaatc

SEQ ID NO: 7763658 - DNA, 22 bp, Homo sapiens
tagggcagagcttgtacacgat

SEQ ID NO: 7763659 - DNA, 22 bp, Homo sapiens
taggatttaggctttaacatct

SEQ ID NO: 7763660 - DNA, 22 bp, Homo sapiens
taggatttactttgacaatatt

SEQ ID NO: 7763661 - DNA, 22 bp, Homo sapiens
taggatggtacaaggcaggggt

SEQ ID NO: 7763662 - DNA, 22 bp, Homo sapiens
taggacagtagctggtgcacag

SEQ ID NO: 7763663 - DNA, 22 bp, Homo sapiens
taggacagttatgggttttatt

SEQ ID NO: 7763664 - DNA, 22 bp, Homo sapiens
taggacagtggagataaccaga

SEQ ID NO: 7763665 - DNA, 22 bp, Homo sapiens
taggagggttagagggaaatat

SEQ ID NO: 7763666 - DNA, 22 bp, Homo sapiens
taggagggggaacaaggcatac

SEQ ID NO: 7763667 - DNA, 22 bp, Homo sapiens
taggacagtttactttggttac

SEQ ID NO: 7763668 - DNA, 22 bp, Homo sapiens
taggagggccctgaaaatggca

SEQ ID NO: 7763669 - DNA, 22 bp, Homo sapiens
taggacaggtgaggggctgtgg

SEQ ID NO: 7763670 - DNA, 22 bp, Homo sapiens
taggaaaagtctagattgatga

SEQ ID NO: 7763671 - DNA, 22 bp, Homo sapiens
tagcttttagtacttaatggct

SEQ ID NO: 7763672 - DNA, 22 bp, Homo sapiens
tagctttgtttatcaaggggca

SEQ ID NO: 7763673 - DNA, 22 bp, Homo sapiens
tagctttgttagaatgtcttca

SEQ ID NO: 7763674 - DNA, 22 bp, Homo sapiens
tagctttgtgtcctgatttagc

SEQ ID NO: 7763675 - DNA, 16 bp, Homo sapiens
tagctttgtgttgtgg

SEQ ID NO: 7763676 - DNA, 22 bp, Homo sapiens
tagctttgtgaagtttacagac

SEQ ID NO: 7763677 - DNA, 22 bp, Homo sapiens
tagctttgtgtatgatgtctgt

SEQ ID NO: 7763678 - DNA, 22 bp, Homo sapiens
tagctttgtattatcagcattg

SEQ ID NO: 7763679 - DNA, 22 bp, Homo sapiens
tagctttgtcctccaccctcag

SEQ ID NO: 7763680 - DNA, 22 bp, Homo sapiens
tagctttagtgaaaaatatcag

SEQ ID NO: 7763681 - DNA, 22 bp, Homo sapiens
tagctttacaaagtgctgcacc

SEQ ID NO: 7763682 - DNA, 22 bp, Homo sapiens
tagctttagaaatattctcaga

SEQ ID NO: 7763683 - DNA, 22 bp, Homo sapiens
tagctttgcctgttaatcacaa

SEQ ID NO: 7763684 - DNA, 22 bp, Homo sapiens
tagctttgctggcaagcatgtc

SEQ ID NO: 7763685 - DNA, 22 bp, Homo sapiens
tagctttggattctttggggaa

SEQ ID NO: 7763686 - DNA, 22 bp, Homo sapiens
tagctttgggaatgctctcctg

SEQ ID NO: 7763687 - DNA, 22 bp, Homo sapiens
tagctttgcctgaagtaatcag

SEQ ID NO: 7763688 - DNA, 22 bp, Homo sapiens
tagctttgcccgtgctggattt

SEQ ID NO: 7763689 - DNA, 22 bp, Homo sapiens
tagctttgccatctgtcacata

SEQ ID NO: 7763690 - DNA, 22 bp, Homo sapiens
tagctttgccacacatgtagat

SEQ ID NO: 7763691 - DNA, 22 bp, Homo sapiens
tagctttgcaaaggaagtttta

SEQ ID NO: 7763692 - DNA, 22 bp, Homo sapiens
tagctttgaccaacgactggtc

SEQ ID NO: 7763693 - DNA, 22 bp, Homo sapiens
tagctttgaacttctgggctca

SEQ ID NO: 7763694 - DNA, 22 bp, Homo sapiens
tagctttgaagttatttaacag

SEQ ID NO: 7763695 - DNA, 22 bp, Homo sapiens
tagctttgacagttgcaggcag

SEQ ID NO: 7763696 - DNA, 22 bp, Homo sapiens
tacatctatctagatgctcaga

SEQ ID NO: 7763697 - DNA, 22 bp, Homo sapiens
tacatccaaagttgaggtgcct

SEQ ID NO: 7763698 - DNA, 22 bp, Homo sapiens
tacatctagccttacaattatt

SEQ ID NO: 7763699 - DNA, 22 bp, Homo sapiens
tacatcattttggagatgagca

SEQ ID NO: 7763700 - DNA, 22 bp, Homo sapiens
tacatatactgagtgatttgct

SEQ ID NO: 7763701 - DNA, 22 bp, Homo sapiens
tacatagtgttttgaagaatta

SEQ ID NO: 7763702 - DNA, 22 bp, Homo sapiens
tacatagtattcacattgtttt

SEQ ID NO: 7763703 - DNA, 16 bp, Homo sapiens
tacattctgatcactg

SEQ ID NO: 7763704 - DNA, 22 bp, Homo sapiens
tacattctgaaataaatggttt

SEQ ID NO: 7763705 - DNA, 22 bp, Homo sapiens
tacattctggaaaggcacagac

SEQ ID NO: 7763706 - DNA, 22 bp, Homo sapiens
tacattctggaaaggcacagac

SEQ ID NO: 7763707 - DNA, 22 bp, Homo sapiens
tacattctcttcccattgtctc

SEQ ID NO: 7763708 - DNA, 22 bp, Homo sapiens
tacattctatatctgttacatc

SEQ ID NO: 7763709 - DNA, 22 bp, Homo sapiens
tacattctactttttcactccc

SEQ ID NO: 7763710 - DNA, 22 bp, Homo sapiens
tacattctggtggagaaagtaa

SEQ ID NO: 7763711 - DNA, 23 bp, Homo sapiens
tacattctgtatttttatagagt

SEQ ID NO: 7763712 - DNA, 22 bp, Homo sapiens
tacatttgggacaataagagaa

SEQ ID NO: 7763713 - DNA, 22 bp, Homo sapiens
tacatttcctgtcagagatata

SEQ ID NO: 7763714 - DNA, 21 bp, Homo sapiens
tacattgactacaaataaagc

SEQ ID NO: 7763715 - DNA, 19 bp, Homo sapiens
tacatacttattctaaaag

SEQ ID NO: 7763716 - DNA, 22 bp, Homo sapiens
tacagtaataaaatgagctaca

SEQ ID NO: 7763717 - DNA, 21 bp, Homo sapiens
tacagtaagttgggtggtcct

SEQ ID NO: 7763718 - DNA, 22 bp, Homo sapiens
tacagtaatctggacatgattt

SEQ ID NO: 7763719 - DNA, 22 bp, Homo sapiens
tacagtaatgtgtccctgcagg

SEQ ID NO: 7763720 - DNA, 22 bp, Homo sapiens
tacagtaactggaattcttctt

SEQ ID NO: 7763721 - DNA, 22 bp, Homo sapiens
tacagtaagatgaaatagcaat

SEQ ID NO: 7763722 - DNA, 22 bp, Homo sapiens
tacaggcatgtagcatggtgat

SEQ ID NO: 7763723 - DNA, 17 bp, Homo sapiens
tacaggagagcaggaac

SEQ ID NO: 7763724 - DNA, 22 bp, Homo sapiens
tacaacagtaatcaaggttttt

SEQ ID NO: 7763725 - DNA, 22 bp, Homo sapiens
tacaacataacgggcattcagt

SEQ ID NO: 7763726 - DNA, 22 bp, Homo sapiens
tacagaaagggatgattgatct

SEQ ID NO: 7763727 - DNA, 22 bp, Homo sapiens
tacagaaagggatgattgatct

SEQ ID NO: 7763728 - DNA, 22 bp, Homo sapiens
tacaaagtcttgggttctaggc

SEQ ID NO: 7763729 - DNA, 22 bp, Homo sapiens
tacaaagtcccattgccatgga

SEQ ID NO: 7763730 - DNA, 22 bp, Homo sapiens
tacaaagtcccattgccatgga

SEQ ID NO: 7763731 - DNA, 22 bp, Homo sapiens
tacaaagtcagaataacaggtg

SEQ ID NO: 7763732 - DNA, 22 bp, Homo sapiens
tacaaagtgattttggaattga

SEQ ID NO: 7763733 - DNA, 22 bp, Homo sapiens
tacaaagtgagcaacctctttt

SEQ ID NO: 7763734 - DNA, 22 bp, Homo sapiens
tacaaagtgacaagctctgctg

SEQ ID NO: 7763735 - DNA, 22 bp, Homo sapiens
tacaaagtgaaataattctgag

SEQ ID NO: 7763736 - DNA, 22 bp, Homo sapiens
tacaaatcagatcatgagttta

SEQ ID NO: 7763737 - DNA, 22 bp, Homo sapiens
tacaaagttttcttggattgag

SEQ ID NO: 7763738 - DNA, 22 bp, Homo sapiens
tacaaagtttggggtcctcaaa

SEQ ID NO: 7763739 - DNA, 22 bp, Homo sapiens
tacaaagttttcttggattgag

SEQ ID NO: 7763740 - DNA, 22 bp, Homo sapiens
tacaaagtttgagaatgctttc

SEQ ID NO: 7763741 - DNA, 22 bp, Homo sapiens
tacaaagtgggaaacgaaggtt

SEQ ID NO: 7763742 - DNA, 22 bp, Homo sapiens
tacaaagtgtgcccatgctgag

SEQ ID NO: 7763743 - DNA, 22 bp, Homo sapiens
tacaaagtgctttagaaatgaa

SEQ ID NO: 7763744 - DNA, 22 bp, Homo sapiens
tacaaagtgctttagaaatgaa

SEQ ID NO: 7763745 - DNA, 22 bp, Homo sapiens
tacaacaggaatttcaactttg

SEQ ID NO: 7763746 - DNA, 21 bp, Homo sapiens
tacaacaggttttatttcgat

SEQ ID NO: 7763747 - DNA, 22 bp, Homo sapiens
tacaacaggaatttcaactttg

SEQ ID NO: 7763748 - DNA, 22 bp, Homo sapiens
tacaacagacctagatgaatga

SEQ ID NO: 7763749 - DNA, 22 bp, Homo sapiens
tacaacactggttcgacatgtg

SEQ ID NO: 7763750 - DNA, 22 bp, Homo sapiens
tacaacagaagtgtttatttag

SEQ ID NO: 7763751 - DNA, 22 bp, Homo sapiens
tacaacaatttccacattagaa

SEQ ID NO: 7763752 - DNA, 20 bp, Homo sapiens
tacaacaagtagagacatac

SEQ ID NO: 7763753 - DNA, 22 bp, Homo sapiens
tacagaaggaagtttagctaaa

SEQ ID NO: 7763754 - DNA, 22 bp, Homo sapiens
tacagagtatttttaatatggt

SEQ ID NO: 7763755 - DNA, 22 bp, Homo sapiens
tacagcaatgctacaagatgac

SEQ ID NO: 7763756 - DNA, 22 bp, Homo sapiens
tacagcaatgcctgaaatagta

SEQ ID NO: 7763757 - DNA, 22 bp, Homo sapiens
tacagcaatggttctaagagtc

SEQ ID NO: 7763758 - DNA, 23 bp, Homo sapiens
tacagcaaggacaacataggtgg

SEQ ID NO: 7763759 - DNA, 22 bp, Homo sapiens
tacagatattgtacagttatag

SEQ ID NO: 7763760 - DNA, 22 bp, Homo sapiens
tacagatattgtacagttatag

SEQ ID NO: 7763761 - DNA, 22 bp, Homo sapiens
tacagatatagagatttataga

SEQ ID NO: 7763762 - DNA, 22 bp, Homo sapiens
taatagaaaggtattttttgca

SEQ ID NO: 7763763 - DNA, 22 bp, Homo sapiens
taatagaaaggtattttttgca

SEQ ID NO: 7763764 - DNA, 22 bp, Homo sapiens
taatgtttccagtctatgatgg

SEQ ID NO: 7763765 - DNA, 22 bp, Homo sapiens
taatgtttccagtctatgatgg

SEQ ID NO: 7763766 - DNA, 22 bp, Homo sapiens
taatagcattatcatcaaaact

SEQ ID NO: 7763767 - DNA, 22 bp, Homo sapiens
taatagaatagtggaaacattg

SEQ ID NO: 7763768 - DNA, 22 bp, Homo sapiens
taatagaatagtggaaacattg

SEQ ID NO: 7763769 - DNA, 22 bp, Homo sapiens
taatagctgtgggaaataaaag

SEQ ID NO: 7763770 - DNA, 22 bp, Homo sapiens
taattacagaggtttgccagtt

SEQ ID NO: 7763771 - DNA, 22 bp, Homo sapiens
taattacaggtccaaaacaatc

SEQ ID NO: 7763772 - DNA, 22 bp, Homo sapiens
taattacaggtccaaaacaatc

SEQ ID NO: 7763773 - DNA, 22 bp, Homo sapiens
taattagagtttggtaaacaat

SEQ ID NO: 7763774 - DNA, 22 bp, Homo sapiens
taattactggaaatttcaaata

SEQ ID NO: 7763775 - DNA, 21 bp, Homo sapiens
tacaaagggaaattctggctc

SEQ ID NO: 7763776 - DNA, 22 bp, Homo sapiens
tacaaaggcggtttttctgggc

SEQ ID NO: 7763777 - DNA, 22 bp, Homo sapiens
tacaaagtaatgtataatatcg

SEQ ID NO: 7763778 - DNA, 22 bp, Homo sapiens
tacaaagtaatgtataatatcg

SEQ ID NO: 7763779 - DNA, 22 bp, Homo sapiens
tacaaagtagaaattcagtaaa

SEQ ID NO: 7763780 - DNA, 22 bp, Homo sapiens
tacaaagtatatttctagctgt

SEQ ID NO: 7763781 - DNA, 22 bp, Homo sapiens
tacaaagtcacattgaaatgaa

SEQ ID NO: 7763782 - DNA, 22 bp, Homo sapiens
tacaaagtcaccagcttcttgc

SEQ ID NO: 7763783 - DNA, 22 bp, Homo sapiens
tacaaagtcaccagcttcttgc

SEQ ID NO: 7763784 - DNA, 22 bp, Homo sapiens
tacaaaggaaacttcttttccc

SEQ ID NO: 7763785 - DNA, 22 bp, Homo sapiens
tacaaaggaaacttcttttccc

SEQ ID NO: 7763786 - DNA, 22 bp, Homo sapiens
tacaaagcttgtactgtgtgac

SEQ ID NO: 7763787 - DNA, 22 bp, Homo sapiens
tacaaagatagtgttagagtaa

SEQ ID NO: 7763788 - DNA, 22 bp, Homo sapiens
tacaaagagtttggtctctaga

SEQ ID NO: 7763789 - DNA, 22 bp, Homo sapiens
tacaaagaggtaattgcatata

SEQ ID NO: 7763790 - DNA, 22 bp, Homo sapiens
tacaaactgttattattattgt

SEQ ID NO: 7763791 - DNA, 20 bp, Homo sapiens
tacaaagaatgaggttcagg

SEQ ID NO: 7763792 - DNA, 20 bp, Homo sapiens
tacaaagagcccctctcttc

SEQ ID NO: 7763793 - DNA, 22 bp, Homo sapiens
tacaaactgtccagcccagagg

SEQ ID NO: 7763794 - DNA, 22 bp, Homo sapiens
tacaaactgtccagcccagagg

SEQ ID NO: 7763795 - DNA, 22 bp, Homo sapiens
tacaaactctttatatttcata

SEQ ID NO: 7763796 - DNA, 22 bp, Homo sapiens
tacaaactccgaagtttgtacc

SEQ ID NO: 7763797 - DNA, 22 bp, Homo sapiens
tacaaaaaattgatactgacga

SEQ ID NO: 7763798 - DNA, 18 bp, Homo sapiens
tacaaactccttgaaggc

SEQ ID NO: 7763799 - DNA, 18 bp, Homo sapiens
tacaaactccttgaaggc

SEQ ID NO: 7763800 - DNA, 22 bp, Homo sapiens
tacaaaaaattgatactgacga

SEQ ID NO: 7763801 - DNA, 22 bp, Homo sapiens
taattattatgacaacaattgc

SEQ ID NO: 7763802 - DNA, 22 bp, Homo sapiens
tacaaaaaattgatactgacga

SEQ ID NO: 7763803 - DNA, 22 bp, Homo sapiens
taaggctcatgtaattagagat

SEQ ID NO: 7763804 - DNA, 22 bp, Homo sapiens
taaggctcatgtaattagagat

SEQ ID NO: 7763805 - DNA, 22 bp, Homo sapiens
taaggctccctttgccacttgt

SEQ ID NO: 7763806 - DNA, 22 bp, Homo sapiens
taaggccaccgttatagaacca

SEQ ID NO: 7763807 - DNA, 22 bp, Homo sapiens
taaggcccgtgagtttcatatc

SEQ ID NO: 7763808 - DNA, 22 bp, Homo sapiens
taagggttcagaatgcagtggt

SEQ ID NO: 7763809 - DNA, 22 bp, Homo sapiens
taaggcaggtagatgactacgg

SEQ ID NO: 7763810 - DNA, 22 bp, Homo sapiens
taaggcaggctttcatccagag

SEQ ID NO: 7763811 - DNA, 22 bp, Homo sapiens
taaggcaggtatggtaccaggc

SEQ ID NO: 7763812 - DNA, 22 bp, Homo sapiens
taaggcaggactggatagctat

SEQ ID NO: 7763813 - DNA, 22 bp, Homo sapiens
taaggcaagtttttagtggaca

SEQ ID NO: 7763814 - DNA, 22 bp, Homo sapiens
taaggcagttttgcctgagata

SEQ ID NO: 7763815 - DNA, 22 bp, Homo sapiens
taaggcagtgagaagaaacagg

SEQ ID NO: 7763816 - DNA, 22 bp, Homo sapiens
taaggcagtgagaagaaacagg

SEQ ID NO: 7763817 - DNA, 22 bp, Homo sapiens
taaggcagtgaaactattctgt

SEQ ID NO: 7763818 - DNA, 22 bp, Homo sapiens
taaggcagtagtgtctgtaggg

SEQ ID NO: 7763819 - DNA, 19 bp, Homo sapiens
taaggccaaaagtaagtgt

SEQ ID NO: 7763820 - DNA, 22 bp, Homo sapiens
taagtaatttgtgcagagatac

SEQ ID NO: 7763821 - DNA, 22 bp, Homo sapiens
taagtaattgcagcaatttgcc

SEQ ID NO: 7763822 - DNA, 22 bp, Homo sapiens
taagtaaatttataatgtgatt

SEQ ID NO: 7763823 - DNA, 21 bp, Homo sapiens
taagtgcaaagagacagatac

SEQ ID NO: 7763824 - DNA, 22 bp, Homo sapiens
taataagtctgttgtttaattg

SEQ ID NO: 7763825 - DNA, 22 bp, Homo sapiens
taagtgtctctcgaattatgct

SEQ ID NO: 7763826 - DNA, 22 bp, Homo sapiens
taatacagggcactttgagtga

SEQ ID NO: 7763827 - DNA, 22 bp, Homo sapiens
taataatagcagtagctgccac

SEQ ID NO: 7763828 - DNA, 22 bp, Homo sapiens
taataattaacagtgatgggtc

SEQ ID NO: 7763829 - DNA, 22 bp, Homo sapiens
taataatagcagtagctgccac

SEQ ID NO: 7763830 - DNA, 22 bp, Homo sapiens
taatacatcattcatctaagga

SEQ ID NO: 7763831 - DNA, 22 bp, Homo sapiens
taatacatcattcatctaagga

SEQ ID NO: 7763832 - DNA, 22 bp, Homo sapiens
taatacctagagatgatacaaa

SEQ ID NO: 7763833 - DNA, 22 bp, Homo sapiens
taatacctggccttgatacagt

SEQ ID NO: 7763834 - DNA, 22 bp, Homo sapiens
taaattagagccaggtaagttt

SEQ ID NO: 7763835 - DNA, 22 bp, Homo sapiens
taaagtgcttcctaacccagag

SEQ ID NO: 7763836 - DNA, 22 bp, Homo sapiens
taaagtggaaggatccactaag

SEQ ID NO: 7763837 - DNA, 23 bp, Homo sapiens
taaagtggcgctgttactgccag

SEQ ID NO: 7763838 - DNA, 22 bp, Homo sapiens
taaagtgggcaaactctcatgg

SEQ ID NO: 7763839 - DNA, 22 bp, Homo sapiens
taaattagggactttagttaat

SEQ ID NO: 7763840 - DNA, 22 bp, Homo sapiens
taaattagggactttagttaat

SEQ ID NO: 7763841 - DNA, 20 bp, Homo sapiens
taaattagccttgaagatta

SEQ ID NO: 7763842 - DNA, 20 bp, Homo sapiens
taaattagccttgaagatta

SEQ ID NO: 7763843 - DNA, 20 bp, Homo sapiens
taaattagccttgaagatta

SEQ ID NO: 7763844 - DNA, 22 bp, Homo sapiens
taaattatgttccatgtccttt

SEQ ID NO: 7763845 - DNA, 22 bp, Homo sapiens
taaattatgtcacatgactctg

SEQ ID NO: 7763846 - DNA, 22 bp, Homo sapiens
taaattatgttccatgtccttt

SEQ ID NO: 7763847 - DNA, 22 bp, Homo sapiens
taaagtaatccttcataaggag

SEQ ID NO: 7763848 - DNA, 22 bp, Homo sapiens
taaagtatattttttctcaata

SEQ ID NO: 7763849 - DNA, 22 bp, Homo sapiens
taaagtgctgggattataggcc

SEQ ID NO: 7763850 - DNA, 22 bp, Homo sapiens
taaagtgcttatgataaccaag

SEQ ID NO: 7763851 - DNA, 22 bp, Homo sapiens
taactaggattacaagcgtgcg

SEQ ID NO: 7763852 - DNA, 22 bp, Homo sapiens
taactaactagtgttcaaaata

SEQ ID NO: 7763853 - DNA, 22 bp, Homo sapiens
taactacaagggcggtctctgt

SEQ ID NO: 7763854 - DNA, 22 bp, Homo sapiens
taaattctacaacttcaaagat

SEQ ID NO: 7763855 - DNA, 22 bp, Homo sapiens
taaattcagtgagtaatttctg

SEQ ID NO: 7763856 - DNA, 22 bp, Homo sapiens
taaatttacccaaggaacatgt

SEQ ID NO: 7763857 - DNA, 22 bp, Homo sapiens
taaattgcataagtacaaatga

SEQ ID NO: 7763858 - DNA, 22 bp, Homo sapiens
taaccaaagggcctaaggaatg

SEQ ID NO: 7763859 - DNA, 22 bp, Homo sapiens
taacattacagacaccttgtgt

SEQ ID NO: 7763860 - DNA, 22 bp, Homo sapiens
taacattaaaagagataattga

SEQ ID NO: 7763861 - DNA, 22 bp, Homo sapiens
taaccatgcatgtctctagttt

SEQ ID NO: 7763862 - DNA, 22 bp, Homo sapiens
taaccatattcacactatgccc

SEQ ID NO: 7763863 - DNA, 22 bp, Homo sapiens
taaagggtaggttttactgtaa

SEQ ID NO: 7763864 - DNA, 22 bp, Homo sapiens
taaacaattcctctctaggcat

SEQ ID NO: 7763865 - DNA, 22 bp, Homo sapiens
taaacaagctgtctgatattct

SEQ ID NO: 7763866 - DNA, 22 bp, Homo sapiens
taaacaagctggactgataagt

SEQ ID NO: 7763867 - DNA, 22 bp, Homo sapiens
taaaattgcggtgaatatttcc

SEQ ID NO: 7763868 - DNA, 22 bp, Homo sapiens
taaacaagaaacattttctgtt

SEQ ID NO: 7763869 - DNA, 22 bp, Homo sapiens
taaaatttgtccctgagtgttg

SEQ ID NO: 7763870 - DNA, 18 bp, Homo sapiens
taaaattcaaggcagggt

SEQ ID NO: 7763871 - DNA, 22 bp, Homo sapiens
taaaatgtgtttctgtatggtt

SEQ ID NO: 7763872 - DNA, 19 bp, Homo sapiens
taaaatgtctgtggtcagt

SEQ ID NO: 7763873 - DNA, 22 bp, Homo sapiens
taaaatggtaactttcatttgc

SEQ ID NO: 7763874 - DNA, 22 bp, Homo sapiens
gtttttacagcagcaaaatact

SEQ ID NO: 7763875 - DNA, 22 bp, Homo sapiens
gtttttactaaggttgctaagt

SEQ ID NO: 7763876 - DNA, 22 bp, Homo sapiens
gtttttatatcctgtggagtgt

SEQ ID NO: 7763877 - DNA, 22 bp, Homo sapiens
gtttttattgtgtaaatgtggg

SEQ ID NO: 7763878 - DNA, 22 bp, Homo sapiens
gtttttattgtgtaaatgtggg

SEQ ID NO: 7763879 - DNA, 22 bp, Homo sapiens
gtttttattgtgtaaatgtggg

SEQ ID NO: 7763880 - DNA, 22 bp, Homo sapiens
gtttttatctaatagcagttat

SEQ ID NO: 7763881 - DNA, 22 bp, Homo sapiens
gtttttatctaatagcagttat

SEQ ID NO: 7763882 - DNA, 22 bp, Homo sapiens
gttttcatgtctattgggcata

SEQ ID NO: 7763883 - DNA, 22 bp, Homo sapiens
gtttccaggcactttttctgct

SEQ ID NO: 7763884 - DNA, 18 bp, Homo sapiens
gttttgaattgtcttaca

SEQ ID NO: 7763885 - DNA, 22 bp, Homo sapiens
gttttgcagagtgcaataaatc

SEQ ID NO: 7763886 - DNA, 19 bp, Homo sapiens
gttttgcaggcagagggga

SEQ ID NO: 7763887 - DNA, 22 bp, Homo sapiens
gttttcattactgctgtgattt

SEQ ID NO: 7763888 - DNA, 22 bp, Homo sapiens
gttttctttgaatgcttctaga

SEQ ID NO: 7763889 - DNA, 22 bp, Homo sapiens
gttggggaaggtgggagaatgt

SEQ ID NO: 7763890 - DNA, 22 bp, Homo sapiens
gttgatgaaaatgaattgcatg

SEQ ID NO: 7763891 - DNA, 22 bp, Homo sapiens
gtttcatggttgtttgatggca

SEQ ID NO: 7763892 - DNA, 22 bp, Homo sapiens
gtttcatggagagctgaatatt

SEQ ID NO: 7763893 - DNA, 18 bp, Homo sapiens
gtttcatgcatgtgaaac

SEQ ID NO: 7763894 - DNA, 22 bp, Homo sapiens
gtttcattacctgacccatgag

SEQ ID NO: 7763895 - DNA, 22 bp, Homo sapiens
gtttcattacctgacccatgag

SEQ ID NO: 7763896 - DNA, 22 bp, Homo sapiens
gtttcatatgcagttaacagca

SEQ ID NO: 7763897 - DNA, 22 bp, Homo sapiens
gtttcatatatagtaactgaaa

SEQ ID NO: 7763898 - DNA, 22 bp, Homo sapiens
gtttcatataccaagcacttga

SEQ ID NO: 7763899 - DNA, 22 bp, Homo sapiens
gtttcataggcatgtgacctat

SEQ ID NO: 7763900 - DNA, 22 bp, Homo sapiens
gtttcataattcaatcaaatga

SEQ ID NO: 7763901 - DNA, 22 bp, Homo sapiens
gttcagctcaagcaataatttt

SEQ ID NO: 7763902 - DNA, 22 bp, Homo sapiens
gttcacatgtggtcatgctgtc

SEQ ID NO: 7763903 - DNA, 22 bp, Homo sapiens
gttcacatgtgttatcttcttt

SEQ ID NO: 7763904 - DNA, 22 bp, Homo sapiens
gttcacatggcattttcacatc

SEQ ID NO: 7763905 - DNA, 22 bp, Homo sapiens
gttcacattaactcaccggtgc

SEQ ID NO: 7763906 - DNA, 22 bp, Homo sapiens
gttcacatgtgttatcttcttt

SEQ ID NO: 7763907 - DNA, 22 bp, Homo sapiens
gttcacatcctgctttttccct

SEQ ID NO: 7763908 - DNA, 22 bp, Homo sapiens
gttcacatcccagaaagagcat

SEQ ID NO: 7763909 - DNA, 22 bp, Homo sapiens
gttcacatcacttcactgaacc

SEQ ID NO: 7763910 - DNA, 22 bp, Homo sapiens
gttcacatccttgtgaggattt

SEQ ID NO: 7763911 - DNA, 22 bp, Homo sapiens
gttcacatcctggctgtgccac

SEQ ID NO: 7763912 - DNA, 22 bp, Homo sapiens
gttcacatgctctcatgctttt

SEQ ID NO: 7763913 - DNA, 22 bp, Homo sapiens
gttcacatgctctcatgctttt

SEQ ID NO: 7763914 - DNA, 22 bp, Homo sapiens
gttcaagtttctgagctttaat

SEQ ID NO: 7763915 - DNA, 22 bp, Homo sapiens
gttacaaaggactgggggccac

SEQ ID NO: 7763916 - DNA, 22 bp, Homo sapiens
gttcatgtttgtgtattgctca

SEQ ID NO: 7763917 - DNA, 22 bp, Homo sapiens
gttcatgtgactactatgacct

SEQ ID NO: 7763918 - DNA, 20 bp, Homo sapiens
gttcatgtctcaaatagaaa

SEQ ID NO: 7763919 - DNA, 22 bp, Homo sapiens
gttgagtgggttaggatgctga

SEQ ID NO: 7763920 - DNA, 22 bp, Homo sapiens
gttcataatttgaaggaatagg

SEQ ID NO: 7763921 - DNA, 22 bp, Homo sapiens
gttcagtgtttttattgacagg

SEQ ID NO: 7763922 - DNA, 22 bp, Homo sapiens
gttcagtgtttacatgattgtt

SEQ ID NO: 7763923 - DNA, 22 bp, Homo sapiens
gttcagtgccagttctaagact

SEQ ID NO: 7763924 - DNA, 22 bp, Homo sapiens
gtgtgggaatggcggtcgtgca

SEQ ID NO: 7763925 - DNA, 22 bp, Homo sapiens
gtgtgcccgggggaagcaggtg

SEQ ID NO: 7763926 - DNA, 22 bp, Homo sapiens
gttacaaactcaggtgccaaaa

SEQ ID NO: 7763927 - DNA, 22 bp, Homo sapiens
gttacaaaggaagcttcactgc

SEQ ID NO: 7763928 - DNA, 22 bp, Homo sapiens
gttacaaagcacttcaagtgaa

SEQ ID NO: 7763929 - DNA, 22 bp, Homo sapiens
gttacaaaggaagcttcactgc

SEQ ID NO: 7763930 - DNA, 22 bp, Homo sapiens
gttaataaaggtatagaatcag

SEQ ID NO: 7763931 - DNA, 23 bp, Homo sapiens
gttaataatgaacactttctccc

SEQ ID NO: 7763932 - DNA, 22 bp, Homo sapiens
gtgtgcatcttggtaatggagc

SEQ ID NO: 7763933 - DNA, 22 bp, Homo sapiens
gtgctctgtgtattaggatgtc

SEQ ID NO: 7763934 - DNA, 21 bp, Homo sapiens
gtgctctgggcagcagagggc

SEQ ID NO: 7763935 - DNA, 22 bp, Homo sapiens
gtgctctgcctggggtcatggc

SEQ ID NO: 7763936 - DNA, 22 bp, Homo sapiens
gtgctctaggaccttagaagtg

SEQ ID NO: 7763937 - DNA, 22 bp, Homo sapiens
gtgctctcctggctgccctgac

SEQ ID NO: 7763938 - DNA, 22 bp, Homo sapiens
gtgctccctccttcctcaagga

SEQ ID NO: 7763939 - DNA, 22 bp, Homo sapiens
tcactttagaggaaacattgag

SEQ ID NO: 7763940 - DNA, 22 bp, Homo sapiens
tcacttcttcagctttccttga

SEQ ID NO: 7763941 - DNA, 22 bp, Homo sapiens
tcactgtgctctctagataggc

SEQ ID NO: 7763942 - DNA, 23 bp, Homo sapiens
tcacttgaagctagaatctgccc

SEQ ID NO: 7763943 - DNA, 20 bp, Homo sapiens
tcacttcttccttttgtcta

SEQ ID NO: 7763944 - DNA, 22 bp, Homo sapiens
tcactgacgtggggctacttga

SEQ ID NO: 7763945 - DNA, 22 bp, Homo sapiens
tcactgaagactgggctctaaa

SEQ ID NO: 7763946 - DNA, 22 bp, Homo sapiens
tcactgaatacttgtctcatcc

SEQ ID NO: 7763947 - DNA, 22 bp, Homo sapiens
tcactctgacttggcctccaac

SEQ ID NO: 7763948 - DNA, 22 bp, Homo sapiens
tcactataatatgtcaaaatac

SEQ ID NO: 7763949 - DNA, 22 bp, Homo sapiens
tcactacaacctccgcctcctg

SEQ ID NO: 7763950 - DNA, 22 bp, Homo sapiens
tcactctggagtccgctaccag

SEQ ID NO: 7763951 - DNA, 22 bp, Homo sapiens
tcacccaggctggagtgcagtg

SEQ ID NO: 7763952 - DNA, 22 bp, Homo sapiens
tcacagtatagagttattttgg

SEQ ID NO: 7763953 - DNA, 22 bp, Homo sapiens
tcacattttatctgagattgac

SEQ ID NO: 7763954 - DNA, 22 bp, Homo sapiens
tcacattttcaaaagctggtgc

SEQ ID NO: 7763955 - DNA, 22 bp, Homo sapiens
tcacagtataacctcatatagg

SEQ ID NO: 7763956 - DNA, 22 bp, Homo sapiens
tcacagtagccatttcatgagt

SEQ ID NO: 7763957 - DNA, 22 bp, Homo sapiens
tcacattttccttggtatctgt

SEQ ID NO: 7763958 - DNA, 22 bp, Homo sapiens
tcacattttcatattctctgag

SEQ ID NO: 7763959 - DNA, 22 bp, Homo sapiens
tcacattttgttcaaggctagt

SEQ ID NO: 7763960 - DNA, 22 bp, Homo sapiens
tcacattttcttaggaaactta

SEQ ID NO: 7763961 - DNA, 22 bp, Homo sapiens
tcacattttctactactgtacg

SEQ ID NO: 7763962 - DNA, 22 bp, Homo sapiens
tcacattttctactactgtacg

SEQ ID NO: 7763963 - DNA, 22 bp, Homo sapiens
tcacattttttactggacttaa

SEQ ID NO: 7763964 - DNA, 22 bp, Homo sapiens
tcagagctaaggggagagcaaa

SEQ ID NO: 7763965 - DNA, 22 bp, Homo sapiens
tcagagctttggagaccaggaa

SEQ ID NO: 7763966 - DNA, 22 bp, Homo sapiens
tcagagctgcccatgcaagggg

SEQ ID NO: 7763967 - DNA, 22 bp, Homo sapiens
tcagcaccagttatcctcaggg

SEQ ID NO: 7763968 - DNA, 22 bp, Homo sapiens
tcagcactgaaattcttcacat

SEQ ID NO: 7763969 - DNA, 22 bp, Homo sapiens
tcagaggaaaggtcagatggct

SEQ ID NO: 7763970 - DNA, 22 bp, Homo sapiens
tcagcaaggctgcattctcatc

SEQ ID NO: 7763971 - DNA, 22 bp, Homo sapiens
tcagagaagacatcattgtgaa

SEQ ID NO: 7763972 - DNA, 22 bp, Homo sapiens
tcagagaactgcagcccttcct

SEQ ID NO: 7763973 - DNA, 22 bp, Homo sapiens
tcagagaagcttaagctgtaat

SEQ ID NO: 7763974 - DNA, 20 bp, Homo sapiens
tcagagaaggagctttcctg

SEQ ID NO: 7763975 - DNA, 20 bp, Homo sapiens
tcagagaaggagctttcctg

SEQ ID NO: 7763976 - DNA, 20 bp, Homo sapiens
tcagagaaggagctttcctg

SEQ ID NO: 7763977 - DNA, 22 bp, Homo sapiens
tcagagaaggcaattttatggt

SEQ ID NO: 7763978 - DNA, 20 bp, Homo sapiens
tcagagaagggactgagatt

SEQ ID NO: 7763979 - DNA, 22 bp, Homo sapiens
tcagagaactccacaccttagg

SEQ ID NO: 7763980 - DNA, 22 bp, Homo sapiens
tcagaaaaggtagctgtgacaa

SEQ ID NO: 7763981 - DNA, 22 bp, Homo sapiens
tcagaaaagagaaaatcttata

SEQ ID NO: 7763982 - DNA, 22 bp, Homo sapiens
tcagaaaagaccacattattct

SEQ ID NO: 7763983 - DNA, 22 bp, Homo sapiens
tcagaaaagaccacattattct

SEQ ID NO: 7763984 - DNA, 22 bp, Homo sapiens
tcacttttgatccctatgcagt

SEQ ID NO: 7763985 - DNA, 22 bp, Homo sapiens
tcacttttgatccctatgcagt

SEQ ID NO: 7763986 - DNA, 22 bp, Homo sapiens
tcacaattcagaaaccaagtag

SEQ ID NO: 7763987 - DNA, 22 bp, Homo sapiens
tcacagaacaagcctggtggag

SEQ ID NO: 7763988 - DNA, 22 bp, Homo sapiens
tcacagaaagctgtgtcctgac

SEQ ID NO: 7763989 - DNA, 22 bp, Homo sapiens
tcacagaaataagatagttatt

SEQ ID NO: 7763990 - DNA, 22 bp, Homo sapiens
tcacaagagctggactgtcttt

SEQ ID NO: 7763991 - DNA, 22 bp, Homo sapiens
tcacaagagctggactgtcttt

SEQ ID NO: 7763992 - DNA, 22 bp, Homo sapiens
tcacaagagtaagttcatgcct

SEQ ID NO: 7763993 - DNA, 22 bp, Homo sapiens
tcacaagatacagttagaagca

SEQ ID NO: 7763994 - DNA, 22 bp, Homo sapiens
tcacaagatatttcagtccttt

SEQ ID NO: 7763995 - DNA, 22 bp, Homo sapiens
tcacaagatggctgctgcagcc

SEQ ID NO: 7763996 - DNA, 22 bp, Homo sapiens
tcacaaaagcttttgaatttgg

SEQ ID NO: 7763997 - DNA, 20 bp, Homo sapiens
tcaattttctacaacatttg

SEQ ID NO: 7763998 - DNA, 20 bp, Homo sapiens
tcaattttctacaacatttg

SEQ ID NO: 7763999 - DNA, 22 bp, Homo sapiens
tcacaaaggatgatgaattctg

SEQ ID NO: 7764000 - DNA, 22 bp, Homo sapiens
tcacagtaaatccagaagaaat

SEQ ID NO: 7764001 - DNA, 22 bp, Homo sapiens
tcacagtactgtgactattgac

SEQ ID NO: 7764002 - DNA, 22 bp, Homo sapiens
tcacagtactgtgtgacttgag

SEQ ID NO: 7764003 - DNA, 22 bp, Homo sapiens
tcacagtactccccaaagtttc

SEQ ID NO: 7764004 - DNA, 22 bp, Homo sapiens
tcacagggtatctgggatggat

SEQ ID NO: 7764005 - DNA, 22 bp, Homo sapiens
tcacaggcctggggcagagggc

SEQ ID NO: 7764006 - DNA, 22 bp, Homo sapiens
tcacaggcccaaaccacgctta

SEQ ID NO: 7764007 - DNA, 22 bp, Homo sapiens
tcacaggcctggggcagagggc

SEQ ID NO: 7764008 - DNA, 22 bp, Homo sapiens
tcacaggctaaatttatgcagg

SEQ ID NO: 7764009 - DNA, 22 bp, Homo sapiens
tcacaggctccagggcctggat

SEQ ID NO: 7764010 - DNA, 21 bp, Homo sapiens
tcacaggctcagggagagagt

SEQ ID NO: 7764011 - DNA, 23 bp, Homo sapiens
tcacagggcactggctggggttg

SEQ ID NO: 7764012 - DNA, 22 bp, Homo sapiens
tcacaggctctagggattaaga

SEQ ID NO: 7764013 - DNA, 22 bp, Homo sapiens
tcacaggctggtctccgaggac

SEQ ID NO: 7764014 - DNA, 22 bp, Homo sapiens
tcacaggctggtctccgaggac

SEQ ID NO: 7764015 - DNA, 22 bp, Homo sapiens
tcacagaagatgctggatgttg

SEQ ID NO: 7764016 - DNA, 22 bp, Homo sapiens
tcacagaagcttgaagattttc

SEQ ID NO: 7764017 - DNA, 22 bp, Homo sapiens
tcacagaaggaccttgtttcat

SEQ ID NO: 7764018 - DNA, 22 bp, Homo sapiens
tcacagaagttgaatttgcatg

SEQ ID NO: 7764019 - DNA, 22 bp, Homo sapiens
tcacaggagtcataattacagt

SEQ ID NO: 7764020 - DNA, 19 bp, Homo sapiens
tcacaggcatctccccaga

SEQ ID NO: 7764021 - DNA, 19 bp, Homo sapiens
tcacaggcatctccccaga

SEQ ID NO: 7764022 - DNA, 22 bp, Homo sapiens
tcaaggaagggatattcttgaa

SEQ ID NO: 7764023 - DNA, 22 bp, Homo sapiens
tcaagataagtcagtatatcaa

SEQ ID NO: 7764024 - DNA, 22 bp, Homo sapiens
tcaagatgaaagatgtagccat

SEQ ID NO: 7764025 - DNA, 22 bp, Homo sapiens
tcaagataccaccattatatgt

SEQ ID NO: 7764026 - DNA, 22 bp, Homo sapiens
tcaaggaatgactatatgagga

SEQ ID NO: 7764027 - DNA, 22 bp, Homo sapiens
tcaaggaatgggtccttccctt

SEQ ID NO: 7764028 - DNA, 22 bp, Homo sapiens
tcaagagattgaataataactg

SEQ ID NO: 7764029 - DNA, 22 bp, Homo sapiens
tcaagagagtgctgcttggggt

SEQ ID NO: 7764030 - DNA, 22 bp, Homo sapiens
tcaagagacaggacgtgtttca

SEQ ID NO: 7764031 - DNA, 18 bp, Homo sapiens
tcaagacatcatgaaata

SEQ ID NO: 7764032 - DNA, 22 bp, Homo sapiens
tcaagagaaggggaaatagact

SEQ ID NO: 7764033 - DNA, 22 bp, Homo sapiens
tcaagagaagtgctccacagta

SEQ ID NO: 7764034 - DNA, 22 bp, Homo sapiens
tcaagagacaggacgtgtttca

SEQ ID NO: 7764035 - DNA, 22 bp, Homo sapiens
tatttcttgagtggtcagtttc

SEQ ID NO: 7764036 - DNA, 22 bp, Homo sapiens
tatttcttgagtggtcagtttc

SEQ ID NO: 7764037 - DNA, 22 bp, Homo sapiens
tatttcttcgggattcaagcta

SEQ ID NO: 7764038 - DNA, 22 bp, Homo sapiens
tatttctgggagttcagaaatt

SEQ ID NO: 7764039 - DNA, 22 bp, Homo sapiens
tatttctgggagttcagaaatt

SEQ ID NO: 7764040 - DNA, 22 bp, Homo sapiens
tatttctgtcagccagatatgg

SEQ ID NO: 7764041 - DNA, 20 bp, Homo sapiens
tatttctgggcaaccattta

SEQ ID NO: 7764042 - DNA, 22 bp, Homo sapiens
tatttctgtatgcataaaagga

SEQ ID NO: 7764043 - DNA, 22 bp, Homo sapiens
tcaagtcttgatgagacaaacc

SEQ ID NO: 7764044 - DNA, 22 bp, Homo sapiens
tcaataaaattgttttcctatc

SEQ ID NO: 7764045 - DNA, 22 bp, Homo sapiens
tcaataaaattgttttcctatc

SEQ ID NO: 7764046 - DNA, 23 bp, Homo sapiens
tcaataactcgggttaaaataga

SEQ ID NO: 7764047 - DNA, 22 bp, Homo sapiens
tcaataaatccctctgaccctg

SEQ ID NO: 7764048 - DNA, 22 bp, Homo sapiens
tcaataaatagcttggctcagc

SEQ ID NO: 7764049 - DNA, 22 bp, Homo sapiens
tcaatttcaacagctgataaga

SEQ ID NO: 7764050 - DNA, 22 bp, Homo sapiens
tcaatttatgtggctattcatt

SEQ ID NO: 7764051 - DNA, 22 bp, Homo sapiens
tcaataatggcaggataaattt

SEQ ID NO: 7764052 - DNA, 22 bp, Homo sapiens
tcaataagtaggatatcaagat

SEQ ID NO: 7764053 - DNA, 22 bp, Homo sapiens
tcaataatggcaggataaattt

SEQ ID NO: 7764054 - DNA, 22 bp, Homo sapiens
tcaaggcacttcatgtctcagt

SEQ ID NO: 7764055 - DNA, 22 bp, Homo sapiens
tcaaggctaaactttcagagta

SEQ ID NO: 7764056 - DNA, 19 bp, Homo sapiens
tcaaggctccctgagggat

SEQ ID NO: 7764057 - DNA, 22 bp, Homo sapiens
tcaagtcatttgactgtgtgtt

SEQ ID NO: 7764058 - DNA, 22 bp, Homo sapiens
tcaagtattattacagatgtag

SEQ ID NO: 7764059 - DNA, 22 bp, Homo sapiens
tcaagtctggagatctggaact

SEQ ID NO: 7764060 - DNA, 22 bp, Homo sapiens
tcaagtctcaatgtattatggt

SEQ ID NO: 7764061 - DNA, 22 bp, Homo sapiens
tcaagtatatctagtcattagg

SEQ ID NO: 7764062 - DNA, 22 bp, Homo sapiens
tcaagtatgacatcaagtttct

SEQ ID NO: 7764063 - DNA, 22 bp, Homo sapiens
tcaagtatatctagtcattagg

SEQ ID NO: 7764064 - DNA, 22 bp, Homo sapiens
tcatggcacttagcacagtcct

SEQ ID NO: 7764065 - DNA, 22 bp, Homo sapiens
tcatggcacttagtgtctcaaa

SEQ ID NO: 7764066 - DNA, 20 bp, Homo sapiens
tcatggcagccacccacagg

SEQ ID NO: 7764067 - DNA, 22 bp, Homo sapiens
tcatggcacatgccctccaggg

SEQ ID NO: 7764068 - DNA, 22 bp, Homo sapiens
tcatggattaaattattaagtt

SEQ ID NO: 7764069 - DNA, 22 bp, Homo sapiens
tcatggatgggcccagctctgt

SEQ ID NO: 7764070 - DNA, 22 bp, Homo sapiens
tcatgcttattgcatatttgga

SEQ ID NO: 7764071 - DNA, 22 bp, Homo sapiens
tcatgcttaaaagacacttgag

SEQ ID NO: 7764072 - DNA, 22 bp, Homo sapiens
tcattatcctagtatcttgaat

SEQ ID NO: 7764073 - DNA, 22 bp, Homo sapiens
tcattataaacatatgctaaag

SEQ ID NO: 7764074 - DNA, 22 bp, Homo sapiens
tcattatagagttgtattttag

SEQ ID NO: 7764075 - DNA, 22 bp, Homo sapiens
tcattattctctttaatgttct

SEQ ID NO: 7764076 - DNA, 22 bp, Homo sapiens
tcattattctctttaatgttct

SEQ ID NO: 7764077 - DNA, 22 bp, Homo sapiens
tcattatttgctttagttatgt

SEQ ID NO: 7764078 - DNA, 22 bp, Homo sapiens
tcattcaggttgggcaagtgtc

SEQ ID NO: 7764079 - DNA, 22 bp, Homo sapiens
tcatataactggatattttcaa

SEQ ID NO: 7764080 - DNA, 22 bp, Homo sapiens
tcatataagtttaaaactatct

SEQ ID NO: 7764081 - DNA, 22 bp, Homo sapiens
tcatataagtttaaaactatct

SEQ ID NO: 7764082 - DNA, 22 bp, Homo sapiens
tcatataagagctttagagtca

SEQ ID NO: 7764083 - DNA, 22 bp, Homo sapiens
tcatataagagctttagagtca

SEQ ID NO: 7764084 - DNA, 22 bp, Homo sapiens
tcatataagtttaaaactatct

SEQ ID NO: 7764085 - DNA, 22 bp, Homo sapiens
tcatataagtttaaaactatct

SEQ ID NO: 7764086 - DNA, 22 bp, Homo sapiens
tcatataagtttaaaactatct

SEQ ID NO: 7764087 - DNA, 22 bp, Homo sapiens
tcatataccagagagtttatat

SEQ ID NO: 7764088 - DNA, 22 bp, Homo sapiens
tcatatatctgcaaagcagtat

SEQ ID NO: 7764089 - DNA, 22 bp, Homo sapiens
tcatatattttggcagtgatca

SEQ ID NO: 7764090 - DNA, 21 bp, Homo sapiens
tcatatttctcttgctattgt

SEQ ID NO: 7764091 - DNA, 22 bp, Homo sapiens
tcatatttaggcctttaattca

SEQ ID NO: 7764092 - DNA, 22 bp, Homo sapiens
tcatatttaggcctttaattca

SEQ ID NO: 7764093 - DNA, 22 bp, Homo sapiens
tcagtgttacattatatagaac

SEQ ID NO: 7764094 - DNA, 22 bp, Homo sapiens
tcagtgtctgtgggcaggatgg

SEQ ID NO: 7764095 - DNA, 22 bp, Homo sapiens
tcagtgtctatagataaggttt

SEQ ID NO: 7764096 - DNA, 22 bp, Homo sapiens
tcagtgtctcatatgaggtttc

SEQ ID NO: 7764097 - DNA, 22 bp, Homo sapiens
tcagtgtccataaataaagttt

SEQ ID NO: 7764098 - DNA, 22 bp, Homo sapiens
tcagtgtccaaaaagaggcaag

SEQ ID NO: 7764099 - DNA, 19 bp, Homo sapiens
tcagtgtccctgttaatat

SEQ ID NO: 7764100 - DNA, 22 bp, Homo sapiens
tcagtgtcccgtctcttaactc

SEQ ID NO: 7764101 - DNA, 22 bp, Homo sapiens
tcagtgtccggagcctgagtgc

SEQ ID NO: 7764102 - DNA, 23 bp, Homo sapiens
tcagtgtctagttgtggaattga

SEQ ID NO: 7764103 - DNA, 22 bp, Homo sapiens
tcagtgtctagggacagtaatc

SEQ ID NO: 7764104 - DNA, 22 bp, Homo sapiens
tcagtgtccttcgttcttgttg

SEQ ID NO: 7764105 - DNA, 22 bp, Homo sapiens
tcagtgtcctgtgcggtgcagc

SEQ ID NO: 7764106 - DNA, 22 bp, Homo sapiens
tcagtggtctaggcaatatata

SEQ ID NO: 7764107 - DNA, 22 bp, Homo sapiens
tcagtggtggaagcagcaaacc

SEQ ID NO: 7764108 - DNA, 22 bp, Homo sapiens
tcagtgtaagttatgtagatgt

SEQ ID NO: 7764109 - DNA, 18 bp, Homo sapiens
tcagtgtagatctgtgta

SEQ ID NO: 7764110 - DNA, 22 bp, Homo sapiens
tcagtgtcatcacttaatataa

SEQ ID NO: 7764111 - DNA, 22 bp, Homo sapiens
tcagtgtcatatcaagaagatg

SEQ ID NO: 7764112 - DNA, 22 bp, Homo sapiens
tcagtgtcagtcttttagatat

SEQ ID NO: 7764113 - DNA, 20 bp, Homo sapiens
tcagtgtcagtagccactac

SEQ ID NO: 7764114 - DNA, 21 bp, Homo sapiens
tcagtgtatttaagaatgttg

SEQ ID NO: 7764115 - DNA, 16 bp, Homo sapiens
tcagtgtcagctcctg

SEQ ID NO: 7764116 - DNA, 22 bp, Homo sapiens
tcagtgtcacaggatgctatgc

SEQ ID NO: 7764117 - DNA, 22 bp, Homo sapiens
tcagtgacaactatgaatattt

SEQ ID NO: 7764118 - DNA, 22 bp, Homo sapiens
tcagtgactgggtattaaatca

SEQ ID NO: 7764119 - DNA, 22 bp, Homo sapiens
tcagtctttgcttatgacaata

SEQ ID NO: 7764120 - DNA, 22 bp, Homo sapiens
tcagtgcagactgtaagttgga

SEQ ID NO: 7764121 - DNA, 20 bp, Homo sapiens
tcagtgattttgaagaggaa

SEQ ID NO: 7764122 - DNA, 22 bp, Homo sapiens
tcagggaagacttcttagagga

SEQ ID NO: 7764123 - DNA, 19 bp, Homo sapiens
tcagggaagttcaaagctc

SEQ ID NO: 7764124 - DNA, 22 bp, Homo sapiens
tcagtcttctagcaaatccagg

SEQ ID NO: 7764125 - DNA, 22 bp, Homo sapiens
tcaggtgttagaagaaatttca

SEQ ID NO: 7764126 - DNA, 22 bp, Homo sapiens
tcaggatggagtctatccagtg

SEQ ID NO: 7764127 - DNA, 22 bp, Homo sapiens
tcaggatggagggaagcacaga

SEQ ID NO: 7764128 - DNA, 22 bp, Homo sapiens
tcaggatgagtcatcaagctgc

SEQ ID NO: 7764129 - DNA, 22 bp, Homo sapiens
tcaggatgagctcataactatg

SEQ ID NO: 7764130 - DNA, 22 bp, Homo sapiens
tcaggatggtgtggaggaaata

SEQ ID NO: 7764131 - DNA, 22 bp, Homo sapiens
tcaggatggcacccaagctctt

SEQ ID NO: 7764132 - DNA, 22 bp, Homo sapiens
tcaggatggcacccaagctctt

SEQ ID NO: 7764133 - DNA, 21 bp, Homo sapiens
tcaggcagtgcaaatacatgg

SEQ ID NO: 7764134 - DNA, 20 bp, Homo sapiens
tcaggcagtggggaaaggca

SEQ ID NO: 7764135 - DNA, 20 bp, Homo sapiens
tcaggatgtgctgagtgaag

SEQ ID NO: 7764136 - DNA, 22 bp, Homo sapiens
tcaggatgttaatatagcatta

SEQ ID NO: 7764137 - DNA, 22 bp, Homo sapiens
tcaggatcaggggcctttcctt

SEQ ID NO: 7764138 - DNA, 22 bp, Homo sapiens
tcaggatccatagactcccaaa

SEQ ID NO: 7764139 - DNA, 22 bp, Homo sapiens
tcaggatgaagtcagaggggtc

SEQ ID NO: 7764140 - DNA, 22 bp, Homo sapiens
tcaggatgacttcaaggaggaa

SEQ ID NO: 7764141 - DNA, 22 bp, Homo sapiens
tcaggatgaccacgagcctcta

SEQ ID NO: 7764142 - DNA, 22 bp, Homo sapiens
tcaggatgaccacgagcctcta

SEQ ID NO: 7764143 - DNA, 22 bp, Homo sapiens
tcaggcctgccctgaaagcaca

SEQ ID NO: 7764144 - DNA, 22 bp, Homo sapiens
tcaggcctgcaaggagagtccc

SEQ ID NO: 7764145 - DNA, 22 bp, Homo sapiens
tcaggccacttcacaggtgatt

SEQ ID NO: 7764146 - DNA, 22 bp, Homo sapiens
tcaggccaggagatcagattga

SEQ ID NO: 7764147 - DNA, 22 bp, Homo sapiens
tcaggcctgagaaaaatccttt

SEQ ID NO: 7764148 - DNA, 22 bp, Homo sapiens
tcaggccacggctcactgagac

SEQ ID NO: 7764149 - DNA, 22 bp, Homo sapiens
tcaggccaaagaaacagcatga

SEQ ID NO: 7764150 - DNA, 19 bp, Homo sapiens
tcaggcagttattcacaaa

SEQ ID NO: 7764151 - DNA, 20 bp, Homo sapiens
tcaggcagtggggaaaggca

SEQ ID NO: 7764152 - DNA, 22 bp, Homo sapiens
tcaggcagtggtaaatgagtta

SEQ ID NO: 7764153 - DNA, 22 bp, Homo sapiens
tcaggcctgtgctggaggagat

SEQ ID NO: 7764154 - DNA, 22 bp, Homo sapiens
tcaggctgctggccagcaggct

SEQ ID NO: 7764155 - DNA, 22 bp, Homo sapiens
tcaggctgataggaggaactga

SEQ ID NO: 7764156 - DNA, 21 bp, Homo sapiens
tcaggctgatgtcgatgttag

SEQ ID NO: 7764157 - DNA, 22 bp, Homo sapiens
tcaggctggagtgcagtggcgc

SEQ ID NO: 7764158 - DNA, 22 bp, Homo sapiens
tcaggctggaatgcagtggggc

SEQ ID NO: 7764159 - DNA, 22 bp, Homo sapiens
tcaggctggaatgcagtggggc

SEQ ID NO: 7764160 - DNA, 18 bp, Homo sapiens
tcaggctggaagtttgcc

SEQ ID NO: 7764161 - DNA, 22 bp, Homo sapiens
tcaggctgctgtactgtgaatg

SEQ ID NO: 7764162 - DNA, 22 bp, Homo sapiens
tcaggctgctttcatgcttaga

SEQ ID NO: 7764163 - DNA, 22 bp, Homo sapiens
tcagggaaatagcagggctgaa

SEQ ID NO: 7764164 - DNA, 22 bp, Homo sapiens
tcagggaaaagtcacactgggt

SEQ ID NO: 7764165 - DNA, 22 bp, Homo sapiens
tcagggaaacctaaggaagcca

SEQ ID NO: 7764166 - DNA, 22 bp, Homo sapiens
tcagggaaacctaaggaagcca

SEQ ID NO: 7764167 - DNA, 22 bp, Homo sapiens
tcagggaaaggggagagtcatt

SEQ ID NO: 7764168 - DNA, 18 bp, Homo sapiens
tcaggctgggcctccttc

SEQ ID NO: 7764169 - DNA, 22 bp, Homo sapiens
tcaggctgggagacaatcactg

SEQ ID NO: 7764170 - DNA, 22 bp, Homo sapiens
tcaggctgggctcctctcccca

SEQ ID NO: 7764171 - DNA, 22 bp, Homo sapiens
tcaggctggggtgctaaggtgt

SEQ ID NO: 7764172 - DNA, 22 bp, Homo sapiens
tcagctccagagttgcacagtg

SEQ ID NO: 7764173 - DNA, 22 bp, Homo sapiens
tcagctcctcatgcaggggata

SEQ ID NO: 7764174 - DNA, 22 bp, Homo sapiens
tcagcctggtgattcctctgtc

SEQ ID NO: 7764175 - DNA, 18 bp, Homo sapiens
tcagcctgttgtctgcct

SEQ ID NO: 7764176 - DNA, 22 bp, Homo sapiens
tcagcaggcacggacaggctgc

SEQ ID NO: 7764177 - DNA, 22 bp, Homo sapiens
tcagcaggcaccggaagtgttt

SEQ ID NO: 7764178 - DNA, 21 bp, Homo sapiens
tcagcaggcaccagaaggctg

SEQ ID NO: 7764179 - DNA, 22 bp, Homo sapiens
tcagcaggcaccggaagtgttt

SEQ ID NO: 7764180 - DNA, 22 bp, Homo sapiens
tcagcctgctccaagtgctgcc

SEQ ID NO: 7764181 - DNA, 22 bp, Homo sapiens
tcagcaggcagaaatctgcaga

SEQ ID NO: 7764182 - DNA, 22 bp, Homo sapiens
tcagcaggcacaccaaaaactg

SEQ ID NO: 7764183 - DNA, 22 bp, Homo sapiens
tcaggaaggcttcacacgagtg

SEQ ID NO: 7764184 - DNA, 22 bp, Homo sapiens
tcaggaaggcgccccatcagga

SEQ ID NO: 7764185 - DNA, 22 bp, Homo sapiens
tcaggaaggagctggcctgcca

SEQ ID NO: 7764186 - DNA, 22 bp, Homo sapiens
tcaggaaggcaaattgcatgat

SEQ ID NO: 7764187 - DNA, 22 bp, Homo sapiens
tcaggaagggctcagtctgtgc

SEQ ID NO: 7764188 - DNA, 21 bp, Homo sapiens
tcaggaagagccagttcatgc

SEQ ID NO: 7764189 - DNA, 22 bp, Homo sapiens
tcaggaagccactccacagaga

SEQ ID NO: 7764190 - DNA, 22 bp, Homo sapiens
tcaggaagctactgccagcagc

SEQ ID NO: 7764191 - DNA, 22 bp, Homo sapiens
tcaggaacataatgtgagtcag

SEQ ID NO: 7764192 - DNA, 21 bp, Homo sapiens
tcccacagaaactgcgaaatt

SEQ ID NO: 7764193 - DNA, 22 bp, Homo sapiens
tcccaagtgtcttggaccaggg

SEQ ID NO: 7764194 - DNA, 22 bp, Homo sapiens
tcccaagcaatgagtcagggcc

SEQ ID NO: 7764195 - DNA, 22 bp, Homo sapiens
tccatgactaggaaaccagttt

SEQ ID NO: 7764196 - DNA, 22 bp, Homo sapiens
tccatgaggcagggaggctggc

SEQ ID NO: 7764197 - DNA, 20 bp, Homo sapiens
tccagggccctggctcctct

SEQ ID NO: 7764198 - DNA, 20 bp, Homo sapiens
tccagggctagggagctcat

SEQ ID NO: 7764199 - DNA, 22 bp, Homo sapiens
tccatcagcatgcaggctgttc

SEQ ID NO: 7764200 - DNA, 22 bp, Homo sapiens
tccaggctctcaggtgtcagca

SEQ ID NO: 7764201 - DNA, 19 bp, Homo sapiens
tccaggctgagagtcagct

SEQ ID NO: 7764202 - DNA, 22 bp, Homo sapiens
tccaggccaatgtagcaggccc

SEQ ID NO: 7764203 - DNA, 22 bp, Homo sapiens
tccaggcatgtggccagtactc

SEQ ID NO: 7764204 - DNA, 22 bp, Homo sapiens
tccaggattgtcagccagaagg

SEQ ID NO: 7764205 - DNA, 22 bp, Homo sapiens
tccaggattgcaggtgcacaac

SEQ ID NO: 7764206 - DNA, 22 bp, Homo sapiens
tccaggagtttgagactgcagt

SEQ ID NO: 7764207 - DNA, 22 bp, Homo sapiens
tccaggcataatgcccagtggt

SEQ ID NO: 7764208 - DNA, 22 bp, Homo sapiens
tccaggagtggggcagaggtct

SEQ ID NO: 7764209 - DNA, 22 bp, Homo sapiens
tccaggaggtgaggggaccaaa

SEQ ID NO: 7764210 - DNA, 22 bp, Homo sapiens
tccaggaggttgagactgcagt

SEQ ID NO: 7764211 - DNA, 22 bp, Homo sapiens
tccaggaggggtaggcagtatg

SEQ ID NO: 7764212 - DNA, 22 bp, Homo sapiens
tccaggagggttttctgccttc

SEQ ID NO: 7764213 - DNA, 22 bp, Homo sapiens
tccaggaggtttggaggaagca

SEQ ID NO: 7764214 - DNA, 22 bp, Homo sapiens
tccaggaggttgagtgagttcc

SEQ ID NO: 7764215 - DNA, 22 bp, Homo sapiens
tccaggagtcagacagatggtg

SEQ ID NO: 7764216 - DNA, 22 bp, Homo sapiens
tccaggagtcctgggagtgatt

SEQ ID NO: 7764217 - DNA, 22 bp, Homo sapiens
tccaggagtctagcctcaggcc

SEQ ID NO: 7764218 - DNA, 22 bp, Homo sapiens
tccaggagtcctgggtggcccc

SEQ ID NO: 7764219 - DNA, 22 bp, Homo sapiens
tccagctcagggttggctcaag

SEQ ID NO: 7764220 - DNA, 18 bp, Homo sapiens
tccagctcacagatgggc

SEQ ID NO: 7764221 - DNA, 23 bp, Homo sapiens
tccagctcccttcaatggcactg

SEQ ID NO: 7764222 - DNA, 23 bp, Homo sapiens
tccagctcccttcaatggcactg

SEQ ID NO: 7764223 - DNA, 22 bp, Homo sapiens
tccagctcccactctcactgct

SEQ ID NO: 7764224 - DNA, 22 bp, Homo sapiens
tccagcagtgctcaggactcac

SEQ ID NO: 7764225 - DNA, 22 bp, Homo sapiens
tccagcagtgctctagagcgtg

SEQ ID NO: 7764226 - DNA, 22 bp, Homo sapiens
tccagcagtgctcaggactcac

SEQ ID NO: 7764227 - DNA, 22 bp, Homo sapiens
tccagcaggttggtcaggtgca

SEQ ID NO: 7764228 - DNA, 22 bp, Homo sapiens
tccagcagtccatgtgagacac

SEQ ID NO: 7764229 - DNA, 22 bp, Homo sapiens
tccagcagtccatgtgagacac

SEQ ID NO: 7764230 - DNA, 22 bp, Homo sapiens
tccagcctttctactcactgag

SEQ ID NO: 7764231 - DNA, 22 bp, Homo sapiens
tccagccaactgcctagggagc

SEQ ID NO: 7764232 - DNA, 19 bp, Homo sapiens
tccagctggtatgcccaga

SEQ ID NO: 7764233 - DNA, 19 bp, Homo sapiens
tccagctggtatgcccaga

SEQ ID NO: 7764234 - DNA, 22 bp, Homo sapiens
tccagctggggccgaagtggat

SEQ ID NO: 7764235 - DNA, 22 bp, Homo sapiens
tccagctctaaggctgatagcc

SEQ ID NO: 7764236 - DNA, 22 bp, Homo sapiens
tccagctcctgagttcactgct

SEQ ID NO: 7764237 - DNA, 22 bp, Homo sapiens
tccagctctgattctcactagc

SEQ ID NO: 7764238 - DNA, 22 bp, Homo sapiens
tccagctctgcttcacagtctc

SEQ ID NO: 7764239 - DNA, 22 bp, Homo sapiens
tccaggaggcctcatttcctgt

SEQ ID NO: 7764240 - DNA, 22 bp, Homo sapiens
tccaggaggctctggttgacgt

SEQ ID NO: 7764241 - DNA, 22 bp, Homo sapiens
tccagctttcacgctcctgcct

SEQ ID NO: 7764242 - DNA, 18 bp, Homo sapiens
tccagcttgcacttaaat

SEQ ID NO: 7764243 - DNA, 19 bp, Homo sapiens
tccagctgttttgagtcac

SEQ ID NO: 7764244 - DNA, 22 bp, Homo sapiens
tccagctgttgttttatctcag

SEQ ID NO: 7764245 - DNA, 22 bp, Homo sapiens
tccagcttataggtagatttaa

SEQ ID NO: 7764246 - DNA, 22 bp, Homo sapiens
tccagagaggtttctccatgct

SEQ ID NO: 7764247 - DNA, 20 bp, Homo sapiens
tccagagagtggcaaagctc

SEQ ID NO: 7764248 - DNA, 20 bp, Homo sapiens
tccagagagtggcaaagctc

SEQ ID NO: 7764249 - DNA, 22 bp, Homo sapiens
tcattgcagactaacaatctca

SEQ ID NO: 7764250 - DNA, 22 bp, Homo sapiens
tcattgagttgcacttttacta

SEQ ID NO: 7764251 - DNA, 22 bp, Homo sapiens
tcattgacagttgtttcaaata

SEQ ID NO: 7764252 - DNA, 22 bp, Homo sapiens
tcattgagcggttcttaaccca

SEQ ID NO: 7764253 - DNA, 22 bp, Homo sapiens
tcattgaggaaaggtagtggct

SEQ ID NO: 7764254 - DNA, 22 bp, Homo sapiens
tcattgagctgtatggacacaa

SEQ ID NO: 7764255 - DNA, 22 bp, Homo sapiens
tcattgagttcaaatccttcat

SEQ ID NO: 7764256 - DNA, 22 bp, Homo sapiens
tcattgagtaatactgtagtgt

SEQ ID NO: 7764257 - DNA, 22 bp, Homo sapiens
tccagagctaattcagcagctg

SEQ ID NO: 7764258 - DNA, 22 bp, Homo sapiens
tccagagctaattcagcagctg

SEQ ID NO: 7764259 - DNA, 22 bp, Homo sapiens
tccagagatctctcttccctgt

SEQ ID NO: 7764260 - DNA, 22 bp, Homo sapiens
tccagagatccaaagaatatga

SEQ ID NO: 7764261 - DNA, 22 bp, Homo sapiens
tccagagatcacactgggcagg

SEQ ID NO: 7764262 - DNA, 22 bp, Homo sapiens
tccagagataactatttaggag

SEQ ID NO: 7764263 - DNA, 22 bp, Homo sapiens
tccagagcaggtggtcagaagg

SEQ ID NO: 7764264 - DNA, 22 bp, Homo sapiens
tccagcagactcatcagcaagg

SEQ ID NO: 7764265 - DNA, 23 bp, Homo sapiens
tccagcagagccttccaggaggg

SEQ ID NO: 7764266 - DNA, 23 bp, Homo sapiens
tccagcagagccttccaggaggg

SEQ ID NO: 7764267 - DNA, 22 bp, Homo sapiens
tccagcagaccatcaaggctca

SEQ ID NO: 7764268 - DNA, 22 bp, Homo sapiens
tccagcagaccatcaaggctca

SEQ ID NO: 7764269 - DNA, 22 bp, Homo sapiens
tccagcagagtctctgaggggg

SEQ ID NO: 7764270 - DNA, 23 bp, Homo sapiens
tccagcagccaagaagggtagaa

SEQ ID NO: 7764271 - DNA, 23 bp, Homo sapiens
tccagcagccaagaagggtagaa

SEQ ID NO: 7764272 - DNA, 23 bp, Homo sapiens
tccagcagccaagaagggtagaa

SEQ ID NO: 7764273 - DNA, 22 bp, Homo sapiens
tccagcagcccgaaggcccatc

SEQ ID NO: 7764274 - DNA, 22 bp, Homo sapiens
tccagcagccacacctctggac

SEQ ID NO: 7764275 - DNA, 22 bp, Homo sapiens
tccagcagccacacctctggac

SEQ ID NO: 7764276 - DNA, 22 bp, Homo sapiens
tccagcaggtccgagacaagtt

SEQ ID NO: 7764277 - DNA, 22 bp, Homo sapiens
tccagcaggtccgagacaagtt

SEQ ID NO: 7764278 - DNA, 18 bp, Homo sapiens
tccagcaggtctgaggtg

SEQ ID NO: 7764279 - DNA, 22 bp, Homo sapiens
tccagcaggtgtttgccaactt

SEQ ID NO: 7764280 - DNA, 22 bp, Homo sapiens
tccagcaggtgtttgccaactt

SEQ ID NO: 7764281 - DNA, 22 bp, Homo sapiens
tccagaggggcagccctgtgct

SEQ ID NO: 7764282 - DNA, 22 bp, Homo sapiens
tcccacagggcttctctgtaca

SEQ ID NO: 7764283 - DNA, 22 bp, Homo sapiens
tcccagggtcctcttctggaat

SEQ ID NO: 7764284 - DNA, 22 bp, Homo sapiens
tcccagggtgaaatgcagtagg

SEQ ID NO: 7764285 - DNA, 21 bp, Homo sapiens
tcccagggtcttatgggatgt

SEQ ID NO: 7764286 - DNA, 22 bp, Homo sapiens
tcccagggttacagccagggca

SEQ ID NO: 7764287 - DNA, 22 bp, Homo sapiens
tcccagggtgcgcctgccctcg

SEQ ID NO: 7764288 - DNA, 22 bp, Homo sapiens
tcccagggttacagccagggca

SEQ ID NO: 7764289 - DNA, 22 bp, Homo sapiens
tcccatatatgcaaaaatgtaa

SEQ ID NO: 7764290 - DNA, 22 bp, Homo sapiens
tcccatcatctgttctggctac

SEQ ID NO: 7764291 - DNA, 20 bp, Homo sapiens
tcccatcacgcctgtgccag

SEQ ID NO: 7764292 - DNA, 22 bp, Homo sapiens
tccccaccccagaactactagg

SEQ ID NO: 7764293 - DNA, 22 bp, Homo sapiens
tccccaccccagaactactagg

SEQ ID NO: 7764294 - DNA, 22 bp, Homo sapiens
tccccacctaagatacccatct

SEQ ID NO: 7764295 - DNA, 22 bp, Homo sapiens
tccccacctaagatacccatct

SEQ ID NO: 7764296 - DNA, 22 bp, Homo sapiens
tccccacctacacactgctcct

SEQ ID NO: 7764297 - DNA, 22 bp, Homo sapiens
tccccacctacacactgctcct

SEQ ID NO: 7764298 - DNA, 22 bp, Homo sapiens
tccccaggaaattctgattctt

SEQ ID NO: 7764299 - DNA, 22 bp, Homo sapiens
tccccaggaatcaggtggttgc

SEQ ID NO: 7764300 - DNA, 22 bp, Homo sapiens
tccccaggactaagttgcaatc

SEQ ID NO: 7764301 - DNA, 22 bp, Homo sapiens
tccccaggaaggcccttcctgg

SEQ ID NO: 7764302 - DNA, 22 bp, Homo sapiens
tccccaggagttttactttgca

SEQ ID NO: 7764303 - DNA, 22 bp, Homo sapiens
tccccaggagcaatgattcagt

SEQ ID NO: 7764304 - DNA, 22 bp, Homo sapiens
tccccagggctgcagagggtgt

SEQ ID NO: 7764305 - DNA, 20 bp, Homo sapiens
tccccagggcatcaggagca

SEQ ID NO: 7764306 - DNA, 22 bp, Homo sapiens
tccccaggggcctgggcacagt

SEQ ID NO: 7764307 - DNA, 22 bp, Homo sapiens
tccccaggggcatctctctgct

SEQ ID NO: 7764308 - DNA, 22 bp, Homo sapiens
gctttctaatctatttccttac

SEQ ID NO: 7764309 - DNA, 22 bp, Homo sapiens
gctttccctgccctcagaagga

SEQ ID NO: 7764310 - DNA, 22 bp, Homo sapiens
gctttcaaatcctaattccaac

SEQ ID NO: 7764311 - DNA, 22 bp, Homo sapiens
gctttggaaactggccctgcgc

SEQ ID NO: 7764312 - DNA, 22 bp, Homo sapiens
gctttgcttcctgttctagcct

SEQ ID NO: 7764313 - DNA, 22 bp, Homo sapiens
gctttggaacttaaatccttgg

SEQ ID NO: 7764314 - DNA, 22 bp, Homo sapiens
ggaagacaagcagtggctgagc

SEQ ID NO: 7764315 - DNA, 22 bp, Homo sapiens
ggaagaggaggagccaggcttt

SEQ ID NO: 7764316 - DNA, 22 bp, Homo sapiens
ggaagaggaggagccaggcttt

SEQ ID NO: 7764317 - DNA, 22 bp, Homo sapiens
gctttggagggcaagagctgtt

SEQ ID NO: 7764318 - DNA, 22 bp, Homo sapiens
gctttggagttaggactcggcc

SEQ ID NO: 7764319 - DNA, 22 bp, Homo sapiens
ggaagaggctctcattgagggc

SEQ ID NO: 7764320 - DNA, 22 bp, Homo sapiens
ggaagaggctctcattgagggc

SEQ ID NO: 7764321 - DNA, 22 bp, Homo sapiens
ggaagaggctgagccaggtccc

SEQ ID NO: 7764322 - DNA, 17 bp, Homo sapiens
ggacacagctcatggct

SEQ ID NO: 7764323 - DNA, 18 bp, Homo sapiens
ggacacagataggtacag

SEQ ID NO: 7764324 - DNA, 22 bp, Homo sapiens
ggaagcagcctgaagccaaggg

SEQ ID NO: 7764325 - DNA, 22 bp, Homo sapiens
ggaagattcagttatctcatga

SEQ ID NO: 7764326 - DNA, 22 bp, Homo sapiens
ggaagatgagaagtggggctcc

SEQ ID NO: 7764327 - DNA, 22 bp, Homo sapiens
ggaagaggctggtagtgcccgt

SEQ ID NO: 7764328 - DNA, 22 bp, Homo sapiens
ggagagagagctcattagctgc

SEQ ID NO: 7764329 - DNA, 22 bp, Homo sapiens
ggagcaggctctgtggtttcca

SEQ ID NO: 7764330 - DNA, 22 bp, Homo sapiens
ggagccagagcactggggagcc

SEQ ID NO: 7764331 - DNA, 22 bp, Homo sapiens
ggacacagtggaagacagcttg

SEQ ID NO: 7764332 - DNA, 23 bp, Homo sapiens
ggacacaggccttgtctgcgcct

SEQ ID NO: 7764333 - DNA, 22 bp, Homo sapiens
ggacacaggcagctgggtgggt

SEQ ID NO: 7764334 - DNA, 22 bp, Homo sapiens
ggacacaggcagctgggtgggt

SEQ ID NO: 7764335 - DNA, 20 bp, Homo sapiens
ggaccagctgtctgaggggc

SEQ ID NO: 7764336 - DNA, 22 bp, Homo sapiens
ggacatggaaatcggcttgctc

SEQ ID NO: 7764337 - DNA, 22 bp, Homo sapiens
ggaccaggccagcctccctgcg

SEQ ID NO: 7764338 - DNA, 22 bp, Homo sapiens
ggaccaggctgagcacctgcct

SEQ ID NO: 7764339 - DNA, 22 bp, Homo sapiens
ggaccaggagctcagagccctc

SEQ ID NO: 7764340 - DNA, 22 bp, Homo sapiens
ggaccaggactggtggtatctc

SEQ ID NO: 7764341 - DNA, 22 bp, Homo sapiens
ggaccaggggcgcactccctgc

SEQ ID NO: 7764342 - DNA, 17 bp, Homo sapiens
ggaccaggggttgccat

SEQ ID NO: 7764343 - DNA, 20 bp, Homo sapiens
ggaccaggtggggcggtggc

SEQ ID NO: 7764344 - DNA, 19 bp, Homo sapiens
ggaccaggtcctgggcagc

SEQ ID NO: 7764345 - DNA, 22 bp, Homo sapiens
ggacccaccaggccgggctcca

SEQ ID NO: 7764346 - DNA, 22 bp, Homo sapiens
ggagacagtatggcttgtagct

SEQ ID NO: 7764347 - DNA, 22 bp, Homo sapiens
gctgtggtctgtgagctccaaa

SEQ ID NO: 7764348 - DNA, 20 bp, Homo sapiens
gctgtgtagcagtgtgcagt

SEQ ID NO: 7764349 - DNA, 22 bp, Homo sapiens
gcttgcagcaggtgcttaggaa

SEQ ID NO: 7764350 - DNA, 19 bp, Homo sapiens
gcttgctggcgggggtctg

SEQ ID NO: 7764351 - DNA, 19 bp, Homo sapiens
gcttgctgctaggtaggga

SEQ ID NO: 7764352 - DNA, 22 bp, Homo sapiens
gctggggctgggctgaggaaga

SEQ ID NO: 7764353 - DNA, 20 bp, Homo sapiens
gctgtgcctccagctggtgg

SEQ ID NO: 7764354 - DNA, 19 bp, Homo sapiens
gctgtgcccctgccgcttg

SEQ ID NO: 7764355 - DNA, 22 bp, Homo sapiens
gctggggcctgaacagtcagct

SEQ ID NO: 7764356 - DNA, 22 bp, Homo sapiens
gctggggaggcagcagagaaca

SEQ ID NO: 7764357 - DNA, 22 bp, Homo sapiens
gctgtggctgtacagagaccat

SEQ ID NO: 7764358 - DNA, 22 bp, Homo sapiens
gctgtggcttgcagctggggct

SEQ ID NO: 7764359 - DNA, 19 bp, Homo sapiens
gctgtgggacagcagggtg

SEQ ID NO: 7764360 - DNA, 22 bp, Homo sapiens
gctgtgggtttccaatcctgga

SEQ ID NO: 7764361 - DNA, 22 bp, Homo sapiens
gctgtgggtaaacgctgagggt

SEQ ID NO: 7764362 - DNA, 19 bp, Homo sapiens
gctgtgggacagcagggtg

SEQ ID NO: 7764363 - DNA, 22 bp, Homo sapiens
gctgggctggaaggccaaggca

SEQ ID NO: 7764364 - DNA, 22 bp, Homo sapiens
gctggctttatggggcttgtgg

SEQ ID NO: 7764365 - DNA, 21 bp, Homo sapiens
gctggctttcctggatgtgca

SEQ ID NO: 7764366 - DNA, 22 bp, Homo sapiens
gctggctttgtcaagggcagca

SEQ ID NO: 7764367 - DNA, 22 bp, Homo sapiens
gctggctttgcactgggtgcat

SEQ ID NO: 7764368 - DNA, 23 bp, Homo sapiens
gctgggcttactctttcagtgag

SEQ ID NO: 7764369 - DNA, 22 bp, Homo sapiens
gctgggctgtagtttgctgacc

SEQ ID NO: 7764370 - DNA, 18 bp, Homo sapiens
gctggcttgctgggtttg

SEQ ID NO: 7764371 - DNA, 21 bp, Homo sapiens
gctggcttcctgagggctgag

SEQ ID NO: 7764372 - DNA, 22 bp, Homo sapiens
gctggctgttggaggtacctgc

SEQ ID NO: 7764373 - DNA, 22 bp, Homo sapiens
gctggcttaatagggatgggct

SEQ ID NO: 7764374 - DNA, 22 bp, Homo sapiens
gctggctgtggcttaagcaaac

SEQ ID NO: 7764375 - DNA, 22 bp, Homo sapiens
gctggctgtgggctccacgctc

SEQ ID NO: 7764376 - DNA, 22 bp, Homo sapiens
gctggctgtgggctccacgctc

SEQ ID NO: 7764377 - DNA, 21 bp, Homo sapiens
gctggctggctgaccggcctt

SEQ ID NO: 7764378 - DNA, 21 bp, Homo sapiens
gctggctggctgaccggcctt

SEQ ID NO: 7764379 - DNA, 22 bp, Homo sapiens
gctggctgtgttccttctgcca

SEQ ID NO: 7764380 - DNA, 22 bp, Homo sapiens
gctggctgtgttccttctgcca

SEQ ID NO: 7764381 - DNA, 22 bp, Homo sapiens
gctggctgtgtttcatctctga

SEQ ID NO: 7764382 - DNA, 22 bp, Homo sapiens
gctggctgttgaataatggcat

SEQ ID NO: 7764383 - DNA, 22 bp, Homo sapiens
gctggctgttgaataatggcat

SEQ ID NO: 7764384 - DNA, 22 bp, Homo sapiens
gctggagaaactgcagctgagg

SEQ ID NO: 7764385 - DNA, 22 bp, Homo sapiens
gctggagaaactgcagctgagg

SEQ ID NO: 7764386 - DNA, 22 bp, Homo sapiens
gctggagaacccaggaggaaga

SEQ ID NO: 7764387 - DNA, 22 bp, Homo sapiens
gctggagacctcagagaaccca

SEQ ID NO: 7764388 - DNA, 22 bp, Homo sapiens
gctggctgcgtcatcacagggc

SEQ ID NO: 7764389 - DNA, 22 bp, Homo sapiens
gctggctgcgtcatcacagggc

SEQ ID NO: 7764390 - DNA, 22 bp, Homo sapiens
gctggctgctaggacagctaca

SEQ ID NO: 7764391 - DNA, 22 bp, Homo sapiens
gctggctggaactagcagttgg

SEQ ID NO: 7764392 - DNA, 22 bp, Homo sapiens
gctggctgctgttgagacttgt

SEQ ID NO: 7764393 - DNA, 22 bp, Homo sapiens
gctggctggaatgggagaagaa

SEQ ID NO: 7764394 - DNA, 22 bp, Homo sapiens
gctggctggaactagcagttgg

SEQ ID NO: 7764395 - DNA, 22 bp, Homo sapiens
gctggctggaatgggagaagaa

SEQ ID NO: 7764396 - DNA, 22 bp, Homo sapiens
gctggctggaatgggagaagaa

SEQ ID NO: 7764397 - DNA, 22 bp, Homo sapiens
gctggctggaggagggaggttg

SEQ ID NO: 7764398 - DNA, 19 bp, Homo sapiens
gctggctggaggagggaca

SEQ ID NO: 7764399 - DNA, 22 bp, Homo sapiens
gctggctggaggtgaggaagaa

SEQ ID NO: 7764400 - DNA, 22 bp, Homo sapiens
gctggctggaggtgaggaagaa

SEQ ID NO: 7764401 - DNA, 22 bp, Homo sapiens
gctggctggagtaaggagggag

SEQ ID NO: 7764402 - DNA, 22 bp, Homo sapiens
gctggctggagtgagctaccct

SEQ ID NO: 7764403 - DNA, 22 bp, Homo sapiens
gctggctggcacgttcgcacgt

SEQ ID NO: 7764404 - DNA, 22 bp, Homo sapiens
gctggctggatggttggttcgc

SEQ ID NO: 7764405 - DNA, 23 bp, Homo sapiens
gctggctggcagtaaaggttgtt

SEQ ID NO: 7764406 - DNA, 22 bp, Homo sapiens
gctggctggcgggtgcgtcctc

SEQ ID NO: 7764407 - DNA, 22 bp, Homo sapiens
gctgctcagtgggcctgagcct

SEQ ID NO: 7764408 - DNA, 22 bp, Homo sapiens
gctgcctgtgtggccactcact

SEQ ID NO: 7764409 - DNA, 22 bp, Homo sapiens
gctgcctgttgaagggtctgtg

SEQ ID NO: 7764410 - DNA, 22 bp, Homo sapiens
gctgcctcactccagcccaata

SEQ ID NO: 7764411 - DNA, 22 bp, Homo sapiens
gctgctgtgaattttttaaatg

SEQ ID NO: 7764412 - DNA, 22 bp, Homo sapiens
gctgctgtgccccatctgcaga

SEQ ID NO: 7764413 - DNA, 22 bp, Homo sapiens
gctgcttctcctccctggggat

SEQ ID NO: 7764414 - DNA, 22 bp, Homo sapiens
gctgctgttgatttagtccaat

SEQ ID NO: 7764415 - DNA, 22 bp, Homo sapiens
gctgcttcctttcctgctgacc

SEQ ID NO: 7764416 - DNA, 22 bp, Homo sapiens
gctgagggctgtaacagcagag

SEQ ID NO: 7764417 - DNA, 22 bp, Homo sapiens
gctgagggcagcctcctaggtc

SEQ ID NO: 7764418 - DNA, 22 bp, Homo sapiens
gctgagggcatgtgtggcgact

SEQ ID NO: 7764419 - DNA, 22 bp, Homo sapiens
gctgcccagggctgagtgtcct

SEQ ID NO: 7764420 - DNA, 22 bp, Homo sapiens
gctgcccagttctgctgctgcc

SEQ ID NO: 7764421 - DNA, 22 bp, Homo sapiens
gctgcctgtcctgaggagtccg

SEQ ID NO: 7764422 - DNA, 22 bp, Homo sapiens
gctgcctccaatctgtgccccg

SEQ ID NO: 7764423 - DNA, 22 bp, Homo sapiens
gctgcctccaatctgtgccccg

SEQ ID NO: 7764424 - DNA, 22 bp, Homo sapiens
gctgcctcaggcacctcctggc

SEQ ID NO: 7764425 - DNA, 22 bp, Homo sapiens
gctgcctcactccagcccaata

SEQ ID NO: 7764426 - DNA, 22 bp, Homo sapiens
gctgccgacccacaggggttaa

SEQ ID NO: 7764427 - DNA, 22 bp, Homo sapiens
gctgccccagctgggggctgga

SEQ ID NO: 7764428 - DNA, 22 bp, Homo sapiens
gctgccccccggactcggcggg

SEQ ID NO: 7764429 - DNA, 22 bp, Homo sapiens
gctccctgttctcagccatgat

SEQ ID NO: 7764430 - DNA, 22 bp, Homo sapiens
gctgaggctcctcgggaggaca

SEQ ID NO: 7764431 - DNA, 22 bp, Homo sapiens
gctgagagatcaaggcaggatt

SEQ ID NO: 7764432 - DNA, 22 bp, Homo sapiens
gctgagagaaaagtgaggttct

SEQ ID NO: 7764433 - DNA, 22 bp, Homo sapiens
gctgagacttccactgccatct

SEQ ID NO: 7764434 - DNA, 22 bp, Homo sapiens
gctgagactgacatgaagaggt

SEQ ID NO: 7764435 - DNA, 22 bp, Homo sapiens
gctgagaatcaagatggagagg

SEQ ID NO: 7764436 - DNA, 22 bp, Homo sapiens
gctgagagcacatagaaggggc

SEQ ID NO: 7764437 - DNA, 17 bp, Homo sapiens
gctgagaggcagcacag

SEQ ID NO: 7764438 - DNA, 21 bp, Homo sapiens
gctgagaggttgggaagttca

SEQ ID NO: 7764439 - DNA, 22 bp, Homo sapiens
gctgagaggcagccagaccctc

SEQ ID NO: 7764440 - DNA, 22 bp, Homo sapiens
gctcccacaaccttcttgctcc

SEQ ID NO: 7764441 - DNA, 22 bp, Homo sapiens
gctcccactgcagccctgagcc

SEQ ID NO: 7764442 - DNA, 22 bp, Homo sapiens
gctcccacgcaattcttttcag

SEQ ID NO: 7764443 - DNA, 22 bp, Homo sapiens
gctcccacctttgctatcagta

SEQ ID NO: 7764444 - DNA, 22 bp, Homo sapiens
gctcccaccttaaccttcacat

SEQ ID NO: 7764445 - DNA, 22 bp, Homo sapiens
gctcccaccgccgctatgggta

SEQ ID NO: 7764446 - DNA, 22 bp, Homo sapiens
gctcccacctccagcctgagtt

SEQ ID NO: 7764447 - DNA, 22 bp, Homo sapiens
gctcccaccaggcagacctacc

SEQ ID NO: 7764448 - DNA, 22 bp, Homo sapiens
gctccctggtagccatgctctc

SEQ ID NO: 7764449 - DNA, 21 bp, Homo sapiens
gctccctgctcagctcctggg

SEQ ID NO: 7764450 - DNA, 22 bp, Homo sapiens
gctccctggtattgctgccact

SEQ ID NO: 7764451 - DNA, 22 bp, Homo sapiens
gctccctggtagccatgctctc

SEQ ID NO: 7764452 - DNA, 23 bp, Homo sapiens
gctccctgtccctgcacttaggc

SEQ ID NO: 7764453 - DNA, 22 bp, Homo sapiens
gctccctgcactctgcagccct

SEQ ID NO: 7764454 - DNA, 22 bp, Homo sapiens
gctccctgactcagttcctgag

SEQ ID NO: 7764455 - DNA, 17 bp, Homo sapiens
gctccctgaggacagct

SEQ ID NO: 7764456 - DNA, 22 bp, Homo sapiens
gctcagagttaaatatagtgct

SEQ ID NO: 7764457 - DNA, 22 bp, Homo sapiens
gctcagagttaattggatgggt

SEQ ID NO: 7764458 - DNA, 22 bp, Homo sapiens
gctcagctacttacaggtggct

SEQ ID NO: 7764459 - DNA, 22 bp, Homo sapiens
gctcagctacttacaggtggct

SEQ ID NO: 7764460 - DNA, 22 bp, Homo sapiens
gctcagctgagcgaaggacatg

SEQ ID NO: 7764461 - DNA, 22 bp, Homo sapiens
gctcagctctatggacacaaag

SEQ ID NO: 7764462 - DNA, 18 bp, Homo sapiens
gctcagctatgggaggtt

SEQ ID NO: 7764463 - DNA, 22 bp, Homo sapiens
gctcagagtggcctggctaggg

SEQ ID NO: 7764464 - DNA, 22 bp, Homo sapiens
gctcagagggttttggccaagt

SEQ ID NO: 7764465 - DNA, 22 bp, Homo sapiens
gctcagagggttttggccaagt

SEQ ID NO: 7764466 - DNA, 23 bp, Homo sapiens
gctcagaggtttttctctggatg

SEQ ID NO: 7764467 - DNA, 22 bp, Homo sapiens
gctactgattgaccttggagag

SEQ ID NO: 7764468 - DNA, 22 bp, Homo sapiens
gctactgattgaccttggagag

SEQ ID NO: 7764469 - DNA, 22 bp, Homo sapiens
gcggtcggcagaggggctctgc

SEQ ID NO: 7764470 - DNA, 22 bp, Homo sapiens
gcggtggggaaaggaggtgctg

SEQ ID NO: 7764471 - DNA, 22 bp, Homo sapiens
gcggtgggggaaaggagcggtt

SEQ ID NO: 7764472 - DNA, 22 bp, Homo sapiens
gcgtctcaaggcccccaggcca

SEQ ID NO: 7764473 - DNA, 22 bp, Homo sapiens
gcggggttccgtgccccagagt

SEQ ID NO: 7764474 - DNA, 22 bp, Homo sapiens
gcctttcctgctctggcattca

SEQ ID NO: 7764475 - DNA, 22 bp, Homo sapiens
gcctttgaattgttgtggtgag

SEQ ID NO: 7764476 - DNA, 22 bp, Homo sapiens
gcctttcacagagatttaaaaa

SEQ ID NO: 7764477 - DNA, 22 bp, Homo sapiens
gcctctggtccctcatgctgtg

SEQ ID NO: 7764478 - DNA, 22 bp, Homo sapiens
gcctgagcaggcgtggaccatg

SEQ ID NO: 7764479 - DNA, 19 bp, Homo sapiens
gcctgagccagccatgcaa

SEQ ID NO: 7764480 - DNA, 22 bp, Homo sapiens
gccttggagatcactgctcatg

SEQ ID NO: 7764481 - DNA, 22 bp, Homo sapiens
gccttggactcgggtggactca

SEQ ID NO: 7764482 - DNA, 22 bp, Homo sapiens
gcctgagccgcctgagcggcgg

SEQ ID NO: 7764483 - DNA, 20 bp, Homo sapiens
gcctgagctattgccaggat

SEQ ID NO: 7764484 - DNA, 22 bp, Homo sapiens
gccttggctgttggagcttgat

SEQ ID NO: 7764485 - DNA, 22 bp, Homo sapiens
gccttggctgccaagctgctga

SEQ ID NO: 7764486 - DNA, 19 bp, Homo sapiens
gccttggcattctctgctt

SEQ ID NO: 7764487 - DNA, 22 bp, Homo sapiens
gccaccagcagaaaaggggcca

SEQ ID NO: 7764488 - DNA, 22 bp, Homo sapiens
gccacatgtcatgtgctcagta

SEQ ID NO: 7764489 - DNA, 22 bp, Homo sapiens
gccaccagccccatgcgctgtg

SEQ ID NO: 7764490 - DNA, 22 bp, Homo sapiens
gccaccagtagctaacaacagt

SEQ ID NO: 7764491 - DNA, 22 bp, Homo sapiens
gccaccagtgggggcctgggca

SEQ ID NO: 7764492 - DNA, 22 bp, Homo sapiens
gccaccagtgggggcctgggca

SEQ ID NO: 7764493 - DNA, 22 bp, Homo sapiens
gcatggctattatgaggcagaa

SEQ ID NO: 7764494 - DNA, 22 bp, Homo sapiens
gcatgcatgtgtgcagacagtc

SEQ ID NO: 7764495 - DNA, 22 bp, Homo sapiens
gcatgctgctgaggctggaata

SEQ ID NO: 7764496 - DNA, 22 bp, Homo sapiens
gcatgctgctgaggctggaata

SEQ ID NO: 7764497 - DNA, 22 bp, Homo sapiens
gcatgctgagcccacgcctggg

SEQ ID NO: 7764498 - DNA, 21 bp, Homo sapiens
gcatgcctgcatcttagtgtt

SEQ ID NO: 7764499 - DNA, 22 bp, Homo sapiens
gcagtgatggggatctcactgg

SEQ ID NO: 7764500 - DNA, 20 bp, Homo sapiens
gcagtgatctcatcggtctg

SEQ ID NO: 7764501 - DNA, 22 bp, Homo sapiens
gcagtgataactttactctttt

SEQ ID NO: 7764502 - DNA, 22 bp, Homo sapiens
gcagtggatggccagcaggggc

SEQ ID NO: 7764503 - DNA, 22 bp, Homo sapiens
gcagtggatggccagcaggggc

SEQ ID NO: 7764504 - DNA, 22 bp, Homo sapiens
gcagtggcatgatgtgggctca

SEQ ID NO: 7764505 - DNA, 22 bp, Homo sapiens
gcagtgggagcttaggcagtgc

SEQ ID NO: 7764506 - DNA, 22 bp, Homo sapiens
gcagtgggagcttaggcagtgc

SEQ ID NO: 7764507 - DNA, 22 bp, Homo sapiens
gcagtggccacatggaggagga

SEQ ID NO: 7764508 - DNA, 22 bp, Homo sapiens
gcatgcaatgtatcagtgatag

SEQ ID NO: 7764509 - DNA, 22 bp, Homo sapiens
gcatgcaatctatccttaggaa

SEQ ID NO: 7764510 - DNA, 22 bp, Homo sapiens
gcatgcaaggggtgtgaagtga

SEQ ID NO: 7764511 - DNA, 22 bp, Homo sapiens
gcatgcaaggaccaagggagca

SEQ ID NO: 7764512 - DNA, 23 bp, Homo sapiens
gcatgcaacttgcagtagtattc

SEQ ID NO: 7764513 - DNA, 22 bp, Homo sapiens
gcatgcaattatggtattagat

SEQ ID NO: 7764514 - DNA, 22 bp, Homo sapiens
gcatgcaggaagggcttgggga

SEQ ID NO: 7764515 - DNA, 21 bp, Homo sapiens
gccacccctggcacaggtgct

SEQ ID NO: 7764516 - DNA, 22 bp, Homo sapiens
gccaccccaacctccctaagtt

SEQ ID NO: 7764517 - DNA, 22 bp, Homo sapiens
gccagcctgtgcttggccaggc

SEQ ID NO: 7764518 - DNA, 22 bp, Homo sapiens
gccagcctgtgggggctctgtg

SEQ ID NO: 7764519 - DNA, 21 bp, Homo sapiens
gccagcctgtttacctgtggt

SEQ ID NO: 7764520 - DNA, 21 bp, Homo sapiens
gccagcctgtttacctgtggt

SEQ ID NO: 7764521 - DNA, 22 bp, Homo sapiens
gccagccttctgtggcctgcaa

SEQ ID NO: 7764522 - DNA, 21 bp, Homo sapiens
gccagcggccgccctccagga

SEQ ID NO: 7764523 - DNA, 22 bp, Homo sapiens
gccagctcagatgcaggaagga

SEQ ID NO: 7764524 - DNA, 22 bp, Homo sapiens
gccagctcccaagtgagcccct

SEQ ID NO: 7764525 - DNA, 22 bp, Homo sapiens
gccagctgaatttccaactgtt

SEQ ID NO: 7764526 - DNA, 22 bp, Homo sapiens
gccagctgacaccttgattttg

SEQ ID NO: 7764527 - DNA, 22 bp, Homo sapiens
gccaggcactgctctaagccct

SEQ ID NO: 7764528 - DNA, 22 bp, Homo sapiens
gccagctgaagccctggtggaa

SEQ ID NO: 7764529 - DNA, 20 bp, Homo sapiens
gccaggcactgttctcaata

SEQ ID NO: 7764530 - DNA, 22 bp, Homo sapiens
gccaggcagacaggtcatcagg

SEQ ID NO: 7764531 - DNA, 22 bp, Homo sapiens
gccaggcagccaccctctgcga

SEQ ID NO: 7764532 - DNA, 22 bp, Homo sapiens
gccaggcagccaccctctgcga

SEQ ID NO: 7764533 - DNA, 22 bp, Homo sapiens
gccaggcagcagcgaggatggt

SEQ ID NO: 7764534 - DNA, 22 bp, Homo sapiens
gccaggcagcagcgaggatggt

SEQ ID NO: 7764535 - DNA, 22 bp, Homo sapiens
gccaggcagatatgtgagctta

SEQ ID NO: 7764536 - DNA, 22 bp, Homo sapiens
gccaggcagatatgtgagctta

SEQ ID NO: 7764537 - DNA, 22 bp, Homo sapiens
gccaggcaggccacgctgtgtt

SEQ ID NO: 7764538 - DNA, 22 bp, Homo sapiens
gccaggcagctgggagggtgcc

SEQ ID NO: 7764539 - DNA, 22 bp, Homo sapiens
gccaggcagctagcaacccctg

SEQ ID NO: 7764540 - DNA, 22 bp, Homo sapiens
gccaggcaggtgtcggagccct

SEQ ID NO: 7764541 - DNA, 18 bp, Homo sapiens
gccaggcagggtggggaa

SEQ ID NO: 7764542 - DNA, 22 bp, Homo sapiens
gccaggcatgggcttctgggcg

SEQ ID NO: 7764543 - DNA, 22 bp, Homo sapiens
gccaggcatgtcctctgcagaa

SEQ ID NO: 7764544 - DNA, 22 bp, Homo sapiens
gccaggcatgtcctctgcagaa

SEQ ID NO: 7764545 - DNA, 21 bp, Homo sapiens
gccagggaagagagttggctg

SEQ ID NO: 7764546 - DNA, 22 bp, Homo sapiens
gccccaccgagggtgcagtcct

SEQ ID NO: 7764547 - DNA, 22 bp, Homo sapiens
gccccaccgagggtgcagtcct

SEQ ID NO: 7764548 - DNA, 22 bp, Homo sapiens
gccccacctgctaccttccagc

SEQ ID NO: 7764549 - DNA, 22 bp, Homo sapiens
gcccagctggcttccagcacat

SEQ ID NO: 7764550 - DNA, 22 bp, Homo sapiens
gcccaggaagttgaggctgccg

SEQ ID NO: 7764551 - DNA, 22 bp, Homo sapiens
gcccagcctccaagctccaagg

SEQ ID NO: 7764552 - DNA, 22 bp, Homo sapiens
gcccagcctccaagctccaagg

SEQ ID NO: 7764553 - DNA, 22 bp, Homo sapiens
gcccagccctgaggtcacagct

SEQ ID NO: 7764554 - DNA, 22 bp, Homo sapiens
gcccagctggcttccagcacat

SEQ ID NO: 7764555 - DNA, 22 bp, Homo sapiens
gcccagcagctggtggagaagg

SEQ ID NO: 7764556 - DNA, 22 bp, Homo sapiens
gcccagcacctctctcagggtt

SEQ ID NO: 7764557 - DNA, 22 bp, Homo sapiens
gcccagcactaaaagctttgct

SEQ ID NO: 7764558 - DNA, 22 bp, Homo sapiens
gcccagcactcctctctgacat

SEQ ID NO: 7764559 - DNA, 22 bp, Homo sapiens
gcccagcactcctctctgacat

SEQ ID NO: 7764560 - DNA, 22 bp, Homo sapiens
gccaggggtgcccacccaagga

SEQ ID NO: 7764561 - DNA, 22 bp, Homo sapiens
gccagggtcctgaagaccaagt

SEQ ID NO: 7764562 - DNA, 22 bp, Homo sapiens
gccagggtgagggctgagaggt

SEQ ID NO: 7764563 - DNA, 22 bp, Homo sapiens
gccagggtggcagaaggcccca

SEQ ID NO: 7764564 - DNA, 22 bp, Homo sapiens
gccagggttcgaatccgtatgg

SEQ ID NO: 7764565 - DNA, 22 bp, Homo sapiens
gccagggttcgaatccgtatgg

SEQ ID NO: 7764566 - DNA, 22 bp, Homo sapiens
gccagggtgtgcagggacagga

SEQ ID NO: 7764567 - DNA, 22 bp, Homo sapiens
gccagggttcaagctattctcc

SEQ ID NO: 7764568 - DNA, 22 bp, Homo sapiens
gcccagcacattgctgaggacc

SEQ ID NO: 7764569 - DNA, 22 bp, Homo sapiens
gcccagcacagctggaagagtc

SEQ ID NO: 7764570 - DNA, 22 bp, Homo sapiens
gcccagcacatctggccttgaa

SEQ ID NO: 7764571 - DNA, 22 bp, Homo sapiens
gcccagcacagctggaagagtc

SEQ ID NO: 7764572 - DNA, 21 bp, Homo sapiens
gcccagcaaggtgagaaggcc

SEQ ID NO: 7764573 - DNA, 21 bp, Homo sapiens
gcccagcaaggtgagaaggcc

SEQ ID NO: 7764574 - DNA, 22 bp, Homo sapiens
gccagggttgccaatgggggca

SEQ ID NO: 7764575 - DNA, 22 bp, Homo sapiens
gccagggttgccaatgggggca

SEQ ID NO: 7764576 - DNA, 22 bp, Homo sapiens
gccagggttcgaatccgtatgg

SEQ ID NO: 7764577 - DNA, 22 bp, Homo sapiens
gcctcctggattttagtgccat

SEQ ID NO: 7764578 - DNA, 22 bp, Homo sapiens
gcctcctgagtagctgggattg

SEQ ID NO: 7764579 - DNA, 22 bp, Homo sapiens
gcctcctgagaagccacaggct

SEQ ID NO: 7764580 - DNA, 22 bp, Homo sapiens
gcctcctgagaagccacaggct

SEQ ID NO: 7764581 - DNA, 22 bp, Homo sapiens
gcctcctgggttcatgccattc

SEQ ID NO: 7764582 - DNA, 22 bp, Homo sapiens
gcctcctggttgcttctccaac

SEQ ID NO: 7764583 - DNA, 22 bp, Homo sapiens
gcctcctggggtgccatcatct

SEQ ID NO: 7764584 - DNA, 22 bp, Homo sapiens
gcctcccttggtgtctcccggg

SEQ ID NO: 7764585 - DNA, 22 bp, Homo sapiens
gcctccggagtcacagtgtctt

SEQ ID NO: 7764586 - DNA, 22 bp, Homo sapiens
gcctccggagttgcagtgtctt

SEQ ID NO: 7764587 - DNA, 22 bp, Homo sapiens
gcctcctgaagtgctgggatta

SEQ ID NO: 7764588 - DNA, 22 bp, Homo sapiens
gccctgggattgggtggaggct

SEQ ID NO: 7764589 - DNA, 22 bp, Homo sapiens
gccctggccttcatctcagaca

SEQ ID NO: 7764590 - DNA, 22 bp, Homo sapiens
gccctgggattgggtggaggct

SEQ ID NO: 7764591 - DNA, 22 bp, Homo sapiens
gccctgggattgggtggaggct

SEQ ID NO: 7764592 - DNA, 22 bp, Homo sapiens
gccctggatggcaggagccatc

SEQ ID NO: 7764593 - DNA, 22 bp, Homo sapiens
gccctggagggccagcgactgg

SEQ ID NO: 7764594 - DNA, 22 bp, Homo sapiens
gccctggatgctcatggcatca

SEQ ID NO: 7764595 - DNA, 22 bp, Homo sapiens
gccctggatgctcatggcatca

SEQ ID NO: 7764596 - DNA, 22 bp, Homo sapiens
gccctggatgtacaggcatgtt

SEQ ID NO: 7764597 - DNA, 22 bp, Homo sapiens
gccctggatgtacaggcatgtt

SEQ ID NO: 7764598 - DNA, 22 bp, Homo sapiens
gccctggatggcaggagccatc

SEQ ID NO: 7764599 - DNA, 22 bp, Homo sapiens
gccccagcctcccgagtagctg

SEQ ID NO: 7764600 - DNA, 22 bp, Homo sapiens
gccccagcctcccgagtagctg

SEQ ID NO: 7764601 - DNA, 22 bp, Homo sapiens
gccccagccctgtggaccatgg

SEQ ID NO: 7764602 - DNA, 17 bp, Homo sapiens
gccctggagccaggcta

SEQ ID NO: 7764603 - DNA, 22 bp, Homo sapiens
gccccaggggaggtgccctgca

SEQ ID NO: 7764604 - DNA, 22 bp, Homo sapiens
gccctggagctagactaggaca

SEQ ID NO: 7764605 - DNA, 17 bp, Homo sapiens
gccctggagccaggcta

SEQ ID NO: 7764606 - DNA, 22 bp, Homo sapiens
gccccagcctgggaactggagg

SEQ ID NO: 7764607 - DNA, 22 bp, Homo sapiens
gccccaggataaatttgtaaga

SEQ ID NO: 7764608 - DNA, 15 bp, Homo sapiens
gccccaggaatcaaa

SEQ ID NO: 7764609 - DNA, 19 bp, Homo sapiens
gcacacagtagggctggca

SEQ ID NO: 7764610 - DNA, 22 bp, Homo sapiens
gcacacagtagggattcaatga

SEQ ID NO: 7764611 - DNA, 22 bp, Homo sapiens
gcacacagtactatatgctaca

SEQ ID NO: 7764612 - DNA, 22 bp, Homo sapiens
gcacacagaacatttggatcct

SEQ ID NO: 7764613 - DNA, 22 bp, Homo sapiens
gcaaatcaccacctagctggat

SEQ ID NO: 7764614 - DNA, 22 bp, Homo sapiens
gcacagtacctgtcacagaggc

SEQ ID NO: 7764615 - DNA, 22 bp, Homo sapiens
gcacagggctgccaggcggctt

SEQ ID NO: 7764616 - DNA, 22 bp, Homo sapiens
gcacagggctgccaggcggctt

SEQ ID NO: 7764617 - DNA, 22 bp, Homo sapiens
gcacactggagcctggaagatt

SEQ ID NO: 7764618 - DNA, 19 bp, Homo sapiens
gcacaccctgcaccaccat

SEQ ID NO: 7764619 - DNA, 22 bp, Homo sapiens
gcacaccctctcaccagcactg

SEQ ID NO: 7764620 - DNA, 22 bp, Homo sapiens
gcaaagtgcttcagtgggagct

SEQ ID NO: 7764621 - DNA, 22 bp, Homo sapiens
gcaaagtgaaatggggcagaga

SEQ ID NO: 7764622 - DNA, 22 bp, Homo sapiens
gcaaagctgggtgtgaatgcac

SEQ ID NO: 7764623 - DNA, 22 bp, Homo sapiens
gcaaagcaatcaggagtagcat

SEQ ID NO: 7764624 - DNA, 22 bp, Homo sapiens
gcaaagcaagattcagatgtag

SEQ ID NO: 7764625 - DNA, 22 bp, Homo sapiens
gaggcccagagaggttgcatga

SEQ ID NO: 7764626 - DNA, 22 bp, Homo sapiens
gaggcccagagaggttgcatga

SEQ ID NO: 7764627 - DNA, 20 bp, Homo sapiens
gaggcccagagaggtgaagc

SEQ ID NO: 7764628 - DNA, 22 bp, Homo sapiens
gaggcccaaggactctgtcccg

SEQ ID NO: 7764629 - DNA, 22 bp, Homo sapiens
gaggccataagaagttcttggg

SEQ ID NO: 7764630 - DNA, 22 bp, Homo sapiens
gcaaagatattagaatagagta

SEQ ID NO: 7764631 - DNA, 22 bp, Homo sapiens
gcaaagactgcaattacttttg

SEQ ID NO: 7764632 - DNA, 22 bp, Homo sapiens
gcaaagacccaggtgtctatcc

SEQ ID NO: 7764633 - DNA, 22 bp, Homo sapiens
gcaaagacaaattagaactcct

SEQ ID NO: 7764634 - DNA, 22 bp, Homo sapiens
gcagagaaagttttgtcctcag

SEQ ID NO: 7764635 - DNA, 22 bp, Homo sapiens
gcagagaacccagcagattggc

SEQ ID NO: 7764636 - DNA, 22 bp, Homo sapiens
gcagagaagatgcccaggcttc

SEQ ID NO: 7764637 - DNA, 18 bp, Homo sapiens
gcagagcagaagctcaag

SEQ ID NO: 7764638 - DNA, 22 bp, Homo sapiens
gcagactgcgagcgtgctggtg

SEQ ID NO: 7764639 - DNA, 22 bp, Homo sapiens
gcagactgtacctggaagaggg

SEQ ID NO: 7764640 - DNA, 22 bp, Homo sapiens
gcacatccaatgattgttttga

SEQ ID NO: 7764641 - DNA, 22 bp, Homo sapiens
gcagaggatagcatatgaacct

SEQ ID NO: 7764642 - DNA, 21 bp, Homo sapiens
gcagaggcacggcaccaaggg

SEQ ID NO: 7764643 - DNA, 22 bp, Homo sapiens
gcagaggcacagccccagatga

SEQ ID NO: 7764644 - DNA, 22 bp, Homo sapiens
gcagaggatcaggctctggaaa

SEQ ID NO: 7764645 - DNA, 22 bp, Homo sapiens
gcagaggatcaggctctggaaa

SEQ ID NO: 7764646 - DNA, 22 bp, Homo sapiens
gcagaggatcaggctctggaaa

SEQ ID NO: 7764647 - DNA, 22 bp, Homo sapiens
gcagaggcacagccccagatga

SEQ ID NO: 7764648 - DNA, 22 bp, Homo sapiens
gcagaggtcctagccaggagtc

SEQ ID NO: 7764649 - DNA, 22 bp, Homo sapiens
gcagaggtcctagccaggagtc

SEQ ID NO: 7764650 - DNA, 22 bp, Homo sapiens
gcagaggccaggccaccagcaa

SEQ ID NO: 7764651 - DNA, 22 bp, Homo sapiens
gcagaggcatttctgacgctgc

SEQ ID NO: 7764652 - DNA, 22 bp, Homo sapiens
gcagaggccaggccaccagcaa

SEQ ID NO: 7764653 - DNA, 22 bp, Homo sapiens
gcagagtggtttcagagttgag

SEQ ID NO: 7764654 - DNA, 22 bp, Homo sapiens
gcagagtggtttcagagttgag

SEQ ID NO: 7764655 - DNA, 22 bp, Homo sapiens
gcagatggagataaatggaact

SEQ ID NO: 7764656 - DNA, 22 bp, Homo sapiens
gcagatggagacgaggttccgc

SEQ ID NO: 7764657 - DNA, 20 bp, Homo sapiens
gcagccgtggagactaggag

SEQ ID NO: 7764658 - DNA, 22 bp, Homo sapiens
gcagccctggcctggcctactt

SEQ ID NO: 7764659 - DNA, 23 bp, Homo sapiens
gcaggacaacagagtgggaaggc

SEQ ID NO: 7764660 - DNA, 22 bp, Homo sapiens
gcaggacaaaatttccagggtg

SEQ ID NO: 7764661 - DNA, 22 bp, Homo sapiens
gcaggaagggaaaggttgactc

SEQ ID NO: 7764662 - DNA, 22 bp, Homo sapiens
gcaggaacccagacaaccaggg

SEQ ID NO: 7764663 - DNA, 19 bp, Homo sapiens
gcaggaaatgagtgattgc

SEQ ID NO: 7764664 - DNA, 22 bp, Homo sapiens
gcaggaaaggttgagactttgc

SEQ ID NO: 7764665 - DNA, 22 bp, Homo sapiens
gcaggaaaaccttcccatgttt

SEQ ID NO: 7764666 - DNA, 22 bp, Homo sapiens
gcagctttttggatgtcagtta

SEQ ID NO: 7764667 - DNA, 22 bp, Homo sapiens
gcagctttgtggagaggcccat

SEQ ID NO: 7764668 - DNA, 23 bp, Homo sapiens
gcaggaactcagggtaggcagca

SEQ ID NO: 7764669 - DNA, 22 bp, Homo sapiens
gcaggaactggagctggatgtt

SEQ ID NO: 7764670 - DNA, 22 bp, Homo sapiens
gcaggaacttgggtgaagtcag

SEQ ID NO: 7764671 - DNA, 22 bp, Homo sapiens
gcaggaagatgagctcaggtaa

SEQ ID NO: 7764672 - DNA, 22 bp, Homo sapiens
gcagatgggagccccaggggag

SEQ ID NO: 7764673 - DNA, 22 bp, Homo sapiens
gcagatggctgagcctgcagat

SEQ ID NO: 7764674 - DNA, 21 bp, Homo sapiens
gcagatgggaagagacgaggc

SEQ ID NO: 7764675 - DNA, 21 bp, Homo sapiens
gcagatgggagtcatcaggct

SEQ ID NO: 7764676 - DNA, 22 bp, Homo sapiens
gcagatggtgccatgtcttgtg

SEQ ID NO: 7764677 - DNA, 22 bp, Homo sapiens
gcagatggtgggggaggagtac

SEQ ID NO: 7764678 - DNA, 22 bp, Homo sapiens
gcagatggtggaggcaagaggc

SEQ ID NO: 7764679 - DNA, 22 bp, Homo sapiens
gcagatggctcagacactgggg

SEQ ID NO: 7764680 - DNA, 22 bp, Homo sapiens
gcagatggcgcagtggaagttc

SEQ ID NO: 7764681 - DNA, 23 bp, Homo sapiens
gcagatggccccagagtgctgcc

SEQ ID NO: 7764682 - DNA, 23 bp, Homo sapiens
gcagatggccccagagtgctgcc

SEQ ID NO: 7764683 - DNA, 22 bp, Homo sapiens
gcagatggatcacctgaggtcg

SEQ ID NO: 7764684 - DNA, 22 bp, Homo sapiens
gcagatggcagcccaggctggg

SEQ ID NO: 7764685 - DNA, 22 bp, Homo sapiens
gcagatggcagcccaggctggg

SEQ ID NO: 7764686 - DNA, 22 bp, Homo sapiens
gcagcccaggtgtagctctttg

SEQ ID NO: 7764687 - DNA, 22 bp, Homo sapiens
gcagatgtaatggctggaggtc

SEQ ID NO: 7764688 - DNA, 22 bp, Homo sapiens
gcagccctcttggtcactaggc

SEQ ID NO: 7764689 - DNA, 22 bp, Homo sapiens
gcagccctcgggtactcacgtg

SEQ ID NO: 7764690 - DNA, 22 bp, Homo sapiens
gcagggacagggcagggccttt

SEQ ID NO: 7764691 - DNA, 18 bp, Homo sapiens
gcagggacacagggtcac

SEQ ID NO: 7764692 - DNA, 18 bp, Homo sapiens
gcagggacacagggtcac

SEQ ID NO: 7764693 - DNA, 22 bp, Homo sapiens
gcagggacaaggcaggtgttct

SEQ ID NO: 7764694 - DNA, 22 bp, Homo sapiens
gcagggaccaaaagaggcagta

SEQ ID NO: 7764695 - DNA, 22 bp, Homo sapiens
gcagggaccaaaagaggcagta

SEQ ID NO: 7764696 - DNA, 22 bp, Homo sapiens
gcagggaccaaaagaggcagta

SEQ ID NO: 7764697 - DNA, 22 bp, Homo sapiens
gcagggacctatgacgatggaa

SEQ ID NO: 7764698 - DNA, 22 bp, Homo sapiens
gcagggacctgccactgctgtc

SEQ ID NO: 7764699 - DNA, 22 bp, Homo sapiens
gcagggacctgccactgctgtc

SEQ ID NO: 7764700 - DNA, 22 bp, Homo sapiens
gcagggcttagaaatggtggct

SEQ ID NO: 7764701 - DNA, 22 bp, Homo sapiens
gcagggctgttcaggagggtgg

SEQ ID NO: 7764702 - DNA, 22 bp, Homo sapiens
gcagggctgttcaggagggtgg

SEQ ID NO: 7764703 - DNA, 22 bp, Homo sapiens
gcagggctgttcaggagggtgg

SEQ ID NO: 7764704 - DNA, 22 bp, Homo sapiens
gcagggctggggctgctcctga

SEQ ID NO: 7764705 - DNA, 22 bp, Homo sapiens
gcagggctgggtcctgtctcat

SEQ ID NO: 7764706 - DNA, 22 bp, Homo sapiens
gcagggctgggtgggagacaga

SEQ ID NO: 7764707 - DNA, 22 bp, Homo sapiens
gcagggctgggtgggagacaga

SEQ ID NO: 7764708 - DNA, 22 bp, Homo sapiens
gcagggctgtggacactttggt

SEQ ID NO: 7764709 - DNA, 16 bp, Homo sapiens
gcaggacactcagaca

SEQ ID NO: 7764710 - DNA, 22 bp, Homo sapiens
gcaggacacagatgcaaggcca

SEQ ID NO: 7764711 - DNA, 16 bp, Homo sapiens
gcaggcagatcacatg

SEQ ID NO: 7764712 - DNA, 22 bp, Homo sapiens
gcaggcagaggtggaggagaca

SEQ ID NO: 7764713 - DNA, 19 bp, Homo sapiens
gcaggcagctggggtatcc

SEQ ID NO: 7764714 - DNA, 22 bp, Homo sapiens
gcaggcagccacgattcccttg

SEQ ID NO: 7764715 - DNA, 22 bp, Homo sapiens
gcaggcagatcacctgtcagga

SEQ ID NO: 7764716 - DNA, 22 bp, Homo sapiens
gcaggcagatcacctgtcagga

SEQ ID NO: 7764717 - DNA, 22 bp, Homo sapiens
gcaggcagatcacctgtcagga

SEQ ID NO: 7764718 - DNA, 22 bp, Homo sapiens
gcagggaagatcttggagctgc

SEQ ID NO: 7764719 - DNA, 21 bp, Homo sapiens
gcagggacaaagcttcaggag

SEQ ID NO: 7764720 - DNA, 19 bp, Homo sapiens
gcaggcagtggcattcgga

SEQ ID NO: 7764721 - DNA, 19 bp, Homo sapiens
gcaggcagtggcattcgga

SEQ ID NO: 7764722 - DNA, 22 bp, Homo sapiens
gcaggcaggtggcatcttgtga

SEQ ID NO: 7764723 - DNA, 22 bp, Homo sapiens
gcagggaagacccggagcagcg

SEQ ID NO: 7764724 - DNA, 22 bp, Homo sapiens
gcaggcagttatttagtagaat

SEQ ID NO: 7764725 - DNA, 22 bp, Homo sapiens
gtccccagctgtgacgagagcc

SEQ ID NO: 7764726 - DNA, 22 bp, Homo sapiens
gtcccctcattttagagaaaga

SEQ ID NO: 7764727 - DNA, 22 bp, Homo sapiens
gtccctcagtagtgcacagtgg

SEQ ID NO: 7764728 - DNA, 22 bp, Homo sapiens
gtccctgcatctgcaggccatg

SEQ ID NO: 7764729 - DNA, 22 bp, Homo sapiens
gtcctgggagatgggaccctga

SEQ ID NO: 7764730 - DNA, 17 bp, Homo sapiens
gtcctgggaggagagag

SEQ ID NO: 7764731 - DNA, 22 bp, Homo sapiens
gtcctgggcccaggggctgcct

SEQ ID NO: 7764732 - DNA, 18 bp, Homo sapiens
gtccacagccctcacagc

SEQ ID NO: 7764733 - DNA, 22 bp, Homo sapiens
gtccacagctctgaggtctccc

SEQ ID NO: 7764734 - DNA, 22 bp, Homo sapiens
gtccacagctctgaggtctccc

SEQ ID NO: 7764735 - DNA, 22 bp, Homo sapiens
gtccacagctggccagggcctc

SEQ ID NO: 7764736 - DNA, 22 bp, Homo sapiens
gtccccagaaaggtgaggcagg

SEQ ID NO: 7764737 - DNA, 22 bp, Homo sapiens
gtccccagagctggtggtggtt

SEQ ID NO: 7764738 - DNA, 19 bp, Homo sapiens
gtatttcaggacaagacgt

SEQ ID NO: 7764739 - DNA, 22 bp, Homo sapiens
gtcattttctagaattatttga

SEQ ID NO: 7764740 - DNA, 22 bp, Homo sapiens
gtcattttctagaattatttga

SEQ ID NO: 7764741 - DNA, 22 bp, Homo sapiens
gtcatttttgactttgaagtga

SEQ ID NO: 7764742 - DNA, 22 bp, Homo sapiens
gtcatttttgactttgaagtga

SEQ ID NO: 7764743 - DNA, 22 bp, Homo sapiens
gtcatttttttcgtaatagtgg

SEQ ID NO: 7764744 - DNA, 22 bp, Homo sapiens
gtcattttgctgcatatttaga

SEQ ID NO: 7764745 - DNA, 22 bp, Homo sapiens
gtcatttttttcgtaatagtgg

SEQ ID NO: 7764746 - DNA, 22 bp, Homo sapiens
gtaaaaggtcaaggccaagtct

SEQ ID NO: 7764747 - DNA, 22 bp, Homo sapiens
gtacatttaggattcattgaaa

SEQ ID NO: 7764748 - DNA, 22 bp, Homo sapiens
gtacatttcatttaaatgatgt

SEQ ID NO: 7764749 - DNA, 22 bp, Homo sapiens
gtacatttatttttgcagcata

SEQ ID NO: 7764750 - DNA, 22 bp, Homo sapiens
gtacatttcagtttccttaaga

SEQ ID NO: 7764751 - DNA, 22 bp, Homo sapiens
gtaccctgtggccagccagcca

SEQ ID NO: 7764752 - DNA, 20 bp, Homo sapiens
gtacattttcaggaggggat

SEQ ID NO: 7764753 - DNA, 22 bp, Homo sapiens
gtacattttgaggttaaaacaa

SEQ ID NO: 7764754 - DNA, 22 bp, Homo sapiens
gtacatttctcttgttcttatt

SEQ ID NO: 7764755 - DNA, 22 bp, Homo sapiens
gtacattttactttgtttgaat

SEQ ID NO: 7764756 - DNA, 22 bp, Homo sapiens
gtacatttctcccaacactaaa

SEQ ID NO: 7764757 - DNA, 22 bp, Homo sapiens
ggttttatagcagtactatcag

SEQ ID NO: 7764758 - DNA, 22 bp, Homo sapiens
gtaaaacaagctttatggttcc

SEQ ID NO: 7764759 - DNA, 22 bp, Homo sapiens
gtaaaacatgttttaactagga

SEQ ID NO: 7764760 - DNA, 22 bp, Homo sapiens
gtaaaaaggccaagcccttgtg

SEQ ID NO: 7764761 - DNA, 22 bp, Homo sapiens
gtattattaagtgtatttgacc

SEQ ID NO: 7764762 - DNA, 22 bp, Homo sapiens
gtattattgtcatgaaataata

SEQ ID NO: 7764763 - DNA, 22 bp, Homo sapiens
gtagaatatatggttagtattg

SEQ ID NO: 7764764 - DNA, 22 bp, Homo sapiens
gtgactctcactttacctgact

SEQ ID NO: 7764765 - DNA, 22 bp, Homo sapiens
gtgacgtgaggggctcctgttg

SEQ ID NO: 7764766 - DNA, 22 bp, Homo sapiens
gtgactcttaaagcaaatcttg

SEQ ID NO: 7764767 - DNA, 22 bp, Homo sapiens
gtgactcttacctacccagcct

SEQ ID NO: 7764768 - DNA, 22 bp, Homo sapiens
gtgcagagaaggagcagtagtt

SEQ ID NO: 7764769 - DNA, 22 bp, Homo sapiens
gtgcagagaaatgagaagtcga

SEQ ID NO: 7764770 - DNA, 22 bp, Homo sapiens
gtgcagagaggaccttggggag

SEQ ID NO: 7764771 - DNA, 22 bp, Homo sapiens
gtgcactgtctggtcaagagca

SEQ ID NO: 7764772 - DNA, 22 bp, Homo sapiens
gtgcactgtctggtcaagagca

SEQ ID NO: 7764773 - DNA, 22 bp, Homo sapiens
gtgcacagatttaattttattc

SEQ ID NO: 7764774 - DNA, 22 bp, Homo sapiens
gtgcagagcaagggctgagggc

SEQ ID NO: 7764775 - DNA, 21 bp, Homo sapiens
gtgcagaggaatgtagggggc

SEQ ID NO: 7764776 - DNA, 22 bp, Homo sapiens
gtgcagaggacgtggcggcctc

SEQ ID NO: 7764777 - DNA, 22 bp, Homo sapiens
gtgcagaggacgtggcggcctc

SEQ ID NO: 7764778 - DNA, 20 bp, Homo sapiens
gtgcagaggcagcctgtggg

SEQ ID NO: 7764779 - DNA, 22 bp, Homo sapiens
gtgcagagtgtctgtggactga

SEQ ID NO: 7764780 - DNA, 22 bp, Homo sapiens
gtgcagatcctgattgcagttc

SEQ ID NO: 7764781 - DNA, 22 bp, Homo sapiens
gtgcagtgaccctggagagctg

SEQ ID NO: 7764782 - DNA, 22 bp, Homo sapiens
gtgcagtgaccctggagagctg

SEQ ID NO: 7764783 - DNA, 22 bp, Homo sapiens
gtgcagtgagcagtgcagcacc

SEQ ID NO: 7764784 - DNA, 22 bp, Homo sapiens
gtgctaggattacaggcatggg

SEQ ID NO: 7764785 - DNA, 22 bp, Homo sapiens
gtgctaggattacaggcatggg

SEQ ID NO: 7764786 - DNA, 22 bp, Homo sapiens
gtgctagggacaaagcagtgaa

SEQ ID NO: 7764787 - DNA, 22 bp, Homo sapiens
gtgcagttgaagcatggggaga

SEQ ID NO: 7764788 - DNA, 22 bp, Homo sapiens
gtctgctgtgccttggggaaaa

SEQ ID NO: 7764789 - DNA, 22 bp, Homo sapiens
gtctgctgcagtcgtggctcta

SEQ ID NO: 7764790 - DNA, 22 bp, Homo sapiens
gtctgctggtgcctggcctgcg

SEQ ID NO: 7764791 - DNA, 22 bp, Homo sapiens
gtctgctggcacgtcacagata

SEQ ID NO: 7764792 - DNA, 22 bp, Homo sapiens
gtctgctcatgctaccgcgggc

SEQ ID NO: 7764793 - DNA, 22 bp, Homo sapiens
gtctgctgcagagcatggcttt

SEQ ID NO: 7764794 - DNA, 22 bp, Homo sapiens
gtcctgggcctgctgaggctga

SEQ ID NO: 7764795 - DNA, 22 bp, Homo sapiens
gtcctgggcggagggctgctgt

SEQ ID NO: 7764796 - DNA, 22 bp, Homo sapiens
gtgaccataatagattatgagt

SEQ ID NO: 7764797 - DNA, 22 bp, Homo sapiens
gtgaccatcagagaataacaaa

SEQ ID NO: 7764798 - DNA, 22 bp, Homo sapiens
gtgaccatttgacatatccttg

SEQ ID NO: 7764799 - DNA, 22 bp, Homo sapiens
gtgaccatcctggtaatgaatc

SEQ ID NO: 7764800 - DNA, 22 bp, Homo sapiens
gtgaacaaaatagcacatatta

SEQ ID NO: 7764801 - DNA, 22 bp, Homo sapiens
ggtgtgtggttttgatacagtc

SEQ ID NO: 7764802 - DNA, 22 bp, Homo sapiens
ggtgtggatcatctgaggtcag

SEQ ID NO: 7764803 - DNA, 22 bp, Homo sapiens
ggtctggaccctcctggagtgg

SEQ ID NO: 7764804 - DNA, 22 bp, Homo sapiens
ggtctggaatggagtaggggtg

SEQ ID NO: 7764805 - DNA, 22 bp, Homo sapiens
ggtggccctaaccgcagcctcc

SEQ ID NO: 7764806 - DNA, 18 bp, Homo sapiens
ggtggcggggatggaggt

SEQ ID NO: 7764807 - DNA, 22 bp, Homo sapiens
ggtggcctccagggcataggtg

SEQ ID NO: 7764808 - DNA, 22 bp, Homo sapiens
ggtggcctcggtggtgcacagg

SEQ ID NO: 7764809 - DNA, 22 bp, Homo sapiens
gggtggcatagggtgatggctt

SEQ ID NO: 7764810 - DNA, 22 bp, Homo sapiens
gggtggcacaggtgcagagggt

SEQ ID NO: 7764811 - DNA, 22 bp, Homo sapiens
gggtggcacaggtgcagagggt

SEQ ID NO: 7764812 - DNA, 22 bp, Homo sapiens
gggtggcaggattggcaggagt

SEQ ID NO: 7764813 - DNA, 22 bp, Homo sapiens
gggtggcaggattggcaggagt

SEQ ID NO: 7764814 - DNA, 23 bp, Homo sapiens
ggtcactggcaagcagtgcagag

SEQ ID NO: 7764815 - DNA, 22 bp, Homo sapiens
ggtcacccatgatcacatcacc

SEQ ID NO: 7764816 - DNA, 22 bp, Homo sapiens
ggtcagaggggattccttggga

SEQ ID NO: 7764817 - DNA, 22 bp, Homo sapiens
ggtcagagggtgggctgcctgt

SEQ ID NO: 7764818 - DNA, 22 bp, Homo sapiens
ggtcagagggtgggctgcctgt

SEQ ID NO: 7764819 - DNA, 22 bp, Homo sapiens
ggtcagagccgttagcattcag

SEQ ID NO: 7764820 - DNA, 22 bp, Homo sapiens
ggtcagaattaggtctagagta

SEQ ID NO: 7764821 - DNA, 22 bp, Homo sapiens
ggtcagaaggattctgggaaat

SEQ ID NO: 7764822 - DNA, 22 bp, Homo sapiens
ggtcagaagtgcaaaatcagtt

SEQ ID NO: 7764823 - DNA, 20 bp, Homo sapiens
ggtcctgtactctcattgaa

SEQ ID NO: 7764824 - DNA, 18 bp, Homo sapiens
ggtcctgggcctggctca

SEQ ID NO: 7764825 - DNA, 18 bp, Homo sapiens
ggtcctgggcctggctca

SEQ ID NO: 7764826 - DNA, 22 bp, Homo sapiens
ggtcctgtctgacatcactgct

SEQ ID NO: 7764827 - DNA, 22 bp, Homo sapiens
ggtctctgaacttccactgcgc

SEQ ID NO: 7764828 - DNA, 22 bp, Homo sapiens
ggtctcctgaggctgccacacc

SEQ ID NO: 7764829 - DNA, 22 bp, Homo sapiens
ggtctctgctcagatgccactt

SEQ ID NO: 7764830 - DNA, 22 bp, Homo sapiens
ggtctctgttgcctccatcaag

SEQ ID NO: 7764831 - DNA, 22 bp, Homo sapiens
gggcttggtggagagaatgctg

SEQ ID NO: 7764832 - DNA, 22 bp, Homo sapiens
ggggaaggaaagttattagcag

SEQ ID NO: 7764833 - DNA, 22 bp, Homo sapiens
ggggaaggatatgattagacta

SEQ ID NO: 7764834 - DNA, 22 bp, Homo sapiens
ggggccgaccgcggttcaggcc

SEQ ID NO: 7764835 - DNA, 22 bp, Homo sapiens
ggggcctatttgttcaacttcc

SEQ ID NO: 7764836 - DNA, 22 bp, Homo sapiens
gggtggaggagaacaggcccca

SEQ ID NO: 7764837 - DNA, 22 bp, Homo sapiens
gggtaggagaggtgtctgtgtg

SEQ ID NO: 7764838 - DNA, 22 bp, Homo sapiens
gggtaggatggtagaagggacc

SEQ ID NO: 7764839 - DNA, 22 bp, Homo sapiens
gggtaggctctgcaggctgggt

SEQ ID NO: 7764840 - DNA, 22 bp, Homo sapiens
gggtagggtgacttaggctggc

SEQ ID NO: 7764841 - DNA, 22 bp, Homo sapiens
ggggtgtggacggctgtgccag

SEQ ID NO: 7764842 - DNA, 21 bp, Homo sapiens
ggggttggcaagagcagagac

SEQ ID NO: 7764843 - DNA, 22 bp, Homo sapiens
gggcttggagtaggctgatgaa

SEQ ID NO: 7764844 - DNA, 22 bp, Homo sapiens
gggcttggcacatgggctcagc

SEQ ID NO: 7764845 - DNA, 22 bp, Homo sapiens
gggcttggcacatgggctcagc

SEQ ID NO: 7764846 - DNA, 22 bp, Homo sapiens
gggcttgggtattgtgagaggt

SEQ ID NO: 7764847 - DNA, 19 bp, Homo sapiens
gggcttggggctgaagcct

SEQ ID NO: 7764848 - DNA, 22 bp, Homo sapiens
gggcttggctcataagtggatg

SEQ ID NO: 7764849 - DNA, 22 bp, Homo sapiens
gggcttggccccagaagagcta

SEQ ID NO: 7764850 - DNA, 22 bp, Homo sapiens
gggctgatgatgagcagaggtg

SEQ ID NO: 7764851 - DNA, 22 bp, Homo sapiens
gggctgcacgtattctgctcac

SEQ ID NO: 7764852 - DNA, 22 bp, Homo sapiens
gggctgcctttcttctgggagc

SEQ ID NO: 7764853 - DNA, 22 bp, Homo sapiens
gggctgagtgtcccaggccgaa

SEQ ID NO: 7764854 - DNA, 22 bp, Homo sapiens
gggctgagttcctgcctcactc

SEQ ID NO: 7764855 - DNA, 22 bp, Homo sapiens
gggctgagagctggaatctgag

SEQ ID NO: 7764856 - DNA, 22 bp, Homo sapiens
gggcatggtggcaggcacctgt

SEQ ID NO: 7764857 - DNA, 22 bp, Homo sapiens
gggcatggccaggtgaggggtc

SEQ ID NO: 7764858 - DNA, 22 bp, Homo sapiens
gggccaagggtgcgtggcagga

SEQ ID NO: 7764859 - DNA, 22 bp, Homo sapiens
gggccaaggggagctggaaggg

SEQ ID NO: 7764860 - DNA, 22 bp, Homo sapiens
ggctctggagacatgtggagag

SEQ ID NO: 7764861 - DNA, 22 bp, Homo sapiens
ggctctggctcctggctttgtg

SEQ ID NO: 7764862 - DNA, 22 bp, Homo sapiens
ggctctttggcgggccttgaac

SEQ ID NO: 7764863 - DNA, 22 bp, Homo sapiens
ggctctttaacttgtctaaatt

SEQ ID NO: 7764864 - DNA, 22 bp, Homo sapiens
ggctctttaacttgtctaaatt

SEQ ID NO: 7764865 - DNA, 22 bp, Homo sapiens
ggctcttgaaatgtggctggcg

SEQ ID NO: 7764866 - DNA, 23 bp, Homo sapiens
ggctgagaagtcccatgataggt

SEQ ID NO: 7764867 - DNA, 22 bp, Homo sapiens
ggctctggagacatgtggagag

SEQ ID NO: 7764868 - DNA, 22 bp, Homo sapiens
ggctccaggagggccttggcca

SEQ ID NO: 7764869 - DNA, 22 bp, Homo sapiens
ggctccaggagggccttggcca

SEQ ID NO: 7764870 - DNA, 22 bp, Homo sapiens
ggctccaggagatgctgggcag

SEQ ID NO: 7764871 - DNA, 18 bp, Homo sapiens
ggctccaggacctaccca

SEQ ID NO: 7764872 - DNA, 22 bp, Homo sapiens
ggctccaggaacctcctctcct

SEQ ID NO: 7764873 - DNA, 22 bp, Homo sapiens
ggctccagatgtctcctggcaa

SEQ ID NO: 7764874 - DNA, 22 bp, Homo sapiens
ggcgggaggctgaggagttggt

SEQ ID NO: 7764875 - DNA, 22 bp, Homo sapiens
ggcggccctgcacgtgctgagg

SEQ ID NO: 7764876 - DNA, 22 bp, Homo sapiens
ggcgggaagttcttgcccactt

SEQ ID NO: 7764877 - DNA, 22 bp, Homo sapiens
ggctccagatgtcccctggcaa

SEQ ID NO: 7764878 - DNA, 22 bp, Homo sapiens
ggctccagatgtctcctggcaa

SEQ ID NO: 7764879 - DNA, 22 bp, Homo sapiens
ggctccagatgtcccctggcaa

SEQ ID NO: 7764880 - DNA, 22 bp, Homo sapiens
ggcttctctcttcacatggctt

SEQ ID NO: 7764881 - DNA, 22 bp, Homo sapiens
ggcttctctcccccagctccac

SEQ ID NO: 7764882 - DNA, 22 bp, Homo sapiens
ggcttctcccctttgagtcttc

SEQ ID NO: 7764883 - DNA, 22 bp, Homo sapiens
ggctgggccagggcctgtggac

SEQ ID NO: 7764884 - DNA, 22 bp, Homo sapiens
ggctgggctccgggagcatgcg

SEQ ID NO: 7764885 - DNA, 21 bp, Homo sapiens
ggctgctgggagagctgcgtg

SEQ ID NO: 7764886 - DNA, 22 bp, Homo sapiens
ggctggcttgcggagtcacaga

SEQ ID NO: 7764887 - DNA, 22 bp, Homo sapiens
ggctggcttggtgagctgtcac

SEQ ID NO: 7764888 - DNA, 22 bp, Homo sapiens
ggctggcttggtgagctgtcac

SEQ ID NO: 7764889 - DNA, 22 bp, Homo sapiens
ggctgctggcattgaggtaggt

SEQ ID NO: 7764890 - DNA, 22 bp, Homo sapiens
ggctgctggcagatgtagttta

SEQ ID NO: 7764891 - DNA, 22 bp, Homo sapiens
ggctgagcactttaggcaggag

SEQ ID NO: 7764892 - DNA, 22 bp, Homo sapiens
ggctgctgagttggccaggaga

SEQ ID NO: 7764893 - DNA, 19 bp, Homo sapiens
gggagagccaggctcaccc

SEQ ID NO: 7764894 - DNA, 22 bp, Homo sapiens
gggagacaagaagtagcctgct

SEQ ID NO: 7764895 - DNA, 22 bp, Homo sapiens
gggagacacgctgcaggcataa

SEQ ID NO: 7764896 - DNA, 19 bp, Homo sapiens
gggagacagctctgggctg

SEQ ID NO: 7764897 - DNA, 22 bp, Homo sapiens
gggagagaattattgccagacc

SEQ ID NO: 7764898 - DNA, 22 bp, Homo sapiens
gggagctgtaagggacaggtag

SEQ ID NO: 7764899 - DNA, 23 bp, Homo sapiens
gggaccagctagggctgtgacct

SEQ ID NO: 7764900 - DNA, 22 bp, Homo sapiens
gggaccagaggctgtgcacaat

SEQ ID NO: 7764901 - DNA, 22 bp, Homo sapiens
gggaccactccgacatgtaggg

SEQ ID NO: 7764902 - DNA, 22 bp, Homo sapiens
gggaccagaagaaggatggtga

SEQ ID NO: 7764903 - DNA, 22 bp, Homo sapiens
gggacaggcccctcgctagctt

SEQ ID NO: 7764904 - DNA, 22 bp, Homo sapiens
gggacaggcaaaggtatgcttc

SEQ ID NO: 7764905 - DNA, 22 bp, Homo sapiens
gggacaggctgagacttgagct

SEQ ID NO: 7764906 - DNA, 22 bp, Homo sapiens
gggacatctttctagtcagggt

SEQ ID NO: 7764907 - DNA, 22 bp, Homo sapiens
gggacaggctgagacttgagct

SEQ ID NO: 7764908 - DNA, 22 bp, Homo sapiens
gggaggagcttggagattcact

SEQ ID NO: 7764909 - DNA, 22 bp, Homo sapiens
gggaggagctgagtgtgtgtgc

SEQ ID NO: 7764910 - DNA, 22 bp, Homo sapiens
gggaggaaagagaagtggtcca

SEQ ID NO: 7764911 - DNA, 22 bp, Homo sapiens
gggattacagatgtgagccatt

SEQ ID NO: 7764912 - DNA, 22 bp, Homo sapiens
gggcaagcagtgaggacagcac

SEQ ID NO: 7764913 - DNA, 22 bp, Homo sapiens
gggcaagaagctggaagcattc

SEQ ID NO: 7764914 - DNA, 22 bp, Homo sapiens
gggcacagcctaactatggaga

SEQ ID NO: 7764915 - DNA, 18 bp, Homo sapiens
gggcatggatgcagcatc

SEQ ID NO: 7764916 - DNA, 23 bp, Homo sapiens
gggcatggagtgtaggtggaagg

SEQ ID NO: 7764917 - DNA, 22 bp, Homo sapiens
gggcaggctgagcatgtcacct

SEQ ID NO: 7764918 - DNA, 22 bp, Homo sapiens
gggcaggagaaggtggatgtcc

SEQ ID NO: 7764919 - DNA, 16 bp, Homo sapiens
gggcaggaatcagggt

SEQ ID NO: 7764920 - DNA, 22 bp, Homo sapiens
gggcaggagaaggtggatgtcc

SEQ ID NO: 7764921 - DNA, 22 bp, Homo sapiens
gggcagctgccagaggccatgg

SEQ ID NO: 7764922 - DNA, 22 bp, Homo sapiens
gggcacaggaatttgggatgtg

SEQ ID NO: 7764923 - DNA, 22 bp, Homo sapiens
gggcacaggagaaggatctggc

SEQ ID NO: 7764924 - DNA, 22 bp, Homo sapiens
gggcagctctggctgtgggaag

SEQ ID NO: 7764925 - DNA, 22 bp, Homo sapiens
gggcagctctggctgtgggaag

SEQ ID NO: 7764926 - DNA, 22 bp, Homo sapiens
gggcagctctgcccatcagagg

SEQ ID NO: 7764927 - DNA, 22 bp, Homo sapiens
ggcaagaaggcttcaggtagct

SEQ ID NO: 7764928 - DNA, 19 bp, Homo sapiens
ggcaaattgaggccagtca

SEQ ID NO: 7764929 - DNA, 22 bp, Homo sapiens
ggcaagagtgaggagtgtctct

SEQ ID NO: 7764930 - DNA, 22 bp, Homo sapiens
ggcaagatccaaggggctagga

SEQ ID NO: 7764931 - DNA, 20 bp, Homo sapiens
ggcaagcaactgagggagga

SEQ ID NO: 7764932 - DNA, 19 bp, Homo sapiens
ggcaagcacaaaagctttg

SEQ ID NO: 7764933 - DNA, 23 bp, Homo sapiens
ggagtgcaatggcgccatctcgg

SEQ ID NO: 7764934 - DNA, 22 bp, Homo sapiens
ggagtgagtactggagtagctg

SEQ ID NO: 7764935 - DNA, 23 bp, Homo sapiens
ggagtgcaatggcgccatctcgg

SEQ ID NO: 7764936 - DNA, 23 bp, Homo sapiens
ggagtgcaatggcgccatctcgg

SEQ ID NO: 7764937 - DNA, 22 bp, Homo sapiens
ggcaaacagacttgaccatctt

SEQ ID NO: 7764938 - DNA, 22 bp, Homo sapiens
ggcaaaaaccataattactttt

SEQ ID NO: 7764939 - DNA, 22 bp, Homo sapiens
ggcaaaaaccgcaataacttct

SEQ ID NO: 7764940 - DNA, 22 bp, Homo sapiens
ggcaaaaaccacaattactttt

SEQ ID NO: 7764941 - DNA, 22 bp, Homo sapiens
ggcaaaaacagcaatgactttt

SEQ ID NO: 7764942 - DNA, 22 bp, Homo sapiens
ggagccagagtttaatgtggag

SEQ ID NO: 7764943 - DNA, 22 bp, Homo sapiens
ggagccagagtctgcagtgtaa

SEQ ID NO: 7764944 - DNA, 22 bp, Homo sapiens
ggagccagagtctgcagtgtaa

SEQ ID NO: 7764945 - DNA, 22 bp, Homo sapiens
ggagccagagggatgcagttga

SEQ ID NO: 7764946 - DNA, 22 bp, Homo sapiens
ggagccagagtctgcagtgtaa

SEQ ID NO: 7764947 - DNA, 22 bp, Homo sapiens
ggagccagaggctgctgctgtg

SEQ ID NO: 7764948 - DNA, 22 bp, Homo sapiens
ggagccagcagggtgacactga

SEQ ID NO: 7764949 - DNA, 19 bp, Homo sapiens
ggagccagctgtggaaggc

SEQ ID NO: 7764950 - DNA, 19 bp, Homo sapiens
ggagccagctgtggaaggc

SEQ ID NO: 7764951 - DNA, 22 bp, Homo sapiens
ggagtaggccccgggagagagt

SEQ ID NO: 7764952 - DNA, 22 bp, Homo sapiens
ggagtgaggcatttgtagctga

SEQ ID NO: 7764953 - DNA, 22 bp, Homo sapiens
ggcagaggtagctggaaccagg

SEQ ID NO: 7764954 - DNA, 22 bp, Homo sapiens
ggcagaggtagctggaaccagg

SEQ ID NO: 7764955 - DNA, 22 bp, Homo sapiens
ggcagaggtagctggaaccagg

SEQ ID NO: 7764956 - DNA, 22 bp, Homo sapiens
ggcaggaggtgagtggcgggtg

SEQ ID NO: 7764957 - DNA, 22 bp, Homo sapiens
ggcaggaggtgagtggcgggtg

SEQ ID NO: 7764958 - DNA, 22 bp, Homo sapiens
ggcaggagggcggacaatgacc

SEQ ID NO: 7764959 - DNA, 22 bp, Homo sapiens
ggcaggcacatttgggggccgt

SEQ ID NO: 7764960 - DNA, 22 bp, Homo sapiens
ggcaggcaccagctcagcaata

SEQ ID NO: 7764961 - DNA, 22 bp, Homo sapiens
ggcaggcaatgaggatgggaag

SEQ ID NO: 7764962 - DNA, 22 bp, Homo sapiens
ggcaggcactgtgctaggcgct

SEQ ID NO: 7764963 - DNA, 22 bp, Homo sapiens
ggcaggcactgtgctaggcgct

SEQ ID NO: 7764964 - DNA, 22 bp, Homo sapiens
ggcaggcactgtgctaggcgct

SEQ ID NO: 7764965 - DNA, 22 bp, Homo sapiens
ggcaggcagaaaaatagaatat

SEQ ID NO: 7764966 - DNA, 22 bp, Homo sapiens
ggcaggcactgtgttttgtgtt

SEQ ID NO: 7764967 - DNA, 22 bp, Homo sapiens
ggcaggcaagtctgctctgtga

SEQ ID NO: 7764968 - DNA, 22 bp, Homo sapiens
ggcaggcaagtctgctctgtga

SEQ ID NO: 7764969 - DNA, 22 bp, Homo sapiens
ggcaggcaaggcagcctggtga

SEQ ID NO: 7764970 - DNA, 22 bp, Homo sapiens
ggcaggcaacggaccactagtc

SEQ ID NO: 7764971 - DNA, 22 bp, Homo sapiens
ggcaggcaaggcagcctggtga

SEQ ID NO: 7764972 - DNA, 20 bp, Homo sapiens
ggcagagggcctgggagaag

SEQ ID NO: 7764973 - DNA, 20 bp, Homo sapiens
ggcagagggcctgggagaag

SEQ ID NO: 7764974 - DNA, 22 bp, Homo sapiens
ggcagaggaggggtgaatttgc

SEQ ID NO: 7764975 - DNA, 22 bp, Homo sapiens
ggcagaggagctggaaacatgg

SEQ ID NO: 7764976 - DNA, 22 bp, Homo sapiens
ggcacagctgatgcagacacac

SEQ ID NO: 7764977 - DNA, 22 bp, Homo sapiens
ggcacaggaatctgtgaagtgc

SEQ ID NO: 7764978 - DNA, 17 bp, Homo sapiens
ggcaccagacggagagt

SEQ ID NO: 7764979 - DNA, 22 bp, Homo sapiens
ggcacagctcaggtcccagctc

SEQ ID NO: 7764980 - DNA, 22 bp, Homo sapiens
ggcacagcgactaccatcgaaa

SEQ ID NO: 7764981 - DNA, 22 bp, Homo sapiens
ggcctcagagaaggctgtgcgg

SEQ ID NO: 7764982 - DNA, 22 bp, Homo sapiens
ggcctcagaccggagctggcca

SEQ ID NO: 7764983 - DNA, 18 bp, Homo sapiens
ggcctcagcctggccgga

SEQ ID NO: 7764984 - DNA, 23 bp, Homo sapiens
ggcctcagcgcacagaaactgct

SEQ ID NO: 7764985 - DNA, 22 bp, Homo sapiens
ggcctcagggttgggcccatta

SEQ ID NO: 7764986 - DNA, 21 bp, Homo sapiens
ggcctcagccacctggctctg

SEQ ID NO: 7764987 - DNA, 18 bp, Homo sapiens
ggcctcagcctggccgga

SEQ ID NO: 7764988 - DNA, 22 bp, Homo sapiens
ggcctcagtttctccatgggtt

SEQ ID NO: 7764989 - DNA, 22 bp, Homo sapiens
ggcctcagtgggccgctgcagg

SEQ ID NO: 7764990 - DNA, 22 bp, Homo sapiens
ggcctcagtgggccgctgcagg

SEQ ID NO: 7764991 - DNA, 22 bp, Homo sapiens
ggcctcagggttgggcccatta

SEQ ID NO: 7764992 - DNA, 22 bp, Homo sapiens
ggcctctggttcgtggtgacct

SEQ ID NO: 7764993 - DNA, 22 bp, Homo sapiens
ggcctctggttcgtggtgacct

SEQ ID NO: 7764994 - DNA, 22 bp, Homo sapiens
ggccttggttctgtcacagccg

SEQ ID NO: 7764995 - DNA, 20 bp, Homo sapiens
ggccttgggtttcgcctgtt

SEQ ID NO: 7764996 - DNA, 22 bp, Homo sapiens
ggccttggtgccatggccagtt

SEQ ID NO: 7764997 - DNA, 22 bp, Homo sapiens
ggccttggtactgtaaaccgag

SEQ ID NO: 7764998 - DNA, 22 bp, Homo sapiens
ggccttgggcgagtccctcagt

SEQ ID NO: 7764999 - DNA, 22 bp, Homo sapiens
ggccttggggtggccttgtccc

SEQ ID NO: 7765000 - DNA, 17 bp, Homo sapiens
ggccttggggcctcagt

SEQ ID NO: 7765001 - DNA, 22 bp, Homo sapiens
ggcctgaggcgtcccagctgtg

SEQ ID NO: 7765002 - DNA, 22 bp, Homo sapiens
ggcctgagggtgggctctcagt

SEQ ID NO: 7765003 - DNA, 21 bp, Homo sapiens
ggcctgagtataggacaggcc

SEQ ID NO: 7765004 - DNA, 22 bp, Homo sapiens
ggccttgggatgtggctgcagc

SEQ ID NO: 7765005 - DNA, 22 bp, Homo sapiens
ggccttgggcagacacgtcaca

SEQ ID NO: 7765006 - DNA, 22 bp, Homo sapiens
ggcctgcacagaggtggctcta

SEQ ID NO: 7765007 - DNA, 21 bp, Homo sapiens
ggcctgagtataggacaggcc

SEQ ID NO: 7765008 - DNA, 22 bp, Homo sapiens
ggcctgagtcacatcaggagag

SEQ ID NO: 7765009 - DNA, 22 bp, Homo sapiens
ggccaggtgcggtggctcacac

SEQ ID NO: 7765010 - DNA, 22 bp, Homo sapiens
ggccagggggcttcagactcca

SEQ ID NO: 7765011 - DNA, 22 bp, Homo sapiens
ggccatgcaggtcagaggtggg

SEQ ID NO: 7765012 - DNA, 22 bp, Homo sapiens
ggccagtttccatgcactattt

SEQ ID NO: 7765013 - DNA, 22 bp, Homo sapiens
ggccagtcccctaatccagggc

SEQ ID NO: 7765014 - DNA, 22 bp, Homo sapiens
ggccaaggctcttgagggctga

SEQ ID NO: 7765015 - DNA, 22 bp, Homo sapiens
ggcatgtgcctgaggtcacaca

SEQ ID NO: 7765016 - DNA, 18 bp, Homo sapiens
ggcatgtgagtgctgagg

SEQ ID NO: 7765017 - DNA, 22 bp, Homo sapiens
ggccaaggtgttctgatatgcc

SEQ ID NO: 7765018 - DNA, 22 bp, Homo sapiens
ggccaaggtgttctgatatgcc

SEQ ID NO: 7765019 - DNA, 19 bp, Homo sapiens
ggccaggctgactgtggtc

SEQ ID NO: 7765020 - DNA, 22 bp, Homo sapiens
ggcaggcagaggctgagacagg

SEQ ID NO: 7765021 - DNA, 22 bp, Homo sapiens
ggcaggtggaagttggcagagc

SEQ ID NO: 7765022 - DNA, 22 bp, Homo sapiens
ggcaggcagatggctgcaccaa

SEQ ID NO: 7765023 - DNA, 22 bp, Homo sapiens
ggcaggtggattttctactcta

SEQ ID NO: 7765024 - DNA, 22 bp, Homo sapiens
ggcaggtgtgagatcgaggcca

SEQ ID NO: 7765025 - DNA, 22 bp, Homo sapiens
ggcaggtggtaaggatttcata

SEQ ID NO: 7765026 - DNA, 22 bp, Homo sapiens
ggcagtgaatgaaacagaggct

SEQ ID NO: 7765027 - DNA, 22 bp, Homo sapiens
ggcagtgaaaaagtatgtttcc

SEQ ID NO: 7765028 - DNA, 22 bp, Homo sapiens
ggcatggcctgtaagacggaga

SEQ ID NO: 7765029 - DNA, 22 bp, Homo sapiens
ggcatggggtgtatgtggcacg

SEQ ID NO: 7765030 - DNA, 22 bp, Homo sapiens
gacccagggtttctgcacaggg

SEQ ID NO: 7765031 - DNA, 22 bp, Homo sapiens
gacagtaagtcagagacttggt

SEQ ID NO: 7765032 - DNA, 22 bp, Homo sapiens
gacagtaaggtggcttcttctt

SEQ ID NO: 7765033 - DNA, 22 bp, Homo sapiens
gacagtaactgagagatgtaat

SEQ ID NO: 7765034 - DNA, 22 bp, Homo sapiens
gacagtaactgagagatgtaat

SEQ ID NO: 7765035 - DNA, 22 bp, Homo sapiens
gacagtaactgagagatgtaat

SEQ ID NO: 7765036 - DNA, 22 bp, Homo sapiens
gacagtaagaccttaccagcct

SEQ ID NO: 7765037 - DNA, 22 bp, Homo sapiens
gacagtaagagtgtctgggttc

SEQ ID NO: 7765038 - DNA, 22 bp, Homo sapiens
gaccctggtgtccaggtcctgc

SEQ ID NO: 7765039 - DNA, 22 bp, Homo sapiens
gacctagattaacattctgtga

SEQ ID NO: 7765040 - DNA, 22 bp, Homo sapiens
gacctcagattttcccaggcca

SEQ ID NO: 7765041 - DNA, 18 bp, Homo sapiens
gacagtaaacttccccat

SEQ ID NO: 7765042 - DNA, 22 bp, Homo sapiens
gacagtaaatgcagtctagcac

SEQ ID NO: 7765043 - DNA, 22 bp, Homo sapiens
gacagtaactacagttctgtgg

SEQ ID NO: 7765044 - DNA, 22 bp, Homo sapiens
gacagggtacgggctaggcaca

SEQ ID NO: 7765045 - DNA, 22 bp, Homo sapiens
gacaggccaggggctgaggtgg

SEQ ID NO: 7765046 - DNA, 22 bp, Homo sapiens
gacaggccccctcaggactgat

SEQ ID NO: 7765047 - DNA, 22 bp, Homo sapiens
gacaataaaatgatcttacagt

SEQ ID NO: 7765048 - DNA, 22 bp, Homo sapiens
gacaaggagccaccagtcacgt

SEQ ID NO: 7765049 - DNA, 22 bp, Homo sapiens
gacaaggaaattactagctgga

SEQ ID NO: 7765050 - DNA, 22 bp, Homo sapiens
gacaaggcagaaagcttaaagg

SEQ ID NO: 7765051 - DNA, 22 bp, Homo sapiens
gacagggctgtgggaggagcag

SEQ ID NO: 7765052 - DNA, 22 bp, Homo sapiens
gacaggctggcaatgccctgct

SEQ ID NO: 7765053 - DNA, 22 bp, Homo sapiens
gaaggaaatctgtgatttatgc

SEQ ID NO: 7765054 - DNA, 22 bp, Homo sapiens
gaaggaaaggtctcatgccttt

SEQ ID NO: 7765055 - DNA, 22 bp, Homo sapiens
gaagcctcaacatctctgcgtc

SEQ ID NO: 7765056 - DNA, 22 bp, Homo sapiens
gaaggaaaacagatctgcctga

SEQ ID NO: 7765057 - DNA, 22 bp, Homo sapiens
gaaggaaaaatactctgtaagg

SEQ ID NO: 7765058 - DNA, 22 bp, Homo sapiens
gaagctttgagagcagaagccc

SEQ ID NO: 7765059 - DNA, 23 bp, Homo sapiens
gaatacagagataaatagaacac

SEQ ID NO: 7765060 - DNA, 19 bp, Homo sapiens
gaatacagataataagcag

SEQ ID NO: 7765061 - DNA, 22 bp, Homo sapiens
gaatacatatcagatgtgtttc

SEQ ID NO: 7765062 - DNA, 22 bp, Homo sapiens
gaataacattttttcctttaca

SEQ ID NO: 7765063 - DNA, 22 bp, Homo sapiens
gaatagatcctcatttattgat

SEQ ID NO: 7765064 - DNA, 22 bp, Homo sapiens
gaatacttttgttaggaaaacg

SEQ ID NO: 7765065 - DNA, 22 bp, Homo sapiens
gaatatattggtgaaaatagtt

SEQ ID NO: 7765066 - DNA, 22 bp, Homo sapiens
gaatatattggtgaaaatagtt

SEQ ID NO: 7765067 - DNA, 22 bp, Homo sapiens
gaatataggacctctgggaaca

SEQ ID NO: 7765068 - DNA, 22 bp, Homo sapiens
gaatacatggcagggagtcatc

SEQ ID NO: 7765069 - DNA, 22 bp, Homo sapiens
gaatatcccgctatgcaaagta

SEQ ID NO: 7765070 - DNA, 22 bp, Homo sapiens
gaatattagtatcagttatacc

SEQ ID NO: 7765071 - DNA, 22 bp, Homo sapiens
gacaagctcttgtttcatggtt

SEQ ID NO: 7765072 - DNA, 22 bp, Homo sapiens
gacaagcaggctcctgaagaaa

SEQ ID NO: 7765073 - DNA, 22 bp, Homo sapiens
ctttcagggcaacacttctttt

SEQ ID NO: 7765074 - DNA, 22 bp, Homo sapiens
ctttcaggttctataggaagcc

SEQ ID NO: 7765075 - DNA, 18 bp, Homo sapiens
ctttatgtgcagagcttt

SEQ ID NO: 7765076 - DNA, 22 bp, Homo sapiens
ctttatgtgctgggcattaagg

SEQ ID NO: 7765077 - DNA, 22 bp, Homo sapiens
gaaatcagttctgaaatttaca

SEQ ID NO: 7765078 - DNA, 22 bp, Homo sapiens
gaaatcagttctgaaatttaca

SEQ ID NO: 7765079 - DNA, 22 bp, Homo sapiens
gaaatcaggatgatgttccaga

SEQ ID NO: 7765080 - DNA, 22 bp, Homo sapiens
ctttcatttgataagaatgcca

SEQ ID NO: 7765081 - DNA, 22 bp, Homo sapiens
ctttcatttgataagaatgcca

SEQ ID NO: 7765082 - DNA, 22 bp, Homo sapiens
gaacagcttcttgggagctggg

SEQ ID NO: 7765083 - DNA, 22 bp, Homo sapiens
gaacagctgctagagatctgtg

SEQ ID NO: 7765084 - DNA, 22 bp, Homo sapiens
gaacagtatttccaggaatccc

SEQ ID NO: 7765085 - DNA, 22 bp, Homo sapiens
gaacagtagatgagatgctaga

SEQ ID NO: 7765086 - DNA, 22 bp, Homo sapiens
gaaatctacgattagtgaaaat

SEQ ID NO: 7765087 - DNA, 22 bp, Homo sapiens
gaaatgcaaattctctctcgct

SEQ ID NO: 7765088 - DNA, 22 bp, Homo sapiens
gaaatctacgattagtgaaaat

SEQ ID NO: 7765089 - DNA, 22 bp, Homo sapiens
gaaatcattagcaaagatatgt

SEQ ID NO: 7765090 - DNA, 22 bp, Homo sapiens
gaaatgcaggcttggattcagc

SEQ ID NO: 7765091 - DNA, 22 bp, Homo sapiens
gaagagaagcatcaataggtaa

SEQ ID NO: 7765092 - DNA, 22 bp, Homo sapiens
gaagagaaaggcaaggagtttt

SEQ ID NO: 7765093 - DNA, 22 bp, Homo sapiens
gaagagaaggtgtaggccatcc

SEQ ID NO: 7765094 - DNA, 22 bp, Homo sapiens
gaagagaagcatcaataggtaa

SEQ ID NO: 7765095 - DNA, 22 bp, Homo sapiens
gaagagctatgtccagggagca

SEQ ID NO: 7765096 - DNA, 22 bp, Homo sapiens
gaagagcttagacagaatcaaa

SEQ ID NO: 7765097 - DNA, 22 bp, Homo sapiens
gaagagctgtgattcaggctta

SEQ ID NO: 7765098 - DNA, 22 bp, Homo sapiens
gaagagctgctcagaacatgat

SEQ ID NO: 7765099 - DNA, 22 bp, Homo sapiens
gaagagctgtcagaaaagctaa

SEQ ID NO: 7765100 - DNA, 22 bp, Homo sapiens
gaagacatgtggattctagttt

SEQ ID NO: 7765101 - DNA, 22 bp, Homo sapiens
gaagacagaaacctgtttggct

SEQ ID NO: 7765102 - DNA, 22 bp, Homo sapiens
gaaccatttctgaatagtttgt

SEQ ID NO: 7765103 - DNA, 22 bp, Homo sapiens
gaaccagcagttgcctgaaaaa

SEQ ID NO: 7765104 - DNA, 22 bp, Homo sapiens
gaaccattgttgaaaagaatag

SEQ ID NO: 7765105 - DNA, 22 bp, Homo sapiens
gaagccaggggcctgacaggca

SEQ ID NO: 7765106 - DNA, 22 bp, Homo sapiens
gaagccaggggcctgacaggca

SEQ ID NO: 7765107 - DNA, 22 bp, Homo sapiens
gaagccagatttggggcatatc

SEQ ID NO: 7765108 - DNA, 22 bp, Homo sapiens
gaagccagcagtggagaaagga

SEQ ID NO: 7765109 - DNA, 22 bp, Homo sapiens
gaagccagattatcacaagcca

SEQ ID NO: 7765110 - DNA, 22 bp, Homo sapiens
gaagatttttcttaatgctccg

SEQ ID NO: 7765111 - DNA, 22 bp, Homo sapiens
gaagatgggaatgatgagtggg

SEQ ID NO: 7765112 - DNA, 22 bp, Homo sapiens
gaagataattcctacttataac

SEQ ID NO: 7765113 - DNA, 22 bp, Homo sapiens
gaagaggctttcctagggcaag

SEQ ID NO: 7765114 - DNA, 22 bp, Homo sapiens
gaagatgttatggagagctcag

SEQ ID NO: 7765115 - DNA, 22 bp, Homo sapiens
gaggagctgttccctcacctct

SEQ ID NO: 7765116 - DNA, 19 bp, Homo sapiens
gaggagctatcggagacag

SEQ ID NO: 7765117 - DNA, 22 bp, Homo sapiens
gaggagcttgaggctaggagcc

SEQ ID NO: 7765118 - DNA, 22 bp, Homo sapiens
gaggagcttcagaggaatctta

SEQ ID NO: 7765119 - DNA, 22 bp, Homo sapiens
gaggaaaataacaactaagggc

SEQ ID NO: 7765120 - DNA, 22 bp, Homo sapiens
gaggaaaataacaactaagggc

SEQ ID NO: 7765121 - DNA, 22 bp, Homo sapiens
gaggaaaatattcagggaggtt

SEQ ID NO: 7765122 - DNA, 22 bp, Homo sapiens
gaggaaaatattcagggaggtt

SEQ ID NO: 7765123 - DNA, 19 bp, Homo sapiens
gaggaggaaaactagtgta

SEQ ID NO: 7765124 - DNA, 22 bp, Homo sapiens
gaggaggcactagttagtgaca

SEQ ID NO: 7765125 - DNA, 22 bp, Homo sapiens
gaggcaagagaagccagctttc

SEQ ID NO: 7765126 - DNA, 22 bp, Homo sapiens
gaggcaagagaagccagctttc

SEQ ID NO: 7765127 - DNA, 22 bp, Homo sapiens
gaggcaaggccgcacgtctcag

SEQ ID NO: 7765128 - DNA, 19 bp, Homo sapiens
gaggcaaggagtttaagcc

SEQ ID NO: 7765129 - DNA, 22 bp, Homo sapiens
gaggaggctaagtgggctctgg

SEQ ID NO: 7765130 - DNA, 22 bp, Homo sapiens
gaggaggccagtggaaggaagc

SEQ ID NO: 7765131 - DNA, 22 bp, Homo sapiens
gaggaggccagtggaaggaagc

SEQ ID NO: 7765132 - DNA, 22 bp, Homo sapiens
gaggaggctaagtgggctctgg

SEQ ID NO: 7765133 - DNA, 22 bp, Homo sapiens
gaggcagaggaaggtggtctct

SEQ ID NO: 7765134 - DNA, 22 bp, Homo sapiens
gaggccagcgcgcagcactttt

SEQ ID NO: 7765135 - DNA, 22 bp, Homo sapiens
gaggccaggaagcccaagatca

SEQ ID NO: 7765136 - DNA, 22 bp, Homo sapiens
gaggccaggacatgaaagctga

SEQ ID NO: 7765137 - DNA, 22 bp, Homo sapiens
gaggcacatcacttggtgcatt

SEQ ID NO: 7765138 - DNA, 22 bp, Homo sapiens
gaggcacatcacttggtgcatt

SEQ ID NO: 7765139 - DNA, 22 bp, Homo sapiens
gaggcacatcacttggtgcatt

SEQ ID NO: 7765140 - DNA, 22 bp, Homo sapiens
gaggcagagaccttcaggacct

SEQ ID NO: 7765141 - DNA, 22 bp, Homo sapiens
gaggcagagaccttcaggacct

SEQ ID NO: 7765142 - DNA, 22 bp, Homo sapiens
gaggcagaagttgcagtgagca

SEQ ID NO: 7765143 - DNA, 22 bp, Homo sapiens
gaggcagagactccaccttcag

SEQ ID NO: 7765144 - DNA, 22 bp, Homo sapiens
gaggcagaagttgcagtgagca

SEQ ID NO: 7765145 - DNA, 22 bp, Homo sapiens
gagcctgatgaaacaggcagac

SEQ ID NO: 7765146 - DNA, 22 bp, Homo sapiens
gagcctgaaatacaggtcactg

SEQ ID NO: 7765147 - DNA, 22 bp, Homo sapiens
gagcctcgtggcggccactgcg

SEQ ID NO: 7765148 - DNA, 22 bp, Homo sapiens
gagccctgttcaggcctcctca

SEQ ID NO: 7765149 - DNA, 22 bp, Homo sapiens
gagccaggtttgaatctcagtc

SEQ ID NO: 7765150 - DNA, 22 bp, Homo sapiens
gagccgaggcgcacagctcggg

SEQ ID NO: 7765151 - DNA, 22 bp, Homo sapiens
gagcccttttcctagatactgt

SEQ ID NO: 7765152 - DNA, 22 bp, Homo sapiens
gagctaggctagggggagtcgc

SEQ ID NO: 7765153 - DNA, 22 bp, Homo sapiens
gagctagcttcttccaggtttc

SEQ ID NO: 7765154 - DNA, 22 bp, Homo sapiens
gagctagggaggaggcttgctc

SEQ ID NO: 7765155 - DNA, 22 bp, Homo sapiens
gagctagtagaacaagtgagga

SEQ ID NO: 7765156 - DNA, 22 bp, Homo sapiens
gagctaggttttccagtcgcat

SEQ ID NO: 7765157 - DNA, 22 bp, Homo sapiens
gagctaagaactgtgccaggtg

SEQ ID NO: 7765158 - DNA, 22 bp, Homo sapiens
gagctaagagtctagaaaggct

SEQ ID NO: 7765159 - DNA, 22 bp, Homo sapiens
gagctaagctatgttatgcagc

SEQ ID NO: 7765160 - DNA, 22 bp, Homo sapiens
gagctaaggcacaggcaggctt

SEQ ID NO: 7765161 - DNA, 22 bp, Homo sapiens
gagctaagtttctggaggcaga

SEQ ID NO: 7765162 - DNA, 22 bp, Homo sapiens
gagctcttagatagggcaggaa

SEQ ID NO: 7765163 - DNA, 22 bp, Homo sapiens
gagctcttatagttctagcagt

SEQ ID NO: 7765164 - DNA, 22 bp, Homo sapiens
gagctctgactgctgggtgaca

SEQ ID NO: 7765165 - DNA, 18 bp, Homo sapiens
gagctgagaagaggatgc

SEQ ID NO: 7765166 - DNA, 22 bp, Homo sapiens
gagctgaattacggtgagtcat

SEQ ID NO: 7765167 - DNA, 19 bp, Homo sapiens
gagctgagagtagcactgg

SEQ ID NO: 7765168 - DNA, 22 bp, Homo sapiens
gagctgagaagcagcgcttgat

SEQ ID NO: 7765169 - DNA, 22 bp, Homo sapiens
gagctgaacaaattgcgagtgg

SEQ ID NO: 7765170 - DNA, 22 bp, Homo sapiens
gagctcttgcttctagtccagg

SEQ ID NO: 7765171 - DNA, 22 bp, Homo sapiens
gagctctttaccaggtcaggac

SEQ ID NO: 7765172 - DNA, 22 bp, Homo sapiens
gagctcttcctttcaggaggcc

SEQ ID NO: 7765173 - DNA, 22 bp, Homo sapiens
gagcttaggccagggacaggga

SEQ ID NO: 7765174 - DNA, 22 bp, Homo sapiens
gagcttaaaacatagccagact

SEQ ID NO: 7765175 - DNA, 22 bp, Homo sapiens
gagcttggctggacctcacgga

SEQ ID NO: 7765176 - DNA, 22 bp, Homo sapiens
gagaagggatatggcttcttga

SEQ ID NO: 7765177 - DNA, 22 bp, Homo sapiens
gagaagggatatgccactctcg

SEQ ID NO: 7765178 - DNA, 22 bp, Homo sapiens
gagaagggcttgggagtcaaca

SEQ ID NO: 7765179 - DNA, 22 bp, Homo sapiens
gagaaggctgatccttggagtt

SEQ ID NO: 7765180 - DNA, 22 bp, Homo sapiens
gagaaggactacggaaaacaga

SEQ ID NO: 7765181 - DNA, 22 bp, Homo sapiens
gacctccagcggccctgcagag

SEQ ID NO: 7765182 - DNA, 22 bp, Homo sapiens
gacctccagcggccctgcagag

SEQ ID NO: 7765183 - DNA, 22 bp, Homo sapiens
gacctctcaggaatctcacatg

SEQ ID NO: 7765184 - DNA, 22 bp, Homo sapiens
gacctccgtgtacacctcccag

SEQ ID NO: 7765185 - DNA, 22 bp, Homo sapiens
gacctcagtattgttcaggatg

SEQ ID NO: 7765186 - DNA, 22 bp, Homo sapiens
gacctcagattttcccaggcca

SEQ ID NO: 7765187 - DNA, 22 bp, Homo sapiens
gacctcagtgaatggtcatgta

SEQ ID NO: 7765188 - DNA, 22 bp, Homo sapiens
gagatgaatgtaaacaaaggca

SEQ ID NO: 7765189 - DNA, 22 bp, Homo sapiens
gagatcggtaaagagcatgcac

SEQ ID NO: 7765190 - DNA, 22 bp, Homo sapiens
gagatgagtgggggatctctca

SEQ ID NO: 7765191 - DNA, 22 bp, Homo sapiens
gagaggctgggttggagatcga

SEQ ID NO: 7765192 - DNA, 22 bp, Homo sapiens
gagaggctgggttggagatcga

SEQ ID NO: 7765193 - DNA, 22 bp, Homo sapiens
gagaggctgggttggagatcga

SEQ ID NO: 7765194 - DNA, 22 bp, Homo sapiens
gagaggctggtaaagtctgaac

SEQ ID NO: 7765195 - DNA, 22 bp, Homo sapiens
gagaggctgtgtgccattgttg

SEQ ID NO: 7765196 - DNA, 22 bp, Homo sapiens
gagaggcttaagggctgtgaag

SEQ ID NO: 7765197 - DNA, 22 bp, Homo sapiens
gagaggcttaagggctgtgaag

SEQ ID NO: 7765198 - DNA, 19 bp, Homo sapiens
gagaggcctgtgcttgaag

SEQ ID NO: 7765199 - DNA, 22 bp, Homo sapiens
gagaggccctgaagcccacaga

SEQ ID NO: 7765200 - DNA, 22 bp, Homo sapiens
gagaggccctgtggtcccagct

SEQ ID NO: 7765201 - DNA, 22 bp, Homo sapiens
gagccaggtcgggccgcggcga

SEQ ID NO: 7765202 - DNA, 22 bp, Homo sapiens
gagccaggggtcagctccgagg

SEQ ID NO: 7765203 - DNA, 22 bp, Homo sapiens
gagccaggggtcagctccgagg

SEQ ID NO: 7765204 - DNA, 22 bp, Homo sapiens
gagccagactgcctgaagctca

SEQ ID NO: 7765205 - DNA, 22 bp, Homo sapiens
gagccagaaaagctgcctgact

SEQ ID NO: 7765206 - DNA, 22 bp, Homo sapiens
gagccactgttgggcactttcc

SEQ ID NO: 7765207 - DNA, 22 bp, Homo sapiens
gagccagcagccggcaccacca

SEQ ID NO: 7765208 - DNA, 22 bp, Homo sapiens
gagccagccgcaagagctgtga

SEQ ID NO: 7765209 - DNA, 22 bp, Homo sapiens
gagcagctgtggggttgaccat

SEQ ID NO: 7765210 - DNA, 22 bp, Homo sapiens
gagcagctgtccccaaagcttc

SEQ ID NO: 7765211 - DNA, 22 bp, Homo sapiens
gagcagctggtaggtgaaccca

SEQ ID NO: 7765212 - DNA, 22 bp, Homo sapiens
gagcagctggctgtattggttt

SEQ ID NO: 7765213 - DNA, 22 bp, Homo sapiens
gagcagctggacaggcctccct

SEQ ID NO: 7765214 - DNA, 22 bp, Homo sapiens
gagcagctgcagtgcagaccct

SEQ ID NO: 7765215 - DNA, 22 bp, Homo sapiens
gagccacagcaacctcaaagga

SEQ ID NO: 7765216 - DNA, 22 bp, Homo sapiens
gagccacagactgtatttggga

SEQ ID NO: 7765217 - DNA, 22 bp, Homo sapiens
gagccacagcaacctcaaagga

SEQ ID NO: 7765218 - DNA, 22 bp, Homo sapiens
gagccacagaaggaaattgggg

SEQ ID NO: 7765219 - DNA, 22 bp, Homo sapiens
gagccacagtggattgattcca

SEQ ID NO: 7765220 - DNA, 22 bp, Homo sapiens
gagccacagtggtggcccacgt

SEQ ID NO: 7765221 - DNA, 22 bp, Homo sapiens
gagcagcttatgtcaagccaga

SEQ ID NO: 7765222 - DNA, 22 bp, Homo sapiens
gagccaagggcgtgctggagag

SEQ ID NO: 7765223 - DNA, 22 bp, Homo sapiens
gagccaagggcgtgctggagag

SEQ ID NO: 7765224 - DNA, 22 bp, Homo sapiens
gagccaagcaccacattaagtt

SEQ ID NO: 7765225 - DNA, 22 bp, Homo sapiens
gagccaagcaatatacccaacc

SEQ ID NO: 7765226 - DNA, 20 bp, Homo sapiens
gagattaactgagaatctag

SEQ ID NO: 7765227 - DNA, 22 bp, Homo sapiens
gagatggagtctttttctgtca

SEQ ID NO: 7765228 - DNA, 22 bp, Homo sapiens
gagatggagtctttttctgtca

SEQ ID NO: 7765229 - DNA, 20 bp, Homo sapiens
gagatggacagatgaagggg

SEQ ID NO: 7765230 - DNA, 23 bp, Homo sapiens
gagatttagcagacaaagctctt

SEQ ID NO: 7765231 - DNA, 22 bp, Homo sapiens
ctgcatccatgttgctgcaaag

SEQ ID NO: 7765232 - DNA, 22 bp, Homo sapiens
ctgcatccatgttgctgcaaag

SEQ ID NO: 7765233 - DNA, 22 bp, Homo sapiens
ctgcatcaggccaattaagaat

SEQ ID NO: 7765234 - DNA, 20 bp, Homo sapiens
ctgcatcatggttaagaaca

SEQ ID NO: 7765235 - DNA, 22 bp, Homo sapiens
ctgccagagatctgggcagagt

SEQ ID NO: 7765236 - DNA, 22 bp, Homo sapiens
ctgccagacacgttatgctcat

SEQ ID NO: 7765237 - DNA, 22 bp, Homo sapiens
ctggcagcttcctttgcatctg

SEQ ID NO: 7765238 - DNA, 22 bp, Homo sapiens
ctggcaggaagaggaaaggtca

SEQ ID NO: 7765239 - DNA, 22 bp, Homo sapiens
ctggcaggaagttagatggtaa

SEQ ID NO: 7765240 - DNA, 22 bp, Homo sapiens
ctggcaggaagttagatggtaa

SEQ ID NO: 7765241 - DNA, 22 bp, Homo sapiens
ctggcaggaagaggaaaggtca

SEQ ID NO: 7765242 - DNA, 22 bp, Homo sapiens
ctgccagcagaggccagcgctg

SEQ ID NO: 7765243 - DNA, 22 bp, Homo sapiens
ctgccagcagaggccagcgctg

SEQ ID NO: 7765244 - DNA, 22 bp, Homo sapiens
ctgccagctcaaagcgcagcta

SEQ ID NO: 7765245 - DNA, 22 bp, Homo sapiens
ctgccagctcaccggctcagac

SEQ ID NO: 7765246 - DNA, 22 bp, Homo sapiens
ctggcaggagcattcacagagg

SEQ ID NO: 7765247 - DNA, 20 bp, Homo sapiens
ctggcaggagcgagtctacc

SEQ ID NO: 7765248 - DNA, 20 bp, Homo sapiens
ctggcaggagcgagtctacc

SEQ ID NO: 7765249 - DNA, 22 bp, Homo sapiens
ctggcaggagctgtggccgtag

SEQ ID NO: 7765250 - DNA, 22 bp, Homo sapiens
ctggcaggagctgtggccgtag

SEQ ID NO: 7765251 - DNA, 22 bp, Homo sapiens
ctggcaggcaaattggtgggag

SEQ ID NO: 7765252 - DNA, 22 bp, Homo sapiens
ctggcaggcaaattggtgggag

SEQ ID NO: 7765253 - DNA, 22 bp, Homo sapiens
ctggcaggatctaaccagggaa

SEQ ID NO: 7765254 - DNA, 22 bp, Homo sapiens
ctggcaggcaaattggtgggag

SEQ ID NO: 7765255 - DNA, 22 bp, Homo sapiens
ctggcagggcaggggtttgtgc

SEQ ID NO: 7765256 - DNA, 22 bp, Homo sapiens
ctggcaggctctctggtcggtt

SEQ ID NO: 7765257 - DNA, 22 bp, Homo sapiens
ctggcaggctctctggtcggtt

SEQ ID NO: 7765258 - DNA, 22 bp, Homo sapiens
ctggcaggctctctggtcggtt

SEQ ID NO: 7765259 - DNA, 22 bp, Homo sapiens
ctggcaggcggaggttgcagtg

SEQ ID NO: 7765260 - DNA, 22 bp, Homo sapiens
ctggcaggcggaggttgcagtg

SEQ ID NO: 7765261 - DNA, 22 bp, Homo sapiens
ctggcaggcggaggttgcagtg

SEQ ID NO: 7765262 - DNA, 22 bp, Homo sapiens
ctggcaggcggcagagcccagg

SEQ ID NO: 7765263 - DNA, 22 bp, Homo sapiens
ctggccagcctcccaggtaccc

SEQ ID NO: 7765264 - DNA, 22 bp, Homo sapiens
ctggccagctgacagcagggct

SEQ ID NO: 7765265 - DNA, 22 bp, Homo sapiens
ctggctcatgtgatgagggcaa

SEQ ID NO: 7765266 - DNA, 22 bp, Homo sapiens
ctggctccaaggaagaggtttt

SEQ ID NO: 7765267 - DNA, 22 bp, Homo sapiens
ctggctgcaggatgaggctgcc

SEQ ID NO: 7765268 - DNA, 22 bp, Homo sapiens
ctggctgcaggaaggagtgggc

SEQ ID NO: 7765269 - DNA, 20 bp, Homo sapiens
ctggctggaaacttagcctt

SEQ ID NO: 7765270 - DNA, 22 bp, Homo sapiens
ctggctggaacgccgaggcggc

SEQ ID NO: 7765271 - DNA, 22 bp, Homo sapiens
ctggctggaagttagagaactt

SEQ ID NO: 7765272 - DNA, 16 bp, Homo sapiens
ctggctggaagcctgg

SEQ ID NO: 7765273 - DNA, 22 bp, Homo sapiens
ctggctggagcaggcatcttgt

SEQ ID NO: 7765274 - DNA, 22 bp, Homo sapiens
ctggctggacttgtgcatgtca

SEQ ID NO: 7765275 - DNA, 22 bp, Homo sapiens
ctggctgcgtctgctctgacag

SEQ ID NO: 7765276 - DNA, 22 bp, Homo sapiens
ctggctgcctggagtgagggag

SEQ ID NO: 7765277 - DNA, 22 bp, Homo sapiens
ctggctgccagcatttggggga

SEQ ID NO: 7765278 - DNA, 22 bp, Homo sapiens
ctggcccaggtggtcgttgagg

SEQ ID NO: 7765279 - DNA, 22 bp, Homo sapiens
ctggcccagtctcagagtgtca

SEQ ID NO: 7765280 - DNA, 19 bp, Homo sapiens
ctggccaggccaggggccc

SEQ ID NO: 7765281 - DNA, 22 bp, Homo sapiens
ctggccctggagggctgtgcga

SEQ ID NO: 7765282 - DNA, 22 bp, Homo sapiens
ctggccctggagggctgtgcga

SEQ ID NO: 7765283 - DNA, 22 bp, Homo sapiens
ctggccctcagactcatgggca

SEQ ID NO: 7765284 - DNA, 22 bp, Homo sapiens
ctggctcacctccgctccagca

SEQ ID NO: 7765285 - DNA, 22 bp, Homo sapiens
ctggctcagacagctgtgcagt

SEQ ID NO: 7765286 - DNA, 22 bp, Homo sapiens
ctggggtgtgctcagagcaggg

SEQ ID NO: 7765287 - DNA, 22 bp, Homo sapiens
ctggggtgtgctcagagcaggg

SEQ ID NO: 7765288 - DNA, 22 bp, Homo sapiens
ctggggctgcggtggaggagcc

SEQ ID NO: 7765289 - DNA, 22 bp, Homo sapiens
ctggggctgcggtggaggagcc

SEQ ID NO: 7765290 - DNA, 22 bp, Homo sapiens
ctggggctgcggacgggagccc

SEQ ID NO: 7765291 - DNA, 22 bp, Homo sapiens
ctggggctgcggacgggagccc

SEQ ID NO: 7765292 - DNA, 22 bp, Homo sapiens
ctggggctgcggacgggagccc

SEQ ID NO: 7765293 - DNA, 22 bp, Homo sapiens
ctgggtctggccacaggaagta

SEQ ID NO: 7765294 - DNA, 22 bp, Homo sapiens
ctgggtctggccacaggaagta

SEQ ID NO: 7765295 - DNA, 22 bp, Homo sapiens
ctggggcccgagccttgggcca

SEQ ID NO: 7765296 - DNA, 22 bp, Homo sapiens
ctggggctcactccagccctgg

SEQ ID NO: 7765297 - DNA, 22 bp, Homo sapiens
ctggggccagtgaggaggcttt

SEQ ID NO: 7765298 - DNA, 22 bp, Homo sapiens
ctggggccacaacggcgcacgc

SEQ ID NO: 7765299 - DNA, 23 bp, Homo sapiens
ctgggctgcttgagtccctggct

SEQ ID NO: 7765300 - DNA, 22 bp, Homo sapiens
ctgggctgctgtccactagggt

SEQ ID NO: 7765301 - DNA, 22 bp, Homo sapiens
ctgggctgctgtccactagggt

SEQ ID NO: 7765302 - DNA, 20 bp, Homo sapiens
ctggggaggaggatgtgttc

SEQ ID NO: 7765303 - DNA, 20 bp, Homo sapiens
ctggggaggaggatgtgttc

SEQ ID NO: 7765304 - DNA, 20 bp, Homo sapiens
ctggggagctgctcccacga

SEQ ID NO: 7765305 - DNA, 22 bp, Homo sapiens
ctgggctgcttgctgaaggggt

SEQ ID NO: 7765306 - DNA, 22 bp, Homo sapiens
ctgggctgcgggcgcccctcca

SEQ ID NO: 7765307 - DNA, 22 bp, Homo sapiens
ctgggctgccaggtaggcacac

SEQ ID NO: 7765308 - DNA, 22 bp, Homo sapiens
ctgggctgcaggagtggggcaa

SEQ ID NO: 7765309 - DNA, 22 bp, Homo sapiens
ctgggctgcaggagtggggcaa

SEQ ID NO: 7765310 - DNA, 22 bp, Homo sapiens
ctgggctgcagcgggagcgacg

SEQ ID NO: 7765311 - DNA, 23 bp, Homo sapiens
ctgggcatggagcttcagaggct

SEQ ID NO: 7765312 - DNA, 22 bp, Homo sapiens
ctgggccacttcctcaggggaa

SEQ ID NO: 7765313 - DNA, 22 bp, Homo sapiens
ctgggccactccagatgcccac

SEQ ID NO: 7765314 - DNA, 22 bp, Homo sapiens
ctgggcaggagaggtggttgga

SEQ ID NO: 7765315 - DNA, 22 bp, Homo sapiens
ctgggcaggagaggtggttgga

SEQ ID NO: 7765316 - DNA, 22 bp, Homo sapiens
ctgggaggcggagcttgcagtg

SEQ ID NO: 7765317 - DNA, 22 bp, Homo sapiens
ctgggaggcactattcaggagg

SEQ ID NO: 7765318 - DNA, 22 bp, Homo sapiens
ctgggaggcagaggttgtagtg

SEQ ID NO: 7765319 - DNA, 22 bp, Homo sapiens
ctgggagctgaggctgacgctg

SEQ ID NO: 7765320 - DNA, 22 bp, Homo sapiens
ctgggagctgaggctgacgctg

SEQ ID NO: 7765321 - DNA, 22 bp, Homo sapiens
ctgggaggattcattgaggtga

SEQ ID NO: 7765322 - DNA, 22 bp, Homo sapiens
ctgggagctagctctgagctga

SEQ ID NO: 7765323 - DNA, 22 bp, Homo sapiens
ctgggagctagctctgagctga

SEQ ID NO: 7765324 - DNA, 22 bp, Homo sapiens
ctgggagctcagccctggggtg

SEQ ID NO: 7765325 - DNA, 22 bp, Homo sapiens
ctggctgtgctgactgagaggg

SEQ ID NO: 7765326 - DNA, 22 bp, Homo sapiens
ctggctttaatgtcatctttct

SEQ ID NO: 7765327 - DNA, 22 bp, Homo sapiens
cttcagaactataaaaagtact

SEQ ID NO: 7765328 - DNA, 22 bp, Homo sapiens
ctgttgtattattcaatattat

SEQ ID NO: 7765329 - DNA, 22 bp, Homo sapiens
ctgttgttccgggagctgcagc

SEQ ID NO: 7765330 - DNA, 22 bp, Homo sapiens
cttatatttgtcaactttacaa

SEQ ID NO: 7765331 - DNA, 22 bp, Homo sapiens
cttatattttaggaacagacaa

SEQ ID NO: 7765332 - DNA, 22 bp, Homo sapiens
cttcagtgcatgtttataatca

SEQ ID NO: 7765333 - DNA, 22 bp, Homo sapiens
cttcagtatcctccacatgtta

SEQ ID NO: 7765334 - DNA, 22 bp, Homo sapiens
cttcagtgaatgttgagtaagg

SEQ ID NO: 7765335 - DNA, 22 bp, Homo sapiens
cttcaggagtagttacctagca

SEQ ID NO: 7765336 - DNA, 20 bp, Homo sapiens
cttcaggacccatcctcccc

SEQ ID NO: 7765337 - DNA, 22 bp, Homo sapiens
cttcagtgttcccatctgtaaa

SEQ ID NO: 7765338 - DNA, 22 bp, Homo sapiens
cttcagtgtcctctctagtaga

SEQ ID NO: 7765339 - DNA, 22 bp, Homo sapiens
cttcctaaaagcttcaagagaa

SEQ ID NO: 7765340 - DNA, 19 bp, Homo sapiens
cttcctggaggagagcctc

SEQ ID NO: 7765341 - DNA, 22 bp, Homo sapiens
cttcctggcaaagcaatcagag

SEQ ID NO: 7765342 - DNA, 22 bp, Homo sapiens
cttgtcttgcacacggttgcca

SEQ ID NO: 7765343 - DNA, 21 bp, Homo sapiens
cttgtcttgcttagaatagac

SEQ ID NO: 7765344 - DNA, 22 bp, Homo sapiens
cttgtcttgcacacggttgcca

SEQ ID NO: 7765345 - DNA, 22 bp, Homo sapiens
ctttatggaatcaaagactgga

SEQ ID NO: 7765346 - DNA, 22 bp, Homo sapiens
ctttatggtaagtatagatgac

SEQ ID NO: 7765347 - DNA, 22 bp, Homo sapiens
ctttatggagtgacacaatggg

SEQ ID NO: 7765348 - DNA, 22 bp, Homo sapiens
cttgtcctttacttgagactca

SEQ ID NO: 7765349 - DNA, 22 bp, Homo sapiens
cttgtcactctggctccagagc

SEQ ID NO: 7765350 - DNA, 22 bp, Homo sapiens
cttgtattctgcctaaccttca

SEQ ID NO: 7765351 - DNA, 22 bp, Homo sapiens
cttgtattcttgtacctttcaa

SEQ ID NO: 7765352 - DNA, 22 bp, Homo sapiens
cttgtattcccctatctctaaa

SEQ ID NO: 7765353 - DNA, 22 bp, Homo sapiens
cttgtatagggaaagataaatc

SEQ ID NO: 7765354 - DNA, 22 bp, Homo sapiens
cttgtagctgactatcttgttc

SEQ ID NO: 7765355 - DNA, 22 bp, Homo sapiens
cttgggtgctggaggctgccgc

SEQ ID NO: 7765356 - DNA, 22 bp, Homo sapiens
cttgccaaattaacatacagaa

SEQ ID NO: 7765357 - DNA, 22 bp, Homo sapiens
cttgccaatggtacaaacgatt

SEQ ID NO: 7765358 - DNA, 20 bp, Homo sapiens
cttgcccagggtctcctgcc

SEQ ID NO: 7765359 - DNA, 22 bp, Homo sapiens
cttgggtgctcagggaaagctt

SEQ ID NO: 7765360 - DNA, 18 bp, Homo sapiens
ctgttctagaactcctgt

SEQ ID NO: 7765361 - DNA, 22 bp, Homo sapiens
ctgttctgaccagtgcagggat

SEQ ID NO: 7765362 - DNA, 22 bp, Homo sapiens
ctgttctgaactgcctgcatgc

SEQ ID NO: 7765363 - DNA, 22 bp, Homo sapiens
ctgttcatgctgattctgtatg

SEQ ID NO: 7765364 - DNA, 22 bp, Homo sapiens
ctgttcaatttgtttcagttat

SEQ ID NO: 7765365 - DNA, 18 bp, Homo sapiens
ctgttgagatgtggctga

SEQ ID NO: 7765366 - DNA, 22 bp, Homo sapiens
ctgttcttatcgtcttaatatc

SEQ ID NO: 7765367 - DNA, 22 bp, Homo sapiens
ctgttcttctgggaatggccct

SEQ ID NO: 7765368 - DNA, 22 bp, Homo sapiens
ctgtgtcttctgcttacagtct

SEQ ID NO: 7765369 - DNA, 23 bp, Homo sapiens
ctgttaaattccttaagagcagg

SEQ ID NO: 7765370 - DNA, 22 bp, Homo sapiens
ctgtgtctctccttacaagact

SEQ ID NO: 7765371 - DNA, 22 bp, Homo sapiens
ctgtggctccagtgaaccaatg

SEQ ID NO: 7765372 - DNA, 22 bp, Homo sapiens
ctgtggctgaactctgaagagg

SEQ ID NO: 7765373 - DNA, 22 bp, Homo sapiens
ctgtggctgtatttggccagag

SEQ ID NO: 7765374 - DNA, 22 bp, Homo sapiens
ctgggtgccagcatggctgagt

SEQ ID NO: 7765375 - DNA, 22 bp, Homo sapiens
ctgggtgcgtgagcgcatgcgt

SEQ ID NO: 7765376 - DNA, 22 bp, Homo sapiens
ctgtcctctgtcctcagcagga

SEQ ID NO: 7765377 - DNA, 22 bp, Homo sapiens
ctgtgccattctttgtagcatg

SEQ ID NO: 7765378 - DNA, 22 bp, Homo sapiens
ctgtgccagcctgtcccaggag

SEQ ID NO: 7765379 - DNA, 22 bp, Homo sapiens
ctgtgccctctttgctggcctt

SEQ ID NO: 7765380 - DNA, 22 bp, Homo sapiens
ctgtgagggtcacagccatgcc

SEQ ID NO: 7765381 - DNA, 22 bp, Homo sapiens
ctgtgcagtccagccctggaca

SEQ ID NO: 7765382 - DNA, 22 bp, Homo sapiens
ctgtgccactgccccaggcctc

SEQ ID NO: 7765383 - DNA, 22 bp, Homo sapiens
ctgtgcagtgtggggtaggcct

SEQ ID NO: 7765384 - DNA, 22 bp, Homo sapiens
ctctgtttctcagcctatttcc

SEQ ID NO: 7765385 - DNA, 22 bp, Homo sapiens
ctctgtttctcagcctatttcc

SEQ ID NO: 7765386 - DNA, 22 bp, Homo sapiens
ctcttagtttgtaaaaataatt

SEQ ID NO: 7765387 - DNA, 22 bp, Homo sapiens
ctcttcagttggtcactattct

SEQ ID NO: 7765388 - DNA, 22 bp, Homo sapiens
ctcttcagttgttgcatattct

SEQ ID NO: 7765389 - DNA, 21 bp, Homo sapiens
ctcttcagtggtgagctcttc

SEQ ID NO: 7765390 - DNA, 22 bp, Homo sapiens
ctcttcagtaaatgacactgtt

SEQ ID NO: 7765391 - DNA, 22 bp, Homo sapiens
ctcttcagatatacagtactct

SEQ ID NO: 7765392 - DNA, 22 bp, Homo sapiens
ctcttcagtaaatgacactgtt

SEQ ID NO: 7765393 - DNA, 22 bp, Homo sapiens
ctcttcaggatggcttgtgatg

SEQ ID NO: 7765394 - DNA, 22 bp, Homo sapiens
ttttcagtggcttgcatatgtt

SEQ ID NO: 7765395 - DNA, 22 bp, Homo sapiens
ttttcagtaatgtctacataat

SEQ ID NO: 7765396 - DNA, 22 bp, Homo sapiens
ttttcagagagcttttatgtcc

SEQ ID NO: 7765397 - DNA, 22 bp, Homo sapiens
ttttcagagagcttttatgtcc

SEQ ID NO: 7765398 - DNA, 22 bp, Homo sapiens
ttttcacttaaggaatttcatg

SEQ ID NO: 7765399 - DNA, 22 bp, Homo sapiens
ctcttcccagctccacgagagg

SEQ ID NO: 7765400 - DNA, 22 bp, Homo sapiens
ttttcagttactgtttatgtga

SEQ ID NO: 7765401 - DNA, 22 bp, Homo sapiens
ttttcagttatagaatggtaga

SEQ ID NO: 7765402 - DNA, 22 bp, Homo sapiens
tttgtacacaggatgttataat

SEQ ID NO: 7765403 - DNA, 22 bp, Homo sapiens
tttgtacacaggtcattcaggg

SEQ ID NO: 7765404 - DNA, 22 bp, Homo sapiens
tttgtacactgtctactatgaa

SEQ ID NO: 7765405 - DNA, 22 bp, Homo sapiens
tttgtacatataaatcttgtat

SEQ ID NO: 7765406 - DNA, 22 bp, Homo sapiens
ttttaagatgctagtatttcag

SEQ ID NO: 7765407 - DNA, 22 bp, Homo sapiens
ttttaatactgctattgtagga

SEQ ID NO: 7765408 - DNA, 22 bp, Homo sapiens
ttttaagttaatataattgagg

SEQ ID NO: 7765409 - DNA, 22 bp, Homo sapiens
ttttagattataagtctaattc

SEQ ID NO: 7765410 - DNA, 22 bp, Homo sapiens
ttttagattgggaaatgtaaag

SEQ ID NO: 7765411 - DNA, 22 bp, Homo sapiens
ttttagcactaagtgatatgct

SEQ ID NO: 7765412 - DNA, 22 bp, Homo sapiens
tttgccaggcttgcatgaattt

SEQ ID NO: 7765413 - DNA, 22 bp, Homo sapiens
tttgcctgggaattctagtgta

SEQ ID NO: 7765414 - DNA, 20 bp, Homo sapiens
tttgctatgcatatctgacc

SEQ ID NO: 7765415 - DNA, 22 bp, Homo sapiens
tttgctataaaagggtcacacg

SEQ ID NO: 7765416 - DNA, 22 bp, Homo sapiens
tttgctattgtgaatagtgcca

SEQ ID NO: 7765417 - DNA, 19 bp, Homo sapiens
tttgggaagcccagagtgt

SEQ ID NO: 7765418 - DNA, 22 bp, Homo sapiens
tttgggaagaggaatctctgga

SEQ ID NO: 7765419 - DNA, 22 bp, Homo sapiens
tttgggaagtgggagcaaggtg

SEQ ID NO: 7765420 - DNA, 22 bp, Homo sapiens
ctctgccaagatgacaggtaag

SEQ ID NO: 7765421 - DNA, 22 bp, Homo sapiens
ctctgcccacgtcttgcccaga

SEQ ID NO: 7765422 - DNA, 22 bp, Homo sapiens
ctctgcccacgtcttgcccaga

SEQ ID NO: 7765423 - DNA, 22 bp, Homo sapiens
ctctgccatcttggagctcaag

SEQ ID NO: 7765424 - DNA, 22 bp, Homo sapiens
ctctgccctcgcacatctgcca

SEQ ID NO: 7765425 - DNA, 19 bp, Homo sapiens
ctctgcctccctcctgggt

SEQ ID NO: 7765426 - DNA, 22 bp, Homo sapiens
tttgcaaataaataagtgctcg

SEQ ID NO: 7765427 - DNA, 22 bp, Homo sapiens
tttgcattttgataagatcact

SEQ ID NO: 7765428 - DNA, 22 bp, Homo sapiens
tttgcaaagttatttagactca

SEQ ID NO: 7765429 - DNA, 22 bp, Homo sapiens
ctctgcccgcggatgccacgtc

SEQ ID NO: 7765430 - DNA, 22 bp, Homo sapiens
ctctgcccgcggatgccacgtc

SEQ ID NO: 7765431 - DNA, 22 bp, Homo sapiens
ctctgcccgtgcctttcccagt

SEQ ID NO: 7765432 - DNA, 20 bp, Homo sapiens
ctgagccaactctcttcttg

SEQ ID NO: 7765433 - DNA, 22 bp, Homo sapiens
ctgagccaaccacagcaggagc

SEQ ID NO: 7765434 - DNA, 22 bp, Homo sapiens
ctgagccataagggaggctggg

SEQ ID NO: 7765435 - DNA, 22 bp, Homo sapiens
ctgagccagtagtcagggacaa

SEQ ID NO: 7765436 - DNA, 22 bp, Homo sapiens
ctgagccatgggtctaagcact

SEQ ID NO: 7765437 - DNA, 22 bp, Homo sapiens
ctgagccatgggtctaagcact

SEQ ID NO: 7765438 - DNA, 22 bp, Homo sapiens
ctgagccatgagcctgcgccca

SEQ ID NO: 7765439 - DNA, 22 bp, Homo sapiens
ctgagccatgagcctgcgccca

SEQ ID NO: 7765440 - DNA, 22 bp, Homo sapiens
ctgagccatgagcctgcgccca

SEQ ID NO: 7765441 - DNA, 22 bp, Homo sapiens
ctgactctcctcaagcataaat

SEQ ID NO: 7765442 - DNA, 22 bp, Homo sapiens
ctgagccaaccacagcaggagc

SEQ ID NO: 7765443 - DNA, 17 bp, Homo sapiens
ctgagccccgggcagct

SEQ ID NO: 7765444 - DNA, 22 bp, Homo sapiens
ctgaccagggtagaggtgagag

SEQ ID NO: 7765445 - DNA, 22 bp, Homo sapiens
ctgacatgtataagctttaagt

SEQ ID NO: 7765446 - DNA, 22 bp, Homo sapiens
ctgacaggttggtagctttgga

SEQ ID NO: 7765447 - DNA, 22 bp, Homo sapiens
ctgacagatgctgctggcagta

SEQ ID NO: 7765448 - DNA, 22 bp, Homo sapiens
ctgacagggtagacagagggca

SEQ ID NO: 7765449 - DNA, 22 bp, Homo sapiens
ctgacagctgttgcagtgaatg

SEQ ID NO: 7765450 - DNA, 22 bp, Homo sapiens
ctgacagctgctgccgccgcat

SEQ ID NO: 7765451 - DNA, 22 bp, Homo sapiens
ctgacagcagcaaatggagata

SEQ ID NO: 7765452 - DNA, 22 bp, Homo sapiens
ctgacagccatgttttagagaa

SEQ ID NO: 7765453 - DNA, 22 bp, Homo sapiens
ctgacagcgagagagttgcccc

SEQ ID NO: 7765454 - DNA, 22 bp, Homo sapiens
ctgacagcaaaggccagtggct

SEQ ID NO: 7765455 - DNA, 22 bp, Homo sapiens
ctgacagctcctagtgctcact

SEQ ID NO: 7765456 - DNA, 19 bp, Homo sapiens
ctgacagcgcctgataaga

SEQ ID NO: 7765457 - DNA, 22 bp, Homo sapiens
ctgacagctctggctagtagaa

SEQ ID NO: 7765458 - DNA, 22 bp, Homo sapiens
ctgacagctgaagggtcccaga

SEQ ID NO: 7765459 - DNA, 22 bp, Homo sapiens
ctgacagctatttttgtagata

SEQ ID NO: 7765460 - DNA, 22 bp, Homo sapiens
ctctttcctcgatgggctcctg

SEQ ID NO: 7765461 - DNA, 22 bp, Homo sapiens
ctctttcctcagccacagtcta

SEQ ID NO: 7765462 - DNA, 22 bp, Homo sapiens
ctctttgaaatccatcactgct

SEQ ID NO: 7765463 - DNA, 22 bp, Homo sapiens
ctctttggagaagcacgtatta

SEQ ID NO: 7765464 - DNA, 22 bp, Homo sapiens
ctctttggagaagcacgtatta

SEQ ID NO: 7765465 - DNA, 22 bp, Homo sapiens
ctctttggatagaattacaaag

SEQ ID NO: 7765466 - DNA, 22 bp, Homo sapiens
ctctttggatagaattacaaag

SEQ ID NO: 7765467 - DNA, 22 bp, Homo sapiens
ctctttggatagaattacaaag

SEQ ID NO: 7765468 - DNA, 19 bp, Homo sapiens
ctctttggagatccttgga

SEQ ID NO: 7765469 - DNA, 22 bp, Homo sapiens
ctctttggagaagcacgtatta

SEQ ID NO: 7765470 - DNA, 19 bp, Homo sapiens
ctctttggagatccttgga

SEQ ID NO: 7765471 - DNA, 22 bp, Homo sapiens
ctctttggatgtttatgataag

SEQ ID NO: 7765472 - DNA, 22 bp, Homo sapiens
ctctttggatgtttatgataag

SEQ ID NO: 7765473 - DNA, 22 bp, Homo sapiens
ctctttggatgtttatgataag

SEQ ID NO: 7765474 - DNA, 22 bp, Homo sapiens
ctctttggccagaaaatgtttt

SEQ ID NO: 7765475 - DNA, 22 bp, Homo sapiens
ctctttggccagaaaatgtttt

SEQ ID NO: 7765476 - DNA, 22 bp, Homo sapiens
ctgcagggcttaccttgctctg

SEQ ID NO: 7765477 - DNA, 22 bp, Homo sapiens
ctgcacatagtaagtactcaat

SEQ ID NO: 7765478 - DNA, 22 bp, Homo sapiens
ctgcaccacagcctgaggcagc

SEQ ID NO: 7765479 - DNA, 22 bp, Homo sapiens
ctgcaccctcaaactcctgggc

SEQ ID NO: 7765480 - DNA, 22 bp, Homo sapiens
ctgcactgacttccccggctgc

SEQ ID NO: 7765481 - DNA, 22 bp, Homo sapiens
ctgcactgagcatctaacctta

SEQ ID NO: 7765482 - DNA, 22 bp, Homo sapiens
ctgcactgagaccctctttgct

SEQ ID NO: 7765483 - DNA, 19 bp, Homo sapiens
ctgcactgagaaaaggagg

SEQ ID NO: 7765484 - DNA, 22 bp, Homo sapiens
ctgcaggcatttattcatgcaa

SEQ ID NO: 7765485 - DNA, 22 bp, Homo sapiens
ctgcactgtgtattccttggct

SEQ ID NO: 7765486 - DNA, 22 bp, Homo sapiens
ctgcactgagctctcccagccc

SEQ ID NO: 7765487 - DNA, 22 bp, Homo sapiens
ctgcactgctgatcccaggtct

SEQ ID NO: 7765488 - DNA, 22 bp, Homo sapiens
ctgcactgtgtaacagataact

SEQ ID NO: 7765489 - DNA, 18 bp, Homo sapiens
ctgcactgtgggtagctc

SEQ ID NO: 7765490 - DNA, 22 bp, Homo sapiens
ctgcactgtgtaacagataact

SEQ ID NO: 7765491 - DNA, 21 bp, Homo sapiens
ctgcaaatacctagttatctg

SEQ ID NO: 7765492 - DNA, 22 bp, Homo sapiens
ctgcaaataggaaaagggcata

SEQ ID NO: 7765493 - DNA, 22 bp, Homo sapiens
ctgcacacatcgcactgcccgt

SEQ ID NO: 7765494 - DNA, 22 bp, Homo sapiens
ctgcaaataggggtgtgaataa

SEQ ID NO: 7765495 - DNA, 22 bp, Homo sapiens
ctgcacacatatggcttctctc

SEQ ID NO: 7765496 - DNA, 22 bp, Homo sapiens
ctgcacacatatggcttctctc

SEQ ID NO: 7765497 - DNA, 22 bp, Homo sapiens
ctgcacagctggccagggagag

SEQ ID NO: 7765498 - DNA, 22 bp, Homo sapiens
ctgcacagctgggcaagatata

SEQ ID NO: 7765499 - DNA, 22 bp, Homo sapiens
ctgcacagcctgtctgggggcc

SEQ ID NO: 7765500 - DNA, 22 bp, Homo sapiens
ctgcacagggatatggggagct

SEQ ID NO: 7765501 - DNA, 22 bp, Homo sapiens
ctgcacagtaagcttcagagat

SEQ ID NO: 7765502 - DNA, 22 bp, Homo sapiens
ctgcacaggggatgagggcagt

SEQ ID NO: 7765503 - DNA, 22 bp, Homo sapiens
ctgcacaggggatgagggcagt

SEQ ID NO: 7765504 - DNA, 22 bp, Homo sapiens
tttaatatctcacacttccatg

SEQ ID NO: 7765505 - DNA, 22 bp, Homo sapiens
ctcccaggcacagggaggagcc

SEQ ID NO: 7765506 - DNA, 22 bp, Homo sapiens
ctcccaggcacagggaggagcc

SEQ ID NO: 7765507 - DNA, 22 bp, Homo sapiens
ctcccaggccatgctctagcca

SEQ ID NO: 7765508 - DNA, 22 bp, Homo sapiens
ctcccaggcagggctgcccact

SEQ ID NO: 7765509 - DNA, 22 bp, Homo sapiens
ctcccagccttcgccagtctga

SEQ ID NO: 7765510 - DNA, 22 bp, Homo sapiens
ctcccactcctggctcaccaca

SEQ ID NO: 7765511 - DNA, 22 bp, Homo sapiens
ctcccactcctggctcaccaca

SEQ ID NO: 7765512 - DNA, 22 bp, Homo sapiens
ctccattgttcgcgcagctgca

SEQ ID NO: 7765513 - DNA, 22 bp, Homo sapiens
ctcccaaggggtaagggagctg

SEQ ID NO: 7765514 - DNA, 22 bp, Homo sapiens
ctcccacatggaatagcaggga

SEQ ID NO: 7765515 - DNA, 22 bp, Homo sapiens
ctccagtgcgcaggacagcccc

SEQ ID NO: 7765516 - DNA, 22 bp, Homo sapiens
ctccatggaaccggggctgctt

SEQ ID NO: 7765517 - DNA, 20 bp, Homo sapiens
ttgtggtttagattatctga

SEQ ID NO: 7765518 - DNA, 20 bp, Homo sapiens
ctccagcccctgccctggtc

SEQ ID NO: 7765519 - DNA, 20 bp, Homo sapiens
ctccagcccctgccctggtc

SEQ ID NO: 7765520 - DNA, 22 bp, Homo sapiens
ctccagccagagtgcctctgtt

SEQ ID NO: 7765521 - DNA, 22 bp, Homo sapiens
ctccagccagagtgcctctgtt

SEQ ID NO: 7765522 - DNA, 22 bp, Homo sapiens
ttgtctttcccagcttctagag

SEQ ID NO: 7765523 - DNA, 22 bp, Homo sapiens
ttgtcttaaatggatggacaat

SEQ ID NO: 7765524 - DNA, 22 bp, Homo sapiens
ttgtctgtgaaatggaaatagt

SEQ ID NO: 7765525 - DNA, 22 bp, Homo sapiens
ttgtcttagagtgaaaacttta

SEQ ID NO: 7765526 - DNA, 22 bp, Homo sapiens
ctcatttatttctcccaaaaca

SEQ ID NO: 7765527 - DNA, 22 bp, Homo sapiens
ctcatttaacagattaaaaagt

SEQ ID NO: 7765528 - DNA, 22 bp, Homo sapiens
ctcatttacctttgcaatcaag

SEQ ID NO: 7765529 - DNA, 22 bp, Homo sapiens
ctcatttactcatctgcaaaac

SEQ ID NO: 7765530 - DNA, 22 bp, Homo sapiens
ctcacaggttagttgtgtggat

SEQ ID NO: 7765531 - DNA, 22 bp, Homo sapiens
ttcttttacattaagatttcag

SEQ ID NO: 7765532 - DNA, 22 bp, Homo sapiens
ttcttttcctacacagcgattt

SEQ ID NO: 7765533 - DNA, 22 bp, Homo sapiens
ttcttttcccaatattttgctg

SEQ ID NO: 7765534 - DNA, 22 bp, Homo sapiens
ttcttttcccaatattttgctg

SEQ ID NO: 7765535 - DNA, 22 bp, Homo sapiens
ctccacaggtgtactgtacctt

SEQ ID NO: 7765536 - DNA, 22 bp, Homo sapiens
ctccacagcccctccagtggca

SEQ ID NO: 7765537 - DNA, 22 bp, Homo sapiens
ttgtacaagtattatgtgaaca

SEQ ID NO: 7765538 - DNA, 22 bp, Homo sapiens
ttggtcagctaataaggacagg

SEQ ID NO: 7765539 - DNA, 22 bp, Homo sapiens
tttatttaaagtcgtgtgttaa

SEQ ID NO: 7765540 - DNA, 22 bp, Homo sapiens
tttatttaccttatgtcctcca

SEQ ID NO: 7765541 - DNA, 22 bp, Homo sapiens
tttatttaccttatgtcctcca

SEQ ID NO: 7765542 - DNA, 22 bp, Homo sapiens
ctcctggcactcagtgtggaag

SEQ ID NO: 7765543 - DNA, 16 bp, Homo sapiens
tttatttactagtgtt

SEQ ID NO: 7765544 - DNA, 17 bp, Homo sapiens
ctcctggcagcctcagg

SEQ ID NO: 7765545 - DNA, 17 bp, Homo sapiens
ctcctggcagcctcagg

SEQ ID NO: 7765546 - DNA, 22 bp, Homo sapiens
ctcctggcagttccccttgtca

SEQ ID NO: 7765547 - DNA, 22 bp, Homo sapiens
ctcctcccaattgccaagtgct

SEQ ID NO: 7765548 - DNA, 22 bp, Homo sapiens
tttattccatgtgtctatgacc

SEQ ID NO: 7765549 - DNA, 22 bp, Homo sapiens
tttagtcatttggatttgatct

SEQ ID NO: 7765550 - DNA, 23 bp, Homo sapiens
tttagtcagttgacagccatata

SEQ ID NO: 7765551 - DNA, 22 bp, Homo sapiens
tttaggttttttcacgtggcta

SEQ ID NO: 7765552 - DNA, 22 bp, Homo sapiens
tttaggttaatcaacaaacatt

SEQ ID NO: 7765553 - DNA, 22 bp, Homo sapiens
ctcccgtgatcctggaggagag

SEQ ID NO: 7765554 - DNA, 22 bp, Homo sapiens
tttccttgggtctcttagtggc

SEQ ID NO: 7765555 - DNA, 20 bp, Homo sapiens
ctctctctccattcccaggg

SEQ ID NO: 7765556 - DNA, 22 bp, Homo sapiens
ctctccaggctgggacaggacc

SEQ ID NO: 7765557 - DNA, 22 bp, Homo sapiens
ctctccaggagctcagagtcta

SEQ ID NO: 7765558 - DNA, 22 bp, Homo sapiens
ctctccaggcgaggtcctactg

SEQ ID NO: 7765559 - DNA, 22 bp, Homo sapiens
ctctccaggcgaggtcctactg

SEQ ID NO: 7765560 - DNA, 22 bp, Homo sapiens
tttcctcacacagaagatcttg

SEQ ID NO: 7765561 - DNA, 22 bp, Homo sapiens
ctctccaggagctcagagtcta

SEQ ID NO: 7765562 - DNA, 22 bp, Homo sapiens
ctctccagtcatattctcagtc

SEQ ID NO: 7765563 - DNA, 22 bp, Homo sapiens
ctctccagggcatgagttccac

SEQ ID NO: 7765564 - DNA, 22 bp, Homo sapiens
ctctccaggggtagatgccttc

SEQ ID NO: 7765565 - DNA, 22 bp, Homo sapiens
tttcctagagtctctagaagaa

SEQ ID NO: 7765566 - DNA, 22 bp, Homo sapiens
tttcctacccttccaggcagag

SEQ ID NO: 7765567 - DNA, 22 bp, Homo sapiens
tttcacataaatggagtaaaga

SEQ ID NO: 7765568 - DNA, 22 bp, Homo sapiens
tttcacataaatattatgccta

SEQ ID NO: 7765569 - DNA, 22 bp, Homo sapiens
tttcacataaatattatgccta

SEQ ID NO: 7765570 - DNA, 22 bp, Homo sapiens
tttcacataaatggagtaaaga

SEQ ID NO: 7765571 - DNA, 22 bp, Homo sapiens
tttcacataaatggagtaaaga

SEQ ID NO: 7765572 - DNA, 22 bp, Homo sapiens
tttcacatacagtgtatagtag

SEQ ID NO: 7765573 - DNA, 22 bp, Homo sapiens
tttcacatacagtgtatagtag

SEQ ID NO: 7765574 - DNA, 22 bp, Homo sapiens
tttcacatagaaagtgatttac

SEQ ID NO: 7765575 - DNA, 22 bp, Homo sapiens
tttcacatagaaagtgatttac

SEQ ID NO: 7765576 - DNA, 22 bp, Homo sapiens
tttcacataaatattatgccta

SEQ ID NO: 7765577 - DNA, 22 bp, Homo sapiens
tttcacagtagaaatcattatg

SEQ ID NO: 7765578 - DNA, 22 bp, Homo sapiens
tttcacagtagaaatcattatg

SEQ ID NO: 7765579 - DNA, 22 bp, Homo sapiens
tttcacaaagcatagcacttta

SEQ ID NO: 7765580 - DNA, 22 bp, Homo sapiens
tttcacaaagcatagcacttta

SEQ ID NO: 7765581 - DNA, 22 bp, Homo sapiens
ctcctggccctgagctcccagg

SEQ ID NO: 7765582 - DNA, 22 bp, Homo sapiens
tttcaatttccaggctagaatt

SEQ ID NO: 7765583 - DNA, 22 bp, Homo sapiens
cgcagctgtccatgtgtggggg

SEQ ID NO: 7765584 - DNA, 22 bp, Homo sapiens
cgcatccagggcgcaggatctg

SEQ ID NO: 7765585 - DNA, 22 bp, Homo sapiens
cgccaggcttggtagctcatgc

SEQ ID NO: 7765586 - DNA, 23 bp, Homo sapiens
cgcccagcctcagtgacctgggc

SEQ ID NO: 7765587 - DNA, 22 bp, Homo sapiens
cctttccccgcgggaggtgcca

SEQ ID NO: 7765588 - DNA, 22 bp, Homo sapiens
cctttcccgctttgagggcaag

SEQ ID NO: 7765589 - DNA, 22 bp, Homo sapiens
cctttcaaagttttgccatgct

SEQ ID NO: 7765590 - DNA, 22 bp, Homo sapiens
cctttcaaaacagaacactagc

SEQ ID NO: 7765591 - DNA, 22 bp, Homo sapiens
cctttcaaaacagaacactagc

SEQ ID NO: 7765592 - DNA, 22 bp, Homo sapiens
cctttctacagatgcctcttgc

SEQ ID NO: 7765593 - DNA, 22 bp, Homo sapiens
cctttctctatcgacccatcgc

SEQ ID NO: 7765594 - DNA, 17 bp, Homo sapiens
cctttctctttcatctc

SEQ ID NO: 7765595 - DNA, 22 bp, Homo sapiens
cgccccggacgtctgaccaaac

SEQ ID NO: 7765596 - DNA, 22 bp, Homo sapiens
cgccccagtctgtaggtgcccc

SEQ ID NO: 7765597 - DNA, 22 bp, Homo sapiens
ttcaacaaaatatatttttcca

SEQ ID NO: 7765598 - DNA, 22 bp, Homo sapiens
cgccggcttgaggcaggcggca

SEQ ID NO: 7765599 - DNA, 22 bp, Homo sapiens
ttcaaattaccacatttgctta

SEQ ID NO: 7765600 - DNA, 22 bp, Homo sapiens
ttcaagtcttccatggtattct

SEQ ID NO: 7765601 - DNA, 22 bp, Homo sapiens
ttcaagtgaggctgtctttaga

SEQ ID NO: 7765602 - DNA, 22 bp, Homo sapiens
ttcaagtctgtttcattgcatg

SEQ ID NO: 7765603 - DNA, 22 bp, Homo sapiens
ttcaagtctgcccagagtcagc

SEQ ID NO: 7765604 - DNA, 20 bp, Homo sapiens
cgcccagtgcggttctgacc

SEQ ID NO: 7765605 - DNA, 22 bp, Homo sapiens
cgcccagggcaggaggccgctc

SEQ ID NO: 7765606 - DNA, 22 bp, Homo sapiens
cgccccagtctgtaggtgcccc

SEQ ID NO: 7765607 - DNA, 22 bp, Homo sapiens
cgcccaggctggagtgcagtgg

SEQ ID NO: 7765608 - DNA, 22 bp, Homo sapiens
cgcccaggctggagtgcagtga

SEQ ID NO: 7765609 - DNA, 22 bp, Homo sapiens
cgcccagctgaaatctccaggc

SEQ ID NO: 7765610 - DNA, 20 bp, Homo sapiens
cgcccaggagggcccatgtg

SEQ ID NO: 7765611 - DNA, 22 bp, Homo sapiens
cgcccaggctggagagcagtgg

SEQ ID NO: 7765612 - DNA, 22 bp, Homo sapiens
ttcacacacagcttcctattgt

SEQ ID NO: 7765613 - DNA, 22 bp, Homo sapiens
ttcacacacagcttcctattgt

SEQ ID NO: 7765614 - DNA, 22 bp, Homo sapiens
ttcacaatttcccttcatcagg

SEQ ID NO: 7765615 - DNA, 22 bp, Homo sapiens
ttcaagtttgtatttctgtatt

SEQ ID NO: 7765616 - DNA, 22 bp, Homo sapiens
ttcaagttacctttaaacagct

SEQ ID NO: 7765617 - DNA, 22 bp, Homo sapiens
ttcaggcccaacgcacagcttc

SEQ ID NO: 7765618 - DNA, 22 bp, Homo sapiens
ttcagggacttagtgtcagttt

SEQ ID NO: 7765619 - DNA, 22 bp, Homo sapiens
ttcagggactttgatgtatcag

SEQ ID NO: 7765620 - DNA, 22 bp, Homo sapiens
ttcaggcatccctacagttagg

SEQ ID NO: 7765621 - DNA, 22 bp, Homo sapiens
ttcagagggcttgctatgtaca

SEQ ID NO: 7765622 - DNA, 22 bp, Homo sapiens
ttcagaggggctaagtacttgc

SEQ ID NO: 7765623 - DNA, 22 bp, Homo sapiens
ttcagaggtagagaggatcttg

SEQ ID NO: 7765624 - DNA, 22 bp, Homo sapiens
ttcagagtacacagagatcttc

SEQ ID NO: 7765625 - DNA, 22 bp, Homo sapiens
ttcagagtggtatgaagtgatg

SEQ ID NO: 7765626 - DNA, 22 bp, Homo sapiens
ttcagagtaggatactagctta

SEQ ID NO: 7765627 - DNA, 20 bp, Homo sapiens
ttcagagtcagcaaatgcag

SEQ ID NO: 7765628 - DNA, 22 bp, Homo sapiens
ttcagataaactacaaataatt

SEQ ID NO: 7765629 - DNA, 22 bp, Homo sapiens
ttcatgaatgttccatgtgagt

SEQ ID NO: 7765630 - DNA, 22 bp, Homo sapiens
ctaaaattacctaccagtttag

SEQ ID NO: 7765631 - DNA, 22 bp, Homo sapiens
ttcatgaatatattgaattagc

SEQ ID NO: 7765632 - DNA, 22 bp, Homo sapiens
ctaaagaagctagcaatctata

SEQ ID NO: 7765633 - DNA, 22 bp, Homo sapiens
ctaaagaattttgcttgaccag

SEQ ID NO: 7765634 - DNA, 22 bp, Homo sapiens
ctaaataatccctctggtctta

SEQ ID NO: 7765635 - DNA, 22 bp, Homo sapiens
ctaaataatccctctggtctta

SEQ ID NO: 7765636 - DNA, 22 bp, Homo sapiens
ctaaataatccctctggtctta

SEQ ID NO: 7765637 - DNA, 22 bp, Homo sapiens
ttcatctggaagttcccaaggc

SEQ ID NO: 7765638 - DNA, 22 bp, Homo sapiens
cggtctcccgtgtgtgtgcgct

SEQ ID NO: 7765639 - DNA, 22 bp, Homo sapiens
cggtcctggcacttgcggctcc

SEQ ID NO: 7765640 - DNA, 22 bp, Homo sapiens
ctaaatcaggccttacagcttc

SEQ ID NO: 7765641 - DNA, 22 bp, Homo sapiens
ttccaggaattcagctctcagt

SEQ ID NO: 7765642 - DNA, 22 bp, Homo sapiens
ttccaggaccaggaagagggga

SEQ ID NO: 7765643 - DNA, 22 bp, Homo sapiens
ttccaggactcgttctggctca

SEQ ID NO: 7765644 - DNA, 22 bp, Homo sapiens
ttccaggacttcatggctctga

SEQ ID NO: 7765645 - DNA, 22 bp, Homo sapiens
ctacaacatagtcttctacaga

SEQ ID NO: 7765646 - DNA, 22 bp, Homo sapiens
ctacaacaccaggcacggagtg

SEQ ID NO: 7765647 - DNA, 22 bp, Homo sapiens
ctacagagaactcagctgccct

SEQ ID NO: 7765648 - DNA, 22 bp, Homo sapiens
ttccaggatgctgctgcttttt

SEQ ID NO: 7765649 - DNA, 22 bp, Homo sapiens
ttccaggatagctttcaggaat

SEQ ID NO: 7765650 - DNA, 22 bp, Homo sapiens
ttccaggaggaggtactagagg

SEQ ID NO: 7765651 - DNA, 22 bp, Homo sapiens
ctacagcagagaccagccacat

SEQ ID NO: 7765652 - DNA, 22 bp, Homo sapiens
ttcctgggcaggacgagagtct

SEQ ID NO: 7765653 - DNA, 22 bp, Homo sapiens
ctacctgaaaaggttgtggtga

SEQ ID NO: 7765654 - DNA, 21 bp, Homo sapiens
ctaccctctcctgctcatatc

SEQ ID NO: 7765655 - DNA, 21 bp, Homo sapiens
ctaccctcactcccattcctc

SEQ ID NO: 7765656 - DNA, 22 bp, Homo sapiens
ctacatttcatccagggagagc

SEQ ID NO: 7765657 - DNA, 21 bp, Homo sapiens
ttcctggggaaggagctgcct

SEQ ID NO: 7765658 - DNA, 22 bp, Homo sapiens
ctacatttacacagttaggctt

SEQ ID NO: 7765659 - DNA, 22 bp, Homo sapiens
ctactgccattgtctctgccat

SEQ ID NO: 7765660 - DNA, 22 bp, Homo sapiens
ctactgtaatagatgaatttga

SEQ ID NO: 7765661 - DNA, 22 bp, Homo sapiens
ctactgatgctatacttctcag

SEQ ID NO: 7765662 - DNA, 22 bp, Homo sapiens
ctactgatgatgttggttgtgg

SEQ ID NO: 7765663 - DNA, 22 bp, Homo sapiens
ctactataaaatacacatctgt

SEQ ID NO: 7765664 - DNA, 21 bp, Homo sapiens
ctacttaagtaggggattagg

SEQ ID NO: 7765665 - DNA, 22 bp, Homo sapiens
ctacttctgtgatgaaactaca

SEQ ID NO: 7765666 - DNA, 19 bp, Homo sapiens
ctactttataatatgcctc

SEQ ID NO: 7765667 - DNA, 22 bp, Homo sapiens
ctagaaaaatactttattgtga

SEQ ID NO: 7765668 - DNA, 22 bp, Homo sapiens
ctagaaaaatactttattgtga

SEQ ID NO: 7765669 - DNA, 22 bp, Homo sapiens
ctatggctcaattctagtggtt

SEQ ID NO: 7765670 - DNA, 22 bp, Homo sapiens
ctatgtatgcgattagaatttt

SEQ ID NO: 7765671 - DNA, 18 bp, Homo sapiens
ctattacaatgcagtggt

SEQ ID NO: 7765672 - DNA, 22 bp, Homo sapiens
ctatgtttatctgtatttctgt

SEQ ID NO: 7765673 - DNA, 22 bp, Homo sapiens
ctattaaatactcttcaaattg

SEQ ID NO: 7765674 - DNA, 22 bp, Homo sapiens
ctagcagggattgggcactggg

SEQ ID NO: 7765675 - DNA, 22 bp, Homo sapiens
ctcacagggttctatcgaagag

SEQ ID NO: 7765676 - DNA, 22 bp, Homo sapiens
ctcaaggaaagtctggagaaga

SEQ ID NO: 7765677 - DNA, 22 bp, Homo sapiens
ctcaagatgtcagggcacctgc

SEQ ID NO: 7765678 - DNA, 22 bp, Homo sapiens
ctcaaaatggttaattttaata

SEQ ID NO: 7765679 - DNA, 22 bp, Homo sapiens
ctcaagtaattagcaacaaata

SEQ ID NO: 7765680 - DNA, 22 bp, Homo sapiens
ctcaagtcagaaataaaagcat

SEQ ID NO: 7765681 - DNA, 22 bp, Homo sapiens
ctcaagtctattgataagtgca

SEQ ID NO: 7765682 - DNA, 22 bp, Homo sapiens
ccttcctggctgtccgcctgat

SEQ ID NO: 7765683 - DNA, 22 bp, Homo sapiens
ccttccccagtgattctctcag

SEQ ID NO: 7765684 - DNA, 22 bp, Homo sapiens
ccttccccaggtgctcactgtc

SEQ ID NO: 7765685 - DNA, 22 bp, Homo sapiens
ccttcccaggctagaccaacat

SEQ ID NO: 7765686 - DNA, 22 bp, Homo sapiens
ccttcccacattccttacatgc

SEQ ID NO: 7765687 - DNA, 22 bp, Homo sapiens
cctgtgtctgaccatgcacatg

SEQ ID NO: 7765688 - DNA, 22 bp, Homo sapiens
cctgtgtcttccccactggtgt

SEQ ID NO: 7765689 - DNA, 22 bp, Homo sapiens
cctgtgtcttccccactggtgt

SEQ ID NO: 7765690 - DNA, 22 bp, Homo sapiens
ttagaaaaaggctgtggtctta

SEQ ID NO: 7765691 - DNA, 22 bp, Homo sapiens
ttagaagttcaggtctgtaatc

SEQ ID NO: 7765692 - DNA, 23 bp, Homo sapiens
ttagacaatcctcaaaaggtaat

SEQ ID NO: 7765693 - DNA, 22 bp, Homo sapiens
ttagaatttctgctcactttga

SEQ ID NO: 7765694 - DNA, 21 bp, Homo sapiens
ccttctccacagggtctccgg

SEQ ID NO: 7765695 - DNA, 21 bp, Homo sapiens
ttacttttgcaccaacctaat

SEQ ID NO: 7765696 - DNA, 22 bp, Homo sapiens
ttacttttgcaccaaactaata

SEQ ID NO: 7765697 - DNA, 21 bp, Homo sapiens
ttacttttgcaccaacctaat

SEQ ID NO: 7765698 - DNA, 22 bp, Homo sapiens
ttacttttgcaccaaactaata

SEQ ID NO: 7765699 - DNA, 22 bp, Homo sapiens
ttacttttgcaccaaactaata

SEQ ID NO: 7765700 - DNA, 22 bp, Homo sapiens
ttactaagttttatgcaactta

SEQ ID NO: 7765701 - DNA, 21 bp, Homo sapiens
ttactaaacaaaacatgcagg

SEQ ID NO: 7765702 - DNA, 22 bp, Homo sapiens
ttagaaaaaacgtcttctagtg

SEQ ID NO: 7765703 - DNA, 22 bp, Homo sapiens
ttagaaaaaggctgtggtctta

SEQ ID NO: 7765704 - DNA, 23 bp, Homo sapiens
ttacttttgcaccaacctaatat

SEQ ID NO: 7765705 - DNA, 21 bp, Homo sapiens
ttacttttgcagcaacctaat

SEQ ID NO: 7765706 - DNA, 21 bp, Homo sapiens
ttacttttgcagcaacctaat

SEQ ID NO: 7765707 - DNA, 22 bp, Homo sapiens
cctgtgggagcccaggcagata

SEQ ID NO: 7765708 - DNA, 22 bp, Homo sapiens
cctgtgggtcacatgggtgact

SEQ ID NO: 7765709 - DNA, 22 bp, Homo sapiens
cctgtgtcctaatccatcaggc

SEQ ID NO: 7765710 - DNA, 22 bp, Homo sapiens
ttaaagtccctgccttaattcc

SEQ ID NO: 7765711 - DNA, 22 bp, Homo sapiens
ttaaaggcgataaggcagtgtt

SEQ ID NO: 7765712 - DNA, 22 bp, Homo sapiens
cctgtggcttccacgacctaat

SEQ ID NO: 7765713 - DNA, 20 bp, Homo sapiens
cctgtgctgccctcggggcc

SEQ ID NO: 7765714 - DNA, 22 bp, Homo sapiens
cctgtgctggacagggctgggc

SEQ ID NO: 7765715 - DNA, 22 bp, Homo sapiens
cctgtgctgggtgtgagggaca

SEQ ID NO: 7765716 - DNA, 22 bp, Homo sapiens
cctgtgctggctttattctcag

SEQ ID NO: 7765717 - DNA, 22 bp, Homo sapiens
cctgtgctggacagggctgggc

SEQ ID NO: 7765718 - DNA, 21 bp, Homo sapiens
cctgtgctatcagcttgggtt

SEQ ID NO: 7765719 - DNA, 22 bp, Homo sapiens
tgtttactttccttctcacagg

SEQ ID NO: 7765720 - DNA, 22 bp, Homo sapiens
tgtttacttgaggtggaaacaa

SEQ ID NO: 7765721 - DNA, 22 bp, Homo sapiens
cctgtctctgcagggccctgcc

SEQ ID NO: 7765722 - DNA, 22 bp, Homo sapiens
tgtttataaattttcttgccat

SEQ ID NO: 7765723 - DNA, 22 bp, Homo sapiens
cctgtctgcatgagtgagcata

SEQ ID NO: 7765724 - DNA, 22 bp, Homo sapiens
cctgtctgaaggcagggggatg

SEQ ID NO: 7765725 - DNA, 22 bp, Homo sapiens
cctgtctggccaccagggcgat

SEQ ID NO: 7765726 - DNA, 22 bp, Homo sapiens
cctgtgccatcctgagcatccc

SEQ ID NO: 7765727 - DNA, 19 bp, Homo sapiens
cctgtctgtcttcagctag

SEQ ID NO: 7765728 - DNA, 22 bp, Homo sapiens
tgttaatatactaaaatccact

SEQ ID NO: 7765729 - DNA, 22 bp, Homo sapiens
tgttaatatactaaaatccact

SEQ ID NO: 7765730 - DNA, 22 bp, Homo sapiens
cctgggcttccacgagcagagg

SEQ ID NO: 7765731 - DNA, 22 bp, Homo sapiens
cctgggctggagtacagcagtg

SEQ ID NO: 7765732 - DNA, 22 bp, Homo sapiens
cctgggctctgaggagggagtc

SEQ ID NO: 7765733 - DNA, 22 bp, Homo sapiens
cctgggctctgaggagggagtc

SEQ ID NO: 7765734 - DNA, 22 bp, Homo sapiens
cctgggctctatcctgacccag

SEQ ID NO: 7765735 - DNA, 22 bp, Homo sapiens
tgtttacttatgtgggtcacat

SEQ ID NO: 7765736 - DNA, 22 bp, Homo sapiens
tgtttacttcatcgagtacttc

SEQ ID NO: 7765737 - DNA, 22 bp, Homo sapiens
tgtttacttaaatgttttcata

SEQ ID NO: 7765738 - DNA, 22 bp, Homo sapiens
cctggtggcttctgggtggacg

SEQ ID NO: 7765739 - DNA, 22 bp, Homo sapiens
cctggtggagaggggcggagcg

SEQ ID NO: 7765740 - DNA, 22 bp, Homo sapiens
cctgggtgtcatgggcagctgg

SEQ ID NO: 7765741 - DNA, 23 bp, Homo sapiens
tgttccagatacgccttttcctc

SEQ ID NO: 7765742 - DNA, 23 bp, Homo sapiens
tgttccagatacgccttttcctc

SEQ ID NO: 7765743 - DNA, 22 bp, Homo sapiens
tggggcttctcctgtaggctca

SEQ ID NO: 7765744 - DNA, 22 bp, Homo sapiens
tggggccacacatctctttcta

SEQ ID NO: 7765745 - DNA, 22 bp, Homo sapiens
tggggcatggatgataagctgg

SEQ ID NO: 7765746 - DNA, 23 bp, Homo sapiens
tggggccaagtgaggaagggtct

SEQ ID NO: 7765747 - DNA, 22 bp, Homo sapiens
cctgggagtggcactcacagca

SEQ ID NO: 7765748 - DNA, 22 bp, Homo sapiens
cctgggatttcctgagcactct

SEQ ID NO: 7765749 - DNA, 22 bp, Homo sapiens
cctgggagtgtcagacttgctt

SEQ ID NO: 7765750 - DNA, 19 bp, Homo sapiens
cctgggagtcagctgaagg

SEQ ID NO: 7765751 - DNA, 22 bp, Homo sapiens
cctgggaggctgaggctgcagt

SEQ ID NO: 7765752 - DNA, 21 bp, Homo sapiens
tgggggagaattggttgcttt

SEQ ID NO: 7765753 - DNA, 22 bp, Homo sapiens
cctgggaggctgaggctgcagt

SEQ ID NO: 7765754 - DNA, 21 bp, Homo sapiens
tgggggagaattggttgcttt

SEQ ID NO: 7765755 - DNA, 22 bp, Homo sapiens
tgtgtctgcactgagtcctcac

SEQ ID NO: 7765756 - DNA, 22 bp, Homo sapiens
tgtgtattaatgtttgtatatg

SEQ ID NO: 7765757 - DNA, 22 bp, Homo sapiens
tgtgtattaccattttacagct

SEQ ID NO: 7765758 - DNA, 22 bp, Homo sapiens
tgtgtattaatgtttgtatatg

SEQ ID NO: 7765759 - DNA, 22 bp, Homo sapiens
ccacagaaaataaagcacgatt

SEQ ID NO: 7765760 - DNA, 22 bp, Homo sapiens
tcctggcaggtcagcaggagca

SEQ ID NO: 7765761 - DNA, 22 bp, Homo sapiens
tcctggcagggtggcagcgggt

SEQ ID NO: 7765762 - DNA, 22 bp, Homo sapiens
tcctggcaggtcagcaggagca

SEQ ID NO: 7765763 - DNA, 22 bp, Homo sapiens
tcctggcagggtggcagcgggt

SEQ ID NO: 7765764 - DNA, 22 bp, Homo sapiens
tcctggcagcccgcaggtgctg

SEQ ID NO: 7765765 - DNA, 22 bp, Homo sapiens
tcctggcagaaatggggctgtg

SEQ ID NO: 7765766 - DNA, 22 bp, Homo sapiens
tcctggcagagagcatgaggcc

SEQ ID NO: 7765767 - DNA, 22 bp, Homo sapiens
tcctggcactttgggggctcgc

SEQ ID NO: 7765768 - DNA, 22 bp, Homo sapiens
tcctggaggagatccaatctga

SEQ ID NO: 7765769 - DNA, 22 bp, Homo sapiens
ccaaggcttcccagagatgctc

SEQ ID NO: 7765770 - DNA, 22 bp, Homo sapiens
ccaaggctggagtgcagtggcg

SEQ ID NO: 7765771 - DNA, 22 bp, Homo sapiens
ccaaggagaatgacaccatgga

SEQ ID NO: 7765772 - DNA, 22 bp, Homo sapiens
ccaaggagcaaggctcaacaag

SEQ ID NO: 7765773 - DNA, 22 bp, Homo sapiens
ccaaggcagaagatggctcttg

SEQ ID NO: 7765774 - DNA, 22 bp, Homo sapiens
ccaaggcaatgtgcagctggtg

SEQ ID NO: 7765775 - DNA, 22 bp, Homo sapiens
ccaaggaggccccaggtcagct

SEQ ID NO: 7765776 - DNA, 22 bp, Homo sapiens
tccttaaagtgcacctcctcat

SEQ ID NO: 7765777 - DNA, 19 bp, Homo sapiens
tccttaaaaaagcagttct

SEQ ID NO: 7765778 - DNA, 19 bp, Homo sapiens
tcctggggaggggcatggc

SEQ ID NO: 7765779 - DNA, 22 bp, Homo sapiens
tcctgggcttgctcctccagct

SEQ ID NO: 7765780 - DNA, 22 bp, Homo sapiens
tcctgggcttcacagactctgt

SEQ ID NO: 7765781 - DNA, 22 bp, Homo sapiens
tcctgggcttagtggctaggtc

SEQ ID NO: 7765782 - DNA, 22 bp, Homo sapiens
ccagagaaggtggagcttgtgt

SEQ ID NO: 7765783 - DNA, 22 bp, Homo sapiens
tctaaggccttcatgtcagtat

SEQ ID NO: 7765784 - DNA, 22 bp, Homo sapiens
ccactgtataagcaaaatgaaa

SEQ ID NO: 7765785 - DNA, 22 bp, Homo sapiens
ccactgtaagtttgaaaataac

SEQ ID NO: 7765786 - DNA, 22 bp, Homo sapiens
ccactgggggctgctcccaggt

SEQ ID NO: 7765787 - DNA, 22 bp, Homo sapiens
catttacaatgtacaggttgtg

SEQ ID NO: 7765788 - DNA, 22 bp, Homo sapiens
catttacacacagaggtgtgct

SEQ ID NO: 7765789 - DNA, 22 bp, Homo sapiens
catttacaatgtacaggttgtg

SEQ ID NO: 7765790 - DNA, 22 bp, Homo sapiens
tccctcctggccgtcaccgctg

SEQ ID NO: 7765791 - DNA, 22 bp, Homo sapiens
tccctcctggccgtcaccgctg

SEQ ID NO: 7765792 - DNA, 22 bp, Homo sapiens
catttacacttctaaccacaag

SEQ ID NO: 7765793 - DNA, 22 bp, Homo sapiens
cattgtcacccaaagctcatag

SEQ ID NO: 7765794 - DNA, 22 bp, Homo sapiens
catttattctcagatccttgtc

SEQ ID NO: 7765795 - DNA, 22 bp, Homo sapiens
catttattgagtggccacagtg

SEQ ID NO: 7765796 - DNA, 22 bp, Homo sapiens
catttattcatgatctgtagct

SEQ ID NO: 7765797 - DNA, 22 bp, Homo sapiens
catttattcatgatctgtagct

SEQ ID NO: 7765798 - DNA, 22 bp, Homo sapiens
catttattcatttgctagggct

SEQ ID NO: 7765799 - DNA, 22 bp, Homo sapiens
catttattcagctcagtcggtt

SEQ ID NO: 7765800 - DNA, 22 bp, Homo sapiens
tccctctccctattgcctggag

SEQ ID NO: 7765801 - DNA, 22 bp, Homo sapiens
tccctctctagcctgttcagta

SEQ ID NO: 7765802 - DNA, 22 bp, Homo sapiens
tccctggggtatcgctgaggca

SEQ ID NO: 7765803 - DNA, 22 bp, Homo sapiens
tccctggggttcctccagccac

SEQ ID NO: 7765804 - DNA, 22 bp, Homo sapiens
tccctgctttcttgtgagggga

SEQ ID NO: 7765805 - DNA, 22 bp, Homo sapiens
tcccacattaccctgactgaca

SEQ ID NO: 7765806 - DNA, 22 bp, Homo sapiens
cattcttgaaccaggcactgtg

SEQ ID NO: 7765807 - DNA, 22 bp, Homo sapiens
cattcttatatttactcattca

SEQ ID NO: 7765808 - DNA, 22 bp, Homo sapiens
cattcttacacaatattttaat

SEQ ID NO: 7765809 - DNA, 22 bp, Homo sapiens
cattcatttgcccagtaagtca

SEQ ID NO: 7765810 - DNA, 22 bp, Homo sapiens
cattctcaatagtagatgagta

SEQ ID NO: 7765811 - DNA, 22 bp, Homo sapiens
cattagcattacttcaaagagt

SEQ ID NO: 7765812 - DNA, 22 bp, Homo sapiens
cattagctatctgtttacatta

SEQ ID NO: 7765813 - DNA, 22 bp, Homo sapiens
cattacttctcatgcttcatgc

SEQ ID NO: 7765814 - DNA, 21 bp, Homo sapiens
cattacatggttttagtgaac

SEQ ID NO: 7765815 - DNA, 22 bp, Homo sapiens
tccatcaccacagaggacagag

SEQ ID NO: 7765816 - DNA, 22 bp, Homo sapiens
tccaggagcatccaggtgaagc

SEQ ID NO: 7765817 - DNA, 23 bp, Homo sapiens
catgggagtgagaatgccagctc

SEQ ID NO: 7765818 - DNA, 22 bp, Homo sapiens
tccaggagaggcctgaccaggt

SEQ ID NO: 7765819 - DNA, 22 bp, Homo sapiens
tccaggagatacactgcaccag

SEQ ID NO: 7765820 - DNA, 22 bp, Homo sapiens
tccaggagatacactgcaccag

SEQ ID NO: 7765821 - DNA, 22 bp, Homo sapiens
tccaggagattcattaggtcat

SEQ ID NO: 7765822 - DNA, 17 bp, Homo sapiens
tccaggagaggcaatgg

SEQ ID NO: 7765823 - DNA, 22 bp, Homo sapiens
cagttttctatggtagaagcat

SEQ ID NO: 7765824 - DNA, 22 bp, Homo sapiens
cagtttgtgctaggcactattt

SEQ ID NO: 7765825 - DNA, 22 bp, Homo sapiens
cagtttgtcttgattcagaaca

SEQ ID NO: 7765826 - DNA, 22 bp, Homo sapiens
tcagatgagtgctttcagctgc

SEQ ID NO: 7765827 - DNA, 22 bp, Homo sapiens
tcagatattctctaagaacaat

SEQ ID NO: 7765828 - DNA, 22 bp, Homo sapiens
cagtttttgccattaagagtaa

SEQ ID NO: 7765829 - DNA, 17 bp, Homo sapiens
cataaaacagttctatt

SEQ ID NO: 7765830 - DNA, 17 bp, Homo sapiens
cataaaacagttctatt

SEQ ID NO: 7765831 - DNA, 22 bp, Homo sapiens
cataaaagccacctatttaaag

SEQ ID NO: 7765832 - DNA, 22 bp, Homo sapiens
tcagataaaggagagcttagca

SEQ ID NO: 7765833 - DNA, 22 bp, Homo sapiens
tcagataagtgaagcaaagttt

SEQ ID NO: 7765834 - DNA, 22 bp, Homo sapiens
tcagataattaatcatgaaatt

SEQ ID NO: 7765835 - DNA, 23 bp, Homo sapiens
tcagaggatcatcaaacgttttc

SEQ ID NO: 7765836 - DNA, 22 bp, Homo sapiens
tcagaggagcaaaagaggggat

SEQ ID NO: 7765837 - DNA, 22 bp, Homo sapiens
tcagaggagcaaaagaggggat

SEQ ID NO: 7765838 - DNA, 22 bp, Homo sapiens
cagttataagactaagctattc

SEQ ID NO: 7765839 - DNA, 22 bp, Homo sapiens
tcaatgaaagagcatgcatttt

SEQ ID NO: 7765840 - DNA, 22 bp, Homo sapiens
cagttgagtctgctagctagga

SEQ ID NO: 7765841 - DNA, 22 bp, Homo sapiens
tcaatatagcagtgtacttgag

SEQ ID NO: 7765842 - DNA, 22 bp, Homo sapiens
tcaatctagagattaaaatagg

SEQ ID NO: 7765843 - DNA, 22 bp, Homo sapiens
cagttgtccccaaaatatacgg

SEQ ID NO: 7765844 - DNA, 22 bp, Homo sapiens
cagttgccttatttccttgctg

SEQ ID NO: 7765845 - DNA, 22 bp, Homo sapiens
cagttgcctgtttccttgtgtg

SEQ ID NO: 7765846 - DNA, 22 bp, Homo sapiens
cagttgcctactacatggcagg

SEQ ID NO: 7765847 - DNA, 22 bp, Homo sapiens
tcaggcagagtggaagctgcaa

SEQ ID NO: 7765848 - DNA, 18 bp, Homo sapiens
cataattttctttcttta

SEQ ID NO: 7765849 - DNA, 22 bp, Homo sapiens
tcagcaggtgaacatcatgcca

SEQ ID NO: 7765850 - DNA, 22 bp, Homo sapiens
tcagcaggtgcctcagattctt

SEQ ID NO: 7765851 - DNA, 22 bp, Homo sapiens
tcagcaggtctgaggcggggcc

SEQ ID NO: 7765852 - DNA, 22 bp, Homo sapiens
tcagcagggtttgacttctaat

SEQ ID NO: 7765853 - DNA, 22 bp, Homo sapiens
tcagcaggtgctttgtttactc

SEQ ID NO: 7765854 - DNA, 22 bp, Homo sapiens
tcagcaggtggtgggcaggtga

SEQ ID NO: 7765855 - DNA, 22 bp, Homo sapiens
cataatatctccgattacttgc

SEQ ID NO: 7765856 - DNA, 22 bp, Homo sapiens
tcagcagtcctccaggatcaag

SEQ ID NO: 7765857 - DNA, 22 bp, Homo sapiens
cataatcagatgtgtacataag

SEQ ID NO: 7765858 - DNA, 22 bp, Homo sapiens
cataatcagatgtgtacataag

SEQ ID NO: 7765859 - DNA, 22 bp, Homo sapiens
tcaggcctagggagaaaattca

SEQ ID NO: 7765860 - DNA, 22 bp, Homo sapiens
catagaaatcaggtgagaatct

SEQ ID NO: 7765861 - DNA, 22 bp, Homo sapiens
catagaaactgagacaaggatt

SEQ ID NO: 7765862 - DNA, 22 bp, Homo sapiens
catagaaactgagacaaggatt

SEQ ID NO: 7765863 - DNA, 22 bp, Homo sapiens
catagaaaagagtaggtaatgt

SEQ ID NO: 7765864 - DNA, 22 bp, Homo sapiens
tcaggcctgagaaaaatccttt

SEQ ID NO: 7765865 - DNA, 22 bp, Homo sapiens
catagaaaagagtaggtaatgt

SEQ ID NO: 7765866 - DNA, 22 bp, Homo sapiens
catagaaactgagacaaggatt

SEQ ID NO: 7765867 - DNA, 21 bp, Homo sapiens
tcaggctgtctgctggttcca

SEQ ID NO: 7765868 - DNA, 17 bp, Homo sapiens
tcaggctgtgcctggta

SEQ ID NO: 7765869 - DNA, 17 bp, Homo sapiens
tcaggctgtgcctggta

SEQ ID NO: 7765870 - DNA, 22 bp, Homo sapiens
tcagggagaggtgagagcctgt

SEQ ID NO: 7765871 - DNA, 22 bp, Homo sapiens
tcagggagagtgacccatccac

SEQ ID NO: 7765872 - DNA, 22 bp, Homo sapiens
tcaggctgttagccacctcctc

SEQ ID NO: 7765873 - DNA, 22 bp, Homo sapiens
tcaggctgtgtctttaaacaat

SEQ ID NO: 7765874 - DNA, 22 bp, Homo sapiens
tcaggctgtgggcactggccat

SEQ ID NO: 7765875 - DNA, 22 bp, Homo sapiens
tcaggctgtgggcactggccat

SEQ ID NO: 7765876 - DNA, 22 bp, Homo sapiens
tcaggctgtggctttgaccgca

SEQ ID NO: 7765877 - DNA, 22 bp, Homo sapiens
tcaggctgtggcttcagttctt

SEQ ID NO: 7765878 - DNA, 19 bp, Homo sapiens
catctggatgattctcctg

SEQ ID NO: 7765879 - DNA, 17 bp, Homo sapiens
catctgctctgcccctt

SEQ ID NO: 7765880 - DNA, 22 bp, Homo sapiens
catgaaaataacattgttgtga

SEQ ID NO: 7765881 - DNA, 22 bp, Homo sapiens
catgaaattgtattggcctcaa

SEQ ID NO: 7765882 - DNA, 22 bp, Homo sapiens
catctgtcttttgttacaaggc

SEQ ID NO: 7765883 - DNA, 22 bp, Homo sapiens
catcttaaattaaagcttaagg

SEQ ID NO: 7765884 - DNA, 22 bp, Homo sapiens
catcttaaaatgtgtcataact

SEQ ID NO: 7765885 - DNA, 22 bp, Homo sapiens
tcagtgctcctaaagtgaatgc

SEQ ID NO: 7765886 - DNA, 22 bp, Homo sapiens
catctcagtgtacagggagtct

SEQ ID NO: 7765887 - DNA, 22 bp, Homo sapiens
tcagtcattgtccttaaaacac

SEQ ID NO: 7765888 - DNA, 22 bp, Homo sapiens
tcagtcacttttgcctgctaca

SEQ ID NO: 7765889 - DNA, 22 bp, Homo sapiens
tcagggattgcaaaattcatcc

SEQ ID NO: 7765890 - DNA, 22 bp, Homo sapiens
tcagtatttctaaacattggct

SEQ ID NO: 7765891 - DNA, 19 bp, Homo sapiens
tcagggagtttacagcatg

SEQ ID NO: 7765892 - DNA, 22 bp, Homo sapiens
tcagggagtgttggcaggatca

SEQ ID NO: 7765893 - DNA, 22 bp, Homo sapiens
tcagggaggtgtctgccagaga

SEQ ID NO: 7765894 - DNA, 22 bp, Homo sapiens
tcagggagtagtttgtgctatg

SEQ ID NO: 7765895 - DNA, 22 bp, Homo sapiens
tcagggagatttggggactcaa

SEQ ID NO: 7765896 - DNA, 22 bp, Homo sapiens
tcagggagggacctgaggctgg

SEQ ID NO: 7765897 - DNA, 22 bp, Homo sapiens
catgacatctgcttagtatgaa

SEQ ID NO: 7765898 - DNA, 22 bp, Homo sapiens
catgacattttaaaaagaacat

SEQ ID NO: 7765899 - DNA, 22 bp, Homo sapiens
catgacagatgcaaaggattgg

SEQ ID NO: 7765900 - DNA, 22 bp, Homo sapiens
catgaatgctgggttcatgtaa

SEQ ID NO: 7765901 - DNA, 22 bp, Homo sapiens
catgaagtcaggatttccatga

SEQ ID NO: 7765902 - DNA, 22 bp, Homo sapiens
catgacaataagccagcagaaa

SEQ ID NO: 7765903 - DNA, 22 bp, Homo sapiens
catgcagtgtgtatctacttaa

SEQ ID NO: 7765904 - DNA, 22 bp, Homo sapiens
catgcatagccagcattgtatg

SEQ ID NO: 7765905 - DNA, 22 bp, Homo sapiens
catgcatagaatgaagaggctg

SEQ ID NO: 7765906 - DNA, 22 bp, Homo sapiens
catgcagtttctctatgcgtag

SEQ ID NO: 7765907 - DNA, 22 bp, Homo sapiens
catgcatatgtcaaaaaagcta

SEQ ID NO: 7765908 - DNA, 22 bp, Homo sapiens
catgcaggtctggagcttgggg

SEQ ID NO: 7765909 - DNA, 22 bp, Homo sapiens
catgcagtgatgcactgcatca

SEQ ID NO: 7765910 - DNA, 22 bp, Homo sapiens
catgcaggttatatgtgcttct

SEQ ID NO: 7765911 - DNA, 22 bp, Homo sapiens
catggcaggaggctgctggcag

SEQ ID NO: 7765912 - DNA, 22 bp, Homo sapiens
catggcaggcttcttcagcctt

SEQ ID NO: 7765913 - DNA, 22 bp, Homo sapiens
catggcagggctgtgggcaggt

SEQ ID NO: 7765914 - DNA, 22 bp, Homo sapiens
catggcagtgattcagcctttg

SEQ ID NO: 7765915 - DNA, 22 bp, Homo sapiens
catggccacatctagctgcaag

SEQ ID NO: 7765916 - DNA, 22 bp, Homo sapiens
catggccaaggatgctcaacca

SEQ ID NO: 7765917 - DNA, 22 bp, Homo sapiens
tccagctggggacatgggcttc

SEQ ID NO: 7765918 - DNA, 22 bp, Homo sapiens
tccaggagaaggccatccagcg

SEQ ID NO: 7765919 - DNA, 22 bp, Homo sapiens
catgcatgccgggctgacagag

SEQ ID NO: 7765920 - DNA, 22 bp, Homo sapiens
catggcagctttgggaggagga

SEQ ID NO: 7765921 - DNA, 22 bp, Homo sapiens
catggcagctttgggaggagga

SEQ ID NO: 7765922 - DNA, 22 bp, Homo sapiens
catggcaggaaggacatgcact

SEQ ID NO: 7765923 - DNA, 22 bp, Homo sapiens
catggcagagcctgcaggtggg

SEQ ID NO: 7765924 - DNA, 17 bp, Homo sapiens
cagtcacaggtcttttc

SEQ ID NO: 7765925 - DNA, 22 bp, Homo sapiens
cagtcacaagcgtacctaattt

SEQ ID NO: 7765926 - DNA, 22 bp, Homo sapiens
cagtcacacaagtggacttggg

SEQ ID NO: 7765927 - DNA, 22 bp, Homo sapiens
cagtcacattgccctgcattta

SEQ ID NO: 7765928 - DNA, 22 bp, Homo sapiens
caggtgggtgtatgaatgcaaa

SEQ ID NO: 7765929 - DNA, 22 bp, Homo sapiens
tattttacagactactttagat

SEQ ID NO: 7765930 - DNA, 22 bp, Homo sapiens
tattttacaaatgggaatgctg

SEQ ID NO: 7765931 - DNA, 22 bp, Homo sapiens
cagtcagaaggaagatgcttaa

SEQ ID NO: 7765932 - DNA, 22 bp, Homo sapiens
cagtcagagtcacagtaatttg

SEQ ID NO: 7765933 - DNA, 22 bp, Homo sapiens
cagtcagaggtcttctaaaaca

SEQ ID NO: 7765934 - DNA, 22 bp, Homo sapiens
cagtcagggacaccagctagga

SEQ ID NO: 7765935 - DNA, 22 bp, Homo sapiens
cagtcattttatttgaaaatta

SEQ ID NO: 7765936 - DNA, 22 bp, Homo sapiens
cagtcattcctaaccaagaaca

SEQ ID NO: 7765937 - DNA, 22 bp, Homo sapiens
cagtcagtcaatactctttgag

SEQ ID NO: 7765938 - DNA, 22 bp, Homo sapiens
tattttatctgccagagtggag

SEQ ID NO: 7765939 - DNA, 22 bp, Homo sapiens
tattttatctgccagagtggag

SEQ ID NO: 7765940 - DNA, 22 bp, Homo sapiens
tattttcaccatgtatccctgt

SEQ ID NO: 7765941 - DNA, 22 bp, Homo sapiens
tcaaaaatgttttatattggta

SEQ ID NO: 7765942 - DNA, 22 bp, Homo sapiens
tcaaaacaatcattggatgtgc

SEQ ID NO: 7765943 - DNA, 22 bp, Homo sapiens
tcaaaacactattacctttaat

SEQ ID NO: 7765944 - DNA, 19 bp, Homo sapiens
tcaaaacacaaatggttga

SEQ ID NO: 7765945 - DNA, 22 bp, Homo sapiens
tcaatagataaagctacataaa

SEQ ID NO: 7765946 - DNA, 23 bp, Homo sapiens
tcaagcaataattggtaatagtg

SEQ ID NO: 7765947 - DNA, 22 bp, Homo sapiens
tcaagcagagtcaaaagtacca

SEQ ID NO: 7765948 - DNA, 22 bp, Homo sapiens
tcaagcagagtcaaaagtacca

SEQ ID NO: 7765949 - DNA, 22 bp, Homo sapiens
tcaagcagggtagcaagctggt

SEQ ID NO: 7765950 - DNA, 22 bp, Homo sapiens
tcaagatgtccagtgcctataa

SEQ ID NO: 7765951 - DNA, 19 bp, Homo sapiens
tcaagatggatggctccca

SEQ ID NO: 7765952 - DNA, 22 bp, Homo sapiens
tcaagatgcatgggtggcataa

SEQ ID NO: 7765953 - DNA, 20 bp, Homo sapiens
tcaagatgaggtcatactgg

SEQ ID NO: 7765954 - DNA, 22 bp, Homo sapiens
tcaagatgaaccaggacattca

SEQ ID NO: 7765955 - DNA, 22 bp, Homo sapiens
tcaacaaatacttaaagcagag

SEQ ID NO: 7765956 - DNA, 22 bp, Homo sapiens
caggtgcctcaggatgagacaa

SEQ ID NO: 7765957 - DNA, 22 bp, Homo sapiens
caggtgctgcgtggcggagctg

SEQ ID NO: 7765958 - DNA, 22 bp, Homo sapiens
caggtaaaaataaatttgtgag

SEQ ID NO: 7765959 - DNA, 22 bp, Homo sapiens
cagggtttcaccatgttagcag

SEQ ID NO: 7765960 - DNA, 22 bp, Homo sapiens
caggtcagaggcgcagccccca

SEQ ID NO: 7765961 - DNA, 22 bp, Homo sapiens
caggtcagaggtagatgagatg

SEQ ID NO: 7765962 - DNA, 22 bp, Homo sapiens
caggtatgaggacactgacagc

SEQ ID NO: 7765963 - DNA, 22 bp, Homo sapiens
tattaaatgttatttgggttgt

SEQ ID NO: 7765964 - DNA, 22 bp, Homo sapiens
tattattaaatggcagaatttt

SEQ ID NO: 7765965 - DNA, 22 bp, Homo sapiens
tattattaaatggcagaatttt

SEQ ID NO: 7765966 - DNA, 22 bp, Homo sapiens
caggtgggtacatcacagagac

SEQ ID NO: 7765967 - DNA, 22 bp, Homo sapiens
tattataatttagggcttggat

SEQ ID NO: 7765968 - DNA, 22 bp, Homo sapiens
tattatgcaaatattcctacct

SEQ ID NO: 7765969 - DNA, 22 bp, Homo sapiens
tagatttgatgtaagcatagtc

SEQ ID NO: 7765970 - DNA, 22 bp, Homo sapiens
cagggagatcttggctcctggt

SEQ ID NO: 7765971 - DNA, 22 bp, Homo sapiens
tagatttgtttccttctctcca

SEQ ID NO: 7765972 - DNA, 22 bp, Homo sapiens
tagatttgcctgggaaagctca

SEQ ID NO: 7765973 - DNA, 22 bp, Homo sapiens
tagatttgtgcaagaagggatt

SEQ ID NO: 7765974 - DNA, 22 bp, Homo sapiens
tagatttcaggagacaaaatgg

SEQ ID NO: 7765975 - DNA, 22 bp, Homo sapiens
tagatttcgctgcatctcaatc

SEQ ID NO: 7765976 - DNA, 22 bp, Homo sapiens
cagggagcagcccctagaagta

SEQ ID NO: 7765977 - DNA, 22 bp, Homo sapiens
cagggagcactgcgagcggcag

SEQ ID NO: 7765978 - DNA, 22 bp, Homo sapiens
cagggagcactgcgagcggcag

SEQ ID NO: 7765979 - DNA, 22 bp, Homo sapiens
cagggagcaggctctgtccatc

SEQ ID NO: 7765980 - DNA, 22 bp, Homo sapiens
cagggagccccaattccatgcc

SEQ ID NO: 7765981 - DNA, 22 bp, Homo sapiens
tagcttaaggagtaccagatca

SEQ ID NO: 7765982 - DNA, 22 bp, Homo sapiens
tagcttaatatgaaacacataa

SEQ ID NO: 7765983 - DNA, 22 bp, Homo sapiens
tagcttaaggcaggcccttgtc

SEQ ID NO: 7765984 - DNA, 22 bp, Homo sapiens
cagggccattggaacaaagagg

SEQ ID NO: 7765985 - DNA, 22 bp, Homo sapiens
cagggccattggaacaaagagg

SEQ ID NO: 7765986 - DNA, 22 bp, Homo sapiens
tagcttctaatacttaccaatt

SEQ ID NO: 7765987 - DNA, 22 bp, Homo sapiens
tagcttctcataatttatgctg

SEQ ID NO: 7765988 - DNA, 22 bp, Homo sapiens
tagcttcagggaaaccactgct

SEQ ID NO: 7765989 - DNA, 22 bp, Homo sapiens
tagcttctgggagtgtttacta

SEQ ID NO: 7765990 - DNA, 22 bp, Homo sapiens
tagcttctcttttcaacatctt

SEQ ID NO: 7765991 - DNA, 22 bp, Homo sapiens
tagcttgtactgcagtagagaa

SEQ ID NO: 7765992 - DNA, 22 bp, Homo sapiens
tagcttgtcagtgaatagctgt

SEQ ID NO: 7765993 - DNA, 22 bp, Homo sapiens
tagcttgttacacagcaatgtt

SEQ ID NO: 7765994 - DNA, 22 bp, Homo sapiens
tagctttaaaaatcatcaaagc

SEQ ID NO: 7765995 - DNA, 22 bp, Homo sapiens
taggcagtgctctgtgcttcag

SEQ ID NO: 7765996 - DNA, 22 bp, Homo sapiens
taggcatgcaaataaatgtgca

SEQ ID NO: 7765997 - DNA, 22 bp, Homo sapiens
cagggctccatgcagggactcc

SEQ ID NO: 7765998 - DNA, 22 bp, Homo sapiens
taggccagaggagcagctttgg

SEQ ID NO: 7765999 - DNA, 22 bp, Homo sapiens
cagggggctgtggctgtccagt

SEQ ID NO: 7766000 - DNA, 22 bp, Homo sapiens
cagggggcagcgtagaaaatga

SEQ ID NO: 7766001 - DNA, 22 bp, Homo sapiens
cagggggctcaaaggagagtgc

SEQ ID NO: 7766002 - DNA, 22 bp, Homo sapiens
caggggtggctgcagcagaggt

SEQ ID NO: 7766003 - DNA, 22 bp, Homo sapiens
caggggtgtttttggccaggag

SEQ ID NO: 7766004 - DNA, 22 bp, Homo sapiens
cagggtagggcaagggaacctg

SEQ ID NO: 7766005 - DNA, 22 bp, Homo sapiens
cagggtcatggcacctgcacgg

SEQ ID NO: 7766006 - DNA, 22 bp, Homo sapiens
cagggtccccgggtctcctgtg

SEQ ID NO: 7766007 - DNA, 22 bp, Homo sapiens
cagggtccggctgcctggctgt

SEQ ID NO: 7766008 - DNA, 22 bp, Homo sapiens
cagggtggggaaatagcgccct

SEQ ID NO: 7766009 - DNA, 22 bp, Homo sapiens
cagggctgtaaattagtgctga

SEQ ID NO: 7766010 - DNA, 22 bp, Homo sapiens
taggcttgcaattaggatggaa

SEQ ID NO: 7766011 - DNA, 22 bp, Homo sapiens
taggcttgttacaaaacagtca

SEQ ID NO: 7766012 - DNA, 22 bp, Homo sapiens
cagggctggatttcatttctag

SEQ ID NO: 7766013 - DNA, 22 bp, Homo sapiens
cagggctggatttcatttctag

SEQ ID NO: 7766014 - DNA, 22 bp, Homo sapiens
taggctgggcctgccttccagg

SEQ ID NO: 7766015 - DNA, 22 bp, Homo sapiens
taggctgggcctgccttccagg

SEQ ID NO: 7766016 - DNA, 18 bp, Homo sapiens
taggctgggggctgtagt

SEQ ID NO: 7766017 - DNA, 18 bp, Homo sapiens
taggctgggggctgtagt

SEQ ID NO: 7766018 - DNA, 22 bp, Homo sapiens
taggctgggggtaggaattgag

SEQ ID NO: 7766019 - DNA, 22 bp, Homo sapiens
taggctgggggtaggaattgag

SEQ ID NO: 7766020 - DNA, 22 bp, Homo sapiens
taggctgggctgagctggacgg

SEQ ID NO: 7766021 - DNA, 22 bp, Homo sapiens
taggctgggctgagctggacgg

SEQ ID NO: 7766022 - DNA, 22 bp, Homo sapiens
cagggctcttccggagcaggga

SEQ ID NO: 7766023 - DNA, 22 bp, Homo sapiens
cagggacaatggcagagcctga

SEQ ID NO: 7766024 - DNA, 22 bp, Homo sapiens
cagggacaaagtgagaaaggaa

SEQ ID NO: 7766025 - DNA, 22 bp, Homo sapiens
cagggacagagactgcaccttg

SEQ ID NO: 7766026 - DNA, 22 bp, Homo sapiens
caggcttgggagcagagccact

SEQ ID NO: 7766027 - DNA, 22 bp, Homo sapiens
caggctgtctgaatggaggccc

SEQ ID NO: 7766028 - DNA, 22 bp, Homo sapiens
caggcttggcagggaggctggt

SEQ ID NO: 7766029 - DNA, 22 bp, Homo sapiens
caggctgccaaggctggggagg

SEQ ID NO: 7766030 - DNA, 22 bp, Homo sapiens
caggctgccaaggctggggagg

SEQ ID NO: 7766031 - DNA, 22 bp, Homo sapiens
caggctggagtgcagtggtgcc

SEQ ID NO: 7766032 - DNA, 22 bp, Homo sapiens
caggctggagtgcagtggtgcc

SEQ ID NO: 7766033 - DNA, 22 bp, Homo sapiens
caggctggagttcagtggtgtg

SEQ ID NO: 7766034 - DNA, 22 bp, Homo sapiens
caggctggagttcagtggtgtg

SEQ ID NO: 7766035 - DNA, 22 bp, Homo sapiens
tagaaaatgttccactgccatt

SEQ ID NO: 7766036 - DNA, 22 bp, Homo sapiens
tagaaacaaagacctgggtgct

SEQ ID NO: 7766037 - DNA, 22 bp, Homo sapiens
tagaaaatggccaagcaggact

SEQ ID NO: 7766038 - DNA, 22 bp, Homo sapiens
tagaaaatggccaagcaggact

SEQ ID NO: 7766039 - DNA, 22 bp, Homo sapiens
caggctgggactgacccctgct

SEQ ID NO: 7766040 - DNA, 22 bp, Homo sapiens
caggctgggactgacccctgct

SEQ ID NO: 7766041 - DNA, 22 bp, Homo sapiens
caggctgggaacgccacccgct

SEQ ID NO: 7766042 - DNA, 22 bp, Homo sapiens
caggctgggaacgccacccgct

SEQ ID NO: 7766043 - DNA, 22 bp, Homo sapiens
caggctgggaacgccacccgct

SEQ ID NO: 7766044 - DNA, 22 bp, Homo sapiens
caggctggcaatgcgtcaagca

SEQ ID NO: 7766045 - DNA, 22 bp, Homo sapiens
caggctggcaatgcgtcaagca

SEQ ID NO: 7766046 - DNA, 22 bp, Homo sapiens
caggctggcaatgcgtcaagca

SEQ ID NO: 7766047 - DNA, 22 bp, Homo sapiens
caggcctgaccctgagcttcac

SEQ ID NO: 7766048 - DNA, 22 bp, Homo sapiens
caggcctcttccatgcagcagc

SEQ ID NO: 7766049 - DNA, 22 bp, Homo sapiens
caggcctgagtgtggaagtctt

SEQ ID NO: 7766050 - DNA, 22 bp, Homo sapiens
caggcctgcaggaaaggctccc

SEQ ID NO: 7766051 - DNA, 22 bp, Homo sapiens
caggcctgcttcttacccttca

SEQ ID NO: 7766052 - DNA, 22 bp, Homo sapiens
caggcctcgaggagacagctac

SEQ ID NO: 7766053 - DNA, 22 bp, Homo sapiens
caggcccagcccttagccaggt

SEQ ID NO: 7766054 - DNA, 22 bp, Homo sapiens
caggcctctatggtcagctgag

SEQ ID NO: 7766055 - DNA, 22 bp, Homo sapiens
caggcctctatggtcagctgag

SEQ ID NO: 7766056 - DNA, 19 bp, Homo sapiens
caggcctctggtctgctgt

SEQ ID NO: 7766057 - DNA, 22 bp, Homo sapiens
caggctacatttgctctgagaa

SEQ ID NO: 7766058 - DNA, 22 bp, Homo sapiens
tacttgttctttcaagagatag

SEQ ID NO: 7766059 - DNA, 22 bp, Homo sapiens
tacttgttttgtgttcctaaac

SEQ ID NO: 7766060 - DNA, 22 bp, Homo sapiens
tactttaaagaggtgtaatgag

SEQ ID NO: 7766061 - DNA, 22 bp, Homo sapiens
tacatttcagagctcctctctg

SEQ ID NO: 7766062 - DNA, 22 bp, Homo sapiens
taatgtataacaaatactcatc

SEQ ID NO: 7766063 - DNA, 22 bp, Homo sapiens
taatatttctaccctgctgcct

SEQ ID NO: 7766064 - DNA, 22 bp, Homo sapiens
taatcacagaaacagactgttt

SEQ ID NO: 7766065 - DNA, 22 bp, Homo sapiens
taatcacaattcagatgtctta

SEQ ID NO: 7766066 - DNA, 22 bp, Homo sapiens
taatcacaattcagatgtctta

SEQ ID NO: 7766067 - DNA, 22 bp, Homo sapiens
caggcagggagctggaaaggat

SEQ ID NO: 7766068 - DNA, 22 bp, Homo sapiens
taatgtctatgggccagataat

SEQ ID NO: 7766069 - DNA, 22 bp, Homo sapiens
taatgtctccagggttgaccta

SEQ ID NO: 7766070 - DNA, 22 bp, Homo sapiens
caggcatggagaggcagagact

SEQ ID NO: 7766071 - DNA, 22 bp, Homo sapiens
caggcatggagaggcagagact

SEQ ID NO: 7766072 - DNA, 22 bp, Homo sapiens
caggcatggatctggaatcatt

SEQ ID NO: 7766073 - DNA, 22 bp, Homo sapiens
caggcatggaaaagcccagagg

SEQ ID NO: 7766074 - DNA, 22 bp, Homo sapiens
caggcatggagaggcagagact

SEQ ID NO: 7766075 - DNA, 22 bp, Homo sapiens
caggcatgatgggaagtgcctg

SEQ ID NO: 7766076 - DNA, 22 bp, Homo sapiens
caggcatgcttctgtctgggca

SEQ ID NO: 7766077 - DNA, 22 bp, Homo sapiens
tacaaaagtaattacggttttt

SEQ ID NO: 7766078 - DNA, 22 bp, Homo sapiens
tacaaaaaattgatactgacga

SEQ ID NO: 7766079 - DNA, 22 bp, Homo sapiens
tacaaaacagtgctctggtcct

SEQ ID NO: 7766080 - DNA, 22 bp, Homo sapiens
caggccagggttgagaagagaa

SEQ ID NO: 7766081 - DNA, 22 bp, Homo sapiens
caggccagagcgcgtggttggg

SEQ ID NO: 7766082 - DNA, 22 bp, Homo sapiens
caggcatgggccatgggaagtg

SEQ ID NO: 7766083 - DNA, 22 bp, Homo sapiens
tacaaaaaattgatactgacga

SEQ ID NO: 7766084 - DNA, 22 bp, Homo sapiens
tacaaaaaattgatactgacga

SEQ ID NO: 7766085 - DNA, 22 bp, Homo sapiens
tacaaaaaattgatactgacga

SEQ ID NO: 7766086 - DNA, 19 bp, Homo sapiens
caggccagtgtcagggggc

SEQ ID NO: 7766087 - DNA, 19 bp, Homo sapiens
caggccagtgtcagggggc

SEQ ID NO: 7766088 - DNA, 22 bp, Homo sapiens
caggccagtgggaaatagggat

SEQ ID NO: 7766089 - DNA, 22 bp, Homo sapiens
caggccaggtgctctagaatca

SEQ ID NO: 7766090 - DNA, 22 bp, Homo sapiens
caggccagtgtgcttcccaggc

SEQ ID NO: 7766091 - DNA, 22 bp, Homo sapiens
caggccagtgtgcttcccaggc

SEQ ID NO: 7766092 - DNA, 22 bp, Homo sapiens
caggccattaccgctgagaccc

SEQ ID NO: 7766093 - DNA, 22 bp, Homo sapiens
caggcccacgaggcacacagag

SEQ ID NO: 7766094 - DNA, 22 bp, Homo sapiens
caggcccactgcttgtctagtc

SEQ ID NO: 7766095 - DNA, 22 bp, Homo sapiens
gtgcttctcttcacacccaact

SEQ ID NO: 7766096 - DNA, 22 bp, Homo sapiens
gtgcttctccgttctgcagcac

SEQ ID NO: 7766097 - DNA, 22 bp, Homo sapiens
gtgcttcctgtattgattccat

SEQ ID NO: 7766098 - DNA, 22 bp, Homo sapiens
gtgcttatccccattctggagg

SEQ ID NO: 7766099 - DNA, 22 bp, Homo sapiens
gtgcttatgtgggagggagagg

SEQ ID NO: 7766100 - DNA, 22 bp, Homo sapiens
cagctcacagccacgccattcc

SEQ ID NO: 7766101 - DNA, 22 bp, Homo sapiens
taagtccacaggctgacagcgg

SEQ ID NO: 7766102 - DNA, 18 bp, Homo sapiens
taagtcattttgccagca

SEQ ID NO: 7766103 - DNA, 22 bp, Homo sapiens
taagtcatcccataacagtgct

SEQ ID NO: 7766104 - DNA, 22 bp, Homo sapiens
taagtcatggagctgggattga

SEQ ID NO: 7766105 - DNA, 22 bp, Homo sapiens
taagtcattaggctgagttcaa

SEQ ID NO: 7766106 - DNA, 22 bp, Homo sapiens
taagtcatttggagccactgga

SEQ ID NO: 7766107 - DNA, 19 bp, Homo sapiens
taagtagtcaaatagtaac

SEQ ID NO: 7766108 - DNA, 22 bp, Homo sapiens
taaggcaggaactggctgtttt

SEQ ID NO: 7766109 - DNA, 22 bp, Homo sapiens
taaggcagctgagcttctaaca

SEQ ID NO: 7766110 - DNA, 22 bp, Homo sapiens
taagtcaggaggtctcctgaca

SEQ ID NO: 7766111 - DNA, 22 bp, Homo sapiens
taagtcagtagaactgtggtca

SEQ ID NO: 7766112 - DNA, 22 bp, Homo sapiens
taagtcataagtcaacaaagga

SEQ ID NO: 7766113 - DNA, 22 bp, Homo sapiens
taagtcatcacattgcagagat

SEQ ID NO: 7766114 - DNA, 22 bp, Homo sapiens
taagtcatgattctgtgttact

SEQ ID NO: 7766115 - DNA, 22 bp, Homo sapiens
taagtcataagtcatgatgtta

SEQ ID NO: 7766116 - DNA, 22 bp, Homo sapiens
taagtcatagattaatggccac

SEQ ID NO: 7766117 - DNA, 22 bp, Homo sapiens
caggcagatgctgacaagagtt

SEQ ID NO: 7766118 - DNA, 22 bp, Homo sapiens
caggcagagttagtgatttagg

SEQ ID NO: 7766119 - DNA, 22 bp, Homo sapiens
caggcagatatgttcgctttaa

SEQ ID NO: 7766120 - DNA, 22 bp, Homo sapiens
caggcagagctgaagatagatg

SEQ ID NO: 7766121 - DNA, 22 bp, Homo sapiens
caggcagagttagagcaactgg

SEQ ID NO: 7766122 - DNA, 22 bp, Homo sapiens
caggcaccccaggtgagcactg

SEQ ID NO: 7766123 - DNA, 22 bp, Homo sapiens
caggcacctgtgtgtctcaggg

SEQ ID NO: 7766124 - DNA, 22 bp, Homo sapiens
caggcacctcacgtgggtccca

SEQ ID NO: 7766125 - DNA, 21 bp, Homo sapiens
taataattccactacagagta

SEQ ID NO: 7766126 - DNA, 21 bp, Homo sapiens
taataattccactacagagta

SEQ ID NO: 7766127 - DNA, 22 bp, Homo sapiens
taataattagttattgatcgtg

SEQ ID NO: 7766128 - DNA, 22 bp, Homo sapiens
caggcagcagaggagtgtggga

SEQ ID NO: 7766129 - DNA, 22 bp, Homo sapiens
caggcagatgctgacaagagtt

SEQ ID NO: 7766130 - DNA, 22 bp, Homo sapiens
caggcagatttgctgccctcca

SEQ ID NO: 7766131 - DNA, 22 bp, Homo sapiens
taatacaaggcaggaagcagta

SEQ ID NO: 7766132 - DNA, 22 bp, Homo sapiens
taataattggcaatgttgagca

SEQ ID NO: 7766133 - DNA, 22 bp, Homo sapiens
taataattggcaatgttgagca

SEQ ID NO: 7766134 - DNA, 22 bp, Homo sapiens
taataattttaaagaaggctag

SEQ ID NO: 7766135 - DNA, 22 bp, Homo sapiens
taataattggctaaccctggga

SEQ ID NO: 7766136 - DNA, 22 bp, Homo sapiens
ccccaccagcaccctctctatc

SEQ ID NO: 7766137 - DNA, 22 bp, Homo sapiens
tgctggagcccaggcggccttt

SEQ ID NO: 7766138 - DNA, 22 bp, Homo sapiens
cccagttgttgccggctctgga

SEQ ID NO: 7766139 - DNA, 22 bp, Homo sapiens
cccagttgttgccggctctgga

SEQ ID NO: 7766140 - DNA, 22 bp, Homo sapiens
cccgactagctgggattacagg

SEQ ID NO: 7766141 - DNA, 18 bp, Homo sapiens
cccggctaatttttggta

SEQ ID NO: 7766142 - DNA, 22 bp, Homo sapiens
cccgctccttacctgtccaacc

SEQ ID NO: 7766143 - DNA, 22 bp, Homo sapiens
ccccttctctgcaagcctgctc

SEQ ID NO: 7766144 - DNA, 22 bp, Homo sapiens
ccccttctgtgtcctgtcagcc

SEQ ID NO: 7766145 - DNA, 22 bp, Homo sapiens
tgctgggatatagcttctaggg

SEQ ID NO: 7766146 - DNA, 22 bp, Homo sapiens
tgctggcttttccttcaggcag

SEQ ID NO: 7766147 - DNA, 22 bp, Homo sapiens
tgctggctttttggtccttgct

SEQ ID NO: 7766148 - DNA, 22 bp, Homo sapiens
ccccttccttcctcagacagcc

SEQ ID NO: 7766149 - DNA, 22 bp, Homo sapiens
ccccttccttcctcagacagcc

SEQ ID NO: 7766150 - DNA, 22 bp, Homo sapiens
tgctggcctcggcgctgggcct

SEQ ID NO: 7766151 - DNA, 21 bp, Homo sapiens
tgctggccatgtgctgggcat

SEQ ID NO: 7766152 - DNA, 23 bp, Homo sapiens
tgctggctaagaatctgcatttt

SEQ ID NO: 7766153 - DNA, 23 bp, Homo sapiens
tgctggctaagaatctgcatttt

SEQ ID NO: 7766154 - DNA, 22 bp, Homo sapiens
tgctggctttagtgattggggt

SEQ ID NO: 7766155 - DNA, 22 bp, Homo sapiens
tgctggctttagtgattggggt

SEQ ID NO: 7766156 - DNA, 23 bp, Homo sapiens
tgctggcttttatctggtcccta

SEQ ID NO: 7766157 - DNA, 22 bp, Homo sapiens
tgctggcttttccttcaggcag

SEQ ID NO: 7766158 - DNA, 22 bp, Homo sapiens
tgctggctttctgtccctggca

SEQ ID NO: 7766159 - DNA, 22 bp, Homo sapiens
tgctggctttctgtccctggca

SEQ ID NO: 7766160 - DNA, 22 bp, Homo sapiens
ccctgagcccatagttgacatt

SEQ ID NO: 7766161 - DNA, 22 bp, Homo sapiens
ccctgagagtgagtgccacctt

SEQ ID NO: 7766162 - DNA, 22 bp, Homo sapiens
ccctgagatgcctcaccctagt

SEQ ID NO: 7766163 - DNA, 22 bp, Homo sapiens
ccctgaggaccaggaaggaggg

SEQ ID NO: 7766164 - DNA, 22 bp, Homo sapiens
tggagcaagctggagagaacat

SEQ ID NO: 7766165 - DNA, 22 bp, Homo sapiens
ccctgaggaaagggtggagggc

SEQ ID NO: 7766166 - DNA, 22 bp, Homo sapiens
ccctctcagtcagagccagata

SEQ ID NO: 7766167 - DNA, 19 bp, Homo sapiens
ccctcttgcacaaagcaaa

SEQ ID NO: 7766168 - DNA, 22 bp, Homo sapiens
ccctgaaatcctgtgctctgtg

SEQ ID NO: 7766169 - DNA, 20 bp, Homo sapiens
ccctgagacaaaggaggggc

SEQ ID NO: 7766170 - DNA, 20 bp, Homo sapiens
ccctgagaccagagagcagc

SEQ ID NO: 7766171 - DNA, 20 bp, Homo sapiens
ccctgagaccagagagcagc

SEQ ID NO: 7766172 - DNA, 22 bp, Homo sapiens
ccctctacagggaagcgctttc

SEQ ID NO: 7766173 - DNA, 22 bp, Homo sapiens
ccctcgctctaggcagccctgt

SEQ ID NO: 7766174 - DNA, 22 bp, Homo sapiens
ccctccttaccaccacagctcc

SEQ ID NO: 7766175 - DNA, 22 bp, Homo sapiens
ccctcctctccctaagagtcac

SEQ ID NO: 7766176 - DNA, 22 bp, Homo sapiens
ccctcctctccctaagagtcac

SEQ ID NO: 7766177 - DNA, 18 bp, Homo sapiens
cccggctaatttttggta

SEQ ID NO: 7766178 - DNA, 22 bp, Homo sapiens
tgctgtggattcagagatgaaa

SEQ ID NO: 7766179 - DNA, 22 bp, Homo sapiens
tgctgtggttcccagagtggat

SEQ ID NO: 7766180 - DNA, 22 bp, Homo sapiens
tgctgttatacttagctggtta

SEQ ID NO: 7766181 - DNA, 22 bp, Homo sapiens
tgccatattgcaaagtgtctgc

SEQ ID NO: 7766182 - DNA, 22 bp, Homo sapiens
tgccatattattgagcatatta

SEQ ID NO: 7766183 - DNA, 22 bp, Homo sapiens
tgcccagccagtttatggtaat

SEQ ID NO: 7766184 - DNA, 22 bp, Homo sapiens
tgcccagcgcccacattctgtc

SEQ ID NO: 7766185 - DNA, 22 bp, Homo sapiens
tgcccagctattcctttcttag

SEQ ID NO: 7766186 - DNA, 22 bp, Homo sapiens
tgcccagcccctatccctggga

SEQ ID NO: 7766187 - DNA, 22 bp, Homo sapiens
tgcccagcctaaacttggcaag

SEQ ID NO: 7766188 - DNA, 22 bp, Homo sapiens
cccaggcagtgtgtgcatgcgt

SEQ ID NO: 7766189 - DNA, 22 bp, Homo sapiens
tgcccagctgtcaaagtagata

SEQ ID NO: 7766190 - DNA, 22 bp, Homo sapiens
cccaggctcagactggcttgtt

SEQ ID NO: 7766191 - DNA, 22 bp, Homo sapiens
tgccctggggagcccagccagg

SEQ ID NO: 7766192 - DNA, 22 bp, Homo sapiens
tgccctgggctttgctatgact

SEQ ID NO: 7766193 - DNA, 22 bp, Homo sapiens
tgccagcttttgactatcttag

SEQ ID NO: 7766194 - DNA, 22 bp, Homo sapiens
tgccagcttgtggtcagaggct

SEQ ID NO: 7766195 - DNA, 22 bp, Homo sapiens
tgccagcttgtggtcagaggct

SEQ ID NO: 7766196 - DNA, 22 bp, Homo sapiens
tgccagcttcttacggctgcct

SEQ ID NO: 7766197 - DNA, 22 bp, Homo sapiens
tgccagctgcttgtcccccaca

SEQ ID NO: 7766198 - DNA, 22 bp, Homo sapiens
tgccagctgcttgtcccccaca

SEQ ID NO: 7766199 - DNA, 22 bp, Homo sapiens
tgccagctgttcccacccaaaa

SEQ ID NO: 7766200 - DNA, 21 bp, Homo sapiens
tgccagctgctgcatctgtct

SEQ ID NO: 7766201 - DNA, 21 bp, Homo sapiens
tgccagctgctgcatctgtct

SEQ ID NO: 7766202 - DNA, 22 bp, Homo sapiens
tgccagctgacagcagagacaa

SEQ ID NO: 7766203 - DNA, 22 bp, Homo sapiens
tgccaggagagtgcatgcaggg

SEQ ID NO: 7766204 - DNA, 22 bp, Homo sapiens
tgccaggaggaggtgggacaga

SEQ ID NO: 7766205 - DNA, 19 bp, Homo sapiens
tgccaggaatactccagaa

SEQ ID NO: 7766206 - DNA, 22 bp, Homo sapiens
tgccaggacaaggaccacatgg

SEQ ID NO: 7766207 - DNA, 22 bp, Homo sapiens
tgccaggaagtgtgtgggcctg

SEQ ID NO: 7766208 - DNA, 19 bp, Homo sapiens
tgccaggaatactccagaa

SEQ ID NO: 7766209 - DNA, 20 bp, Homo sapiens
tgcacagacaatgagcccag

SEQ ID NO: 7766210 - DNA, 22 bp, Homo sapiens
tgcacagagagatgagacacgt

SEQ ID NO: 7766211 - DNA, 22 bp, Homo sapiens
tgcacagagagatgagacacgt

SEQ ID NO: 7766212 - DNA, 22 bp, Homo sapiens
tgcacagagggaggcataaaat

SEQ ID NO: 7766213 - DNA, 22 bp, Homo sapiens
tgcacagagcaggcaccagcgg

SEQ ID NO: 7766214 - DNA, 22 bp, Homo sapiens
tgcacagagcaggcaccagcgg

SEQ ID NO: 7766215 - DNA, 22 bp, Homo sapiens
tgccacagaggtgaagcccact

SEQ ID NO: 7766216 - DNA, 19 bp, Homo sapiens
tgccacagataaaaactga

SEQ ID NO: 7766217 - DNA, 22 bp, Homo sapiens
tgcacagatctggtggcaagga

SEQ ID NO: 7766218 - DNA, 22 bp, Homo sapiens
tgccagctcccttttctcctcc

SEQ ID NO: 7766219 - DNA, 22 bp, Homo sapiens
tgccacagcagtgctttgacag

SEQ ID NO: 7766220 - DNA, 22 bp, Homo sapiens
tgccagctcccttttctcctcc

SEQ ID NO: 7766221 - DNA, 22 bp, Homo sapiens
tgccagctcccttttctcctcc

SEQ ID NO: 7766222 - DNA, 22 bp, Homo sapiens
tgccagctccgaggagctgcag

SEQ ID NO: 7766223 - DNA, 22 bp, Homo sapiens
tgccagctcctgcagctcctgt

SEQ ID NO: 7766224 - DNA, 22 bp, Homo sapiens
tgccaggatataagagtgcgat

SEQ ID NO: 7766225 - DNA, 22 bp, Homo sapiens
tgccaggagtcaggccaggcag

SEQ ID NO: 7766226 - DNA, 22 bp, Homo sapiens
cccaggagacatatagaaggac

SEQ ID NO: 7766227 - DNA, 22 bp, Homo sapiens
tgccaggatggccagggggcca

SEQ ID NO: 7766228 - DNA, 22 bp, Homo sapiens
cccaggagagagacttgaatct

SEQ ID NO: 7766229 - DNA, 22 bp, Homo sapiens
cccaggagacctgtgaaaggac

SEQ ID NO: 7766230 - DNA, 22 bp, Homo sapiens
tgccaggctaagtggaggactt

SEQ ID NO: 7766231 - DNA, 22 bp, Homo sapiens
cccaggagagaggccagttggc

SEQ ID NO: 7766232 - DNA, 22 bp, Homo sapiens
cccaggagagaggggataaagc

SEQ ID NO: 7766233 - DNA, 22 bp, Homo sapiens
cccaggagagaggccagttggc

SEQ ID NO: 7766234 - DNA, 22 bp, Homo sapiens
tgccctggttacactggagtcc

SEQ ID NO: 7766235 - DNA, 22 bp, Homo sapiens
tgccctggtgaagtgctctcct

SEQ ID NO: 7766236 - DNA, 23 bp, Homo sapiens
cccagggacacgatgacacctcc

SEQ ID NO: 7766237 - DNA, 22 bp, Homo sapiens
tgcctgttgcccacctgataaa

SEQ ID NO: 7766238 - DNA, 23 bp, Homo sapiens
tgccttagttagcacatttctaa

SEQ ID NO: 7766239 - DNA, 22 bp, Homo sapiens
tgccttcctggagctgaaggct

SEQ ID NO: 7766240 - DNA, 22 bp, Homo sapiens
tgccttcatccatgttatagtg

SEQ ID NO: 7766241 - DNA, 17 bp, Homo sapiens
cccagggaccactgctt

SEQ ID NO: 7766242 - DNA, 22 bp, Homo sapiens
cccagggacagatgggcagcta

SEQ ID NO: 7766243 - DNA, 22 bp, Homo sapiens
cccagggttgcctgcctctgct

SEQ ID NO: 7766244 - DNA, 22 bp, Homo sapiens
cccagggtggatgcaagcagca

SEQ ID NO: 7766245 - DNA, 19 bp, Homo sapiens
cccagggtttcctctctcc

SEQ ID NO: 7766246 - DNA, 22 bp, Homo sapiens
cccagggtccctgctctctgtg

SEQ ID NO: 7766247 - DNA, 22 bp, Homo sapiens
cccagggtagctgagctggcag

SEQ ID NO: 7766248 - DNA, 22 bp, Homo sapiens
cccagggtccctgctctctgtg

SEQ ID NO: 7766249 - DNA, 22 bp, Homo sapiens
cccagggtccggataaccctgg

SEQ ID NO: 7766250 - DNA, 22 bp, Homo sapiens
cccagggtgcggccctggctgg

SEQ ID NO: 7766251 - DNA, 22 bp, Homo sapiens
cccagggtgcggccctggctgg

SEQ ID NO: 7766252 - DNA, 22 bp, Homo sapiens
cccagggtgctaattaaatatg

SEQ ID NO: 7766253 - DNA, 22 bp, Homo sapiens
cccagggtaatcatgtgaagcc

SEQ ID NO: 7766254 - DNA, 22 bp, Homo sapiens
tggcttccaaattatccctaga

SEQ ID NO: 7766255 - DNA, 22 bp, Homo sapiens
tggctggctttcttgtatttac

SEQ ID NO: 7766256 - DNA, 22 bp, Homo sapiens
tggctggcttgttcactgactg

SEQ ID NO: 7766257 - DNA, 20 bp, Homo sapiens
tggctggcttgtatttcctt

SEQ ID NO: 7766258 - DNA, 22 bp, Homo sapiens
tggctggctgtccagctgggca

SEQ ID NO: 7766259 - DNA, 22 bp, Homo sapiens
tggctggctgtccagctgggca

SEQ ID NO: 7766260 - DNA, 22 bp, Homo sapiens
tggctggctgtcagtaggctgt

SEQ ID NO: 7766261 - DNA, 22 bp, Homo sapiens
tggctggctgtcaaggaaagcc

SEQ ID NO: 7766262 - DNA, 22 bp, Homo sapiens
tggctggctgtcaaggaaagcc

SEQ ID NO: 7766263 - DNA, 22 bp, Homo sapiens
tggctggctagtgggcaggatt

SEQ ID NO: 7766264 - DNA, 18 bp, Homo sapiens
tggctggctctgtcatct

SEQ ID NO: 7766265 - DNA, 22 bp, Homo sapiens
tggctggctggaccacacctgc

SEQ ID NO: 7766266 - DNA, 19 bp, Homo sapiens
tggcttccatctctctcat

SEQ ID NO: 7766267 - DNA, 16 bp, Homo sapiens
tggcttcccagagata

SEQ ID NO: 7766268 - DNA, 22 bp, Homo sapiens
tggcttccagtaatcaggattt

SEQ ID NO: 7766269 - DNA, 22 bp, Homo sapiens
tggcttccagagctgctccacc

SEQ ID NO: 7766270 - DNA, 22 bp, Homo sapiens
tggcttccactgtgtgccccct

SEQ ID NO: 7766271 - DNA, 22 bp, Homo sapiens
tggcttccagaactgagcaaca

SEQ ID NO: 7766272 - DNA, 22 bp, Homo sapiens
cctctgcccttttcctgtatca

SEQ ID NO: 7766273 - DNA, 22 bp, Homo sapiens
cctctgcctgcacatcatcctg

SEQ ID NO: 7766274 - DNA, 22 bp, Homo sapiens
tgggaaggacgtgtcagtggca

SEQ ID NO: 7766275 - DNA, 22 bp, Homo sapiens
tgggaaggaactgcctttagct

SEQ ID NO: 7766276 - DNA, 22 bp, Homo sapiens
tgggaagctgcattttaacaag

SEQ ID NO: 7766277 - DNA, 22 bp, Homo sapiens
tgggaagctactcatgcaggca

SEQ ID NO: 7766278 - DNA, 22 bp, Homo sapiens
cctcttctgagtgagactccct

SEQ ID NO: 7766279 - DNA, 18 bp, Homo sapiens
tgggagtgggagtggata

SEQ ID NO: 7766280 - DNA, 22 bp, Homo sapiens
tgggagtgttcttggcttgctt

SEQ ID NO: 7766281 - DNA, 22 bp, Homo sapiens
tgggagtgttcttggcttgctt

SEQ ID NO: 7766282 - DNA, 22 bp, Homo sapiens
tgggagtgttcttggcttgctt

SEQ ID NO: 7766283 - DNA, 19 bp, Homo sapiens
tgggagtggggaaggtcct

SEQ ID NO: 7766284 - DNA, 22 bp, Homo sapiens
tgggagtggggcatagaaggta

SEQ ID NO: 7766285 - DNA, 22 bp, Homo sapiens
tgggcccaagagagtctccaac

SEQ ID NO: 7766286 - DNA, 22 bp, Homo sapiens
tgggccagtttctcattgaaat

SEQ ID NO: 7766287 - DNA, 22 bp, Homo sapiens
cctgagcctgagtggtgcaggg

SEQ ID NO: 7766288 - DNA, 22 bp, Homo sapiens
cctgagccgagcgctctttctc

SEQ ID NO: 7766289 - DNA, 22 bp, Homo sapiens
tgggctgcggataggcctcgga

SEQ ID NO: 7766290 - DNA, 22 bp, Homo sapiens
tgggcccatcattgctgtgggc

SEQ ID NO: 7766291 - DNA, 22 bp, Homo sapiens
tgggcccatcattgctgtgggc

SEQ ID NO: 7766292 - DNA, 22 bp, Homo sapiens
tgggccctgacttcaagcatcc

SEQ ID NO: 7766293 - DNA, 22 bp, Homo sapiens
tgggcccaagtgcaatgcagtg

SEQ ID NO: 7766294 - DNA, 22 bp, Homo sapiens
cctgagctagggaaggaagacc

SEQ ID NO: 7766295 - DNA, 21 bp, Homo sapiens
cctagcctcttacccagcttt

SEQ ID NO: 7766296 - DNA, 18 bp, Homo sapiens
cctagcctccaagctcat

SEQ ID NO: 7766297 - DNA, 22 bp, Homo sapiens
cctagccttcggcctacccatc

SEQ ID NO: 7766298 - DNA, 22 bp, Homo sapiens
cctagactagaggcagggagcc

SEQ ID NO: 7766299 - DNA, 22 bp, Homo sapiens
cctagaggctgcaaggagaggc

SEQ ID NO: 7766300 - DNA, 22 bp, Homo sapiens
tggcagggtgggcttcagcccc

SEQ ID NO: 7766301 - DNA, 22 bp, Homo sapiens
tggcagggttggccaccttacc

SEQ ID NO: 7766302 - DNA, 22 bp, Homo sapiens
cctcagaggtgaacatcagtgc

SEQ ID NO: 7766303 - DNA, 22 bp, Homo sapiens
cccttcctgggtgtcccggagt

SEQ ID NO: 7766304 - DNA, 22 bp, Homo sapiens
cccttctctttcactcactatt

SEQ ID NO: 7766305 - DNA, 22 bp, Homo sapiens
ccctgcagccttgcatgccttc

SEQ ID NO: 7766306 - DNA, 18 bp, Homo sapiens
tggagcaggtaggcatga

SEQ ID NO: 7766307 - DNA, 22 bp, Homo sapiens
ccctgcaggggacctgcagcct

SEQ ID NO: 7766308 - DNA, 22 bp, Homo sapiens
ccctgcaggggacctgcagcct

SEQ ID NO: 7766309 - DNA, 22 bp, Homo sapiens
ccctgcaggctcagactggagt

SEQ ID NO: 7766310 - DNA, 21 bp, Homo sapiens
ccctgcaggccagggctgagc

SEQ ID NO: 7766311 - DNA, 22 bp, Homo sapiens
cctcatgctgcatctctgaggt

SEQ ID NO: 7766312 - DNA, 20 bp, Homo sapiens
cctcagtgtcctggactggg

SEQ ID NO: 7766313 - DNA, 22 bp, Homo sapiens
cctcagggacgggatcacttgg

SEQ ID NO: 7766314 - DNA, 22 bp, Homo sapiens
cctcagggactccatgctgcag

SEQ ID NO: 7766315 - DNA, 18 bp, Homo sapiens
cctcagggagagagacgc

SEQ ID NO: 7766316 - DNA, 22 bp, Homo sapiens
tggcccagcagttctgccccag

SEQ ID NO: 7766317 - DNA, 20 bp, Homo sapiens
tggcccagcacgacgaggac

SEQ ID NO: 7766318 - DNA, 20 bp, Homo sapiens
tggcccagcacgacgaggac

SEQ ID NO: 7766319 - DNA, 22 bp, Homo sapiens
tggcccagcactccaagtaggg

SEQ ID NO: 7766320 - DNA, 22 bp, Homo sapiens
tggcccagagcactgctgggca

SEQ ID NO: 7766321 - DNA, 22 bp, Homo sapiens
tggcccagatctctgaccttga

SEQ ID NO: 7766322 - DNA, 19 bp, Homo sapiens
tggcccagatggtcctggg

SEQ ID NO: 7766323 - DNA, 22 bp, Homo sapiens
cctcagagtaggtctcagctgt

SEQ ID NO: 7766324 - DNA, 22 bp, Homo sapiens
cctcagcatcctcatgctcagt

SEQ ID NO: 7766325 - DNA, 22 bp, Homo sapiens
cctcagcatcctcctgctcagt

SEQ ID NO: 7766326 - DNA, 22 bp, Homo sapiens
tggcccagagcactgctgggca

SEQ ID NO: 7766327 - DNA, 22 bp, Homo sapiens
cctcaggcttacgggcaatgga

SEQ ID NO: 7766328 - DNA, 22 bp, Homo sapiens
cctcaggcttacgggcaatgga

SEQ ID NO: 7766329 - DNA, 22 bp, Homo sapiens
cctcagggaatgggaggctggg

SEQ ID NO: 7766330 - DNA, 22 bp, Homo sapiens
cctcaggctctgggtgcctacc

SEQ ID NO: 7766331 - DNA, 22 bp, Homo sapiens
cctcaggctagctactgtccct

SEQ ID NO: 7766332 - DNA, 22 bp, Homo sapiens
ccatgttggaacttcacattct

SEQ ID NO: 7766333 - DNA, 22 bp, Homo sapiens
ccattctttcagtgtctcatgt

SEQ ID NO: 7766334 - DNA, 22 bp, Homo sapiens
ccattggagagttttaagaagg

SEQ ID NO: 7766335 - DNA, 21 bp, Homo sapiens
ccattgagaccatggaggagt

SEQ ID NO: 7766336 - DNA, 22 bp, Homo sapiens
ccattggagccaagagttttac

SEQ ID NO: 7766337 - DNA, 19 bp, Homo sapiens
ccattgtaaagaaaaatgt

SEQ ID NO: 7766338 - DNA, 22 bp, Homo sapiens
tgattcaagctactgttactgg

SEQ ID NO: 7766339 - DNA, 22 bp, Homo sapiens
tgattcaagccaccacatactg

SEQ ID NO: 7766340 - DNA, 22 bp, Homo sapiens
tgattcaagattggttagctgt

SEQ ID NO: 7766341 - DNA, 22 bp, Homo sapiens
ccattgtaaattctgtggaagt

SEQ ID NO: 7766342 - DNA, 22 bp, Homo sapiens
ccattgtaaagagtatactttg

SEQ ID NO: 7766343 - DNA, 22 bp, Homo sapiens
tgattttattgaaacttcactt

SEQ ID NO: 7766344 - DNA, 22 bp, Homo sapiens
tgattttacttagcatgatgtt

SEQ ID NO: 7766345 - DNA, 23 bp, Homo sapiens
tgattttaaaaagtaagttatca

SEQ ID NO: 7766346 - DNA, 23 bp, Homo sapiens
tgattttaaaaagtaagttatca

SEQ ID NO: 7766347 - DNA, 22 bp, Homo sapiens
tgcaaatagcctgatgaaagaa

SEQ ID NO: 7766348 - DNA, 22 bp, Homo sapiens
tgcaaatagcctgatgaaagaa

SEQ ID NO: 7766349 - DNA, 22 bp, Homo sapiens
tgcaaatattccatgctgttca

SEQ ID NO: 7766350 - DNA, 22 bp, Homo sapiens
tgcaaatattagcattcgatat

SEQ ID NO: 7766351 - DNA, 22 bp, Homo sapiens
tgcaaatagcctatatttatag

SEQ ID NO: 7766352 - DNA, 23 bp, Homo sapiens
tgcaaataccatgctgtcctgtc

SEQ ID NO: 7766353 - DNA, 22 bp, Homo sapiens
tgcaaataaatttctgttcatt

SEQ ID NO: 7766354 - DNA, 23 bp, Homo sapiens
tgcaaataacaaggagtttaagg

SEQ ID NO: 7766355 - DNA, 22 bp, Homo sapiens
tgcacacatatgagcatgtgtg

SEQ ID NO: 7766356 - DNA, 22 bp, Homo sapiens
tgcacacctctccaccactctc

SEQ ID NO: 7766357 - DNA, 22 bp, Homo sapiens
tgcacacctctccaccactctc

SEQ ID NO: 7766358 - DNA, 22 bp, Homo sapiens
tgcacacatgtttacaagcatc

SEQ ID NO: 7766359 - DNA, 22 bp, Homo sapiens
tgcacacatgtttacaagcatc

SEQ ID NO: 7766360 - DNA, 22 bp, Homo sapiens
cccagaaggcttgccaggaagc

SEQ ID NO: 7766361 - DNA, 22 bp, Homo sapiens
cccagaaggctaagcgtggatt

SEQ ID NO: 7766362 - DNA, 22 bp, Homo sapiens
cccagacataacagcagagagg

SEQ ID NO: 7766363 - DNA, 19 bp, Homo sapiens
ccagtcctctttgggcctg

SEQ ID NO: 7766364 - DNA, 22 bp, Homo sapiens
ccagtcctcagatggtctgtgc

SEQ ID NO: 7766365 - DNA, 22 bp, Homo sapiens
ccagtgttccctcgggttcatg

SEQ ID NO: 7766366 - DNA, 22 bp, Homo sapiens
tgagggctgcttccagagctag

SEQ ID NO: 7766367 - DNA, 22 bp, Homo sapiens
tgagggccgaggagctgtgggt

SEQ ID NO: 7766368 - DNA, 22 bp, Homo sapiens
tgagggctaaattgtggcaggt

SEQ ID NO: 7766369 - DNA, 22 bp, Homo sapiens
ccatgccatactggccacccgg

SEQ ID NO: 7766370 - DNA, 22 bp, Homo sapiens
ccatgccttcctttccctggaa

SEQ ID NO: 7766371 - DNA, 22 bp, Homo sapiens
ccatgctgaccctgtgcaggca

SEQ ID NO: 7766372 - DNA, 22 bp, Homo sapiens
ccatggaactcagtaaattata

SEQ ID NO: 7766373 - DNA, 22 bp, Homo sapiens
tgaggtcacctggaggcagcct

SEQ ID NO: 7766374 - DNA, 22 bp, Homo sapiens
ccatgtggggtcagtgtttggg

SEQ ID NO: 7766375 - DNA, 22 bp, Homo sapiens
tgaggagaaatgctcagagcca

SEQ ID NO: 7766376 - DNA, 22 bp, Homo sapiens
ccaggtgtgatttggcagtgtc

SEQ ID NO: 7766377 - DNA, 22 bp, Homo sapiens
ccaggtgtgctctgcagtggat

SEQ ID NO: 7766378 - DNA, 22 bp, Homo sapiens
ccaggggctgcagatccatggt

SEQ ID NO: 7766379 - DNA, 22 bp, Homo sapiens
ccaggggctctcagggtgtgtg

SEQ ID NO: 7766380 - DNA, 22 bp, Homo sapiens
tgagaagtactacaagagaggg

SEQ ID NO: 7766381 - DNA, 22 bp, Homo sapiens
tgagaaggtgaaagtgtggaga

SEQ ID NO: 7766382 - DNA, 20 bp, Homo sapiens
tgagaaggggtcagctgtac

SEQ ID NO: 7766383 - DNA, 22 bp, Homo sapiens
ccagggtcacaaataactgcag

SEQ ID NO: 7766384 - DNA, 22 bp, Homo sapiens
ccagggtaccccaagggcaggt

SEQ ID NO: 7766385 - DNA, 22 bp, Homo sapiens
tgacaactttacaaaattcttc

SEQ ID NO: 7766386 - DNA, 22 bp, Homo sapiens
tgaatgatacagaattatgtag

SEQ ID NO: 7766387 - DNA, 22 bp, Homo sapiens
tgaatgatatgtgaaaaggaac

SEQ ID NO: 7766388 - DNA, 22 bp, Homo sapiens
tgaatgatatattgggaataat

SEQ ID NO: 7766389 - DNA, 22 bp, Homo sapiens
tgaatgatctccgattagtcct

SEQ ID NO: 7766390 - DNA, 22 bp, Homo sapiens
tgaatgatctagttttgtagac

SEQ ID NO: 7766391 - DNA, 22 bp, Homo sapiens
tgaatgatttgggtgcattcag

SEQ ID NO: 7766392 - DNA, 22 bp, Homo sapiens
tgaatgatttcttaggcaattg

SEQ ID NO: 7766393 - DNA, 23 bp, Homo sapiens
tgaatgattgtactgagctttta

SEQ ID NO: 7766394 - DNA, 22 bp, Homo sapiens
tgaatgattaaaacccggacta

SEQ ID NO: 7766395 - DNA, 22 bp, Homo sapiens
tgaatgatgtataatattgaga

SEQ ID NO: 7766396 - DNA, 22 bp, Homo sapiens
tgaatgatggtgtgttcttgcc

SEQ ID NO: 7766397 - DNA, 23 bp, Homo sapiens
tgaatgatggtgctcctcatctt

SEQ ID NO: 7766398 - DNA, 21 bp, Homo sapiens
tgaatgatgccccagagttgt

SEQ ID NO: 7766399 - DNA, 22 bp, Homo sapiens
tgaatgatgcatttgtttccca

SEQ ID NO: 7766400 - DNA, 22 bp, Homo sapiens
tgaatgatgcagtataatgata

SEQ ID NO: 7766401 - DNA, 22 bp, Homo sapiens
tgaatgatgaggggagaataat

SEQ ID NO: 7766402 - DNA, 21 bp, Homo sapiens
tgaatgatctggttgcctttt

SEQ ID NO: 7766403 - DNA, 21 bp, Homo sapiens
ccaggctggccatggtattga

SEQ ID NO: 7766404 - DNA, 20 bp, Homo sapiens
ccaggctggcaaatgggggc

SEQ ID NO: 7766405 - DNA, 22 bp, Homo sapiens
ccaggctggagtgtagtcgcat

SEQ ID NO: 7766406 - DNA, 22 bp, Homo sapiens
ccaggctggattttgcagttca

SEQ ID NO: 7766407 - DNA, 22 bp, Homo sapiens
ccaggctggagtgcaatggtgc

SEQ ID NO: 7766408 - DNA, 22 bp, Homo sapiens
ccaggctggagtgcagtagtgt

SEQ ID NO: 7766409 - DNA, 22 bp, Homo sapiens
ccaggctggagtgcagtagtgt

SEQ ID NO: 7766410 - DNA, 22 bp, Homo sapiens
ccaggctggagtgcagtggcac

SEQ ID NO: 7766411 - DNA, 22 bp, Homo sapiens
ccaggggaaacagggagcactc

SEQ ID NO: 7766412 - DNA, 22 bp, Homo sapiens
ccagggctttgccaaagtccag

SEQ ID NO: 7766413 - DNA, 19 bp, Homo sapiens
ccagggctttaagttgagg

SEQ ID NO: 7766414 - DNA, 22 bp, Homo sapiens
ccagggcttcagttagtggtga

SEQ ID NO: 7766415 - DNA, 22 bp, Homo sapiens
ccagggctgctgtgggactcca

SEQ ID NO: 7766416 - DNA, 22 bp, Homo sapiens
tgacaatggatattagttgtgg

SEQ ID NO: 7766417 - DNA, 22 bp, Homo sapiens
tgacaatagcgatttatcttgc

SEQ ID NO: 7766418 - DNA, 22 bp, Homo sapiens
tgacaatagcgatttatcttgc

SEQ ID NO: 7766419 - DNA, 22 bp, Homo sapiens
tgacaagctttacagaattgaa

SEQ ID NO: 7766420 - DNA, 22 bp, Homo sapiens
tgacatctagtaggtagagacc

SEQ ID NO: 7766421 - DNA, 22 bp, Homo sapiens
tgacatcattggccattgggga

SEQ ID NO: 7766422 - DNA, 19 bp, Homo sapiens
tgacatagcaagacaaaac

SEQ ID NO: 7766423 - DNA, 22 bp, Homo sapiens
tctttcaatccattcatatgtc

SEQ ID NO: 7766424 - DNA, 22 bp, Homo sapiens
tctttcaagggccctagtttgg

SEQ ID NO: 7766425 - DNA, 22 bp, Homo sapiens
tctttcaaatgcttgaattgga

SEQ ID NO: 7766426 - DNA, 22 bp, Homo sapiens
ccaggccagggctgcagcgagc

SEQ ID NO: 7766427 - DNA, 19 bp, Homo sapiens
ccaggcctgcgggcgttgg

SEQ ID NO: 7766428 - DNA, 22 bp, Homo sapiens
ccaggcctggaccatgccaggg

SEQ ID NO: 7766429 - DNA, 22 bp, Homo sapiens
tctttctttatcacctgatatg

SEQ ID NO: 7766430 - DNA, 22 bp, Homo sapiens
tctttcttggtataaagcaggg

SEQ ID NO: 7766431 - DNA, 22 bp, Homo sapiens
tctttcttggtattctgagcta

SEQ ID NO: 7766432 - DNA, 22 bp, Homo sapiens
tctttcttctttcatagtgtga

SEQ ID NO: 7766433 - DNA, 22 bp, Homo sapiens
tctttcttctttcatagtgtga

SEQ ID NO: 7766434 - DNA, 22 bp, Homo sapiens
ccaggcctggccaggggatgcc

SEQ ID NO: 7766435 - DNA, 21 bp, Homo sapiens
ccaggctcctgaggctggtca

SEQ ID NO: 7766436 - DNA, 22 bp, Homo sapiens
ccaggctctgcgctggacatgg

SEQ ID NO: 7766437 - DNA, 22 bp, Homo sapiens
ccaggctgaatatgttccaggg

SEQ ID NO: 7766438 - DNA, 22 bp, Homo sapiens
ccaggctggagtgcaatggcgt

SEQ ID NO: 7766439 - DNA, 22 bp, Homo sapiens
ccaggctggagtgcaatggtgc

SEQ ID NO: 7766440 - DNA, 22 bp, Homo sapiens
ccaggctgctgttggtgtccgc

SEQ ID NO: 7766441 - DNA, 22 bp, Homo sapiens
ccaggctggagtgcaatggcat

SEQ ID NO: 7766442 - DNA, 22 bp, Homo sapiens
tctttggtgatatctctttggt

SEQ ID NO: 7766443 - DNA, 22 bp, Homo sapiens
ccaggctgctgttggtgtccgc

SEQ ID NO: 7766444 - DNA, 22 bp, Homo sapiens
tctttgggagaaggggtcccag

SEQ ID NO: 7766445 - DNA, 22 bp, Homo sapiens
tctttggctgcctgaagcccaa

SEQ ID NO: 7766446 - DNA, 22 bp, Homo sapiens
tctttggctttgccacacccaa

SEQ ID NO: 7766447 - DNA, 22 bp, Homo sapiens
tctttggctttgccacacccaa

SEQ ID NO: 7766448 - DNA, 22 bp, Homo sapiens
tctttggcttgtctcctcagtt

SEQ ID NO: 7766449 - DNA, 22 bp, Homo sapiens
tctttggcttgtctcctcagtt

SEQ ID NO: 7766450 - DNA, 22 bp, Homo sapiens
tctttggctatgatttactgtt

SEQ ID NO: 7766451 - DNA, 22 bp, Homo sapiens
ccaggctgagcatgattggagc

SEQ ID NO: 7766452 - DNA, 22 bp, Homo sapiens
tctttggccttaggagcccttg

SEQ ID NO: 7766453 - DNA, 22 bp, Homo sapiens
ccaggaggttgaggctgcagtg

SEQ ID NO: 7766454 - DNA, 22 bp, Homo sapiens
ccaggagtcaataaaggaagct

SEQ ID NO: 7766455 - DNA, 17 bp, Homo sapiens
ccaggagagatgcttgt

SEQ ID NO: 7766456 - DNA, 22 bp, Homo sapiens
ccaggaggttgaggctgcagtg

SEQ ID NO: 7766457 - DNA, 22 bp, Homo sapiens
ccaggaggttgaggctgcagtg

SEQ ID NO: 7766458 - DNA, 22 bp, Homo sapiens
ccaggagactgtactgatattt

SEQ ID NO: 7766459 - DNA, 22 bp, Homo sapiens
tcttagaatgtcaactgatgtt

SEQ ID NO: 7766460 - DNA, 22 bp, Homo sapiens
ccaggcaaggtctcctagagag

SEQ ID NO: 7766461 - DNA, 22 bp, Homo sapiens
tcttcacatggagaagcaactc

SEQ ID NO: 7766462 - DNA, 22 bp, Homo sapiens
ccaggatgacccccactttcct

SEQ ID NO: 7766463 - DNA, 22 bp, Homo sapiens
ccaggatggggagcagatagaa

SEQ ID NO: 7766464 - DNA, 22 bp, Homo sapiens
ccaggagttggaggctgcagtg

SEQ ID NO: 7766465 - DNA, 22 bp, Homo sapiens
ccaggagtttgaggctgcagtg

SEQ ID NO: 7766466 - DNA, 22 bp, Homo sapiens
tcttcagagtgagcagtgtcat

SEQ ID NO: 7766467 - DNA, 22 bp, Homo sapiens
tcttccagtctgtaggactagg

SEQ ID NO: 7766468 - DNA, 22 bp, Homo sapiens
tcttcccactgcccatgggcag

SEQ ID NO: 7766469 - DNA, 22 bp, Homo sapiens
tcttcccagctgctgcgatgcc

SEQ ID NO: 7766470 - DNA, 22 bp, Homo sapiens
tcttcccagaccttacatgtga

SEQ ID NO: 7766471 - DNA, 22 bp, Homo sapiens
tcttcccagaggaggtgccagc

SEQ ID NO: 7766472 - DNA, 22 bp, Homo sapiens
tcttcagaggaagtcagtcttt

SEQ ID NO: 7766473 - DNA, 22 bp, Homo sapiens
tcttcagaagatcacatcagtg

SEQ ID NO: 7766474 - DNA, 22 bp, Homo sapiens
ccaggcaggcgatggtgcagtg

SEQ ID NO: 7766475 - DNA, 22 bp, Homo sapiens
tcttccctcttctgccaaatac

SEQ ID NO: 7766476 - DNA, 22 bp, Homo sapiens
tcttcccattagtaatgaagtg

SEQ ID NO: 7766477 - DNA, 22 bp, Homo sapiens
ccaggccagagtgcagtggcac

SEQ ID NO: 7766478 - DNA, 22 bp, Homo sapiens
ccagctgcttgggaaaatgtct

SEQ ID NO: 7766479 - DNA, 22 bp, Homo sapiens
ccagctgctgtgcagggaggct

SEQ ID NO: 7766480 - DNA, 20 bp, Homo sapiens
ccagctgagccaaggggaga

SEQ ID NO: 7766481 - DNA, 22 bp, Homo sapiens
ccagctgaggcagccacacagg

SEQ ID NO: 7766482 - DNA, 22 bp, Homo sapiens
ccagctgattcggtggtggttg

SEQ ID NO: 7766483 - DNA, 22 bp, Homo sapiens
ccagctgcaggggagcagtgga

SEQ ID NO: 7766484 - DNA, 21 bp, Homo sapiens
tctggaagaaaaaagtattat

SEQ ID NO: 7766485 - DNA, 22 bp, Homo sapiens
tctggaaagatcattaaatcca

SEQ ID NO: 7766486 - DNA, 22 bp, Homo sapiens
tctggaaataaaattatagttg

SEQ ID NO: 7766487 - DNA, 22 bp, Homo sapiens
tctgcttctcctacttcatggg

SEQ ID NO: 7766488 - DNA, 22 bp, Homo sapiens
tctgcttgtgtctgtccagcct

SEQ ID NO: 7766489 - DNA, 22 bp, Homo sapiens
ccagagacgtcggtcagggcgc

SEQ ID NO: 7766490 - DNA, 22 bp, Homo sapiens
ccaggacaattcgtcactttct

SEQ ID NO: 7766491 - DNA, 22 bp, Homo sapiens
ccaggacacgatttttagtctg

SEQ ID NO: 7766492 - DNA, 22 bp, Homo sapiens
tctggctcagggctctgaggga

SEQ ID NO: 7766493 - DNA, 18 bp, Homo sapiens
ccaggacaggcaaaaggt

SEQ ID NO: 7766494 - DNA, 22 bp, Homo sapiens
ccaggacagggagacgggagcc

SEQ ID NO: 7766495 - DNA, 22 bp, Homo sapiens
ccaggacactgcttcacagcag

SEQ ID NO: 7766496 - DNA, 22 bp, Homo sapiens
ccaggacaggagttggcttcgc

SEQ ID NO: 7766497 - DNA, 22 bp, Homo sapiens
ccaggacatgttgcaagtttat

SEQ ID NO: 7766498 - DNA, 22 bp, Homo sapiens
ccaggacagtgaacatgtaaga

SEQ ID NO: 7766499 - DNA, 22 bp, Homo sapiens
tctggtcatcggaaagatcaaa

SEQ ID NO: 7766500 - DNA, 22 bp, Homo sapiens
ccaggactttaagtccagcact

SEQ ID NO: 7766501 - DNA, 22 bp, Homo sapiens
ccaggagaagcatctgagtgta

SEQ ID NO: 7766502 - DNA, 22 bp, Homo sapiens
ccaggagaagcatctgagtgta

SEQ ID NO: 7766503 - DNA, 22 bp, Homo sapiens
ccaggagaataatggcagatta

SEQ ID NO: 7766504 - DNA, 22 bp, Homo sapiens
ccaggactcaatgaccacaggg

SEQ ID NO: 7766505 - DNA, 22 bp, Homo sapiens
tctggtaacctttatccctcct

SEQ ID NO: 7766506 - DNA, 22 bp, Homo sapiens
ttgttacatacagcagaacata

SEQ ID NO: 7766507 - DNA, 22 bp, Homo sapiens
ttgttacatcttatgtaagtgg

SEQ ID NO: 7766508 - DNA, 22 bp, Homo sapiens
ttgttacagcagtgatttcaga

SEQ ID NO: 7766509 - DNA, 22 bp, Homo sapiens
ttgttacagcagtgatttcaga

SEQ ID NO: 7766510 - DNA, 22 bp, Homo sapiens
ttgtgttttcttatggcataaa

SEQ ID NO: 7766511 - DNA, 22 bp, Homo sapiens
ttgttataaagactaaatatgt

SEQ ID NO: 7766512 - DNA, 22 bp, Homo sapiens
ttgttagtaagtgacaaaaatc

SEQ ID NO: 7766513 - DNA, 22 bp, Homo sapiens
ttgttagtttatataatgtagt

SEQ ID NO: 7766514 - DNA, 22 bp, Homo sapiens
ttgtttaaaatgtagcaagaaa

SEQ ID NO: 7766515 - DNA, 22 bp, Homo sapiens
ttgtgtttcccttgcatattcc

SEQ ID NO: 7766516 - DNA, 22 bp, Homo sapiens
ttgtgtttctggccaagatgga

SEQ ID NO: 7766517 - DNA, 22 bp, Homo sapiens
ttgtgttaaggtgcatctagtg

SEQ ID NO: 7766518 - DNA, 21 bp, Homo sapiens
ttgtttcctcccaaaatgcca

SEQ ID NO: 7766519 - DNA, 22 bp, Homo sapiens
ttgtttctccagtctaggaaaa

SEQ ID NO: 7766520 - DNA, 22 bp, Homo sapiens
ttgtttctccagtctaggaaaa

SEQ ID NO: 7766521 - DNA, 22 bp, Homo sapiens
ttgtttctctggtcttgagtga

SEQ ID NO: 7766522 - DNA, 22 bp, Homo sapiens
ttgtttctcctggtgcctgata

SEQ ID NO: 7766523 - DNA, 20 bp, Homo sapiens
ttgtttctgctattttctaa

SEQ ID NO: 7766524 - DNA, 22 bp, Homo sapiens
ttgtttcttcaggcttttagga

SEQ ID NO: 7766525 - DNA, 22 bp, Homo sapiens
ttgtttctgagttttcatgtat

SEQ ID NO: 7766526 - DNA, 22 bp, Homo sapiens
ttgtttctctggtcttgagtga

SEQ ID NO: 7766527 - DNA, 20 bp, Homo sapiens
ttgtttctgctattttctaa

SEQ ID NO: 7766528 - DNA, 22 bp, Homo sapiens
ttgtttctttgaagtttctaga

SEQ ID NO: 7766529 - DNA, 22 bp, Homo sapiens
ttgtttctttgaagtttctaga

SEQ ID NO: 7766530 - DNA, 23 bp, Homo sapiens
ttgtttctttgtattgtctctat

SEQ ID NO: 7766531 - DNA, 22 bp, Homo sapiens
ttgtttcttcaggcttttagga

SEQ ID NO: 7766532 - DNA, 22 bp, Homo sapiens
ttgtttcttcaggcttttagga

SEQ ID NO: 7766533 - DNA, 17 bp, Homo sapiens
ttgtttcttctctgtgg

SEQ ID NO: 7766534 - DNA, 22 bp, Homo sapiens
ttgtttcttcatttagaagctt

SEQ ID NO: 7766535 - DNA, 22 bp, Homo sapiens
ttgtttcttcatttagaagctt

SEQ ID NO: 7766536 - DNA, 22 bp, Homo sapiens
ttgtttcttcatttagaagctt

SEQ ID NO: 7766537 - DNA, 22 bp, Homo sapiens
ttgttttaacctagtgtttatg

SEQ ID NO: 7766538 - DNA, 20 bp, Homo sapiens
ttgttttaaatcctggatga

SEQ ID NO: 7766539 - DNA, 18 bp, Homo sapiens
ttgttttaagactctgtc

SEQ ID NO: 7766540 - DNA, 22 bp, Homo sapiens
ttgttttaacgactcagcttgt

SEQ ID NO: 7766541 - DNA, 22 bp, Homo sapiens
ttgttttatctttctacagact

SEQ ID NO: 7766542 - DNA, 22 bp, Homo sapiens
ttgttttcagggtgtcattcac

SEQ ID NO: 7766543 - DNA, 22 bp, Homo sapiens
ttgtctgaattcttctaggcag

SEQ ID NO: 7766544 - DNA, 22 bp, Homo sapiens
ttgtctgacttctttagttact

SEQ ID NO: 7766545 - DNA, 22 bp, Homo sapiens
ttgtctgaatatgtatgtatcc

SEQ ID NO: 7766546 - DNA, 22 bp, Homo sapiens
ttgtctgaatctggagctctct

SEQ ID NO: 7766547 - DNA, 22 bp, Homo sapiens
ttgtctgatgttccctcatgat

SEQ ID NO: 7766548 - DNA, 22 bp, Homo sapiens
ttgtctgatgttccctcatgat

SEQ ID NO: 7766549 - DNA, 22 bp, Homo sapiens
ttgtctgagagatggcagaggt

SEQ ID NO: 7766550 - DNA, 22 bp, Homo sapiens
ttgtctgagaaagtgagttgct

SEQ ID NO: 7766551 - DNA, 22 bp, Homo sapiens
ttgtctgagagatggcagaggt

SEQ ID NO: 7766552 - DNA, 22 bp, Homo sapiens
ttgtctgagggtttgagagaat

SEQ ID NO: 7766553 - DNA, 22 bp, Homo sapiens
ttgtctgaaccatctccctggc

SEQ ID NO: 7766554 - DNA, 22 bp, Homo sapiens
ttgtctgaagtcacacagatgc

SEQ ID NO: 7766555 - DNA, 22 bp, Homo sapiens
ttgtctctaagtgtgatcttca

SEQ ID NO: 7766556 - DNA, 22 bp, Homo sapiens
ttgtgaatagtgccgctataaa

SEQ ID NO: 7766557 - DNA, 22 bp, Homo sapiens
ttgtgaatagtgccacaataaa

SEQ ID NO: 7766558 - DNA, 22 bp, Homo sapiens
ttgtcgggcttacgcagggcca

SEQ ID NO: 7766559 - DNA, 22 bp, Homo sapiens
ttggttttctcagctggaccat

SEQ ID NO: 7766560 - DNA, 22 bp, Homo sapiens
ttggttttctatcctctgcaat

SEQ ID NO: 7766561 - DNA, 21 bp, Homo sapiens
ttggttttctgagtctgtaca

SEQ ID NO: 7766562 - DNA, 22 bp, Homo sapiens
ttggttttgggatgtacaaagg

SEQ ID NO: 7766563 - DNA, 22 bp, Homo sapiens
ttggttttgaaatagcttattg

SEQ ID NO: 7766564 - DNA, 22 bp, Homo sapiens
ttggttttgggatgtacaaagg

SEQ ID NO: 7766565 - DNA, 22 bp, Homo sapiens
ttggttttcatagctccactct

SEQ ID NO: 7766566 - DNA, 22 bp, Homo sapiens
ttggttttcaggggcaggataa

SEQ ID NO: 7766567 - DNA, 22 bp, Homo sapiens
ttggttttatcttaagattctt

SEQ ID NO: 7766568 - DNA, 22 bp, Homo sapiens
ttggttcacattagatttcctt

SEQ ID NO: 7766569 - DNA, 22 bp, Homo sapiens
ttggttcaggacatatttgagt

SEQ ID NO: 7766570 - DNA, 22 bp, Homo sapiens
ttggttcagatgggatctgcga

SEQ ID NO: 7766571 - DNA, 22 bp, Homo sapiens
ttggttcagtaggcatgcctgg

SEQ ID NO: 7766572 - DNA, 22 bp, Homo sapiens
ttggttcaaagggattcaattt

SEQ ID NO: 7766573 - DNA, 22 bp, Homo sapiens
ttggttcaacttttctaagtag

SEQ ID NO: 7766574 - DNA, 22 bp, Homo sapiens
ttggttcaatactaacttgaac

SEQ ID NO: 7766575 - DNA, 22 bp, Homo sapiens
ttggttcaaaacatggaagggt

SEQ ID NO: 7766576 - DNA, 22 bp, Homo sapiens
ttggttcattttctcatctaga

SEQ ID NO: 7766577 - DNA, 20 bp, Homo sapiens
ttggttgagccagggcctgg

SEQ ID NO: 7766578 - DNA, 22 bp, Homo sapiens
ttggttcattattgaatgtgct

SEQ ID NO: 7766579 - DNA, 19 bp, Homo sapiens
ttggttcatggatgcccaa

SEQ ID NO: 7766580 - DNA, 22 bp, Homo sapiens
ttggttcattgcaggcgccggg

SEQ ID NO: 7766581 - DNA, 21 bp, Homo sapiens
ttgcaatgggcattttggagg

SEQ ID NO: 7766582 - DNA, 23 bp, Homo sapiens
ttgcaaatttcagttagttcatg

SEQ ID NO: 7766583 - DNA, 22 bp, Homo sapiens
ttgcaacattgtaagtttatat

SEQ ID NO: 7766584 - DNA, 22 bp, Homo sapiens
ttgcaacacaaagtttgattcc

SEQ ID NO: 7766585 - DNA, 22 bp, Homo sapiens
ttgcaaattcatggatctgaat

SEQ ID NO: 7766586 - DNA, 22 bp, Homo sapiens
ttgcaaattattttagtccctt

SEQ ID NO: 7766587 - DNA, 22 bp, Homo sapiens
ttgcaaattccaatccaatatt

SEQ ID NO: 7766588 - DNA, 22 bp, Homo sapiens
ttgcaaattgcaagagttggat

SEQ ID NO: 7766589 - DNA, 18 bp, Homo sapiens
ttgcaaattcttccctgt

SEQ ID NO: 7766590 - DNA, 22 bp, Homo sapiens
ttgcaaattcgtcactgttaaa

SEQ ID NO: 7766591 - DNA, 22 bp, Homo sapiens
ttggggtgttggatggagcaag

SEQ ID NO: 7766592 - DNA, 22 bp, Homo sapiens
ttggggtggaagtgaggatcat

SEQ ID NO: 7766593 - DNA, 22 bp, Homo sapiens
ttggggtgttcagggtacttct

SEQ ID NO: 7766594 - DNA, 22 bp, Homo sapiens
ttggtctgtgttacatcattta

SEQ ID NO: 7766595 - DNA, 22 bp, Homo sapiens
ttggtgaacacatacacatttt

SEQ ID NO: 7766596 - DNA, 19 bp, Homo sapiens
ttggtggtggttttggttc

SEQ ID NO: 7766597 - DNA, 22 bp, Homo sapiens
ttggtgtacatctccccttcat

SEQ ID NO: 7766598 - DNA, 22 bp, Homo sapiens
tttattaatgtagcatccatgg

SEQ ID NO: 7766599 - DNA, 22 bp, Homo sapiens
tttataattatctctactctta

SEQ ID NO: 7766600 - DNA, 22 bp, Homo sapiens
tttatacttcataatgtctatt

SEQ ID NO: 7766601 - DNA, 22 bp, Homo sapiens
tttataaaatagactgggtcta

SEQ ID NO: 7766602 - DNA, 22 bp, Homo sapiens
tttataaacagtaccacggtgc

SEQ ID NO: 7766603 - DNA, 22 bp, Homo sapiens
tttattattctgttctctctac

SEQ ID NO: 7766604 - DNA, 22 bp, Homo sapiens
tttattatccagtgttgtcatg

SEQ ID NO: 7766605 - DNA, 22 bp, Homo sapiens
tttattatccagtgttgtcatg

SEQ ID NO: 7766606 - DNA, 22 bp, Homo sapiens
tttatttcactctccggatact

SEQ ID NO: 7766607 - DNA, 22 bp, Homo sapiens
tttcaaacatatcttcattact

SEQ ID NO: 7766608 - DNA, 22 bp, Homo sapiens
tttcaaacatagatctgaatat

SEQ ID NO: 7766609 - DNA, 22 bp, Homo sapiens
tttaattttcctcttcctggag

SEQ ID NO: 7766610 - DNA, 22 bp, Homo sapiens
tttaattttctgggcccagcag

SEQ ID NO: 7766611 - DNA, 22 bp, Homo sapiens
tttaatttgtatttctagaggg

SEQ ID NO: 7766612 - DNA, 22 bp, Homo sapiens
tttaatttgtatttctagaggg

SEQ ID NO: 7766613 - DNA, 22 bp, Homo sapiens
tttaattttcctcttcctggag

SEQ ID NO: 7766614 - DNA, 23 bp, Homo sapiens
tttaaaagttgtaatgtaggctt

SEQ ID NO: 7766615 - DNA, 23 bp, Homo sapiens
ttgtttttagaggtggcatgaga

SEQ ID NO: 7766616 - DNA, 23 bp, Homo sapiens
ttgtttttagaggtggcatgaga

SEQ ID NO: 7766617 - DNA, 22 bp, Homo sapiens
ttgtttttagagaagccctgaa

SEQ ID NO: 7766618 - DNA, 22 bp, Homo sapiens
ttgtttttaaacatgtgactga

SEQ ID NO: 7766619 - DNA, 22 bp, Homo sapiens
tttaaaatttagacctctccac

SEQ ID NO: 7766620 - DNA, 22 bp, Homo sapiens
tttaatgtttgagtcagtatat

SEQ ID NO: 7766621 - DNA, 22 bp, Homo sapiens
tttaaacatatctgttgaggga

SEQ ID NO: 7766622 - DNA, 22 bp, Homo sapiens
tttactttgtgtcaagtcaaga

SEQ ID NO: 7766623 - DNA, 22 bp, Homo sapiens
tttacttttggtaaggtcattt

SEQ ID NO: 7766624 - DNA, 22 bp, Homo sapiens
tttactttctcaagtatatagg

SEQ ID NO: 7766625 - DNA, 22 bp, Homo sapiens
tttactgtctcagagagacaaa

SEQ ID NO: 7766626 - DNA, 22 bp, Homo sapiens
tttactgtgtccatctgtgact

SEQ ID NO: 7766627 - DNA, 22 bp, Homo sapiens
tttacttctgcatttcccctag

SEQ ID NO: 7766628 - DNA, 22 bp, Homo sapiens
tttactgagtgacctagaataa

SEQ ID NO: 7766629 - DNA, 22 bp, Homo sapiens
tttactgacctccaatcccact

SEQ ID NO: 7766630 - DNA, 22 bp, Homo sapiens
tttaccagaattgccaccagaa

SEQ ID NO: 7766631 - DNA, 22 bp, Homo sapiens
tttacaagtacacctaacagct

SEQ ID NO: 7766632 - DNA, 22 bp, Homo sapiens
tttacaaggcagaactgattaa

SEQ ID NO: 7766633 - DNA, 22 bp, Homo sapiens
tttacaacctcatattctgatg

SEQ ID NO: 7766634 - DNA, 22 bp, Homo sapiens
tttacaagaaatcatgatgcta

SEQ ID NO: 7766635 - DNA, 22 bp, Homo sapiens
tttacaaggatcaagggatctc

SEQ ID NO: 7766636 - DNA, 22 bp, Homo sapiens
tttactaagtacttgtatccct

SEQ ID NO: 7766637 - DNA, 22 bp, Homo sapiens
tttactaagcccagttatatgc

SEQ ID NO: 7766638 - DNA, 22 bp, Homo sapiens
tttactacttgtgataactgaa

SEQ ID NO: 7766639 - DNA, 22 bp, Homo sapiens
tttacctagtataatgcaacct

SEQ ID NO: 7766640 - DNA, 22 bp, Homo sapiens
tttcattgcagagtctgtgtgc

SEQ ID NO: 7766641 - DNA, 22 bp, Homo sapiens
tttcattgcctttggaaggtct

SEQ ID NO: 7766642 - DNA, 22 bp, Homo sapiens
tttcattgccataaggtgggat

SEQ ID NO: 7766643 - DNA, 22 bp, Homo sapiens
tttcattggcagagcctgtttt

SEQ ID NO: 7766644 - DNA, 22 bp, Homo sapiens
tttcattggctccctgatgaat

SEQ ID NO: 7766645 - DNA, 22 bp, Homo sapiens
tttcattgtccccaggcaagac

SEQ ID NO: 7766646 - DNA, 22 bp, Homo sapiens
tttcattgtctacatatgacat

SEQ ID NO: 7766647 - DNA, 22 bp, Homo sapiens
tttcattgtgatgcttttatca

SEQ ID NO: 7766648 - DNA, 20 bp, Homo sapiens
tttcattgtcagaatcttat

SEQ ID NO: 7766649 - DNA, 22 bp, Homo sapiens
tttcattgtcaataaactgtat

SEQ ID NO: 7766650 - DNA, 22 bp, Homo sapiens
tttcattgtcatctatcttaga

SEQ ID NO: 7766651 - DNA, 22 bp, Homo sapiens
tttcattgtcagagctttgaat

SEQ ID NO: 7766652 - DNA, 22 bp, Homo sapiens
tttcattgtcatctatcttaga

SEQ ID NO: 7766653 - DNA, 22 bp, Homo sapiens
tttcatttcatagaattgtgtt

SEQ ID NO: 7766654 - DNA, 22 bp, Homo sapiens
tttcatttcatagaattgtgtt

SEQ ID NO: 7766655 - DNA, 22 bp, Homo sapiens
tttccaaaagtttgttctgtgc

SEQ ID NO: 7766656 - DNA, 22 bp, Homo sapiens
tttccaaaatgaatctaatgca

SEQ ID NO: 7766657 - DNA, 22 bp, Homo sapiens
tttccaaagttgccataagctt

SEQ ID NO: 7766658 - DNA, 22 bp, Homo sapiens
tttccaaataaggtcacactca

SEQ ID NO: 7766659 - DNA, 22 bp, Homo sapiens
tttccaaaggtggcaggaacaa

SEQ ID NO: 7766660 - DNA, 22 bp, Homo sapiens
tttccaaaggtggcaggaacaa

SEQ ID NO: 7766661 - DNA, 22 bp, Homo sapiens
tttccaaaggaggaaccagttt

SEQ ID NO: 7766662 - DNA, 22 bp, Homo sapiens
tttcctcttctggcaggcaggg

SEQ ID NO: 7766663 - DNA, 22 bp, Homo sapiens
tttcctctgtcatgacagctga

SEQ ID NO: 7766664 - DNA, 22 bp, Homo sapiens
tttcctctgggccctgccaccc

SEQ ID NO: 7766665 - DNA, 22 bp, Homo sapiens
tttcaggattttatgagatagt

SEQ ID NO: 7766666 - DNA, 22 bp, Homo sapiens
tttcaggattagtttaagcagg

SEQ ID NO: 7766667 - DNA, 22 bp, Homo sapiens
tttcaggagagaccagaaatga

SEQ ID NO: 7766668 - DNA, 22 bp, Homo sapiens
tttcaggatcaaatgaaatcgt

SEQ ID NO: 7766669 - DNA, 19 bp, Homo sapiens
tttcaggagctatgcaggg

SEQ ID NO: 7766670 - DNA, 22 bp, Homo sapiens
tttcaggactcaaaacgataat

SEQ ID NO: 7766671 - DNA, 22 bp, Homo sapiens
tttcaggacacctttaaaaacg

SEQ ID NO: 7766672 - DNA, 22 bp, Homo sapiens
tttcaggaaacatttaatggca

SEQ ID NO: 7766673 - DNA, 22 bp, Homo sapiens
tttcaggccatagcacagggaa

SEQ ID NO: 7766674 - DNA, 22 bp, Homo sapiens
tttcagagttggggaaaagcag

SEQ ID NO: 7766675 - DNA, 22 bp, Homo sapiens
tttcagagttgtcttcttgacc

SEQ ID NO: 7766676 - DNA, 22 bp, Homo sapiens
tttcaaagagttgtaaattact

SEQ ID NO: 7766677 - DNA, 17 bp, Homo sapiens
tttcaaagcagtcagga

SEQ ID NO: 7766678 - DNA, 22 bp, Homo sapiens
tttcaaagaccattaactatca

SEQ ID NO: 7766679 - DNA, 22 bp, Homo sapiens
tttcaaagaccattaactatca

SEQ ID NO: 7766680 - DNA, 22 bp, Homo sapiens
tttcaaactttactcttgaatc

SEQ ID NO: 7766681 - DNA, 22 bp, Homo sapiens
tttcagaggaaatctcattgag

SEQ ID NO: 7766682 - DNA, 22 bp, Homo sapiens
tttcagaggaaatctcattgag

SEQ ID NO: 7766683 - DNA, 22 bp, Homo sapiens
tttcagagctgagatgccacag

SEQ ID NO: 7766684 - DNA, 20 bp, Homo sapiens
tttcagagtgtctttccatt

SEQ ID NO: 7766685 - DNA, 22 bp, Homo sapiens
tttcagagtcagctcctctcta

SEQ ID NO: 7766686 - DNA, 22 bp, Homo sapiens
tttcagaggtatgctgcttatc

SEQ ID NO: 7766687 - DNA, 22 bp, Homo sapiens
tttcagaggtgcttggaatgct

SEQ ID NO: 7766688 - DNA, 22 bp, Homo sapiens
tttctcagtgcagtttctacgt

SEQ ID NO: 7766689 - DNA, 21 bp, Homo sapiens
tttctcagttgtgtgagcagc

SEQ ID NO: 7766690 - DNA, 21 bp, Homo sapiens
tttctcataaaatactcatta

SEQ ID NO: 7766691 - DNA, 22 bp, Homo sapiens
tttctcatagtcatgcctctta

SEQ ID NO: 7766692 - DNA, 21 bp, Homo sapiens
tttctcataaaatactcatta

SEQ ID NO: 7766693 - DNA, 22 bp, Homo sapiens
tttctcagtcacatgaaccaat

SEQ ID NO: 7766694 - DNA, 22 bp, Homo sapiens
tttctcagctcagcatctgggt

SEQ ID NO: 7766695 - DNA, 22 bp, Homo sapiens
tttctattttaaaggcatatgg

SEQ ID NO: 7766696 - DNA, 22 bp, Homo sapiens
tttctattttaaaggcatatgg

SEQ ID NO: 7766697 - DNA, 22 bp, Homo sapiens
tttctattttaaaggcatatgg

SEQ ID NO: 7766698 - DNA, 22 bp, Homo sapiens
tttctatttacagtgctaggta

SEQ ID NO: 7766699 - DNA, 22 bp, Homo sapiens
tttctattgtaagtctcctata

SEQ ID NO: 7766700 - DNA, 22 bp, Homo sapiens
tttctattgtaagtctcctata

SEQ ID NO: 7766701 - DNA, 22 bp, Homo sapiens
tttctagaaatagagatagagt

SEQ ID NO: 7766702 - DNA, 23 bp, Homo sapiens
tttctcatccagagagtcagtcc

SEQ ID NO: 7766703 - DNA, 22 bp, Homo sapiens
tttctcatggaacatagctcct

SEQ ID NO: 7766704 - DNA, 22 bp, Homo sapiens
tttctcatggacccttcatgat

SEQ ID NO: 7766705 - DNA, 22 bp, Homo sapiens
tttctcatggacccttcatgat

SEQ ID NO: 7766706 - DNA, 22 bp, Homo sapiens
tttctccctttataagactgta

SEQ ID NO: 7766707 - DNA, 22 bp, Homo sapiens
tttctccccagtctaatctgga

SEQ ID NO: 7766708 - DNA, 22 bp, Homo sapiens
tttctcctaactcaaatttaag

SEQ ID NO: 7766709 - DNA, 22 bp, Homo sapiens
tttcctgtgcttaacaaatatt

SEQ ID NO: 7766710 - DNA, 22 bp, Homo sapiens
tttcctctttgtgacacagctg

SEQ ID NO: 7766711 - DNA, 22 bp, Homo sapiens
tttccttcctaaggtgaagcaa

SEQ ID NO: 7766712 - DNA, 22 bp, Homo sapiens
tttccttcatcatctgagagct

SEQ ID NO: 7766713 - DNA, 22 bp, Homo sapiens
tttccttccctggatgagaagt

SEQ ID NO: 7766714 - DNA, 21 bp, Homo sapiens
tttctaagtaactggcagcat

SEQ ID NO: 7766715 - DNA, 22 bp, Homo sapiens
tttctaagtaaacacagcatac

SEQ ID NO: 7766716 - DNA, 22 bp, Homo sapiens
tttctaagtatcttgcagtttt

SEQ ID NO: 7766717 - DNA, 22 bp, Homo sapiens
tttctaagtgtgattttagatt

SEQ ID NO: 7766718 - DNA, 22 bp, Homo sapiens
tttctaagtgtgattttagatt

SEQ ID NO: 7766719 - DNA, 22 bp, Homo sapiens
tttctaagtgtattgagcttgg

SEQ ID NO: 7766720 - DNA, 22 bp, Homo sapiens
tttctaagtgtattgagcttgg

SEQ ID NO: 7766721 - DNA, 21 bp, Homo sapiens
tttctaagtgcttggtttggg

SEQ ID NO: 7766722 - DNA, 22 bp, Homo sapiens
tttctaagtgtgtttcatagga

SEQ ID NO: 7766723 - DNA, 22 bp, Homo sapiens
tttctacatttgtaaccagatt

SEQ ID NO: 7766724 - DNA, 22 bp, Homo sapiens
tttctaatctttagttacaaaa

SEQ ID NO: 7766725 - DNA, 22 bp, Homo sapiens
tttctaatctgattctcctacc

SEQ ID NO: 7766726 - DNA, 19 bp, Homo sapiens
tttctaatgtgtttttctt

SEQ ID NO: 7766727 - DNA, 22 bp, Homo sapiens
tttctttaaaggaactctgttt

SEQ ID NO: 7766728 - DNA, 22 bp, Homo sapiens
tttctttaattctcacagcaat

SEQ ID NO: 7766729 - DNA, 22 bp, Homo sapiens
tttcttgtgcctaattttgggc

SEQ ID NO: 7766730 - DNA, 22 bp, Homo sapiens
tttctttaggctgtgttgccaa

SEQ ID NO: 7766731 - DNA, 22 bp, Homo sapiens
tttctttatcatagcatctttg

SEQ ID NO: 7766732 - DNA, 22 bp, Homo sapiens
tttctttatcatagcatctttg

SEQ ID NO: 7766733 - DNA, 22 bp, Homo sapiens
tttctttatcctcctttgcaca

SEQ ID NO: 7766734 - DNA, 22 bp, Homo sapiens
tttcttctgagatcagggagaa

SEQ ID NO: 7766735 - DNA, 22 bp, Homo sapiens
tttcttctcacccaggacagag

SEQ ID NO: 7766736 - DNA, 22 bp, Homo sapiens
tttcttctcacccaggacagag

SEQ ID NO: 7766737 - DNA, 22 bp, Homo sapiens
tttcttctaagatttcaaacta

SEQ ID NO: 7766738 - DNA, 22 bp, Homo sapiens
tttcttccttaccttactagag

SEQ ID NO: 7766739 - DNA, 22 bp, Homo sapiens
tttcttcctaaatatgatttcc

SEQ ID NO: 7766740 - DNA, 22 bp, Homo sapiens
tttcttcctaaatatgatttcc

SEQ ID NO: 7766741 - DNA, 22 bp, Homo sapiens
tttcttcagagagagctttccc

SEQ ID NO: 7766742 - DNA, 22 bp, Homo sapiens
tttcttatgagcaagactctat

SEQ ID NO: 7766743 - DNA, 22 bp, Homo sapiens
tttcttatgagcaagactctat

SEQ ID NO: 7766744 - DNA, 22 bp, Homo sapiens
tttcttatggggtagtccttta

SEQ ID NO: 7766745 - DNA, 22 bp, Homo sapiens
tttcttccaaaggcacgttctc

SEQ ID NO: 7766746 - DNA, 19 bp, Homo sapiens
tttcttccaaagactatgg

SEQ ID NO: 7766747 - DNA, 23 bp, Homo sapiens
tttctgttcctctagctttgcat

SEQ ID NO: 7766748 - DNA, 22 bp, Homo sapiens
tttctgttaggcatcattttaa

SEQ ID NO: 7766749 - DNA, 21 bp, Homo sapiens
tttcttatctgtaaagtggga

SEQ ID NO: 7766750 - DNA, 22 bp, Homo sapiens
tttctgttgtacttaaactagg

SEQ ID NO: 7766751 - DNA, 22 bp, Homo sapiens
tttctgttgtacttaaactagg

SEQ ID NO: 7766752 - DNA, 22 bp, Homo sapiens
tttctgttgtacttaaactagg

SEQ ID NO: 7766753 - DNA, 22 bp, Homo sapiens
tttctgttgtacttaaactagg

SEQ ID NO: 7766754 - DNA, 22 bp, Homo sapiens
tttctgtgaattataaaatttg

SEQ ID NO: 7766755 - DNA, 22 bp, Homo sapiens
tttctctaaatagggaggctta

SEQ ID NO: 7766756 - DNA, 22 bp, Homo sapiens
tttctctgttctctaactgtaa

SEQ ID NO: 7766757 - DNA, 22 bp, Homo sapiens
tttctcctgagttccacgctac

SEQ ID NO: 7766758 - DNA, 22 bp, Homo sapiens
tttctctttgacaggaatcaga

SEQ ID NO: 7766759 - DNA, 22 bp, Homo sapiens
tttctgaaaactgaagtagtgc

SEQ ID NO: 7766760 - DNA, 22 bp, Homo sapiens
tttctgaaaactgaagtagtgc

SEQ ID NO: 7766761 - DNA, 22 bp, Homo sapiens
tttctcttcactgtgtgcctca

SEQ ID NO: 7766762 - DNA, 22 bp, Homo sapiens
tttctgaagatacagctttgct

SEQ ID NO: 7766763 - DNA, 22 bp, Homo sapiens
tttctgaagatacagctttgct

SEQ ID NO: 7766764 - DNA, 22 bp, Homo sapiens
tttctgaacttggtactggagc

SEQ ID NO: 7766765 - DNA, 22 bp, Homo sapiens
tttctgaacttggtactggagc

SEQ ID NO: 7766766 - DNA, 22 bp, Homo sapiens
tttctgaagatacagctttgct

SEQ ID NO: 7766767 - DNA, 21 bp, Homo sapiens
tttctgaaggcaacatctatc

SEQ ID NO: 7766768 - DNA, 21 bp, Homo sapiens
tttctgaaggcaacatctatc

SEQ ID NO: 7766769 - DNA, 22 bp, Homo sapiens
tttctgaagggcagcagactct

SEQ ID NO: 7766770 - DNA, 21 bp, Homo sapiens
tttctgaaggcaacatctatc

SEQ ID NO: 7766771 - DNA, 22 bp, Homo sapiens
tttctgaaacatggtctttgta

SEQ ID NO: 7766772 - DNA, 22 bp, Homo sapiens
tttctgaaaactgaagtagtgc

SEQ ID NO: 7766773 - DNA, 22 bp, Homo sapiens
tttctgaaatctcttttgagga

SEQ ID NO: 7766774 - DNA, 22 bp, Homo sapiens
tttctgaaatctcttttgagga

SEQ ID NO: 7766775 - DNA, 22 bp, Homo sapiens
tttctgaaacatggtctttgta

SEQ ID NO: 7766776 - DNA, 22 bp, Homo sapiens
tttctgaacaaagccattatca

SEQ ID NO: 7766777 - DNA, 22 bp, Homo sapiens
tttctgaacaaagccattatca

SEQ ID NO: 7766778 - DNA, 22 bp, Homo sapiens
tttctgaaatgctggctttgga

SEQ ID NO: 7766779 - DNA, 22 bp, Homo sapiens
tttctggcagcgggacaggggt

SEQ ID NO: 7766780 - DNA, 22 bp, Homo sapiens
tttctgggactggggagattct

SEQ ID NO: 7766781 - DNA, 21 bp, Homo sapiens
tttctgggtggctgcatagtg

SEQ ID NO: 7766782 - DNA, 22 bp, Homo sapiens
tttctgtaagtggcaaataatg

SEQ ID NO: 7766783 - DNA, 20 bp, Homo sapiens
tttctgtagctcagtattca

SEQ ID NO: 7766784 - DNA, 22 bp, Homo sapiens
tttctgctttcagagtgagaca

SEQ ID NO: 7766785 - DNA, 22 bp, Homo sapiens
tttctggaaccacaaaagtatg

SEQ ID NO: 7766786 - DNA, 22 bp, Homo sapiens
tttctgaattcctaggatgttg

SEQ ID NO: 7766787 - DNA, 22 bp, Homo sapiens
tttctgaatttactcaaggtca

SEQ ID NO: 7766788 - DNA, 22 bp, Homo sapiens
tttctgaatttactcaaggtca

SEQ ID NO: 7766789 - DNA, 22 bp, Homo sapiens
tttctgaataactctatgatat

SEQ ID NO: 7766790 - DNA, 18 bp, Homo sapiens
tttctgaatgtctatttc

SEQ ID NO: 7766791 - DNA, 22 bp, Homo sapiens
tttctgaattcctaggatgttg

SEQ ID NO: 7766792 - DNA, 22 bp, Homo sapiens
tttctgaattcctaggatgttg

SEQ ID NO: 7766793 - DNA, 18 bp, Homo sapiens
tttctgaatgtctatttc

SEQ ID NO: 7766794 - DNA, 22 bp, Homo sapiens
tttctgaagtcttctaacagat

SEQ ID NO: 7766795 - DNA, 22 bp, Homo sapiens
tttctgaagtcttctaacagat

SEQ ID NO: 7766796 - DNA, 22 bp, Homo sapiens
tttctgaataactctatgatat

SEQ ID NO: 7766797 - DNA, 23 bp, Homo sapiens
tttctgaagttgagatggacttt

SEQ ID NO: 7766798 - DNA, 23 bp, Homo sapiens
tttctgaagttgagatggacttt

SEQ ID NO: 7766799 - DNA, 22 bp, Homo sapiens
tttctgaaggttaaggaattag

SEQ ID NO: 7766800 - DNA, 22 bp, Homo sapiens
tttctgaaggttaaggaattag

SEQ ID NO: 7766801 - DNA, 22 bp, Homo sapiens
tttctgaaggttaaggaattag

SEQ ID NO: 7766802 - DNA, 22 bp, Homo sapiens
tttctgaagggcagcagactct

SEQ ID NO: 7766803 - DNA, 22 bp, Homo sapiens
tttctgcatttacaaaatgagg

SEQ ID NO: 7766804 - DNA, 22 bp, Homo sapiens
tttctgcatgcatttaattaaa

SEQ ID NO: 7766805 - DNA, 22 bp, Homo sapiens
tttgtttgaaagtctctacagc

SEQ ID NO: 7766806 - DNA, 22 bp, Homo sapiens
tttgttttcaatgtgtcattca

SEQ ID NO: 7766807 - DNA, 22 bp, Homo sapiens
tttgttttcaatgtgtcattca

SEQ ID NO: 7766808 - DNA, 22 bp, Homo sapiens
tttgtttctgcaatacctatag

SEQ ID NO: 7766809 - DNA, 22 bp, Homo sapiens
tttgtttagatggtaaatcagt

SEQ ID NO: 7766810 - DNA, 22 bp, Homo sapiens
tttgttttcaatgtgtcattca

SEQ ID NO: 7766811 - DNA, 22 bp, Homo sapiens
tttgttttctgtaggcctttcc

SEQ ID NO: 7766812 - DNA, 22 bp, Homo sapiens
tttgttttgaactagctcagaa

SEQ ID NO: 7766813 - DNA, 22 bp, Homo sapiens
ttttataaagagagtcagttgg

SEQ ID NO: 7766814 - DNA, 22 bp, Homo sapiens
ttttatacttaagacagagttt

SEQ ID NO: 7766815 - DNA, 22 bp, Homo sapiens
ttttataagcaagaaagggaaa

SEQ ID NO: 7766816 - DNA, 22 bp, Homo sapiens
ttttatcaatcattaagacatt

SEQ ID NO: 7766817 - DNA, 22 bp, Homo sapiens
tttgtttacaaaaataagcagt

SEQ ID NO: 7766818 - DNA, 22 bp, Homo sapiens
tttgtttacaaaaataagcagt

SEQ ID NO: 7766819 - DNA, 22 bp, Homo sapiens
tttgtttactcattcattgatg

SEQ ID NO: 7766820 - DNA, 22 bp, Homo sapiens
tttgtttactcattcattgatg

SEQ ID NO: 7766821 - DNA, 22 bp, Homo sapiens
tttgttcacctagcaaactttt

SEQ ID NO: 7766822 - DNA, 22 bp, Homo sapiens
tttgtatttttcccagctagct

SEQ ID NO: 7766823 - DNA, 22 bp, Homo sapiens
tttgtactgaagattgtaaact

SEQ ID NO: 7766824 - DNA, 22 bp, Homo sapiens
tttgtagagaatgttaagcact

SEQ ID NO: 7766825 - DNA, 22 bp, Homo sapiens
tttgtataagaacattctagca

SEQ ID NO: 7766826 - DNA, 22 bp, Homo sapiens
tttgtataaattggagcaatgt

SEQ ID NO: 7766827 - DNA, 22 bp, Homo sapiens
tttggacaaatgtctgactttc

SEQ ID NO: 7766828 - DNA, 19 bp, Homo sapiens
tttggacagagtgtccagg

SEQ ID NO: 7766829 - DNA, 22 bp, Homo sapiens
tttggacatgttgagtctgata

SEQ ID NO: 7766830 - DNA, 22 bp, Homo sapiens
tttggaggggaagaccttggag

SEQ ID NO: 7766831 - DNA, 22 bp, Homo sapiens
tttggagatagggcctagcaat

SEQ ID NO: 7766832 - DNA, 22 bp, Homo sapiens
tttggagagatgaagttctgtg

SEQ ID NO: 7766833 - DNA, 22 bp, Homo sapiens
tttggagagcagctaggccctt

SEQ ID NO: 7766834 - DNA, 22 bp, Homo sapiens
tttggattccatgctctccggg

SEQ ID NO: 7766835 - DNA, 22 bp, Homo sapiens
tttggattgcttggatgcttcg

SEQ ID NO: 7766836 - DNA, 22 bp, Homo sapiens
tttgcagagtgcagaagcatct

SEQ ID NO: 7766837 - DNA, 22 bp, Homo sapiens
tttgcacacacaataacaaatg

SEQ ID NO: 7766838 - DNA, 22 bp, Homo sapiens
tttgcaaatgctctgcagagct

SEQ ID NO: 7766839 - DNA, 22 bp, Homo sapiens
tttgcaaattcttgtctagcct

SEQ ID NO: 7766840 - DNA, 23 bp, Homo sapiens
tttgcaaattttcctgactactc

SEQ ID NO: 7766841 - DNA, 22 bp, Homo sapiens
tttgcaaatttcgtctcctcag

SEQ ID NO: 7766842 - DNA, 22 bp, Homo sapiens
tttgcaatgtgaaattaaagaa

SEQ ID NO: 7766843 - DNA, 22 bp, Homo sapiens
tttgcaatagtcctggcctgta

SEQ ID NO: 7766844 - DNA, 22 bp, Homo sapiens
tttgcaaatacagaggtcttgc

SEQ ID NO: 7766845 - DNA, 22 bp, Homo sapiens
tttgcaaatgaagctctgagga

SEQ ID NO: 7766846 - DNA, 22 bp, Homo sapiens
tttgcaaatgaagctctgagga

SEQ ID NO: 7766847 - DNA, 22 bp, Homo sapiens
tttgcaaataccatgaaacttg

SEQ ID NO: 7766848 - DNA, 22 bp, Homo sapiens
tttgcaaataaataagtgctcg

SEQ ID NO: 7766849 - DNA, 22 bp, Homo sapiens
tttgcaaaatgaggtgaagagt

SEQ ID NO: 7766850 - DNA, 22 bp, Homo sapiens
tttgattttcagcaatagtggc

SEQ ID NO: 7766851 - DNA, 20 bp, Homo sapiens
tttgatttcacaaggccagt

SEQ ID NO: 7766852 - DNA, 20 bp, Homo sapiens
tttgatttcacaaggccagt

SEQ ID NO: 7766853 - DNA, 22 bp, Homo sapiens
tttgatttactggatattctca

SEQ ID NO: 7766854 - DNA, 22 bp, Homo sapiens
tttctttatcctcctttgcaca

SEQ ID NO: 7766855 - DNA, 22 bp, Homo sapiens
ttttcctttggaagatgcatat

SEQ ID NO: 7766856 - DNA, 22 bp, Homo sapiens
ttttctaaaagaagtcactgat

SEQ ID NO: 7766857 - DNA, 23 bp, Homo sapiens
ttttcctttggacaggctgtatt

SEQ ID NO: 7766858 - DNA, 22 bp, Homo sapiens
ttttctaacatctagtaatttg

SEQ ID NO: 7766859 - DNA, 22 bp, Homo sapiens
ttttctaacatctagtaatttg

SEQ ID NO: 7766860 - DNA, 22 bp, Homo sapiens
ttttctaacatctagtaatttg

SEQ ID NO: 7766861 - DNA, 22 bp, Homo sapiens
ttttcttctacctgctgtccaa

SEQ ID NO: 7766862 - DNA, 22 bp, Homo sapiens
ttttctttaatctggtggggtg

SEQ ID NO: 7766863 - DNA, 22 bp, Homo sapiens
ttttctatctcctagaactgcc

SEQ ID NO: 7766864 - DNA, 22 bp, Homo sapiens
ttttctattaactcattttgca

SEQ ID NO: 7766865 - DNA, 22 bp, Homo sapiens
ttttatctacctatgctcattt

SEQ ID NO: 7766866 - DNA, 22 bp, Homo sapiens
ttttatcattacccagctgaaa

SEQ ID NO: 7766867 - DNA, 22 bp, Homo sapiens
ttttatctgcttcattagttga

SEQ ID NO: 7766868 - DNA, 19 bp, Homo sapiens
ttttccttctcctcttaat

SEQ ID NO: 7766869 - DNA, 22 bp, Homo sapiens
ttttatgaagataattttctga

SEQ ID NO: 7766870 - DNA, 22 bp, Homo sapiens
ttttggcaaaggcattctcttt

SEQ ID NO: 7766871 - DNA, 22 bp, Homo sapiens
ttttggcactgcgtctacatgg

SEQ ID NO: 7766872 - DNA, 22 bp, Homo sapiens
ttttgcaatgagatgcttgtca

SEQ ID NO: 7766873 - DNA, 22 bp, Homo sapiens
ttttgcaaagtacattatcagg

SEQ ID NO: 7766874 - DNA, 22 bp, Homo sapiens
ttttgatatcatgatgaacaga

SEQ ID NO: 7766875 - DNA, 22 bp, Homo sapiens
ttttgcaaagtacattatcagg

SEQ ID NO: 7766876 - DNA, 22 bp, Homo sapiens
tttttcctagcgatttgtcagc

SEQ ID NO: 7766877 - DNA, 22 bp, Homo sapiens
tttttcattgcagcctctctcc

SEQ ID NO: 7766878 - DNA, 22 bp, Homo sapiens
tttttccagggttagatgttta

SEQ ID NO: 7766879 - DNA, 22 bp, Homo sapiens
tttttcccaaaggcaattgcct

SEQ ID NO: 7766880 - DNA, 22 bp, Homo sapiens
tttttcccatatagaaagccaa

SEQ ID NO: 7766881 - DNA, 22 bp, Homo sapiens
tttttcatgagactagaagtca

SEQ ID NO: 7766882 - DNA, 22 bp, Homo sapiens
tttttcatgagactagaagtca

SEQ ID NO: 7766883 - DNA, 22 bp, Homo sapiens
tttttcatgagactagaagtca

SEQ ID NO: 7766884 - DNA, 22 bp, Homo sapiens
ttttggctctgtctgtatcttt

SEQ ID NO: 7766885 - DNA, 22 bp, Homo sapiens
ttttggctctgcaggtttgcac

SEQ ID NO: 7766886 - DNA, 22 bp, Homo sapiens
ttttggctccagtggtttgtgc

SEQ ID NO: 7766887 - DNA, 22 bp, Homo sapiens
tttttggcccttagctctgtat

SEQ ID NO: 7766888 - DNA, 22 bp, Homo sapiens
tttttggaaggagatccacact

SEQ ID NO: 7766889 - DNA, 22 bp, Homo sapiens
tttttgctaatccccagccact

SEQ ID NO: 7766890 - DNA, 22 bp, Homo sapiens
tttttgcaccaacctaatagaa

SEQ ID NO: 7766891 - DNA, 22 bp, Homo sapiens
tttttctactgcccacattgta

SEQ ID NO: 7766892 - DNA, 22 bp, Homo sapiens
tttttgaaggctgatgtgatta

SEQ ID NO: 7766893 - DNA, 22 bp, Homo sapiens
tgttatataacttacaacctgt

SEQ ID NO: 7766894 - DNA, 22 bp, Homo sapiens
tgttatttatctgagcatttat

SEQ ID NO: 7766895 - DNA, 22 bp, Homo sapiens
tgttccctggtaaactgactcc

SEQ ID NO: 7766896 - DNA, 22 bp, Homo sapiens
tgttatttgggaaagttgtaca

SEQ ID NO: 7766897 - DNA, 22 bp, Homo sapiens
tgtgttctgaaggagaagagtg

SEQ ID NO: 7766898 - DNA, 22 bp, Homo sapiens
tgtgttaatttattgcctcaga

SEQ ID NO: 7766899 - DNA, 22 bp, Homo sapiens
tgtgttttatctattgtatctt

SEQ ID NO: 7766900 - DNA, 22 bp, Homo sapiens
tgtgttttccagaatggtgttt

SEQ ID NO: 7766901 - DNA, 22 bp, Homo sapiens
tgtgtttagagagcacattcag

SEQ ID NO: 7766902 - DNA, 22 bp, Homo sapiens
tgtgtttcagaaccttctttca

SEQ ID NO: 7766903 - DNA, 22 bp, Homo sapiens
tgtgtttctctgaggggtccct

SEQ ID NO: 7766904 - DNA, 22 bp, Homo sapiens
tgtgtttctgagaatcccacct

SEQ ID NO: 7766905 - DNA, 22 bp, Homo sapiens
tgtttacaaggagtttatattg

SEQ ID NO: 7766906 - DNA, 22 bp, Homo sapiens
tgtttacaaggagaatttgagg

SEQ ID NO: 7766907 - DNA, 22 bp, Homo sapiens
tgtttacacaatagtctctctc

SEQ ID NO: 7766908 - DNA, 22 bp, Homo sapiens
tgtttacaagccacttgttaag

SEQ ID NO: 7766909 - DNA, 22 bp, Homo sapiens
tgtttacaaaaccgtggtactg

SEQ ID NO: 7766910 - DNA, 22 bp, Homo sapiens
tgtttacagaaggcagacttcc

SEQ ID NO: 7766911 - DNA, 22 bp, Homo sapiens
tgtttacagaaggcagacttcc

SEQ ID NO: 7766912 - DNA, 22 bp, Homo sapiens
tgtttacagctgatcaggcatc

SEQ ID NO: 7766913 - DNA, 22 bp, Homo sapiens
tgtttacagcactgcacactgc

SEQ ID NO: 7766914 - DNA, 22 bp, Homo sapiens
tgtttacacttcaaggttaagg

SEQ ID NO: 7766915 - DNA, 22 bp, Homo sapiens
tgtttacagtttttagtaccct

SEQ ID NO: 7766916 - DNA, 22 bp, Homo sapiens
tgtttacatagtagctgccctg

SEQ ID NO: 7766917 - DNA, 22 bp, Homo sapiens
tgtttacagggtgattttacct

SEQ ID NO: 7766918 - DNA, 22 bp, Homo sapiens
tgtttacagggtgattttacct

SEQ ID NO: 7766919 - DNA, 22 bp, Homo sapiens
tgttctaagtgttttgttcatg

SEQ ID NO: 7766920 - DNA, 22 bp, Homo sapiens
tgttctctaagaaaagaagcat

SEQ ID NO: 7766921 - DNA, 22 bp, Homo sapiens
tgttctaggcaaaagctgattt

SEQ ID NO: 7766922 - DNA, 19 bp, Homo sapiens
tgttctagcggcaccaggc

SEQ ID NO: 7766923 - DNA, 22 bp, Homo sapiens
tgttctatgctctttaaggtga

SEQ ID NO: 7766924 - DNA, 22 bp, Homo sapiens
tgttctggctccttttaaatgt

SEQ ID NO: 7766925 - DNA, 22 bp, Homo sapiens
tgttctggggacagcgtcccat

SEQ ID NO: 7766926 - DNA, 22 bp, Homo sapiens
tgttctggggttgagagacaat

SEQ ID NO: 7766927 - DNA, 22 bp, Homo sapiens
tgttctggtgaggccatggggt

SEQ ID NO: 7766928 - DNA, 17 bp, Homo sapiens
tgttctcttcagaaatc

SEQ ID NO: 7766929 - DNA, 22 bp, Homo sapiens
tgttctctctggctgccagtac

SEQ ID NO: 7766930 - DNA, 22 bp, Homo sapiens
tgttctggagataagaggtaga

SEQ ID NO: 7766931 - DNA, 22 bp, Homo sapiens
tgttctggagataagaggtaga

SEQ ID NO: 7766932 - DNA, 22 bp, Homo sapiens
tgtttcattagtactgacaata

SEQ ID NO: 7766933 - DNA, 21 bp, Homo sapiens
tgtttcatgctattttcttgt

SEQ ID NO: 7766934 - DNA, 22 bp, Homo sapiens
tgtttcatgaaacatgtttagg

SEQ ID NO: 7766935 - DNA, 20 bp, Homo sapiens
tgtttcataagctgtcctat

SEQ ID NO: 7766936 - DNA, 22 bp, Homo sapiens
tgtttcaagtttgctcaaagga

SEQ ID NO: 7766937 - DNA, 22 bp, Homo sapiens
tgtttcactaagcagaaatata

SEQ ID NO: 7766938 - DNA, 22 bp, Homo sapiens
tgtttactatgatgtaacctat

SEQ ID NO: 7766939 - DNA, 22 bp, Homo sapiens
tgtttacatgcataagcttaag

SEQ ID NO: 7766940 - DNA, 22 bp, Homo sapiens
tgtttacatgcataagcttaag

SEQ ID NO: 7766941 - DNA, 22 bp, Homo sapiens
tgtttacatatttggtctcaga

SEQ ID NO: 7766942 - DNA, 22 bp, Homo sapiens
tgtttacatatttggtctcaga

SEQ ID NO: 7766943 - DNA, 22 bp, Homo sapiens
tgtttacatgcataagcttaag

SEQ ID NO: 7766944 - DNA, 22 bp, Homo sapiens
tgtttacatggaggttttcagc

SEQ ID NO: 7766945 - DNA, 19 bp, Homo sapiens
tgtttacatgtttcttcag

SEQ ID NO: 7766946 - DNA, 22 bp, Homo sapiens
tgtttgatgacgacattgtaga

SEQ ID NO: 7766947 - DNA, 22 bp, Homo sapiens
tgtttgaataacttggatatat

SEQ ID NO: 7766948 - DNA, 22 bp, Homo sapiens
tgttttctcttgaaaagcagtc

SEQ ID NO: 7766949 - DNA, 23 bp, Homo sapiens
tgtttctagaatcattgatgtct

SEQ ID NO: 7766950 - DNA, 23 bp, Homo sapiens
tgtttctagaatcattgatgtct

SEQ ID NO: 7766951 - DNA, 22 bp, Homo sapiens
tgtttccttctgtctctttgga

SEQ ID NO: 7766952 - DNA, 22 bp, Homo sapiens
tgtttcttgggtgctcacatca

SEQ ID NO: 7766953 - DNA, 22 bp, Homo sapiens
tgtggacatactaggcctaggc

SEQ ID NO: 7766954 - DNA, 22 bp, Homo sapiens
tgtggagcagcgtcacagcctt

SEQ ID NO: 7766955 - DNA, 22 bp, Homo sapiens
tccccctcattacctcattcaa

SEQ ID NO: 7766956 - DNA, 22 bp, Homo sapiens
tcccctccaactccaactatgg

SEQ ID NO: 7766957 - DNA, 22 bp, Homo sapiens
tcccctcccttccaacagagct

SEQ ID NO: 7766958 - DNA, 22 bp, Homo sapiens
tcccccactctaaaggagcctt

SEQ ID NO: 7766959 - DNA, 22 bp, Homo sapiens
tcccccactctaaaggagcctt

SEQ ID NO: 7766960 - DNA, 22 bp, Homo sapiens
tcccccaactcttagcactgta

SEQ ID NO: 7766961 - DNA, 22 bp, Homo sapiens
tcccccaaatgaatgaggaata

SEQ ID NO: 7766962 - DNA, 22 bp, Homo sapiens
tcccccaggctggagtgcagtg

SEQ ID NO: 7766963 - DNA, 22 bp, Homo sapiens
tcccccaggctggagtgcagtg

SEQ ID NO: 7766964 - DNA, 22 bp, Homo sapiens
tccccagggtccctgcttccat

SEQ ID NO: 7766965 - DNA, 22 bp, Homo sapiens
tccccagtcccggcggtgggtg

SEQ ID NO: 7766966 - DNA, 22 bp, Homo sapiens
tccccagtaagcctgcactgtg

SEQ ID NO: 7766967 - DNA, 22 bp, Homo sapiens
tccccaggtcctgtcggctcct

SEQ ID NO: 7766968 - DNA, 22 bp, Homo sapiens
tgtggatgaataaagtgcagac

SEQ ID NO: 7766969 - DNA, 20 bp, Homo sapiens
tgtggatgaggtaaggatag

SEQ ID NO: 7766970 - DNA, 22 bp, Homo sapiens
tgtggcagaactgggactcaaa

SEQ ID NO: 7766971 - DNA, 22 bp, Homo sapiens
tgtggcagaactgggactcaaa

SEQ ID NO: 7766972 - DNA, 22 bp, Homo sapiens
tgtggcagaaccagaattcaaa

SEQ ID NO: 7766973 - DNA, 22 bp, Homo sapiens
tgtggcagaaagcatgtggaca

SEQ ID NO: 7766974 - DNA, 22 bp, Homo sapiens
tgtggcacttacatcctagttt

SEQ ID NO: 7766975 - DNA, 22 bp, Homo sapiens
tgtggcagaaagcatgtggaca

SEQ ID NO: 7766976 - DNA, 21 bp, Homo sapiens
tgtggcagatgttgggaggca

SEQ ID NO: 7766977 - DNA, 21 bp, Homo sapiens
tgtggcagatgttgggaggca

SEQ ID NO: 7766978 - DNA, 22 bp, Homo sapiens
tgtggcagattttataaattgc

SEQ ID NO: 7766979 - DNA, 22 bp, Homo sapiens
tgtggcagagtaaggacccagt

SEQ ID NO: 7766980 - DNA, 21 bp, Homo sapiens
tgtggcagagacaatgctagt

SEQ ID NO: 7766981 - DNA, 22 bp, Homo sapiens
tgtggcagtataagagctagaa

SEQ ID NO: 7766982 - DNA, 22 bp, Homo sapiens
tgtggcagtaaaattgggcaac

SEQ ID NO: 7766983 - DNA, 19 bp, Homo sapiens
tgtggccatggttcagctg

SEQ ID NO: 7766984 - DNA, 22 bp, Homo sapiens
tgtgtaaaatctgattaatact

SEQ ID NO: 7766985 - DNA, 22 bp, Homo sapiens
tgtgtaaatttatttacataaa

SEQ ID NO: 7766986 - DNA, 21 bp, Homo sapiens
tgtgtaatatgtataagaata

SEQ ID NO: 7766987 - DNA, 21 bp, Homo sapiens
tgtgtaatatgtataagaata

SEQ ID NO: 7766988 - DNA, 19 bp, Homo sapiens
tgtggggagtcagggggct

SEQ ID NO: 7766989 - DNA, 22 bp, Homo sapiens
tgtgggtggcatcgtcctggcc

SEQ ID NO: 7766990 - DNA, 22 bp, Homo sapiens
tgtggtgagaaactggtagatt

SEQ ID NO: 7766991 - DNA, 22 bp, Homo sapiens
tgtgtctttggcgatgtctgga

SEQ ID NO: 7766992 - DNA, 19 bp, Homo sapiens
tgtgtgcaaatggaagcca

SEQ ID NO: 7766993 - DNA, 22 bp, Homo sapiens
tgtgtgaggtggttctgagaag

SEQ ID NO: 7766994 - DNA, 22 bp, Homo sapiens
ttagaggggctgctgaatggga

SEQ ID NO: 7766995 - DNA, 22 bp, Homo sapiens
ttagaggactgtaggtgggaat

SEQ ID NO: 7766996 - DNA, 22 bp, Homo sapiens
ttacttttctattcgatatgtg

SEQ ID NO: 7766997 - DNA, 19 bp, Homo sapiens
ttagaaactgttgacactg

SEQ ID NO: 7766998 - DNA, 22 bp, Homo sapiens
ttacattttggggtaaggataa

SEQ ID NO: 7766999 - DNA, 22 bp, Homo sapiens
ttactggctgggcctgagggct

SEQ ID NO: 7767000 - DNA, 22 bp, Homo sapiens
ttactgtaaaggtcacatggtg

SEQ ID NO: 7767001 - DNA, 22 bp, Homo sapiens
ttactgatggaacagagataga

SEQ ID NO: 7767002 - DNA, 22 bp, Homo sapiens
ttactgatacacataagaattt

SEQ ID NO: 7767003 - DNA, 22 bp, Homo sapiens
ttactttagatcatactgtgtg

SEQ ID NO: 7767004 - DNA, 21 bp, Homo sapiens
ttactttagaaattgcctttt

SEQ ID NO: 7767005 - DNA, 22 bp, Homo sapiens
ttactttagatcatactgtgtg

SEQ ID NO: 7767006 - DNA, 22 bp, Homo sapiens
ttacttgattgtggagtctgag

SEQ ID NO: 7767007 - DNA, 22 bp, Homo sapiens
ttacttgatgtatgatgagtag

SEQ ID NO: 7767008 - DNA, 22 bp, Homo sapiens
ttacttgacataaatgagttta

SEQ ID NO: 7767009 - DNA, 22 bp, Homo sapiens
ttacttcttgtctcatgcctat

SEQ ID NO: 7767010 - DNA, 18 bp, Homo sapiens
ttactgttatcaaaacag

SEQ ID NO: 7767011 - DNA, 22 bp, Homo sapiens
ttactgtttgaaaaatgaatgt

SEQ ID NO: 7767012 - DNA, 22 bp, Homo sapiens
ttacagtacagaaaataacaga

SEQ ID NO: 7767013 - DNA, 21 bp, Homo sapiens
ttacaggtcatccaagtcacc

SEQ ID NO: 7767014 - DNA, 22 bp, Homo sapiens
ttacatgacaaagctttggctc

SEQ ID NO: 7767015 - DNA, 19 bp, Homo sapiens
ttacatctgcaacactggt

SEQ ID NO: 7767016 - DNA, 22 bp, Homo sapiens
ttacatcactttacttaataat

SEQ ID NO: 7767017 - DNA, 22 bp, Homo sapiens
ttacatattatccaaaactgct

SEQ ID NO: 7767018 - DNA, 22 bp, Homo sapiens
ttacatattatccaaaactgct

SEQ ID NO: 7767019 - DNA, 22 bp, Homo sapiens
ttaattttctcatctgtgaaat

SEQ ID NO: 7767020 - DNA, 22 bp, Homo sapiens
ttacaaacaacagacatttatt

SEQ ID NO: 7767021 - DNA, 22 bp, Homo sapiens
ttacaaacaacagacatttatt

SEQ ID NO: 7767022 - DNA, 22 bp, Homo sapiens
ttaattttctcatctgtgaaat

SEQ ID NO: 7767023 - DNA, 21 bp, Homo sapiens
ttaatttattcatgatagcta

SEQ ID NO: 7767024 - DNA, 22 bp, Homo sapiens
ttacacaacatctgtattatta

SEQ ID NO: 7767025 - DNA, 22 bp, Homo sapiens
ttacacaatatatggtacttgg

SEQ ID NO: 7767026 - DNA, 22 bp, Homo sapiens
ttacacaacagtgcatcagcag

SEQ ID NO: 7767027 - DNA, 22 bp, Homo sapiens
ttacacaaagttagctcttgca

SEQ ID NO: 7767028 - DNA, 22 bp, Homo sapiens
ttacacaaacacattccagata

SEQ ID NO: 7767029 - DNA, 22 bp, Homo sapiens
ttacaaactgtcatatagtatt

SEQ ID NO: 7767030 - DNA, 22 bp, Homo sapiens
ttacaaactgtcatatagtatt

SEQ ID NO: 7767031 - DNA, 22 bp, Homo sapiens
ttacaaagaaaattaggcattt

SEQ ID NO: 7767032 - DNA, 22 bp, Homo sapiens
ttacaaactccagtgagtgagc

SEQ ID NO: 7767033 - DNA, 22 bp, Homo sapiens
ttacaaacaagatcttattctt

SEQ ID NO: 7767034 - DNA, 22 bp, Homo sapiens
ttacacagaaacactgttcaga

SEQ ID NO: 7767035 - DNA, 22 bp, Homo sapiens
ttacacaattactcactcctgg

SEQ ID NO: 7767036 - DNA, 22 bp, Homo sapiens
ttacacaattttattgacctaa

SEQ ID NO: 7767037 - DNA, 22 bp, Homo sapiens
ttacacagacatggcatcatga

SEQ ID NO: 7767038 - DNA, 22 bp, Homo sapiens
ttacacagtgaatttactcaag

SEQ ID NO: 7767039 - DNA, 22 bp, Homo sapiens
ttacacagtatccaaggttctt

SEQ ID NO: 7767040 - DNA, 22 bp, Homo sapiens
ttacacagtggttaagtctggg

SEQ ID NO: 7767041 - DNA, 22 bp, Homo sapiens
ttacacatgctttgtgtgtatg

SEQ ID NO: 7767042 - DNA, 22 bp, Homo sapiens
ttacacattgcagatcaaaatg

SEQ ID NO: 7767043 - DNA, 22 bp, Homo sapiens
ttaaggctgataagtcagatat

SEQ ID NO: 7767044 - DNA, 22 bp, Homo sapiens
ttaaggctgtggggattactgc

SEQ ID NO: 7767045 - DNA, 22 bp, Homo sapiens
ttaaggcattctcctactaata

SEQ ID NO: 7767046 - DNA, 22 bp, Homo sapiens
ttaaggcacagagaggttaagt

SEQ ID NO: 7767047 - DNA, 22 bp, Homo sapiens
ttaaggaattacgaaaatattt

SEQ ID NO: 7767048 - DNA, 22 bp, Homo sapiens
ttaagtgagcttgaataatctt

SEQ ID NO: 7767049 - DNA, 22 bp, Homo sapiens
ttaagtcactggacttgcctag

SEQ ID NO: 7767050 - DNA, 22 bp, Homo sapiens
ttaagtcacttatctaaagaca

SEQ ID NO: 7767051 - DNA, 22 bp, Homo sapiens
ttaagtcatttctgattataga

SEQ ID NO: 7767052 - DNA, 22 bp, Homo sapiens
ttaagtcaatatcaatctcagc

SEQ ID NO: 7767053 - DNA, 22 bp, Homo sapiens
ttaagtatatccatttgactgg

SEQ ID NO: 7767054 - DNA, 22 bp, Homo sapiens
ttaagtgtttagtaagagatgt

SEQ ID NO: 7767055 - DNA, 22 bp, Homo sapiens
ttaataaacaggtgcagctgaa

SEQ ID NO: 7767056 - DNA, 22 bp, Homo sapiens
ttaataaacaggtgcagctgaa

SEQ ID NO: 7767057 - DNA, 22 bp, Homo sapiens
ttaattagagctgatgttcata

SEQ ID NO: 7767058 - DNA, 22 bp, Homo sapiens
ttaattactaagcacaatgcaa

SEQ ID NO: 7767059 - DNA, 22 bp, Homo sapiens
ttaattagtagaggcatttagt

SEQ ID NO: 7767060 - DNA, 22 bp, Homo sapiens
ttaatttatacataatcacagg

SEQ ID NO: 7767061 - DNA, 22 bp, Homo sapiens
ttaatttatacataatcacagg

SEQ ID NO: 7767062 - DNA, 22 bp, Homo sapiens
ttaacattgtccttagcagatt

SEQ ID NO: 7767063 - DNA, 22 bp, Homo sapiens
ttaacattgtccttagcagatt

SEQ ID NO: 7767064 - DNA, 22 bp, Homo sapiens
ttaacagagaacatagaagtag

SEQ ID NO: 7767065 - DNA, 20 bp, Homo sapiens
ttaagaaaagcacatcctgc

SEQ ID NO: 7767066 - DNA, 22 bp, Homo sapiens
ttaagacatgtgagcataactt

SEQ ID NO: 7767067 - DNA, 22 bp, Homo sapiens
ttaagagaaggaatgacctagc

SEQ ID NO: 7767068 - DNA, 22 bp, Homo sapiens
ttaaggaaggtgaatttcttgg

SEQ ID NO: 7767069 - DNA, 22 bp, Homo sapiens
ttaaggaacaattctacacacc

SEQ ID NO: 7767070 - DNA, 22 bp, Homo sapiens
tgttttgtgcatttacaacatg

SEQ ID NO: 7767071 - DNA, 19 bp, Homo sapiens
tgttttgttaaagcagtcc

SEQ ID NO: 7767072 - DNA, 23 bp, Homo sapiens
tgttttcttgtcctggtataatt

SEQ ID NO: 7767073 - DNA, 22 bp, Homo sapiens
tgttttggttttcaccgagtcc

SEQ ID NO: 7767074 - DNA, 22 bp, Homo sapiens
tgttttgtagctaatagctatt

SEQ ID NO: 7767075 - DNA, 17 bp, Homo sapiens
tgttttctgctaccttt

SEQ ID NO: 7767076 - DNA, 17 bp, Homo sapiens
tgttttctgctaccttt

SEQ ID NO: 7767077 - DNA, 22 bp, Homo sapiens
tgttttctgggtggaaggtact

SEQ ID NO: 7767078 - DNA, 17 bp, Homo sapiens
tgttttctgctaccttt

SEQ ID NO: 7767079 - DNA, 22 bp, Homo sapiens
ttaaatattttcagcagggtca

SEQ ID NO: 7767080 - DNA, 22 bp, Homo sapiens
ttaaatattatgttgtctgcaa

SEQ ID NO: 7767081 - DNA, 22 bp, Homo sapiens
tgtttttaaaatgtcctggtta

SEQ ID NO: 7767082 - DNA, 22 bp, Homo sapiens
ttaaagcatgttgcttaacagg

SEQ ID NO: 7767083 - DNA, 22 bp, Homo sapiens
tgtttttcaaatattgctctgt

SEQ ID NO: 7767084 - DNA, 22 bp, Homo sapiens
ttaaagcatcacactattaatt

SEQ ID NO: 7767085 - DNA, 23 bp, Homo sapiens
tgtttttcattcacatgggctgt

SEQ ID NO: 7767086 - DNA, 22 bp, Homo sapiens
ttaacaaagtaacgggaaaaga

SEQ ID NO: 7767087 - DNA, 22 bp, Homo sapiens
ttaacaatagagtttcttcagg

SEQ ID NO: 7767088 - DNA, 22 bp, Homo sapiens
ttaacaatagagtttcttcagg

SEQ ID NO: 7767089 - DNA, 22 bp, Homo sapiens
ttaacacagggggagacaaagt

SEQ ID NO: 7767090 - DNA, 22 bp, Homo sapiens
ttaacacatatttatcaattgc

SEQ ID NO: 7767091 - DNA, 22 bp, Homo sapiens
ttaacaaaaatatcaggcatca

SEQ ID NO: 7767092 - DNA, 22 bp, Homo sapiens
ttaacaaaaatatcaggcatca

SEQ ID NO: 7767093 - DNA, 22 bp, Homo sapiens
ttaaatgtttaatctaacttga

SEQ ID NO: 7767094 - DNA, 22 bp, Homo sapiens
ttaaatgaggctgatgtagatt

SEQ ID NO: 7767095 - DNA, 22 bp, Homo sapiens
ttaaatgagatgttcagatatt

SEQ ID NO: 7767096 - DNA, 22 bp, Homo sapiens
ttaaatgagatgttcagatatt

SEQ ID NO: 7767097 - DNA, 22 bp, Homo sapiens
ttaaatgaacgagatatgcaac

SEQ ID NO: 7767098 - DNA, 22 bp, Homo sapiens
ttaaatgaacgagatatgcaac

SEQ ID NO: 7767099 - DNA, 22 bp, Homo sapiens
ttccacaggtttcagactgttc

SEQ ID NO: 7767100 - DNA, 20 bp, Homo sapiens
ttccctggaaggagaagcag

SEQ ID NO: 7767101 - DNA, 22 bp, Homo sapiens
ttccagagctttgcgcttggaa

SEQ ID NO: 7767102 - DNA, 22 bp, Homo sapiens
ttccctggccctggcacgctct

SEQ ID NO: 7767103 - DNA, 22 bp, Homo sapiens
ttcctaatggcaaaacatgttt

SEQ ID NO: 7767104 - DNA, 22 bp, Homo sapiens
ttcctaatgtctactttagttc

SEQ ID NO: 7767105 - DNA, 22 bp, Homo sapiens
ttcctaagtcctgccagcagtc

SEQ ID NO: 7767106 - DNA, 22 bp, Homo sapiens
ttcctcagcacaaagccaagat

SEQ ID NO: 7767107 - DNA, 22 bp, Homo sapiens
ttcctcagctcagcgagagaga

SEQ ID NO: 7767108 - DNA, 22 bp, Homo sapiens
ttcctcagagggcgctggggaa

SEQ ID NO: 7767109 - DNA, 22 bp, Homo sapiens
ttcctcagagagacagaaacta

SEQ ID NO: 7767110 - DNA, 22 bp, Homo sapiens
ttcctagaatggttagaaaata

SEQ ID NO: 7767111 - DNA, 22 bp, Homo sapiens
ttcctaggatggtgaagcagga

SEQ ID NO: 7767112 - DNA, 22 bp, Homo sapiens
ttcctatttccatgaaacacaa

SEQ ID NO: 7767113 - DNA, 22 bp, Homo sapiens
ttcctagggcagagccgctggg

SEQ ID NO: 7767114 - DNA, 22 bp, Homo sapiens
ttcctcagttagtgcctgaggc

SEQ ID NO: 7767115 - DNA, 22 bp, Homo sapiens
ttcctcatggggttccttcaga

SEQ ID NO: 7767116 - DNA, 22 bp, Homo sapiens
ttcctcagctgtgtcctggcga

SEQ ID NO: 7767117 - DNA, 22 bp, Homo sapiens
ttcctcagggaggctagcagta

SEQ ID NO: 7767118 - DNA, 22 bp, Homo sapiens
ttcctgtggccttacatctgtg

SEQ ID NO: 7767119 - DNA, 22 bp, Homo sapiens
ttcctgtgtgaccgagacagtg

SEQ ID NO: 7767120 - DNA, 22 bp, Homo sapiens
ttcctgtgtgttggtggcagaa

SEQ ID NO: 7767121 - DNA, 22 bp, Homo sapiens
ttctaagtcactcagattttgg

SEQ ID NO: 7767122 - DNA, 22 bp, Homo sapiens
ttctaagctctgaaataaatct

SEQ ID NO: 7767123 - DNA, 22 bp, Homo sapiens
ttccttctcagccctcgaggat

SEQ ID NO: 7767124 - DNA, 22 bp, Homo sapiens
ttctacaaatatttactgttcc

SEQ ID NO: 7767125 - DNA, 22 bp, Homo sapiens
ttctacaatatgaataatgaag

SEQ ID NO: 7767126 - DNA, 22 bp, Homo sapiens
ttctacaatatgaataatgaag

SEQ ID NO: 7767127 - DNA, 22 bp, Homo sapiens
ttctactttctctgtcattaaa

SEQ ID NO: 7767128 - DNA, 22 bp, Homo sapiens
ttctactttagcatgctcattc

SEQ ID NO: 7767129 - DNA, 22 bp, Homo sapiens
ttctacttctgacactgtttgt

SEQ ID NO: 7767130 - DNA, 22 bp, Homo sapiens
ttctaagtcctacctgaaagca

SEQ ID NO: 7767131 - DNA, 22 bp, Homo sapiens
ttctaagtgattctagctggac

SEQ ID NO: 7767132 - DNA, 19 bp, Homo sapiens
ttctaagttttgcttgctg

SEQ ID NO: 7767133 - DNA, 22 bp, Homo sapiens
ttctaggaagggaagcatggca

SEQ ID NO: 7767134 - DNA, 22 bp, Homo sapiens
ttctagagaactcgagtgcctt

SEQ ID NO: 7767135 - DNA, 22 bp, Homo sapiens
ttcatgtaataggatgtgttaa

SEQ ID NO: 7767136 - DNA, 22 bp, Homo sapiens
ttcatgtaacttttcttctcca

SEQ ID NO: 7767137 - DNA, 22 bp, Homo sapiens
ttcatgtccagaggaagttgag

SEQ ID NO: 7767138 - DNA, 22 bp, Homo sapiens
ttcatgtattgcattgtgtcct

SEQ ID NO: 7767139 - DNA, 22 bp, Homo sapiens
ttcatgtatttatcatgtaaat

SEQ ID NO: 7767140 - DNA, 22 bp, Homo sapiens
ttcatgtagtgtaatgtcttca

SEQ ID NO: 7767141 - DNA, 22 bp, Homo sapiens
ttcatgtagtgtaatgtcttca

SEQ ID NO: 7767142 - DNA, 22 bp, Homo sapiens
ttcatgtttcaattgttaatgt

SEQ ID NO: 7767143 - DNA, 22 bp, Homo sapiens
ttcatgtgtatggaacattttt

SEQ ID NO: 7767144 - DNA, 22 bp, Homo sapiens
ttcatgtgccagagctgaaaat

SEQ ID NO: 7767145 - DNA, 23 bp, Homo sapiens
ttcatgttccctccttctggtga

SEQ ID NO: 7767146 - DNA, 22 bp, Homo sapiens
ttcatgtgtctgtagcacatat

SEQ ID NO: 7767147 - DNA, 22 bp, Homo sapiens
ttcatgttcatgcttaggaaaa

SEQ ID NO: 7767148 - DNA, 21 bp, Homo sapiens
ttcatcattggtaaaaagtgg

SEQ ID NO: 7767149 - DNA, 23 bp, Homo sapiens
ttcatgatgattaatcagctaca

SEQ ID NO: 7767150 - DNA, 22 bp, Homo sapiens
ttcagtgtcaatttttaaatat

SEQ ID NO: 7767151 - DNA, 22 bp, Homo sapiens
ttcagtgtcacaagagcaagcc

SEQ ID NO: 7767152 - DNA, 22 bp, Homo sapiens
ttcatcatctacaaccaggacc

SEQ ID NO: 7767153 - DNA, 22 bp, Homo sapiens
ttcagtgtatcttgtcagggag

SEQ ID NO: 7767154 - DNA, 22 bp, Homo sapiens
ttcagtgtacagtgaagggatt

SEQ ID NO: 7767155 - DNA, 22 bp, Homo sapiens
ttcagtgtatattttttgagta

SEQ ID NO: 7767156 - DNA, 22 bp, Homo sapiens
ttcagtgacttacctggagcca

SEQ ID NO: 7767157 - DNA, 22 bp, Homo sapiens
ttcagtatgtgtaaactacttt

SEQ ID NO: 7767158 - DNA, 22 bp, Homo sapiens
ttcagtatgttggacgttatgt

SEQ ID NO: 7767159 - DNA, 22 bp, Homo sapiens
ttcagtatttgaaaccataggc

SEQ ID NO: 7767160 - DNA, 22 bp, Homo sapiens
ttcagtatgtgtaaactacttt

SEQ ID NO: 7767161 - DNA, 22 bp, Homo sapiens
ttcagtatgacagacgcattgg

SEQ ID NO: 7767162 - DNA, 22 bp, Homo sapiens
ttcagtatacattatctaattg

SEQ ID NO: 7767163 - DNA, 22 bp, Homo sapiens
ttcagtatctgcaaaatgggga

SEQ ID NO: 7767164 - DNA, 22 bp, Homo sapiens
ttcacagtggctaagttctgca

SEQ ID NO: 7767165 - DNA, 22 bp, Homo sapiens
ttcacagtggctaagttctgca

SEQ ID NO: 7767166 - DNA, 22 bp, Homo sapiens
ttcacagtggccctctctgagt

SEQ ID NO: 7767167 - DNA, 22 bp, Homo sapiens
ttcacagtggccctctctgagt

SEQ ID NO: 7767168 - DNA, 22 bp, Homo sapiens
ttcacagtggctgacaggctgg

SEQ ID NO: 7767169 - DNA, 22 bp, Homo sapiens
ttcacagtggctgtgccatttg

SEQ ID NO: 7767170 - DNA, 22 bp, Homo sapiens
ttcacattcagaaaaagcccgt

SEQ ID NO: 7767171 - DNA, 22 bp, Homo sapiens
ttcacattgaaggtgctttctt

SEQ ID NO: 7767172 - DNA, 22 bp, Homo sapiens
ttcacaaacaccagaatggcta

SEQ ID NO: 7767173 - DNA, 22 bp, Homo sapiens
ttcacaaaatggtttgttgatg

SEQ ID NO: 7767174 - DNA, 22 bp, Homo sapiens
ttcaatttgtgctaaggcaccg

SEQ ID NO: 7767175 - DNA, 22 bp, Homo sapiens
ttcaatttagtgatgttgttgg

SEQ ID NO: 7767176 - DNA, 22 bp, Homo sapiens
ttcaatttcataatatctagct

SEQ ID NO: 7767177 - DNA, 22 bp, Homo sapiens
ttcaagaagcccaaagactagc

SEQ ID NO: 7767178 - DNA, 22 bp, Homo sapiens
ttcaatgttaagaagaatatgt

SEQ ID NO: 7767179 - DNA, 22 bp, Homo sapiens
ttcaatgttaagaagaatatgt

SEQ ID NO: 7767180 - DNA, 22 bp, Homo sapiens
ttcaattcaattctaaatatat

SEQ ID NO: 7767181 - DNA, 22 bp, Homo sapiens
ttcacaataatgtccatcctct

SEQ ID NO: 7767182 - DNA, 22 bp, Homo sapiens
ttcacaaagctggagcatttcc

SEQ ID NO: 7767183 - DNA, 22 bp, Homo sapiens
ttcacaaagctggagcatttcc

SEQ ID NO: 7767184 - DNA, 22 bp, Homo sapiens
ttcacagtcacccttctccatg

SEQ ID NO: 7767185 - DNA, 22 bp, Homo sapiens
ttcacagtgctgcacctggctt

SEQ ID NO: 7767186 - DNA, 22 bp, Homo sapiens
ttcacagtgctgcacctggctt

SEQ ID NO: 7767187 - DNA, 22 bp, Homo sapiens
ttcacagtgagctatgtcttgt

SEQ ID NO: 7767188 - DNA, 22 bp, Homo sapiens
ttcacagtgagctatgtcttgt

SEQ ID NO: 7767189 - DNA, 22 bp, Homo sapiens
ttcaactttatgcatatgtatt

SEQ ID NO: 7767190 - DNA, 22 bp, Homo sapiens
ttcaactgggcggatctgagaa

SEQ ID NO: 7767191 - DNA, 22 bp, Homo sapiens
ttcaactttaggcaaagaaaac

SEQ ID NO: 7767192 - DNA, 22 bp, Homo sapiens
ttcaactcttcaagatcacatc

SEQ ID NO: 7767193 - DNA, 22 bp, Homo sapiens
ttcaactagaggtgattttgcc

SEQ ID NO: 7767194 - DNA, 22 bp, Homo sapiens
ttcaacatgttctacataaggg

SEQ ID NO: 7767195 - DNA, 22 bp, Homo sapiens
ttcaacatgctttatttctaaa

SEQ ID NO: 7767196 - DNA, 22 bp, Homo sapiens
ttcaacaatgcacttgagtata

SEQ ID NO: 7767197 - DNA, 22 bp, Homo sapiens
ttcaacaattaagtatcagcct

SEQ ID NO: 7767198 - DNA, 22 bp, Homo sapiens
ttcaacaattaagtatcagcct

SEQ ID NO: 7767199 - DNA, 22 bp, Homo sapiens
ttcaacaattaagtatcagcct

SEQ ID NO: 7767200 - DNA, 22 bp, Homo sapiens
ttagagtttttgtaagtacaat

SEQ ID NO: 7767201 - DNA, 22 bp, Homo sapiens
ttagataaaagtgttcaataaa

SEQ ID NO: 7767202 - DNA, 22 bp, Homo sapiens
ttagataaattaagactttaca

SEQ ID NO: 7767203 - DNA, 22 bp, Homo sapiens
ttagaggttctatgtgtctgga

SEQ ID NO: 7767204 - DNA, 21 bp, Homo sapiens
ttagagttgccattatatgta

SEQ ID NO: 7767205 - DNA, 22 bp, Homo sapiens
ttagagttttatcattgcctta

SEQ ID NO: 7767206 - DNA, 22 bp, Homo sapiens
ttcaacaagtcttttttcactg

SEQ ID NO: 7767207 - DNA, 22 bp, Homo sapiens
ttcaacaagtcttttttcactg

SEQ ID NO: 7767208 - DNA, 22 bp, Homo sapiens
ttcaacaagtatttattgagca

SEQ ID NO: 7767209 - DNA, 22 bp, Homo sapiens
ttcaacaagtagtacacacagt

SEQ ID NO: 7767210 - DNA, 22 bp, Homo sapiens
ttcaacaaatatttattgagct

SEQ ID NO: 7767211 - DNA, 22 bp, Homo sapiens
ttcaacaaggctgtcaaaagtt

SEQ ID NO: 7767212 - DNA, 22 bp, Homo sapiens
ttcaacaacttggttcaaatgg

SEQ ID NO: 7767213 - DNA, 22 bp, Homo sapiens
ttcaacaaggctgtcaaaagtt

SEQ ID NO: 7767214 - DNA, 17 bp, Homo sapiens
ttcaaagcttatcaagg

SEQ ID NO: 7767215 - DNA, 22 bp, Homo sapiens
ttcaaagtaccgtacttaatgg

SEQ ID NO: 7767216 - DNA, 22 bp, Homo sapiens
ttcaacaaactgttcacgaatg

SEQ ID NO: 7767217 - DNA, 22 bp, Homo sapiens
ttcaacaaaatatatttttcca

SEQ ID NO: 7767218 - DNA, 21 bp, Homo sapiens
ttcaacaaagggaataagttt

SEQ ID NO: 7767219 - DNA, 22 bp, Homo sapiens
ttcaacaaactgttcacgaatg

SEQ ID NO: 7767220 - DNA, 22 bp, Homo sapiens
ttctgtttactcagaaatacaa

SEQ ID NO: 7767221 - DNA, 22 bp, Homo sapiens
ttctgttttagaaataagtagt

SEQ ID NO: 7767222 - DNA, 22 bp, Homo sapiens
ttcttaaaacttatggacaggt

SEQ ID NO: 7767223 - DNA, 22 bp, Homo sapiens
ttcttacagagtttacagagcc

SEQ ID NO: 7767224 - DNA, 22 bp, Homo sapiens
ttcttacactcttaaaaatcat

SEQ ID NO: 7767225 - DNA, 22 bp, Homo sapiens
ttctgggcccaaccctagagtg

SEQ ID NO: 7767226 - DNA, 21 bp, Homo sapiens
ttctgggccggagaaggggcg

SEQ ID NO: 7767227 - DNA, 22 bp, Homo sapiens
ttctgggctgtccagagggtga

SEQ ID NO: 7767228 - DNA, 22 bp, Homo sapiens
ttctggtatgggaaatttcaag

SEQ ID NO: 7767229 - DNA, 22 bp, Homo sapiens
ttctttaaaatagtgagaaaga

SEQ ID NO: 7767230 - DNA, 22 bp, Homo sapiens
ttctttaaaatagtgagaaaga

SEQ ID NO: 7767231 - DNA, 22 bp, Homo sapiens
ttcttgatgtaccaacttggga

SEQ ID NO: 7767232 - DNA, 22 bp, Homo sapiens
ttcttgattcttccttgaagga

SEQ ID NO: 7767233 - DNA, 22 bp, Homo sapiens
ttctttaggtagatccagtttt

SEQ ID NO: 7767234 - DNA, 22 bp, Homo sapiens
ttctttatcagttactcatagg

SEQ ID NO: 7767235 - DNA, 22 bp, Homo sapiens
ttctttatcagttactcatagg

SEQ ID NO: 7767236 - DNA, 22 bp, Homo sapiens
ttctttatcagttactcatagg

SEQ ID NO: 7767237 - DNA, 22 bp, Homo sapiens
ttctttaccagtgaaatgttat

SEQ ID NO: 7767238 - DNA, 22 bp, Homo sapiens
ttctttaccactactcttccaa

SEQ ID NO: 7767239 - DNA, 20 bp, Homo sapiens
ttctttacgacctttctgca

SEQ ID NO: 7767240 - DNA, 22 bp, Homo sapiens
ttctttagcaacttggatttag

SEQ ID NO: 7767241 - DNA, 20 bp, Homo sapiens
ttcttgagccaaaaggcata

SEQ ID NO: 7767242 - DNA, 22 bp, Homo sapiens
ttcttctttcctataattaatt

SEQ ID NO: 7767243 - DNA, 22 bp, Homo sapiens
ttcttacagatttggtgaatga

SEQ ID NO: 7767244 - DNA, 22 bp, Homo sapiens
ttcttacagccctattactaaa

SEQ ID NO: 7767245 - DNA, 22 bp, Homo sapiens
ttcttacatattttcatatggt

SEQ ID NO: 7767246 - DNA, 22 bp, Homo sapiens
ttcttacatctataaagttggg

SEQ ID NO: 7767247 - DNA, 22 bp, Homo sapiens
ttcttacatcagtttattttgt

SEQ ID NO: 7767248 - DNA, 22 bp, Homo sapiens
ttcttacattactttacatgtg

SEQ ID NO: 7767249 - DNA, 17 bp, Homo sapiens
ttctgagccacttcctt

SEQ ID NO: 7767250 - DNA, 22 bp, Homo sapiens
ttctgagcctcattcatgaggc

SEQ ID NO: 7767251 - DNA, 22 bp, Homo sapiens
ttctgagattgttaggcactaa

SEQ ID NO: 7767252 - DNA, 22 bp, Homo sapiens
ttctgagattgttaggcactaa

SEQ ID NO: 7767253 - DNA, 19 bp, Homo sapiens
ttctgggcagcacatgaat

SEQ ID NO: 7767254 - DNA, 22 bp, Homo sapiens
ttctggaaaagaaagttaagat

SEQ ID NO: 7767255 - DNA, 22 bp, Homo sapiens
ttctgcttttagctaaactata

SEQ ID NO: 7767256 - DNA, 20 bp, Homo sapiens
ttctgcttgcaaatatcaag

SEQ ID NO: 7767257 - DNA, 22 bp, Homo sapiens
ttctgagaagggtgggtctggc

SEQ ID NO: 7767258 - DNA, 22 bp, Homo sapiens
ttctgacacattactacatgga

SEQ ID NO: 7767259 - DNA, 22 bp, Homo sapiens
ttctagttttgccttatcaaca

SEQ ID NO: 7767260 - DNA, 22 bp, Homo sapiens
ttctataagactcatatttctt

SEQ ID NO: 7767261 - DNA, 22 bp, Homo sapiens
ttctcttttagaggctccatga

SEQ ID NO: 7767262 - DNA, 22 bp, Homo sapiens
ttctgaagggctaagtgtctat

SEQ ID NO: 7767263 - DNA, 22 bp, Homo sapiens
ttctgaaggtcagcagcttggt

SEQ ID NO: 7767264 - DNA, 22 bp, Homo sapiens
ttctcttttcaccagttgctaa

SEQ ID NO: 7767265 - DNA, 22 bp, Homo sapiens
ttctcttttcaccagttgctaa

SEQ ID NO: 7767266 - DNA, 22 bp, Homo sapiens
ttctagtgtccttggacttgct

SEQ ID NO: 7767267 - DNA, 22 bp, Homo sapiens
ttctagttaaagtatgtattag

SEQ ID NO: 7767268 - DNA, 22 bp, Homo sapiens
ttctagttaaagtatgtattag

SEQ ID NO: 7767269 - DNA, 20 bp, Homo sapiens
ttctagtttggagttattaa

SEQ ID NO: 7767270 - DNA, 22 bp, Homo sapiens
ttctttcccagaagatatgttt

SEQ ID NO: 7767271 - DNA, 22 bp, Homo sapiens
ttctttcccagtagatgtgaaa

SEQ ID NO: 7767272 - DNA, 22 bp, Homo sapiens
ttctttccacagaggggatgat

SEQ ID NO: 7767273 - DNA, 22 bp, Homo sapiens
ttctttccaaccagatattggt

SEQ ID NO: 7767274 - DNA, 22 bp, Homo sapiens
ttctttattgagacttcattgt

SEQ ID NO: 7767275 - DNA, 22 bp, Homo sapiens
ttctttatgttaatgaatctat

SEQ ID NO: 7767276 - DNA, 22 bp, Homo sapiens
ttctttatgttaatgaatctat

SEQ ID NO: 7767277 - DNA, 22 bp, Homo sapiens
ttgaagaattaggacgtgagta

SEQ ID NO: 7767278 - DNA, 22 bp, Homo sapiens
ttctttccttgcctcagtgaag

SEQ ID NO: 7767279 - DNA, 22 bp, Homo sapiens
ttctttccccatggagttcgga

SEQ ID NO: 7767280 - DNA, 22 bp, Homo sapiens
ttgagcaatgtcactgaggctt

SEQ ID NO: 7767281 - DNA, 22 bp, Homo sapiens
ttgagcaagtgtacgagcaggc

SEQ ID NO: 7767282 - DNA, 22 bp, Homo sapiens
ttgagcaagcctgcggcgggaa

SEQ ID NO: 7767283 - DNA, 22 bp, Homo sapiens
ttgaatgaatagttgctagaag

SEQ ID NO: 7767284 - DNA, 22 bp, Homo sapiens
ttgaatgaatggtccatataga

SEQ ID NO: 7767285 - DNA, 20 bp, Homo sapiens
ttgaatgaatgtctggctca

SEQ ID NO: 7767286 - DNA, 22 bp, Homo sapiens
ttgaatgaattctacttccaga

SEQ ID NO: 7767287 - DNA, 22 bp, Homo sapiens
ttgaatgaatttgagcagagat

SEQ ID NO: 7767288 - DNA, 22 bp, Homo sapiens
ttgaatgaataaaagagtaagg

SEQ ID NO: 7767289 - DNA, 22 bp, Homo sapiens
ttgaatgatcctatctagcaca

SEQ ID NO: 7767290 - DNA, 22 bp, Homo sapiens
ttgaatgattaaagtcatctga

SEQ ID NO: 7767291 - DNA, 22 bp, Homo sapiens
ttgaatgagtgttttactcatg

SEQ ID NO: 7767292 - DNA, 22 bp, Homo sapiens
ttgaatgagtgttttactcatg

SEQ ID NO: 7767293 - DNA, 22 bp, Homo sapiens
ttgaatgaggaagagcactggc

SEQ ID NO: 7767294 - DNA, 16 bp, Homo sapiens
ttgaatgactgtgtgc

SEQ ID NO: 7767295 - DNA, 22 bp, Homo sapiens
ttgaatgaccatgatgcaaggg

SEQ ID NO: 7767296 - DNA, 22 bp, Homo sapiens
ttgaatgagaagttattgccat

SEQ ID NO: 7767297 - DNA, 22 bp, Homo sapiens
ttgaatgtaggtcttggtgagc

SEQ ID NO: 7767298 - DNA, 22 bp, Homo sapiens
ttgagatgacttaaatttggga

SEQ ID NO: 7767299 - DNA, 22 bp, Homo sapiens
ttgatcatctaagagtaatagt

SEQ ID NO: 7767300 - DNA, 22 bp, Homo sapiens
ttgatcatttttctggtaaaat

SEQ ID NO: 7767301 - DNA, 22 bp, Homo sapiens
ttgatcaagtgggaaatagtaa

SEQ ID NO: 7767302 - DNA, 22 bp, Homo sapiens
ttgatcttgtgatagttcaact

SEQ ID NO: 7767303 - DNA, 22 bp, Homo sapiens
ttgatctcttgtgtatggtaga

SEQ ID NO: 7767304 - DNA, 22 bp, Homo sapiens
ttgattaaaatgagacatcatt

SEQ ID NO: 7767305 - DNA, 22 bp, Homo sapiens
ttgattcaaaacaggaggtagg

SEQ ID NO: 7767306 - DNA, 22 bp, Homo sapiens
ttgattcaaaggggacaagtgg

SEQ ID NO: 7767307 - DNA, 20 bp, Homo sapiens
ttgattcaagggctgatgga

SEQ ID NO: 7767308 - DNA, 22 bp, Homo sapiens
ttgattcaaccacttaataatc

SEQ ID NO: 7767309 - DNA, 22 bp, Homo sapiens
ttgattcaaccacttaataatc

SEQ ID NO: 7767310 - DNA, 22 bp, Homo sapiens
ttgatgttgctcttaacagtat

SEQ ID NO: 7767311 - DNA, 22 bp, Homo sapiens
ttgattcatttattgagtgcct

SEQ ID NO: 7767312 - DNA, 22 bp, Homo sapiens
ttgattcatggacaggccaggt

SEQ ID NO: 7767313 - DNA, 22 bp, Homo sapiens
ttgattcatcttctaataccca

SEQ ID NO: 7767314 - DNA, 22 bp, Homo sapiens
ttgattcagagaagattggccc

SEQ ID NO: 7767315 - DNA, 22 bp, Homo sapiens
ttgattcagaaaaagatggaga

SEQ ID NO: 7767316 - DNA, 22 bp, Homo sapiens
ttgattcacaattaccaagact

SEQ ID NO: 7767317 - DNA, 18 bp, Homo sapiens
ttgattcatattaaccat

SEQ ID NO: 7767318 - DNA, 22 bp, Homo sapiens
ttgattcatatagatatgcgtg

SEQ ID NO: 7767319 - DNA, 22 bp, Homo sapiens
ttgattcagtaaagctaaattt

SEQ ID NO: 7767320 - DNA, 22 bp, Homo sapiens
ttgcaaagagtcatgtaagtca

SEQ ID NO: 7767321 - DNA, 22 bp, Homo sapiens
ttgcaaagagtcatgtaagtca

SEQ ID NO: 7767322 - DNA, 21 bp, Homo sapiens
ttgattttaggaagtttgtca

SEQ ID NO: 7767323 - DNA, 22 bp, Homo sapiens
ttgatttctattgagttcctgt

SEQ ID NO: 7767324 - DNA, 22 bp, Homo sapiens
ttgatttctattcagatgtaga

SEQ ID NO: 7767325 - DNA, 22 bp, Homo sapiens
ttgatttctattgagttcctgt

SEQ ID NO: 7767326 - DNA, 22 bp, Homo sapiens
ttgatttgattgtaatggctct

SEQ ID NO: 7767327 - DNA, 22 bp, Homo sapiens
ttgattttaaaatagtgacact

SEQ ID NO: 7767328 - DNA, 22 bp, Homo sapiens
ttgatttcaaaatatatgcttg

SEQ ID NO: 7767329 - DNA, 23 bp, Homo sapiens
ttgatttcaaatgcagagaacac

SEQ ID NO: 7767330 - DNA, 22 bp, Homo sapiens
ttgatttatagaatgttcaagc

SEQ ID NO: 7767331 - DNA, 22 bp, Homo sapiens
ttgcaaatattgtttacctttc

SEQ ID NO: 7767332 - DNA, 22 bp, Homo sapiens
ttgcaaatcacaagagcagagc

SEQ ID NO: 7767333 - DNA, 22 bp, Homo sapiens
ttgcaaatcagaagtatagatt

SEQ ID NO: 7767334 - DNA, 22 bp, Homo sapiens
ttgcaaatgaccattgccacat

SEQ ID NO: 7767335 - DNA, 22 bp, Homo sapiens
ttgcaaatctcttgtgtttggt

SEQ ID NO: 7767336 - DNA, 22 bp, Homo sapiens
ttgcaaatctttgccagaaggc

SEQ ID NO: 7767337 - DNA, 22 bp, Homo sapiens
ttgcaaatatgttctcctattc

SEQ ID NO: 7767338 - DNA, 22 bp, Homo sapiens
ttgcaaatattcccctaggtct

SEQ ID NO: 7767339 - DNA, 20 bp, Homo sapiens
ttgcaaatatcgtgggtcag

SEQ ID NO: 7767340 - DNA, 20 bp, Homo sapiens
ttgcaaatatctattgattg

SEQ ID NO: 7767341 - DNA, 22 bp, Homo sapiens
ttgcaaataatagcctgaaact

SEQ ID NO: 7767342 - DNA, 22 bp, Homo sapiens
ttgcaaataaacaagtatacat

SEQ ID NO: 7767343 - DNA, 22 bp, Homo sapiens
ttgcaaatgtgaataattacac

SEQ ID NO: 7767344 - DNA, 22 bp, Homo sapiens
ttgcaaatgtgagtttagactg

SEQ ID NO: 7767345 - DNA, 22 bp, Homo sapiens
ttgcaaatggaggcctggcagc

SEQ ID NO: 7767346 - DNA, 22 bp, Homo sapiens
ttgcaaatggtaccaagggtct

SEQ ID NO: 7767347 - DNA, 22 bp, Homo sapiens
ttgcaaatgggcaaagcagatc

SEQ ID NO: 7767348 - DNA, 22 bp, Homo sapiens
ttgcaaattatataagggatgc

SEQ ID NO: 7767349 - DNA, 22 bp, Homo sapiens
ttgcaaattaaagaggatagca

SEQ ID NO: 7767350 - DNA, 22 bp, Homo sapiens
ttgcaaatgttatactgccagt

SEQ ID NO: 7767351 - DNA, 22 bp, Homo sapiens
ttgcaaatgtttcataacagta

SEQ ID NO: 7767352 - DNA, 22 bp, Homo sapiens
ttgcaaatgtggttagggcttt

SEQ ID NO: 7767353 - DNA, 20 bp, Homo sapiens
ggacaggaagacaacctacc

SEQ ID NO: 7767354 - DNA, 22 bp, Homo sapiens
ggacatttagaacagagtattt

SEQ ID NO: 7767355 - DNA, 22 bp, Homo sapiens
ggacatggagctccatggaggc

SEQ ID NO: 7767356 - DNA, 22 bp, Homo sapiens
ggaagctgaacttagcaaggaa

SEQ ID NO: 7767357 - DNA, 22 bp, Homo sapiens
ggaagctccccaagcctgccct

SEQ ID NO: 7767358 - DNA, 22 bp, Homo sapiens
cacacagtggagtattactcag

SEQ ID NO: 7767359 - DNA, 22 bp, Homo sapiens
cacacaggagagtgctggaggt

SEQ ID NO: 7767360 - DNA, 22 bp, Homo sapiens
ggaccagctatcaatgccaggg

SEQ ID NO: 7767361 - DNA, 22 bp, Homo sapiens
cacacaggatgaagcagcagaa

SEQ ID NO: 7767362 - DNA, 22 bp, Homo sapiens
cacacagggagaaagaaagcct

SEQ ID NO: 7767363 - DNA, 22 bp, Homo sapiens
cacacaggtaagcctctttcaa

SEQ ID NO: 7767364 - DNA, 22 bp, Homo sapiens
ggagaagggacagactcagctt

SEQ ID NO: 7767365 - DNA, 22 bp, Homo sapiens
ggagaagggacagactcagctt

SEQ ID NO: 7767366 - DNA, 22 bp, Homo sapiens
caattctttcagctgcatttgt

SEQ ID NO: 7767367 - DNA, 22 bp, Homo sapiens
caattgtcagtgctgtttaaat

SEQ ID NO: 7767368 - DNA, 22 bp, Homo sapiens
caatttcactaataatatttac

SEQ ID NO: 7767369 - DNA, 22 bp, Homo sapiens
caatttcaatgaggccacaggg

SEQ ID NO: 7767370 - DNA, 22 bp, Homo sapiens
caatttcactaataatatttac

SEQ ID NO: 7767371 - DNA, 22 bp, Homo sapiens
caatttcaatacaaaatacatt

SEQ ID NO: 7767372 - DNA, 22 bp, Homo sapiens
caatttcaatacaaaatacatt

SEQ ID NO: 7767373 - DNA, 22 bp, Homo sapiens
caatttcatcttgtgcttcaat

SEQ ID NO: 7767374 - DNA, 22 bp, Homo sapiens
caatttcatggataaaagatgt

SEQ ID NO: 7767375 - DNA, 22 bp, Homo sapiens
caatttcatggataaaagatgt

SEQ ID NO: 7767376 - DNA, 22 bp, Homo sapiens
caatttccttcatagatgactg

SEQ ID NO: 7767377 - DNA, 22 bp, Homo sapiens
caatttcattaatagatataga

SEQ ID NO: 7767378 - DNA, 22 bp, Homo sapiens
caaggctctgcttctatcacat

SEQ ID NO: 7767379 - DNA, 22 bp, Homo sapiens
caaggctctggaccaaatccca

SEQ ID NO: 7767380 - DNA, 22 bp, Homo sapiens
caaggctgagaaattctgccct

SEQ ID NO: 7767381 - DNA, 22 bp, Homo sapiens
caaggctggctcacaataatga

SEQ ID NO: 7767382 - DNA, 22 bp, Homo sapiens
caatatataatgagtactttcc

SEQ ID NO: 7767383 - DNA, 22 bp, Homo sapiens
caatagttcggtcctgaaggcc

SEQ ID NO: 7767384 - DNA, 22 bp, Homo sapiens
caatatataggaacaacttagg

SEQ ID NO: 7767385 - DNA, 19 bp, Homo sapiens
caatatatagtgagtggat

SEQ ID NO: 7767386 - DNA, 22 bp, Homo sapiens
caatatataatgagtactttcc

SEQ ID NO: 7767387 - DNA, 22 bp, Homo sapiens
caatatataggaacaacttagg

SEQ ID NO: 7767388 - DNA, 22 bp, Homo sapiens
caatatataggaacaacttagg

SEQ ID NO: 7767389 - DNA, 22 bp, Homo sapiens
caatagaaaactcaatacttaa

SEQ ID NO: 7767390 - DNA, 22 bp, Homo sapiens
caaagtcagctgccagtcccaa

SEQ ID NO: 7767391 - DNA, 22 bp, Homo sapiens
caaagtatgaaccagtttctct

SEQ ID NO: 7767392 - DNA, 22 bp, Homo sapiens
caaagtcttcagttgattctga

SEQ ID NO: 7767393 - DNA, 22 bp, Homo sapiens
caaagtcatggggatgcaggtc

SEQ ID NO: 7767394 - DNA, 22 bp, Homo sapiens
caaagtcataaaacttgtaagt

SEQ ID NO: 7767395 - DNA, 17 bp, Homo sapiens
gctgccacctttggagc

SEQ ID NO: 7767396 - DNA, 22 bp, Homo sapiens
gctgccacgatctctgctgtag

SEQ ID NO: 7767397 - DNA, 22 bp, Homo sapiens
caaagtcttggtgatcaacttt

SEQ ID NO: 7767398 - DNA, 22 bp, Homo sapiens
caaagtgctaggattacaggcc

SEQ ID NO: 7767399 - DNA, 22 bp, Homo sapiens
caaagtgctaggattacaggcg

SEQ ID NO: 7767400 - DNA, 22 bp, Homo sapiens
gctgccctgtccggctctcctg

SEQ ID NO: 7767401 - DNA, 22 bp, Homo sapiens
caagaaatttcttaagaactaa

SEQ ID NO: 7767402 - DNA, 22 bp, Homo sapiens
caagaaacaccaatgactgctg

SEQ ID NO: 7767403 - DNA, 22 bp, Homo sapiens
caagaaactttattctgccata

SEQ ID NO: 7767404 - DNA, 22 bp, Homo sapiens
caagaaatgggatttgactgcc

SEQ ID NO: 7767405 - DNA, 22 bp, Homo sapiens
caagaaatgtttactgagcatc

SEQ ID NO: 7767406 - DNA, 22 bp, Homo sapiens
caagaaattctgttcagatagc

SEQ ID NO: 7767407 - DNA, 22 bp, Homo sapiens
caacacaggggttatgccatgg

SEQ ID NO: 7767408 - DNA, 22 bp, Homo sapiens
caacaatatgctgagtttttca

SEQ ID NO: 7767409 - DNA, 22 bp, Homo sapiens
caacaatatgctgagtttttca

SEQ ID NO: 7767410 - DNA, 22 bp, Homo sapiens
caacacattgaagctatgatga

SEQ ID NO: 7767411 - DNA, 22 bp, Homo sapiens
caacacattgaagctatgatga

SEQ ID NO: 7767412 - DNA, 22 bp, Homo sapiens
caacacaggttctgcaaaggaa

SEQ ID NO: 7767413 - DNA, 22 bp, Homo sapiens
caactatagggagagtggttaa

SEQ ID NO: 7767414 - DNA, 22 bp, Homo sapiens
caactacatccacactttgtta

SEQ ID NO: 7767415 - DNA, 22 bp, Homo sapiens
caactatagatcaaatgagttt

SEQ ID NO: 7767416 - DNA, 22 bp, Homo sapiens
caactactggtgctcaggaaat

SEQ ID NO: 7767417 - DNA, 22 bp, Homo sapiens
caacaacatgggattcatttct

SEQ ID NO: 7767418 - DNA, 22 bp, Homo sapiens
caaattttgtgtgttctctagt

SEQ ID NO: 7767419 - DNA, 22 bp, Homo sapiens
caaattttgtgtgttctctagt

SEQ ID NO: 7767420 - DNA, 22 bp, Homo sapiens
caacaatatgccagactcaatt

SEQ ID NO: 7767421 - DNA, 22 bp, Homo sapiens
caacaatatgccagactcaatt

SEQ ID NO: 7767422 - DNA, 22 bp, Homo sapiens
caaattttgtgtgttctctagt

SEQ ID NO: 7767423 - DNA, 22 bp, Homo sapiens
gctggagaaacaggaggaggaa

SEQ ID NO: 7767424 - DNA, 22 bp, Homo sapiens
caagaagttgacagccaggtga

SEQ ID NO: 7767425 - DNA, 22 bp, Homo sapiens
gctggacttagaggtggaaaag

SEQ ID NO: 7767426 - DNA, 22 bp, Homo sapiens
caagaatcttgcagcttagact

SEQ ID NO: 7767427 - DNA, 18 bp, Homo sapiens
caagaatctctaaagaag

SEQ ID NO: 7767428 - DNA, 22 bp, Homo sapiens
caagaattaagaattttgatgt

SEQ ID NO: 7767429 - DNA, 22 bp, Homo sapiens
caagacaagatctaagcatgct

SEQ ID NO: 7767430 - DNA, 22 bp, Homo sapiens
caagaatcaacattatttagtg

SEQ ID NO: 7767431 - DNA, 20 bp, Homo sapiens
gctggaagggctagagggct

SEQ ID NO: 7767432 - DNA, 22 bp, Homo sapiens
gctgctggcgctgggcgtccgg

SEQ ID NO: 7767433 - DNA, 18 bp, Homo sapiens
gctgcctgcattcctcac

SEQ ID NO: 7767434 - DNA, 22 bp, Homo sapiens
gctgcctgcctagttccacagt

SEQ ID NO: 7767435 - DNA, 22 bp, Homo sapiens
caagccatattttgaagaatga

SEQ ID NO: 7767436 - DNA, 22 bp, Homo sapiens
gctggctgaggtctagctcttt

SEQ ID NO: 7767437 - DNA, 22 bp, Homo sapiens
gctggctgaggtctagctcttt

SEQ ID NO: 7767438 - DNA, 22 bp, Homo sapiens
gctggctgagttctgtcgtctg

SEQ ID NO: 7767439 - DNA, 22 bp, Homo sapiens
caagccatactgggtgaaatca

SEQ ID NO: 7767440 - DNA, 17 bp, Homo sapiens
gctggctgacccatgcc

SEQ ID NO: 7767441 - DNA, 22 bp, Homo sapiens
gctggctgagcactggtttata

SEQ ID NO: 7767442 - DNA, 22 bp, Homo sapiens
gctggctgagatctgttttcct

SEQ ID NO: 7767443 - DNA, 22 bp, Homo sapiens
gctggctgacagagatttaaaa

SEQ ID NO: 7767444 - DNA, 22 bp, Homo sapiens
gctggctgacagatttggggtg

SEQ ID NO: 7767445 - DNA, 22 bp, Homo sapiens
gctggctcttcagtggagatag

SEQ ID NO: 7767446 - DNA, 22 bp, Homo sapiens
gctggctctttttgccgggctc

SEQ ID NO: 7767447 - DNA, 20 bp, Homo sapiens
gctggctgaactgaaagcaa

SEQ ID NO: 7767448 - DNA, 22 bp, Homo sapiens
gctggctgaatcttctgcaata

SEQ ID NO: 7767449 - DNA, 22 bp, Homo sapiens
gctggggagcaagagtagtgag

SEQ ID NO: 7767450 - DNA, 20 bp, Homo sapiens
gctgggctttgactgacaca

SEQ ID NO: 7767451 - DNA, 19 bp, Homo sapiens
gctggggaatggatattga

SEQ ID NO: 7767452 - DNA, 22 bp, Homo sapiens
gctgggctcagacctagtgaac

SEQ ID NO: 7767453 - DNA, 22 bp, Homo sapiens
caagccttggaaatccattctg

SEQ ID NO: 7767454 - DNA, 22 bp, Homo sapiens
cactgcactccagcctgggtga

SEQ ID NO: 7767455 - DNA, 22 bp, Homo sapiens
cactgcactccagcttgggcaa

SEQ ID NO: 7767456 - DNA, 22 bp, Homo sapiens
cactgcactccagcctgggtca

SEQ ID NO: 7767457 - DNA, 22 bp, Homo sapiens
ggctctgcttcagaaggctcat

SEQ ID NO: 7767458 - DNA, 22 bp, Homo sapiens
cacttgaactgtttgaatgaga

SEQ ID NO: 7767459 - DNA, 22 bp, Homo sapiens
cacttgaagtttgggggactct

SEQ ID NO: 7767460 - DNA, 22 bp, Homo sapiens
cacttgaagtgaattgctcacc

SEQ ID NO: 7767461 - DNA, 22 bp, Homo sapiens
cacttgaaatattaggggtgat

SEQ ID NO: 7767462 - DNA, 22 bp, Homo sapiens
cacttgaacccgggaggctgag

SEQ ID NO: 7767463 - DNA, 22 bp, Homo sapiens
cacttgaaagtaatggttgtgc

SEQ ID NO: 7767464 - DNA, 22 bp, Homo sapiens
cacttgaaaatcagaggaaatt

SEQ ID NO: 7767465 - DNA, 21 bp, Homo sapiens
cacttgaatggtgttttacaa

SEQ ID NO: 7767466 - DNA, 22 bp, Homo sapiens
cacttgaatggcattgttcctt

SEQ ID NO: 7767467 - DNA, 22 bp, Homo sapiens
cacttgaatgagaatttcctgg

SEQ ID NO: 7767468 - DNA, 22 bp, Homo sapiens
cacttgaatgaaagagactcct

SEQ ID NO: 7767469 - DNA, 17 bp, Homo sapiens
cacttgctggtctacct

SEQ ID NO: 7767470 - DNA, 22 bp, Homo sapiens
ggctggcaagtcagtgctgatg

SEQ ID NO: 7767471 - DNA, 22 bp, Homo sapiens
ggctggatgtactttggggctg

SEQ ID NO: 7767472 - DNA, 20 bp, Homo sapiens
ggctctggaatctggtgggc

SEQ ID NO: 7767473 - DNA, 22 bp, Homo sapiens
cacttaaatctgttgagaaaaa

SEQ ID NO: 7767474 - DNA, 22 bp, Homo sapiens
cacttagatactagatcacaaa

SEQ ID NO: 7767475 - DNA, 22 bp, Homo sapiens
cacttagaaaacttgagcaagt

SEQ ID NO: 7767476 - DNA, 22 bp, Homo sapiens
cacttagagccagatgcatagt

SEQ ID NO: 7767477 - DNA, 22 bp, Homo sapiens
cacttcaaggaatatctagaaa

SEQ ID NO: 7767478 - DNA, 21 bp, Homo sapiens
cactcaataaatgtcatatgc

SEQ ID NO: 7767479 - DNA, 22 bp, Homo sapiens
cactcaatacaatggttggcac

SEQ ID NO: 7767480 - DNA, 23 bp, Homo sapiens
cacggcagcctccgagggtgctg

SEQ ID NO: 7767481 - DNA, 22 bp, Homo sapiens
ggccagggccaaggctttccca

SEQ ID NO: 7767482 - DNA, 22 bp, Homo sapiens
cactatatgcctttgaaataca

SEQ ID NO: 7767483 - DNA, 22 bp, Homo sapiens
cactgcactccagcctgggaga

SEQ ID NO: 7767484 - DNA, 22 bp, Homo sapiens
cactgcactccagcctgggaga

SEQ ID NO: 7767485 - DNA, 22 bp, Homo sapiens
cactgcactccagcctggcgac

SEQ ID NO: 7767486 - DNA, 22 bp, Homo sapiens
cactgcaacctccacctcctgg

SEQ ID NO: 7767487 - DNA, 22 bp, Homo sapiens
cactccctctagttgcattctg

SEQ ID NO: 7767488 - DNA, 22 bp, Homo sapiens
cactcccttcaggagcctagga

SEQ ID NO: 7767489 - DNA, 22 bp, Homo sapiens
cacctgctgagctgctgggggt

SEQ ID NO: 7767490 - DNA, 22 bp, Homo sapiens
ggccagggaggagaggcccctg

SEQ ID NO: 7767491 - DNA, 22 bp, Homo sapiens
ggccaggctggtctcagacttc

SEQ ID NO: 7767492 - DNA, 22 bp, Homo sapiens
ggccaggctggtctcagacttc

SEQ ID NO: 7767493 - DNA, 20 bp, Homo sapiens
caccaggcgctctgagaaca

SEQ ID NO: 7767494 - DNA, 22 bp, Homo sapiens
caccaggcacatagtaggcact

SEQ ID NO: 7767495 - DNA, 22 bp, Homo sapiens
caccaggctgaaccagagggga

SEQ ID NO: 7767496 - DNA, 22 bp, Homo sapiens
caccaggctgcccaggacaggg

SEQ ID NO: 7767497 - DNA, 22 bp, Homo sapiens
caccaggctggagtgcagaggt

SEQ ID NO: 7767498 - DNA, 22 bp, Homo sapiens
cacctgcccagcacctgggatc

SEQ ID NO: 7767499 - DNA, 22 bp, Homo sapiens
cacctgccccagtcttggagct

SEQ ID NO: 7767500 - DNA, 22 bp, Homo sapiens
caccactggaggtcttggcttt

SEQ ID NO: 7767501 - DNA, 22 bp, Homo sapiens
caccactgcttcctgccatctg

SEQ ID NO: 7767502 - DNA, 22 bp, Homo sapiens
caccactgtatccctagcactt

SEQ ID NO: 7767503 - DNA, 22 bp, Homo sapiens
caccagctccaccagggcaggt

SEQ ID NO: 7767504 - DNA, 22 bp, Homo sapiens
cacatgtgtgctgaggactgtg

SEQ ID NO: 7767505 - DNA, 22 bp, Homo sapiens
cacattcaattacacagatagg

SEQ ID NO: 7767506 - DNA, 22 bp, Homo sapiens
cacatgaaggctggggtcgtga

SEQ ID NO: 7767507 - DNA, 16 bp, Homo sapiens
cacatatatttatatg

SEQ ID NO: 7767508 - DNA, 22 bp, Homo sapiens
cacatgaggtggagatgaatga

SEQ ID NO: 7767509 - DNA, 22 bp, Homo sapiens
cacatgaggtgacttccaagct

SEQ ID NO: 7767510 - DNA, 22 bp, Homo sapiens
cacatgaggtgacttccaagct

SEQ ID NO: 7767511 - DNA, 19 bp, Homo sapiens
cacatgagggctgagggac

SEQ ID NO: 7767512 - DNA, 22 bp, Homo sapiens
cacatgagagcccccaagagca

SEQ ID NO: 7767513 - DNA, 22 bp, Homo sapiens
cacatgagacaattaaagactt

SEQ ID NO: 7767514 - DNA, 22 bp, Homo sapiens
ggcaatagttgtgggttcttta

SEQ ID NO: 7767515 - DNA, 22 bp, Homo sapiens
ggcaagtgtgagaagggactgg

SEQ ID NO: 7767516 - DNA, 16 bp, Homo sapiens
cacatatatttatatg

SEQ ID NO: 7767517 - DNA, 22 bp, Homo sapiens
cacatatatgaaatgaggaatt

SEQ ID NO: 7767518 - DNA, 22 bp, Homo sapiens
cacatatatgaaatgaggaatt

SEQ ID NO: 7767519 - DNA, 22 bp, Homo sapiens
ggcaatgtttcgatgggagctg

SEQ ID NO: 7767520 - DNA, 22 bp, Homo sapiens
cacatgcaggagccaatgtaca

SEQ ID NO: 7767521 - DNA, 22 bp, Homo sapiens
cacatgagtgtaggaagaggga

SEQ ID NO: 7767522 - DNA, 22 bp, Homo sapiens
cacatgagtcctgccaggtatg

SEQ ID NO: 7767523 - DNA, 22 bp, Homo sapiens
cacatgagtcctgccaggtatg

SEQ ID NO: 7767524 - DNA, 22 bp, Homo sapiens
cacatgagtgagaacatgcagt

SEQ ID NO: 7767525 - DNA, 20 bp, Homo sapiens
ggcagatgcagagctatgca

SEQ ID NO: 7767526 - DNA, 18 bp, Homo sapiens
ggcagatgacaggagaga

SEQ ID NO: 7767527 - DNA, 22 bp, Homo sapiens
ggcagatggaagaggctgggtc

SEQ ID NO: 7767528 - DNA, 22 bp, Homo sapiens
ggcagatgacagaccagtatgt

SEQ ID NO: 7767529 - DNA, 22 bp, Homo sapiens
ggcaaggggtcaggctgagaca

SEQ ID NO: 7767530 - DNA, 22 bp, Homo sapiens
cacagtgcgaaagaaacccagc

SEQ ID NO: 7767531 - DNA, 19 bp, Homo sapiens
cacagtgcagccatttctc

SEQ ID NO: 7767532 - DNA, 22 bp, Homo sapiens
cacagtgactggcacatagtaa

SEQ ID NO: 7767533 - DNA, 22 bp, Homo sapiens
cacagtgacctctttaaaaggg

SEQ ID NO: 7767534 - DNA, 22 bp, Homo sapiens
cacagtgaatttcaagtgttgt

SEQ ID NO: 7767535 - DNA, 22 bp, Homo sapiens
cacagtgattgatttttacttt

SEQ ID NO: 7767536 - DNA, 18 bp, Homo sapiens
cacagtgacttctgatac

SEQ ID NO: 7767537 - DNA, 22 bp, Homo sapiens
cacagtgcaatcggccacaaat

SEQ ID NO: 7767538 - DNA, 22 bp, Homo sapiens
cacagtgcactaagctccgggg

SEQ ID NO: 7767539 - DNA, 22 bp, Homo sapiens
cacagtgcatgatgggcagaag

SEQ ID NO: 7767540 - DNA, 22 bp, Homo sapiens
cacagtctcctctcttagcctg

SEQ ID NO: 7767541 - DNA, 22 bp, Homo sapiens
cacagtaaggtatcccagtgaa

SEQ ID NO: 7767542 - DNA, 22 bp, Homo sapiens
cacagtgaagcatgcagacatc

SEQ ID NO: 7767543 - DNA, 22 bp, Homo sapiens
cacagtaaccccaggactggga

SEQ ID NO: 7767544 - DNA, 22 bp, Homo sapiens
cacagtaactcctgacccctcg

SEQ ID NO: 7767545 - DNA, 22 bp, Homo sapiens
cacagtaactggcgtgtagtaa

SEQ ID NO: 7767546 - DNA, 22 bp, Homo sapiens
cacagtaagaaatgaagaggta

SEQ ID NO: 7767547 - DNA, 22 bp, Homo sapiens
cacaggtgtatgaatatgtcca

SEQ ID NO: 7767548 - DNA, 21 bp, Homo sapiens
cacaggtgggtcagtgaggcc

SEQ ID NO: 7767549 - DNA, 22 bp, Homo sapiens
cacaggtgtgtcctggtcttgt

SEQ ID NO: 7767550 - DNA, 23 bp, Homo sapiens
cacaggcagaaatcaagacggta

SEQ ID NO: 7767551 - DNA, 22 bp, Homo sapiens
cacaggcaggaggttctccagt

SEQ ID NO: 7767552 - DNA, 22 bp, Homo sapiens
cacaggcaggaggttctccagt

SEQ ID NO: 7767553 - DNA, 22 bp, Homo sapiens
cacaggcacgcctctggccagg

SEQ ID NO: 7767554 - DNA, 22 bp, Homo sapiens
cacaggcacccctgactgctca

SEQ ID NO: 7767555 - DNA, 22 bp, Homo sapiens
ggagagcctccacggcttctgt

SEQ ID NO: 7767556 - DNA, 18 bp, Homo sapiens
cacaggagccacactcac

SEQ ID NO: 7767557 - DNA, 22 bp, Homo sapiens
cacaggaggttaggaagtggtc

SEQ ID NO: 7767558 - DNA, 22 bp, Homo sapiens
cacaggagtgctgctattgttg

SEQ ID NO: 7767559 - DNA, 22 bp, Homo sapiens
cacaggccaataccctctctct

SEQ ID NO: 7767560 - DNA, 20 bp, Homo sapiens
cacaggccccaagacctgta

SEQ ID NO: 7767561 - DNA, 22 bp, Homo sapiens
cacaggccagtaagactgtgtt

SEQ ID NO: 7767562 - DNA, 20 bp, Homo sapiens
cacaggccttgtgagcagac

SEQ ID NO: 7767563 - DNA, 22 bp, Homo sapiens
cacaggtaatagcctaggctat

SEQ ID NO: 7767564 - DNA, 22 bp, Homo sapiens
cacagggctttgatggctgagt

SEQ ID NO: 7767565 - DNA, 22 bp, Homo sapiens
gtagggagcccagagcccagtg

SEQ ID NO: 7767566 - DNA, 22 bp, Homo sapiens
gtcacagatctcttgagtcaag

SEQ ID NO: 7767567 - DNA, 22 bp, Homo sapiens
cagcatctcccaggcatttgcc

SEQ ID NO: 7767568 - DNA, 22 bp, Homo sapiens
cagcatcctttgctggtttccc

SEQ ID NO: 7767569 - DNA, 22 bp, Homo sapiens
gtcagcagcatgtttaatcaaa

SEQ ID NO: 7767570 - DNA, 22 bp, Homo sapiens
gtcagcaaaaaatttatgtgag

SEQ ID NO: 7767571 - DNA, 22 bp, Homo sapiens
gtcagcaaggaaaatgtgtcac

SEQ ID NO: 7767572 - DNA, 22 bp, Homo sapiens
cagccaggcccagatcatgctg

SEQ ID NO: 7767573 - DNA, 22 bp, Homo sapiens
cagccaggagcctctgcaacta

SEQ ID NO: 7767574 - DNA, 22 bp, Homo sapiens
cagccaggactcccatttagga

SEQ ID NO: 7767575 - DNA, 22 bp, Homo sapiens
cagccaggacagggaaactagt

SEQ ID NO: 7767576 - DNA, 22 bp, Homo sapiens
cagccagctggtgcggcagagc

SEQ ID NO: 7767577 - DNA, 22 bp, Homo sapiens
gtccagaggtccaggatcaagg

SEQ ID NO: 7767578 - DNA, 20 bp, Homo sapiens
gtccagagtaatgtgctgac

SEQ ID NO: 7767579 - DNA, 20 bp, Homo sapiens
gtccagagtaatgtgctgac

SEQ ID NO: 7767580 - DNA, 22 bp, Homo sapiens
gtccagagggctgcaggatgct

SEQ ID NO: 7767581 - DNA, 22 bp, Homo sapiens
gtccagagggctgcaggatgct

SEQ ID NO: 7767582 - DNA, 22 bp, Homo sapiens
gtccagagggctgcaggatgct

SEQ ID NO: 7767583 - DNA, 22 bp, Homo sapiens
gtccagagatggacgagcagat

SEQ ID NO: 7767584 - DNA, 22 bp, Homo sapiens
gtccagagaggcaggaggctac

SEQ ID NO: 7767585 - DNA, 22 bp, Homo sapiens
gtccagagaggcaggaggctac

SEQ ID NO: 7767586 - DNA, 22 bp, Homo sapiens
gtccagagagtaaagggggtaa

SEQ ID NO: 7767587 - DNA, 22 bp, Homo sapiens
cagcatctctttttgcattcct

SEQ ID NO: 7767588 - DNA, 22 bp, Homo sapiens
gtagaaaaagcagtaagtctca

SEQ ID NO: 7767589 - DNA, 22 bp, Homo sapiens
gtagaaaaagcagtaagtctca

SEQ ID NO: 7767590 - DNA, 22 bp, Homo sapiens
gtactttagagtaaaatagacc

SEQ ID NO: 7767591 - DNA, 22 bp, Homo sapiens
gtagaaaattaggatgaggctt

SEQ ID NO: 7767592 - DNA, 22 bp, Homo sapiens
gtactttaaatcaatgtagatt

SEQ ID NO: 7767593 - DNA, 22 bp, Homo sapiens
gtaggcaggtggaggagtgaag

SEQ ID NO: 7767594 - DNA, 22 bp, Homo sapiens
gtaggctgtgtgaggctagaga

SEQ ID NO: 7767595 - DNA, 22 bp, Homo sapiens
gtacacactgtttgatcatttc

SEQ ID NO: 7767596 - DNA, 22 bp, Homo sapiens
cagcagcctagaagctctacca

SEQ ID NO: 7767597 - DNA, 22 bp, Homo sapiens
gtactaaaaaatgatcagtttg

SEQ ID NO: 7767598 - DNA, 22 bp, Homo sapiens
gtactaaacagagaaccaatat

SEQ ID NO: 7767599 - DNA, 22 bp, Homo sapiens
cagcagccgagagggggctctg

SEQ ID NO: 7767600 - DNA, 22 bp, Homo sapiens
cagcagcctacaatgcacagaa

SEQ ID NO: 7767601 - DNA, 22 bp, Homo sapiens
cagcagcctacaatgcacagaa

SEQ ID NO: 7767602 - DNA, 22 bp, Homo sapiens
cagcagccactagagggctcac

SEQ ID NO: 7767603 - DNA, 22 bp, Homo sapiens
cagcagcagccccaggaaggtt

SEQ ID NO: 7767604 - DNA, 22 bp, Homo sapiens
cagcaaaatttgaggattgcct

SEQ ID NO: 7767605 - DNA, 22 bp, Homo sapiens
cagcaaaggtagaagcacagga

SEQ ID NO: 7767606 - DNA, 22 bp, Homo sapiens
cagattaagtgctcaacagtgt

SEQ ID NO: 7767607 - DNA, 22 bp, Homo sapiens
cagattagttgtgctatggcct

SEQ ID NO: 7767608 - DNA, 19 bp, Homo sapiens
cagccctcttaccactgtg

SEQ ID NO: 7767609 - DNA, 23 bp, Homo sapiens
gtgagcagcaccatgaggctaga

SEQ ID NO: 7767610 - DNA, 22 bp, Homo sapiens
cagccctgtctatgactgatga

SEQ ID NO: 7767611 - DNA, 22 bp, Homo sapiens
cagccctgaaacaacctcctct

SEQ ID NO: 7767612 - DNA, 22 bp, Homo sapiens
cagccctgtccctgagggacct

SEQ ID NO: 7767613 - DNA, 22 bp, Homo sapiens
cagccctgtccaatgtctgctc

SEQ ID NO: 7767614 - DNA, 20 bp, Homo sapiens
ggggttggctggcacaggga

SEQ ID NO: 7767615 - DNA, 22 bp, Homo sapiens
gggtaatgaacaggtggcagag

SEQ ID NO: 7767616 - DNA, 22 bp, Homo sapiens
ggggtgaggtttatgttctggg

SEQ ID NO: 7767617 - DNA, 22 bp, Homo sapiens
ggggtgagctgggcctgtgcct

SEQ ID NO: 7767618 - DNA, 22 bp, Homo sapiens
ggggccttttctgaatgtggaa

SEQ ID NO: 7767619 - DNA, 22 bp, Homo sapiens
ggggaggaagctctcagttcca

SEQ ID NO: 7767620 - DNA, 22 bp, Homo sapiens
ggggcagctaccggaagtaggg

SEQ ID NO: 7767621 - DNA, 22 bp, Homo sapiens
ggggcctctgcagtcacgctgg

SEQ ID NO: 7767622 - DNA, 21 bp, Homo sapiens
ggggcctctccacacagccgg

SEQ ID NO: 7767623 - DNA, 22 bp, Homo sapiens
cagagccagcccactgttcccg

SEQ ID NO: 7767624 - DNA, 22 bp, Homo sapiens
cagagccacttggagatgagaa

SEQ ID NO: 7767625 - DNA, 21 bp, Homo sapiens
gggctggaggatgggaagccc

SEQ ID NO: 7767626 - DNA, 19 bp, Homo sapiens
gggctggagggatagagcc

SEQ ID NO: 7767627 - DNA, 22 bp, Homo sapiens
gggctggaggtgagcaggacag

SEQ ID NO: 7767628 - DNA, 19 bp, Homo sapiens
gggctggagggatagagcc

SEQ ID NO: 7767629 - DNA, 22 bp, Homo sapiens
gggctgtgggacccggcacttt

SEQ ID NO: 7767630 - DNA, 22 bp, Homo sapiens
gggctgtgaggtgagaacttac

SEQ ID NO: 7767631 - DNA, 22 bp, Homo sapiens
gggctgtgagagtggggctgct

SEQ ID NO: 7767632 - DNA, 22 bp, Homo sapiens
gggctggagttgggaagacaaa

SEQ ID NO: 7767633 - DNA, 22 bp, Homo sapiens
cagatgaggacagatgactggg

SEQ ID NO: 7767634 - DNA, 23 bp, Homo sapiens
cagatgaggttggcagcatggtc

SEQ ID NO: 7767635 - DNA, 22 bp, Homo sapiens
cagatgagagtggccagggttc

SEQ ID NO: 7767636 - DNA, 19 bp, Homo sapiens
cagatgagaaaagtgaggt

SEQ ID NO: 7767637 - DNA, 22 bp, Homo sapiens
ggtcaagtaacaaatcaggagc

SEQ ID NO: 7767638 - DNA, 22 bp, Homo sapiens
ggtcaagacgggctctgccctt

SEQ ID NO: 7767639 - DNA, 22 bp, Homo sapiens
cagatatgctgagactcctgtg

SEQ ID NO: 7767640 - DNA, 22 bp, Homo sapiens
ggtcctggcagctctgtgtcca

SEQ ID NO: 7767641 - DNA, 22 bp, Homo sapiens
ggtcctggaagtgtaagtggca

SEQ ID NO: 7767642 - DNA, 22 bp, Homo sapiens
cagatgctaagttatcagcagg

SEQ ID NO: 7767643 - DNA, 20 bp, Homo sapiens
gggtgtgggcccggccaggc

SEQ ID NO: 7767644 - DNA, 20 bp, Homo sapiens
gggtgtgggcccggccaggc

SEQ ID NO: 7767645 - DNA, 22 bp, Homo sapiens
gggttgaggcggatgtcggcgg

SEQ ID NO: 7767646 - DNA, 19 bp, Homo sapiens
ggtatatgggcctcacttg

SEQ ID NO: 7767647 - DNA, 22 bp, Homo sapiens
ggtataaatgatcagatcgctg

SEQ ID NO: 7767648 - DNA, 22 bp, Homo sapiens
ggtagtcggccttgccctgggc

SEQ ID NO: 7767649 - DNA, 22 bp, Homo sapiens
gggtaggaaatccagaggtggc

SEQ ID NO: 7767650 - DNA, 22 bp, Homo sapiens
gggtaggaaatccagaggtggc

SEQ ID NO: 7767651 - DNA, 22 bp, Homo sapiens
gggtccaggtcttcaggcagag

SEQ ID NO: 7767652 - DNA, 22 bp, Homo sapiens
gggtccaggtcttcaggcagag

SEQ ID NO: 7767653 - DNA, 21 bp, Homo sapiens
gggtcctgggatgggatccag

SEQ ID NO: 7767654 - DNA, 22 bp, Homo sapiens
gggtcctgcgtgggcccaggac

SEQ ID NO: 7767655 - DNA, 22 bp, Homo sapiens
gggtgggatctgtggagcctca

SEQ ID NO: 7767656 - DNA, 18 bp, Homo sapiens
gggtcctgtgggagacag

SEQ ID NO: 7767657 - DNA, 18 bp, Homo sapiens
gggtccccagctgcaggg

SEQ ID NO: 7767658 - DNA, 22 bp, Homo sapiens
gggatgagagctgggacagaag

SEQ ID NO: 7767659 - DNA, 22 bp, Homo sapiens
cagagcagaagcggtcctcaca

SEQ ID NO: 7767660 - DNA, 22 bp, Homo sapiens
gggatgagagtagggtgtgaaa

SEQ ID NO: 7767661 - DNA, 22 bp, Homo sapiens
cagagacaacctggtagagaaa

SEQ ID NO: 7767662 - DNA, 22 bp, Homo sapiens
cagagacacttaacaggaatgg

SEQ ID NO: 7767663 - DNA, 22 bp, Homo sapiens
cagagaacttagctagttttcc

SEQ ID NO: 7767664 - DNA, 22 bp, Homo sapiens
cagagaagaaagtgactataat

SEQ ID NO: 7767665 - DNA, 22 bp, Homo sapiens
cagagaagagtctggcctctct

SEQ ID NO: 7767666 - DNA, 20 bp, Homo sapiens
gggaggcattggtccctcac

SEQ ID NO: 7767667 - DNA, 22 bp, Homo sapiens
gggaggcatgtgttatccactt

SEQ ID NO: 7767668 - DNA, 22 bp, Homo sapiens
cagacttgacggcagctgcttt

SEQ ID NO: 7767669 - DNA, 20 bp, Homo sapiens
cagagcagtgcccaggcggc

SEQ ID NO: 7767670 - DNA, 19 bp, Homo sapiens
cagagcagtggttcctgaa

SEQ ID NO: 7767671 - DNA, 22 bp, Homo sapiens
cagagccaaacctcagggcccg

SEQ ID NO: 7767672 - DNA, 20 bp, Homo sapiens
cagagccaagagcagcatct

SEQ ID NO: 7767673 - DNA, 22 bp, Homo sapiens
cagagccactgtctgccaggca

SEQ ID NO: 7767674 - DNA, 22 bp, Homo sapiens
gggcaggggtagcattccaagt

SEQ ID NO: 7767675 - DNA, 22 bp, Homo sapiens
gggcaggggtagcattccaagt

SEQ ID NO: 7767676 - DNA, 22 bp, Homo sapiens
gggcaggggtcagtggccccaa

SEQ ID NO: 7767677 - DNA, 22 bp, Homo sapiens
cagagcagaaggtccaagcctg

SEQ ID NO: 7767678 - DNA, 22 bp, Homo sapiens
cagagcagaagcggtcctcaca

SEQ ID NO: 7767679 - DNA, 18 bp, Homo sapiens
cagagcagaggtggagcg

SEQ ID NO: 7767680 - DNA, 22 bp, Homo sapiens
cagagcaggggtttcccaggtt

SEQ ID NO: 7767681 - DNA, 22 bp, Homo sapiens
cagagcaggcccactgccctcc

SEQ ID NO: 7767682 - DNA, 22 bp, Homo sapiens
gggcaggtactgggtggtgagc

SEQ ID NO: 7767683 - DNA, 22 bp, Homo sapiens
cagacaaggccatctttcattt

SEQ ID NO: 7767684 - DNA, 22 bp, Homo sapiens
cagacaaagcggaaactgttta

SEQ ID NO: 7767685 - DNA, 22 bp, Homo sapiens
cagaatttcagtgatgttttct

SEQ ID NO: 7767686 - DNA, 22 bp, Homo sapiens
cagaaaatagagtttctctgag

SEQ ID NO: 7767687 - DNA, 22 bp, Homo sapiens
cagaaacacttgtagagaagtt

SEQ ID NO: 7767688 - DNA, 22 bp, Homo sapiens
ggctggcactgaggagagctct

SEQ ID NO: 7767689 - DNA, 22 bp, Homo sapiens
ggctggcactgaggagagctct

SEQ ID NO: 7767690 - DNA, 22 bp, Homo sapiens
ggctggcactgaggagagctct

SEQ ID NO: 7767691 - DNA, 22 bp, Homo sapiens
cagaaaatagagtttctctgag

SEQ ID NO: 7767692 - DNA, 22 bp, Homo sapiens
cagaaaatagagtttctctgag

SEQ ID NO: 7767693 - DNA, 22 bp, Homo sapiens
ggctggcacgaagccctgctgg

SEQ ID NO: 7767694 - DNA, 22 bp, Homo sapiens
ggctggcactctgtccagtgtc

SEQ ID NO: 7767695 - DNA, 22 bp, Homo sapiens
ggctggcacccttggggatagg

SEQ ID NO: 7767696 - DNA, 22 bp, Homo sapiens
ggctggcacctgccctccgctg

SEQ ID NO: 7767697 - DNA, 19 bp, Homo sapiens
ggctggcaagtgacagtgt

SEQ ID NO: 7767698 - DNA, 19 bp, Homo sapiens
ggctggcaagtgacagtgt

SEQ ID NO: 7767699 - DNA, 22 bp, Homo sapiens
ggctggcaagtgtctgctcatg

SEQ ID NO: 7767700 - DNA, 22 bp, Homo sapiens
ggctggcacagagggctggtgt

SEQ ID NO: 7767701 - DNA, 22 bp, Homo sapiens
gggaggcacgaggcgcgcagtg

SEQ ID NO: 7767702 - DNA, 22 bp, Homo sapiens
gggaggcagtgctggaggctgg

SEQ ID NO: 7767703 - DNA, 22 bp, Homo sapiens
gggaggcagtgctggaggctgg

SEQ ID NO: 7767704 - DNA, 22 bp, Homo sapiens
gggaggcagtgctggaggctgg

SEQ ID NO: 7767705 - DNA, 22 bp, Homo sapiens
gggagctgatcaggtggattca

SEQ ID NO: 7767706 - DNA, 22 bp, Homo sapiens
cagacagaaggaaggccaacat

SEQ ID NO: 7767707 - DNA, 22 bp, Homo sapiens
gggagcatttattttccgttag

SEQ ID NO: 7767708 - DNA, 22 bp, Homo sapiens
gggagcataaactcagatttca

SEQ ID NO: 7767709 - DNA, 22 bp, Homo sapiens
cagacacacaagcaatctaagt

SEQ ID NO: 7767710 - DNA, 22 bp, Homo sapiens
cagacacacaccctggcctagc

SEQ ID NO: 7767711 - DNA, 22 bp, Homo sapiens
cagacacagatatgcatatggc

SEQ ID NO: 7767712 - DNA, 22 bp, Homo sapiens
cagacacagatatgcatatggc

SEQ ID NO: 7767713 - DNA, 22 bp, Homo sapiens
ctttacttcagcaagctttcct

SEQ ID NO: 7767714 - DNA, 22 bp, Homo sapiens
ctttattcctacaagattttct

SEQ ID NO: 7767715 - DNA, 22 bp, Homo sapiens
ctttattcctacaagattttct

SEQ ID NO: 7767716 - DNA, 22 bp, Homo sapiens
ctttattctgcaaattgccttg

SEQ ID NO: 7767717 - DNA, 22 bp, Homo sapiens
ctttattctgcaaattgccttg

SEQ ID NO: 7767718 - DNA, 17 bp, Homo sapiens
cttgttttccactggga

SEQ ID NO: 7767719 - DNA, 22 bp, Homo sapiens
cttgttttctaaaacatcattt

SEQ ID NO: 7767720 - DNA, 22 bp, Homo sapiens
cttgttttaaactgttgtggct

SEQ ID NO: 7767721 - DNA, 22 bp, Homo sapiens
atctttgggatatttgtgatta

SEQ ID NO: 7767722 - DNA, 20 bp, Homo sapiens
atctttggctcagaagcctt

SEQ ID NO: 7767723 - DNA, 22 bp, Homo sapiens
atctttgggatatttgtgatta

SEQ ID NO: 7767724 - DNA, 22 bp, Homo sapiens
atctttgggatcctgatttact

SEQ ID NO: 7767725 - DNA, 22 bp, Homo sapiens
atctttgggatcctgatttact

SEQ ID NO: 7767726 - DNA, 22 bp, Homo sapiens
atctttggccacttgtgctgca

SEQ ID NO: 7767727 - DNA, 20 bp, Homo sapiens
atctttggctcagaagcctt

SEQ ID NO: 7767728 - DNA, 22 bp, Homo sapiens
atctttggccacttgtgctgca

SEQ ID NO: 7767729 - DNA, 22 bp, Homo sapiens
atctttggacggtcccaactga

SEQ ID NO: 7767730 - DNA, 22 bp, Homo sapiens
atctttggatcgctcccccttc

SEQ ID NO: 7767731 - DNA, 22 bp, Homo sapiens
atctttggatcgctcccccttc

SEQ ID NO: 7767732 - DNA, 22 bp, Homo sapiens
atctttggaaagccaagcacag

SEQ ID NO: 7767733 - DNA, 22 bp, Homo sapiens
atctttggaaagccaagcacag

SEQ ID NO: 7767734 - DNA, 22 bp, Homo sapiens
atctttggacggtcccaactga

SEQ ID NO: 7767735 - DNA, 22 bp, Homo sapiens
cttctccagccacgcccactcc

SEQ ID NO: 7767736 - DNA, 22 bp, Homo sapiens
cttctccctggcttctgcacac

SEQ ID NO: 7767737 - DNA, 18 bp, Homo sapiens
cttctcccatcttggcca

SEQ ID NO: 7767738 - DNA, 22 bp, Homo sapiens
cttctccctgggggctctttat

SEQ ID NO: 7767739 - DNA, 22 bp, Homo sapiens
atctttctatttctaaaaacta

SEQ ID NO: 7767740 - DNA, 18 bp, Homo sapiens
atctttccatagcatgtt

SEQ ID NO: 7767741 - DNA, 18 bp, Homo sapiens
atctttccatagcatgtt

SEQ ID NO: 7767742 - DNA, 22 bp, Homo sapiens
atctttctctgcactatacaat

SEQ ID NO: 7767743 - DNA, 22 bp, Homo sapiens
atctttcttatttgaagaaaga

SEQ ID NO: 7767744 - DNA, 22 bp, Homo sapiens
atctttcagggccatttgtatt

SEQ ID NO: 7767745 - DNA, 22 bp, Homo sapiens
ctttgctttactcccactgtgt

SEQ ID NO: 7767746 - DNA, 22 bp, Homo sapiens
ctttgctgccagaacccagcag

SEQ ID NO: 7767747 - DNA, 22 bp, Homo sapiens
ctttgcttactggtgtctgcat

SEQ ID NO: 7767748 - DNA, 22 bp, Homo sapiens
ctttgcttctccaacctgctca

SEQ ID NO: 7767749 - DNA, 22 bp, Homo sapiens
ctttctttcgaagacgtgatta

SEQ ID NO: 7767750 - DNA, 23 bp, Homo sapiens
ctttgccacccagagcctgacag

SEQ ID NO: 7767751 - DNA, 20 bp, Homo sapiens
ctttgcctattctctgcctg

SEQ ID NO: 7767752 - DNA, 22 bp, Homo sapiens
ctttggcttttagatatccatt

SEQ ID NO: 7767753 - DNA, 22 bp, Homo sapiens
ctttggctgacgaggaggaggc

SEQ ID NO: 7767754 - DNA, 22 bp, Homo sapiens
ctttggctgcattcgagttgct

SEQ ID NO: 7767755 - DNA, 22 bp, Homo sapiens
ctttggctgggcaaagggaggt

SEQ ID NO: 7767756 - DNA, 22 bp, Homo sapiens
ctttggcttttagatatccatt

SEQ ID NO: 7767757 - DNA, 22 bp, Homo sapiens
ctttggcttgccctggcagtac

SEQ ID NO: 7767758 - DNA, 22 bp, Homo sapiens
atgacacataaaacaaggactg

SEQ ID NO: 7767759 - DNA, 22 bp, Homo sapiens
atgacacaagagcagaagccat

SEQ ID NO: 7767760 - DNA, 22 bp, Homo sapiens
atgagaaagagttgtatctaga

SEQ ID NO: 7767761 - DNA, 22 bp, Homo sapiens
atgagaaagagttgtatctaga

SEQ ID NO: 7767762 - DNA, 22 bp, Homo sapiens
atgagaaatttattacaagcta

SEQ ID NO: 7767763 - DNA, 22 bp, Homo sapiens
atgagatgtgtctaatggaacc

SEQ ID NO: 7767764 - DNA, 22 bp, Homo sapiens
atgagaggtttcgtcagaggaa

SEQ ID NO: 7767765 - DNA, 22 bp, Homo sapiens
atgagattttatagtgtcttga

SEQ ID NO: 7767766 - DNA, 22 bp, Homo sapiens
atgagatgttcaggagtctgag

SEQ ID NO: 7767767 - DNA, 22 bp, Homo sapiens
ctttttatagctatgtcctatg

SEQ ID NO: 7767768 - DNA, 22 bp, Homo sapiens
ctttttatctcttaatgatgtt

SEQ ID NO: 7767769 - DNA, 22 bp, Homo sapiens
ctttttatctcttaatgatgtt

SEQ ID NO: 7767770 - DNA, 22 bp, Homo sapiens
ctttttcattggctttaggaca

SEQ ID NO: 7767771 - DNA, 19 bp, Homo sapiens
ctttttcaccttctagaag

SEQ ID NO: 7767772 - DNA, 19 bp, Homo sapiens
ctttttcaccttctagaag

SEQ ID NO: 7767773 - DNA, 22 bp, Homo sapiens
ctttttcattggctttaggaca

SEQ ID NO: 7767774 - DNA, 22 bp, Homo sapiens
ctttttataccgtgccagttga

SEQ ID NO: 7767775 - DNA, 22 bp, Homo sapiens
ctttttatagctatgtcctatg

SEQ ID NO: 7767776 - DNA, 22 bp, Homo sapiens
ctttttactctgttgtctcagc

SEQ ID NO: 7767777 - DNA, 22 bp, Homo sapiens
gacaggaaacaagaaggcagga

SEQ ID NO: 7767778 - DNA, 16 bp, Homo sapiens
atgctgctattagagg

SEQ ID NO: 7767779 - DNA, 22 bp, Homo sapiens
atgctataaactctaggtcatt

SEQ ID NO: 7767780 - DNA, 22 bp, Homo sapiens
gacagcttagtgaaaatgtaaa

SEQ ID NO: 7767781 - DNA, 22 bp, Homo sapiens
atgctatactcaaagaaattca

SEQ ID NO: 7767782 - DNA, 22 bp, Homo sapiens
atgctatacatatgacatcaca

SEQ ID NO: 7767783 - DNA, 22 bp, Homo sapiens
gaattttaagtgttcgcctctt

SEQ ID NO: 7767784 - DNA, 22 bp, Homo sapiens
gaattttaataaaggtttatca

SEQ ID NO: 7767785 - DNA, 22 bp, Homo sapiens
gaattttagaatatgtgggctt

SEQ ID NO: 7767786 - DNA, 22 bp, Homo sapiens
gaatttcctctaaacccctgag

SEQ ID NO: 7767787 - DNA, 22 bp, Homo sapiens
gaatttgaaaagtgatgggaat

SEQ ID NO: 7767788 - DNA, 22 bp, Homo sapiens
atgctaaactatgatcattttc

SEQ ID NO: 7767789 - DNA, 22 bp, Homo sapiens
atgctaaatgttaatgttacct

SEQ ID NO: 7767790 - DNA, 23 bp, Homo sapiens
gaagtcagccctacagagagcag

SEQ ID NO: 7767791 - DNA, 22 bp, Homo sapiens
gaagtcagaaaagaattaggga

SEQ ID NO: 7767792 - DNA, 22 bp, Homo sapiens
atgccactgcacttcagcctgg

SEQ ID NO: 7767793 - DNA, 22 bp, Homo sapiens
gaaggaggcgttagccctagga

SEQ ID NO: 7767794 - DNA, 22 bp, Homo sapiens
gaaggaggctccccaaagtctg

SEQ ID NO: 7767795 - DNA, 22 bp, Homo sapiens
gaagccttgaactgcaaacccc

SEQ ID NO: 7767796 - DNA, 22 bp, Homo sapiens
gaagagcatatgaagagcatat

SEQ ID NO: 7767797 - DNA, 22 bp, Homo sapiens
atgatgttaccagtacttagag

SEQ ID NO: 7767798 - DNA, 22 bp, Homo sapiens
atgatgtaaatagagcctaggt

SEQ ID NO: 7767799 - DNA, 22 bp, Homo sapiens
gaagagagagccctggggtccg

SEQ ID NO: 7767800 - DNA, 22 bp, Homo sapiens
atggcagacctgggctggagaa

SEQ ID NO: 7767801 - DNA, 22 bp, Homo sapiens
atggcagacctgggctggagaa

SEQ ID NO: 7767802 - DNA, 22 bp, Homo sapiens
atggcagaatccatagtaggtg

SEQ ID NO: 7767803 - DNA, 22 bp, Homo sapiens
atggcagacacaggcaggcaga

SEQ ID NO: 7767804 - DNA, 22 bp, Homo sapiens
atggcagaaagaatagaggcta

SEQ ID NO: 7767805 - DNA, 22 bp, Homo sapiens
atggcagaagtcaagatgagtt

SEQ ID NO: 7767806 - DNA, 22 bp, Homo sapiens
atggcagaagtcaagatgagtt

SEQ ID NO: 7767807 - DNA, 22 bp, Homo sapiens
atggagggtgtcagagagcgaa

SEQ ID NO: 7767808 - DNA, 22 bp, Homo sapiens
gagaatacaaccagaagctgag

SEQ ID NO: 7767809 - DNA, 17 bp, Homo sapiens
gagacagcaggagcccc

SEQ ID NO: 7767810 - DNA, 22 bp, Homo sapiens
atgctggcagccgagtgctcca

SEQ ID NO: 7767811 - DNA, 22 bp, Homo sapiens
atgctggattgagagcaagggg

SEQ ID NO: 7767812 - DNA, 22 bp, Homo sapiens
atgctgggaagtcctaaccaca

SEQ ID NO: 7767813 - DNA, 22 bp, Homo sapiens
atgctggggcctcagaccagaa

SEQ ID NO: 7767814 - DNA, 22 bp, Homo sapiens
atgcttaactctgtacatagtt

SEQ ID NO: 7767815 - DNA, 22 bp, Homo sapiens
atggcagacgaggcagcagggg

SEQ ID NO: 7767816 - DNA, 22 bp, Homo sapiens
atggccgcctgtccttcccgcc

SEQ ID NO: 7767817 - DNA, 22 bp, Homo sapiens
atggccgcctgtccttcccgcc

SEQ ID NO: 7767818 - DNA, 22 bp, Homo sapiens
atggctctctccttactgctgc

SEQ ID NO: 7767819 - DNA, 22 bp, Homo sapiens
atggctctcttgacctaggcac

SEQ ID NO: 7767820 - DNA, 22 bp, Homo sapiens
atggctctgagaacctgagcta

SEQ ID NO: 7767821 - DNA, 22 bp, Homo sapiens
gagcacagctggaggtagcatt

SEQ ID NO: 7767822 - DNA, 22 bp, Homo sapiens
gagcacagctgtcttgcaagct

SEQ ID NO: 7767823 - DNA, 22 bp, Homo sapiens
gagcacaggctttggtggacac

SEQ ID NO: 7767824 - DNA, 22 bp, Homo sapiens
gagctgagtgtcctaggcatgg

SEQ ID NO: 7767825 - DNA, 20 bp, Homo sapiens
gagctgagtgtggtcatggg

SEQ ID NO: 7767826 - DNA, 22 bp, Homo sapiens
atgggcagagtggggacaggaa

SEQ ID NO: 7767827 - DNA, 22 bp, Homo sapiens
gagctgccctgagctttgcatg

SEQ ID NO: 7767828 - DNA, 22 bp, Homo sapiens
gagctgccagtgtatgaattct

SEQ ID NO: 7767829 - DNA, 21 bp, Homo sapiens
atgggcagaggcagagaggct

SEQ ID NO: 7767830 - DNA, 22 bp, Homo sapiens
gagccccaccctagacattctg

SEQ ID NO: 7767831 - DNA, 21 bp, Homo sapiens
atgggcagaggcagagaggct

SEQ ID NO: 7767832 - DNA, 22 bp, Homo sapiens
gagcccagtctgctcctgcgcc

SEQ ID NO: 7767833 - DNA, 22 bp, Homo sapiens
gagcccagtctgctcctgcgcc

SEQ ID NO: 7767834 - DNA, 22 bp, Homo sapiens
gagccccaggacagctctagtt

SEQ ID NO: 7767835 - DNA, 22 bp, Homo sapiens
gaggcacagtcccgaggcaagg

SEQ ID NO: 7767836 - DNA, 22 bp, Homo sapiens
gaggcacagtcccgaggcaagg

SEQ ID NO: 7767837 - DNA, 22 bp, Homo sapiens
gaggcacagtgtttggtcagtg

SEQ ID NO: 7767838 - DNA, 22 bp, Homo sapiens
gaggcacagtgtttggtcagtg

SEQ ID NO: 7767839 - DNA, 22 bp, Homo sapiens
gaggcacagtgtttggtcagtg

SEQ ID NO: 7767840 - DNA, 18 bp, Homo sapiens
gaggcacatagttggggc

SEQ ID NO: 7767841 - DNA, 22 bp, Homo sapiens
gaggcacagagtaggtgcacac

SEQ ID NO: 7767842 - DNA, 22 bp, Homo sapiens
gaggcacagagccctaggagct

SEQ ID NO: 7767843 - DNA, 22 bp, Homo sapiens
gaggcacagagccctaggagct

SEQ ID NO: 7767844 - DNA, 22 bp, Homo sapiens
gaggaggggcacttgtctccta

SEQ ID NO: 7767845 - DNA, 22 bp, Homo sapiens
gaggaggggacagtacttgtgc

SEQ ID NO: 7767846 - DNA, 22 bp, Homo sapiens
gaggagctgggtcagggagaca

SEQ ID NO: 7767847 - DNA, 22 bp, Homo sapiens
atgggcagctgcagcagtggtg

SEQ ID NO: 7767848 - DNA, 22 bp, Homo sapiens
atgggcagctgcagcagtggtg

SEQ ID NO: 7767849 - DNA, 22 bp, Homo sapiens
atgtatgtttctatatatgaca

SEQ ID NO: 7767850 - DNA, 22 bp, Homo sapiens
atgtatgtctgatgcacatgca

SEQ ID NO: 7767851 - DNA, 22 bp, Homo sapiens
atgtatgttcaagcaatgatta

SEQ ID NO: 7767852 - DNA, 22 bp, Homo sapiens
atgtatgttagtgtattatcta

SEQ ID NO: 7767853 - DNA, 22 bp, Homo sapiens
atgtatgtagtgtacatataca

SEQ ID NO: 7767854 - DNA, 22 bp, Homo sapiens
gaggctccatggaggagtatgg

SEQ ID NO: 7767855 - DNA, 22 bp, Homo sapiens
gaggctcccaaggggctaggcc

SEQ ID NO: 7767856 - DNA, 22 bp, Homo sapiens
gaggctccctcaactctgggtg

SEQ ID NO: 7767857 - DNA, 22 bp, Homo sapiens
gaggctccgtgctgctgccctg

SEQ ID NO: 7767858 - DNA, 22 bp, Homo sapiens
gaggctccctttaggtccagat

SEQ ID NO: 7767859 - DNA, 22 bp, Homo sapiens
gaggcctgggttggaggtgcat

SEQ ID NO: 7767860 - DNA, 22 bp, Homo sapiens
atgtattgtctcttttccttaa

SEQ ID NO: 7767861 - DNA, 23 bp, Homo sapiens
atgtatttaaatttcagtgatga

SEQ ID NO: 7767862 - DNA, 22 bp, Homo sapiens
atgtatttactgagaaggaaac

SEQ ID NO: 7767863 - DNA, 22 bp, Homo sapiens
atgtatttctatgtagtgaaga

SEQ ID NO: 7767864 - DNA, 22 bp, Homo sapiens
gaggttctgggggtctgcctgg

SEQ ID NO: 7767865 - DNA, 22 bp, Homo sapiens
atgtggctagtgcaactgagaa

SEQ ID NO: 7767866 - DNA, 22 bp, Homo sapiens
atgttacatagtccttatttgt

SEQ ID NO: 7767867 - DNA, 22 bp, Homo sapiens
atgttaggcaatctttcttgtt

SEQ ID NO: 7767868 - DNA, 22 bp, Homo sapiens
atgtcagaagctggatgacagc

SEQ ID NO: 7767869 - DNA, 22 bp, Homo sapiens
gaggctcttttctgctgtgtct

SEQ ID NO: 7767870 - DNA, 22 bp, Homo sapiens
gaggctcttttctgctgtgtct

SEQ ID NO: 7767871 - DNA, 22 bp, Homo sapiens
atgtggcattcttggtcatttc

SEQ ID NO: 7767872 - DNA, 22 bp, Homo sapiens
atgtggcaccgatctttagcca

SEQ ID NO: 7767873 - DNA, 22 bp, Homo sapiens
gatggcaggcaggtgagtagag

SEQ ID NO: 7767874 - DNA, 22 bp, Homo sapiens
gatggcagcagcagccagggat

SEQ ID NO: 7767875 - DNA, 22 bp, Homo sapiens
gatggcagtcaaccaggtgagg

SEQ ID NO: 7767876 - DNA, 22 bp, Homo sapiens
gatggagtctgaagctgggaac

SEQ ID NO: 7767877 - DNA, 22 bp, Homo sapiens
gatggcaccttgaacgctgcgt

SEQ ID NO: 7767878 - DNA, 22 bp, Homo sapiens
atgttatttctgaaagatcatt

SEQ ID NO: 7767879 - DNA, 22 bp, Homo sapiens
atgttatttattgaaacacttt

SEQ ID NO: 7767880 - DNA, 22 bp, Homo sapiens
atgttattcaatttgaatccaa

SEQ ID NO: 7767881 - DNA, 22 bp, Homo sapiens
atgttattaaagtacagattct

SEQ ID NO: 7767882 - DNA, 22 bp, Homo sapiens
atgttatgtctgggaaggggta

SEQ ID NO: 7767883 - DNA, 22 bp, Homo sapiens
gatgtgactaacttggtaccag

SEQ ID NO: 7767884 - DNA, 22 bp, Homo sapiens
gatgtctttttccaggctcttt

SEQ ID NO: 7767885 - DNA, 22 bp, Homo sapiens
gattcaggcctgcatctcagca

SEQ ID NO: 7767886 - DNA, 22 bp, Homo sapiens
gattctgatctatagtgttata

SEQ ID NO: 7767887 - DNA, 22 bp, Homo sapiens
attaaattggatctgcatagtt

SEQ ID NO: 7767888 - DNA, 22 bp, Homo sapiens
attaaattggacgctgggggaa

SEQ ID NO: 7767889 - DNA, 22 bp, Homo sapiens
gattcttaagacattatgtatt

SEQ ID NO: 7767890 - DNA, 22 bp, Homo sapiens
attaaattttcactaggctccc

SEQ ID NO: 7767891 - DNA, 22 bp, Homo sapiens
gcacacaggcagtttccagcca

SEQ ID NO: 7767892 - DNA, 22 bp, Homo sapiens
gcacagggccctgtgcgtaggt

SEQ ID NO: 7767893 - DNA, 22 bp, Homo sapiens
gcacagggcctggcacataaga

SEQ ID NO: 7767894 - DNA, 22 bp, Homo sapiens
gcaccaggcagctgagcaggcc

SEQ ID NO: 7767895 - DNA, 22 bp, Homo sapiens
gcacacagctagattaccattc

SEQ ID NO: 7767896 - DNA, 16 bp, Homo sapiens
gcacacagccagcctt

SEQ ID NO: 7767897 - DNA, 22 bp, Homo sapiens
gcacacagagaggtggtatgtc

SEQ ID NO: 7767898 - DNA, 22 bp, Homo sapiens
gcacacagactaaccatatttc

SEQ ID NO: 7767899 - DNA, 22 bp, Homo sapiens
gcacacagaattgattcactgt

SEQ ID NO: 7767900 - DNA, 22 bp, Homo sapiens
gcacacagaatcagtgggcata

SEQ ID NO: 7767901 - DNA, 22 bp, Homo sapiens
attatataaaattctggaagct

SEQ ID NO: 7767902 - DNA, 22 bp, Homo sapiens
attatataggacttgcccttcc

SEQ ID NO: 7767903 - DNA, 22 bp, Homo sapiens
attataggcttgagccaccgtg

SEQ ID NO: 7767904 - DNA, 22 bp, Homo sapiens
attaagagcctactatgtgccg

SEQ ID NO: 7767905 - DNA, 22 bp, Homo sapiens
attaagatcattgtagaagatt

SEQ ID NO: 7767906 - DNA, 22 bp, Homo sapiens
attaagatcattgtagaagatt

SEQ ID NO: 7767907 - DNA, 22 bp, Homo sapiens
gcacccagaataaggacaggac

SEQ ID NO: 7767908 - DNA, 22 bp, Homo sapiens
gcagagatccttgctggatgac

SEQ ID NO: 7767909 - DNA, 22 bp, Homo sapiens
attccaaacttaccccagagga

SEQ ID NO: 7767910 - DNA, 19 bp, Homo sapiens
attcatttttgccttctaa

SEQ ID NO: 7767911 - DNA, 22 bp, Homo sapiens
attcacaactgatccttgctca

SEQ ID NO: 7767912 - DNA, 22 bp, Homo sapiens
gcagcttggtgaaaggtgatgg

SEQ ID NO: 7767913 - DNA, 22 bp, Homo sapiens
gcagcttcctgagtgtggacag

SEQ ID NO: 7767914 - DNA, 22 bp, Homo sapiens
gcagcttcagtaggtgaagaca

SEQ ID NO: 7767915 - DNA, 22 bp, Homo sapiens
gcagcttggatttctgtagttt

SEQ ID NO: 7767916 - DNA, 22 bp, Homo sapiens
gcagcttcagccagagggccag

SEQ ID NO: 7767917 - DNA, 22 bp, Homo sapiens
gcaggcaggagcccaactgcct

SEQ ID NO: 7767918 - DNA, 22 bp, Homo sapiens
gcaggcaggagcccaactgcct

SEQ ID NO: 7767919 - DNA, 22 bp, Homo sapiens
gcaggcaggcttccttgaactg

SEQ ID NO: 7767920 - DNA, 22 bp, Homo sapiens
gcaggcaggagcccaactgcct

SEQ ID NO: 7767921 - DNA, 20 bp, Homo sapiens
gcaggcagggaatgggggtg

SEQ ID NO: 7767922 - DNA, 22 bp, Homo sapiens
gcaggcaggcttccttgaactg

SEQ ID NO: 7767923 - DNA, 20 bp, Homo sapiens
gcaggcagggaatgggggtg

SEQ ID NO: 7767924 - DNA, 22 bp, Homo sapiens
attctcatttttatagatgaga

SEQ ID NO: 7767925 - DNA, 22 bp, Homo sapiens
attctcatttgctggctatatg

SEQ ID NO: 7767926 - DNA, 22 bp, Homo sapiens
attctgagtacaacaagatgtt

SEQ ID NO: 7767927 - DNA, 22 bp, Homo sapiens
attctgagaggcacaatgtgga

SEQ ID NO: 7767928 - DNA, 22 bp, Homo sapiens
gcagctgttcagctggccagat

SEQ ID NO: 7767929 - DNA, 22 bp, Homo sapiens
attctgagttagagtcagccag

SEQ ID NO: 7767930 - DNA, 21 bp, Homo sapiens
attctgagttgtcagtcttca

SEQ ID NO: 7767931 - DNA, 22 bp, Homo sapiens
gcatggcaaatatcgagggcag

SEQ ID NO: 7767932 - DNA, 22 bp, Homo sapiens
gcatggcaagaccctgtctcta

SEQ ID NO: 7767933 - DNA, 22 bp, Homo sapiens
gcatggcagccagtacatggtg

SEQ ID NO: 7767934 - DNA, 22 bp, Homo sapiens
gcatggcagaacacctcgcccg

SEQ ID NO: 7767935 - DNA, 22 bp, Homo sapiens
gcatggcaagatcaggagacca

SEQ ID NO: 7767936 - DNA, 22 bp, Homo sapiens
gcatggcagaacacctcgcccg

SEQ ID NO: 7767937 - DNA, 22 bp, Homo sapiens
attgcacatctgcactacagcc

SEQ ID NO: 7767938 - DNA, 22 bp, Homo sapiens
attgcactccggcctgggtgac

SEQ ID NO: 7767939 - DNA, 22 bp, Homo sapiens
attgcactccagcctgggtgac

SEQ ID NO: 7767940 - DNA, 22 bp, Homo sapiens
gcaggtgttctcagaggaggct

SEQ ID NO: 7767941 - DNA, 22 bp, Homo sapiens
gcaggttatccaactacaatgt

SEQ ID NO: 7767942 - DNA, 22 bp, Homo sapiens
gcagtaagaaagtcaagcagtt

SEQ ID NO: 7767943 - DNA, 22 bp, Homo sapiens
gcagtaagatgtttcccagagc

SEQ ID NO: 7767944 - DNA, 22 bp, Homo sapiens
attgcaaaggtcccattcaaga

SEQ ID NO: 7767945 - DNA, 22 bp, Homo sapiens
attgcaaataatgcgagccagt

SEQ ID NO: 7767946 - DNA, 22 bp, Homo sapiens
gcagggcaaacccaggtgttca

SEQ ID NO: 7767947 - DNA, 22 bp, Homo sapiens
gcagggcagtaagagctagagt

SEQ ID NO: 7767948 - DNA, 22 bp, Homo sapiens
gcagggcagtgtgtctgtgggg

SEQ ID NO: 7767949 - DNA, 22 bp, Homo sapiens
gcaggcaggtggcatcttgtga

SEQ ID NO: 7767950 - DNA, 22 bp, Homo sapiens
attctgcatggtggtgtctctg

SEQ ID NO: 7767951 - DNA, 22 bp, Homo sapiens
attctgcacatccaagaacagg

SEQ ID NO: 7767952 - DNA, 20 bp, Homo sapiens
gcagggcatcttggccccca

SEQ ID NO: 7767953 - DNA, 22 bp, Homo sapiens
gcagggcatagaggcacggagg

SEQ ID NO: 7767954 - DNA, 22 bp, Homo sapiens
gcagggcatccctgagcgggtg

SEQ ID NO: 7767955 - DNA, 22 bp, Homo sapiens
attcttttttaaggaatagaac

SEQ ID NO: 7767956 - DNA, 22 bp, Homo sapiens
attctttgaacagttttcctgt

SEQ ID NO: 7767957 - DNA, 22 bp, Homo sapiens
attttcagtgtaaatgttttat

SEQ ID NO: 7767958 - DNA, 22 bp, Homo sapiens
attttcatcatgggtttaacat

SEQ ID NO: 7767959 - DNA, 22 bp, Homo sapiens
attttcatcatgggtttaacat

SEQ ID NO: 7767960 - DNA, 21 bp, Homo sapiens
attttcattaattcagtgtgg

SEQ ID NO: 7767961 - DNA, 21 bp, Homo sapiens
attttcattaattcagtgtgg

SEQ ID NO: 7767962 - DNA, 21 bp, Homo sapiens
attttcatttccaggggagga

SEQ ID NO: 7767963 - DNA, 21 bp, Homo sapiens
attttcattaattcagtgtgg

SEQ ID NO: 7767964 - DNA, 22 bp, Homo sapiens
attttccaaaataattgttact

SEQ ID NO: 7767965 - DNA, 22 bp, Homo sapiens
attttccttctaagaggaaggt

SEQ ID NO: 7767966 - DNA, 22 bp, Homo sapiens
attttcctctggtttccccaga

SEQ ID NO: 7767967 - DNA, 22 bp, Homo sapiens
gccttcccaagacgcctgagtt

SEQ ID NO: 7767968 - DNA, 19 bp, Homo sapiens
gccttcccaccacccgtcc

SEQ ID NO: 7767969 - DNA, 22 bp, Homo sapiens
atttgtatcaatctcaatatat

SEQ ID NO: 7767970 - DNA, 22 bp, Homo sapiens
atttgtatcaatctcaatatat

SEQ ID NO: 7767971 - DNA, 22 bp, Homo sapiens
atttgtatcaatctcaatatat

SEQ ID NO: 7767972 - DNA, 22 bp, Homo sapiens
atttgtatcttctaatattatc

SEQ ID NO: 7767973 - DNA, 22 bp, Homo sapiens
atttgtcaataagatgaacata

SEQ ID NO: 7767974 - DNA, 22 bp, Homo sapiens
atttgtcaaaacacagagaaca

SEQ ID NO: 7767975 - DNA, 22 bp, Homo sapiens
atttgtcagtggaagtgattca

SEQ ID NO: 7767976 - DNA, 22 bp, Homo sapiens
atttgtcactgagagagttaga

SEQ ID NO: 7767977 - DNA, 22 bp, Homo sapiens
atttgtcacacatagtttatcc

SEQ ID NO: 7767978 - DNA, 22 bp, Homo sapiens
atttgtcatgtatgtaaagttg

SEQ ID NO: 7767979 - DNA, 22 bp, Homo sapiens
attttagagctccaagtacagc

SEQ ID NO: 7767980 - DNA, 22 bp, Homo sapiens
atttgtaaagtgcttaaaagta

SEQ ID NO: 7767981 - DNA, 22 bp, Homo sapiens
atttgtaagctagagccatgat

SEQ ID NO: 7767982 - DNA, 22 bp, Homo sapiens
caaaagcaaagtccctgaatgt

SEQ ID NO: 7767983 - DNA, 22 bp, Homo sapiens
caaaagcagcaagtttatatgt

SEQ ID NO: 7767984 - DNA, 20 bp, Homo sapiens
caaaagcaatgaagttatga

SEQ ID NO: 7767985 - DNA, 22 bp, Homo sapiens
gctcagagagtttcacaagttt

SEQ ID NO: 7767986 - DNA, 22 bp, Homo sapiens
gctcagagaatcagcagacacc

SEQ ID NO: 7767987 - DNA, 22 bp, Homo sapiens
attttgcacactatgcagcttt

SEQ ID NO: 7767988 - DNA, 22 bp, Homo sapiens
attttgcacactatgcagcttt

SEQ ID NO: 7767989 - DNA, 22 bp, Homo sapiens
attttgcacactatgcagcttt

SEQ ID NO: 7767990 - DNA, 22 bp, Homo sapiens
attttgctgctatgccttgcaa

SEQ ID NO: 7767991 - DNA, 22 bp, Homo sapiens
gctcaaatgtcatggggagcct

SEQ ID NO: 7767992 - DNA, 22 bp, Homo sapiens
gctcaaatcccagcgggctcct

SEQ ID NO: 7767993 - DNA, 22 bp, Homo sapiens
attttgaatcaccttggaagaa

SEQ ID NO: 7767994 - DNA, 22 bp, Homo sapiens
attttgaagggaattgaagttc

SEQ ID NO: 7767995 - DNA, 22 bp, Homo sapiens
caaaagcagcaagtttatatgt

SEQ ID NO: 7767996 - DNA, 22 bp, Homo sapiens
caaagaatcactcatctttagc

SEQ ID NO: 7767997 - DNA, 22 bp, Homo sapiens
caaagaatgagtgagtacataa

SEQ ID NO: 7767998 - DNA, 22 bp, Homo sapiens
caaagacacgggaaacaacgtt

SEQ ID NO: 7767999 - DNA, 20 bp, Homo sapiens
caaagacatgctaggggtgg

SEQ ID NO: 7768000 - DNA, 22 bp, Homo sapiens
caaagacacgggaaacaacgtt

SEQ ID NO: 7768001 - DNA, 22 bp, Homo sapiens
atttattacctcggagtttctg

SEQ ID NO: 7768002 - DNA, 22 bp, Homo sapiens
atttattaagcatctgctatgt

SEQ ID NO: 7768003 - DNA, 20 bp, Homo sapiens
atttatgtatagcttgttgt

SEQ ID NO: 7768004 - DNA, 22 bp, Homo sapiens
atttatgattagcctattgttg

SEQ ID NO: 7768005 - DNA, 22 bp, Homo sapiens
atttatcatcagaccttttaaa

SEQ ID NO: 7768006 - DNA, 22 bp, Homo sapiens
atttatcaccagttagctgact

SEQ ID NO: 7768007 - DNA, 22 bp, Homo sapiens
atttatcaccagttagctgact

SEQ ID NO: 7768008 - DNA, 22 bp, Homo sapiens
atttatctctggaaactaagca

SEQ ID NO: 7768009 - DNA, 22 bp, Homo sapiens
gccagctgcttctccagaattt

SEQ ID NO: 7768010 - DNA, 22 bp, Homo sapiens
gccagctggagactggcagggg

SEQ ID NO: 7768011 - DNA, 22 bp, Homo sapiens
gccagctggagactggcagggg

SEQ ID NO: 7768012 - DNA, 22 bp, Homo sapiens
gccagctggagtgagagtgggc

SEQ ID NO: 7768013 - DNA, 22 bp, Homo sapiens
gccagctggagtgagagtgggc

SEQ ID NO: 7768014 - DNA, 22 bp, Homo sapiens
gccagctggagtgagagtgggc

SEQ ID NO: 7768015 - DNA, 18 bp, Homo sapiens
gccagctgcacggccctc

SEQ ID NO: 7768016 - DNA, 22 bp, Homo sapiens
gccagctgctggaacagcgcga

SEQ ID NO: 7768017 - DNA, 22 bp, Homo sapiens
gccagctgccaagttgtgagat

SEQ ID NO: 7768018 - DNA, 22 bp, Homo sapiens
gccagccacttcccagactggc

SEQ ID NO: 7768019 - DNA, 23 bp, Homo sapiens
gccagccagaatttctccactgt

SEQ ID NO: 7768020 - DNA, 22 bp, Homo sapiens
gccagccagaaacgtcacactg

SEQ ID NO: 7768021 - DNA, 20 bp, Homo sapiens
gcatggcatgtagtgaagtg

SEQ ID NO: 7768022 - DNA, 22 bp, Homo sapiens
gcccagtctcttctggccctgt

SEQ ID NO: 7768023 - DNA, 22 bp, Homo sapiens
gcccagtctcttctggccctgt

SEQ ID NO: 7768024 - DNA, 22 bp, Homo sapiens
gcccagggtgaagtgcagttgt

SEQ ID NO: 7768025 - DNA, 22 bp, Homo sapiens
gcccaggttggagagcagtggc

SEQ ID NO: 7768026 - DNA, 22 bp, Homo sapiens
gccatcctctgagcactaggca

SEQ ID NO: 7768027 - DNA, 22 bp, Homo sapiens
gccatctcggagctatcaaagg

SEQ ID NO: 7768028 - DNA, 22 bp, Homo sapiens
gccatgcttggtatgctgtgag

SEQ ID NO: 7768029 - DNA, 22 bp, Homo sapiens
gccatgcttggtatgctgtgag

SEQ ID NO: 7768030 - DNA, 19 bp, Homo sapiens
atttattgtatgattccat

SEQ ID NO: 7768031 - DNA, 22 bp, Homo sapiens
gccctgggctccctgctccaca

SEQ ID NO: 7768032 - DNA, 17 bp, Homo sapiens
gccctgcctgctgccct

SEQ ID NO: 7768033 - DNA, 22 bp, Homo sapiens
gccctggggaaggtgtctccaa

SEQ ID NO: 7768034 - DNA, 23 bp, Homo sapiens
atttcccattgtgtcagcagagc

SEQ ID NO: 7768035 - DNA, 22 bp, Homo sapiens
atttccctccagggaaagctta

SEQ ID NO: 7768036 - DNA, 17 bp, Homo sapiens
atttcccagcagtgcta

SEQ ID NO: 7768037 - DNA, 22 bp, Homo sapiens
atttcccaggactagaaatata

SEQ ID NO: 7768038 - DNA, 22 bp, Homo sapiens
atttcccagggccctcatagtt

SEQ ID NO: 7768039 - DNA, 22 bp, Homo sapiens
atttcccactctactacatgct

SEQ ID NO: 7768040 - DNA, 22 bp, Homo sapiens
atttcccaatacgctaagtgga

SEQ ID NO: 7768041 - DNA, 22 bp, Homo sapiens
atttcttcaggtcagaaataga

SEQ ID NO: 7768042 - DNA, 22 bp, Homo sapiens
atttcttatgaatattgactgt

SEQ ID NO: 7768043 - DNA, 22 bp, Homo sapiens
atttcttacataacaaattgtt

SEQ ID NO: 7768044 - DNA, 22 bp, Homo sapiens
atttctgtttgctactataagt

SEQ ID NO: 7768045 - DNA, 22 bp, Homo sapiens
atttctgttgcttataaattac

SEQ ID NO: 7768046 - DNA, 22 bp, Homo sapiens
atctcattttggtttctactta

SEQ ID NO: 7768047 - DNA, 22 bp, Homo sapiens
atctcataaacacacatatatg

SEQ ID NO: 7768048 - DNA, 22 bp, Homo sapiens
cttcatgagggtaatctacaaa

SEQ ID NO: 7768049 - DNA, 22 bp, Homo sapiens
cttcatagaacagaaatttaat

SEQ ID NO: 7768050 - DNA, 22 bp, Homo sapiens
cttcattaaccaaaatgcaata

SEQ ID NO: 7768051 - DNA, 23 bp, Homo sapiens
cttcacaatcaaaatcagttctg

SEQ ID NO: 7768052 - DNA, 22 bp, Homo sapiens
ctgtttcacgtgtttaagccca

SEQ ID NO: 7768053 - DNA, 22 bp, Homo sapiens
cttcagagtgcagaagattggg

SEQ ID NO: 7768054 - DNA, 22 bp, Homo sapiens
atccttaatttacttgcatctt

SEQ ID NO: 7768055 - DNA, 22 bp, Homo sapiens
atccttaatttcctgggcctca

SEQ ID NO: 7768056 - DNA, 22 bp, Homo sapiens
atcattaaatataagcttcaca

SEQ ID NO: 7768057 - DNA, 22 bp, Homo sapiens
ctgtttatggaggtaaggcatc

SEQ ID NO: 7768058 - DNA, 22 bp, Homo sapiens
ctgtttatggaggtaaggcatc

SEQ ID NO: 7768059 - DNA, 22 bp, Homo sapiens
ctgtttattacactggatagca

SEQ ID NO: 7768060 - DNA, 22 bp, Homo sapiens
ctgttattcaagacaaaggcag

SEQ ID NO: 7768061 - DNA, 23 bp, Homo sapiens
ctgtccaggattcttgagagaac

SEQ ID NO: 7768062 - DNA, 22 bp, Homo sapiens
atcaggatctgggagcctgaaa

SEQ ID NO: 7768063 - DNA, 22 bp, Homo sapiens
atatcagaaatagtaagcagag

SEQ ID NO: 7768064 - DNA, 22 bp, Homo sapiens
atatcacagatgcagaaagaga

SEQ ID NO: 7768065 - DNA, 22 bp, Homo sapiens
atatcacaggaaaggaagatac

SEQ ID NO: 7768066 - DNA, 22 bp, Homo sapiens
atatcacaggtgtttacctgat

SEQ ID NO: 7768067 - DNA, 22 bp, Homo sapiens
atatcaaagctagtggaaattt

SEQ ID NO: 7768068 - DNA, 22 bp, Homo sapiens
atatcaaacgaagttattttaa

SEQ ID NO: 7768069 - DNA, 22 bp, Homo sapiens
atatcaaagctagtggaaattt

SEQ ID NO: 7768070 - DNA, 22 bp, Homo sapiens
atatcaaaataaacagcatgca

SEQ ID NO: 7768071 - DNA, 22 bp, Homo sapiens
atatattttttgagacagagtc

SEQ ID NO: 7768072 - DNA, 22 bp, Homo sapiens
atagtcttagatcagataaagt

SEQ ID NO: 7768073 - DNA, 22 bp, Homo sapiens
atagtatttccagaaatagtct

SEQ ID NO: 7768074 - DNA, 22 bp, Homo sapiens
atagtatttccagaaatagtct

SEQ ID NO: 7768075 - DNA, 22 bp, Homo sapiens
atatattttttgagacagagtc

SEQ ID NO: 7768076 - DNA, 22 bp, Homo sapiens
atatattttgcggtcacgtggc

SEQ ID NO: 7768077 - DNA, 22 bp, Homo sapiens
atatattttgcggtcacgtggc

SEQ ID NO: 7768078 - DNA, 22 bp, Homo sapiens
atatattttgcggtcacgtggc

SEQ ID NO: 7768079 - DNA, 22 bp, Homo sapiens
atatattacaaaagaggaagga

SEQ ID NO: 7768080 - DNA, 22 bp, Homo sapiens
atatattttgaatagcctctgt

SEQ ID NO: 7768081 - DNA, 22 bp, Homo sapiens
atatattacaaaagaggaagga

SEQ ID NO: 7768082 - DNA, 17 bp, Homo sapiens
ctgggcctctgcccttt

SEQ ID NO: 7768083 - DNA, 22 bp, Homo sapiens
ctgggctgtaatgtggcactga

SEQ ID NO: 7768084 - DNA, 22 bp, Homo sapiens
ctgggccatgggccagcgaggc

SEQ ID NO: 7768085 - DNA, 22 bp, Homo sapiens
ctgggccatctctctgcaagtg

SEQ ID NO: 7768086 - DNA, 22 bp, Homo sapiens
ctgggccatggaagtctctgcc

SEQ ID NO: 7768087 - DNA, 22 bp, Homo sapiens
ctgggccagggaggtgtctgta

SEQ ID NO: 7768088 - DNA, 22 bp, Homo sapiens
ctggggaggcagggctgcccct

SEQ ID NO: 7768089 - DNA, 22 bp, Homo sapiens
ctggggaggatgctacgacctg

SEQ ID NO: 7768090 - DNA, 22 bp, Homo sapiens
ctggggaggcagggctgcccct

SEQ ID NO: 7768091 - DNA, 22 bp, Homo sapiens
ctggggaggatgctacgacctg

SEQ ID NO: 7768092 - DNA, 22 bp, Homo sapiens
ctgggctgtcaatggccctctg

SEQ ID NO: 7768093 - DNA, 22 bp, Homo sapiens
ctggtgggagcagcaggcagct

SEQ ID NO: 7768094 - DNA, 22 bp, Homo sapiens
ctggtggagagtgggctctgga

SEQ ID NO: 7768095 - DNA, 22 bp, Homo sapiens
atattttgaagttaataatgtg

SEQ ID NO: 7768096 - DNA, 22 bp, Homo sapiens
ctgtaatcccagctactcggga

SEQ ID NO: 7768097 - DNA, 22 bp, Homo sapiens
atattttcacagaacttgcaaa

SEQ ID NO: 7768098 - DNA, 22 bp, Homo sapiens
atattttcactgaaccaaagta

SEQ ID NO: 7768099 - DNA, 22 bp, Homo sapiens
atattttcactgaaccaaagta

SEQ ID NO: 7768100 - DNA, 22 bp, Homo sapiens
atattttccgaacttgaggtag

SEQ ID NO: 7768101 - DNA, 22 bp, Homo sapiens
ctgtccagctgaccagagcagc

SEQ ID NO: 7768102 - DNA, 22 bp, Homo sapiens
ctgtatttagttaaaatgctaa

SEQ ID NO: 7768103 - DNA, 22 bp, Homo sapiens
ctgtatgtttctatgaatgtga

SEQ ID NO: 7768104 - DNA, 22 bp, Homo sapiens
atagtacaatcagttaattagt

SEQ ID NO: 7768105 - DNA, 22 bp, Homo sapiens
atagacacatgttattatactt

SEQ ID NO: 7768106 - DNA, 22 bp, Homo sapiens
atagacaatggtttgccaagaa

SEQ ID NO: 7768107 - DNA, 22 bp, Homo sapiens
atagaatttgtacttgtagaac

SEQ ID NO: 7768108 - DNA, 22 bp, Homo sapiens
atagacaaacacgaagatgaca

SEQ ID NO: 7768109 - DNA, 22 bp, Homo sapiens
atagaattcgtgtttgtaattc

SEQ ID NO: 7768110 - DNA, 22 bp, Homo sapiens
atagaatgtattatagtacaga

SEQ ID NO: 7768111 - DNA, 22 bp, Homo sapiens
atagaaatgtattttggactag

SEQ ID NO: 7768112 - DNA, 19 bp, Homo sapiens
atagaaagggttaaagaca

SEQ ID NO: 7768113 - DNA, 19 bp, Homo sapiens
atagaaagggttaaagaca

SEQ ID NO: 7768114 - DNA, 22 bp, Homo sapiens
atagaatatgacttttagatcc

SEQ ID NO: 7768115 - DNA, 22 bp, Homo sapiens
atagaatatgacttttagatcc

SEQ ID NO: 7768116 - DNA, 22 bp, Homo sapiens
atagaaacagaggtcaggcatt

SEQ ID NO: 7768117 - DNA, 22 bp, Homo sapiens
atagaaacagggaagcaaagca

SEQ ID NO: 7768118 - DNA, 22 bp, Homo sapiens
atacttttaattccttctgagt

SEQ ID NO: 7768119 - DNA, 22 bp, Homo sapiens
atactttgctacattgtacatt

SEQ ID NO: 7768120 - DNA, 22 bp, Homo sapiens
atactttgggggttagtgtaga

SEQ ID NO: 7768121 - DNA, 21 bp, Homo sapiens
ctggagcttggtgagaagtgt

SEQ ID NO: 7768122 - DNA, 22 bp, Homo sapiens
ctggagctgtcttcacaggcct

SEQ ID NO: 7768123 - DNA, 17 bp, Homo sapiens
ctggagctgtgtaacct

SEQ ID NO: 7768124 - DNA, 22 bp, Homo sapiens
ctggccaggctctcacgtggtc

SEQ ID NO: 7768125 - DNA, 22 bp, Homo sapiens
atacatgaggaggctggaaaca

SEQ ID NO: 7768126 - DNA, 22 bp, Homo sapiens
atacatgacagcatagcatcct

SEQ ID NO: 7768127 - DNA, 22 bp, Homo sapiens
atacatctcatgtaagagataa

SEQ ID NO: 7768128 - DNA, 22 bp, Homo sapiens
ctggagctggtatagggacaaa

SEQ ID NO: 7768129 - DNA, 21 bp, Homo sapiens
atacagaaggtggcaaagtac

SEQ ID NO: 7768130 - DNA, 21 bp, Homo sapiens
atacagaaggtggcaaagtac

SEQ ID NO: 7768131 - DNA, 22 bp, Homo sapiens
atacagaagcctgtatttctgg

SEQ ID NO: 7768132 - DNA, 22 bp, Homo sapiens
ctggaaatcactactagtcaat

SEQ ID NO: 7768133 - DNA, 22 bp, Homo sapiens
ataattaatttcagtaatctcc

SEQ ID NO: 7768134 - DNA, 22 bp, Homo sapiens
ataattaatttcagtaatctcc

SEQ ID NO: 7768135 - DNA, 22 bp, Homo sapiens
ataatcagaattcatgaaagat

SEQ ID NO: 7768136 - DNA, 22 bp, Homo sapiens
ataatcattcacataaggtgct

SEQ ID NO: 7768137 - DNA, 22 bp, Homo sapiens
ataatgtttttgtataagcatg

SEQ ID NO: 7768138 - DNA, 22 bp, Homo sapiens
ataatgtctgcagagccacaca

SEQ ID NO: 7768139 - DNA, 22 bp, Homo sapiens
ataatttacaactgcttttaat

SEQ ID NO: 7768140 - DNA, 22 bp, Homo sapiens
atacagaaaatgatgcagagtt

SEQ ID NO: 7768141 - DNA, 22 bp, Homo sapiens
atacagaactctcagttgtata

SEQ ID NO: 7768142 - DNA, 22 bp, Homo sapiens
atacagaagaactatagccact

SEQ ID NO: 7768143 - DNA, 22 bp, Homo sapiens
atacagaagaactatagccact

SEQ ID NO: 7768144 - DNA, 18 bp, Homo sapiens
ctgcctgctctccagctt

SEQ ID NO: 7768145 - DNA, 23 bp, Homo sapiens
ataataattatggcagcaaagtg

SEQ ID NO: 7768146 - DNA, 22 bp, Homo sapiens
ataataacacctgaataggaaa

SEQ ID NO: 7768147 - DNA, 22 bp, Homo sapiens
ataataacacctgaataggaaa

SEQ ID NO: 7768148 - DNA, 22 bp, Homo sapiens
ataataaaccaggatgggtctg

SEQ ID NO: 7768149 - DNA, 22 bp, Homo sapiens
ataataaaccaggatgggtctg

SEQ ID NO: 7768150 - DNA, 22 bp, Homo sapiens
ataataaaccaggatgggtctg

SEQ ID NO: 7768151 - DNA, 22 bp, Homo sapiens
ataataacaatgccagatgcct

SEQ ID NO: 7768152 - DNA, 22 bp, Homo sapiens
ataataaaccaggatgggtctg

SEQ ID NO: 7768153 - DNA, 22 bp, Homo sapiens
ctgcctgctgacattctttata

SEQ ID NO: 7768154 - DNA, 22 bp, Homo sapiens
ataagtttgtctttgtaaagat

SEQ ID NO: 7768155 - DNA, 22 bp, Homo sapiens
ctgccctgtctgcagcctggct

SEQ ID NO: 7768156 - DNA, 22 bp, Homo sapiens
ctgccctgtggctctgagtcat

SEQ ID NO: 7768157 - DNA, 22 bp, Homo sapiens
ctgccctcgggccctcccatag

SEQ ID NO: 7768158 - DNA, 22 bp, Homo sapiens
ctgccctcgggccctcccatag

SEQ ID NO: 7768159 - DNA, 22 bp, Homo sapiens
ctgccctcccagttggtccgtg

SEQ ID NO: 7768160 - DNA, 22 bp, Homo sapiens
ctgccctctagaggaggactga

SEQ ID NO: 7768161 - DNA, 22 bp, Homo sapiens
ctgccctctagggatgcactgg

SEQ ID NO: 7768162 - DNA, 22 bp, Homo sapiens
ctgccctctagggatgcactgg

SEQ ID NO: 7768163 - DNA, 22 bp, Homo sapiens
agttttcaatatatgatagtga

SEQ ID NO: 7768164 - DNA, 22 bp, Homo sapiens
agttttcagtaaatattagtga

SEQ ID NO: 7768165 - DNA, 22 bp, Homo sapiens
agttttcagtaaatattagtga

SEQ ID NO: 7768166 - DNA, 22 bp, Homo sapiens
agttttcagtaaatattagtga

SEQ ID NO: 7768167 - DNA, 22 bp, Homo sapiens
agttttctcacatcaaaaatga

SEQ ID NO: 7768168 - DNA, 22 bp, Homo sapiens
agttttctgctaaaccagctaa

SEQ ID NO: 7768169 - DNA, 22 bp, Homo sapiens
agttttctgggatcactggaat

SEQ ID NO: 7768170 - DNA, 21 bp, Homo sapiens
agttttctgagttataaaata

SEQ ID NO: 7768171 - DNA, 22 bp, Homo sapiens
agttttctgatgtgtagtgaga

SEQ ID NO: 7768172 - DNA, 22 bp, Homo sapiens
agttttctttcgcaaaggtaca

SEQ ID NO: 7768173 - DNA, 22 bp, Homo sapiens
agttttctttcgcaaaggtaca

SEQ ID NO: 7768174 - DNA, 22 bp, Homo sapiens
agttttcttcattttgtggcca

SEQ ID NO: 7768175 - DNA, 22 bp, Homo sapiens
agtgttcatttattcattcact

SEQ ID NO: 7768176 - DNA, 22 bp, Homo sapiens
agtttacaacagtagctatgga

SEQ ID NO: 7768177 - DNA, 22 bp, Homo sapiens
agtttacaacagtagctatgga

SEQ ID NO: 7768178 - DNA, 22 bp, Homo sapiens
agtgttactggttcatgaatct

SEQ ID NO: 7768179 - DNA, 23 bp, Homo sapiens
agtgttcagcatgtagtaaatac

SEQ ID NO: 7768180 - DNA, 21 bp, Homo sapiens
agtgttaatggaaattatatt

SEQ ID NO: 7768181 - DNA, 22 bp, Homo sapiens
agtgttaatggtgtatattagg

SEQ ID NO: 7768182 - DNA, 22 bp, Homo sapiens
agtgttaatggtgtatattagg

SEQ ID NO: 7768183 - DNA, 18 bp, Homo sapiens
agtgttaagtaagtagca

SEQ ID NO: 7768184 - DNA, 22 bp, Homo sapiens
agtgttaagagaaaattctgct

SEQ ID NO: 7768185 - DNA, 22 bp, Homo sapiens
ctgagaggcggaggttgcagtg

SEQ ID NO: 7768186 - DNA, 22 bp, Homo sapiens
agtttcaattcttttcacaaag

SEQ ID NO: 7768187 - DNA, 22 bp, Homo sapiens
agtttatttttgataagtcttg

SEQ ID NO: 7768188 - DNA, 22 bp, Homo sapiens
agtttcactaaggtctgtgtgt

SEQ ID NO: 7768189 - DNA, 21 bp, Homo sapiens
agtttcaggaagttcagctgc

SEQ ID NO: 7768190 - DNA, 18 bp, Homo sapiens
agtttcagggcaggaaac

SEQ ID NO: 7768191 - DNA, 22 bp, Homo sapiens
agtttcagtgttgacagatggt

SEQ ID NO: 7768192 - DNA, 22 bp, Homo sapiens
agtttcatattaccatgtcacc

SEQ ID NO: 7768193 - DNA, 22 bp, Homo sapiens
agtttcatccgatctggtctca

SEQ ID NO: 7768194 - DNA, 22 bp, Homo sapiens
agtttcatattaccatgtcacc

SEQ ID NO: 7768195 - DNA, 22 bp, Homo sapiens
agtttctctagagtctttgaaa

SEQ ID NO: 7768196 - DNA, 22 bp, Homo sapiens
agtttctagcctcactgtttag

SEQ ID NO: 7768197 - DNA, 22 bp, Homo sapiens
agtttctatgtgaaatgcacat

SEQ ID NO: 7768198 - DNA, 22 bp, Homo sapiens
agtttctatgtaagctacgtga

SEQ ID NO: 7768199 - DNA, 22 bp, Homo sapiens
agtttctctttgacaccaaaat

SEQ ID NO: 7768200 - DNA, 22 bp, Homo sapiens
agtttcttcatccaaaaaatgg

SEQ ID NO: 7768201 - DNA, 22 bp, Homo sapiens
agtttctttagatagaaagttc

SEQ ID NO: 7768202 - DNA, 22 bp, Homo sapiens
agtttcttgccgtgctttccat

SEQ ID NO: 7768203 - DNA, 22 bp, Homo sapiens
agtttcttgaagactgatgttt

SEQ ID NO: 7768204 - DNA, 22 bp, Homo sapiens
ctgagtggaacataggatgata

SEQ ID NO: 7768205 - DNA, 22 bp, Homo sapiens
ctgagtttccagataagacctt

SEQ ID NO: 7768206 - DNA, 22 bp, Homo sapiens
agttttattccaatgtgcagca

SEQ ID NO: 7768207 - DNA, 22 bp, Homo sapiens
cgcgctctccttctggcaccca

SEQ ID NO: 7768208 - DNA, 22 bp, Homo sapiens
cgcgaggtggaggttgcagtga

SEQ ID NO: 7768209 - DNA, 19 bp, Homo sapiens
cgcctggcaggccctgcgc

SEQ ID NO: 7768210 - DNA, 22 bp, Homo sapiens
cgcggtggcggcctccagcgcc

SEQ ID NO: 7768211 - DNA, 22 bp, Homo sapiens
cgcggtggcggcctccagcgcc

SEQ ID NO: 7768212 - DNA, 22 bp, Homo sapiens
cgcgctgcagacagcggaggcc

SEQ ID NO: 7768213 - DNA, 22 bp, Homo sapiens
cgcgctgtttacgtgacttaat

SEQ ID NO: 7768214 - DNA, 22 bp, Homo sapiens
cggtcaggtgcagcgttggcac

SEQ ID NO: 7768215 - DNA, 22 bp, Homo sapiens
cgtgccactgcactctagcctg

SEQ ID NO: 7768216 - DNA, 22 bp, Homo sapiens
cgtgccactgcactctagcctg

SEQ ID NO: 7768217 - DNA, 22 bp, Homo sapiens
cgtgcgcctcagcctcgtgcgc

SEQ ID NO: 7768218 - DNA, 22 bp, Homo sapiens
cgtggcagtggaaggctgggtg

SEQ ID NO: 7768219 - DNA, 22 bp, Homo sapiens
cgtggccacccagtggtgcgtg

SEQ ID NO: 7768220 - DNA, 22 bp, Homo sapiens
cgtggccagcacaaggcagtga

SEQ ID NO: 7768221 - DNA, 22 bp, Homo sapiens
ctaaaattatcaagataattcc

SEQ ID NO: 7768222 - DNA, 22 bp, Homo sapiens
ctaaacaagatactaatgaggt

SEQ ID NO: 7768223 - DNA, 22 bp, Homo sapiens
ctaaacatgttggtgctttaaa

SEQ ID NO: 7768224 - DNA, 22 bp, Homo sapiens
ctaaacatgcaagagcttctgg

SEQ ID NO: 7768225 - DNA, 22 bp, Homo sapiens
ctaaacaagggattataattga

SEQ ID NO: 7768226 - DNA, 22 bp, Homo sapiens
ctaaacaagggattataattga

SEQ ID NO: 7768227 - DNA, 22 bp, Homo sapiens
ctaaacaatgaacaaagcactg

SEQ ID NO: 7768228 - DNA, 22 bp, Homo sapiens
ctacactagagttgcaatggaa

SEQ ID NO: 7768229 - DNA, 22 bp, Homo sapiens
ctacacagttctgcctaatggc

SEQ ID NO: 7768230 - DNA, 22 bp, Homo sapiens
ctacagaaaatcagccacaggc

SEQ ID NO: 7768231 - DNA, 22 bp, Homo sapiens
ctacagaagaaactatcactat

SEQ ID NO: 7768232 - DNA, 22 bp, Homo sapiens
ctacagaaacctttttcataca

SEQ ID NO: 7768233 - DNA, 22 bp, Homo sapiens
agtcaggggatctagacttgaa

SEQ ID NO: 7768234 - DNA, 22 bp, Homo sapiens
agtcaggctgacaggctaggag

SEQ ID NO: 7768235 - DNA, 22 bp, Homo sapiens
agtcataattataaacatcagt

SEQ ID NO: 7768236 - DNA, 22 bp, Homo sapiens
agtcagagttttgaggtgtgac

SEQ ID NO: 7768237 - DNA, 22 bp, Homo sapiens
agtcagagttcttggggagaca

SEQ ID NO: 7768238 - DNA, 22 bp, Homo sapiens
ctacaagatttttaaaactgta

SEQ ID NO: 7768239 - DNA, 22 bp, Homo sapiens
agtcagatttaaagctgtttga

SEQ ID NO: 7768240 - DNA, 22 bp, Homo sapiens
ctacaacattatgctttctgtc

SEQ ID NO: 7768241 - DNA, 22 bp, Homo sapiens
agtcagaattcgatcccaggtc

SEQ ID NO: 7768242 - DNA, 22 bp, Homo sapiens
agtcactttctacttggtttct

SEQ ID NO: 7768243 - DNA, 22 bp, Homo sapiens
agtcagagaccctagatctaat

SEQ ID NO: 7768244 - DNA, 22 bp, Homo sapiens
agtcagagcaaactggacagac

SEQ ID NO: 7768245 - DNA, 22 bp, Homo sapiens
aggtgtggctggggcagaggcc

SEQ ID NO: 7768246 - DNA, 19 bp, Homo sapiens
aggtgtgggggctgcagac

SEQ ID NO: 7768247 - DNA, 19 bp, Homo sapiens
aggtgtgggggctgcagac

SEQ ID NO: 7768248 - DNA, 17 bp, Homo sapiens
aggtgtggtcaagggag

SEQ ID NO: 7768249 - DNA, 22 bp, Homo sapiens
cctggtccccatcggcccagcg

SEQ ID NO: 7768250 - DNA, 22 bp, Homo sapiens
cctggtccccatcggcccagcg

SEQ ID NO: 7768251 - DNA, 22 bp, Homo sapiens
cctggtgcccccaagccagctg

SEQ ID NO: 7768252 - DNA, 22 bp, Homo sapiens
aggttagtgctgaaatgacatg

SEQ ID NO: 7768253 - DNA, 23 bp, Homo sapiens
aggttatgattatagagcgagga

SEQ ID NO: 7768254 - DNA, 22 bp, Homo sapiens
aggttggcctcagggaggctct

SEQ ID NO: 7768255 - DNA, 22 bp, Homo sapiens
aggtttctcctttaaagcatgg

SEQ ID NO: 7768256 - DNA, 22 bp, Homo sapiens
agtaatagtgaatcgactatga

SEQ ID NO: 7768257 - DNA, 22 bp, Homo sapiens
agtaatgaggatgtttgcaaaa

SEQ ID NO: 7768258 - DNA, 22 bp, Homo sapiens
agtaatgaagatttgttgcaca

SEQ ID NO: 7768259 - DNA, 22 bp, Homo sapiens
agtaatgaatacggtatttgaa

SEQ ID NO: 7768260 - DNA, 21 bp, Homo sapiens
agtacaaaaattcctttctca

SEQ ID NO: 7768261 - DNA, 22 bp, Homo sapiens
agtacaaatgcagccagagtag

SEQ ID NO: 7768262 - DNA, 22 bp, Homo sapiens
agtacaaactgtttcaaagtag

SEQ ID NO: 7768263 - DNA, 22 bp, Homo sapiens
agtacaaactgtttcaaagtag

SEQ ID NO: 7768264 - DNA, 22 bp, Homo sapiens
agtacaaactgtttcaaagtag

SEQ ID NO: 7768265 - DNA, 22 bp, Homo sapiens
agtacaaaatgcagcatcatca

SEQ ID NO: 7768266 - DNA, 22 bp, Homo sapiens
agtacaaaggcccttgattact

SEQ ID NO: 7768267 - DNA, 23 bp, Homo sapiens
aggtggagctgtgcagccggggc

SEQ ID NO: 7768268 - DNA, 22 bp, Homo sapiens
aggtggagtgaaggaaaggcag

SEQ ID NO: 7768269 - DNA, 22 bp, Homo sapiens
aggtggagtgtgcagggagagc

SEQ ID NO: 7768270 - DNA, 22 bp, Homo sapiens
cctggtcaggtaactgggctga

SEQ ID NO: 7768271 - DNA, 22 bp, Homo sapiens
cctggtcagagcagtcaggatc

SEQ ID NO: 7768272 - DNA, 22 bp, Homo sapiens
cctggtcacccctctctctgca

SEQ ID NO: 7768273 - DNA, 22 bp, Homo sapiens
cctgggttggagagcaatggtg

SEQ ID NO: 7768274 - DNA, 22 bp, Homo sapiens
cctgggcaggatgggcccggtg

SEQ ID NO: 7768275 - DNA, 22 bp, Homo sapiens
cctgggcaggtgtggcttcccc

SEQ ID NO: 7768276 - DNA, 18 bp, Homo sapiens
aggtctgaggaagagcct

SEQ ID NO: 7768277 - DNA, 22 bp, Homo sapiens
aggtctgagtatggcctgagaa

SEQ ID NO: 7768278 - DNA, 22 bp, Homo sapiens
aggtctggaaacagcagggaga

SEQ ID NO: 7768279 - DNA, 22 bp, Homo sapiens
aggtatgtatgtgtgtatattt

SEQ ID NO: 7768280 - DNA, 22 bp, Homo sapiens
aggtctggaggcggagtcagga

SEQ ID NO: 7768281 - DNA, 22 bp, Homo sapiens
aggtctggtgagagcaggtgct

SEQ ID NO: 7768282 - DNA, 22 bp, Homo sapiens
aggtgagggtgccagtgcatgg

SEQ ID NO: 7768283 - DNA, 22 bp, Homo sapiens
agggtggaagatggcactatct

SEQ ID NO: 7768284 - DNA, 23 bp, Homo sapiens
agggtgagcaagctatggagacc

SEQ ID NO: 7768285 - DNA, 22 bp, Homo sapiens
cctgcctgcgtcctctgagggc

SEQ ID NO: 7768286 - DNA, 21 bp, Homo sapiens
cctggactaaaaccaggccac

SEQ ID NO: 7768287 - DNA, 22 bp, Homo sapiens
cctggagcaggagctgcagagg

SEQ ID NO: 7768288 - DNA, 22 bp, Homo sapiens
cctgcctggatcagccatcctg

SEQ ID NO: 7768289 - DNA, 22 bp, Homo sapiens
cctgcctggatcagccatcctg

SEQ ID NO: 7768290 - DNA, 22 bp, Homo sapiens
cctggctcattatgtgccccca

SEQ ID NO: 7768291 - DNA, 22 bp, Homo sapiens
cctggctccaaagctgtgactc

SEQ ID NO: 7768292 - DNA, 22 bp, Homo sapiens
cctggctcaggcacgcatggct

SEQ ID NO: 7768293 - DNA, 22 bp, Homo sapiens
cctggctcagaccccagttctg

SEQ ID NO: 7768294 - DNA, 22 bp, Homo sapiens
cctggctcagaccccagttctg

SEQ ID NO: 7768295 - DNA, 22 bp, Homo sapiens
cctggctcaaggcgaggactcc

SEQ ID NO: 7768296 - DNA, 22 bp, Homo sapiens
cctggctcaaggcgaggactcc

SEQ ID NO: 7768297 - DNA, 22 bp, Homo sapiens
cctggcctttgaacgctagact

SEQ ID NO: 7768298 - DNA, 22 bp, Homo sapiens
cctggctaggagagctgggctc

SEQ ID NO: 7768299 - DNA, 22 bp, Homo sapiens
cctggccagcagccccttcctc

SEQ ID NO: 7768300 - DNA, 22 bp, Homo sapiens
cctggagcccctctggccagcc

SEQ ID NO: 7768301 - DNA, 22 bp, Homo sapiens
cctggagcccctctggccagcc

SEQ ID NO: 7768302 - DNA, 22 bp, Homo sapiens
agtgcaggctcgcttgtgaggc

SEQ ID NO: 7768303 - DNA, 22 bp, Homo sapiens
agtgcaggagcctggccagagc

SEQ ID NO: 7768304 - DNA, 22 bp, Homo sapiens
agtgcaggccccaggccaggcc

SEQ ID NO: 7768305 - DNA, 22 bp, Homo sapiens
ctctctggcttggcacggagat

SEQ ID NO: 7768306 - DNA, 18 bp, Homo sapiens
ctctctgggtgaggacaa

SEQ ID NO: 7768307 - DNA, 17 bp, Homo sapiens
agtggcaggcagatggg

SEQ ID NO: 7768308 - DNA, 22 bp, Homo sapiens
agtggctggagccccaggctgg

SEQ ID NO: 7768309 - DNA, 22 bp, Homo sapiens
agtggcaggcggagatgtagga

SEQ ID NO: 7768310 - DNA, 22 bp, Homo sapiens
ctctgacattctgtgactctga

SEQ ID NO: 7768311 - DNA, 22 bp, Homo sapiens
agtgggagggccatatggtgaa

SEQ ID NO: 7768312 - DNA, 22 bp, Homo sapiens
agtgggcaggcagggtgcgcag

SEQ ID NO: 7768313 - DNA, 22 bp, Homo sapiens
agtgggcccttgtcacactgat

SEQ ID NO: 7768314 - DNA, 22 bp, Homo sapiens
agtggggaagagcatgggccct

SEQ ID NO: 7768315 - DNA, 22 bp, Homo sapiens
ctcttacattcttttactagca

SEQ ID NO: 7768316 - DNA, 22 bp, Homo sapiens
ctcttacattcttttactagca

SEQ ID NO: 7768317 - DNA, 22 bp, Homo sapiens
agtgtctgcctatttttcaagc

SEQ ID NO: 7768318 - DNA, 22 bp, Homo sapiens
ctcttaaagaatgttccagctg

SEQ ID NO: 7768319 - DNA, 22 bp, Homo sapiens
agtggggacttatgccagcatt

SEQ ID NO: 7768320 - DNA, 22 bp, Homo sapiens
agtggggacaatgagagcaggt

SEQ ID NO: 7768321 - DNA, 22 bp, Homo sapiens
agtggggaggtccaggccaccc

SEQ ID NO: 7768322 - DNA, 20 bp, Homo sapiens
agtggggagtcaggagtgcc

SEQ ID NO: 7768323 - DNA, 22 bp, Homo sapiens
ctgaagcaaatgaaacagctct

SEQ ID NO: 7768324 - DNA, 22 bp, Homo sapiens
ctgaagcagatgtggctgagat

SEQ ID NO: 7768325 - DNA, 22 bp, Homo sapiens
ctgaagcaggaacagcgagatt

SEQ ID NO: 7768326 - DNA, 22 bp, Homo sapiens
ctgaagcaattgagagatgttt

SEQ ID NO: 7768327 - DNA, 22 bp, Homo sapiens
ctgaagccacgatagcttccta

SEQ ID NO: 7768328 - DNA, 22 bp, Homo sapiens
ctgaagccacgatagcttccta

SEQ ID NO: 7768329 - DNA, 22 bp, Homo sapiens
ctgaagccatgtgctcactggt

SEQ ID NO: 7768330 - DNA, 22 bp, Homo sapiens
ctgaagcagggagtgatgaagt

SEQ ID NO: 7768331 - DNA, 22 bp, Homo sapiens
ctgaagcaggaggggaggcgct

SEQ ID NO: 7768332 - DNA, 22 bp, Homo sapiens
ctgaagcttagtttacgctcca

SEQ ID NO: 7768333 - DNA, 22 bp, Homo sapiens
ctgaagctgggcacttcctttt

SEQ ID NO: 7768334 - DNA, 22 bp, Homo sapiens
ctgaagctgaaaacttccagca

SEQ ID NO: 7768335 - DNA, 22 bp, Homo sapiens
ctgaagctaggtcaaaaaaggg

SEQ ID NO: 7768336 - DNA, 22 bp, Homo sapiens
ctgagaggatgctgcagtggag

SEQ ID NO: 7768337 - DNA, 22 bp, Homo sapiens
ctgagaggatgctgcagtggag

SEQ ID NO: 7768338 - DNA, 22 bp, Homo sapiens
ctgagaggaacatcttatgctt

SEQ ID NO: 7768339 - DNA, 22 bp, Homo sapiens
ctgagaggcggagcttgcagtg

SEQ ID NO: 7768340 - DNA, 22 bp, Homo sapiens
agtcataattataaacatcagt

SEQ ID NO: 7768341 - DNA, 22 bp, Homo sapiens
agtcatatgacccttcacaaac

SEQ ID NO: 7768342 - DNA, 22 bp, Homo sapiens
agtcatatttatataatttccc

SEQ ID NO: 7768343 - DNA, 22 bp, Homo sapiens
agtcatcatctgccctcactgg

SEQ ID NO: 7768344 - DNA, 22 bp, Homo sapiens
agtcatcatgtacagagagcaa

SEQ ID NO: 7768345 - DNA, 22 bp, Homo sapiens
agtccaaagcagatgagggcca

SEQ ID NO: 7768346 - DNA, 22 bp, Homo sapiens
agtcattttctgcctgtaatct

SEQ ID NO: 7768347 - DNA, 22 bp, Homo sapiens
agtctctttaatcacagtgtct

SEQ ID NO: 7768348 - DNA, 20 bp, Homo sapiens
agtctctcccagaatgagca

SEQ ID NO: 7768349 - DNA, 22 bp, Homo sapiens
agtctgaagactcatgtctgaa

SEQ ID NO: 7768350 - DNA, 22 bp, Homo sapiens
agtctgaaccagatggcaaggt

SEQ ID NO: 7768351 - DNA, 22 bp, Homo sapiens
agtctctttgtataaataggca

SEQ ID NO: 7768352 - DNA, 22 bp, Homo sapiens
agtctctttctaaataaggtca

SEQ ID NO: 7768353 - DNA, 22 bp, Homo sapiens
agtctcttttgcgaagagtgtt

SEQ ID NO: 7768354 - DNA, 22 bp, Homo sapiens
agtctgagtctaaaggcttgag

SEQ ID NO: 7768355 - DNA, 23 bp, Homo sapiens
agtctgaattgagatgtgctgtg

SEQ ID NO: 7768356 - DNA, 22 bp, Homo sapiens
agtctgagtatctctgagccag

SEQ ID NO: 7768357 - DNA, 22 bp, Homo sapiens
agtctgaaggcaatctgctgac

SEQ ID NO: 7768358 - DNA, 22 bp, Homo sapiens
agtctgaagtagtctttagtgt

SEQ ID NO: 7768359 - DNA, 22 bp, Homo sapiens
agtctgaagatattcttgcagg

SEQ ID NO: 7768360 - DNA, 22 bp, Homo sapiens
agtctgcttcctggagaactca

SEQ ID NO: 7768361 - DNA, 22 bp, Homo sapiens
agtctggaatttggcctgagca

SEQ ID NO: 7768362 - DNA, 22 bp, Homo sapiens
agtcttaatagagaaaaactgt

SEQ ID NO: 7768363 - DNA, 22 bp, Homo sapiens
ctcaggatgcaattccatcaag

SEQ ID NO: 7768364 - DNA, 22 bp, Homo sapiens
ctcaggcacgggtcagtgagcg

SEQ ID NO: 7768365 - DNA, 22 bp, Homo sapiens
ctcaggatgtcggtgactattg

SEQ ID NO: 7768366 - DNA, 22 bp, Homo sapiens
ctcaggcacttttgtcacagac

SEQ ID NO: 7768367 - DNA, 22 bp, Homo sapiens
ctcaggcacttttgtcacagac

SEQ ID NO: 7768368 - DNA, 22 bp, Homo sapiens
agtgacagtctcagagatcagg

SEQ ID NO: 7768369 - DNA, 22 bp, Homo sapiens
ctccagttggccccagttggtt

SEQ ID NO: 7768370 - DNA, 22 bp, Homo sapiens
ctccagtggtgatggggaagaa

SEQ ID NO: 7768371 - DNA, 20 bp, Homo sapiens
ctccagtgttcaggggagtg

SEQ ID NO: 7768372 - DNA, 22 bp, Homo sapiens
agtgcagagacctggtcaggca

SEQ ID NO: 7768373 - DNA, 22 bp, Homo sapiens
agtgcagaggctgggaaatgct

SEQ ID NO: 7768374 - DNA, 22 bp, Homo sapiens
agtgcagatttttagtcagctt

SEQ ID NO: 7768375 - DNA, 22 bp, Homo sapiens
agtgcagatttttagtcagctt

SEQ ID NO: 7768376 - DNA, 22 bp, Homo sapiens
agtgaccaatcactgaatgatt

SEQ ID NO: 7768377 - DNA, 22 bp, Homo sapiens
agtgacgtttattgggtgtgaa

SEQ ID NO: 7768378 - DNA, 22 bp, Homo sapiens
agtgaccgaggcacttggcaac

SEQ ID NO: 7768379 - DNA, 22 bp, Homo sapiens
ctcctccctgcgattgctctgc

SEQ ID NO: 7768380 - DNA, 22 bp, Homo sapiens
ctcctccctctttgccacacat

SEQ ID NO: 7768381 - DNA, 22 bp, Homo sapiens
ctcctctccatcagcgccaccc

SEQ ID NO: 7768382 - DNA, 22 bp, Homo sapiens
ctcccagggtagggagagacta

SEQ ID NO: 7768383 - DNA, 22 bp, Homo sapiens
ctcccaggggaactatcaagta

SEQ ID NO: 7768384 - DNA, 22 bp, Homo sapiens
ctcctcagctgggaggagtccc

SEQ ID NO: 7768385 - DNA, 22 bp, Homo sapiens
ctcccagggtctaggctgctgg

SEQ ID NO: 7768386 - DNA, 21 bp, Homo sapiens
ctcccagggtgactgttcaac

SEQ ID NO: 7768387 - DNA, 22 bp, Homo sapiens
aggcaggggagctggaagggta

SEQ ID NO: 7768388 - DNA, 22 bp, Homo sapiens
aggcaggggagctggaagggta

SEQ ID NO: 7768389 - DNA, 22 bp, Homo sapiens
aggcagggtcttgctatgttgc

SEQ ID NO: 7768390 - DNA, 22 bp, Homo sapiens
aggcagggtgatgataatgatt

SEQ ID NO: 7768391 - DNA, 22 bp, Homo sapiens
ccacagcttcgcagtctgctgc

SEQ ID NO: 7768392 - DNA, 20 bp, Homo sapiens
ccacaggagtccagtcgacc

SEQ ID NO: 7768393 - DNA, 22 bp, Homo sapiens
ccacaggaggatgttcagacaa

SEQ ID NO: 7768394 - DNA, 22 bp, Homo sapiens
ccacaggacggaggtctggccg

SEQ ID NO: 7768395 - DNA, 22 bp, Homo sapiens
aggcatggacatttcggcagct

SEQ ID NO: 7768396 - DNA, 22 bp, Homo sapiens
aggcatggatgtagcagtgacc

SEQ ID NO: 7768397 - DNA, 22 bp, Homo sapiens
aggcatggatgtagcagtgacc

SEQ ID NO: 7768398 - DNA, 22 bp, Homo sapiens
aggcatggcactgagcagcttc

SEQ ID NO: 7768399 - DNA, 22 bp, Homo sapiens
aggcatggcactgagcagcttc

SEQ ID NO: 7768400 - DNA, 22 bp, Homo sapiens
ccagcactgttctaaggaaaca

SEQ ID NO: 7768401 - DNA, 22 bp, Homo sapiens
ccagcagaagctcccgctgggt

SEQ ID NO: 7768402 - DNA, 22 bp, Homo sapiens
ccagcagaagctcccgctgggt

SEQ ID NO: 7768403 - DNA, 22 bp, Homo sapiens
ccagcagagcatggggaggaag

SEQ ID NO: 7768404 - DNA, 22 bp, Homo sapiens
aggccagagaggggaccagcct

SEQ ID NO: 7768405 - DNA, 22 bp, Homo sapiens
aggccagacagctagaaacagg

SEQ ID NO: 7768406 - DNA, 22 bp, Homo sapiens
aggccagacagctagaaacagg

SEQ ID NO: 7768407 - DNA, 22 bp, Homo sapiens
ccagcagaggggcggagtgcag

SEQ ID NO: 7768408 - DNA, 22 bp, Homo sapiens
ccagcctcatcgcctgcctgtc

SEQ ID NO: 7768409 - DNA, 22 bp, Homo sapiens
aggccagagttaaggagaacag

SEQ ID NO: 7768410 - DNA, 22 bp, Homo sapiens
ccagcctccatgtagatagctg

SEQ ID NO: 7768411 - DNA, 22 bp, Homo sapiens
ccagcctgaaatgcctcatcct

SEQ ID NO: 7768412 - DNA, 22 bp, Homo sapiens
ccagcctgaaatgcctcatcct

SEQ ID NO: 7768413 - DNA, 22 bp, Homo sapiens
aggcccagcccgtcctcgtgct

SEQ ID NO: 7768414 - DNA, 19 bp, Homo sapiens
aggcccagcgctgggggct

SEQ ID NO: 7768415 - DNA, 21 bp, Homo sapiens
aggcccagagtcttgggggga

SEQ ID NO: 7768416 - DNA, 22 bp, Homo sapiens
aggcccagagagccagttagtg

SEQ ID NO: 7768417 - DNA, 22 bp, Homo sapiens
aggcccagagcaggaaagggtt

SEQ ID NO: 7768418 - DNA, 22 bp, Homo sapiens
ccagcctggactgggtcttgtg

SEQ ID NO: 7768419 - DNA, 22 bp, Homo sapiens
ccagcctgaaatgcctcatcct

SEQ ID NO: 7768420 - DNA, 22 bp, Homo sapiens
aggcccagagagccagttagtg

SEQ ID NO: 7768421 - DNA, 22 bp, Homo sapiens
aggcccagctggacaaactgct

SEQ ID NO: 7768422 - DNA, 22 bp, Homo sapiens
aggcccagctggacaaactgct

SEQ ID NO: 7768423 - DNA, 22 bp, Homo sapiens
ccagcttgtttgaagctcgtca

SEQ ID NO: 7768424 - DNA, 22 bp, Homo sapiens
ccagcttgaagatgtgctggtt

SEQ ID NO: 7768425 - DNA, 21 bp, Homo sapiens
ccagctttcccaagtcccttt

SEQ ID NO: 7768426 - DNA, 22 bp, Homo sapiens
ccagcttttcagaatctgcctg

SEQ ID NO: 7768427 - DNA, 22 bp, Homo sapiens
aggccctggcactgcctgggag

SEQ ID NO: 7768428 - DNA, 22 bp, Homo sapiens
ccaggacaagtgtggccatggc

SEQ ID NO: 7768429 - DNA, 22 bp, Homo sapiens
aggccctgggcagttctgtagc

SEQ ID NO: 7768430 - DNA, 22 bp, Homo sapiens
aggccctggcccccagagattc

SEQ ID NO: 7768431 - DNA, 22 bp, Homo sapiens
ccaggagagcaggcgtgcagct

SEQ ID NO: 7768432 - DNA, 22 bp, Homo sapiens
ccaggagcgggaaaaggaagaa

SEQ ID NO: 7768433 - DNA, 22 bp, Homo sapiens
ccaggagcgcgtgaacaggctg

SEQ ID NO: 7768434 - DNA, 22 bp, Homo sapiens
ccaggagatgggaaagtagcag

SEQ ID NO: 7768435 - DNA, 22 bp, Homo sapiens
ccatgtacatgaacacggcggc

SEQ ID NO: 7768436 - DNA, 22 bp, Homo sapiens
ccatgggagatgatggggagtg

SEQ ID NO: 7768437 - DNA, 20 bp, Homo sapiens
aggctgcctaaggctctgca

SEQ ID NO: 7768438 - DNA, 20 bp, Homo sapiens
aggctgcctaaggctctgca

SEQ ID NO: 7768439 - DNA, 22 bp, Homo sapiens
ccatgtggctagcgtgcctgca

SEQ ID NO: 7768440 - DNA, 22 bp, Homo sapiens
cccactgctgctctccatggca

SEQ ID NO: 7768441 - DNA, 22 bp, Homo sapiens
aggctgcctggctgtgagtgaa

SEQ ID NO: 7768442 - DNA, 22 bp, Homo sapiens
aggctgcctcttttgagagggt

SEQ ID NO: 7768443 - DNA, 21 bp, Homo sapiens
cccagagcctagggagggcac

SEQ ID NO: 7768444 - DNA, 22 bp, Homo sapiens
cccagagccggtggtgctcaca

SEQ ID NO: 7768445 - DNA, 22 bp, Homo sapiens
aggctggctgacttctgaagca

SEQ ID NO: 7768446 - DNA, 22 bp, Homo sapiens
aggctggctgaaaaacaccctt

SEQ ID NO: 7768447 - DNA, 22 bp, Homo sapiens
aggctggctcggcttttctgtc

SEQ ID NO: 7768448 - DNA, 17 bp, Homo sapiens
aggctggctcacaggga

SEQ ID NO: 7768449 - DNA, 17 bp, Homo sapiens
aggctggctcacaggga

SEQ ID NO: 7768450 - DNA, 22 bp, Homo sapiens
aggctgaggggcgagggaccct

SEQ ID NO: 7768451 - DNA, 22 bp, Homo sapiens
aggctctgtgcagcctgcatct

SEQ ID NO: 7768452 - DNA, 22 bp, Homo sapiens
aggctctgtgcagcctgcatct

SEQ ID NO: 7768453 - DNA, 22 bp, Homo sapiens
aggctctgtcaggcggagcagc

SEQ ID NO: 7768454 - DNA, 22 bp, Homo sapiens
aggctctgtgacaatcaagctg

SEQ ID NO: 7768455 - DNA, 22 bp, Homo sapiens
aggctgaggtgtgctgtgatcg

SEQ ID NO: 7768456 - DNA, 22 bp, Homo sapiens
aggctgaggtgtgctgtgatcg

SEQ ID NO: 7768457 - DNA, 22 bp, Homo sapiens
aggctgaggtaggaggatcgct

SEQ ID NO: 7768458 - DNA, 22 bp, Homo sapiens
aggctgaggtaggaggatcgct

SEQ ID NO: 7768459 - DNA, 22 bp, Homo sapiens
aggctgagtcgggaggatcact

SEQ ID NO: 7768460 - DNA, 19 bp, Homo sapiens
ccatgcagcctgggggcag

SEQ ID NO: 7768461 - DNA, 22 bp, Homo sapiens
aggctgagtcgggaggatcact

SEQ ID NO: 7768462 - DNA, 22 bp, Homo sapiens
ccagggaagtagttgtgagagc

SEQ ID NO: 7768463 - DNA, 22 bp, Homo sapiens
ccagggagcccacaggacaatg

SEQ ID NO: 7768464 - DNA, 22 bp, Homo sapiens
ccagggagcctggtgtgtcagc

SEQ ID NO: 7768465 - DNA, 22 bp, Homo sapiens
aggctccgtccagtctcaggcc

SEQ ID NO: 7768466 - DNA, 22 bp, Homo sapiens
ccagggaggagcatttcatggt

SEQ ID NO: 7768467 - DNA, 22 bp, Homo sapiens
ccagggtcttggagaggagtgc

SEQ ID NO: 7768468 - DNA, 22 bp, Homo sapiens
ccagggtcttggagaggagtgc

SEQ ID NO: 7768469 - DNA, 22 bp, Homo sapiens
ccagggtcttcgaggcagcaat

SEQ ID NO: 7768470 - DNA, 22 bp, Homo sapiens
ccaggagctggagggtgcagtg

SEQ ID NO: 7768471 - DNA, 17 bp, Homo sapiens
ccaggagcgtgggtctc

SEQ ID NO: 7768472 - DNA, 22 bp, Homo sapiens
ccaggagctatgtacacactat

SEQ ID NO: 7768473 - DNA, 22 bp, Homo sapiens
ccaggagctggcatgtggagag

SEQ ID NO: 7768474 - DNA, 22 bp, Homo sapiens
aggctcagtatagctggcaagt

SEQ ID NO: 7768475 - DNA, 22 bp, Homo sapiens
aggctcagttctgtggtgagcc

SEQ ID NO: 7768476 - DNA, 22 bp, Homo sapiens
aggctcagtgcaaatcattctg

SEQ ID NO: 7768477 - DNA, 22 bp, Homo sapiens
aggctccaaattaccaagctct

SEQ ID NO: 7768478 - DNA, 22 bp, Homo sapiens
aggctcattcttgcctctgagc

SEQ ID NO: 7768479 - DNA, 22 bp, Homo sapiens
aggctcatccccacaaagcaaa

SEQ ID NO: 7768480 - DNA, 22 bp, Homo sapiens
aggctccaccccgccagacctt

SEQ ID NO: 7768481 - DNA, 23 bp, Homo sapiens
aggctccacatgggcactttgca

SEQ ID NO: 7768482 - DNA, 22 bp, Homo sapiens
aggctccaccagtcaggtgcat

SEQ ID NO: 7768483 - DNA, 22 bp, Homo sapiens
aggctccaccctacagagctcc

SEQ ID NO: 7768484 - DNA, 23 bp, Homo sapiens
ccagggaaggccatcttcaactg

SEQ ID NO: 7768485 - DNA, 22 bp, Homo sapiens
ccagggaaggctgctggctgtg

SEQ ID NO: 7768486 - DNA, 21 bp, Homo sapiens
ccgccgctgatagctctgggc

SEQ ID NO: 7768487 - DNA, 22 bp, Homo sapiens
ccgaggctggagtgcagtggcg

SEQ ID NO: 7768488 - DNA, 22 bp, Homo sapiens
ccctttcctgaagaatattttt

SEQ ID NO: 7768489 - DNA, 22 bp, Homo sapiens
ccctttcccttctggctcaggg

SEQ ID NO: 7768490 - DNA, 22 bp, Homo sapiens
cccttcccttctgggagatcca

SEQ ID NO: 7768491 - DNA, 22 bp, Homo sapiens
agggccagagtctgtgtagata

SEQ ID NO: 7768492 - DNA, 22 bp, Homo sapiens
agggccagaatccctcagtcta

SEQ ID NO: 7768493 - DNA, 22 bp, Homo sapiens
ccctggaggctggaggcagtag

SEQ ID NO: 7768494 - DNA, 22 bp, Homo sapiens
ccctggaggcaaaggttgcagt

SEQ ID NO: 7768495 - DNA, 22 bp, Homo sapiens
agggccctctggcaggccaggc

SEQ ID NO: 7768496 - DNA, 22 bp, Homo sapiens
cctccccacgggcagccggcgc

SEQ ID NO: 7768497 - DNA, 22 bp, Homo sapiens
cctctggcttactgttgggttt

SEQ ID NO: 7768498 - DNA, 22 bp, Homo sapiens
agggctgcaggcaagatatggc

SEQ ID NO: 7768499 - DNA, 22 bp, Homo sapiens
cctcctggatggatttggtgga

SEQ ID NO: 7768500 - DNA, 22 bp, Homo sapiens
cctcctggaggctctagggaaa

SEQ ID NO: 7768501 - DNA, 22 bp, Homo sapiens
cctcctggagcattggtgagga

SEQ ID NO: 7768502 - DNA, 22 bp, Homo sapiens
cctcctggaggctctaagggag

SEQ ID NO: 7768503 - DNA, 22 bp, Homo sapiens
cctcctggaaaaattccctggc

SEQ ID NO: 7768504 - DNA, 22 bp, Homo sapiens
cctcctggaaaaattccctggc

SEQ ID NO: 7768505 - DNA, 22 bp, Homo sapiens
aggggctggcttatctgagagt

SEQ ID NO: 7768506 - DNA, 22 bp, Homo sapiens
aggggctgcctggcttggcact

SEQ ID NO: 7768507 - DNA, 22 bp, Homo sapiens
cctgaggaccagcacccatctg

SEQ ID NO: 7768508 - DNA, 22 bp, Homo sapiens
cctgaggatattcaccagcatg

SEQ ID NO: 7768509 - DNA, 22 bp, Homo sapiens
cctgaggccctggctgtgctga

SEQ ID NO: 7768510 - DNA, 22 bp, Homo sapiens
aggggctgcctggcttggcact

SEQ ID NO: 7768511 - DNA, 22 bp, Homo sapiens
cctgaggacatcagcatcacct

SEQ ID NO: 7768512 - DNA, 22 bp, Homo sapiens
cctgaggacacacgctgcagga

SEQ ID NO: 7768513 - DNA, 22 bp, Homo sapiens
agggatgctgctaagtggtcta

SEQ ID NO: 7768514 - DNA, 22 bp, Homo sapiens
agggatggaagctcgtctgcaa

SEQ ID NO: 7768515 - DNA, 22 bp, Homo sapiens
agggatggagtgcggcccggac

SEQ ID NO: 7768516 - DNA, 22 bp, Homo sapiens
agggatggaagctcgtctgcaa

SEQ ID NO: 7768517 - DNA, 22 bp, Homo sapiens
agggatggatcttggccctgga

SEQ ID NO: 7768518 - DNA, 22 bp, Homo sapiens
agggagtggttaagaaggtgca

SEQ ID NO: 7768519 - DNA, 22 bp, Homo sapiens
agggcagagatctgagtgggca

SEQ ID NO: 7768520 - DNA, 22 bp, Homo sapiens
agggcagagagatgaatgggat

SEQ ID NO: 7768521 - DNA, 22 bp, Homo sapiens
ccctggaggaccccaatgtggc

SEQ ID NO: 7768522 - DNA, 22 bp, Homo sapiens
ccctcccaggagtggccagaga

SEQ ID NO: 7768523 - DNA, 22 bp, Homo sapiens
ccctcccaggagtggccagaga

SEQ ID NO: 7768524 - DNA, 22 bp, Homo sapiens
agggatgggaactcctccagca

SEQ ID NO: 7768525 - DNA, 22 bp, Homo sapiens
ccctctgcctgcgccctggtgt

SEQ ID NO: 7768526 - DNA, 20 bp, Homo sapiens
ccctctgcacatggctgtgg

SEQ ID NO: 7768527 - DNA, 22 bp, Homo sapiens
ccctctgcaggctggacctgcc

SEQ ID NO: 7768528 - DNA, 22 bp, Homo sapiens
ccctctgctcaggtgcataggc

SEQ ID NO: 7768529 - DNA, 22 bp, Homo sapiens
ccctctggctcttctcaggccg

SEQ ID NO: 7768530 - DNA, 22 bp, Homo sapiens
cccaggggtaaggcgcagcgtg

SEQ ID NO: 7768531 - DNA, 22 bp, Homo sapiens
cccaggggaggtcctcagggaa

SEQ ID NO: 7768532 - DNA, 22 bp, Homo sapiens
cccagggcttttctcactagac

SEQ ID NO: 7768533 - DNA, 21 bp, Homo sapiens
cccagggaagccgcagtcacc

SEQ ID NO: 7768534 - DNA, 22 bp, Homo sapiens
cccagggccctggacagctaca

SEQ ID NO: 7768535 - DNA, 22 bp, Homo sapiens
cccagggctgcagatggaggct

SEQ ID NO: 7768536 - DNA, 22 bp, Homo sapiens
cccagggctgcagatggaggct

SEQ ID NO: 7768537 - DNA, 22 bp, Homo sapiens
cccaggatggggctgcagttat

SEQ ID NO: 7768538 - DNA, 22 bp, Homo sapiens
cccaggagtttgagttcagcat

SEQ ID NO: 7768539 - DNA, 22 bp, Homo sapiens
cccaggagttggaggctgcagt

SEQ ID NO: 7768540 - DNA, 22 bp, Homo sapiens
cccaggagttggaggctgcagt

SEQ ID NO: 7768541 - DNA, 23 bp, Homo sapiens
cccaggagtttcactgcaaaggt

SEQ ID NO: 7768542 - DNA, 22 bp, Homo sapiens
agggaaattaatgtgagcaatg

SEQ ID NO: 7768543 - DNA, 22 bp, Homo sapiens
agggaacagtgaaaggcatcag

SEQ ID NO: 7768544 - DNA, 22 bp, Homo sapiens
agggaaatggagagtgtagttt

SEQ ID NO: 7768545 - DNA, 22 bp, Homo sapiens
agggaaattaatgtgagcaatg

SEQ ID NO: 7768546 - DNA, 22 bp, Homo sapiens
aggcttggaagtggcagaactg

SEQ ID NO: 7768547 - DNA, 22 bp, Homo sapiens
aggcttggaggttctgtagcca

SEQ ID NO: 7768548 - DNA, 22 bp, Homo sapiens
aggcttggaggttctgtagcca

SEQ ID NO: 7768549 - DNA, 21 bp, Homo sapiens
aggcttggatctagacaggcc

SEQ ID NO: 7768550 - DNA, 19 bp, Homo sapiens
aggcttggattgtggccaa

SEQ ID NO: 7768551 - DNA, 19 bp, Homo sapiens
aggcttggattgtggccaa

SEQ ID NO: 7768552 - DNA, 22 bp, Homo sapiens
cccaggagttggaggctacggt

SEQ ID NO: 7768553 - DNA, 22 bp, Homo sapiens
cccaggagttggaggctacggt

SEQ ID NO: 7768554 - DNA, 22 bp, Homo sapiens
aggcttggaaaatttacagtgt

SEQ ID NO: 7768555 - DNA, 19 bp, Homo sapiens
aggcttggaacagccttat

SEQ ID NO: 7768556 - DNA, 19 bp, Homo sapiens
aggcttggaacagccttat

SEQ ID NO: 7768557 - DNA, 22 bp, Homo sapiens
aggcttctgtctttaggagttg

SEQ ID NO: 7768558 - DNA, 22 bp, Homo sapiens
aggcttctgataccatgagaga

SEQ ID NO: 7768559 - DNA, 22 bp, Homo sapiens
aggcttctacgtggtcccaggg

SEQ ID NO: 7768560 - DNA, 22 bp, Homo sapiens
aggcttctagggttggcagcgg

SEQ ID NO: 7768561 - DNA, 22 bp, Homo sapiens
aggctggctgacttctgaagca

SEQ ID NO: 7768562 - DNA, 22 bp, Homo sapiens
aggctggctgagctgcagcctg

SEQ ID NO: 7768563 - DNA, 22 bp, Homo sapiens
aggctggctggcaggggacaca

SEQ ID NO: 7768564 - DNA, 22 bp, Homo sapiens
aggcttcacctgcacctgagct

SEQ ID NO: 7768565 - DNA, 22 bp, Homo sapiens
aggcttcacgatgggtgaggtg

SEQ ID NO: 7768566 - DNA, 22 bp, Homo sapiens
aggcttcgcaaggttagagctg

SEQ ID NO: 7768567 - DNA, 22 bp, Homo sapiens
cagctctggttcctgggcccag

SEQ ID NO: 7768568 - DNA, 22 bp, Homo sapiens
cagctgaattcttcagactcca

SEQ ID NO: 7768569 - DNA, 22 bp, Homo sapiens
cagctgagaccagaatgcaggt

SEQ ID NO: 7768570 - DNA, 22 bp, Homo sapiens
agctgattccactttttcccca

SEQ ID NO: 7768571 - DNA, 22 bp, Homo sapiens
agctgcaagtgttgcctcctac

SEQ ID NO: 7768572 - DNA, 22 bp, Homo sapiens
agctgcaattaaagactgtgaa

SEQ ID NO: 7768573 - DNA, 22 bp, Homo sapiens
caggaaggcccacctgtcctgt

SEQ ID NO: 7768574 - DNA, 22 bp, Homo sapiens
caggaaggcgcggctgtgcctg

SEQ ID NO: 7768575 - DNA, 22 bp, Homo sapiens
caggaaggggctcactctggcc

SEQ ID NO: 7768576 - DNA, 22 bp, Homo sapiens
caggaaggggctcactctggcc

SEQ ID NO: 7768577 - DNA, 22 bp, Homo sapiens
agctgccacagagcctggccag

SEQ ID NO: 7768578 - DNA, 22 bp, Homo sapiens
agctgccaagttggagtagcaa

SEQ ID NO: 7768579 - DNA, 22 bp, Homo sapiens
caggaaggaccgtccagatcag

SEQ ID NO: 7768580 - DNA, 22 bp, Homo sapiens
agctgcagaggtttgtgcaaca

SEQ ID NO: 7768581 - DNA, 19 bp, Homo sapiens
agctgctggcccagggacc

SEQ ID NO: 7768582 - DNA, 22 bp, Homo sapiens
agctgctgcaagtggtgctaac

SEQ ID NO: 7768583 - DNA, 19 bp, Homo sapiens
agctgctgattggtggagg

SEQ ID NO: 7768584 - DNA, 22 bp, Homo sapiens
agctgctgcgcctcaccctggc

SEQ ID NO: 7768585 - DNA, 22 bp, Homo sapiens
agctgctgcctcactggtctgt

SEQ ID NO: 7768586 - DNA, 22 bp, Homo sapiens
caggaggattgcttgaggccag

SEQ ID NO: 7768587 - DNA, 22 bp, Homo sapiens
caggaggattgcttgaggccag

SEQ ID NO: 7768588 - DNA, 22 bp, Homo sapiens
caggaggattgcttgaggccag

SEQ ID NO: 7768589 - DNA, 22 bp, Homo sapiens
caggaggaggtgaggtagaact

SEQ ID NO: 7768590 - DNA, 22 bp, Homo sapiens
caggaggagggtacaccatcag

SEQ ID NO: 7768591 - DNA, 22 bp, Homo sapiens
caggagccccaggctgacaata

SEQ ID NO: 7768592 - DNA, 22 bp, Homo sapiens
caggagcccagagtcctcagct

SEQ ID NO: 7768593 - DNA, 22 bp, Homo sapiens
caggagccccaggctgacaata

SEQ ID NO: 7768594 - DNA, 22 bp, Homo sapiens
agctgccacctctgcctttggg

SEQ ID NO: 7768595 - DNA, 22 bp, Homo sapiens
caggaggagcattagcgtctca

SEQ ID NO: 7768596 - DNA, 22 bp, Homo sapiens
caggaggacatactggctcaca

SEQ ID NO: 7768597 - DNA, 22 bp, Homo sapiens
caggaggacatactggctcaca

SEQ ID NO: 7768598 - DNA, 20 bp, Homo sapiens
caggccagaggtttgatggc

SEQ ID NO: 7768599 - DNA, 20 bp, Homo sapiens
caggcagtttgtggttaggg

SEQ ID NO: 7768600 - DNA, 22 bp, Homo sapiens
agctggcctccgggtgcctggg

SEQ ID NO: 7768601 - DNA, 22 bp, Homo sapiens
agctggccggcctccaggtgga

SEQ ID NO: 7768602 - DNA, 20 bp, Homo sapiens
agctggcccccggtggcctg

SEQ ID NO: 7768603 - DNA, 20 bp, Homo sapiens
agctggcccacaggtgtggg

SEQ ID NO: 7768604 - DNA, 22 bp, Homo sapiens
agctggccattgtgagtggcct

SEQ ID NO: 7768605 - DNA, 22 bp, Homo sapiens
caggccagggagaatatgaagc

SEQ ID NO: 7768606 - DNA, 22 bp, Homo sapiens
caggccagcgtccagaacaagc

SEQ ID NO: 7768607 - DNA, 22 bp, Homo sapiens
caggccagcttcctgacatcct

SEQ ID NO: 7768608 - DNA, 22 bp, Homo sapiens
caggctcactgtaaggtcagct

SEQ ID NO: 7768609 - DNA, 22 bp, Homo sapiens
agctggggcatttatccactaa

SEQ ID NO: 7768610 - DNA, 22 bp, Homo sapiens
agctggggcatttatccactaa

SEQ ID NO: 7768611 - DNA, 18 bp, Homo sapiens
agctggggcctctggtcc

SEQ ID NO: 7768612 - DNA, 18 bp, Homo sapiens
agctggggcctctggtcc

SEQ ID NO: 7768613 - DNA, 22 bp, Homo sapiens
caggctcagaagccagtggagc

SEQ ID NO: 7768614 - DNA, 22 bp, Homo sapiens
caggctcagctctggccagtgc

SEQ ID NO: 7768615 - DNA, 22 bp, Homo sapiens
caggctccactgtaggcagctc

SEQ ID NO: 7768616 - DNA, 22 bp, Homo sapiens
agctgtgattatccactggaat

SEQ ID NO: 7768617 - DNA, 22 bp, Homo sapiens
caggctgcggtcggctctggtc

SEQ ID NO: 7768618 - DNA, 22 bp, Homo sapiens
caggctgcggtcggctctggtc

SEQ ID NO: 7768619 - DNA, 22 bp, Homo sapiens
agctgtggaagactgtcagggt

SEQ ID NO: 7768620 - DNA, 22 bp, Homo sapiens
agctgtggcagcagccgtggca

SEQ ID NO: 7768621 - DNA, 22 bp, Homo sapiens
agctgtggcaaccttgtcagac

SEQ ID NO: 7768622 - DNA, 19 bp, Homo sapiens
cagggatgggtagggactc

SEQ ID NO: 7768623 - DNA, 22 bp, Homo sapiens
cagggagctttcccaggaccct

SEQ ID NO: 7768624 - DNA, 22 bp, Homo sapiens
cagggagctggtgccagccgac

SEQ ID NO: 7768625 - DNA, 22 bp, Homo sapiens
cagggatgggatggagtcagtt

SEQ ID NO: 7768626 - DNA, 22 bp, Homo sapiens
cagggatgggatggagtcagtt

SEQ ID NO: 7768627 - DNA, 22 bp, Homo sapiens
cagggagctctgggccggactc

SEQ ID NO: 7768628 - DNA, 22 bp, Homo sapiens
caggctggagttacctttaggg

SEQ ID NO: 7768629 - DNA, 22 bp, Homo sapiens
caggctggagttacctttaggg

SEQ ID NO: 7768630 - DNA, 22 bp, Homo sapiens
caggctggagttacctttaggg

SEQ ID NO: 7768631 - DNA, 22 bp, Homo sapiens
cagggagaaatctccaggaggt

SEQ ID NO: 7768632 - DNA, 22 bp, Homo sapiens
caggctggagtgcagttgtgca

SEQ ID NO: 7768633 - DNA, 22 bp, Homo sapiens
caggctggagtgcagttgtgca

SEQ ID NO: 7768634 - DNA, 22 bp, Homo sapiens
caggctggacattagatacata

SEQ ID NO: 7768635 - DNA, 22 bp, Homo sapiens
caggctggacattagatacata

SEQ ID NO: 7768636 - DNA, 22 bp, Homo sapiens
caggctggagtacaattgtgtg

SEQ ID NO: 7768637 - DNA, 22 bp, Homo sapiens
caggctgctgacaggcttggag

SEQ ID NO: 7768638 - DNA, 22 bp, Homo sapiens
caggctggagtacaattgtgtg

SEQ ID NO: 7768639 - DNA, 22 bp, Homo sapiens
caggctggagtgcagtgtcgcc

SEQ ID NO: 7768640 - DNA, 22 bp, Homo sapiens
caggctggagtgcagtgtcgcc

SEQ ID NO: 7768641 - DNA, 22 bp, Homo sapiens
caggtgagtaacaatgggtgat

SEQ ID NO: 7768642 - DNA, 22 bp, Homo sapiens
cagggtgcgccactcagatgta

SEQ ID NO: 7768643 - DNA, 22 bp, Homo sapiens
cagggtgcctcccgctcgccgg

SEQ ID NO: 7768644 - DNA, 22 bp, Homo sapiens
cagggtgcctgtcctcagcaaa

SEQ ID NO: 7768645 - DNA, 22 bp, Homo sapiens
caggtcctttagtgtccagaac

SEQ ID NO: 7768646 - DNA, 22 bp, Homo sapiens
cagggtgcagtgtcgctgctag

SEQ ID NO: 7768647 - DNA, 22 bp, Homo sapiens
cagggtgcatacccatgcatac

SEQ ID NO: 7768648 - DNA, 22 bp, Homo sapiens
cagggtgcagtgtcgctgctag

SEQ ID NO: 7768649 - DNA, 22 bp, Homo sapiens
caggggctgtggcacatggtgt

SEQ ID NO: 7768650 - DNA, 22 bp, Homo sapiens
caggggctgagaaggaacgtcc

SEQ ID NO: 7768651 - DNA, 22 bp, Homo sapiens
caggggctgaaatgttggggtt

SEQ ID NO: 7768652 - DNA, 22 bp, Homo sapiens
cagggcctgcaagagacctggg

SEQ ID NO: 7768653 - DNA, 22 bp, Homo sapiens
cagggcctccccggcagtcttt

SEQ ID NO: 7768654 - DNA, 22 bp, Homo sapiens
cagggctctgccttgagggatg

SEQ ID NO: 7768655 - DNA, 22 bp, Homo sapiens
cagggctcgctcttgcccttcg

SEQ ID NO: 7768656 - DNA, 22 bp, Homo sapiens
cagggctcccttgcaaggaggg

SEQ ID NO: 7768657 - DNA, 22 bp, Homo sapiens
cagtggagagacttttactctt

SEQ ID NO: 7768658 - DNA, 22 bp, Homo sapiens
aggagaagtaaggctagatgat

SEQ ID NO: 7768659 - DNA, 22 bp, Homo sapiens
aggagaaggaggcccctcacac

SEQ ID NO: 7768660 - DNA, 22 bp, Homo sapiens
cagtggcctttcctgctgctca

SEQ ID NO: 7768661 - DNA, 22 bp, Homo sapiens
cagtggcatggttgactgcagt

SEQ ID NO: 7768662 - DNA, 21 bp, Homo sapiens
cagtgcaggggttagcgtgta

SEQ ID NO: 7768663 - DNA, 22 bp, Homo sapiens
aggacaggattccttgccttgc

SEQ ID NO: 7768664 - DNA, 22 bp, Homo sapiens
caggtgggagcgaggagctact

SEQ ID NO: 7768665 - DNA, 22 bp, Homo sapiens
aggaccagtgagtctggcaagt

SEQ ID NO: 7768666 - DNA, 22 bp, Homo sapiens
aggacctgaaattcttgctttt

SEQ ID NO: 7768667 - DNA, 22 bp, Homo sapiens
aggacctactgatatcttagca

SEQ ID NO: 7768668 - DNA, 22 bp, Homo sapiens
aggacgctctcgctgaacttct

SEQ ID NO: 7768669 - DNA, 22 bp, Homo sapiens
aggacgctctcgctgaacttct

SEQ ID NO: 7768670 - DNA, 22 bp, Homo sapiens
cagttttagggcaatgtgaaga

SEQ ID NO: 7768671 - DNA, 22 bp, Homo sapiens
cagtttctctcaataagcatcg

SEQ ID NO: 7768672 - DNA, 22 bp, Homo sapiens
cagttttaaattgttagataat

SEQ ID NO: 7768673 - DNA, 22 bp, Homo sapiens
cagtttctcagacttcccttgt

SEQ ID NO: 7768674 - DNA, 22 bp, Homo sapiens
cagtttctcagacttcccttgt

SEQ ID NO: 7768675 - DNA, 22 bp, Homo sapiens
cagtttctacgacttaagcaca

SEQ ID NO: 7768676 - DNA, 21 bp, Homo sapiens
cagtggtctgtctccattttt

SEQ ID NO: 7768677 - DNA, 22 bp, Homo sapiens
cagtggtgaagagcaggggctc

SEQ ID NO: 7768678 - DNA, 22 bp, Homo sapiens
cagtggtggaatgaggaattgt

SEQ ID NO: 7768679 - DNA, 18 bp, Homo sapiens
cagtggtgctgggatgtg

SEQ ID NO: 7768680 - DNA, 23 bp, Homo sapiens
cagtggtcagaacgtgggagggt

SEQ ID NO: 7768681 - DNA, 22 bp, Homo sapiens
cagtggcgtgatctctgctcac

SEQ ID NO: 7768682 - DNA, 22 bp, Homo sapiens
cagtggcgtgatctctgctcac

SEQ ID NO: 7768683 - DNA, 22 bp, Homo sapiens
cagtggcgtgatctctgctcac

SEQ ID NO: 7768684 - DNA, 22 bp, Homo sapiens
cagtggcgtgatctctgctcac

SEQ ID NO: 7768685 - DNA, 22 bp, Homo sapiens
aggagggagcttaagccaggca

SEQ ID NO: 7768686 - DNA, 22 bp, Homo sapiens
aggagggagcactatatgggga

SEQ ID NO: 7768687 - DNA, 22 bp, Homo sapiens
aggagggagcttaagccaggca

SEQ ID NO: 7768688 - DNA, 22 bp, Homo sapiens
aggagggagcttaagccaggca

SEQ ID NO: 7768689 - DNA, 22 bp, Homo sapiens
catattctgttggtcacataga

SEQ ID NO: 7768690 - DNA, 22 bp, Homo sapiens
catattaaggtctgtaaggggt

SEQ ID NO: 7768691 - DNA, 22 bp, Homo sapiens
catagattcttatttccatctt

SEQ ID NO: 7768692 - DNA, 22 bp, Homo sapiens
catagcttaggggttaaactca

SEQ ID NO: 7768693 - DNA, 22 bp, Homo sapiens
catggggcccatgtgctccaag

SEQ ID NO: 7768694 - DNA, 22 bp, Homo sapiens
catggggatgaggctgagactt

SEQ ID NO: 7768695 - DNA, 23 bp, Homo sapiens
catggggagcagtgctcctgacc

SEQ ID NO: 7768696 - DNA, 22 bp, Homo sapiens
catggggagacacctagggaaa

SEQ ID NO: 7768697 - DNA, 22 bp, Homo sapiens
catgtcaacaggcccagaaaat

SEQ ID NO: 7768698 - DNA, 17 bp, Homo sapiens
catgtatttgaaacaga

SEQ ID NO: 7768699 - DNA, 22 bp, Homo sapiens
catgtattgaagtgtgcatctg

SEQ ID NO: 7768700 - DNA, 22 bp, Homo sapiens
catggtactgccacagaagagt

SEQ ID NO: 7768701 - DNA, 21 bp, Homo sapiens
aggagggcacaaggccaggaa

SEQ ID NO: 7768702 - DNA, 22 bp, Homo sapiens
catgctaaaccagaacatagga

SEQ ID NO: 7768703 - DNA, 22 bp, Homo sapiens
catggcaatttcataaacaggt

SEQ ID NO: 7768704 - DNA, 22 bp, Homo sapiens
catggattgaatataaattaga

SEQ ID NO: 7768705 - DNA, 22 bp, Homo sapiens
catggcagaaacctgagctgct

SEQ ID NO: 7768706 - DNA, 22 bp, Homo sapiens
catggcagagaaggggaactgg

SEQ ID NO: 7768707 - DNA, 22 bp, Homo sapiens
catgttttgtgtacagaatatt

SEQ ID NO: 7768708 - DNA, 22 bp, Homo sapiens
cattaaattccttgttctcaaa

SEQ ID NO: 7768709 - DNA, 22 bp, Homo sapiens
aggcactgtgctgatgtcttat

SEQ ID NO: 7768710 - DNA, 22 bp, Homo sapiens
cattaacaatgactgcttgact

SEQ ID NO: 7768711 - DNA, 21 bp, Homo sapiens
aggcagcaggatccagggaca

SEQ ID NO: 7768712 - DNA, 19 bp, Homo sapiens
aggcagcaggccagggatg

SEQ ID NO: 7768713 - DNA, 21 bp, Homo sapiens
aggcagcaggatccagggaca

SEQ ID NO: 7768714 - DNA, 22 bp, Homo sapiens
ccaagcaaggctaattcacttg

SEQ ID NO: 7768715 - DNA, 22 bp, Homo sapiens
ccaaaggcggaactgagtctct

SEQ ID NO: 7768716 - DNA, 23 bp, Homo sapiens
aggcagcaggttgtccagggtga

SEQ ID NO: 7768717 - DNA, 23 bp, Homo sapiens
aggcagcaggttgtccagggtga

SEQ ID NO: 7768718 - DNA, 22 bp, Homo sapiens
aggcagcagggccactggctga

SEQ ID NO: 7768719 - DNA, 19 bp, Homo sapiens
aggcagcaggccagggatg

SEQ ID NO: 7768720 - DNA, 20 bp, Homo sapiens
ccaataaagctctataggga

SEQ ID NO: 7768721 - DNA, 22 bp, Homo sapiens
ccaagctttcgatcaaccagaa

SEQ ID NO: 7768722 - DNA, 22 bp, Homo sapiens
ccaagctggatttagctgcaca

SEQ ID NO: 7768723 - DNA, 22 bp, Homo sapiens
acagtttaggatgagagaacac

SEQ ID NO: 7768724 - DNA, 20 bp, Homo sapiens
aggatgcagggagtctgcag

SEQ ID NO: 7768725 - DNA, 21 bp, Homo sapiens
aggatggaaaggactaggggt

SEQ ID NO: 7768726 - DNA, 22 bp, Homo sapiens
aggatgaggctggcaggtcttg

SEQ ID NO: 7768727 - DNA, 21 bp, Homo sapiens
acatacattatctttttaaaa

SEQ ID NO: 7768728 - DNA, 22 bp, Homo sapiens
aggcagctgccctctccttcct

SEQ ID NO: 7768729 - DNA, 22 bp, Homo sapiens
aggcagctctgtggcctcccag

SEQ ID NO: 7768730 - DNA, 21 bp, Homo sapiens
aggcagctcaggcccagagag

SEQ ID NO: 7768731 - DNA, 22 bp, Homo sapiens
acatattgagctctaaaagtac

SEQ ID NO: 7768732 - DNA, 22 bp, Homo sapiens
aggcagctggaggcagagacta

SEQ ID NO: 7768733 - DNA, 18 bp, Homo sapiens
acatacattctgtctgca

SEQ ID NO: 7768734 - DNA, 21 bp, Homo sapiens
acatacattatctttttaaaa

SEQ ID NO: 7768735 - DNA, 22 bp, Homo sapiens
acatagaaggaagagtagtagg

SEQ ID NO: 7768736 - DNA, 22 bp, Homo sapiens
acatagcttaaatgagaagata

SEQ ID NO: 7768737 - DNA, 19 bp, Homo sapiens
acatagctggctacactgt

SEQ ID NO: 7768738 - DNA, 20 bp, Homo sapiens
acatagctatagaaagtcga

SEQ ID NO: 7768739 - DNA, 22 bp, Homo sapiens
acatagctcagtatcacttact

SEQ ID NO: 7768740 - DNA, 22 bp, Homo sapiens
acatagcataaagaatgactct

SEQ ID NO: 7768741 - DNA, 17 bp, Homo sapiens
aggcagctcagaacatc

SEQ ID NO: 7768742 - DNA, 22 bp, Homo sapiens
aggcagctaagatggataatga

SEQ ID NO: 7768743 - DNA, 22 bp, Homo sapiens
acagtcagggcttactcaggga

SEQ ID NO: 7768744 - DNA, 19 bp, Homo sapiens
acagtccagctgtttgtac

SEQ ID NO: 7768745 - DNA, 21 bp, Homo sapiens
acagtctccccagatctctcc

SEQ ID NO: 7768746 - DNA, 22 bp, Homo sapiens
acagtctctgttgctgctgttt

SEQ ID NO: 7768747 - DNA, 19 bp, Homo sapiens
acagtgtctgtatataaat

SEQ ID NO: 7768748 - DNA, 22 bp, Homo sapiens
acagtgtggttgtttctggtta

SEQ ID NO: 7768749 - DNA, 22 bp, Homo sapiens
acagtctgcctctcagagcagc

SEQ ID NO: 7768750 - DNA, 22 bp, Homo sapiens
acagtctgcctctcagagcagc

SEQ ID NO: 7768751 - DNA, 22 bp, Homo sapiens
acagtctgcagggtgaacatgt

SEQ ID NO: 7768752 - DNA, 22 bp, Homo sapiens
acagtgtctgacacgtaggaag

SEQ ID NO: 7768753 - DNA, 22 bp, Homo sapiens
acagtgtctgacacattgtagc

SEQ ID NO: 7768754 - DNA, 23 bp, Homo sapiens
acagtgtctgctgcaagatatct

SEQ ID NO: 7768755 - DNA, 22 bp, Homo sapiens
acagtgtctcctggtacccagt

SEQ ID NO: 7768756 - DNA, 22 bp, Homo sapiens
acagtaaaacatttttattagg

SEQ ID NO: 7768757 - DNA, 22 bp, Homo sapiens
acagtaaaacatttttattagg

SEQ ID NO: 7768758 - DNA, 22 bp, Homo sapiens
acagtaaacaatgcagcaaatt

SEQ ID NO: 7768759 - DNA, 22 bp, Homo sapiens
acagtaaacaatgcagcaaatt

SEQ ID NO: 7768760 - DNA, 22 bp, Homo sapiens
acagtaaaaagccttagaattt

SEQ ID NO: 7768761 - DNA, 22 bp, Homo sapiens
acagtaaaaagccttagaattt

SEQ ID NO: 7768762 - DNA, 22 bp, Homo sapiens
acagtaaatcaacagaatatct

SEQ ID NO: 7768763 - DNA, 18 bp, Homo sapiens
acagtaaagaaaggaatt

SEQ ID NO: 7768764 - DNA, 22 bp, Homo sapiens
aggacacagactgattgcagca

SEQ ID NO: 7768765 - DNA, 22 bp, Homo sapiens
aggagcaaatgatgagacagca

SEQ ID NO: 7768766 - DNA, 22 bp, Homo sapiens
acagtacaccactgtgtacagt

SEQ ID NO: 7768767 - DNA, 22 bp, Homo sapiens
acagtacagctaatgtcattag

SEQ ID NO: 7768768 - DNA, 22 bp, Homo sapiens
aggacacacttctgaggtcttt

SEQ ID NO: 7768769 - DNA, 22 bp, Homo sapiens
aggacaattttggcatagttct

SEQ ID NO: 7768770 - DNA, 22 bp, Homo sapiens
acaggggcaggcaggacccttt

SEQ ID NO: 7768771 - DNA, 22 bp, Homo sapiens
aggaagaacagataatggacgc

SEQ ID NO: 7768772 - DNA, 22 bp, Homo sapiens
acagggagccccagcatttcca

SEQ ID NO: 7768773 - DNA, 23 bp, Homo sapiens
aggaagagagagtgcctctttct

SEQ ID NO: 7768774 - DNA, 22 bp, Homo sapiens
acaggcaggcttcggccagagc

SEQ ID NO: 7768775 - DNA, 22 bp, Homo sapiens
acaggcaggcgggacagcccga

SEQ ID NO: 7768776 - DNA, 22 bp, Homo sapiens
acaggcaggcgggacagcccga

SEQ ID NO: 7768777 - DNA, 22 bp, Homo sapiens
acaggcagcgtcattgctgctc

SEQ ID NO: 7768778 - DNA, 22 bp, Homo sapiens
acaggcagcactaatctctggt

SEQ ID NO: 7768779 - DNA, 22 bp, Homo sapiens
acaggcagcgtcattgctgctc

SEQ ID NO: 7768780 - DNA, 22 bp, Homo sapiens
acaggcagattaagggtaggca

SEQ ID NO: 7768781 - DNA, 22 bp, Homo sapiens
acaggcagcaaaatcagcctca

SEQ ID NO: 7768782 - DNA, 22 bp, Homo sapiens
acagggagatgggtgaaagcgg

SEQ ID NO: 7768783 - DNA, 22 bp, Homo sapiens
acagggagatatcttcaatatc

SEQ ID NO: 7768784 - DNA, 22 bp, Homo sapiens
acaggctgttggggtccagggt

SEQ ID NO: 7768785 - DNA, 22 bp, Homo sapiens
acaggcaggcttcggccagagc

SEQ ID NO: 7768786 - DNA, 22 bp, Homo sapiens
acaggcagggacctcttgagtt

SEQ ID NO: 7768787 - DNA, 22 bp, Homo sapiens
acaggcagggaccttggctaag

SEQ ID NO: 7768788 - DNA, 23 bp, Homo sapiens
acaggaggggacaggtggccgtg

SEQ ID NO: 7768789 - DNA, 22 bp, Homo sapiens
agctggcacagaccaggagatc

SEQ ID NO: 7768790 - DNA, 22 bp, Homo sapiens
agctggattccagtgcagtcac

SEQ ID NO: 7768791 - DNA, 22 bp, Homo sapiens
acaggcacaggtgtgccccacc

SEQ ID NO: 7768792 - DNA, 22 bp, Homo sapiens
agctgacaggatggcattatta

SEQ ID NO: 7768793 - DNA, 22 bp, Homo sapiens
agctgacataagcactttctaa

SEQ ID NO: 7768794 - DNA, 22 bp, Homo sapiens
agctctggttattgaagcaggg

SEQ ID NO: 7768795 - DNA, 22 bp, Homo sapiens
agctctgggtcacggctgccga

SEQ ID NO: 7768796 - DNA, 22 bp, Homo sapiens
agctgaaggctagaacagctgg

SEQ ID NO: 7768797 - DNA, 22 bp, Homo sapiens
agctggaggggccagcaggtgt

SEQ ID NO: 7768798 - DNA, 22 bp, Homo sapiens
agctggatgaatttggaacact

SEQ ID NO: 7768799 - DNA, 22 bp, Homo sapiens
agctggattaaatatagctttc

SEQ ID NO: 7768800 - DNA, 22 bp, Homo sapiens
acagctgggtgctgctcagagc

SEQ ID NO: 7768801 - DNA, 22 bp, Homo sapiens
acagctgtatccccagagctca

SEQ ID NO: 7768802 - DNA, 22 bp, Homo sapiens
agctgagaggtggcaagctgta

SEQ ID NO: 7768803 - DNA, 22 bp, Homo sapiens
agctgagaggtggcaagctgta

SEQ ID NO: 7768804 - DNA, 22 bp, Homo sapiens
acagctggcaggggggcatgaa

SEQ ID NO: 7768805 - DNA, 22 bp, Homo sapiens
acatgccagcctcagcagcagt

SEQ ID NO: 7768806 - DNA, 22 bp, Homo sapiens
acatccatcttatgagataggt

SEQ ID NO: 7768807 - DNA, 22 bp, Homo sapiens
acatgcttgtttttcacaacct

SEQ ID NO: 7768808 - DNA, 20 bp, Homo sapiens
acatgcttgagaggatgcag

SEQ ID NO: 7768809 - DNA, 22 bp, Homo sapiens
acatgcttccaaattatgttgg

SEQ ID NO: 7768810 - DNA, 22 bp, Homo sapiens
acatgcttctgtttcaagaact

SEQ ID NO: 7768811 - DNA, 22 bp, Homo sapiens
acatcatcgtgcacatacataa

SEQ ID NO: 7768812 - DNA, 22 bp, Homo sapiens
aggccaggggtgagcacttctg

SEQ ID NO: 7768813 - DNA, 22 bp, Homo sapiens
aggccagggtagggcccattgt

SEQ ID NO: 7768814 - DNA, 22 bp, Homo sapiens
aggccaggcctttctccattcc

SEQ ID NO: 7768815 - DNA, 22 bp, Homo sapiens
aggccagggcactgctctttag

SEQ ID NO: 7768816 - DNA, 22 bp, Homo sapiens
acatgttagctactattgttat

SEQ ID NO: 7768817 - DNA, 22 bp, Homo sapiens
acatgtttaagtttaatgaaaa

SEQ ID NO: 7768818 - DNA, 22 bp, Homo sapiens
aggccagggtcccacactcgca

SEQ ID NO: 7768819 - DNA, 22 bp, Homo sapiens
aggcctgaagtgtggagtgggg

SEQ ID NO: 7768820 - DNA, 20 bp, Homo sapiens
aggcctgagagatgactggg

SEQ ID NO: 7768821 - DNA, 22 bp, Homo sapiens
aggcctgagcagaggagtggac

SEQ ID NO: 7768822 - DNA, 22 bp, Homo sapiens
aggcctcttcagggagcatgga

SEQ ID NO: 7768823 - DNA, 22 bp, Homo sapiens
aggcctctgggtctcctctgac

SEQ ID NO: 7768824 - DNA, 22 bp, Homo sapiens
acatgtttaagtttaatgaaaa

SEQ ID NO: 7768825 - DNA, 22 bp, Homo sapiens
acatgtttaagtttaatgaaaa

SEQ ID NO: 7768826 - DNA, 22 bp, Homo sapiens
acatgtttgcctgcaggcttag

SEQ ID NO: 7768827 - DNA, 22 bp, Homo sapiens
aggcctgaggttcctgtgctca

SEQ ID NO: 7768828 - DNA, 22 bp, Homo sapiens
aggctgaaaacgagatggcaat

SEQ ID NO: 7768829 - DNA, 22 bp, Homo sapiens
aggctcttcttttattaactga

SEQ ID NO: 7768830 - DNA, 22 bp, Homo sapiens
aggctctgtttgctgtggtacc

SEQ ID NO: 7768831 - DNA, 22 bp, Homo sapiens
aggctctgttattctagagggc

SEQ ID NO: 7768832 - DNA, 22 bp, Homo sapiens
aggctgagactgtgcattagtg

SEQ ID NO: 7768833 - DNA, 22 bp, Homo sapiens
acattgatatttcaaatacagg

SEQ ID NO: 7768834 - DNA, 22 bp, Homo sapiens
aggctgagaaagtgggaagatg

SEQ ID NO: 7768835 - DNA, 22 bp, Homo sapiens
acattgtataatgattatcaca

SEQ ID NO: 7768836 - DNA, 22 bp, Homo sapiens
acattgtataatgattatcaca

SEQ ID NO: 7768837 - DNA, 22 bp, Homo sapiens
acatttcactgttcacagcagg

SEQ ID NO: 7768838 - DNA, 22 bp, Homo sapiens
acattgtagttgttctgcagca

SEQ ID NO: 7768839 - DNA, 22 bp, Homo sapiens
acattgtagacttttcatatgt

SEQ ID NO: 7768840 - DNA, 22 bp, Homo sapiens
acattgtaaatacctttatcac

SEQ ID NO: 7768841 - DNA, 22 bp, Homo sapiens
aggctgaggagggatgttgctt

SEQ ID NO: 7768842 - DNA, 18 bp, Homo sapiens
acatttctatgcttctgg

SEQ ID NO: 7768843 - DNA, 22 bp, Homo sapiens
aggctgagctggcccttgaaat

SEQ ID NO: 7768844 - DNA, 22 bp, Homo sapiens
acatttcttttcatctctatat

SEQ ID NO: 7768845 - DNA, 22 bp, Homo sapiens
acatttggcatcttgtaacact

SEQ ID NO: 7768846 - DNA, 22 bp, Homo sapiens
acatttgataattataaagaca

SEQ ID NO: 7768847 - DNA, 22 bp, Homo sapiens
acatttgaggatgttaagaatg

SEQ ID NO: 7768848 - DNA, 20 bp, Homo sapiens
acatttgagtatcatctact

SEQ ID NO: 7768849 - DNA, 22 bp, Homo sapiens
acatttgagtcatatttgctta

SEQ ID NO: 7768850 - DNA, 22 bp, Homo sapiens
acatttgagcatctactaagtg

SEQ ID NO: 7768851 - DNA, 22 bp, Homo sapiens
acatttgagcatatttcttgtc

SEQ ID NO: 7768852 - DNA, 22 bp, Homo sapiens
acatttgactctgttcatatta

SEQ ID NO: 7768853 - DNA, 22 bp, Homo sapiens
acatttgaaataaactcaagtg

SEQ ID NO: 7768854 - DNA, 22 bp, Homo sapiens
agggctgcccagtgtgagagct

SEQ ID NO: 7768855 - DNA, 22 bp, Homo sapiens
acccaggacacagagatgaccc

SEQ ID NO: 7768856 - DNA, 22 bp, Homo sapiens
acccagccacagcattgaggga

SEQ ID NO: 7768857 - DNA, 22 bp, Homo sapiens
acccagccatgttcagttctct

SEQ ID NO: 7768858 - DNA, 22 bp, Homo sapiens
acccagcatgacacctgcacat

SEQ ID NO: 7768859 - DNA, 22 bp, Homo sapiens
acccagcatgacacctgcacat

SEQ ID NO: 7768860 - DNA, 19 bp, Homo sapiens
acccagcccaggagtggca

SEQ ID NO: 7768861 - DNA, 22 bp, Homo sapiens
acccagcccagaatctggggcc

SEQ ID NO: 7768862 - DNA, 22 bp, Homo sapiens
acccagcctacaaagctcacct

SEQ ID NO: 7768863 - DNA, 22 bp, Homo sapiens
accaggctgtgaagtgagacta

SEQ ID NO: 7768864 - DNA, 22 bp, Homo sapiens
accaggctggagtgcagtggcg

SEQ ID NO: 7768865 - DNA, 22 bp, Homo sapiens
accaggctggagtgcagtggcg

SEQ ID NO: 7768866 - DNA, 22 bp, Homo sapiens
agggggcaggagagacctgctg

SEQ ID NO: 7768867 - DNA, 22 bp, Homo sapiens
agggggcatcaggtcctggctc

SEQ ID NO: 7768868 - DNA, 22 bp, Homo sapiens
agggggaggctgtgctgcgtct

SEQ ID NO: 7768869 - DNA, 20 bp, Homo sapiens
accctccactgttcactgtg

SEQ ID NO: 7768870 - DNA, 22 bp, Homo sapiens
accctccactttatctgtcttt

SEQ ID NO: 7768871 - DNA, 22 bp, Homo sapiens
agggggctcagtgactgaagtg

SEQ ID NO: 7768872 - DNA, 22 bp, Homo sapiens
agggggctcctccggtgcttcc

SEQ ID NO: 7768873 - DNA, 22 bp, Homo sapiens
agggggctcagcatggatggag

SEQ ID NO: 7768874 - DNA, 22 bp, Homo sapiens
agggggctcagcaggctctgga

SEQ ID NO: 7768875 - DNA, 22 bp, Homo sapiens
agggggcattatgaggcttttc

SEQ ID NO: 7768876 - DNA, 22 bp, Homo sapiens
acccaggctggagtgcagtggt

SEQ ID NO: 7768877 - DNA, 22 bp, Homo sapiens
acccaggctggagtgcagtggt

SEQ ID NO: 7768878 - DNA, 22 bp, Homo sapiens
acccaggctggcagaggctcct

SEQ ID NO: 7768879 - DNA, 22 bp, Homo sapiens
acccaggctggagtgcagtgtc

SEQ ID NO: 7768880 - DNA, 22 bp, Homo sapiens
acccaggctggagtgcagtgtc

SEQ ID NO: 7768881 - DNA, 22 bp, Homo sapiens
acccaggctggagtgcagtggc

SEQ ID NO: 7768882 - DNA, 22 bp, Homo sapiens
acccaggctggagtgcagtggc

SEQ ID NO: 7768883 - DNA, 22 bp, Homo sapiens
acccaggctggagtgcagtggg

SEQ ID NO: 7768884 - DNA, 22 bp, Homo sapiens
acccaggctggagtgcagtggg

SEQ ID NO: 7768885 - DNA, 22 bp, Homo sapiens
acccaggctggagtgcagtgat

SEQ ID NO: 7768886 - DNA, 22 bp, Homo sapiens
acccaggctggagtgcagtgat

SEQ ID NO: 7768887 - DNA, 22 bp, Homo sapiens
acccaggctggagtgcagtgac

SEQ ID NO: 7768888 - DNA, 22 bp, Homo sapiens
acccaggctggagtgcagtgac

SEQ ID NO: 7768889 - DNA, 22 bp, Homo sapiens
agggctgcctgactccagagcc

SEQ ID NO: 7768890 - DNA, 22 bp, Homo sapiens
agggagacacatgaggaagtca

SEQ ID NO: 7768891 - DNA, 22 bp, Homo sapiens
agggagacaaaagcagctgcca

SEQ ID NO: 7768892 - DNA, 22 bp, Homo sapiens
aggctttactgcctcaggactc

SEQ ID NO: 7768893 - DNA, 22 bp, Homo sapiens
aggcttgttttactaaaagcaa

SEQ ID NO: 7768894 - DNA, 22 bp, Homo sapiens
aggcttgggactgcttaggagc

SEQ ID NO: 7768895 - DNA, 20 bp, Homo sapiens
aggcttggcttggcaggaac

SEQ ID NO: 7768896 - DNA, 20 bp, Homo sapiens
aggcttggcttggcaggaac

SEQ ID NO: 7768897 - DNA, 18 bp, Homo sapiens
aggcttgggcccagcagc

SEQ ID NO: 7768898 - DNA, 22 bp, Homo sapiens
aggcttgggactgcttaggagc

SEQ ID NO: 7768899 - DNA, 22 bp, Homo sapiens
aggcttgggactgcttaggagc

SEQ ID NO: 7768900 - DNA, 22 bp, Homo sapiens
accagccccaccgggactgcag

SEQ ID NO: 7768901 - DNA, 20 bp, Homo sapiens
aggcttggcttggcaggaac

SEQ ID NO: 7768902 - DNA, 22 bp, Homo sapiens
aggcttggttaattctgtgtga

SEQ ID NO: 7768903 - DNA, 22 bp, Homo sapiens
aggcttggttaattctgtgtga

SEQ ID NO: 7768904 - DNA, 22 bp, Homo sapiens
aggcttggtttatagaagtaat

SEQ ID NO: 7768905 - DNA, 19 bp, Homo sapiens
aggcttggttgcagcaagc

SEQ ID NO: 7768906 - DNA, 22 bp, Homo sapiens
aggcttgtctcagaagatgctg

SEQ ID NO: 7768907 - DNA, 22 bp, Homo sapiens
aggcttggtgccaaggagcctg

SEQ ID NO: 7768908 - DNA, 22 bp, Homo sapiens
aggcttgggtcagaaggcttgt

SEQ ID NO: 7768909 - DNA, 18 bp, Homo sapiens
aggcttgggcccagcagc

SEQ ID NO: 7768910 - DNA, 22 bp, Homo sapiens
accagcagttatgaggccagga

SEQ ID NO: 7768911 - DNA, 22 bp, Homo sapiens
accagcagttatgaggccagga

SEQ ID NO: 7768912 - DNA, 22 bp, Homo sapiens
accagcagttatgaggccagga

SEQ ID NO: 7768913 - DNA, 22 bp, Homo sapiens
accagcagggctgggccaatgg

SEQ ID NO: 7768914 - DNA, 22 bp, Homo sapiens
accagcagctgccagagtggag

SEQ ID NO: 7768915 - DNA, 22 bp, Homo sapiens
accagcagctgccagagtggag

SEQ ID NO: 7768916 - DNA, 22 bp, Homo sapiens
accagcagctgccagagtggag

SEQ ID NO: 7768917 - DNA, 22 bp, Homo sapiens
accagcctggccaacatggtga

SEQ ID NO: 7768918 - DNA, 22 bp, Homo sapiens
accagcctggccaacatggcaa

SEQ ID NO: 7768919 - DNA, 22 bp, Homo sapiens
accagctcagaagccagaaaga

SEQ ID NO: 7768920 - DNA, 22 bp, Homo sapiens
accagcctgtctgagtcgtggg

SEQ ID NO: 7768921 - DNA, 22 bp, Homo sapiens
accagcctcctagctgctcctg

SEQ ID NO: 7768922 - DNA, 17 bp, Homo sapiens
accagcctctcctgggg

SEQ ID NO: 7768923 - DNA, 17 bp, Homo sapiens
accagcctctcctgggg

SEQ ID NO: 7768924 - DNA, 22 bp, Homo sapiens
agggcagcaatgcagctgctgc

SEQ ID NO: 7768925 - DNA, 22 bp, Homo sapiens
agggcagcaatgcagctgctgc

SEQ ID NO: 7768926 - DNA, 22 bp, Homo sapiens
agggcagcacagctgtgctcct

SEQ ID NO: 7768927 - DNA, 22 bp, Homo sapiens
agggcagcaatttggttcctgg

SEQ ID NO: 7768928 - DNA, 22 bp, Homo sapiens
agggcagcaatgcagctgctgc

SEQ ID NO: 7768929 - DNA, 22 bp, Homo sapiens
agggcagcagcggcccaggcct

SEQ ID NO: 7768930 - DNA, 22 bp, Homo sapiens
agggcagcagctcctcctagct

SEQ ID NO: 7768931 - DNA, 22 bp, Homo sapiens
agaaaaggttgaaagtaggatt

SEQ ID NO: 7768932 - DNA, 22 bp, Homo sapiens
atatgcttgggactgatacagt

SEQ ID NO: 7768933 - DNA, 22 bp, Homo sapiens
atatgcttatgatgtctcaagt

SEQ ID NO: 7768934 - DNA, 22 bp, Homo sapiens
atatgcttacagcttaaaatcc

SEQ ID NO: 7768935 - DNA, 22 bp, Homo sapiens
atatgaaagtaagcatgtgtgt

SEQ ID NO: 7768936 - DNA, 22 bp, Homo sapiens
actttcatgttcatttggaacc

SEQ ID NO: 7768937 - DNA, 22 bp, Homo sapiens
actttcaagaacttctttaatg

SEQ ID NO: 7768938 - DNA, 22 bp, Homo sapiens
actttcaagcaagaacactttg

SEQ ID NO: 7768939 - DNA, 22 bp, Homo sapiens
actttcaagccctctagagaca

SEQ ID NO: 7768940 - DNA, 22 bp, Homo sapiens
actttcaatttgcactaaccta

SEQ ID NO: 7768941 - DNA, 22 bp, Homo sapiens
actttccctctcagaactctta

SEQ ID NO: 7768942 - DNA, 22 bp, Homo sapiens
actttcccacttaatgtattta

SEQ ID NO: 7768943 - DNA, 23 bp, Homo sapiens
actttcccatagcatggcttcct

SEQ ID NO: 7768944 - DNA, 23 bp, Homo sapiens
actttcccatagcatggcttcct

SEQ ID NO: 7768945 - DNA, 21 bp, Homo sapiens
agaaaagtatttgaatcaaga

SEQ ID NO: 7768946 - DNA, 21 bp, Homo sapiens
agaaaagtatttgaatcaaga

SEQ ID NO: 7768947 - DNA, 21 bp, Homo sapiens
agaaaagtatttgaatcaaga

SEQ ID NO: 7768948 - DNA, 22 bp, Homo sapiens
agaaaataaattgatggtggaa

SEQ ID NO: 7768949 - DNA, 22 bp, Homo sapiens
atattcatcgtgtagaaatact

SEQ ID NO: 7768950 - DNA, 22 bp, Homo sapiens
atattcattgaacacctactac

SEQ ID NO: 7768951 - DNA, 22 bp, Homo sapiens
atattcattgaacacctactac

SEQ ID NO: 7768952 - DNA, 22 bp, Homo sapiens
atatttcacgtaggttgttttc

SEQ ID NO: 7768953 - DNA, 22 bp, Homo sapiens
atatttcatggggttccatact

SEQ ID NO: 7768954 - DNA, 23 bp, Homo sapiens
atatttccaggttagtgaggtaa

SEQ ID NO: 7768955 - DNA, 22 bp, Homo sapiens
agaaagggttctctgaggtgct

SEQ ID NO: 7768956 - DNA, 22 bp, Homo sapiens
agaaagtacagatgagacactt

SEQ ID NO: 7768957 - DNA, 22 bp, Homo sapiens
agaaaggtcacttagcctcagc

SEQ ID NO: 7768958 - DNA, 22 bp, Homo sapiens
agaaagtgtgtcatactaagtg

SEQ ID NO: 7768959 - DNA, 22 bp, Homo sapiens
agaaagtgcttccctttggtga

SEQ ID NO: 7768960 - DNA, 22 bp, Homo sapiens
agaaagtgcttccctttggact

SEQ ID NO: 7768961 - DNA, 22 bp, Homo sapiens
agaaagtgcctcccttgggagc

SEQ ID NO: 7768962 - DNA, 22 bp, Homo sapiens
agaaagtgaccttgaaaactgg

SEQ ID NO: 7768963 - DNA, 22 bp, Homo sapiens
agaaagtgaacgtgttcagttt

SEQ ID NO: 7768964 - DNA, 22 bp, Homo sapiens
agaacacactgggggaaacaag

SEQ ID NO: 7768965 - DNA, 22 bp, Homo sapiens
agaacagcctatagtggccttt

SEQ ID NO: 7768966 - DNA, 22 bp, Homo sapiens
agaacagcaggaaggccaggta

SEQ ID NO: 7768967 - DNA, 22 bp, Homo sapiens
atcatctgggttaatgtgctca

SEQ ID NO: 7768968 - DNA, 22 bp, Homo sapiens
atcatcttaaatctagaatgtg

SEQ ID NO: 7768969 - DNA, 22 bp, Homo sapiens
atcatcttcgaaaaaagtcaga

SEQ ID NO: 7768970 - DNA, 22 bp, Homo sapiens
atcatcttgaaagtctatgttt

SEQ ID NO: 7768971 - DNA, 22 bp, Homo sapiens
atcgcaagtttaaaaatctttg

SEQ ID NO: 7768972 - DNA, 22 bp, Homo sapiens
atcggcaagccccacaccgtcc

SEQ ID NO: 7768973 - DNA, 22 bp, Homo sapiens
atctaaactatagtacctagtc

SEQ ID NO: 7768974 - DNA, 22 bp, Homo sapiens
atctaaaatgtggttagttggt

SEQ ID NO: 7768975 - DNA, 22 bp, Homo sapiens
atctaactgggctattttattg

SEQ ID NO: 7768976 - DNA, 22 bp, Homo sapiens
atctcacaggactgaaacgtaa

SEQ ID NO: 7768977 - DNA, 22 bp, Homo sapiens
atctcacatcctcagtagtgca

SEQ ID NO: 7768978 - DNA, 22 bp, Homo sapiens
atctcaactaagcctaactttt

SEQ ID NO: 7768979 - DNA, 22 bp, Homo sapiens
atctcacactgggtttgagggt

SEQ ID NO: 7768980 - DNA, 22 bp, Homo sapiens
actgtcaaaagagattatatta

SEQ ID NO: 7768981 - DNA, 22 bp, Homo sapiens
actgtataaggcataggtaagc

SEQ ID NO: 7768982 - DNA, 22 bp, Homo sapiens
actgtcaagagattcaaattca

SEQ ID NO: 7768983 - DNA, 22 bp, Homo sapiens
actgtcactgacagaatcaaca

SEQ ID NO: 7768984 - DNA, 22 bp, Homo sapiens
actgggactgtatgtgctggac

SEQ ID NO: 7768985 - DNA, 20 bp, Homo sapiens
actgggagctaacggagatt

SEQ ID NO: 7768986 - DNA, 22 bp, Homo sapiens
actgggaagatggaggcaagca

SEQ ID NO: 7768987 - DNA, 22 bp, Homo sapiens
ataatctgacaaagacttaagc

SEQ ID NO: 7768988 - DNA, 22 bp, Homo sapiens
ataagtaggaaaatttgaatat

SEQ ID NO: 7768989 - DNA, 22 bp, Homo sapiens
actgtgatgttctctatcttgg

SEQ ID NO: 7768990 - DNA, 22 bp, Homo sapiens
actgtgagtttatttatctgat

SEQ ID NO: 7768991 - DNA, 22 bp, Homo sapiens
ataaacacttctagggcacaca

SEQ ID NO: 7768992 - DNA, 22 bp, Homo sapiens
ataaacagtaaatgtgagcagt

SEQ ID NO: 7768993 - DNA, 22 bp, Homo sapiens
ataaaatttgctactgttaaat

SEQ ID NO: 7768994 - DNA, 22 bp, Homo sapiens
ataaacaagactggccaacttt

SEQ ID NO: 7768995 - DNA, 22 bp, Homo sapiens
ataaaatttgctactgttaaat

SEQ ID NO: 7768996 - DNA, 22 bp, Homo sapiens
ataaaatttgctactgttaaat

SEQ ID NO: 7768997 - DNA, 22 bp, Homo sapiens
ataaaatgtctccactgggctc

SEQ ID NO: 7768998 - DNA, 22 bp, Homo sapiens
acttaaagtagttttactgtgg

SEQ ID NO: 7768999 - DNA, 22 bp, Homo sapiens
acttaaatagaactcctcaata

SEQ ID NO: 7769000 - DNA, 22 bp, Homo sapiens
acttaaagttataatttgctaa

SEQ ID NO: 7769001 - DNA, 23 bp, Homo sapiens
acttaaatggttctttatctcag

SEQ ID NO: 7769002 - DNA, 21 bp, Homo sapiens
acttaaattccttgatattta

SEQ ID NO: 7769003 - DNA, 22 bp, Homo sapiens
atacagatgttgaatgttatat

SEQ ID NO: 7769004 - DNA, 22 bp, Homo sapiens
acttacaagctagggaagcttg

SEQ ID NO: 7769005 - DNA, 22 bp, Homo sapiens
acttctgattaaggatgaatgc

SEQ ID NO: 7769006 - DNA, 22 bp, Homo sapiens
acttctgataaagagcatgtgc

SEQ ID NO: 7769007 - DNA, 22 bp, Homo sapiens
acttctgagaaatttaaggaca

SEQ ID NO: 7769008 - DNA, 22 bp, Homo sapiens
atacagtaaccacattctatag

SEQ ID NO: 7769009 - DNA, 22 bp, Homo sapiens
atacagggacatccagtttttc

SEQ ID NO: 7769010 - DNA, 22 bp, Homo sapiens
atacaggatgctgaacatctct

SEQ ID NO: 7769011 - DNA, 22 bp, Homo sapiens
atacatgttgagaaaatatctg

SEQ ID NO: 7769012 - DNA, 22 bp, Homo sapiens
acttcttgggaccctggcaccg

SEQ ID NO: 7769013 - DNA, 22 bp, Homo sapiens
acttcttcttcagctgggggat

SEQ ID NO: 7769014 - DNA, 22 bp, Homo sapiens
acttcttgatgaaaatggtact

SEQ ID NO: 7769015 - DNA, 22 bp, Homo sapiens
acttctggtgtcatactgcatt

SEQ ID NO: 7769016 - DNA, 22 bp, Homo sapiens
atacattagctcatatgattaa

SEQ ID NO: 7769017 - DNA, 22 bp, Homo sapiens
atacatgttgagaaaatatctg

SEQ ID NO: 7769018 - DNA, 22 bp, Homo sapiens
atactgattagttgagaaagca

SEQ ID NO: 7769019 - DNA, 22 bp, Homo sapiens
atactgatgatgtgaagaaaca

SEQ ID NO: 7769020 - DNA, 22 bp, Homo sapiens
atactgtgtgcagagtcctaat

SEQ ID NO: 7769021 - DNA, 22 bp, Homo sapiens
actttcaaaagagaagtcatga

SEQ ID NO: 7769022 - DNA, 22 bp, Homo sapiens
actggcttgtgagacaatgcct

SEQ ID NO: 7769023 - DNA, 22 bp, Homo sapiens
agtgtatctaggtatctatagt

SEQ ID NO: 7769024 - DNA, 22 bp, Homo sapiens
agtgtatcatggttggcagaca

SEQ ID NO: 7769025 - DNA, 23 bp, Homo sapiens
actgctttattcatgaggctctc

SEQ ID NO: 7769026 - DNA, 22 bp, Homo sapiens
actgcagcaaagcccgtgtctt

SEQ ID NO: 7769027 - DNA, 22 bp, Homo sapiens
actgcagaggtggggtgcagag

SEQ ID NO: 7769028 - DNA, 22 bp, Homo sapiens
actgcacttcagcctgggtgtc

SEQ ID NO: 7769029 - DNA, 19 bp, Homo sapiens
actgcactttagcctgggc

SEQ ID NO: 7769030 - DNA, 22 bp, Homo sapiens
actgcacttcagcctgggtgtc

SEQ ID NO: 7769031 - DNA, 22 bp, Homo sapiens
agtgtacagttctatgaatttc

SEQ ID NO: 7769032 - DNA, 22 bp, Homo sapiens
actgcacttcagcctgggtgac

SEQ ID NO: 7769033 - DNA, 22 bp, Homo sapiens
actgcacttcagcctgggtgac

SEQ ID NO: 7769034 - DNA, 22 bp, Homo sapiens
agtggcagtggctgggcagagc

SEQ ID NO: 7769035 - DNA, 22 bp, Homo sapiens
agtggcagggctggctgctgca

SEQ ID NO: 7769036 - DNA, 22 bp, Homo sapiens
agtggcagtagatgagctggtt

SEQ ID NO: 7769037 - DNA, 22 bp, Homo sapiens
agtggcagagccagggttggga

SEQ ID NO: 7769038 - DNA, 22 bp, Homo sapiens
agtcccagcttcccccatgcag

SEQ ID NO: 7769039 - DNA, 22 bp, Homo sapiens
actcctgtgggcatggcacccc

SEQ ID NO: 7769040 - DNA, 22 bp, Homo sapiens
actcctggtttgtgtcctggct

SEQ ID NO: 7769041 - DNA, 22 bp, Homo sapiens
actcctggttcccagttgagat

SEQ ID NO: 7769042 - DNA, 22 bp, Homo sapiens
actcctggtgctgatgaagaga

SEQ ID NO: 7769043 - DNA, 17 bp, Homo sapiens
actcctggtctgaaggg

SEQ ID NO: 7769044 - DNA, 22 bp, Homo sapiens
actcctgggttccggagattct

SEQ ID NO: 7769045 - DNA, 22 bp, Homo sapiens
actcctgggttctaaatttgaa

SEQ ID NO: 7769046 - DNA, 20 bp, Homo sapiens
actcctggtaacttttgtga

SEQ ID NO: 7769047 - DNA, 22 bp, Homo sapiens
actcctgggttgcagtcctcaa

SEQ ID NO: 7769048 - DNA, 22 bp, Homo sapiens
actctgtaattctgaagcacct

SEQ ID NO: 7769049 - DNA, 22 bp, Homo sapiens
agtctttacatgtgttatatat

SEQ ID NO: 7769050 - DNA, 22 bp, Homo sapiens
agtctttaagtaatgataggca

SEQ ID NO: 7769051 - DNA, 18 bp, Homo sapiens
agtcttgttctgttgccc

SEQ ID NO: 7769052 - DNA, 18 bp, Homo sapiens
agtctttaaagatgttac

SEQ ID NO: 7769053 - DNA, 22 bp, Homo sapiens
agtcttcttgatcttttcagtg

SEQ ID NO: 7769054 - DNA, 23 bp, Homo sapiens
actcgtggaattctctgcgatcg

SEQ ID NO: 7769055 - DNA, 22 bp, Homo sapiens
actcgtgtcaagatcctaagtc

SEQ ID NO: 7769056 - DNA, 22 bp, Homo sapiens
actctaaaatgctatgagatct

SEQ ID NO: 7769057 - DNA, 22 bp, Homo sapiens
agtgcagtggttaggagccagg

SEQ ID NO: 7769058 - DNA, 22 bp, Homo sapiens
agtgcaattttgctttcccaat

SEQ ID NO: 7769059 - DNA, 23 bp, Homo sapiens
actctgtaggctgtccatgtgca

SEQ ID NO: 7769060 - DNA, 22 bp, Homo sapiens
actctgtagcctgtaagagagc

SEQ ID NO: 7769061 - DNA, 22 bp, Homo sapiens
actctgtagagtataccaatgt

SEQ ID NO: 7769062 - DNA, 20 bp, Homo sapiens
actctgtaggtaatgagact

SEQ ID NO: 7769063 - DNA, 22 bp, Homo sapiens
actctgtatccctctcaaattg

SEQ ID NO: 7769064 - DNA, 22 bp, Homo sapiens
agtgcataaaggaaaaactgaa

SEQ ID NO: 7769065 - DNA, 22 bp, Homo sapiens
agtgcatacccttctaaaaagt

SEQ ID NO: 7769066 - DNA, 22 bp, Homo sapiens
acgcccggtctccatagttttt

SEQ ID NO: 7769067 - DNA, 22 bp, Homo sapiens
acgcccggtctccatagttttt

SEQ ID NO: 7769068 - DNA, 22 bp, Homo sapiens
acgcccagactcccatactttg

SEQ ID NO: 7769069 - DNA, 22 bp, Homo sapiens
acgcagtttgtggacatttttt

SEQ ID NO: 7769070 - DNA, 20 bp, Homo sapiens
aggtggctcctgctgggggt

SEQ ID NO: 7769071 - DNA, 22 bp, Homo sapiens
agtaaaaattgaggtgcaaaat

SEQ ID NO: 7769072 - DNA, 22 bp, Homo sapiens
acggaatgagtcttgaaaagtg

SEQ ID NO: 7769073 - DNA, 22 bp, Homo sapiens
actagccaagttttacgactaa

SEQ ID NO: 7769074 - DNA, 22 bp, Homo sapiens
agtaaaatcaccatctctttgt

SEQ ID NO: 7769075 - DNA, 22 bp, Homo sapiens
agtaaaacagagaaatcactca

SEQ ID NO: 7769076 - DNA, 22 bp, Homo sapiens
agtaaaacagagaaatcactca

SEQ ID NO: 7769077 - DNA, 22 bp, Homo sapiens
agtaaaatttctgctgaggaga

SEQ ID NO: 7769078 - DNA, 22 bp, Homo sapiens
agtaaaattgtattggaaaaca

SEQ ID NO: 7769079 - DNA, 22 bp, Homo sapiens
agtattttcgccatcacaagaa

SEQ ID NO: 7769080 - DNA, 22 bp, Homo sapiens
agtattttcaaccatagcctgg

SEQ ID NO: 7769081 - DNA, 22 bp, Homo sapiens
agtatttgatcagatgatagta

SEQ ID NO: 7769082 - DNA, 22 bp, Homo sapiens
agtatttgttgattgatatgaa

SEQ ID NO: 7769083 - DNA, 22 bp, Homo sapiens
agtatactccccatcctagaaa

SEQ ID NO: 7769084 - DNA, 22 bp, Homo sapiens
agtatactgaaagtaaatatga

SEQ ID NO: 7769085 - DNA, 22 bp, Homo sapiens
actaggggctcaggcccaggga

SEQ ID NO: 7769086 - DNA, 21 bp, Homo sapiens
actagctttctggagaagtgt

SEQ ID NO: 7769087 - DNA, 22 bp, Homo sapiens
actcaggagggatcagctatca

SEQ ID NO: 7769088 - DNA, 22 bp, Homo sapiens
agtcaaataagactgtcataag

SEQ ID NO: 7769089 - DNA, 19 bp, Homo sapiens
accctctcagtgcctgagg

SEQ ID NO: 7769090 - DNA, 22 bp, Homo sapiens
acctcccttgctaaagactgtg

SEQ ID NO: 7769091 - DNA, 22 bp, Homo sapiens
acctcctgatgagagtaaagga

SEQ ID NO: 7769092 - DNA, 22 bp, Homo sapiens
acctgaggcctccccagcagac

SEQ ID NO: 7769093 - DNA, 22 bp, Homo sapiens
acctgagggcccaaacttggta

SEQ ID NO: 7769094 - DNA, 22 bp, Homo sapiens
acctgcaagcattacacttcta

SEQ ID NO: 7769095 - DNA, 22 bp, Homo sapiens
acctgaggctgttagtctaggt

SEQ ID NO: 7769096 - DNA, 22 bp, Homo sapiens
acctgaggctgttagtctaggt

SEQ ID NO: 7769097 - DNA, 22 bp, Homo sapiens
aggtcctgtttcttccctgggg

SEQ ID NO: 7769098 - DNA, 22 bp, Homo sapiens
aggtcctgtttcttccctgggg

SEQ ID NO: 7769099 - DNA, 22 bp, Homo sapiens
aggtcctgtcttatctctgtaa

SEQ ID NO: 7769100 - DNA, 22 bp, Homo sapiens
aggtggctatgaggatgcagtc

SEQ ID NO: 7769101 - DNA, 22 bp, Homo sapiens
acctggcactacaggcacctgt

SEQ ID NO: 7769102 - DNA, 20 bp, Homo sapiens
acctggctctcaggagcaac

SEQ ID NO: 7769103 - DNA, 23 bp, Homo sapiens
attattaaggacatggactttgt

SEQ ID NO: 7769104 - DNA, 22 bp, Homo sapiens
attattaaagcttaggtcttat

SEQ ID NO: 7769105 - DNA, 22 bp, Homo sapiens
attataggcttgagccaccgtg

SEQ ID NO: 7769106 - DNA, 22 bp, Homo sapiens
attattataaagtgcatgacct

SEQ ID NO: 7769107 - DNA, 22 bp, Homo sapiens
attattcaacacttgagaaatt

SEQ ID NO: 7769108 - DNA, 22 bp, Homo sapiens
attattcaacacttgagaaatt

SEQ ID NO: 7769109 - DNA, 22 bp, Homo sapiens
agaggcactgttcttagcgact

SEQ ID NO: 7769110 - DNA, 21 bp, Homo sapiens
attattatttctgtgtccagc

SEQ ID NO: 7769111 - DNA, 22 bp, Homo sapiens
attattattgttgatgttaggg

SEQ ID NO: 7769112 - DNA, 22 bp, Homo sapiens
attattattgttgatgttaggg

SEQ ID NO: 7769113 - DNA, 22 bp, Homo sapiens
attattatggttgctcttttcc

SEQ ID NO: 7769114 - DNA, 22 bp, Homo sapiens
agaggagctgggaggccctcgt

SEQ ID NO: 7769115 - DNA, 22 bp, Homo sapiens
agaggaggaagagctttaaaat

SEQ ID NO: 7769116 - DNA, 22 bp, Homo sapiens
attataggcttgagccaccgtg

SEQ ID NO: 7769117 - DNA, 22 bp, Homo sapiens
agaggaggctctgggatcgtcc

SEQ ID NO: 7769118 - DNA, 21 bp, Homo sapiens
agagctggtaggtaggtaggt

SEQ ID NO: 7769119 - DNA, 22 bp, Homo sapiens
agagctggtttactcaggaatt

SEQ ID NO: 7769120 - DNA, 21 bp, Homo sapiens
agagctgggacttgcctgaga

SEQ ID NO: 7769121 - DNA, 22 bp, Homo sapiens
agagctgtggatagtcctggat

SEQ ID NO: 7769122 - DNA, 22 bp, Homo sapiens
atgtttatgcaaacatgtgagt

SEQ ID NO: 7769123 - DNA, 22 bp, Homo sapiens
atgtttatgcaaacatgtgagt

SEQ ID NO: 7769124 - DNA, 22 bp, Homo sapiens
atgtttatgcaaacatgtgagt

SEQ ID NO: 7769125 - DNA, 22 bp, Homo sapiens
atgtttatgcaaacatgtgagt

SEQ ID NO: 7769126 - DNA, 22 bp, Homo sapiens
agagctgtttggacatctgagt

SEQ ID NO: 7769127 - DNA, 22 bp, Homo sapiens
atgtttacagaggaagtgcctc

SEQ ID NO: 7769128 - DNA, 21 bp, Homo sapiens
atgtttacactgactactgtg

SEQ ID NO: 7769129 - DNA, 22 bp, Homo sapiens
atgtttatggagcaggtattag

SEQ ID NO: 7769130 - DNA, 22 bp, Homo sapiens
atgtttatgttgggctatattt

SEQ ID NO: 7769131 - DNA, 22 bp, Homo sapiens
atgtttatgttgggctatattt

SEQ ID NO: 7769132 - DNA, 22 bp, Homo sapiens
attcattggcttgaactccacc

SEQ ID NO: 7769133 - DNA, 22 bp, Homo sapiens
attcatttaggtattcacttac

SEQ ID NO: 7769134 - DNA, 22 bp, Homo sapiens
attcatttaggtattcacttac

SEQ ID NO: 7769135 - DNA, 22 bp, Homo sapiens
agaggcctgtgtgctccagtgg

SEQ ID NO: 7769136 - DNA, 22 bp, Homo sapiens
attcatttgctattgtgtatgg

SEQ ID NO: 7769137 - DNA, 22 bp, Homo sapiens
attcatttgctattgtgtatgg

SEQ ID NO: 7769138 - DNA, 22 bp, Homo sapiens
agaggctcagaggcctggtcct

SEQ ID NO: 7769139 - DNA, 22 bp, Homo sapiens
agaggcgcagactcttgagtgt

SEQ ID NO: 7769140 - DNA, 22 bp, Homo sapiens
attcatgtaacattagagaaat

SEQ ID NO: 7769141 - DNA, 18 bp, Homo sapiens
agagggaaagcaggctga

SEQ ID NO: 7769142 - DNA, 17 bp, Homo sapiens
agagggaaaatgcggtt

SEQ ID NO: 7769143 - DNA, 22 bp, Homo sapiens
agagggaaatccaggagtgctt

SEQ ID NO: 7769144 - DNA, 22 bp, Homo sapiens
agagggagaagctaaaataact

SEQ ID NO: 7769145 - DNA, 22 bp, Homo sapiens
agagggagaaaagaatcagttg

SEQ ID NO: 7769146 - DNA, 22 bp, Homo sapiens
attccagacaggtaaattaggt

SEQ ID NO: 7769147 - DNA, 21 bp, Homo sapiens
agagggagagtggcccttcca

SEQ ID NO: 7769148 - DNA, 22 bp, Homo sapiens
agataaacccaacttaatgaag

SEQ ID NO: 7769149 - DNA, 22 bp, Homo sapiens
agataaaatggttcaaaggcta

SEQ ID NO: 7769150 - DNA, 22 bp, Homo sapiens
agataaattcctaagatttcag

SEQ ID NO: 7769151 - DNA, 22 bp, Homo sapiens
atttcacattaatttgatgctc

SEQ ID NO: 7769152 - DNA, 22 bp, Homo sapiens
atttcacattaatttgatgctc

SEQ ID NO: 7769153 - DNA, 22 bp, Homo sapiens
atttcacttagtgtaatgtctt

SEQ ID NO: 7769154 - DNA, 22 bp, Homo sapiens
agagttgctatagaaggatgga

SEQ ID NO: 7769155 - DNA, 21 bp, Homo sapiens
agagttcttgctgagcaagcc

SEQ ID NO: 7769156 - DNA, 22 bp, Homo sapiens
agagttctgaaattatctttac

SEQ ID NO: 7769157 - DNA, 22 bp, Homo sapiens
agaggtcttttggtctgcagaa

SEQ ID NO: 7769158 - DNA, 21 bp, Homo sapiens
attgctctgttgtgtctagaa

SEQ ID NO: 7769159 - DNA, 22 bp, Homo sapiens
attgctaatgtgcgaatgtgta

SEQ ID NO: 7769160 - DNA, 22 bp, Homo sapiens
attgctaggaacaggttgcacc

SEQ ID NO: 7769161 - DNA, 21 bp, Homo sapiens
agaggtctaagattctagctt

SEQ ID NO: 7769162 - DNA, 22 bp, Homo sapiens
atttggagacaggatttttcag

SEQ ID NO: 7769163 - DNA, 22 bp, Homo sapiens
atttgcttttactatgttaaaa

SEQ ID NO: 7769164 - DNA, 22 bp, Homo sapiens
atttctctgcctcagcttctgc

SEQ ID NO: 7769165 - DNA, 22 bp, Homo sapiens
atttctcattaagatcttccaa

SEQ ID NO: 7769166 - DNA, 22 bp, Homo sapiens
atttctcatctttgtgaatggt

SEQ ID NO: 7769167 - DNA, 22 bp, Homo sapiens
atttcctgatctgtaaaatagc

SEQ ID NO: 7769168 - DNA, 22 bp, Homo sapiens
agatacattgttctaagcattg

SEQ ID NO: 7769169 - DNA, 22 bp, Homo sapiens
agatacattgttctaagcattg

SEQ ID NO: 7769170 - DNA, 21 bp, Homo sapiens
caaaaggataggaaattaggg

SEQ ID NO: 7769171 - DNA, 22 bp, Homo sapiens
atttgtttcagggccttggtat

SEQ ID NO: 7769172 - DNA, 20 bp, Homo sapiens
atttgtttctactctctgac

SEQ ID NO: 7769173 - DNA, 22 bp, Homo sapiens
atttgtttatcgtcgattgtag

SEQ ID NO: 7769174 - DNA, 22 bp, Homo sapiens
caaaaggccagtactttgtttg

SEQ ID NO: 7769175 - DNA, 22 bp, Homo sapiens
atttgttcagcattgaatttgg

SEQ ID NO: 7769176 - DNA, 22 bp, Homo sapiens
atttgttcagcattgaatttgg

SEQ ID NO: 7769177 - DNA, 22 bp, Homo sapiens
atttgttcatgggttgttatgc

SEQ ID NO: 7769178 - DNA, 22 bp, Homo sapiens
atttgttccacacatatttact

SEQ ID NO: 7769179 - DNA, 22 bp, Homo sapiens
atttggctattgaattattcct

SEQ ID NO: 7769180 - DNA, 22 bp, Homo sapiens
atttgtgggactataatgcagg

SEQ ID NO: 7769181 - DNA, 22 bp, Homo sapiens
atgaacaatgactacatattga

SEQ ID NO: 7769182 - DNA, 18 bp, Homo sapiens
agacaaacttcttctgcc

SEQ ID NO: 7769183 - DNA, 18 bp, Homo sapiens
agacaaacttcttctgcc

SEQ ID NO: 7769184 - DNA, 22 bp, Homo sapiens
agacaaaccttgttttatgatg

SEQ ID NO: 7769185 - DNA, 22 bp, Homo sapiens
agacaaataactttttatgtcc

SEQ ID NO: 7769186 - DNA, 22 bp, Homo sapiens
agacaaataactttttatgtcc

SEQ ID NO: 7769187 - DNA, 22 bp, Homo sapiens
agacaaatggtaattatgtcta

SEQ ID NO: 7769188 - DNA, 22 bp, Homo sapiens
agacaaattgggacattgtgtt

SEQ ID NO: 7769189 - DNA, 22 bp, Homo sapiens
agacaaatggagtatgagcaac

SEQ ID NO: 7769190 - DNA, 20 bp, Homo sapiens
agaagtcagctcagaagtga

SEQ ID NO: 7769191 - DNA, 22 bp, Homo sapiens
agaagtcagccacagtgggaga

SEQ ID NO: 7769192 - DNA, 22 bp, Homo sapiens
agaagtcaatgatgagagtgct

SEQ ID NO: 7769193 - DNA, 21 bp, Homo sapiens
agaagtcaattgaactgaaat

SEQ ID NO: 7769194 - DNA, 22 bp, Homo sapiens
agaaggctggccctgggtggcc

SEQ ID NO: 7769195 - DNA, 22 bp, Homo sapiens
agaaggctttaagtactggcat

SEQ ID NO: 7769196 - DNA, 22 bp, Homo sapiens
agaagtggtctgtcttccagat

SEQ ID NO: 7769197 - DNA, 22 bp, Homo sapiens
agaagttaccacatacttctct

SEQ ID NO: 7769198 - DNA, 22 bp, Homo sapiens
agaagtttccagtctagtaagg

SEQ ID NO: 7769199 - DNA, 22 bp, Homo sapiens
agaagtttgaaattaggagaaa

SEQ ID NO: 7769200 - DNA, 22 bp, Homo sapiens
agaagtttggtcctataaactc

SEQ ID NO: 7769201 - DNA, 22 bp, Homo sapiens
agaagtttggtccttttcaagg

SEQ ID NO: 7769202 - DNA, 22 bp, Homo sapiens
atgaaacatgctttgtggatga

SEQ ID NO: 7769203 - DNA, 22 bp, Homo sapiens
atgaaactctaacttaacaagt

SEQ ID NO: 7769204 - DNA, 22 bp, Homo sapiens
atgcacatgtatctatatacaa

SEQ ID NO: 7769205 - DNA, 17 bp, Homo sapiens
atgcacatgtaagagga

SEQ ID NO: 7769206 - DNA, 22 bp, Homo sapiens
atgcacatgaggcaagcaaaat

SEQ ID NO: 7769207 - DNA, 23 bp, Homo sapiens
atgcaacattgccagtatgggca

SEQ ID NO: 7769208 - DNA, 22 bp, Homo sapiens
atgcaagacataaataatcttt

SEQ ID NO: 7769209 - DNA, 22 bp, Homo sapiens
atgcacatcactctgaagaaaa

SEQ ID NO: 7769210 - DNA, 22 bp, Homo sapiens
atgcaacatccaattccttttg

SEQ ID NO: 7769211 - DNA, 22 bp, Homo sapiens
atgcaacatacattctgaagct

SEQ ID NO: 7769212 - DNA, 22 bp, Homo sapiens
atgacaaattcagaccatagca

SEQ ID NO: 7769213 - DNA, 22 bp, Homo sapiens
atgacaaacccaggatgtaaca

SEQ ID NO: 7769214 - DNA, 22 bp, Homo sapiens
atgacaaaagaagacatgaggt

SEQ ID NO: 7769215 - DNA, 22 bp, Homo sapiens
atgacaaaatgaatgcagctag

SEQ ID NO: 7769216 - DNA, 22 bp, Homo sapiens
agacagcatgatacatgatgct

SEQ ID NO: 7769217 - DNA, 22 bp, Homo sapiens
agacagcatggagctgataaca

SEQ ID NO: 7769218 - DNA, 22 bp, Homo sapiens
agacagcagcagaggggctccc

SEQ ID NO: 7769219 - DNA, 22 bp, Homo sapiens
agacagcagaaactagagcact

SEQ ID NO: 7769220 - DNA, 22 bp, Homo sapiens
agacagcaggggagtctggttt

SEQ ID NO: 7769221 - DNA, 22 bp, Homo sapiens
agacatcaatgatcagaggtag

SEQ ID NO: 7769222 - DNA, 22 bp, Homo sapiens
agacagctgctcgcagagctat

SEQ ID NO: 7769223 - DNA, 22 bp, Homo sapiens
agacaggacacaagctgcataa

SEQ ID NO: 7769224 - DNA, 22 bp, Homo sapiens
agacaggagagggaactgccgg

SEQ ID NO: 7769225 - DNA, 20 bp, Homo sapiens
agacaggagcccccattcag

SEQ ID NO: 7769226 - DNA, 22 bp, Homo sapiens
agacaggatgcatactcttggt

SEQ ID NO: 7769227 - DNA, 22 bp, Homo sapiens
agacaggcagaggctgcagagg

SEQ ID NO: 7769228 - DNA, 22 bp, Homo sapiens
atggccttagtgatgattaata

SEQ ID NO: 7769229 - DNA, 20 bp, Homo sapiens
atggcctgctagaagtctgt

SEQ ID NO: 7769230 - DNA, 22 bp, Homo sapiens
agagaccttttgccttctagtt

SEQ ID NO: 7769231 - DNA, 22 bp, Homo sapiens
agagacctttgttattctagga

SEQ ID NO: 7769232 - DNA, 22 bp, Homo sapiens
agagatgaaaagtggagactgg

SEQ ID NO: 7769233 - DNA, 22 bp, Homo sapiens
agagaagcagggagtcatctgt

SEQ ID NO: 7769234 - DNA, 22 bp, Homo sapiens
agagaagcattcttctcagggc

SEQ ID NO: 7769235 - DNA, 22 bp, Homo sapiens
agagacagggttttgtcgtgtt

SEQ ID NO: 7769236 - DNA, 22 bp, Homo sapiens
agagaagagcaatgataaattt

SEQ ID NO: 7769237 - DNA, 22 bp, Homo sapiens
agagaagagcaatgataaattt

SEQ ID NO: 7769238 - DNA, 22 bp, Homo sapiens
atggccagctcagagcactcag

SEQ ID NO: 7769239 - DNA, 22 bp, Homo sapiens
agacccagaaagcagctgcatt

SEQ ID NO: 7769240 - DNA, 22 bp, Homo sapiens
agagatgcattcagcatggatg

SEQ ID NO: 7769241 - DNA, 22 bp, Homo sapiens
agagatgactgatggctgatta

SEQ ID NO: 7769242 - DNA, 22 bp, Homo sapiens
agagatgcagggtacatggaat

SEQ ID NO: 7769243 - DNA, 22 bp, Homo sapiens
agagatgaatcttgagactctg

SEQ ID NO: 7769244 - DNA, 22 bp, Homo sapiens
agagatggccttaggtgggaat

SEQ ID NO: 7769245 - DNA, 22 bp, Homo sapiens
atgggggaaagtacgagcatgg

SEQ ID NO: 7769246 - DNA, 22 bp, Homo sapiens
atggggtgaccatgagcattta

SEQ ID NO: 7769247 - DNA, 20 bp, Homo sapiens
atggggtgagtgacgccctc

SEQ ID NO: 7769248 - DNA, 22 bp, Homo sapiens
agagccaaggctgagagctatt

SEQ ID NO: 7769249 - DNA, 22 bp, Homo sapiens
atgggtggagggtgacacggat

SEQ ID NO: 7769250 - DNA, 22 bp, Homo sapiens
atggggtggagtccgggcagcg

SEQ ID NO: 7769251 - DNA, 22 bp, Homo sapiens
agagcagcctgtgatgatgcac

SEQ ID NO: 7769252 - DNA, 22 bp, Homo sapiens
atgtggggactctgagagaatt

SEQ ID NO: 7769253 - DNA, 22 bp, Homo sapiens
atgtggttgaagaattacatct

SEQ ID NO: 7769254 - DNA, 22 bp, Homo sapiens
agagcctgtacttttctgtgaa

SEQ ID NO: 7769255 - DNA, 22 bp, Homo sapiens
agagcctgcagtggagaccttg

SEQ ID NO: 7769256 - DNA, 22 bp, Homo sapiens
atgtcaaagcagactgagagcg

SEQ ID NO: 7769257 - DNA, 22 bp, Homo sapiens
atgtcaaatcagttttatcaga

SEQ ID NO: 7769258 - DNA, 22 bp, Homo sapiens
atgtattttaagatttgcctca

SEQ ID NO: 7769259 - DNA, 22 bp, Homo sapiens
atgtatttgcgaggttaggaaa

SEQ ID NO: 7769260 - DNA, 22 bp, Homo sapiens
atgtatttgcgtatggacatac

SEQ ID NO: 7769261 - DNA, 22 bp, Homo sapiens
atgtatttgcttgttatggatt

SEQ ID NO: 7769262 - DNA, 22 bp, Homo sapiens
atgtatttgcttgttatggatt

SEQ ID NO: 7769263 - DNA, 22 bp, Homo sapiens
atgtattttaagatttgcctca

SEQ ID NO: 7769264 - DNA, 22 bp, Homo sapiens
cagaatgtagatcatcatcaag

SEQ ID NO: 7769265 - DNA, 22 bp, Homo sapiens
cagaatggcttttatggctcag

SEQ ID NO: 7769266 - DNA, 22 bp, Homo sapiens
cagaatgtatatgatctaaggt

SEQ ID NO: 7769267 - DNA, 22 bp, Homo sapiens
agccactttactttcatatttt

SEQ ID NO: 7769268 - DNA, 22 bp, Homo sapiens
agccagaaaaacaccaagagga

SEQ ID NO: 7769269 - DNA, 22 bp, Homo sapiens
agccactttactttcatatttt

SEQ ID NO: 7769270 - DNA, 22 bp, Homo sapiens
cagaataccctatagacagaat

SEQ ID NO: 7769271 - DNA, 22 bp, Homo sapiens
cagaatctctgggagtggatca

SEQ ID NO: 7769272 - DNA, 22 bp, Homo sapiens
cagaatctgagtcgtgattgta

SEQ ID NO: 7769273 - DNA, 22 bp, Homo sapiens
agccactcagtgctgtattgac

SEQ ID NO: 7769274 - DNA, 22 bp, Homo sapiens
agccacagtgcaagagagaaaa

SEQ ID NO: 7769275 - DNA, 22 bp, Homo sapiens
agccacatgagtgagccatctt

SEQ ID NO: 7769276 - DNA, 22 bp, Homo sapiens
agccacatggacctgatgctag

SEQ ID NO: 7769277 - DNA, 22 bp, Homo sapiens
agcatataaatggacatatttg

SEQ ID NO: 7769278 - DNA, 22 bp, Homo sapiens
agccacagtctgtagccagctt

SEQ ID NO: 7769279 - DNA, 22 bp, Homo sapiens
cagaaatatcagttgaaagtgc

SEQ ID NO: 7769280 - DNA, 22 bp, Homo sapiens
cagaaatctccatgtcagacat

SEQ ID NO: 7769281 - DNA, 22 bp, Homo sapiens
cagaaatatttattgagtgaca

SEQ ID NO: 7769282 - DNA, 22 bp, Homo sapiens
agcccaggctggagtgcagtgg

SEQ ID NO: 7769283 - DNA, 20 bp, Homo sapiens
agcccaggcctgtgtgagtc

SEQ ID NO: 7769284 - DNA, 18 bp, Homo sapiens
agcccaggcatcgtctgc

SEQ ID NO: 7769285 - DNA, 18 bp, Homo sapiens
agcccaggcatcgtctgc

SEQ ID NO: 7769286 - DNA, 22 bp, Homo sapiens
agcccaggcagagggatgcttg

SEQ ID NO: 7769287 - DNA, 22 bp, Homo sapiens
cagagggagccctccaggagca

SEQ ID NO: 7769288 - DNA, 23 bp, Homo sapiens
cagaggcatcggattcaacatca

SEQ ID NO: 7769289 - DNA, 22 bp, Homo sapiens
cagaggcatataattgctgggg

SEQ ID NO: 7769290 - DNA, 22 bp, Homo sapiens
cagaggcatactcccagtcttg

SEQ ID NO: 7769291 - DNA, 22 bp, Homo sapiens
agcccaggcagagggatgcttg

SEQ ID NO: 7769292 - DNA, 22 bp, Homo sapiens
cagaggcattactgaaaaggtg

SEQ ID NO: 7769293 - DNA, 22 bp, Homo sapiens
cagaggcagtggggttgctcct

SEQ ID NO: 7769294 - DNA, 21 bp, Homo sapiens
cagaggcaggtcctgggacgg

SEQ ID NO: 7769295 - DNA, 21 bp, Homo sapiens
cagaggcaggtcctgggacgg

SEQ ID NO: 7769296 - DNA, 22 bp, Homo sapiens
agcccagccggattcccagttc

SEQ ID NO: 7769297 - DNA, 21 bp, Homo sapiens
cagaggcaggctctgtgtgtg

SEQ ID NO: 7769298 - DNA, 22 bp, Homo sapiens
cagagaaagaagcccattcatt

SEQ ID NO: 7769299 - DNA, 22 bp, Homo sapiens
cagagaaactcagatagctgat

SEQ ID NO: 7769300 - DNA, 22 bp, Homo sapiens
cagagaaaaaatcctgctctca

SEQ ID NO: 7769301 - DNA, 22 bp, Homo sapiens
cagacttttgggaggtctgtgg

SEQ ID NO: 7769302 - DNA, 22 bp, Homo sapiens
agcccagcactgggggcccagc

SEQ ID NO: 7769303 - DNA, 22 bp, Homo sapiens
agcccagcagaaagtccagcct

SEQ ID NO: 7769304 - DNA, 22 bp, Homo sapiens
agcccagcaaaggggtttgaga

SEQ ID NO: 7769305 - DNA, 22 bp, Homo sapiens
agcccagcaaagggaggttcag

SEQ ID NO: 7769306 - DNA, 22 bp, Homo sapiens
agcccagcccgggctgcgcttt

SEQ ID NO: 7769307 - DNA, 22 bp, Homo sapiens
agcccagccactattaaatgtt

SEQ ID NO: 7769308 - DNA, 23 bp, Homo sapiens
agcccagcagagaacctaggtcc

SEQ ID NO: 7769309 - DNA, 22 bp, Homo sapiens
agcccagcagtaagattagaga

SEQ ID NO: 7769310 - DNA, 22 bp, Homo sapiens
agcccaaggcttccctgctggc

SEQ ID NO: 7769311 - DNA, 22 bp, Homo sapiens
agcccagagggtagcagaagaa

SEQ ID NO: 7769312 - DNA, 22 bp, Homo sapiens
cagctcattcctcaatctagga

SEQ ID NO: 7769313 - DNA, 22 bp, Homo sapiens
cagctcagtttcaataccaggt

SEQ ID NO: 7769314 - DNA, 22 bp, Homo sapiens
cagctcagtcttgaagcactgg

SEQ ID NO: 7769315 - DNA, 22 bp, Homo sapiens
agctcctgattctcagagatag

SEQ ID NO: 7769316 - DNA, 22 bp, Homo sapiens
agctcctgatacatgcaggaat

SEQ ID NO: 7769317 - DNA, 23 bp, Homo sapiens
agctcctgaggccagcctctcct

SEQ ID NO: 7769318 - DNA, 22 bp, Homo sapiens
cagctcagtctggagagatgca

SEQ ID NO: 7769319 - DNA, 23 bp, Homo sapiens
cagccctgaaatcgaggtgacac

SEQ ID NO: 7769320 - DNA, 22 bp, Homo sapiens
cagccctgagagaaccatctat

SEQ ID NO: 7769321 - DNA, 22 bp, Homo sapiens
cagccctgagagaaccatctat

SEQ ID NO: 7769322 - DNA, 22 bp, Homo sapiens
cagccctgcagagggcgctcct

SEQ ID NO: 7769323 - DNA, 22 bp, Homo sapiens
cagccctgcagagggcgctcct

SEQ ID NO: 7769324 - DNA, 22 bp, Homo sapiens
cagccctgagttagcccacgga

SEQ ID NO: 7769325 - DNA, 22 bp, Homo sapiens
cagcagtgtctccagcatcaca

SEQ ID NO: 7769326 - DNA, 22 bp, Homo sapiens
cagcagggggcagcgcagatca

SEQ ID NO: 7769327 - DNA, 22 bp, Homo sapiens
cagcataggatgtggagccagg

SEQ ID NO: 7769328 - DNA, 22 bp, Homo sapiens
cagcatagctgattaaggcaaa

SEQ ID NO: 7769329 - DNA, 22 bp, Homo sapiens
agcctctgatggctcccaagga

SEQ ID NO: 7769330 - DNA, 22 bp, Homo sapiens
agcctctgctggccctggcact

SEQ ID NO: 7769331 - DNA, 22 bp, Homo sapiens
agcctctgtagaaagcagtgtg

SEQ ID NO: 7769332 - DNA, 22 bp, Homo sapiens
agcctctggccctagactgctt

SEQ ID NO: 7769333 - DNA, 22 bp, Homo sapiens
agcctctggtcctccctcagct

SEQ ID NO: 7769334 - DNA, 22 bp, Homo sapiens
cagagggagtttctgaggttgc

SEQ ID NO: 7769335 - DNA, 22 bp, Homo sapiens
cagagggcacatggtttcctca

SEQ ID NO: 7769336 - DNA, 22 bp, Homo sapiens
cagagggccatctctatcttca

SEQ ID NO: 7769337 - DNA, 22 bp, Homo sapiens
cagagggccccctggccacagt

SEQ ID NO: 7769338 - DNA, 22 bp, Homo sapiens
cagaggtgctggagtgagtcct

SEQ ID NO: 7769339 - DNA, 22 bp, Homo sapiens
agcctccctatgcaccttcagg

SEQ ID NO: 7769340 - DNA, 22 bp, Homo sapiens
agcctgagagccaagctgtgca

SEQ ID NO: 7769341 - DNA, 22 bp, Homo sapiens
agcctgagagccaagctgtgca

SEQ ID NO: 7769342 - DNA, 22 bp, Homo sapiens
cagcagcattgctctggattcc

SEQ ID NO: 7769343 - DNA, 22 bp, Homo sapiens
agcctgagctgcctgccgcctc

SEQ ID NO: 7769344 - DNA, 22 bp, Homo sapiens
agcctgagccccatccagctga

SEQ ID NO: 7769345 - DNA, 22 bp, Homo sapiens
agcctgagccccatccagctga

SEQ ID NO: 7769346 - DNA, 22 bp, Homo sapiens
agcctggagttcccaggagaag

SEQ ID NO: 7769347 - DNA, 22 bp, Homo sapiens
agcctggatcctaggctcagct

SEQ ID NO: 7769348 - DNA, 22 bp, Homo sapiens
agcctggcactgaggcagggcg

SEQ ID NO: 7769349 - DNA, 23 bp, Homo sapiens
agcctggcacctgcagatcggag

SEQ ID NO: 7769350 - DNA, 20 bp, Homo sapiens
agcctggcaaacacccccag

SEQ ID NO: 7769351 - DNA, 22 bp, Homo sapiens
cagcagggcccccgggtgcgcc

SEQ ID NO: 7769352 - DNA, 22 bp, Homo sapiens
agcctggcactgaggcagggcg

SEQ ID NO: 7769353 - DNA, 22 bp, Homo sapiens
agcctggcactgccccatccat

SEQ ID NO: 7769354 - DNA, 22 bp, Homo sapiens
cacacactggagcaaggagatg

SEQ ID NO: 7769355 - DNA, 22 bp, Homo sapiens
cacacactgttaatgtaggagt

SEQ ID NO: 7769356 - DNA, 22 bp, Homo sapiens
agcaggagtttgatgcttttat

SEQ ID NO: 7769357 - DNA, 22 bp, Homo sapiens
agcaggcaccagggctcgtcct

SEQ ID NO: 7769358 - DNA, 22 bp, Homo sapiens
agcaggcacaagaaagggaggt

SEQ ID NO: 7769359 - DNA, 22 bp, Homo sapiens
agcaggcacgctccctgcgcga

SEQ ID NO: 7769360 - DNA, 17 bp, Homo sapiens
agcaggcacgtcagcac

SEQ ID NO: 7769361 - DNA, 22 bp, Homo sapiens
cacacaaatattctggaggcaa

SEQ ID NO: 7769362 - DNA, 22 bp, Homo sapiens
cacaattttcctttaagtgtat

SEQ ID NO: 7769363 - DNA, 22 bp, Homo sapiens
agcagctgcagggagggtctgc

SEQ ID NO: 7769364 - DNA, 22 bp, Homo sapiens
agcaggcaggaatggtggaaca

SEQ ID NO: 7769365 - DNA, 22 bp, Homo sapiens
agcaggcagctgggggagttga

SEQ ID NO: 7769366 - DNA, 22 bp, Homo sapiens
agcaggcaggaaggcagcactg

SEQ ID NO: 7769367 - DNA, 22 bp, Homo sapiens
agcaggcaggaaggcagcactg

SEQ ID NO: 7769368 - DNA, 22 bp, Homo sapiens
agcaggcagcctaggaagtgaa

SEQ ID NO: 7769369 - DNA, 22 bp, Homo sapiens
agcaggcactatgccaggatct

SEQ ID NO: 7769370 - DNA, 22 bp, Homo sapiens
agcaggcagccatttggaaggc

SEQ ID NO: 7769371 - DNA, 17 bp, Homo sapiens
agcaggctgcagaggcc

SEQ ID NO: 7769372 - DNA, 20 bp, Homo sapiens
agcaggctgcagggtgaaat

SEQ ID NO: 7769373 - DNA, 22 bp, Homo sapiens
agcaggctgatgggcatgcttg

SEQ ID NO: 7769374 - DNA, 22 bp, Homo sapiens
agcaggctgatgggcatgcttg

SEQ ID NO: 7769375 - DNA, 22 bp, Homo sapiens
agcaggctccttccttctctgg

SEQ ID NO: 7769376 - DNA, 22 bp, Homo sapiens
agcaggctgagcacccaggggg

SEQ ID NO: 7769377 - DNA, 22 bp, Homo sapiens
agcaggctgagcacccaggggg

SEQ ID NO: 7769378 - DNA, 22 bp, Homo sapiens
agcaggctccaggctggccatc

SEQ ID NO: 7769379 - DNA, 22 bp, Homo sapiens
agcaggctccttccttctctgg

SEQ ID NO: 7769380 - DNA, 22 bp, Homo sapiens
agcaggctccaggctggccatc

SEQ ID NO: 7769381 - DNA, 22 bp, Homo sapiens
cacagtttgcataggaaaaaca

SEQ ID NO: 7769382 - DNA, 22 bp, Homo sapiens
cacctagggtttcgcctttctt

SEQ ID NO: 7769383 - DNA, 22 bp, Homo sapiens
caccctttgctgctcttcctcc

SEQ ID NO: 7769384 - DNA, 22 bp, Homo sapiens
cacccaggctggagtgcagtgg

SEQ ID NO: 7769385 - DNA, 22 bp, Homo sapiens
cacccagggctgtgcctgccca

SEQ ID NO: 7769386 - DNA, 22 bp, Homo sapiens
caccctgtcagttgcaggatag

SEQ ID NO: 7769387 - DNA, 22 bp, Homo sapiens
cacccaggctggagtgcattgg

SEQ ID NO: 7769388 - DNA, 22 bp, Homo sapiens
cacctcatggataagataaact

SEQ ID NO: 7769389 - DNA, 22 bp, Homo sapiens
cacctgagcactggggccgccc

SEQ ID NO: 7769390 - DNA, 22 bp, Homo sapiens
cactgctacctctgcctcccgg

SEQ ID NO: 7769391 - DNA, 22 bp, Homo sapiens
cacccaggctggagtgcagtgg

SEQ ID NO: 7769392 - DNA, 22 bp, Homo sapiens
cacccaggctggagtgcagtga

SEQ ID NO: 7769393 - DNA, 22 bp, Homo sapiens
cacccaggctggagtgcagggg

SEQ ID NO: 7769394 - DNA, 22 bp, Homo sapiens
cacccaggctggagtgcagtga

SEQ ID NO: 7769395 - DNA, 22 bp, Homo sapiens
cacccaggctggagtgcagggg

SEQ ID NO: 7769396 - DNA, 22 bp, Homo sapiens
cacccaggctggagagcagtgg

SEQ ID NO: 7769397 - DNA, 22 bp, Homo sapiens
agcaggggtctctgctaatgaa

SEQ ID NO: 7769398 - DNA, 22 bp, Homo sapiens
agcaggggtctctgctaatgaa

SEQ ID NO: 7769399 - DNA, 22 bp, Homo sapiens
agcaggggtggaaggtagcttt

SEQ ID NO: 7769400 - DNA, 22 bp, Homo sapiens
agcagggtatgttagagctgta

SEQ ID NO: 7769401 - DNA, 22 bp, Homo sapiens
agcagggtttggggattggcac

SEQ ID NO: 7769402 - DNA, 22 bp, Homo sapiens
agcagggttctcagttggtgct

SEQ ID NO: 7769403 - DNA, 22 bp, Homo sapiens
agcagggttccaggagttgcag

SEQ ID NO: 7769404 - DNA, 22 bp, Homo sapiens
agcagggttccttaaggccata

SEQ ID NO: 7769405 - DNA, 22 bp, Homo sapiens
agcagggtcctgaggtgagtca

SEQ ID NO: 7769406 - DNA, 22 bp, Homo sapiens
agcagggtcctgaggtgagtca

SEQ ID NO: 7769407 - DNA, 22 bp, Homo sapiens
agcagggtgtggtggccctgga

SEQ ID NO: 7769408 - DNA, 22 bp, Homo sapiens
agcagggtgtggtggccctgga

SEQ ID NO: 7769409 - DNA, 22 bp, Homo sapiens
agcaggggtaacagaaggaaag

SEQ ID NO: 7769410 - DNA, 22 bp, Homo sapiens
agcagggggcatccttgccctt

SEQ ID NO: 7769411 - DNA, 22 bp, Homo sapiens
agcagggggagttagactagat

SEQ ID NO: 7769412 - DNA, 22 bp, Homo sapiens
agcaggggctcctccacagcca

SEQ ID NO: 7769413 - DNA, 22 bp, Homo sapiens
agcagggggcatccttgccctt

SEQ ID NO: 7769414 - DNA, 22 bp, Homo sapiens
agcagggctggggcacgagcca

SEQ ID NO: 7769415 - DNA, 22 bp, Homo sapiens
agcagggctttgtctctgtgaa

SEQ ID NO: 7769416 - DNA, 23 bp, Homo sapiens
agcaggctgcttctccacagctg

SEQ ID NO: 7769417 - DNA, 23 bp, Homo sapiens
agcaggctgcttctccacagctg

SEQ ID NO: 7769418 - DNA, 22 bp, Homo sapiens
agcaggctgctggcgttgaagt

SEQ ID NO: 7769419 - DNA, 22 bp, Homo sapiens
agcaggctgccttccaaagcct

SEQ ID NO: 7769420 - DNA, 20 bp, Homo sapiens
agcaggctgcagggtgaaat

SEQ ID NO: 7769421 - DNA, 22 bp, Homo sapiens
agcaggggctcctccacagcca

SEQ ID NO: 7769422 - DNA, 22 bp, Homo sapiens
caaatagtttttcatgtattat

SEQ ID NO: 7769423 - DNA, 22 bp, Homo sapiens
caaatagtttttcatgtattat

SEQ ID NO: 7769424 - DNA, 22 bp, Homo sapiens
caaatagtgtcacattgtgagg

SEQ ID NO: 7769425 - DNA, 22 bp, Homo sapiens
caaatagtgtcacattgtgagg

SEQ ID NO: 7769426 - DNA, 22 bp, Homo sapiens
caacagaaggaagcagggtcag

SEQ ID NO: 7769427 - DNA, 22 bp, Homo sapiens
caacagagagaccagaaacagg

SEQ ID NO: 7769428 - DNA, 20 bp, Homo sapiens
caacagaggggtctggagta

SEQ ID NO: 7769429 - DNA, 22 bp, Homo sapiens
agcaccagagctatgggcctgc

SEQ ID NO: 7769430 - DNA, 22 bp, Homo sapiens
agcacattttctcaaagctcat

SEQ ID NO: 7769431 - DNA, 22 bp, Homo sapiens
caagacaatgggtaagtgtaac

SEQ ID NO: 7769432 - DNA, 22 bp, Homo sapiens
caaatagacttcaatctcttga

SEQ ID NO: 7769433 - DNA, 22 bp, Homo sapiens
caaatagacttcaatctcttga

SEQ ID NO: 7769434 - DNA, 22 bp, Homo sapiens
caaatagattgttcaatcctga

SEQ ID NO: 7769435 - DNA, 22 bp, Homo sapiens
agcacagtaattgatattactg

SEQ ID NO: 7769436 - DNA, 22 bp, Homo sapiens
agcacagtgcctgacatatatg

SEQ ID NO: 7769437 - DNA, 22 bp, Homo sapiens
agcacagtaaagcagtgtcaca

SEQ ID NO: 7769438 - DNA, 19 bp, Homo sapiens
agcacagtttccacatgca

SEQ ID NO: 7769439 - DNA, 22 bp, Homo sapiens
agcaaagaagggttcttcatta

SEQ ID NO: 7769440 - DNA, 22 bp, Homo sapiens
caaaataccacgacttgtttta

SEQ ID NO: 7769441 - DNA, 22 bp, Homo sapiens
caaaagtcttcctattctctta

SEQ ID NO: 7769442 - DNA, 22 bp, Homo sapiens
agcacaggtgaaacagtcaggt

SEQ ID NO: 7769443 - DNA, 22 bp, Homo sapiens
agcaaagatgtccggggcaagc

SEQ ID NO: 7769444 - DNA, 22 bp, Homo sapiens
agcagccacccagctgctcatt

SEQ ID NO: 7769445 - DNA, 20 bp, Homo sapiens
cacaagaggagttccctgag

SEQ ID NO: 7769446 - DNA, 22 bp, Homo sapiens
agcagccaaccttacattcatc

SEQ ID NO: 7769447 - DNA, 22 bp, Homo sapiens
cacaaggctttcatctggcata

SEQ ID NO: 7769448 - DNA, 20 bp, Homo sapiens
cacaagagaatacacactgg

SEQ ID NO: 7769449 - DNA, 22 bp, Homo sapiens
cacaagagagtgcgcgttgcaa

SEQ ID NO: 7769450 - DNA, 22 bp, Homo sapiens
agcagcagattatggtctacat

SEQ ID NO: 7769451 - DNA, 22 bp, Homo sapiens
agcagcaggctagggaactgct

SEQ ID NO: 7769452 - DNA, 22 bp, Homo sapiens
agcagcaggctagggaactgct

SEQ ID NO: 7769453 - DNA, 22 bp, Homo sapiens
caagcaacgactttcaagctgt

SEQ ID NO: 7769454 - DNA, 22 bp, Homo sapiens
caagcaacgactttcaagctgt

SEQ ID NO: 7769455 - DNA, 22 bp, Homo sapiens
caagagcacgtgccctccataa

SEQ ID NO: 7769456 - DNA, 22 bp, Homo sapiens
caagagcatccctgcatccagc

SEQ ID NO: 7769457 - DNA, 22 bp, Homo sapiens
caagagcaggtgctgcttccat

SEQ ID NO: 7769458 - DNA, 17 bp, Homo sapiens
caagagagatgactgga

SEQ ID NO: 7769459 - DNA, 17 bp, Homo sapiens
caagagagatgactgga

SEQ ID NO: 7769460 - DNA, 22 bp, Homo sapiens
caagagcatttagttagctggt

SEQ ID NO: 7769461 - DNA, 22 bp, Homo sapiens
aacaaagtttcaggaagataga

SEQ ID NO: 7769462 - DNA, 22 bp, Homo sapiens
aacaaagtttcaggaagataga

SEQ ID NO: 7769463 - DNA, 22 bp, Homo sapiens
aacaaatcttaaagtaattcaa

SEQ ID NO: 7769464 - DNA, 22 bp, Homo sapiens
aacacatagacgtttgatatca

SEQ ID NO: 7769465 - DNA, 22 bp, Homo sapiens
aacacataggcagagcatgaca

SEQ ID NO: 7769466 - DNA, 19 bp, Homo sapiens
aacaccagagtcaggagtc

SEQ ID NO: 7769467 - DNA, 22 bp, Homo sapiens
aagtccagctctaaatatctga

SEQ ID NO: 7769468 - DNA, 22 bp, Homo sapiens
aacaggaatgaggagaaaaggt

SEQ ID NO: 7769469 - DNA, 22 bp, Homo sapiens
aagtcattcctgcttgttgccc

SEQ ID NO: 7769470 - DNA, 22 bp, Homo sapiens
aacagcatgctgggtaacattg

SEQ ID NO: 7769471 - DNA, 22 bp, Homo sapiens
aagtcattatctcttctaatct

SEQ ID NO: 7769472 - DNA, 22 bp, Homo sapiens
aacagcagggatggggtggcca

SEQ ID NO: 7769473 - DNA, 22 bp, Homo sapiens
aaggtctgagttttgccaggcc

SEQ ID NO: 7769474 - DNA, 22 bp, Homo sapiens
aacagaggctccctgcacttgt

SEQ ID NO: 7769475 - DNA, 22 bp, Homo sapiens
aaattgcagatgctaaatgact

SEQ ID NO: 7769476 - DNA, 22 bp, Homo sapiens
aaattctatgtcaatgtttatt

SEQ ID NO: 7769477 - DNA, 22 bp, Homo sapiens
aaattctctaaagaaaacatga

SEQ ID NO: 7769478 - DNA, 22 bp, Homo sapiens
aaattctatgtcaatgtttatt

SEQ ID NO: 7769479 - DNA, 22 bp, Homo sapiens
aaattctttcatggctaataag

SEQ ID NO: 7769480 - DNA, 22 bp, Homo sapiens
aaattctggcctatcacagtga

SEQ ID NO: 7769481 - DNA, 20 bp, Homo sapiens
aacaaactacaaaattatgt

SEQ ID NO: 7769482 - DNA, 22 bp, Homo sapiens
aaattttagaccaggcaaaact

SEQ ID NO: 7769483 - DNA, 22 bp, Homo sapiens
aaattttagactcctgggtcta

SEQ ID NO: 7769484 - DNA, 22 bp, Homo sapiens
aacaaacaaacattttgtcatc

SEQ ID NO: 7769485 - DNA, 22 bp, Homo sapiens
aaattttagaccaggcaaaact

SEQ ID NO: 7769486 - DNA, 22 bp, Homo sapiens
aaatgtctatctggcatattcc

SEQ ID NO: 7769487 - DNA, 22 bp, Homo sapiens
aagctgaggcccatggcaaggt

SEQ ID NO: 7769488 - DNA, 22 bp, Homo sapiens
aagctgaggatacatgaagcct

SEQ ID NO: 7769489 - DNA, 19 bp, Homo sapiens
aagctgagggctgtccacc

SEQ ID NO: 7769490 - DNA, 22 bp, Homo sapiens
aaatgtgtcatattcaaagtca

SEQ ID NO: 7769491 - DNA, 21 bp, Homo sapiens
aaatgtgttccataatgcttt

SEQ ID NO: 7769492 - DNA, 22 bp, Homo sapiens
aaatgtgtgtatgtacatatat

SEQ ID NO: 7769493 - DNA, 22 bp, Homo sapiens
aaatgtgtatatgaaacatgat

SEQ ID NO: 7769494 - DNA, 22 bp, Homo sapiens
aaatgtgtcagtttcattctct

SEQ ID NO: 7769495 - DNA, 22 bp, Homo sapiens
aaatgttctactttgataatta

SEQ ID NO: 7769496 - DNA, 22 bp, Homo sapiens
aaatgtgttcctttgctacaga

SEQ ID NO: 7769497 - DNA, 22 bp, Homo sapiens
aaatgtgtttcgaaaactggtg

SEQ ID NO: 7769498 - DNA, 22 bp, Homo sapiens
aaatgtgtttgataggaatatt

SEQ ID NO: 7769499 - DNA, 22 bp, Homo sapiens
aaatgtttctacttgtgagcat

SEQ ID NO: 7769500 - DNA, 22 bp, Homo sapiens
aaattcactctgttcctcatgg

SEQ ID NO: 7769501 - DNA, 22 bp, Homo sapiens
aaattctaaggtcacaatgttg

SEQ ID NO: 7769502 - DNA, 22 bp, Homo sapiens
aaattctaaggtcacaatgttg

SEQ ID NO: 7769503 - DNA, 22 bp, Homo sapiens
aaattcacttgcctgcttagct

SEQ ID NO: 7769504 - DNA, 22 bp, Homo sapiens
aaattcacttgcctgcttagct

SEQ ID NO: 7769505 - DNA, 22 bp, Homo sapiens
aaccaccattctctcctcttcc

SEQ ID NO: 7769506 - DNA, 22 bp, Homo sapiens
aaccacagagccccctcagatg

SEQ ID NO: 7769507 - DNA, 22 bp, Homo sapiens
aaccaacataggaatgcagaga

SEQ ID NO: 7769508 - DNA, 22 bp, Homo sapiens
aaccaacataggaatgcagaga

SEQ ID NO: 7769509 - DNA, 22 bp, Homo sapiens
aatagttgtagtatctatctcg

SEQ ID NO: 7769510 - DNA, 22 bp, Homo sapiens
aatagttgtgaatcaggactag

SEQ ID NO: 7769511 - DNA, 22 bp, Homo sapiens
aatagttgtgaatcaggactag

SEQ ID NO: 7769512 - DNA, 21 bp, Homo sapiens
aaccagagccaggctctcagc

SEQ ID NO: 7769513 - DNA, 22 bp, Homo sapiens
aataagaactccatttactcgt

SEQ ID NO: 7769514 - DNA, 21 bp, Homo sapiens
aacatttcaggatccaaattg

SEQ ID NO: 7769515 - DNA, 22 bp, Homo sapiens
aataagaacaactaaggtttat

SEQ ID NO: 7769516 - DNA, 22 bp, Homo sapiens
aataagaactccatttactcgt

SEQ ID NO: 7769517 - DNA, 22 bp, Homo sapiens
aataagaactccatttactcgt

SEQ ID NO: 7769518 - DNA, 22 bp, Homo sapiens
aataagaaagagtcagcttcag

SEQ ID NO: 7769519 - DNA, 22 bp, Homo sapiens
aataagaacaactaaggtttat

SEQ ID NO: 7769520 - DNA, 22 bp, Homo sapiens
aataacttcatcttcaggatag

SEQ ID NO: 7769521 - DNA, 22 bp, Homo sapiens
aataacttgtatggttattcca

SEQ ID NO: 7769522 - DNA, 22 bp, Homo sapiens
aataacttttaaaagaccctgg

SEQ ID NO: 7769523 - DNA, 22 bp, Homo sapiens
aataacttgaagatctcttcca

SEQ ID NO: 7769524 - DNA, 22 bp, Homo sapiens
aataacttcatgtaacatttaa

SEQ ID NO: 7769525 - DNA, 18 bp, Homo sapiens
aacatgcattagaactgc

SEQ ID NO: 7769526 - DNA, 22 bp, Homo sapiens
aacatgcatgttatttatcagt

SEQ ID NO: 7769527 - DNA, 22 bp, Homo sapiens
aacagtaaaaatcatttagttg

SEQ ID NO: 7769528 - DNA, 22 bp, Homo sapiens
aacagtaaaaatcatttagttg

SEQ ID NO: 7769529 - DNA, 22 bp, Homo sapiens
aacagtaaagacagaatttatc

SEQ ID NO: 7769530 - DNA, 22 bp, Homo sapiens
aacagtaaagacagaatttatc

SEQ ID NO: 7769531 - DNA, 22 bp, Homo sapiens
aacatgcatgaagaagttatat

SEQ ID NO: 7769532 - DNA, 20 bp, Homo sapiens
aacagggcagaagcggagac

SEQ ID NO: 7769533 - DNA, 22 bp, Homo sapiens
aacaggcaaactgtgggatccc

SEQ ID NO: 7769534 - DNA, 22 bp, Homo sapiens
aacaggcactaagcatgtgggg

SEQ ID NO: 7769535 - DNA, 22 bp, Homo sapiens
aacaggcaatttaggactcttt

SEQ ID NO: 7769536 - DNA, 22 bp, Homo sapiens
aacttaaacccactcatgtaga

SEQ ID NO: 7769537 - DNA, 22 bp, Homo sapiens
aacttaaacccactcatgtaga

SEQ ID NO: 7769538 - DNA, 22 bp, Homo sapiens
aacttaggaaaataaggcatga

SEQ ID NO: 7769539 - DNA, 22 bp, Homo sapiens
aacttacaatgttagagtctca

SEQ ID NO: 7769540 - DNA, 22 bp, Homo sapiens
aatgatatttattgaatagatg

SEQ ID NO: 7769541 - DNA, 22 bp, Homo sapiens
aatgatatttattgaatagatg

SEQ ID NO: 7769542 - DNA, 22 bp, Homo sapiens
aatgataccgccaatattacca

SEQ ID NO: 7769543 - DNA, 22 bp, Homo sapiens
aatgatacatatgtatcgttag

SEQ ID NO: 7769544 - DNA, 22 bp, Homo sapiens
aactgcttagtgatggatgacc

SEQ ID NO: 7769545 - DNA, 22 bp, Homo sapiens
aactgcttagtgatggatgacc

SEQ ID NO: 7769546 - DNA, 22 bp, Homo sapiens
aatcataattttgtgaatgtag

SEQ ID NO: 7769547 - DNA, 22 bp, Homo sapiens
aactacattttacagaagatga

SEQ ID NO: 7769548 - DNA, 22 bp, Homo sapiens
aactacattttacagaagatga

SEQ ID NO: 7769549 - DNA, 22 bp, Homo sapiens
aatataatgctgttttatgcca

SEQ ID NO: 7769550 - DNA, 22 bp, Homo sapiens
aatataatgctgttttatgcca

SEQ ID NO: 7769551 - DNA, 22 bp, Homo sapiens
aacgcccgtggttgccaaggta

SEQ ID NO: 7769552 - DNA, 22 bp, Homo sapiens
aactacagaaaaggtaagctct

SEQ ID NO: 7769553 - DNA, 22 bp, Homo sapiens
aacgtcattgattgatggtagt

SEQ ID NO: 7769554 - DNA, 22 bp, Homo sapiens
aatcattgagacaaattagctt

SEQ ID NO: 7769555 - DNA, 22 bp, Homo sapiens
aactgcaatcacttttgcacca

SEQ ID NO: 7769556 - DNA, 22 bp, Homo sapiens
aactgcaattacttttgcacca

SEQ ID NO: 7769557 - DNA, 22 bp, Homo sapiens
aactgcaattacttttgcgcca

SEQ ID NO: 7769558 - DNA, 22 bp, Homo sapiens
aactgcaattacttttgcacta

SEQ ID NO: 7769559 - DNA, 22 bp, Homo sapiens
aactgcattcagaaagctcact

SEQ ID NO: 7769560 - DNA, 22 bp, Homo sapiens
aactgcaagagtaaatgtctag

SEQ ID NO: 7769561 - DNA, 22 bp, Homo sapiens
aactgcaacttgtttgattctt

SEQ ID NO: 7769562 - DNA, 22 bp, Homo sapiens
aactgcaacttcgtaaagtgag

SEQ ID NO: 7769563 - DNA, 23 bp, Homo sapiens
aactgcaaggttgctgggaagta

SEQ ID NO: 7769564 - DNA, 22 bp, Homo sapiens
aactgcaagctctttactgcta

SEQ ID NO: 7769565 - DNA, 22 bp, Homo sapiens
aactgcaataacttgtgcacca

SEQ ID NO: 7769566 - DNA, 22 bp, Homo sapiens
aactgcaagtggggcttgtcat

SEQ ID NO: 7769567 - DNA, 22 bp, Homo sapiens
aactgaaacgtatttttgagat

SEQ ID NO: 7769568 - DNA, 22 bp, Homo sapiens
aatccacacatctggcatgtga

SEQ ID NO: 7769569 - DNA, 22 bp, Homo sapiens
acaaagagaccatgagccaaac

SEQ ID NO: 7769570 - DNA, 22 bp, Homo sapiens
acaaagataagtcagaaagtca

SEQ ID NO: 7769571 - DNA, 22 bp, Homo sapiens
acaaagatcttgctttcctact

SEQ ID NO: 7769572 - DNA, 22 bp, Homo sapiens
acaaagctagagaagagaattg

SEQ ID NO: 7769573 - DNA, 22 bp, Homo sapiens
aagagagaactcccttcgccag

SEQ ID NO: 7769574 - DNA, 22 bp, Homo sapiens
acaaagcacgagtgccatggac

SEQ ID NO: 7769575 - DNA, 17 bp, Homo sapiens
aagagaggctgagctgg

SEQ ID NO: 7769576 - DNA, 17 bp, Homo sapiens
aagagaggctgagctgg

SEQ ID NO: 7769577 - DNA, 22 bp, Homo sapiens
aagaggaactgggggctgagtc

SEQ ID NO: 7769578 - DNA, 22 bp, Homo sapiens
aagagcagtgttttactcagct

SEQ ID NO: 7769579 - DNA, 22 bp, Homo sapiens
acaaggctgaacagtgaagccg

SEQ ID NO: 7769580 - DNA, 22 bp, Homo sapiens
aagaatacgtatcaacaatggt

SEQ ID NO: 7769581 - DNA, 22 bp, Homo sapiens
aattgtctttatcacagttcaa

SEQ ID NO: 7769582 - DNA, 22 bp, Homo sapiens
aattgtaagtgctgagttaagg

SEQ ID NO: 7769583 - DNA, 22 bp, Homo sapiens
aattgtaactacattgagaaca

SEQ ID NO: 7769584 - DNA, 17 bp, Homo sapiens
aattgtcagcagtagct

SEQ ID NO: 7769585 - DNA, 22 bp, Homo sapiens
aagaaatgcagaaatgtgctgg

SEQ ID NO: 7769586 - DNA, 22 bp, Homo sapiens
aagaagcactttcctacatgtt

SEQ ID NO: 7769587 - DNA, 22 bp, Homo sapiens
aatgttttgcattagttttcta

SEQ ID NO: 7769588 - DNA, 22 bp, Homo sapiens
aagaaatacatggtttttgagt

SEQ ID NO: 7769589 - DNA, 22 bp, Homo sapiens
aagaaataagacttctctgtcc

SEQ ID NO: 7769590 - DNA, 22 bp, Homo sapiens
aagaaatattgggccttataaa

SEQ ID NO: 7769591 - DNA, 22 bp, Homo sapiens
aacttcatgggttcaaagctgg

SEQ ID NO: 7769592 - DNA, 22 bp, Homo sapiens
aacttattccataggctcactg

SEQ ID NO: 7769593 - DNA, 22 bp, Homo sapiens
aacttagtttagggtattgatt

SEQ ID NO: 7769594 - DNA, 22 bp, Homo sapiens
aacttattgaacattctcgaat

SEQ ID NO: 7769595 - DNA, 22 bp, Homo sapiens
aagaggcgccgggtacgtggcg

SEQ ID NO: 7769596 - DNA, 22 bp, Homo sapiens
aagattctttgaggattttact

SEQ ID NO: 7769597 - DNA, 22 bp, Homo sapiens
aagatttaccactttattcaag

SEQ ID NO: 7769598 - DNA, 22 bp, Homo sapiens
aagattctgtatttctaacaat

SEQ ID NO: 7769599 - DNA, 20 bp, Homo sapiens
aagattctgatttgtagcgt

SEQ ID NO: 7769600 - DNA, 22 bp, Homo sapiens
acacaggggaaagtggagctga

SEQ ID NO: 7769601 - DNA, 22 bp, Homo sapiens
acacagggtctagagttaggcc

SEQ ID NO: 7769602 - DNA, 22 bp, Homo sapiens
acacagggggcattctaggagt

SEQ ID NO: 7769603 - DNA, 22 bp, Homo sapiens
acacagtagtgtggaaaaacat

SEQ ID NO: 7769604 - DNA, 22 bp, Homo sapiens
acacagtaggccaccatgtcat

SEQ ID NO: 7769605 - DNA, 22 bp, Homo sapiens
aagcacaggagacgcacagcca

SEQ ID NO: 7769606 - DNA, 22 bp, Homo sapiens
acactggtgtagttttctgcag

SEQ ID NO: 7769607 - DNA, 18 bp, Homo sapiens
aagcacaggtgtttcagg

SEQ ID NO: 7769608 - DNA, 22 bp, Homo sapiens
aagcacagggactcaggaccgg

SEQ ID NO: 7769609 - DNA, 22 bp, Homo sapiens
aagcacaggggaaataagttgt

SEQ ID NO: 7769610 - DNA, 22 bp, Homo sapiens
aagcacagtgccaagttctatt

SEQ ID NO: 7769611 - DNA, 22 bp, Homo sapiens
aagcacagtaaaagcagatttt

SEQ ID NO: 7769612 - DNA, 17 bp, Homo sapiens
aagatttcattagctga

SEQ ID NO: 7769613 - DNA, 22 bp, Homo sapiens
aagatttactttctttgtaata

SEQ ID NO: 7769614 - DNA, 22 bp, Homo sapiens
aagatttactagcataatagct

SEQ ID NO: 7769615 - DNA, 22 bp, Homo sapiens
acactgctcacttcttcccttg

SEQ ID NO: 7769616 - DNA, 22 bp, Homo sapiens
aagcagcattcagtgaaatgtg

SEQ ID NO: 7769617 - DNA, 18 bp, Homo sapiens
acagacaaaatggaaatg

SEQ ID NO: 7769618 - DNA, 22 bp, Homo sapiens
acagaatttacacatctctaaa

SEQ ID NO: 7769619 - DNA, 22 bp, Homo sapiens
acagaattgaagctgagtaaat

SEQ ID NO: 7769620 - DNA, 22 bp, Homo sapiens
acagaattatcaggaaatgtta

SEQ ID NO: 7769621 - DNA, 22 bp, Homo sapiens
acagcagctaacccctgggcca

SEQ ID NO: 7769622 - DNA, 22 bp, Homo sapiens
aagccaggagcgaggcctcggc

SEQ ID NO: 7769623 - DNA, 22 bp, Homo sapiens
aagccaggataaagttgtttta

SEQ ID NO: 7769624 - DNA, 22 bp, Homo sapiens
aagccaggcatgcttggacagt

SEQ ID NO: 7769625 - DNA, 22 bp, Homo sapiens
aagccaggaagggagctgtccc

SEQ ID NO: 7769626 - DNA, 22 bp, Homo sapiens
aagccaggaatggagtcttcgc

SEQ ID NO: 7769627 - DNA, 22 bp, Homo sapiens
aagccaggaccaaactcatcct

SEQ ID NO: 7769628 - DNA, 22 bp, Homo sapiens
aagccaggaccaaactcatcct

SEQ ID NO: 7769629 - DNA, 22 bp, Homo sapiens
aagccaggaagagagccttcac

SEQ ID NO: 7769630 - DNA, 22 bp, Homo sapiens
aagccaagtgctggccatgggc

SEQ ID NO: 7769631 - DNA, 22 bp, Homo sapiens
acagcagctaacccctgggcca

SEQ ID NO: 7769632 - DNA, 22 bp, Homo sapiens
aaattacagatcaccaatgcat

SEQ ID NO: 7769633 - DNA, 22 bp, Homo sapiens
aaattacagatcaccaatgcat

SEQ ID NO: 7769634 - DNA, 22 bp, Homo sapiens
aaattagaaatactttcaaagc

SEQ ID NO: 7769635 - DNA, 22 bp, Homo sapiens
aaagaggggactgttaattcca

SEQ ID NO: 7769636 - DNA, 22 bp, Homo sapiens
aaatgcagaatgatttcatcta

SEQ ID NO: 7769637 - DNA, 22 bp, Homo sapiens
aaatgcagacagcttcacacac

SEQ ID NO: 7769638 - DNA, 22 bp, Homo sapiens
aaatgcagatccctgaatctca

SEQ ID NO: 7769639 - DNA, 22 bp, Homo sapiens
aaagaggcaggtgttactggaa

SEQ ID NO: 7769640 - DNA, 22 bp, Homo sapiens
aaagagcaccctcaatgtctga

SEQ ID NO: 7769641 - DNA, 22 bp, Homo sapiens
aaatgcagcagctaattgaaaa

SEQ ID NO: 7769642 - DNA, 22 bp, Homo sapiens
aaatgcagcagctaattgaaaa

SEQ ID NO: 7769643 - DNA, 21 bp, Homo sapiens
aaagagcttttgtgctagtta

SEQ ID NO: 7769644 - DNA, 22 bp, Homo sapiens
aaagaatctatatatcaccacc

SEQ ID NO: 7769645 - DNA, 22 bp, Homo sapiens
aaagaatctatatatcaccacc

SEQ ID NO: 7769646 - DNA, 22 bp, Homo sapiens
aaagaatgtctgaacagctggc

SEQ ID NO: 7769647 - DNA, 22 bp, Homo sapiens
aaagaatttgtacaccctacta

SEQ ID NO: 7769648 - DNA, 22 bp, Homo sapiens
aaagaagtgttgaatttgcaag

SEQ ID NO: 7769649 - DNA, 22 bp, Homo sapiens
aaactgcaatgacaggtaggag

SEQ ID NO: 7769650 - DNA, 22 bp, Homo sapiens
aaagaactaatgtgcaaggttt

SEQ ID NO: 7769651 - DNA, 22 bp, Homo sapiens
aaagaacatcggagtgggcggg

SEQ ID NO: 7769652 - DNA, 22 bp, Homo sapiens
aaactcttcctttctttaaagt

SEQ ID NO: 7769653 - DNA, 17 bp, Homo sapiens
aaactgaaaaattcact

SEQ ID NO: 7769654 - DNA, 21 bp, Homo sapiens
aaactgaccttgcctgagaca

SEQ ID NO: 7769655 - DNA, 21 bp, Homo sapiens
aaactgaccttgcctgagaca

SEQ ID NO: 7769656 - DNA, 22 bp, Homo sapiens
aaactgaagtagattctgaaat

SEQ ID NO: 7769657 - DNA, 22 bp, Homo sapiens
aaacctgttaatagagcgatgc

SEQ ID NO: 7769658 - DNA, 19 bp, Homo sapiens
aaacctgttagtagagcac

SEQ ID NO: 7769659 - DNA, 22 bp, Homo sapiens
aaacctgaatgtatgtcagaag

SEQ ID NO: 7769660 - DNA, 22 bp, Homo sapiens
aaacctgaagtacgttacataa

SEQ ID NO: 7769661 - DNA, 22 bp, Homo sapiens
aaacctatatagtcttagaagc

SEQ ID NO: 7769662 - DNA, 22 bp, Homo sapiens
aaaccctgctcttatggaactt

SEQ ID NO: 7769663 - DNA, 22 bp, Homo sapiens
aaaccctgcccttcccaagatg

SEQ ID NO: 7769664 - DNA, 22 bp, Homo sapiens
aaacccatggctgatatcacta

SEQ ID NO: 7769665 - DNA, 22 bp, Homo sapiens
aaaggtcttctcaaacatccca

SEQ ID NO: 7769666 - DNA, 21 bp, Homo sapiens
aaagttcatgctttaatattc

SEQ ID NO: 7769667 - DNA, 21 bp, Homo sapiens
aaagttcatgctttaatattc

SEQ ID NO: 7769668 - DNA, 20 bp, Homo sapiens
aaagttcatgtttgcacttt

SEQ ID NO: 7769669 - DNA, 18 bp, Homo sapiens
aaagttcagggagagttg

SEQ ID NO: 7769670 - DNA, 22 bp, Homo sapiens
aaacagtgactggtacataata

SEQ ID NO: 7769671 - DNA, 22 bp, Homo sapiens
aaacagtgccaggcagatgcca

SEQ ID NO: 7769672 - DNA, 22 bp, Homo sapiens
aaacaatgttcctatattagag

SEQ ID NO: 7769673 - DNA, 22 bp, Homo sapiens
aaacaatgtacatttataatgc

SEQ ID NO: 7769674 - DNA, 22 bp, Homo sapiens
aaacaatgtacacatgaatgtt

SEQ ID NO: 7769675 - DNA, 22 bp, Homo sapiens
aaaggtaacagttataaccagg

SEQ ID NO: 7769676 - DNA, 22 bp, Homo sapiens
aaacagttgttatttttatatg

SEQ ID NO: 7769677 - DNA, 22 bp, Homo sapiens
aaacagtttataacatgatact

SEQ ID NO: 7769678 - DNA, 22 bp, Homo sapiens
aaacagttctcatttgtttaga

SEQ ID NO: 7769679 - DNA, 22 bp, Homo sapiens
aaacagtggccaattctggaga

SEQ ID NO: 7769680 - DNA, 18 bp, Homo sapiens
aaacagtgcctaagtgtc

SEQ ID NO: 7769681 - DNA, 22 bp, Homo sapiens
aaagaagggacagactgcctct

SEQ ID NO: 7769682 - DNA, 22 bp, Homo sapiens
aaaagtattggccaccatttct

SEQ ID NO: 7769683 - DNA, 22 bp, Homo sapiens
aaagacatggaactagagatgg

SEQ ID NO: 7769684 - DNA, 22 bp, Homo sapiens
aaaagtatggtggtccttttta

SEQ ID NO: 7769685 - DNA, 22 bp, Homo sapiens
aaaagtatagggtttggagtca

SEQ ID NO: 7769686 - DNA, 22 bp, Homo sapiens
aaaagtactattttaacaaagt

SEQ ID NO: 7769687 - DNA, 22 bp, Homo sapiens
aaaagtactattttaacaaagt

SEQ ID NO: 7769688 - DNA, 22 bp, Homo sapiens
aaactctaagacactgtacaat

SEQ ID NO: 7769689 - DNA, 19 bp, Homo sapiens
aaactcatagactcatatt

SEQ ID NO: 7769690 - DNA, 22 bp, Homo sapiens
aaactaggttctgatttccaag

SEQ ID NO: 7769691 - DNA, 22 bp, Homo sapiens
aaactagccacacagaatacac

SEQ ID NO: 7769692 - DNA, 22 bp, Homo sapiens
aaactcaagtctatgaacaagg

SEQ ID NO: 7769693 - DNA, 22 bp, Homo sapiens
aaactcaaggatttagacgaag

SEQ ID NO: 7769694 - DNA, 22 bp, Homo sapiens
aaactcaaattaaactagctta

SEQ ID NO: 7769695 - DNA, 22 bp, Homo sapiens
aaacccagagactagaaagacc

SEQ ID NO: 7769696 - DNA, 22 bp, Homo sapiens
aaacaagagtcttgctccacct

SEQ ID NO: 7769697 - DNA, 20 bp, Homo sapiens
aaacaaggttgctctgagga

SEQ ID NO: 7769698 - DNA, 22 bp, Homo sapiens
aaacaaggtccttctgtgacat

SEQ ID NO: 7769699 - DNA, 22 bp, Homo sapiens
aaaatctaagtagcgagtaagg

SEQ ID NO: 7769700 - DNA, 20 bp, Homo sapiens
aaaatctcccagaaacttat

SEQ ID NO: 7769701 - DNA, 22 bp, Homo sapiens
aaaatctcattatcaggaaggg

SEQ ID NO: 7769702 - DNA, 22 bp, Homo sapiens
aaaattttgccctatccttcat

SEQ ID NO: 7769703 - DNA, 22 bp, Homo sapiens
aaacaagtgtaaactagtctgt

SEQ ID NO: 7769704 - DNA, 22 bp, Homo sapiens
aaacaagtgtaaactagtctgt

SEQ ID NO: 7769705 - DNA, 22 bp, Homo sapiens
aaacaagtcactttatcttgaa

SEQ ID NO: 7769706 - DNA, 23 bp, Homo sapiens
aaacaagtctctcaatggcttgc

SEQ ID NO: 7769707 - DNA, 22 bp, Homo sapiens
aaacaatgaaattcattcttca

SEQ ID NO: 7769708 - DNA, 22 bp, Homo sapiens
aaagacattgaagaaggactta

SEQ ID NO: 7769709 - DNA, 22 bp, Homo sapiens
aaagacctgaaatataatctag

SEQ ID NO: 7769710 - DNA, 22 bp, Homo sapiens
aaagacctgtggtagctctaaa

SEQ ID NO: 7769711 - DNA, 22 bp, Homo sapiens
aaagacattagattaacgtaca

SEQ ID NO: 7769712 - DNA, 22 bp, Homo sapiens
aaagacattagcttagatgtca

SEQ ID NO: 7769713 - DNA, 22 bp, Homo sapiens
aaaatcctctaattctagaata

SEQ ID NO: 7769714 - DNA, 22 bp, Homo sapiens
aaaaaatcagatctttggttaa

SEQ ID NO: 7769715 - DNA, 22 bp, Homo sapiens
aaaaaattatcatagttcctga

SEQ ID NO: 7769716 - DNA, 22 bp, Homo sapiens
aaaaaattatcatagttcctga

SEQ ID NO: 7769717 - DNA, 22 bp, Homo sapiens
aaaaaattatcatagttcctga

SEQ ID NO: 7769718 - DNA, 20 bp, Homo sapiens
aaaaacagtaatgctgaaga

SEQ ID NO: 7769719 - DNA, 20 bp, Homo sapiens
aaaaacagtaatgctgaaga

SEQ ID NO: 7769720 - DNA, 22 bp, Homo sapiens
aaaaacacaactgtctttctct

SEQ ID NO: 7769721 - DNA, 22 bp, Homo sapiens
aaaaacacaactgtctttctct

SEQ ID NO: 7769722 - DNA, 22 bp, Homo sapiens
aaaaacacaactgtctttctct

SEQ ID NO: 7769723 - DNA, 22 bp, Homo sapiens
aaaaaattccattctgtgcctt

SEQ ID NO: 7769724 - DNA, 22 bp, Homo sapiens
aaaaaattccattctgtgcctt

SEQ ID NO: 7769725 - DNA, 22 bp, Homo sapiens
aaaaaattccattctgtgcctt

SEQ ID NO: 7769726 - DNA, 22 bp, Homo sapiens
aaaatcttgactgtttttagaa

SEQ ID NO: 7769727 - DNA, 23 bp, Homo sapiens
aaaatcttctgcctatgaagaaa

SEQ ID NO: 7769728 - DNA, 23 bp, Homo sapiens
aaaatcttctgcctatgaagaaa

SEQ ID NO: 7769729 - DNA, 22 bp, Homo sapiens
aaaaacctcaattacttttgca

SEQ ID NO: 7769730 - DNA, 22 bp, Homo sapiens
aaaaacctttcattgcaaatgt

SEQ ID NO: 7769731 - DNA, 22 bp, Homo sapiens
aaaaacctttcccatactaaga

SEQ ID NO: 7769732 - DNA, 22 bp, Homo sapiens
aaaaacctttcccatactaaga

SEQ ID NO: 7769733 - DNA, 22 bp, Homo sapiens
aaaatagttaacgttcagagta

SEQ ID NO: 7769734 - DNA, 22 bp, Homo sapiens
aaaaatctatgactgcttctcc

SEQ ID NO: 7769735 - DNA, 22 bp, Homo sapiens
aaaaatcacttttataggcagc

SEQ ID NO: 7769736 - DNA, 22 bp, Homo sapiens
aaaaatcacttttataggcagc

SEQ ID NO: 7769737 - DNA, 22 bp, Homo sapiens
aaaaatcacttttataggcagc

SEQ ID NO: 7769738 - DNA, 22 bp, Homo sapiens
aaaaatagaaggattgactgag

SEQ ID NO: 7769739 - DNA, 22 bp, Homo sapiens
aaaatgaataagttaacccagg

SEQ ID NO: 7769740 - DNA, 22 bp, Homo sapiens
aaaaatagaaggattgactgag

SEQ ID NO: 7769741 - DNA, 22 bp, Homo sapiens
aaaaatagcttctcttgtccct

SEQ ID NO: 7769742 - DNA, 22 bp, Homo sapiens
aaacagaagggtaggtaaacat

SEQ ID NO: 7769743 - DNA, 22 bp, Homo sapiens
aaaagacaggtgtctgcggccc

SEQ ID NO: 7769744 - DNA, 22 bp, Homo sapiens
aaaagacatctatttcaggcag

SEQ ID NO: 7769745 - DNA, 22 bp, Homo sapiens
aaacagaaatttcctcatgctc

SEQ ID NO: 7769746 - DNA, 22 bp, Homo sapiens
aaacagaaatttcctcatgctc

SEQ ID NO: 7769747 - DNA, 22 bp, Homo sapiens
aaacacttcctgtaacatgaca

SEQ ID NO: 7769748 - DNA, 22 bp, Homo sapiens
aaacacttcttaggtcttaagt

SEQ ID NO: 7769749 - DNA, 22 bp, Homo sapiens
aaacacttcttaggtcttaagt

SEQ ID NO: 7769750 - DNA, 22 bp, Homo sapiens
aaacacttcaaggacttctgtc

SEQ ID NO: 7769751 - DNA, 22 bp, Homo sapiens
aaacacttcaaggacttctgtc

SEQ ID NO: 7769752 - DNA, 22 bp, Homo sapiens
aaagccaggggagggattccca

SEQ ID NO: 7769753 - DNA, 22 bp, Homo sapiens
aaagccagtggtatgagagaaa

SEQ ID NO: 7769754 - DNA, 22 bp, Homo sapiens
aaagccagttcttagagaaagc

SEQ ID NO: 7769755 - DNA, 22 bp, Homo sapiens
aaagccagggtccaggcctgcc

SEQ ID NO: 7769756 - DNA, 22 bp, Homo sapiens
aaagccagggtccaggcctgcc

SEQ ID NO: 7769757 - DNA, 22 bp, Homo sapiens
aaagccaggttgtgtgcaggaa

SEQ ID NO: 7769758 - DNA, 22 bp, Homo sapiens
aaagccagtttctggaagtacc

SEQ ID NO: 7769759 - DNA, 22 bp, Homo sapiens
aaagccagttcttttatattgg

SEQ ID NO: 7769760 - DNA, 22 bp, Homo sapiens
aaagccagtttgtctctttaaa

SEQ ID NO: 7769761 - DNA, 22 bp, Homo sapiens
aacaaaacatttgtcttgtttc

SEQ ID NO: 7769762 - DNA, 22 bp, Homo sapiens
aaattttgtattctagttctag

SEQ ID NO: 7769763 - DNA, 22 bp, Homo sapiens
aaattttcagagcactagagaa

SEQ ID NO: 7769764 - DNA, 22 bp, Homo sapiens
aaattttcctggtaaagatgga

SEQ ID NO: 7769765 - DNA, 22 bp, Homo sapiens
aaattttagtaaggaagttgag

SEQ ID NO: 7769766 - DNA, 22 bp, Homo sapiens
aaattttagactcctgggtcta

SEQ ID NO: 7769767 - DNA, 22 bp, Homo sapiens
aaattttagtaaggaagttgag

SEQ ID NO: 7769768 - DNA, 22 bp, Homo sapiens
aaagctgcccttgtgaaacaag

SEQ ID NO: 7769769 - DNA, 22 bp, Homo sapiens
aaagctgctgccaatcaggctt

SEQ ID NO: 7769770 - DNA, 22 bp, Homo sapiens
aaagctggcctctcaggcttta

SEQ ID NO: 7769771 - DNA, 22 bp, Homo sapiens
aaagctttctagctatgttcta

SEQ ID NO: 7769772 - DNA, 22 bp, Homo sapiens
aaagctgggggccctggtctag

SEQ ID NO: 7769773 - DNA, 22 bp, Homo sapiens
aacagcagcatgacagctgggt

SEQ ID NO: 7769774 - DNA, 22 bp, Homo sapiens
aaagccttttctgtttaacaca

SEQ ID NO: 7769775 - DNA, 22 bp, Homo sapiens
aacagataatttctaagttact

SEQ ID NO: 7769776 - DNA, 22 bp, Homo sapiens
aacagatataggcagaactttg

SEQ ID NO: 7769777 - DNA, 22 bp, Homo sapiens
aacagattgtaacctgatagcc

SEQ ID NO: 7769778 - DNA, 22 bp, Homo sapiens
aacagcaagggcggggtcaaga

SEQ ID NO: 7769779 - DNA, 22 bp, Homo sapiens
aaagtattcaaaaatatttggt

SEQ ID NO: 7769780 - DNA, 22 bp, Homo sapiens
aaagtatttgtgatttttacca

SEQ ID NO: 7769781 - DNA, 22 bp, Homo sapiens
aaagtcaaaatgctctcctgtc

SEQ ID NO: 7769782 - DNA, 22 bp, Homo sapiens
aaagtcaaggtttagactagag

SEQ ID NO: 7769783 - DNA, 22 bp, Homo sapiens
aaagtagcttagttgatatttc

SEQ ID NO: 7769784 - DNA, 22 bp, Homo sapiens
aaagtagcccttctggaattta

SEQ ID NO: 7769785 - DNA, 22 bp, Homo sapiens
aaagtatatttacttactgtga

SEQ ID NO: 7769786 - DNA, 22 bp, Homo sapiens
aaagtatcaagggaagcatttt

SEQ ID NO: 7769787 - DNA, 22 bp, Homo sapiens
aaagtatatttacttactgtga

SEQ ID NO: 7769788 - DNA, 22 bp, Homo sapiens
aaagtatatatgcactttagaa

SEQ ID NO: 7769789 - DNA, 22 bp, Homo sapiens
aaagtgcagtaacttgcccaag

SEQ ID NO: 7769790 - DNA, 22 bp, Homo sapiens
aaagtgcagggtgctctggtat

SEQ ID NO: 7769791 - DNA, 22 bp, Homo sapiens
aaagtgcagcttgtgatcccta

SEQ ID NO: 7769792 - DNA, 22 bp, Homo sapiens
aaagtcacatagcatcacttct

SEQ ID NO: 7769793 - DNA, 22 bp, Homo sapiens
aaagtcaatgatttctcctgga

SEQ ID NO: 7769794 - DNA, 22 bp, Homo sapiens
aaagtgtaaaagcatgttaggg

SEQ ID NO: 7769795 - DNA, 22 bp, Homo sapiens
aaaggtttattgattctgctct

SEQ ID NO: 7769796 - DNA, 22 bp, Homo sapiens
aaaggtttatttaatcagggag

SEQ ID NO: 7769797 - DNA, 22 bp, Homo sapiens
aaaggaaaataagtagttccat

SEQ ID NO: 7769798 - DNA, 22 bp, Homo sapiens
aaagcttttcagtatgttcatg

SEQ ID NO: 7769799 - DNA, 22 bp, Homo sapiens
aaagctttgtaaataaacaggt

SEQ ID NO: 7769800 - DNA, 22 bp, Homo sapiens
aaaggaagattgagcttttcca

SEQ ID NO: 7769801 - DNA, 22 bp, Homo sapiens
aaagggcctccgcctgggcagg

SEQ ID NO: 7769802 - DNA, 22 bp, Homo sapiens
aactaaaactggtttgttctct

SEQ ID NO: 7769803 - DNA, 22 bp, Homo sapiens
aactaaaactggtttgttctct

SEQ ID NO: 7769804 - DNA, 22 bp, Homo sapiens
aactaaaagtgtgtctcttgta

SEQ ID NO: 7769805 - DNA, 22 bp, Homo sapiens
aactaaatctggcatttagagc

SEQ ID NO: 7769806 - DNA, 22 bp, Homo sapiens
aactaacagtcattaaaagaac

SEQ ID NO: 7769807 - DNA, 22 bp, Homo sapiens
aactaacagtcattaaaagaac

SEQ ID NO: 7769808 - DNA, 22 bp, Homo sapiens
aaatgcatgagaaagtattctg

SEQ ID NO: 7769809 - DNA, 22 bp, Homo sapiens
aaatgcagttggtggggatatg

SEQ ID NO: 7769810 - DNA, 22 bp, Homo sapiens
aaatgcagtggttctacttctc

SEQ ID NO: 7769811 - DNA, 20 bp, Homo sapiens
aaatgcagttctgccttggc

SEQ ID NO: 7769812 - DNA, 21 bp, Homo sapiens
aaatgcagtctctgagatctg

SEQ ID NO: 7769813 - DNA, 22 bp, Homo sapiens
aaatgcaggtagtatttatttt

SEQ ID NO: 7769814 - DNA, 20 bp, Homo sapiens
aaatgcagggctgctgcgga

SEQ ID NO: 7769815 - DNA, 23 bp, Homo sapiens
aaatgcagggtcgcaggttacag

SEQ ID NO: 7769816 - DNA, 22 bp, Homo sapiens
aagcacagatgcaagggggacc

SEQ ID NO: 7769817 - DNA, 22 bp, Homo sapiens
aagcacagagaggtaaagtaac

SEQ ID NO: 7769818 - DNA, 22 bp, Homo sapiens
aagcacagactccctctgagtg

SEQ ID NO: 7769819 - DNA, 22 bp, Homo sapiens
aagcacagagatgggcacgcct

SEQ ID NO: 7769820 - DNA, 22 bp, Homo sapiens
aagcacagaccagatctccagg

SEQ ID NO: 7769821 - DNA, 22 bp, Homo sapiens
aagcacagacacaaaaggcttt

SEQ ID NO: 7769822 - DNA, 23 bp, Homo sapiens
aagcacagaatggtttaggagtt

SEQ ID NO: 7769823 - DNA, 22 bp, Homo sapiens
aagctgaagccggatcaaaaag

SEQ ID NO: 7769824 - DNA, 22 bp, Homo sapiens
aagctgaatctgaaatagaatt

SEQ ID NO: 7769825 - DNA, 22 bp, Homo sapiens
aagctgaattttctaaaagaat

SEQ ID NO: 7769826 - DNA, 22 bp, Homo sapiens
aaatgtattgcataggatattt

SEQ ID NO: 7769827 - DNA, 22 bp, Homo sapiens
aaatgtattgcataggatattt

SEQ ID NO: 7769828 - DNA, 20 bp, Homo sapiens
aaatgtataggacccttcta

SEQ ID NO: 7769829 - DNA, 22 bp, Homo sapiens
aaatgtactgatacttatttta

SEQ ID NO: 7769830 - DNA, 18 bp, Homo sapiens
aaatgtactgtccatggc

SEQ ID NO: 7769831 - DNA, 22 bp, Homo sapiens
aagcatgggaggcctggaggag

SEQ ID NO: 7769832 - DNA, 18 bp, Homo sapiens
aaatggcagaatggatag

SEQ ID NO: 7769833 - DNA, 22 bp, Homo sapiens
aaatgtaagtctttgtttctta

SEQ ID NO: 7769834 - DNA, 22 bp, Homo sapiens
aaatgtaagtctttgtttctta

SEQ ID NO: 7769835 - DNA, 22 bp, Homo sapiens
aaataagttaaactagaatgat

SEQ ID NO: 7769836 - DNA, 22 bp, Homo sapiens
aaataattatagcgagtctatc

SEQ ID NO: 7769837 - DNA, 22 bp, Homo sapiens
aaataagtgtgggccagtcaaa

SEQ ID NO: 7769838 - DNA, 22 bp, Homo sapiens
aaataagttaaactagaatgat

SEQ ID NO: 7769839 - DNA, 22 bp, Homo sapiens
aaataagcacttaactgtatca

SEQ ID NO: 7769840 - DNA, 22 bp, Homo sapiens
aaataagaaattcttctttgca

SEQ ID NO: 7769841 - DNA, 22 bp, Homo sapiens
aaataagaaattcttctttgca

SEQ ID NO: 7769842 - DNA, 22 bp, Homo sapiens
aaataagaggacagatgtttgg

SEQ ID NO: 7769843 - DNA, 22 bp, Homo sapiens
aaataactttctgtgtatagtc

SEQ ID NO: 7769844 - DNA, 22 bp, Homo sapiens
aaataactttctgtgtatagtc

SEQ ID NO: 7769845 - DNA, 22 bp, Homo sapiens
aaataacttggtttcatcagag

SEQ ID NO: 7769846 - DNA, 22 bp, Homo sapiens
aaataacttggtttcatcagag

SEQ ID NO: 7769847 - DNA, 22 bp, Homo sapiens
aaataacagtcagggacaacat

SEQ ID NO: 7769848 - DNA, 22 bp, Homo sapiens
aaagtgtggcacaagtcacatc

SEQ ID NO: 7769849 - DNA, 22 bp, Homo sapiens
aaatagattgctgaggcattac

SEQ ID NO: 7769850 - DNA, 22 bp, Homo sapiens
aaatagattgctgaggcattac

SEQ ID NO: 7769851 - DNA, 22 bp, Homo sapiens
aaatagagctgggttaaacttt

SEQ ID NO: 7769852 - DNA, 22 bp, Homo sapiens
aaatagatttcctagcattgga

SEQ ID NO: 7769853 - DNA, 22 bp, Homo sapiens
aaatagatttcctagcattgga

SEQ ID NO: 7769854 - DNA, 22 bp, Homo sapiens
aaatagatttctctgggtttgt

SEQ ID NO: 7769855 - DNA, 22 bp, Homo sapiens
aaatagcagaagcagagggggt

SEQ ID NO: 7769856 - DNA, 22 bp, Homo sapiens
aaatagcacagcagctgaggct

SEQ ID NO: 7769857 - DNA, 23 bp, Homo sapiens
aaatagagataggccagctttgc

SEQ ID NO: 7769858 - DNA, 23 bp, Homo sapiens
aaatagagataggccagctttgc

SEQ ID NO: 7769859 - DNA, 22 bp, Homo sapiens
aaatagacaggcttaaatagga

SEQ ID NO: 7769860 - DNA, 22 bp, Homo sapiens
aaataattgagttggtcaatat

SEQ ID NO: 7769861 - DNA, 22 bp, Homo sapiens
aaataattgagttggtcaatat

SEQ ID NO: 7769862 - DNA, 22 bp, Homo sapiens
aaatagcataaaataggaagct

SEQ ID NO: 7769863 - DNA, 22 bp, Homo sapiens
aaatagcttttcataattctca

SEQ ID NO: 7769864 - DNA, 22 bp, Homo sapiens
aaatagctgaaagttcctagat

SEQ ID NO: 7769865 - DNA, 23 bp, Homo sapiens
aaataggagtatctggatcatga

SEQ ID NO: 7769866 - DNA, 22 bp, Homo sapiens
aaatcagatcttacacaattgt

SEQ ID NO: 7769867 - DNA, 22 bp, Homo sapiens
aaatcagagtggttggtcatcc

SEQ ID NO: 7769868 - DNA, 22 bp, Homo sapiens
aaatccatcaaatcttctagaa

SEQ ID NO: 7769869 - DNA, 22 bp, Homo sapiens
aaatccatggtaatctgttaca

SEQ ID NO: 7769870 - DNA, 22 bp, Homo sapiens
aaatccattctgttttaaaagt

SEQ ID NO: 7769871 - DNA, 22 bp, Homo sapiens
aatgaacggtgtccatctgttt

SEQ ID NO: 7769872 - DNA, 21 bp, Homo sapiens
agaaatacagcagggatgatc

SEQ ID NO: 7769873 - DNA, 22 bp, Homo sapiens
agaaatacaaagtactaagata

SEQ ID NO: 7769874 - DNA, 22 bp, Homo sapiens
agaaatacaaagtactaagata

SEQ ID NO: 7769875 - DNA, 22 bp, Homo sapiens
agaaatactaggaatattcata

SEQ ID NO: 7769876 - DNA, 22 bp, Homo sapiens
aatgaacacagccctctacttt

SEQ ID NO: 7769877 - DNA, 22 bp, Homo sapiens
agaaaactctacatctgtatgt

SEQ ID NO: 7769878 - DNA, 22 bp, Homo sapiens
agaaaacattacataggtgtgt

SEQ ID NO: 7769879 - DNA, 22 bp, Homo sapiens
agaaaacataggagacaggaaa

SEQ ID NO: 7769880 - DNA, 22 bp, Homo sapiens
agaaaacagaaagtcattggtg

SEQ ID NO: 7769881 - DNA, 22 bp, Homo sapiens
agaaaacataggagacaggaaa

SEQ ID NO: 7769882 - DNA, 22 bp, Homo sapiens
agaaaacagaaagtcattggtg

SEQ ID NO: 7769883 - DNA, 22 bp, Homo sapiens
agaaaacactgccccctctctc

SEQ ID NO: 7769884 - DNA, 22 bp, Homo sapiens
agaaaaatcttggcgcttgtct

SEQ ID NO: 7769885 - DNA, 22 bp, Homo sapiens
agaaaaatcttggcgcttgtct

SEQ ID NO: 7769886 - DNA, 22 bp, Homo sapiens
aatgagaaccttgaaaggaact

SEQ ID NO: 7769887 - DNA, 22 bp, Homo sapiens
aatgagaaaacacagaggaggt

SEQ ID NO: 7769888 - DNA, 22 bp, Homo sapiens
aatgagaagcctaggtgtactg

SEQ ID NO: 7769889 - DNA, 22 bp, Homo sapiens
aatgagaatgtaagtgaagaga

SEQ ID NO: 7769890 - DNA, 22 bp, Homo sapiens
aatgaatgtttgttgagtgaag

SEQ ID NO: 7769891 - DNA, 22 bp, Homo sapiens
aatgaatgggtttaatatttta

SEQ ID NO: 7769892 - DNA, 22 bp, Homo sapiens
agaaatactgcctaagactgta

SEQ ID NO: 7769893 - DNA, 22 bp, Homo sapiens
agaagggaactcagagatgatt

SEQ ID NO: 7769894 - DNA, 22 bp, Homo sapiens
agaagggagagaaagttggtta

SEQ ID NO: 7769895 - DNA, 22 bp, Homo sapiens
aatgagtcaaaacagcatatag

SEQ ID NO: 7769896 - DNA, 22 bp, Homo sapiens
aatgagatggaattcccgccta

SEQ ID NO: 7769897 - DNA, 20 bp, Homo sapiens
aatgagattccttatgatag

SEQ ID NO: 7769898 - DNA, 22 bp, Homo sapiens
aatcataattgtatacattcat

SEQ ID NO: 7769899 - DNA, 22 bp, Homo sapiens
aatccatagaataaaattgcag

SEQ ID NO: 7769900 - DNA, 22 bp, Homo sapiens
acttgtttcaactgtactctca

SEQ ID NO: 7769901 - DNA, 22 bp, Homo sapiens
acttgtttcaactgtactctcc

SEQ ID NO: 7769902 - DNA, 22 bp, Homo sapiens
acttgtttgaatctctctagag

SEQ ID NO: 7769903 - DNA, 22 bp, Homo sapiens
acttgttttatctgtcaataga

SEQ ID NO: 7769904 - DNA, 22 bp, Homo sapiens
aatcctgacctgggcatgcttg

SEQ ID NO: 7769905 - DNA, 22 bp, Homo sapiens
aatccatgttgatgtatatttt

SEQ ID NO: 7769906 - DNA, 22 bp, Homo sapiens
aatccatgaagtgaacaatctg

SEQ ID NO: 7769907 - DNA, 22 bp, Homo sapiens
aatccatgcatgcaaggaaagg

SEQ ID NO: 7769908 - DNA, 22 bp, Homo sapiens
aatcaaagaatgggctagttgg

SEQ ID NO: 7769909 - DNA, 22 bp, Homo sapiens
aatcaaaacctacagaggtaat

SEQ ID NO: 7769910 - DNA, 22 bp, Homo sapiens
aatcaaaacctacagaggtaat

SEQ ID NO: 7769911 - DNA, 22 bp, Homo sapiens
aatcaacattgttttaagtcaa

SEQ ID NO: 7769912 - DNA, 22 bp, Homo sapiens
aatcaactgtttccacagggag

SEQ ID NO: 7769913 - DNA, 22 bp, Homo sapiens
aatcaactgtttccacagggag

SEQ ID NO: 7769914 - DNA, 22 bp, Homo sapiens
aatcaacaggatgtgcattgta

SEQ ID NO: 7769915 - DNA, 21 bp, Homo sapiens
aatcaaatgtcatatccccag

SEQ ID NO: 7769916 - DNA, 22 bp, Homo sapiens
aatcaagagctgactatatttt

SEQ ID NO: 7769917 - DNA, 22 bp, Homo sapiens
acttgtaaacaaatctaatgta

SEQ ID NO: 7769918 - DNA, 22 bp, Homo sapiens
acttgtgttaccaaggtttggt

SEQ ID NO: 7769919 - DNA, 22 bp, Homo sapiens
acttgtctttgtaaaatagaaa

SEQ ID NO: 7769920 - DNA, 22 bp, Homo sapiens
aatatatgtggtattgaccagc

SEQ ID NO: 7769921 - DNA, 23 bp, Homo sapiens
aatatatgtgtttttctgcttca

SEQ ID NO: 7769922 - DNA, 22 bp, Homo sapiens
aatatatttgaatcaggaacaa

SEQ ID NO: 7769923 - DNA, 21 bp, Homo sapiens
aatatatgcaatgctttctgc

SEQ ID NO: 7769924 - DNA, 22 bp, Homo sapiens
aatatatgagggagctatttga

SEQ ID NO: 7769925 - DNA, 22 bp, Homo sapiens
aatatatagaagtacccgttgt

SEQ ID NO: 7769926 - DNA, 22 bp, Homo sapiens
acttgaatttagtttttcctaa

SEQ ID NO: 7769927 - DNA, 22 bp, Homo sapiens
aatacaatcaaattcactagca

SEQ ID NO: 7769928 - DNA, 22 bp, Homo sapiens
aatacaatcaaattcactagca

SEQ ID NO: 7769929 - DNA, 22 bp, Homo sapiens
aatacaatcaaattcactagca

SEQ ID NO: 7769930 - DNA, 22 bp, Homo sapiens
acttgaataggaaagccacaaa

SEQ ID NO: 7769931 - DNA, 22 bp, Homo sapiens
acttgaataggtgtcaaggcca

SEQ ID NO: 7769932 - DNA, 22 bp, Homo sapiens
acttgaattatatttctagaga

SEQ ID NO: 7769933 - DNA, 22 bp, Homo sapiens
acttgaattcaaagcgaaagca

SEQ ID NO: 7769934 - DNA, 22 bp, Homo sapiens
acttgaattaggccttgagaga

SEQ ID NO: 7769935 - DNA, 22 bp, Homo sapiens
actgcctgtttggcatggcccc

SEQ ID NO: 7769936 - DNA, 22 bp, Homo sapiens
actgcctgtttggcatggcccc

SEQ ID NO: 7769937 - DNA, 22 bp, Homo sapiens
actgcctgtgtcccttcagtgc

SEQ ID NO: 7769938 - DNA, 23 bp, Homo sapiens
actgcctgtgccgatctctctca

SEQ ID NO: 7769939 - DNA, 22 bp, Homo sapiens
aataagatcttaaaggttatat

SEQ ID NO: 7769940 - DNA, 22 bp, Homo sapiens
aataagatcctgaagatatgtt

SEQ ID NO: 7769941 - DNA, 22 bp, Homo sapiens
aataagatgtgcttgagtttgg

SEQ ID NO: 7769942 - DNA, 22 bp, Homo sapiens
aataagatgtgcttgagtttgg

SEQ ID NO: 7769943 - DNA, 22 bp, Homo sapiens
aataagattactggttgtctga

SEQ ID NO: 7769944 - DNA, 22 bp, Homo sapiens
aataattatttgagagcagacc

SEQ ID NO: 7769945 - DNA, 22 bp, Homo sapiens
aatacaagatttatagttgttt

SEQ ID NO: 7769946 - DNA, 22 bp, Homo sapiens
aataatgtgtgctgcagtctta

SEQ ID NO: 7769947 - DNA, 22 bp, Homo sapiens
aataatgttgacgatagtctta

SEQ ID NO: 7769948 - DNA, 22 bp, Homo sapiens
aataatgttgacgatagtctta

SEQ ID NO: 7769949 - DNA, 22 bp, Homo sapiens
aataattagtgggacagagaac

SEQ ID NO: 7769950 - DNA, 22 bp, Homo sapiens
aataattagtgggacagagaac

SEQ ID NO: 7769951 - DNA, 22 bp, Homo sapiens
aataattagtgggacagagaac

SEQ ID NO: 7769952 - DNA, 22 bp, Homo sapiens
aagttctagaggttgatttggt

SEQ ID NO: 7769953 - DNA, 22 bp, Homo sapiens
aagtttaaggtggaagtggtgg

SEQ ID NO: 7769954 - DNA, 22 bp, Homo sapiens
aagtttaacttgaattctttct

SEQ ID NO: 7769955 - DNA, 22 bp, Homo sapiens
aataagaatttacttgtcaaga

SEQ ID NO: 7769956 - DNA, 22 bp, Homo sapiens
aataagataagatttctgctct

SEQ ID NO: 7769957 - DNA, 22 bp, Homo sapiens
aataagaattgccagatttgaa

SEQ ID NO: 7769958 - DNA, 22 bp, Homo sapiens
aataacttcagttcttacatta

SEQ ID NO: 7769959 - DNA, 22 bp, Homo sapiens
aataacttaagaaatttcccca

SEQ ID NO: 7769960 - DNA, 22 bp, Homo sapiens
aagtttctcaatggcaactggg

SEQ ID NO: 7769961 - DNA, 22 bp, Homo sapiens
aataacttaagaaatttcccca

SEQ ID NO: 7769962 - DNA, 22 bp, Homo sapiens
aagtttcatgatgtaattattg

SEQ ID NO: 7769963 - DNA, 22 bp, Homo sapiens
aagtttcatgatgtaattattg

SEQ ID NO: 7769964 - DNA, 22 bp, Homo sapiens
aagtttcatgacttggttatta

SEQ ID NO: 7769965 - DNA, 22 bp, Homo sapiens
aagtttcatgacttggttatta

SEQ ID NO: 7769966 - DNA, 22 bp, Homo sapiens
aagtttcaagaggttctttgaa

SEQ ID NO: 7769967 - DNA, 22 bp, Homo sapiens
aagtttcaaatgttgattatgc

SEQ ID NO: 7769968 - DNA, 22 bp, Homo sapiens
aagtttcaaatgttgattatgc

SEQ ID NO: 7769969 - DNA, 22 bp, Homo sapiens
aagtttcaaatataaaattaca

SEQ ID NO: 7769970 - DNA, 22 bp, Homo sapiens
aagtggactaatacaaggacta

SEQ ID NO: 7769971 - DNA, 22 bp, Homo sapiens
aagtgcatacactagttaattg

SEQ ID NO: 7769972 - DNA, 22 bp, Homo sapiens
aagtgcataataactcccaagt

SEQ ID NO: 7769973 - DNA, 22 bp, Homo sapiens
aagtgcatagtaatggagtcaa

SEQ ID NO: 7769974 - DNA, 22 bp, Homo sapiens
aagtgcatatttttgttgtaga

SEQ ID NO: 7769975 - DNA, 22 bp, Homo sapiens
aagtgcttggattgcaggtatg

SEQ ID NO: 7769976 - DNA, 22 bp, Homo sapiens
aagtgcttggctaatggttatg

SEQ ID NO: 7769977 - DNA, 22 bp, Homo sapiens
aagtcacagctaaatagctaag

SEQ ID NO: 7769978 - DNA, 22 bp, Homo sapiens
aagtcagaaatatctgccatca

SEQ ID NO: 7769979 - DNA, 22 bp, Homo sapiens
aagtcagaaaacagagcaatta

SEQ ID NO: 7769980 - DNA, 22 bp, Homo sapiens
aagtcagaaatcatctagtgta

SEQ ID NO: 7769981 - DNA, 22 bp, Homo sapiens
aagtcagaaattattcaggaat

SEQ ID NO: 7769982 - DNA, 22 bp, Homo sapiens
aagtcagaataatgtttctttt

SEQ ID NO: 7769983 - DNA, 22 bp, Homo sapiens
aagtcagacagctgagctgcct

SEQ ID NO: 7769984 - DNA, 22 bp, Homo sapiens
aagtcagacagctgagctgcct

SEQ ID NO: 7769985 - DNA, 22 bp, Homo sapiens
aagtcagaccttgttgatagct

SEQ ID NO: 7769986 - DNA, 22 bp, Homo sapiens
aagtcagagatgccaaagatta

SEQ ID NO: 7769987 - DNA, 22 bp, Homo sapiens
aagtcagagatcaaggtgtcta

SEQ ID NO: 7769988 - DNA, 23 bp, Homo sapiens
aagtcagagccaagtcaatgaga

SEQ ID NO: 7769989 - DNA, 22 bp, Homo sapiens
aagtcagataggtgagtccaaa

SEQ ID NO: 7769990 - DNA, 22 bp, Homo sapiens
aagtcagagcaactgagacatt

SEQ ID NO: 7769991 - DNA, 22 bp, Homo sapiens
aagtgttttggcttctgtacac

SEQ ID NO: 7769992 - DNA, 22 bp, Homo sapiens
aagttatatcatctcattgacg

SEQ ID NO: 7769993 - DNA, 22 bp, Homo sapiens
aagttattgcagcaatccaagt

SEQ ID NO: 7769994 - DNA, 22 bp, Homo sapiens
aagttactggcaagggctgcag

SEQ ID NO: 7769995 - DNA, 22 bp, Homo sapiens
aagttactggcaagggctgcag

SEQ ID NO: 7769996 - DNA, 22 bp, Homo sapiens
aagttactatgactcttctttt

SEQ ID NO: 7769997 - DNA, 22 bp, Homo sapiens
aagtgttttgtaaacagaaaag

SEQ ID NO: 7769998 - DNA, 22 bp, Homo sapiens
actcccactccagagtagaagc

SEQ ID NO: 7769999 - DNA, 22 bp, Homo sapiens
actccaggttttttcactgaag

SEQ ID NO: 7770000 - DNA, 20 bp, Homo sapiens
actccaggtggcatgaggac

SEQ ID NO: 7770001 - DNA, 22 bp, Homo sapiens
aagctgccaatggtaagctgct

SEQ ID NO: 7770002 - DNA, 22 bp, Homo sapiens
aagctgccacacggtgagtact

SEQ ID NO: 7770003 - DNA, 22 bp, Homo sapiens
aagctgccagctgagctgaggc

SEQ ID NO: 7770004 - DNA, 22 bp, Homo sapiens
acaggcagtgatttcctctggt

SEQ ID NO: 7770005 - DNA, 22 bp, Homo sapiens
acaggcagtgggccagatttgt

SEQ ID NO: 7770006 - DNA, 22 bp, Homo sapiens
acaggcaggttgagaaacattt

SEQ ID NO: 7770007 - DNA, 18 bp, Homo sapiens
aagctgccctcaggcagg

SEQ ID NO: 7770008 - DNA, 22 bp, Homo sapiens
acaggcaggtcctgtcccagct

SEQ ID NO: 7770009 - DNA, 22 bp, Homo sapiens
aagctgcccaagactgaagcat

SEQ ID NO: 7770010 - DNA, 22 bp, Homo sapiens
aagccagggtttgtggatctat

SEQ ID NO: 7770011 - DNA, 22 bp, Homo sapiens
aagccagggtttgtggatctat

SEQ ID NO: 7770012 - DNA, 18 bp, Homo sapiens
aagccaggtcaagataag

SEQ ID NO: 7770013 - DNA, 22 bp, Homo sapiens
aagccaggtgtgcccaggatcc

SEQ ID NO: 7770014 - DNA, 22 bp, Homo sapiens
aagccaggtgttgtggtaagag

SEQ ID NO: 7770015 - DNA, 22 bp, Homo sapiens
aagccaggtgtttaggccagcg

SEQ ID NO: 7770016 - DNA, 22 bp, Homo sapiens
aagccagggattcctgagggag

SEQ ID NO: 7770017 - DNA, 22 bp, Homo sapiens
aagccaggctgcacttgctggg

SEQ ID NO: 7770018 - DNA, 22 bp, Homo sapiens
aagccaggccattctctggttc

SEQ ID NO: 7770019 - DNA, 22 bp, Homo sapiens
aagccaggggctgcttaggaga

SEQ ID NO: 7770020 - DNA, 22 bp, Homo sapiens
aagccaggggttggtatgctat

SEQ ID NO: 7770021 - DNA, 22 bp, Homo sapiens
aagccagggtcaggggcctcct

SEQ ID NO: 7770022 - DNA, 22 bp, Homo sapiens
aagccaggggttggtatgctat

SEQ ID NO: 7770023 - DNA, 22 bp, Homo sapiens
aaggaaatacaacatgtattca

SEQ ID NO: 7770024 - DNA, 22 bp, Homo sapiens
aaggaaatagatgcagatggta

SEQ ID NO: 7770025 - DNA, 22 bp, Homo sapiens
aaggaaatacttctgcagagca

SEQ ID NO: 7770026 - DNA, 22 bp, Homo sapiens
aaggaaatacttctgcagagca

SEQ ID NO: 7770027 - DNA, 22 bp, Homo sapiens
aagctttaaggaattttatgga

SEQ ID NO: 7770028 - DNA, 22 bp, Homo sapiens
aagctttaagtgtcagtcagcc

SEQ ID NO: 7770029 - DNA, 22 bp, Homo sapiens
acaggcagttgaggtttgtgtg

SEQ ID NO: 7770030 - DNA, 22 bp, Homo sapiens
acaggcatccaggactaggcct

SEQ ID NO: 7770031 - DNA, 22 bp, Homo sapiens
acaggcagttgaggtttgtgtg

SEQ ID NO: 7770032 - DNA, 22 bp, Homo sapiens
aaggaaatctttgtaacatctt

SEQ ID NO: 7770033 - DNA, 22 bp, Homo sapiens
acagggctctgacaccaaggta

SEQ ID NO: 7770034 - DNA, 22 bp, Homo sapiens
acagtacagtgcagaggaagat

SEQ ID NO: 7770035 - DNA, 22 bp, Homo sapiens
acaggtgtggggctgtggtact

SEQ ID NO: 7770036 - DNA, 22 bp, Homo sapiens
aaggcagtaggtgtttcaaact

SEQ ID NO: 7770037 - DNA, 22 bp, Homo sapiens
aaggcagtaggatcttccacag

SEQ ID NO: 7770038 - DNA, 22 bp, Homo sapiens
aaggcagtctggtttcaaagca

SEQ ID NO: 7770039 - DNA, 22 bp, Homo sapiens
aaggcagtttgggccaccatct

SEQ ID NO: 7770040 - DNA, 22 bp, Homo sapiens
aaggcagttcactcacgcagcc

SEQ ID NO: 7770041 - DNA, 22 bp, Homo sapiens
aaggcagtggttgtgatactgt

SEQ ID NO: 7770042 - DNA, 22 bp, Homo sapiens
aaggcagggaaagtggattagg

SEQ ID NO: 7770043 - DNA, 22 bp, Homo sapiens
acagttctttggatggaagaat

SEQ ID NO: 7770044 - DNA, 22 bp, Homo sapiens
acagttcttaaaacttgaatta

SEQ ID NO: 7770045 - DNA, 22 bp, Homo sapiens
acagttctgagctataattgct

SEQ ID NO: 7770046 - DNA, 22 bp, Homo sapiens
acagttctgagctataattgct

SEQ ID NO: 7770047 - DNA, 22 bp, Homo sapiens
aaggcagagatattcttgatct

SEQ ID NO: 7770048 - DNA, 22 bp, Homo sapiens
aaggcagctcagctcatggcag

SEQ ID NO: 7770049 - DNA, 22 bp, Homo sapiens
aaggcagccttttgagttgatt

SEQ ID NO: 7770050 - DNA, 22 bp, Homo sapiens
aaggcagatataaagactagag

SEQ ID NO: 7770051 - DNA, 22 bp, Homo sapiens
aaggaacactacaaggctggga

SEQ ID NO: 7770052 - DNA, 22 bp, Homo sapiens
aaggaaatgtgcctgacactgc

SEQ ID NO: 7770053 - DNA, 22 bp, Homo sapiens
aaggaaattaggttattttgct

SEQ ID NO: 7770054 - DNA, 22 bp, Homo sapiens
aaggaaatgaggttgatggatg

SEQ ID NO: 7770055 - DNA, 22 bp, Homo sapiens
aaggaaatgaagctgatgttgg

SEQ ID NO: 7770056 - DNA, 22 bp, Homo sapiens
acagtataccattgtgactttg

SEQ ID NO: 7770057 - DNA, 22 bp, Homo sapiens
acagtagaccctggataaacat

SEQ ID NO: 7770058 - DNA, 22 bp, Homo sapiens
acagtagatggctcagagacag

SEQ ID NO: 7770059 - DNA, 22 bp, Homo sapiens
aaggaagaagggaagttactta

SEQ ID NO: 7770060 - DNA, 22 bp, Homo sapiens
aaggaactgatgctcaaagaat

SEQ ID NO: 7770061 - DNA, 22 bp, Homo sapiens
aaggaacttgccacagaaaaga

SEQ ID NO: 7770062 - DNA, 19 bp, Homo sapiens
aaggcagaagttggatatg

SEQ ID NO: 7770063 - DNA, 22 bp, Homo sapiens
aaggcagaaattcaactactgg

SEQ ID NO: 7770064 - DNA, 21 bp, Homo sapiens
aaggcagaagcatggaatgag

SEQ ID NO: 7770065 - DNA, 22 bp, Homo sapiens
aaggcagaaagggatgtgagtg

SEQ ID NO: 7770066 - DNA, 22 bp, Homo sapiens
aaggcagaaagggatgtgagtg

SEQ ID NO: 7770067 - DNA, 22 bp, Homo sapiens
aagtatctttctagcaactaaa

SEQ ID NO: 7770068 - DNA, 22 bp, Homo sapiens
aagtcaatcaagggtgtaggca

SEQ ID NO: 7770069 - DNA, 22 bp, Homo sapiens
aagtcaatttatgttctcagac

SEQ ID NO: 7770070 - DNA, 22 bp, Homo sapiens
aagtcaattagtaaacttggaa

SEQ ID NO: 7770071 - DNA, 22 bp, Homo sapiens
aagtcacacagttaacatgagg

SEQ ID NO: 7770072 - DNA, 22 bp, Homo sapiens
accccagggctgccagcctcct

SEQ ID NO: 7770073 - DNA, 22 bp, Homo sapiens
accccagggctgccagcctcct

SEQ ID NO: 7770074 - DNA, 22 bp, Homo sapiens
accccaggcccagggaagaggc

SEQ ID NO: 7770075 - DNA, 23 bp, Homo sapiens
accccaggcatcgcattcctctt

SEQ ID NO: 7770076 - DNA, 22 bp, Homo sapiens
acccccaaacatcaagggctga

SEQ ID NO: 7770077 - DNA, 22 bp, Homo sapiens
accccaggtctccaggctctgg

SEQ ID NO: 7770078 - DNA, 22 bp, Homo sapiens
accccaggtccaggttacagag

SEQ ID NO: 7770079 - DNA, 22 bp, Homo sapiens
accccaggtcatctgagagtcc

SEQ ID NO: 7770080 - DNA, 22 bp, Homo sapiens
accccaggagctgtgcctagtc

SEQ ID NO: 7770081 - DNA, 22 bp, Homo sapiens
accccaggagctgtgcctagtc

SEQ ID NO: 7770082 - DNA, 22 bp, Homo sapiens
accccaggaagtggaggtcatg

SEQ ID NO: 7770083 - DNA, 22 bp, Homo sapiens
aagtacatgttgttcaaaagcc

SEQ ID NO: 7770084 - DNA, 22 bp, Homo sapiens
aagtacatgttgctcaacagcc

SEQ ID NO: 7770085 - DNA, 22 bp, Homo sapiens
aaggtgaactggtaatgacaga

SEQ ID NO: 7770086 - DNA, 22 bp, Homo sapiens
aagtaacaggcatgtgaatgac

SEQ ID NO: 7770087 - DNA, 22 bp, Homo sapiens
accatgtcatttattggccaaa

SEQ ID NO: 7770088 - DNA, 22 bp, Homo sapiens
accatgcatcagttaaaaggag

SEQ ID NO: 7770089 - DNA, 22 bp, Homo sapiens
aaggctggggtgcagacggcct

SEQ ID NO: 7770090 - DNA, 22 bp, Homo sapiens
aaggctggggtgcagacggcct

SEQ ID NO: 7770091 - DNA, 22 bp, Homo sapiens
aaggctggtttccttgatgttt

SEQ ID NO: 7770092 - DNA, 22 bp, Homo sapiens
aaggctggtttccttgatgttt

SEQ ID NO: 7770093 - DNA, 22 bp, Homo sapiens
aaggctgtggttctatacagaa

SEQ ID NO: 7770094 - DNA, 22 bp, Homo sapiens
aaggcttctggagcttgctggc

SEQ ID NO: 7770095 - DNA, 22 bp, Homo sapiens
aaggcttctttagtgtcctaat

SEQ ID NO: 7770096 - DNA, 22 bp, Homo sapiens
aaggctcttggagtgaatgcag

SEQ ID NO: 7770097 - DNA, 22 bp, Homo sapiens
aaggcatgaaagcgaaatgaga

SEQ ID NO: 7770098 - DNA, 22 bp, Homo sapiens
aagggcaggaaaagatggatgt

SEQ ID NO: 7770099 - DNA, 22 bp, Homo sapiens
aagggaaatcatatggtgcagt

SEQ ID NO: 7770100 - DNA, 22 bp, Homo sapiens
aagggaaatcctcagcccagga

SEQ ID NO: 7770101 - DNA, 22 bp, Homo sapiens
acacataagaaactacaaagag

SEQ ID NO: 7770102 - DNA, 22 bp, Homo sapiens
agcagcagtgtgtggtcatgtt

SEQ ID NO: 7770103 - DNA, 22 bp, Homo sapiens
agcagcagtcctttgtgtaatt

SEQ ID NO: 7770104 - DNA, 22 bp, Homo sapiens
acacaggcaatgtgagtgggag

SEQ ID NO: 7770105 - DNA, 21 bp, Homo sapiens
acacaggcagtgtcccgaggt

SEQ ID NO: 7770106 - DNA, 22 bp, Homo sapiens
agcagcttgttaaaaagttcca

SEQ ID NO: 7770107 - DNA, 22 bp, Homo sapiens
agcagctttcacctccccgcct

SEQ ID NO: 7770108 - DNA, 22 bp, Homo sapiens
agcagctttaagtcactggtta

SEQ ID NO: 7770109 - DNA, 22 bp, Homo sapiens
agcagctttcctctggggtcag

SEQ ID NO: 7770110 - DNA, 22 bp, Homo sapiens
agcagcttgggtctctcctgct

SEQ ID NO: 7770111 - DNA, 21 bp, Homo sapiens
agcagcttgagtctggagctc

SEQ ID NO: 7770112 - DNA, 22 bp, Homo sapiens
agcacctgctatgtgtcaggga

SEQ ID NO: 7770113 - DNA, 22 bp, Homo sapiens
acaattgtggcaatttgtatgt

SEQ ID NO: 7770114 - DNA, 22 bp, Homo sapiens
acaatttatccattgtatagtt

SEQ ID NO: 7770115 - DNA, 22 bp, Homo sapiens
acaatttatccattgtatagtt

SEQ ID NO: 7770116 - DNA, 22 bp, Homo sapiens
acaatttatccattgtatagtt

SEQ ID NO: 7770117 - DNA, 22 bp, Homo sapiens
acacaggaagtcagcactgatg

SEQ ID NO: 7770118 - DNA, 22 bp, Homo sapiens
acaatttcttatagttcaattc

SEQ ID NO: 7770119 - DNA, 22 bp, Homo sapiens
acaatttctaatatagatctta

SEQ ID NO: 7770120 - DNA, 22 bp, Homo sapiens
acaattttaagccagagtgggt

SEQ ID NO: 7770121 - DNA, 22 bp, Homo sapiens
acaattttccccataggttatc

SEQ ID NO: 7770122 - DNA, 22 bp, Homo sapiens
acaattttccccataggttatc

SEQ ID NO: 7770123 - DNA, 22 bp, Homo sapiens
acacatttgcataatacctcat

SEQ ID NO: 7770124 - DNA, 19 bp, Homo sapiens
acacatttgcacaatccac

SEQ ID NO: 7770125 - DNA, 22 bp, Homo sapiens
acacatttgggctcctacataa

SEQ ID NO: 7770126 - DNA, 22 bp, Homo sapiens
acacatttgggctcctacataa

SEQ ID NO: 7770127 - DNA, 22 bp, Homo sapiens
acacatttgctaaaatgagctc

SEQ ID NO: 7770128 - DNA, 22 bp, Homo sapiens
acacattatctcattaaatact

SEQ ID NO: 7770129 - DNA, 22 bp, Homo sapiens
agcagggcagtgcttcagctct

SEQ ID NO: 7770130 - DNA, 23 bp, Homo sapiens
acacatttttcccgttctgaggt

SEQ ID NO: 7770131 - DNA, 22 bp, Homo sapiens
acacattttctaacagggatca

SEQ ID NO: 7770132 - DNA, 22 bp, Homo sapiens
acacattttggctaggtggaga

SEQ ID NO: 7770133 - DNA, 22 bp, Homo sapiens
acacattttgttaaaccctgtg

SEQ ID NO: 7770134 - DNA, 22 bp, Homo sapiens
acacattttcaacactgtcaag

SEQ ID NO: 7770135 - DNA, 22 bp, Homo sapiens
acacattttcaacactgtcaag

SEQ ID NO: 7770136 - DNA, 22 bp, Homo sapiens
acacattttcaacactgtcaag

SEQ ID NO: 7770137 - DNA, 22 bp, Homo sapiens
acacattttcaacactgtcaag

SEQ ID NO: 7770138 - DNA, 23 bp, Homo sapiens
acactgtctcatggatagactgc

SEQ ID NO: 7770139 - DNA, 22 bp, Homo sapiens
agcagggcccactaggggagat

SEQ ID NO: 7770140 - DNA, 22 bp, Homo sapiens
agcagggcccactaggggagat

SEQ ID NO: 7770141 - DNA, 22 bp, Homo sapiens
agcagggcagttaaagggtcct

SEQ ID NO: 7770142 - DNA, 22 bp, Homo sapiens
agcagggcatgaataagggttt

SEQ ID NO: 7770143 - DNA, 18 bp, Homo sapiens
agcagggcattttgccat

SEQ ID NO: 7770144 - DNA, 22 bp, Homo sapiens
agcagggccaacagtaaacacc

SEQ ID NO: 7770145 - DNA, 22 bp, Homo sapiens
acagaaattgggcaaatggaag

SEQ ID NO: 7770146 - DNA, 22 bp, Homo sapiens
agccacaggaaacagagacagc

SEQ ID NO: 7770147 - DNA, 22 bp, Homo sapiens
agccacaggccatgagatacca

SEQ ID NO: 7770148 - DNA, 22 bp, Homo sapiens
agccacagggggtgagggacaa

SEQ ID NO: 7770149 - DNA, 22 bp, Homo sapiens
acagaaattcaaactggaattt

SEQ ID NO: 7770150 - DNA, 22 bp, Homo sapiens
acagaaattctgggacagaaaa

SEQ ID NO: 7770151 - DNA, 22 bp, Homo sapiens
acagaaagatgatttgaaatgg

SEQ ID NO: 7770152 - DNA, 22 bp, Homo sapiens
acagataaatttataggagtgt

SEQ ID NO: 7770153 - DNA, 22 bp, Homo sapiens
acagataaggcagttaagagtt

SEQ ID NO: 7770154 - DNA, 22 bp, Homo sapiens
acagataaagaaacaatcacag

SEQ ID NO: 7770155 - DNA, 22 bp, Homo sapiens
agcccccaggagtctccacgcc

SEQ ID NO: 7770156 - DNA, 22 bp, Homo sapiens
agccccctccctagtgactgga

SEQ ID NO: 7770157 - DNA, 22 bp, Homo sapiens
agccagggtgggtgaatgctat

SEQ ID NO: 7770158 - DNA, 22 bp, Homo sapiens
agccacagtctgatgcctgaga

SEQ ID NO: 7770159 - DNA, 22 bp, Homo sapiens
agccacagtctgatgcctgaga

SEQ ID NO: 7770160 - DNA, 22 bp, Homo sapiens
agccacagtcaacctgtccata

SEQ ID NO: 7770161 - DNA, 22 bp, Homo sapiens
agccacaggtgttggccagtgt

SEQ ID NO: 7770162 - DNA, 22 bp, Homo sapiens
agccacagtcaacctgtccata

SEQ ID NO: 7770163 - DNA, 22 bp, Homo sapiens
agccacagtcaacctgtccata

SEQ ID NO: 7770164 - DNA, 22 bp, Homo sapiens
agccacagtcaacctgtccata

SEQ ID NO: 7770165 - DNA, 22 bp, Homo sapiens
agcccagctttcacccctctgg

SEQ ID NO: 7770166 - DNA, 19 bp, Homo sapiens
agcccagcttatttgtcag

SEQ ID NO: 7770167 - DNA, 22 bp, Homo sapiens
agcccagcttccttctgtctct

SEQ ID NO: 7770168 - DNA, 22 bp, Homo sapiens
agcccagcttccttctgtctct

SEQ ID NO: 7770169 - DNA, 22 bp, Homo sapiens
agcccagcggagcgggcccggg

SEQ ID NO: 7770170 - DNA, 22 bp, Homo sapiens
agcccagctgcctgcctgctgt

SEQ ID NO: 7770171 - DNA, 22 bp, Homo sapiens
agcccagctgctatgtacctgg

SEQ ID NO: 7770172 - DNA, 18 bp, Homo sapiens
agcccagcggagtgaatc

SEQ ID NO: 7770173 - DNA, 22 bp, Homo sapiens
agcccagctcctccacagaata

SEQ ID NO: 7770174 - DNA, 17 bp, Homo sapiens
agcctgccccatgctgc

SEQ ID NO: 7770175 - DNA, 17 bp, Homo sapiens
agcctgccccatgctgc

SEQ ID NO: 7770176 - DNA, 22 bp, Homo sapiens
agcctgcctcagactcaggata

SEQ ID NO: 7770177 - DNA, 22 bp, Homo sapiens
agcctgcctcagactcaggata

SEQ ID NO: 7770178 - DNA, 22 bp, Homo sapiens
agcctgcctgtgaggctttgag

SEQ ID NO: 7770179 - DNA, 22 bp, Homo sapiens
agcctgcctgtgaggctttgag

SEQ ID NO: 7770180 - DNA, 22 bp, Homo sapiens
agcctgccaggcgctgcctgga

SEQ ID NO: 7770181 - DNA, 20 bp, Homo sapiens
agcctgccagctggcccaga

SEQ ID NO: 7770182 - DNA, 20 bp, Homo sapiens
agcctgccagctggcccaga

SEQ ID NO: 7770183 - DNA, 22 bp, Homo sapiens
acagcaaaagacaagaacttaa

SEQ ID NO: 7770184 - DNA, 22 bp, Homo sapiens
acagcaaaggacgaacactctg

SEQ ID NO: 7770185 - DNA, 22 bp, Homo sapiens
acagcaactcctgcttctgagt

SEQ ID NO: 7770186 - DNA, 22 bp, Homo sapiens
agcctgccttgggctgcttgag

SEQ ID NO: 7770187 - DNA, 22 bp, Homo sapiens
agctaggataagcagagactgg

SEQ ID NO: 7770188 - DNA, 22 bp, Homo sapiens
agctaggggaccaaggtggccc

SEQ ID NO: 7770189 - DNA, 17 bp, Homo sapiens
agctagggcctagaatc

SEQ ID NO: 7770190 - DNA, 22 bp, Homo sapiens
agctagggcaaatatgagatac

SEQ ID NO: 7770191 - DNA, 17 bp, Homo sapiens
agctagggcctagaatc

SEQ ID NO: 7770192 - DNA, 22 bp, Homo sapiens
agctagggacagataccagcca

SEQ ID NO: 7770193 - DNA, 22 bp, Homo sapiens
agctaggggaccaaggtggccc

SEQ ID NO: 7770194 - DNA, 22 bp, Homo sapiens
agctaggggaccaaggtggccc

SEQ ID NO: 7770195 - DNA, 22 bp, Homo sapiens
agctaggggaccaaggtggccc

SEQ ID NO: 7770196 - DNA, 23 bp, Homo sapiens
agctataaaatctgtgacagcag

SEQ ID NO: 7770197 - DNA, 22 bp, Homo sapiens
agctcctgttctgagagcagga

SEQ ID NO: 7770198 - DNA, 22 bp, Homo sapiens
agctctcaagataagaaagaac

SEQ ID NO: 7770199 - DNA, 22 bp, Homo sapiens
agctctgggggaaagtctgctc

SEQ ID NO: 7770200 - DNA, 22 bp, Homo sapiens
agctctgggggaaagtctgctc

SEQ ID NO: 7770201 - DNA, 22 bp, Homo sapiens
acagcaggcatgaagaaatgtt

SEQ ID NO: 7770202 - DNA, 22 bp, Homo sapiens
acagcaggcacacaaggataga

SEQ ID NO: 7770203 - DNA, 22 bp, Homo sapiens
acagcaggcatgaatgacactg

SEQ ID NO: 7770204 - DNA, 22 bp, Homo sapiens
acagcaggagccttcatatgct

SEQ ID NO: 7770205 - DNA, 22 bp, Homo sapiens
acagcaggatttggcgatgttg

SEQ ID NO: 7770206 - DNA, 22 bp, Homo sapiens
acagcaggaattaacatataag

SEQ ID NO: 7770207 - DNA, 22 bp, Homo sapiens
acaaacttccatcatgaatttt

SEQ ID NO: 7770208 - DNA, 22 bp, Homo sapiens
acaaacttatgtttcatatgta

SEQ ID NO: 7770209 - DNA, 22 bp, Homo sapiens
acaaacagagttgaaaaatagg

SEQ ID NO: 7770210 - DNA, 22 bp, Homo sapiens
acaaacagagttgaaaaatagg

SEQ ID NO: 7770211 - DNA, 22 bp, Homo sapiens
acaaaccagcttaagcaagatg

SEQ ID NO: 7770212 - DNA, 22 bp, Homo sapiens
acaaacatcttgacctcagatt

SEQ ID NO: 7770213 - DNA, 20 bp, Homo sapiens
acaaaataggtactgggtag

SEQ ID NO: 7770214 - DNA, 22 bp, Homo sapiens
acaaaattacctagttattttc

SEQ ID NO: 7770215 - DNA, 22 bp, Homo sapiens
acaaaattgtgttaaactttat

SEQ ID NO: 7770216 - DNA, 22 bp, Homo sapiens
acaaaattgtgttaaactttat

SEQ ID NO: 7770217 - DNA, 22 bp, Homo sapiens
agagctggggccagagtcaagg

SEQ ID NO: 7770218 - DNA, 22 bp, Homo sapiens
agagctggggccagagtcaagg

SEQ ID NO: 7770219 - DNA, 22 bp, Homo sapiens
agagctgggtgaagtgccatca

SEQ ID NO: 7770220 - DNA, 22 bp, Homo sapiens
agagctgggtggtggtgactca

SEQ ID NO: 7770221 - DNA, 22 bp, Homo sapiens
aattttattagaaggcaagggg

SEQ ID NO: 7770222 - DNA, 22 bp, Homo sapiens
aattttattagaaggcaagggg

SEQ ID NO: 7770223 - DNA, 22 bp, Homo sapiens
aattttatgccttgcacgttgg

SEQ ID NO: 7770224 - DNA, 22 bp, Homo sapiens
aattttatgccttgcacgttgg

SEQ ID NO: 7770225 - DNA, 22 bp, Homo sapiens
aattttattaactggatgtagc

SEQ ID NO: 7770226 - DNA, 22 bp, Homo sapiens
aattttattaactggatgtagc

SEQ ID NO: 7770227 - DNA, 22 bp, Homo sapiens
agaggccatctgctctgtgggg

SEQ ID NO: 7770228 - DNA, 22 bp, Homo sapiens
agaggccatctgctctgtgggg

SEQ ID NO: 7770229 - DNA, 20 bp, Homo sapiens
agaggccagttaggagtcta

SEQ ID NO: 7770230 - DNA, 20 bp, Homo sapiens
agaggccagttaggagtcta

SEQ ID NO: 7770231 - DNA, 22 bp, Homo sapiens
acaaaaagctccattactgtcc

SEQ ID NO: 7770232 - DNA, 22 bp, Homo sapiens
acaaaaagggagatgaggtaga

SEQ ID NO: 7770233 - DNA, 20 bp, Homo sapiens
acaaaataggtactgggtag

SEQ ID NO: 7770234 - DNA, 22 bp, Homo sapiens
acaaaatagagttctcccctgg

SEQ ID NO: 7770235 - DNA, 22 bp, Homo sapiens
agaggccccaggtgagcatgcc

SEQ ID NO: 7770236 - DNA, 22 bp, Homo sapiens
agaggccccaggtgagcatgcc

SEQ ID NO: 7770237 - DNA, 22 bp, Homo sapiens
agaggccccatgggatggcggt

SEQ ID NO: 7770238 - DNA, 22 bp, Homo sapiens
agaggccatgctagaggcctgg

SEQ ID NO: 7770239 - DNA, 22 bp, Homo sapiens
acaattagtgatcagtgatgcc

SEQ ID NO: 7770240 - DNA, 22 bp, Homo sapiens
acaattactcaactttgctgct

SEQ ID NO: 7770241 - DNA, 22 bp, Homo sapiens
acaattagctgtgtgtctatct

SEQ ID NO: 7770242 - DNA, 22 bp, Homo sapiens
acaatgtttttgttcaaagagt

SEQ ID NO: 7770243 - DNA, 22 bp, Homo sapiens
acaatgttttgaaacatctagg

SEQ ID NO: 7770244 - DNA, 22 bp, Homo sapiens
agcaaggattatcctgggaagg

SEQ ID NO: 7770245 - DNA, 22 bp, Homo sapiens
agcaaggcagtcagctggctgg

SEQ ID NO: 7770246 - DNA, 22 bp, Homo sapiens
agcaaggaaactatggagagat

SEQ ID NO: 7770247 - DNA, 22 bp, Homo sapiens
agcaagctggaggggctcatga

SEQ ID NO: 7770248 - DNA, 22 bp, Homo sapiens
agcaagctgtcaagagagctga

SEQ ID NO: 7770249 - DNA, 22 bp, Homo sapiens
agcaagctgttcttggagagta

SEQ ID NO: 7770250 - DNA, 22 bp, Homo sapiens
agcaagctaacataggagattg

SEQ ID NO: 7770251 - DNA, 22 bp, Homo sapiens
agcaagcattgctggttaggtc

SEQ ID NO: 7770252 - DNA, 22 bp, Homo sapiens
acaagtttatttgattagaaca

SEQ ID NO: 7770253 - DNA, 22 bp, Homo sapiens
acaagtatttaaggttagtata

SEQ ID NO: 7770254 - DNA, 22 bp, Homo sapiens
acaagttaccaaaaaagattca

SEQ ID NO: 7770255 - DNA, 22 bp, Homo sapiens
acaagttaccaaaaaagattca

SEQ ID NO: 7770256 - DNA, 22 bp, Homo sapiens
acaaatggagaaactgaggccc

SEQ ID NO: 7770257 - DNA, 22 bp, Homo sapiens
acaaatgtctacattgagaata

SEQ ID NO: 7770258 - DNA, 22 bp, Homo sapiens
acaaatgtggacatggataatg

SEQ ID NO: 7770259 - DNA, 22 bp, Homo sapiens
acaaattaccatggaatttggg

SEQ ID NO: 7770260 - DNA, 22 bp, Homo sapiens
acaaattatagaaaattgagct

SEQ ID NO: 7770261 - DNA, 22 bp, Homo sapiens
acaaattatagaaaattgagct

SEQ ID NO: 7770262 - DNA, 22 bp, Homo sapiens
acaaattatagaaaattgagct

SEQ ID NO: 7770263 - DNA, 22 bp, Homo sapiens
acaaggaacaagcatgtagttt

SEQ ID NO: 7770264 - DNA, 22 bp, Homo sapiens
agagctgggacttggactcaat

SEQ ID NO: 7770265 - DNA, 22 bp, Homo sapiens
aatttacagttgctgatggtac

SEQ ID NO: 7770266 - DNA, 22 bp, Homo sapiens
aatttacagttgctgatggtac

SEQ ID NO: 7770267 - DNA, 22 bp, Homo sapiens
aatttacacttcatttggaggg

SEQ ID NO: 7770268 - DNA, 22 bp, Homo sapiens
aatttacaggtgcactcgccat

SEQ ID NO: 7770269 - DNA, 22 bp, Homo sapiens
aattatattgtggtgtgaatgt

SEQ ID NO: 7770270 - DNA, 22 bp, Homo sapiens
aattatggtatgttcaacaact

SEQ ID NO: 7770271 - DNA, 22 bp, Homo sapiens
aattatatgttaatcttcaatt

SEQ ID NO: 7770272 - DNA, 22 bp, Homo sapiens
aattatacaattgtcaagttct

SEQ ID NO: 7770273 - DNA, 22 bp, Homo sapiens
aattactgggtctgagattaat

SEQ ID NO: 7770274 - DNA, 22 bp, Homo sapiens
aattaccaggatttttcagtat

SEQ ID NO: 7770275 - DNA, 23 bp, Homo sapiens
aattaccatgcaacttgtgaaac

SEQ ID NO: 7770276 - DNA, 22 bp, Homo sapiens
aatgttgtgtttcagttcaaga

SEQ ID NO: 7770277 - DNA, 22 bp, Homo sapiens
aatgttcagtgcctttaaacat

SEQ ID NO: 7770278 - DNA, 22 bp, Homo sapiens
aatgttgatgttttcagtgagc

SEQ ID NO: 7770279 - DNA, 22 bp, Homo sapiens
aatgttgcagagtgattgtcca

SEQ ID NO: 7770280 - DNA, 22 bp, Homo sapiens
aatgttgaggatatcagaaaat

SEQ ID NO: 7770281 - DNA, 22 bp, Homo sapiens
aatgttatttctgcatagtagt

SEQ ID NO: 7770282 - DNA, 22 bp, Homo sapiens
aatgttattgtcctttccaaaa

SEQ ID NO: 7770283 - DNA, 22 bp, Homo sapiens
agaaggggcccaaggatgtcag

SEQ ID NO: 7770284 - DNA, 22 bp, Homo sapiens
aatgcaagatcaaatctaacac

SEQ ID NO: 7770285 - DNA, 22 bp, Homo sapiens
aatgcaaagtgaggtgagtggc

SEQ ID NO: 7770286 - DNA, 22 bp, Homo sapiens
aatgcaaactccactggagcag

SEQ ID NO: 7770287 - DNA, 22 bp, Homo sapiens
aatgcaaacttcttgttacttg

SEQ ID NO: 7770288 - DNA, 18 bp, Homo sapiens
aatgcaatgtatttgcag

SEQ ID NO: 7770289 - DNA, 22 bp, Homo sapiens
aatgcaatgcagcacctccttg

SEQ ID NO: 7770290 - DNA, 22 bp, Homo sapiens
aatgcaagtcaatgctataccc

SEQ ID NO: 7770291 - DNA, 22 bp, Homo sapiens
aatgcaaggcctgtatctgatt

SEQ ID NO: 7770292 - DNA, 22 bp, Homo sapiens
aatgcaaggcctgtatctgatt

SEQ ID NO: 7770293 - DNA, 22 bp, Homo sapiens
agacagagatactatgttgtca

SEQ ID NO: 7770294 - DNA, 22 bp, Homo sapiens
agacaggccactctggtctggt

SEQ ID NO: 7770295 - DNA, 22 bp, Homo sapiens
agacagcaatatgggagacgga

SEQ ID NO: 7770296 - DNA, 21 bp, Homo sapiens
agacagagtgcagtctacata

SEQ ID NO: 7770297 - DNA, 22 bp, Homo sapiens
agacagggtgatcgcttgagcc

SEQ ID NO: 7770298 - DNA, 22 bp, Homo sapiens
agacagggtcttgatcagagct

SEQ ID NO: 7770299 - DNA, 22 bp, Homo sapiens
aatgtcagcctgaaagctattc

SEQ ID NO: 7770300 - DNA, 22 bp, Homo sapiens
aatgtcatagcaaagagagtga

SEQ ID NO: 7770301 - DNA, 22 bp, Homo sapiens
aatgtcatagcatttcttcaat

SEQ ID NO: 7770302 - DNA, 21 bp, Homo sapiens
aatgtcattgaatggtgagac

SEQ ID NO: 7770303 - DNA, 22 bp, Homo sapiens
aatgtcattgagctccaatcct

SEQ ID NO: 7770304 - DNA, 22 bp, Homo sapiens
aatgtctgctctactcaggagg

SEQ ID NO: 7770305 - DNA, 22 bp, Homo sapiens
aatgtctgcctgaactttatat

SEQ ID NO: 7770306 - DNA, 22 bp, Homo sapiens
aatgtctgccagaactgatcat

SEQ ID NO: 7770307 - DNA, 22 bp, Homo sapiens
aatgtctgagtctctgtatccc

SEQ ID NO: 7770308 - DNA, 22 bp, Homo sapiens
aatgtctgaggctcatctgagg

SEQ ID NO: 7770309 - DNA, 22 bp, Homo sapiens
aatgtctgaaaatcagactgca

SEQ ID NO: 7770310 - DNA, 22 bp, Homo sapiens
aatgtctgtgccttaaaacttc

SEQ ID NO: 7770311 - DNA, 22 bp, Homo sapiens
aatgtgtttagttaatgagttg

SEQ ID NO: 7770312 - DNA, 22 bp, Homo sapiens
aatgtcatttttaaatgtgaga

SEQ ID NO: 7770313 - DNA, 22 bp, Homo sapiens
aatgtcatttaaaataattctg

SEQ ID NO: 7770314 - DNA, 22 bp, Homo sapiens
tcaaatgagaggcagggcagct

SEQ ID NO: 7770315 - DNA, 22 bp, Homo sapiens
tcaaatctttaacatgtgcaaa

SEQ ID NO: 7770316 - DNA, 22 bp, Homo sapiens
tcaaatctttgaccacttatgt

SEQ ID NO: 7770317 - DNA, 22 bp, Homo sapiens
tcaaatctcactctgcatttct

SEQ ID NO: 7770318 - DNA, 22 bp, Homo sapiens
tcaaatattggctatttcacat

SEQ ID NO: 7770319 - DNA, 21 bp, Homo sapiens
tcaaatcaggtatcactattg

SEQ ID NO: 7770320 - DNA, 22 bp, Homo sapiens
tcaaataccagcaatttcatgt

SEQ ID NO: 7770321 - DNA, 22 bp, Homo sapiens
tcaaatacatggtcaatcaact

SEQ ID NO: 7770322 - DNA, 22 bp, Homo sapiens
tcaaatatgtgatagaagctaa

SEQ ID NO: 7770323 - DNA, 22 bp, Homo sapiens
tcaaatagttgacattaacttg

SEQ ID NO: 7770324 - DNA, 22 bp, Homo sapiens
tcaaatatgtgatagaagctaa

SEQ ID NO: 7770325 - DNA, 22 bp, Homo sapiens
tcaaatagttgacattaacttg

SEQ ID NO: 7770326 - DNA, 22 bp, Homo sapiens
tcaaataatgccattcatcatc

SEQ ID NO: 7770327 - DNA, 22 bp, Homo sapiens
tcaaataaggagtcatgaccat

SEQ ID NO: 7770328 - DNA, 22 bp, Homo sapiens
tcaaataatgccattcatcatc

SEQ ID NO: 7770329 - DNA, 18 bp, Homo sapiens
tcaaagtctggctccact

SEQ ID NO: 7770330 - DNA, 22 bp, Homo sapiens
tcaaataaggagtcatgaccat

SEQ ID NO: 7770331 - DNA, 22 bp, Homo sapiens
tcaaagtattttaactgtatcc

SEQ ID NO: 7770332 - DNA, 22 bp, Homo sapiens
tcaaagtataattgcttttttg

SEQ ID NO: 7770333 - DNA, 22 bp, Homo sapiens
tcaaagtatatcccttcgaaac

SEQ ID NO: 7770334 - DNA, 22 bp, Homo sapiens
tcaaagtattttaactgtatcc

SEQ ID NO: 7770335 - DNA, 17 bp, Homo sapiens
tcaaagtattctgatgc

SEQ ID NO: 7770336 - DNA, 22 bp, Homo sapiens
tcaaagtagccggatggaattt

SEQ ID NO: 7770337 - DNA, 22 bp, Homo sapiens
tcaaagtagccggatggaattt

SEQ ID NO: 7770338 - DNA, 22 bp, Homo sapiens
tcaaagtagagttcagtgcagc

SEQ ID NO: 7770339 - DNA, 22 bp, Homo sapiens
tcaaagtactactcagttcagc

SEQ ID NO: 7770340 - DNA, 22 bp, Homo sapiens
tcaaagtaagaatttattacaa

SEQ ID NO: 7770341 - DNA, 22 bp, Homo sapiens
tcaaagtaccattatcagtgga

SEQ ID NO: 7770342 - DNA, 22 bp, Homo sapiens
tcaaagtaccagagtgaactga

SEQ ID NO: 7770343 - DNA, 22 bp, Homo sapiens
tcaaaggcttgtggttctggga

SEQ ID NO: 7770344 - DNA, 22 bp, Homo sapiens
tcaaaggctgcttgtcttctgg

SEQ ID NO: 7770345 - DNA, 22 bp, Homo sapiens
tcaaagtaaaagtatagagttt

SEQ ID NO: 7770346 - DNA, 22 bp, Homo sapiens
tcaaagtaaaagtatagagttt

SEQ ID NO: 7770347 - DNA, 22 bp, Homo sapiens
tcaaaaataagatattctggac

SEQ ID NO: 7770348 - DNA, 22 bp, Homo sapiens
tcaaaaataagatattctggac

SEQ ID NO: 7770349 - DNA, 22 bp, Homo sapiens
tcaaaaataagatattctggac

SEQ ID NO: 7770350 - DNA, 22 bp, Homo sapiens
tatttttgcctctcagataaaa

SEQ ID NO: 7770351 - DNA, 22 bp, Homo sapiens
tatttttgcctctcagataaaa

SEQ ID NO: 7770352 - DNA, 22 bp, Homo sapiens
tattttgactattaaaccaaca

SEQ ID NO: 7770353 - DNA, 22 bp, Homo sapiens
tattttgcaaacctgagtttga

SEQ ID NO: 7770354 - DNA, 20 bp, Homo sapiens
tattttgcaattatggttca

SEQ ID NO: 7770355 - DNA, 22 bp, Homo sapiens
tattttgctttagctgactgtt

SEQ ID NO: 7770356 - DNA, 22 bp, Homo sapiens
tcaaagagctattcagttgtgg

SEQ ID NO: 7770357 - DNA, 22 bp, Homo sapiens
tcaaagactatatattttattt

SEQ ID NO: 7770358 - DNA, 22 bp, Homo sapiens
tcaaagactatatattttattt

SEQ ID NO: 7770359 - DNA, 22 bp, Homo sapiens
tcaaagattgaaactaaggaga

SEQ ID NO: 7770360 - DNA, 22 bp, Homo sapiens
tcaaagatgggttttgtttgat

SEQ ID NO: 7770361 - DNA, 22 bp, Homo sapiens
tcaaagatgataggaaatcata

SEQ ID NO: 7770362 - DNA, 22 bp, Homo sapiens
tcaaagatgatgctgaagttat

SEQ ID NO: 7770363 - DNA, 20 bp, Homo sapiens
tcaaagacaagctctcatcc

SEQ ID NO: 7770364 - DNA, 22 bp, Homo sapiens
tcaaactggcagacttctactt

SEQ ID NO: 7770365 - DNA, 22 bp, Homo sapiens
tatttaataaaactatggcatg

SEQ ID NO: 7770366 - DNA, 22 bp, Homo sapiens
tattgtgctcaccattacatcc

SEQ ID NO: 7770367 - DNA, 22 bp, Homo sapiens
tattacaaattataatgggaga

SEQ ID NO: 7770368 - DNA, 22 bp, Homo sapiens
tattacaagaaagggcatgaat

SEQ ID NO: 7770369 - DNA, 23 bp, Homo sapiens
tattacaattggtcttattaaga

SEQ ID NO: 7770370 - DNA, 22 bp, Homo sapiens
tattgtccaataggatgttcct

SEQ ID NO: 7770371 - DNA, 22 bp, Homo sapiens
tattgtccaataggatgttcct

SEQ ID NO: 7770372 - DNA, 22 bp, Homo sapiens
tattgtatcttctgtttagaag

SEQ ID NO: 7770373 - DNA, 22 bp, Homo sapiens
tatttgatagagataaatgata

SEQ ID NO: 7770374 - DNA, 22 bp, Homo sapiens
tatttgaaggcatacattttga

SEQ ID NO: 7770375 - DNA, 22 bp, Homo sapiens
tatttcttgttattctcgttga

SEQ ID NO: 7770376 - DNA, 22 bp, Homo sapiens
tatttgcaacataaaactctga

SEQ ID NO: 7770377 - DNA, 22 bp, Homo sapiens
tatttgatgaaggtaaagtctt

SEQ ID NO: 7770378 - DNA, 23 bp, Homo sapiens
tatttgctactggtaattctgga

SEQ ID NO: 7770379 - DNA, 22 bp, Homo sapiens
tatttgcaggcttttgtcatgg

SEQ ID NO: 7770380 - DNA, 22 bp, Homo sapiens
tatttgcaggcttttgtcatgg

SEQ ID NO: 7770381 - DNA, 22 bp, Homo sapiens
tatttgcaggcttttgtcatgg

SEQ ID NO: 7770382 - DNA, 22 bp, Homo sapiens
tatttgcaggcttttgtcatgg

SEQ ID NO: 7770383 - DNA, 22 bp, Homo sapiens
tatttgcaggacatagatatgg

SEQ ID NO: 7770384 - DNA, 22 bp, Homo sapiens
tatttgcaggacatagatatgg

SEQ ID NO: 7770385 - DNA, 22 bp, Homo sapiens
tatttgcaggacatagatatgg

SEQ ID NO: 7770386 - DNA, 22 bp, Homo sapiens
tattttctggacagtcttgctt

SEQ ID NO: 7770387 - DNA, 23 bp, Homo sapiens
tattttccaaatgatgactacat

SEQ ID NO: 7770388 - DNA, 22 bp, Homo sapiens
tattttctggggagagtgaacc

SEQ ID NO: 7770389 - DNA, 22 bp, Homo sapiens
tattttgacgattttatgcaaa

SEQ ID NO: 7770390 - DNA, 22 bp, Homo sapiens
tattttgacgattttatgcaaa

SEQ ID NO: 7770391 - DNA, 22 bp, Homo sapiens
tatggtcatttgttagtgcttt

SEQ ID NO: 7770392 - DNA, 22 bp, Homo sapiens
tatggcttcttttgcaactact

SEQ ID NO: 7770393 - DNA, 22 bp, Homo sapiens
tatggaaagtgttttcttctgt

SEQ ID NO: 7770394 - DNA, 22 bp, Homo sapiens
tatggaaactaattcatttttc

SEQ ID NO: 7770395 - DNA, 22 bp, Homo sapiens
tatggaaaaatgtatcttgtca

SEQ ID NO: 7770396 - DNA, 22 bp, Homo sapiens
tatgtattctcagatttactaa

SEQ ID NO: 7770397 - DNA, 22 bp, Homo sapiens
tatgtattattcatcagtggga

SEQ ID NO: 7770398 - DNA, 22 bp, Homo sapiens
tatgtattagagctccatgagg

SEQ ID NO: 7770399 - DNA, 22 bp, Homo sapiens
tatgtattagagctccatgagg

SEQ ID NO: 7770400 - DNA, 22 bp, Homo sapiens
tatgtatatgtgtgttgacaac

SEQ ID NO: 7770401 - DNA, 18 bp, Homo sapiens
tatgtataacatagttca

SEQ ID NO: 7770402 - DNA, 22 bp, Homo sapiens
tatgtatagagtcttttaaatt

SEQ ID NO: 7770403 - DNA, 22 bp, Homo sapiens
tatgtataatcacagagtgtca

SEQ ID NO: 7770404 - DNA, 22 bp, Homo sapiens
tattaataagtgactactagct

SEQ ID NO: 7770405 - DNA, 21 bp, Homo sapiens
tattaatatgtctaagctgat

SEQ ID NO: 7770406 - DNA, 22 bp, Homo sapiens
tattaatatgtgtgtgcatgta

SEQ ID NO: 7770407 - DNA, 22 bp, Homo sapiens
tattaattcttgccaattctcc

SEQ ID NO: 7770408 - DNA, 22 bp, Homo sapiens
tattaatatgtgtgtgcatgta

SEQ ID NO: 7770409 - DNA, 22 bp, Homo sapiens
tattaatatgtgtgtgcatgta

SEQ ID NO: 7770410 - DNA, 22 bp, Homo sapiens
tattaagtatcttgatgacaaa

SEQ ID NO: 7770411 - DNA, 22 bp, Homo sapiens
tattaataaatatgtaggggcc

SEQ ID NO: 7770412 - DNA, 22 bp, Homo sapiens
tattaacatgaactgacttttc

SEQ ID NO: 7770413 - DNA, 22 bp, Homo sapiens
tattaacattttatgaaaataa

SEQ ID NO: 7770414 - DNA, 22 bp, Homo sapiens
tattaaattatggatttaggag

SEQ ID NO: 7770415 - DNA, 22 bp, Homo sapiens
tattaaattatggatttaggag

SEQ ID NO: 7770416 - DNA, 22 bp, Homo sapiens
tatgtttctgggcttgatattt

SEQ ID NO: 7770417 - DNA, 22 bp, Homo sapiens
tatgtttcatcaggcatggagt

SEQ ID NO: 7770418 - DNA, 22 bp, Homo sapiens
tatgaaatttaaacacagatca

SEQ ID NO: 7770419 - DNA, 22 bp, Homo sapiens
tatgaaattgccatttttatgg

SEQ ID NO: 7770420 - DNA, 22 bp, Homo sapiens
tatgaaattgccatttttatgg

SEQ ID NO: 7770421 - DNA, 22 bp, Homo sapiens
tatgaaatgatggggaaaatag

SEQ ID NO: 7770422 - DNA, 22 bp, Homo sapiens
tatgaatataccacaatttagg

SEQ ID NO: 7770423 - DNA, 22 bp, Homo sapiens
tatgacaaatgatatatttggc

SEQ ID NO: 7770424 - DNA, 22 bp, Homo sapiens
tatgaattctgttcattgatga

SEQ ID NO: 7770425 - DNA, 22 bp, Homo sapiens
tatgacaagaaatacagaggta

SEQ ID NO: 7770426 - DNA, 22 bp, Homo sapiens
tatgacaaggtggagtatgagt

SEQ ID NO: 7770427 - DNA, 22 bp, Homo sapiens
tatgacaaggtggagtatgagt

SEQ ID NO: 7770428 - DNA, 22 bp, Homo sapiens
tatgaaaatttagctgaagcat

SEQ ID NO: 7770429 - DNA, 22 bp, Homo sapiens
tatgaaaatttagctgaagcat

SEQ ID NO: 7770430 - DNA, 23 bp, Homo sapiens
tatctttttcaatgttggaaata

SEQ ID NO: 7770431 - DNA, 22 bp, Homo sapiens
tatcatttgttattattagtgg

SEQ ID NO: 7770432 - DNA, 22 bp, Homo sapiens
tatcaggaattgaatggcttca

SEQ ID NO: 7770433 - DNA, 23 bp, Homo sapiens
tatcatttcagctctctgcctgg

SEQ ID NO: 7770434 - DNA, 22 bp, Homo sapiens
tatcattttactgtgacatttt

SEQ ID NO: 7770435 - DNA, 22 bp, Homo sapiens
tatcattttactgtgacatttt

SEQ ID NO: 7770436 - DNA, 22 bp, Homo sapiens
tatcattttactgtgacatttt

SEQ ID NO: 7770437 - DNA, 22 bp, Homo sapiens
tatcaggaagaacacgtgaaat

SEQ ID NO: 7770438 - DNA, 22 bp, Homo sapiens
tatcatttaacagaatcattgc

SEQ ID NO: 7770439 - DNA, 22 bp, Homo sapiens
tatcagatgacatcttctatgg

SEQ ID NO: 7770440 - DNA, 21 bp, Homo sapiens
tatcagaagagaaagaatgat

SEQ ID NO: 7770441 - DNA, 22 bp, Homo sapiens
tatcagaaatgccttaaattgg

SEQ ID NO: 7770442 - DNA, 21 bp, Homo sapiens
tatcacagtagaataggatct

SEQ ID NO: 7770443 - DNA, 22 bp, Homo sapiens
tatcacatagtgtttagtaaat

SEQ ID NO: 7770444 - DNA, 22 bp, Homo sapiens
tatcacatttggagatttatga

SEQ ID NO: 7770445 - DNA, 22 bp, Homo sapiens
tatcacatcaatgttttaaaat

SEQ ID NO: 7770446 - DNA, 22 bp, Homo sapiens
tataaagaaggcacagcaagac

SEQ ID NO: 7770447 - DNA, 18 bp, Homo sapiens
tataaacacacttaggtt

SEQ ID NO: 7770448 - DNA, 22 bp, Homo sapiens
tataaaacagaaagcactacct

SEQ ID NO: 7770449 - DNA, 22 bp, Homo sapiens
tataaagagtctcaaagaagtt

SEQ ID NO: 7770450 - DNA, 22 bp, Homo sapiens
tatcacaggtgtgatttacatt

SEQ ID NO: 7770451 - DNA, 22 bp, Homo sapiens
tataaagtgtgaactgtgagta

SEQ ID NO: 7770452 - DNA, 22 bp, Homo sapiens
tataaagagtctcaaagaagtt

SEQ ID NO: 7770453 - DNA, 22 bp, Homo sapiens
tagcagggtccaatgtgaggca

SEQ ID NO: 7770454 - DNA, 22 bp, Homo sapiens
tagcaggctcgcaataaaatgt

SEQ ID NO: 7770455 - DNA, 23 bp, Homo sapiens
tagcaggctttcttttctctcac

SEQ ID NO: 7770456 - DNA, 22 bp, Homo sapiens
tagcaggcatctcagagataat

SEQ ID NO: 7770457 - DNA, 22 bp, Homo sapiens
tagcaaatgtgttatgctatgc

SEQ ID NO: 7770458 - DNA, 22 bp, Homo sapiens
tagcaaataaaacagtattgaa

SEQ ID NO: 7770459 - DNA, 22 bp, Homo sapiens
tagcaaataaaacagtattgaa

SEQ ID NO: 7770460 - DNA, 22 bp, Homo sapiens
tagcaaaggatgactatgtacc

SEQ ID NO: 7770461 - DNA, 22 bp, Homo sapiens
tagcaaatgtctgaaggaatag

SEQ ID NO: 7770462 - DNA, 22 bp, Homo sapiens
tagcaaaatgtggatgtagttg

SEQ ID NO: 7770463 - DNA, 22 bp, Homo sapiens
tagagaggtttgaattggctgc

SEQ ID NO: 7770464 - DNA, 22 bp, Homo sapiens
tagagtcagagaatcattacag

SEQ ID NO: 7770465 - DNA, 22 bp, Homo sapiens
tagagaaaagcagggatcagga

SEQ ID NO: 7770466 - DNA, 22 bp, Homo sapiens
tagagaaataagctttgccttg

SEQ ID NO: 7770467 - DNA, 22 bp, Homo sapiens
tagactttgatattgtacaccc

SEQ ID NO: 7770468 - DNA, 21 bp, Homo sapiens
tagagaaaagaagctgttcct

SEQ ID NO: 7770469 - DNA, 21 bp, Homo sapiens
tagagaaaagaagctgttcct

SEQ ID NO: 7770470 - DNA, 22 bp, Homo sapiens
tagatactcagaaatgctttca

SEQ ID NO: 7770471 - DNA, 22 bp, Homo sapiens
tagatactcagaaatgctttca

SEQ ID NO: 7770472 - DNA, 22 bp, Homo sapiens
tagataggtgattaggaaaagc

SEQ ID NO: 7770473 - DNA, 22 bp, Homo sapiens
tagatacatttttctttcctgt

SEQ ID NO: 7770474 - DNA, 22 bp, Homo sapiens
tagatacatacattttaaaatg

SEQ ID NO: 7770475 - DNA, 22 bp, Homo sapiens
tagactctgcatttacctccca

SEQ ID NO: 7770476 - DNA, 22 bp, Homo sapiens
tagaaatgggttacatttagag

SEQ ID NO: 7770477 - DNA, 22 bp, Homo sapiens
tagaaatggggaagtagttagg

SEQ ID NO: 7770478 - DNA, 22 bp, Homo sapiens
tagttgacatcatcagcctgga

SEQ ID NO: 7770479 - DNA, 20 bp, Homo sapiens
tagttgccaaaatgccctgc

SEQ ID NO: 7770480 - DNA, 22 bp, Homo sapiens
tagtttagcactaagaaaaaca

SEQ ID NO: 7770481 - DNA, 22 bp, Homo sapiens
tagtttagtaagaggagagctg

SEQ ID NO: 7770482 - DNA, 22 bp, Homo sapiens
tagtttaggtcgtacaagcaaa

SEQ ID NO: 7770483 - DNA, 22 bp, Homo sapiens
tagttttataatgttaacatct

SEQ ID NO: 7770484 - DNA, 22 bp, Homo sapiens
tagttttataatgttaacatct

SEQ ID NO: 7770485 - DNA, 22 bp, Homo sapiens
tagttttatgaattggtataat

SEQ ID NO: 7770486 - DNA, 22 bp, Homo sapiens
taggggagctcgggtgcaatcg

SEQ ID NO: 7770487 - DNA, 22 bp, Homo sapiens
taggggaattgcagtgtgtcca

SEQ ID NO: 7770488 - DNA, 21 bp, Homo sapiens
tagggggcagtgggatgctta

SEQ ID NO: 7770489 - DNA, 22 bp, Homo sapiens
tagggggctttgctgcttgaca

SEQ ID NO: 7770490 - DNA, 22 bp, Homo sapiens
tagggggctgtcctgtgcatta

SEQ ID NO: 7770491 - DNA, 22 bp, Homo sapiens
tagtggaggggatgcaaagctt

SEQ ID NO: 7770492 - DNA, 22 bp, Homo sapiens
tagtggagaagtggagtctgtg

SEQ ID NO: 7770493 - DNA, 22 bp, Homo sapiens
tagtgcttaacacaaagtgatt

SEQ ID NO: 7770494 - DNA, 22 bp, Homo sapiens
tagtgcttattactgtgctgtc

SEQ ID NO: 7770495 - DNA, 22 bp, Homo sapiens
tagctggtcctcagctccagcc

SEQ ID NO: 7770496 - DNA, 22 bp, Homo sapiens
tagctgtggagcagaggtctcc

SEQ ID NO: 7770497 - DNA, 22 bp, Homo sapiens
tagctgtgtagacactcagagc

SEQ ID NO: 7770498 - DNA, 22 bp, Homo sapiens
tagctgtgtaacatgagaatgt

SEQ ID NO: 7770499 - DNA, 20 bp, Homo sapiens
taggcagagctgtgcagcct

SEQ ID NO: 7770500 - DNA, 22 bp, Homo sapiens
taggcagagaggccataagaat

SEQ ID NO: 7770501 - DNA, 22 bp, Homo sapiens
taggcagaattgtgggctctaa

SEQ ID NO: 7770502 - DNA, 22 bp, Homo sapiens
taggcagaattcattgtgctgc

SEQ ID NO: 7770503 - DNA, 22 bp, Homo sapiens
taggcagaattgttgaatgaag

SEQ ID NO: 7770504 - DNA, 23 bp, Homo sapiens
taggcaggactcagatatgacag

SEQ ID NO: 7770505 - DNA, 21 bp, Homo sapiens
taggcagaggagcaggtatct

SEQ ID NO: 7770506 - DNA, 22 bp, Homo sapiens
taggcagaggtatggtaaggac

SEQ ID NO: 7770507 - DNA, 22 bp, Homo sapiens
taggcagagtttaatggttaag

SEQ ID NO: 7770508 - DNA, 22 bp, Homo sapiens
taggcagattccatattttggc

SEQ ID NO: 7770509 - DNA, 22 bp, Homo sapiens
taggcagatgttaacaggaaaa

SEQ ID NO: 7770510 - DNA, 22 bp, Homo sapiens
taggccagttggtggccctgga

SEQ ID NO: 7770511 - DNA, 22 bp, Homo sapiens
taggccaggacagagcttccag

SEQ ID NO: 7770512 - DNA, 22 bp, Homo sapiens
taggccaggaatcagcaagctt

SEQ ID NO: 7770513 - DNA, 22 bp, Homo sapiens
taggccagattactagagtagg

SEQ ID NO: 7770514 - DNA, 22 bp, Homo sapiens
taggcccagttccgcctcccgg

SEQ ID NO: 7770515 - DNA, 22 bp, Homo sapiens
tagggcagagtccaggatgggc

SEQ ID NO: 7770516 - DNA, 22 bp, Homo sapiens
tagggcagattcggtggagttt

SEQ ID NO: 7770517 - DNA, 22 bp, Homo sapiens
tagggcagccacccaggctgct

SEQ ID NO: 7770518 - DNA, 22 bp, Homo sapiens
tagggcagccacccaggctgct

SEQ ID NO: 7770519 - DNA, 21 bp, Homo sapiens
tagggctctatttttatttca

SEQ ID NO: 7770520 - DNA, 23 bp, Homo sapiens
tagggcagctgggagggacatgc

SEQ ID NO: 7770521 - DNA, 22 bp, Homo sapiens
tagggcagctgcatcaggcact

SEQ ID NO: 7770522 - DNA, 22 bp, Homo sapiens
tagggctgaggcaacaagggag

SEQ ID NO: 7770523 - DNA, 22 bp, Homo sapiens
tagggctgtggtcagtcctcta

SEQ ID NO: 7770524 - DNA, 22 bp, Homo sapiens
tagggctgggtacactcttgcc

SEQ ID NO: 7770525 - DNA, 22 bp, Homo sapiens
tagggctggcgtgctcagggaa

SEQ ID NO: 7770526 - DNA, 22 bp, Homo sapiens
tagggctgtttaaaagtgaggt

SEQ ID NO: 7770527 - DNA, 22 bp, Homo sapiens
tagggctgtgtctccaggacca

SEQ ID NO: 7770528 - DNA, 22 bp, Homo sapiens
tacacagtatatgggatcacag

SEQ ID NO: 7770529 - DNA, 22 bp, Homo sapiens
tacacatacattgcttacaagg

SEQ ID NO: 7770530 - DNA, 22 bp, Homo sapiens
tacagaatgttatgaagcatag

SEQ ID NO: 7770531 - DNA, 22 bp, Homo sapiens
tacacataggagggtaataaaa

SEQ ID NO: 7770532 - DNA, 22 bp, Homo sapiens
tacagaataaagcgtgaagctt

SEQ ID NO: 7770533 - DNA, 22 bp, Homo sapiens
tacacataggtctgaataaaaa

SEQ ID NO: 7770534 - DNA, 22 bp, Homo sapiens
tacaagaggtatatagaaacag

SEQ ID NO: 7770535 - DNA, 22 bp, Homo sapiens
tacaagaggatgtggacatgga

SEQ ID NO: 7770536 - DNA, 22 bp, Homo sapiens
tacaagagtgagattatcatgt

SEQ ID NO: 7770537 - DNA, 22 bp, Homo sapiens
tacaagaatttctttctggttg

SEQ ID NO: 7770538 - DNA, 22 bp, Homo sapiens
tacaagagacaccagggaggct

SEQ ID NO: 7770539 - DNA, 22 bp, Homo sapiens
tacaagagcagtaagcttgtcc

SEQ ID NO: 7770540 - DNA, 22 bp, Homo sapiens
tacaagagaactaatgtaagtc

SEQ ID NO: 7770541 - DNA, 22 bp, Homo sapiens
tacaagaaggaaaactagcaat

SEQ ID NO: 7770542 - DNA, 22 bp, Homo sapiens
tacaagaaggaaaactagcaat

SEQ ID NO: 7770543 - DNA, 22 bp, Homo sapiens
tacaagaaggaaaactagcaat

SEQ ID NO: 7770544 - DNA, 22 bp, Homo sapiens
tacaagaaggatggagcccact

SEQ ID NO: 7770545 - DNA, 22 bp, Homo sapiens
tacaagaaggatggagcccact

SEQ ID NO: 7770546 - DNA, 22 bp, Homo sapiens
tacaagaatgtcttaaaagctc

SEQ ID NO: 7770547 - DNA, 22 bp, Homo sapiens
taatttatgatgcaaagaaaag

SEQ ID NO: 7770548 - DNA, 22 bp, Homo sapiens
tacaacattgtgttgcttcata

SEQ ID NO: 7770549 - DNA, 22 bp, Homo sapiens
tacaagaaactacatgaatgca

SEQ ID NO: 7770550 - DNA, 22 bp, Homo sapiens
tacaagaaatttctgcatatat

SEQ ID NO: 7770551 - DNA, 22 bp, Homo sapiens
tacaagaaatttctgcatatat

SEQ ID NO: 7770552 - DNA, 22 bp, Homo sapiens
taattatttgaagacattagag

SEQ ID NO: 7770553 - DNA, 22 bp, Homo sapiens
taattattgtctgaagagttat

SEQ ID NO: 7770554 - DNA, 23 bp, Homo sapiens
taattcacatatacattgcttca

SEQ ID NO: 7770555 - DNA, 22 bp, Homo sapiens
taattcatgggcccagtgatat

SEQ ID NO: 7770556 - DNA, 22 bp, Homo sapiens
taattattatgacaacaattgc

SEQ ID NO: 7770557 - DNA, 22 bp, Homo sapiens
taattattctagtcacatagca

SEQ ID NO: 7770558 - DNA, 22 bp, Homo sapiens
taattattgtctgaagagttat

SEQ ID NO: 7770559 - DNA, 22 bp, Homo sapiens
taatctgaagaaacaggacttg

SEQ ID NO: 7770560 - DNA, 22 bp, Homo sapiens
taatatatttctgctaagctca

SEQ ID NO: 7770561 - DNA, 22 bp, Homo sapiens
taaggacattggttttgagtaa

SEQ ID NO: 7770562 - DNA, 22 bp, Homo sapiens
taatagttgtgactttgtaaag

SEQ ID NO: 7770563 - DNA, 22 bp, Homo sapiens
taatataccaaactgtaatttt

SEQ ID NO: 7770564 - DNA, 22 bp, Homo sapiens
taatataccaaactgtaatttt

SEQ ID NO: 7770565 - DNA, 22 bp, Homo sapiens
taatatacttcccatagtttga

SEQ ID NO: 7770566 - DNA, 22 bp, Homo sapiens
taatatacttcccatagtttga

SEQ ID NO: 7770567 - DNA, 21 bp, Homo sapiens
taatataggttcacaactagt

SEQ ID NO: 7770568 - DNA, 22 bp, Homo sapiens
taagcctgcatgaaccatgaga

SEQ ID NO: 7770569 - DNA, 22 bp, Homo sapiens
taagccatacatttcagactct

SEQ ID NO: 7770570 - DNA, 22 bp, Homo sapiens
taaggaaaatggacatcaaaca

SEQ ID NO: 7770571 - DNA, 22 bp, Homo sapiens
taagctctccaggtgatcatga

SEQ ID NO: 7770572 - DNA, 22 bp, Homo sapiens
taaggaagtcacaagaatcgct

SEQ ID NO: 7770573 - DNA, 22 bp, Homo sapiens
taaggaagagcttggtaatagg

SEQ ID NO: 7770574 - DNA, 22 bp, Homo sapiens
taaggaaagtacatgttttgac

SEQ ID NO: 7770575 - DNA, 22 bp, Homo sapiens
taaggaaagtgccatgatttct

SEQ ID NO: 7770576 - DNA, 22 bp, Homo sapiens
taaggaaacaacttgtattttt

SEQ ID NO: 7770577 - DNA, 22 bp, Homo sapiens
tactgaaaaagaatccagacct

SEQ ID NO: 7770578 - DNA, 22 bp, Homo sapiens
tactgaaactcttgtaaatatc

SEQ ID NO: 7770579 - DNA, 22 bp, Homo sapiens
tactcctgctgatcctgccagc

SEQ ID NO: 7770580 - DNA, 22 bp, Homo sapiens
tactgaaagaatacataatttc

SEQ ID NO: 7770581 - DNA, 22 bp, Homo sapiens
tactgaaacttttcttcaactg

SEQ ID NO: 7770582 - DNA, 22 bp, Homo sapiens
tacttacagaaggaagcaattg

SEQ ID NO: 7770583 - DNA, 18 bp, Homo sapiens
tactgtttaattgattac

SEQ ID NO: 7770584 - DNA, 22 bp, Homo sapiens
tactgttcatgccttcataaag

SEQ ID NO: 7770585 - DNA, 22 bp, Homo sapiens
tactgttagagccagaaaccta

SEQ ID NO: 7770586 - DNA, 22 bp, Homo sapiens
tactgttagagcgatttgtcct

SEQ ID NO: 7770587 - DNA, 22 bp, Homo sapiens
tactgtttttaaaattgcatcc

SEQ ID NO: 7770588 - DNA, 22 bp, Homo sapiens
taccagggaacagggatattaa

SEQ ID NO: 7770589 - DNA, 22 bp, Homo sapiens
taccataacgtaatgaacttga

SEQ ID NO: 7770590 - DNA, 22 bp, Homo sapiens
taccataacgtaatgaacttga

SEQ ID NO: 7770591 - DNA, 22 bp, Homo sapiens
taccatgcttgagatacagtga

SEQ ID NO: 7770592 - DNA, 22 bp, Homo sapiens
taccatttcagtaaaaacttag

SEQ ID NO: 7770593 - DNA, 22 bp, Homo sapiens
taccatttcagtaaaaacttag

SEQ ID NO: 7770594 - DNA, 22 bp, Homo sapiens
taccaggcagctgcacagaggc

SEQ ID NO: 7770595 - DNA, 22 bp, Homo sapiens
taccacaggccaaatttgaggt

SEQ ID NO: 7770596 - DNA, 22 bp, Homo sapiens
taccacagtttatctattcagc

SEQ ID NO: 7770597 - DNA, 22 bp, Homo sapiens
taccacagacagatttcagtaa

SEQ ID NO: 7770598 - DNA, 22 bp, Homo sapiens
taccaattctattttggattga

SEQ ID NO: 7770599 - DNA, 21 bp, Homo sapiens
taccaattgccttctagttgt

SEQ ID NO: 7770600 - DNA, 20 bp, Homo sapiens
taccacttatttgaataatt

SEQ ID NO: 7770601 - DNA, 22 bp, Homo sapiens
tactagaaaaacacatgctctg

SEQ ID NO: 7770602 - DNA, 22 bp, Homo sapiens
tactacaagggccctaaaaggt

SEQ ID NO: 7770603 - DNA, 22 bp, Homo sapiens
tactactttcccccacatattt

SEQ ID NO: 7770604 - DNA, 22 bp, Homo sapiens
taccatttctacatatcttgtc

SEQ ID NO: 7770605 - DNA, 22 bp, Homo sapiens
taccatttgagagagaacataa

SEQ ID NO: 7770606 - DNA, 22 bp, Homo sapiens
tactacaaggccgaagctctca

SEQ ID NO: 7770607 - DNA, 22 bp, Homo sapiens
taccatttgagagagaacataa

SEQ ID NO: 7770608 - DNA, 22 bp, Homo sapiens
tacagaggctgggttttcaggg

SEQ ID NO: 7770609 - DNA, 22 bp, Homo sapiens
tacagagggattatctaagggt

SEQ ID NO: 7770610 - DNA, 22 bp, Homo sapiens
tacagaggggacatggaagaca

SEQ ID NO: 7770611 - DNA, 22 bp, Homo sapiens
tacagagggtaattgatcaagg

SEQ ID NO: 7770612 - DNA, 22 bp, Homo sapiens
tacagaggaggggattttaata

SEQ ID NO: 7770613 - DNA, 22 bp, Homo sapiens
tacagaggagaccaaggctcag

SEQ ID NO: 7770614 - DNA, 22 bp, Homo sapiens
tacagaggaggtggttgggagt

SEQ ID NO: 7770615 - DNA, 22 bp, Homo sapiens
tacagaggcacatgcaattttc

SEQ ID NO: 7770616 - DNA, 22 bp, Homo sapiens
tacagtctctgataactgtcag

SEQ ID NO: 7770617 - DNA, 22 bp, Homo sapiens
tacagtgaatgaatggctgtgc

SEQ ID NO: 7770618 - DNA, 19 bp, Homo sapiens
tacagtgaaccaggaggag

SEQ ID NO: 7770619 - DNA, 22 bp, Homo sapiens
taccaagtgtattatgctttgt

SEQ ID NO: 7770620 - DNA, 20 bp, Homo sapiens
taccaacagcaggaagcata

SEQ ID NO: 7770621 - DNA, 22 bp, Homo sapiens
taccaaatgtaatcattctaat

SEQ ID NO: 7770622 - DNA, 19 bp, Homo sapiens
taccaaattgcattatggc

SEQ ID NO: 7770623 - DNA, 22 bp, Homo sapiens
tacatgctccttatgagaatct

SEQ ID NO: 7770624 - DNA, 22 bp, Homo sapiens
tacatgcatgtgtgtaaatata

SEQ ID NO: 7770625 - DNA, 22 bp, Homo sapiens
tacatggtggtggcacttgact

SEQ ID NO: 7770626 - DNA, 22 bp, Homo sapiens
tacatgcttctatatgtgaagt

SEQ ID NO: 7770627 - DNA, 22 bp, Homo sapiens
tacagttaaaaagttcaatggt

SEQ ID NO: 7770628 - DNA, 22 bp, Homo sapiens
tacatgaatgtttcaatattgt

SEQ ID NO: 7770629 - DNA, 22 bp, Homo sapiens
tacatgcacatgaacatgtgtg

SEQ ID NO: 7770630 - DNA, 18 bp, Homo sapiens
tacatgcataaatgaagc

SEQ ID NO: 7770631 - DNA, 22 bp, Homo sapiens
tacatgcatgatacaaagttgc

SEQ ID NO: 7770632 - DNA, 21 bp, Homo sapiens
gttttaagggagaaaacctag

SEQ ID NO: 7770633 - DNA, 22 bp, Homo sapiens
gtttcaagtagctgctgattat

SEQ ID NO: 7770634 - DNA, 22 bp, Homo sapiens
gtttcttttgtgatcaccaacc

SEQ ID NO: 7770635 - DNA, 22 bp, Homo sapiens
gtttcttttaaaatatgtagac

SEQ ID NO: 7770636 - DNA, 22 bp, Homo sapiens
gtttcttatttcaactggaaca

SEQ ID NO: 7770637 - DNA, 22 bp, Homo sapiens
gtttctttctattgactgaaca

SEQ ID NO: 7770638 - DNA, 22 bp, Homo sapiens
gttgagagttaagcgggctaat

SEQ ID NO: 7770639 - DNA, 22 bp, Homo sapiens
gtttatattcaacggagtatct

SEQ ID NO: 7770640 - DNA, 21 bp, Homo sapiens
gtttatgaatcttgtcctgct

SEQ ID NO: 7770641 - DNA, 22 bp, Homo sapiens
gtttatgaattgcattcccttt

SEQ ID NO: 7770642 - DNA, 22 bp, Homo sapiens
gtttcaaagtcagaaaaggagg

SEQ ID NO: 7770643 - DNA, 22 bp, Homo sapiens
gtttcaaagggaagacgctgga

SEQ ID NO: 7770644 - DNA, 22 bp, Homo sapiens
gtttattagagttttctgtctg

SEQ ID NO: 7770645 - DNA, 22 bp, Homo sapiens
gttcttggaccagcagcattga

SEQ ID NO: 7770646 - DNA, 22 bp, Homo sapiens
gttctttaggggcccaatttcc

SEQ ID NO: 7770647 - DNA, 22 bp, Homo sapiens
gttgaaaatacagattcctagg

SEQ ID NO: 7770648 - DNA, 22 bp, Homo sapiens
gttatattggcagaagagaaga

SEQ ID NO: 7770649 - DNA, 22 bp, Homo sapiens
gttatatatagtatttctctga

SEQ ID NO: 7770650 - DNA, 22 bp, Homo sapiens
gttatataattcctgtggtagt

SEQ ID NO: 7770651 - DNA, 22 bp, Homo sapiens
gttatataagacaaatcagagt

SEQ ID NO: 7770652 - DNA, 22 bp, Homo sapiens
gtgttctttatttagtgatgct

SEQ ID NO: 7770653 - DNA, 22 bp, Homo sapiens
gtgtttaacatctggtttatac

SEQ ID NO: 7770654 - DNA, 22 bp, Homo sapiens
gtgttcatggatgtcaatttga

SEQ ID NO: 7770655 - DNA, 21 bp, Homo sapiens
gtgctgggacacagccaggct

SEQ ID NO: 7770656 - DNA, 21 bp, Homo sapiens
gtgctgggacacagccaggct

SEQ ID NO: 7770657 - DNA, 22 bp, Homo sapiens
gtgctggctgccaggaggctgc

SEQ ID NO: 7770658 - DNA, 22 bp, Homo sapiens
gtgctggctgccaggaggctgc

SEQ ID NO: 7770659 - DNA, 22 bp, Homo sapiens
gtgctggctggacatggagcac

SEQ ID NO: 7770660 - DNA, 22 bp, Homo sapiens
gtgctggctggacatggagcac

SEQ ID NO: 7770661 - DNA, 17 bp, Homo sapiens
gtgctggcctggggctc

SEQ ID NO: 7770662 - DNA, 22 bp, Homo sapiens
gttaaattcgatgatggataaa

SEQ ID NO: 7770663 - DNA, 22 bp, Homo sapiens
gtgtttctggggcattcatagt

SEQ ID NO: 7770664 - DNA, 22 bp, Homo sapiens
gtgtttcctctagaagccatgg

SEQ ID NO: 7770665 - DNA, 22 bp, Homo sapiens
gtgtttcccctcctggagaagg

SEQ ID NO: 7770666 - DNA, 22 bp, Homo sapiens
gtgtttccctggcacaagaacc

SEQ ID NO: 7770667 - DNA, 22 bp, Homo sapiens
gtgtttcttgcactccccggac

SEQ ID NO: 7770668 - DNA, 22 bp, Homo sapiens
gtgtttcttgcactccccggac

SEQ ID NO: 7770669 - DNA, 22 bp, Homo sapiens
gtgtttaataggtagctgaatc

SEQ ID NO: 7770670 - DNA, 22 bp, Homo sapiens
gtgtttccagttcagaaagcaa

SEQ ID NO: 7770671 - DNA, 22 bp, Homo sapiens
taaagacatggtgtaggtgaac

SEQ ID NO: 7770672 - DNA, 23 bp, Homo sapiens
taaagcaaagtcaagtgcactcc

SEQ ID NO: 7770673 - DNA, 22 bp, Homo sapiens
taaagcaaggaatagagtagtc

SEQ ID NO: 7770674 - DNA, 22 bp, Homo sapiens
taaagcaatttgagcaagttct

SEQ ID NO: 7770675 - DNA, 22 bp, Homo sapiens
taaagcacagtatgagcattgg

SEQ ID NO: 7770676 - DNA, 22 bp, Homo sapiens
taaatgatttatgtatgtgaaa

SEQ ID NO: 7770677 - DNA, 20 bp, Homo sapiens
taaagcagccgtggagggta

SEQ ID NO: 7770678 - DNA, 20 bp, Homo sapiens
taaatgcatgaatgtaaggc

SEQ ID NO: 7770679 - DNA, 19 bp, Homo sapiens
taaaaggatgtggaaggat

SEQ ID NO: 7770680 - DNA, 22 bp, Homo sapiens
taaaagtaggaatgaaacgcat

SEQ ID NO: 7770681 - DNA, 22 bp, Homo sapiens
taaaagtatactttcaaaggag

SEQ ID NO: 7770682 - DNA, 22 bp, Homo sapiens
taaaaggcacttggatgctgag

SEQ ID NO: 7770683 - DNA, 22 bp, Homo sapiens
taaaaggattagcaggatgggc

SEQ ID NO: 7770684 - DNA, 22 bp, Homo sapiens
taaaaggcaatactagatgagt

SEQ ID NO: 7770685 - DNA, 22 bp, Homo sapiens
taaagacataggatcagggaga

SEQ ID NO: 7770686 - DNA, 22 bp, Homo sapiens
taaagacactggttttaatcat

SEQ ID NO: 7770687 - DNA, 22 bp, Homo sapiens
taaaagttagctaggacaaagt

SEQ ID NO: 7770688 - DNA, 22 bp, Homo sapiens
taaaagttagctaggacaaagt

SEQ ID NO: 7770689 - DNA, 22 bp, Homo sapiens
taaaagagaatggataacagag

SEQ ID NO: 7770690 - DNA, 22 bp, Homo sapiens
taaaagaagcttcaaggccggc

SEQ ID NO: 7770691 - DNA, 22 bp, Homo sapiens
taaaagaagcttcaaggccggc

SEQ ID NO: 7770692 - DNA, 22 bp, Homo sapiens
taaaacttctcatttttatggt

SEQ ID NO: 7770693 - DNA, 22 bp, Homo sapiens
taaaactgaatacatactgagg

SEQ ID NO: 7770694 - DNA, 18 bp, Homo sapiens
taacatgttttcattaag

SEQ ID NO: 7770695 - DNA, 22 bp, Homo sapiens
taagacaattcttcagtcacaa

SEQ ID NO: 7770696 - DNA, 22 bp, Homo sapiens
taagacagggagggctctcagc

SEQ ID NO: 7770697 - DNA, 22 bp, Homo sapiens
taagacagggtctattcttagt

SEQ ID NO: 7770698 - DNA, 22 bp, Homo sapiens
taagacaattcttcagtcacaa

SEQ ID NO: 7770699 - DNA, 22 bp, Homo sapiens
taagacaaatactatttcaaga

SEQ ID NO: 7770700 - DNA, 22 bp, Homo sapiens
taagagaactggatagatagga

SEQ ID NO: 7770701 - DNA, 22 bp, Homo sapiens
taagagaatgttgtggctaggt

SEQ ID NO: 7770702 - DNA, 22 bp, Homo sapiens
taagagaaggatctgttccagg

SEQ ID NO: 7770703 - DNA, 22 bp, Homo sapiens
taagagcagaacagcaacatat

SEQ ID NO: 7770704 - DNA, 22 bp, Homo sapiens
taagagcagaggttgaataaat

SEQ ID NO: 7770705 - DNA, 18 bp, Homo sapiens
taagagcagactgtaggc

SEQ ID NO: 7770706 - DNA, 22 bp, Homo sapiens
taacagcagtcctcttctcatg

SEQ ID NO: 7770707 - DNA, 22 bp, Homo sapiens
taaatgtgcactttacttttca

SEQ ID NO: 7770708 - DNA, 22 bp, Homo sapiens
taaatgtgttgtggatgaagtt

SEQ ID NO: 7770709 - DNA, 22 bp, Homo sapiens
taacatctttagcagctcgaac

SEQ ID NO: 7770710 - DNA, 22 bp, Homo sapiens
taacatgagagctaagacatta

SEQ ID NO: 7770711 - DNA, 22 bp, Homo sapiens
taacatccacattagatgattc

SEQ ID NO: 7770712 - DNA, 22 bp, Homo sapiens
taacagtgacctgaatgtcaat

SEQ ID NO: 7770713 - DNA, 22 bp, Homo sapiens
taacagtgtgtccagtcagttt

SEQ ID NO: 7770714 - DNA, 22 bp, Homo sapiens
tcccagccttatctcccctggc

SEQ ID NO: 7770715 - DNA, 22 bp, Homo sapiens
tcccagccttccagtctggttt

SEQ ID NO: 7770716 - DNA, 22 bp, Homo sapiens
tcccagcctgacagtgcatcaa

SEQ ID NO: 7770717 - DNA, 22 bp, Homo sapiens
tcccagcctggaccctgccagt

SEQ ID NO: 7770718 - DNA, 22 bp, Homo sapiens
tcccagccttccttgtggtgaa

SEQ ID NO: 7770719 - DNA, 22 bp, Homo sapiens
tcccagcctttctttctccagc

SEQ ID NO: 7770720 - DNA, 22 bp, Homo sapiens
tcccaggcaggtgacaggggga

SEQ ID NO: 7770721 - DNA, 22 bp, Homo sapiens
tcccaggccacacttggggaac

SEQ ID NO: 7770722 - DNA, 16 bp, Homo sapiens
tcccaggccaggtgga

SEQ ID NO: 7770723 - DNA, 22 bp, Homo sapiens
tcccaggcgcctggtggggagc

SEQ ID NO: 7770724 - DNA, 22 bp, Homo sapiens
tcccaggccataaaactcagag

SEQ ID NO: 7770725 - DNA, 22 bp, Homo sapiens
tcccagcctcctgacagttttg

SEQ ID NO: 7770726 - DNA, 22 bp, Homo sapiens
tcccagcataacaaactgcccg

SEQ ID NO: 7770727 - DNA, 22 bp, Homo sapiens
tcccagcattaatgcctgtcag

SEQ ID NO: 7770728 - DNA, 22 bp, Homo sapiens
tcccagcattaatgcctgtcag

SEQ ID NO: 7770729 - DNA, 22 bp, Homo sapiens
tcccagccggtgcctgggtccc

SEQ ID NO: 7770730 - DNA, 22 bp, Homo sapiens
tcccaagatgacacagtggacg

SEQ ID NO: 7770731 - DNA, 22 bp, Homo sapiens
tcccaaagtcaagctgtgtctt

SEQ ID NO: 7770732 - DNA, 22 bp, Homo sapiens
tcccagagccaagctatggatg

SEQ ID NO: 7770733 - DNA, 22 bp, Homo sapiens
tccattatacttctgattcaaa

SEQ ID NO: 7770734 - DNA, 22 bp, Homo sapiens
tccatttactattctcatatcg

SEQ ID NO: 7770735 - DNA, 22 bp, Homo sapiens
tccattgtgattatatacaaaa

SEQ ID NO: 7770736 - DNA, 22 bp, Homo sapiens
tccattatacttctgattcaaa

SEQ ID NO: 7770737 - DNA, 22 bp, Homo sapiens
tccatggagatggatgactgta

SEQ ID NO: 7770738 - DNA, 22 bp, Homo sapiens
tccaggctgggctgaagggtgc

SEQ ID NO: 7770739 - DNA, 21 bp, Homo sapiens
tccagggaacttctcaggaat

SEQ ID NO: 7770740 - DNA, 22 bp, Homo sapiens
tccagggaagagcagaggctac

SEQ ID NO: 7770741 - DNA, 22 bp, Homo sapiens
tccagggaagagcagaggctac

SEQ ID NO: 7770742 - DNA, 22 bp, Homo sapiens
tccagggaagagcagaggctac

SEQ ID NO: 7770743 - DNA, 22 bp, Homo sapiens
tccagggaaggtgtgaggctgg

SEQ ID NO: 7770744 - DNA, 22 bp, Homo sapiens
tccagggacagcgctggagcta

SEQ ID NO: 7770745 - DNA, 22 bp, Homo sapiens
tccagggacacagagtccttct

SEQ ID NO: 7770746 - DNA, 19 bp, Homo sapiens
tccatgcccaggcaccaag

SEQ ID NO: 7770747 - DNA, 18 bp, Homo sapiens
tccagggcttcctcctct

SEQ ID NO: 7770748 - DNA, 22 bp, Homo sapiens
tccaggcctggctccattcagt

SEQ ID NO: 7770749 - DNA, 22 bp, Homo sapiens
tccaggcctctagccctctctt

SEQ ID NO: 7770750 - DNA, 22 bp, Homo sapiens
tccacaagatgataaagagagg

SEQ ID NO: 7770751 - DNA, 22 bp, Homo sapiens
tccacaaggcagctcctccagg

SEQ ID NO: 7770752 - DNA, 21 bp, Homo sapiens
tccacaagttagaaggaaatt

SEQ ID NO: 7770753 - DNA, 22 bp, Homo sapiens
tccaggctggacatgaggcggg

SEQ ID NO: 7770754 - DNA, 22 bp, Homo sapiens
tccaggctaggtttacaggaca

SEQ ID NO: 7770755 - DNA, 19 bp, Homo sapiens
tccctccctgtaatctcac

SEQ ID NO: 7770756 - DNA, 22 bp, Homo sapiens
tccctgaaacatctctgtggat

SEQ ID NO: 7770757 - DNA, 22 bp, Homo sapiens
tccctgaaatttgaagaggaat

SEQ ID NO: 7770758 - DNA, 22 bp, Homo sapiens
tccctgaagccagggaaggaag

SEQ ID NO: 7770759 - DNA, 22 bp, Homo sapiens
tccctgaatctcgaactagcct

SEQ ID NO: 7770760 - DNA, 22 bp, Homo sapiens
tccctgaaacataatagatgcc

SEQ ID NO: 7770761 - DNA, 22 bp, Homo sapiens
tccctgccctgccttcatggtt

SEQ ID NO: 7770762 - DNA, 22 bp, Homo sapiens
tccctgcctcctggcagtgcca

SEQ ID NO: 7770763 - DNA, 22 bp, Homo sapiens
tccctccccacttctgagcttt

SEQ ID NO: 7770764 - DNA, 23 bp, Homo sapiens
tcccagggaaggtgagcgaggct

SEQ ID NO: 7770765 - DNA, 22 bp, Homo sapiens
tcccaggctgggggcctgaagt

SEQ ID NO: 7770766 - DNA, 23 bp, Homo sapiens
tcccagggaaggtgagcgaggct

SEQ ID NO: 7770767 - DNA, 20 bp, Homo sapiens
tcccaggctgggctccagct

SEQ ID NO: 7770768 - DNA, 22 bp, Homo sapiens
tcccaggctggggccaggtgac

SEQ ID NO: 7770769 - DNA, 22 bp, Homo sapiens
tcccaggctggggccaggtgac

SEQ ID NO: 7770770 - DNA, 22 bp, Homo sapiens
tcccaggctaggcctctgcgtt

SEQ ID NO: 7770771 - DNA, 20 bp, Homo sapiens
tcccaggctccaccctagac

SEQ ID NO: 7770772 - DNA, 22 bp, Homo sapiens
tcccaggctaggcctctgcgtt

SEQ ID NO: 7770773 - DNA, 22 bp, Homo sapiens
tcccaggctaccagtgaggtca

SEQ ID NO: 7770774 - DNA, 20 bp, Homo sapiens
tcccaggctccaccctagac

SEQ ID NO: 7770775 - DNA, 20 bp, Homo sapiens
tcccaggctccaccctagac

SEQ ID NO: 7770776 - DNA, 22 bp, Homo sapiens
tcccaggctcttcaaggaagac

SEQ ID NO: 7770777 - DNA, 22 bp, Homo sapiens
tcccaggctggcaggcagcagt

SEQ ID NO: 7770778 - DNA, 22 bp, Homo sapiens
tccctcagattggcaattagat

SEQ ID NO: 7770779 - DNA, 22 bp, Homo sapiens
tcccagggacccagcctgatac

SEQ ID NO: 7770780 - DNA, 22 bp, Homo sapiens
tcccagggactggatgatgcag

SEQ ID NO: 7770781 - DNA, 22 bp, Homo sapiens
tcccgcttcttccgaatcgcga

SEQ ID NO: 7770782 - DNA, 22 bp, Homo sapiens
tccccttggcttggtcaagagg

SEQ ID NO: 7770783 - DNA, 22 bp, Homo sapiens
tccctggagataacttctggga

SEQ ID NO: 7770784 - DNA, 22 bp, Homo sapiens
tccctgggaccggcagctcaca

SEQ ID NO: 7770785 - DNA, 22 bp, Homo sapiens
tccctgggaccggcagctcaca

SEQ ID NO: 7770786 - DNA, 22 bp, Homo sapiens
tccctggcctggaaggatatca

SEQ ID NO: 7770787 - DNA, 22 bp, Homo sapiens
tcctagaatgcacctctgctgt

SEQ ID NO: 7770788 - DNA, 22 bp, Homo sapiens
tcctagcttgtcagttctctaa

SEQ ID NO: 7770789 - DNA, 22 bp, Homo sapiens
tcctagctggcctctcaccagc

SEQ ID NO: 7770790 - DNA, 20 bp, Homo sapiens
tcctagcttctctctgtaca

SEQ ID NO: 7770791 - DNA, 19 bp, Homo sapiens
tcctagcacctggcacata

SEQ ID NO: 7770792 - DNA, 22 bp, Homo sapiens
tcctagcctggtgagaaactgt

SEQ ID NO: 7770793 - DNA, 22 bp, Homo sapiens
tcctaggctccagaactgtgaa

SEQ ID NO: 7770794 - DNA, 22 bp, Homo sapiens
tccctgggagatgatgatgagg

SEQ ID NO: 7770795 - DNA, 22 bp, Homo sapiens
tccctgggcaagtttactcttc

SEQ ID NO: 7770796 - DNA, 22 bp, Homo sapiens
tcctcagcatggaatctggact

SEQ ID NO: 7770797 - DNA, 22 bp, Homo sapiens
tcctcagagcatagcgctgtct

SEQ ID NO: 7770798 - DNA, 22 bp, Homo sapiens
tcctcagatataaatgagggtg

SEQ ID NO: 7770799 - DNA, 22 bp, Homo sapiens
tcctcagggcggcctccgtctt

SEQ ID NO: 7770800 - DNA, 21 bp, Homo sapiens
tcctcagggccccagagcact

SEQ ID NO: 7770801 - DNA, 22 bp, Homo sapiens
tcctcagcattagcacagacat

SEQ ID NO: 7770802 - DNA, 22 bp, Homo sapiens
tcctcaggtcaaagcaggagaa

SEQ ID NO: 7770803 - DNA, 22 bp, Homo sapiens
tcctcaggtcaaagcaggagaa

SEQ ID NO: 7770804 - DNA, 22 bp, Homo sapiens
tcctcaggggtttcaggtgtac

SEQ ID NO: 7770805 - DNA, 19 bp, Homo sapiens
tcctcaggggctcacagac

SEQ ID NO: 7770806 - DNA, 22 bp, Homo sapiens
tcctcagggggccaacccagcc

SEQ ID NO: 7770807 - DNA, 22 bp, Homo sapiens
tcctcagaatggatggcagggg

SEQ ID NO: 7770808 - DNA, 22 bp, Homo sapiens
tcctcagaatcacctggcagct

SEQ ID NO: 7770809 - DNA, 22 bp, Homo sapiens
tcctcagaaacccctgtgaggt

SEQ ID NO: 7770810 - DNA, 22 bp, Homo sapiens
tcctcagaagaacccctagatt

SEQ ID NO: 7770811 - DNA, 22 bp, Homo sapiens
tcctcacagagtggcaggcaat

SEQ ID NO: 7770812 - DNA, 22 bp, Homo sapiens
tcctgcagccactgcaggcaga

SEQ ID NO: 7770813 - DNA, 22 bp, Homo sapiens
tcctgcagacctcagtcaggtc

SEQ ID NO: 7770814 - DNA, 22 bp, Homo sapiens
tcctgcaggcctgttcccagta

SEQ ID NO: 7770815 - DNA, 22 bp, Homo sapiens
tcctgcagctgaagctcatgtg

SEQ ID NO: 7770816 - DNA, 22 bp, Homo sapiens
tcctgcagctctgagaagcatc

SEQ ID NO: 7770817 - DNA, 22 bp, Homo sapiens
tcctgcctagcaggtgacctat

SEQ ID NO: 7770818 - DNA, 22 bp, Homo sapiens
tcctgcctagcaggtgacctat

SEQ ID NO: 7770819 - DNA, 22 bp, Homo sapiens
tcctgcctaccttgcggaggtg

SEQ ID NO: 7770820 - DNA, 22 bp, Homo sapiens
tcctgcctaccttgcggaggtg

SEQ ID NO: 7770821 - DNA, 22 bp, Homo sapiens
tcctgcctcaggctctggagta

SEQ ID NO: 7770822 - DNA, 22 bp, Homo sapiens
tcctgcctcacagttgaagttt

SEQ ID NO: 7770823 - DNA, 22 bp, Homo sapiens
tcctgcctcacagttgaagttt

SEQ ID NO: 7770824 - DNA, 22 bp, Homo sapiens
tcctgcctcaggctctggagta

SEQ ID NO: 7770825 - DNA, 22 bp, Homo sapiens
tcctgcctctccatgctaacta

SEQ ID NO: 7770826 - DNA, 22 bp, Homo sapiens
tcctgcctctccatgctaacta

SEQ ID NO: 7770827 - DNA, 22 bp, Homo sapiens
tcctgcctgagcgtggaggagg

SEQ ID NO: 7770828 - DNA, 22 bp, Homo sapiens
tcctgcctgagcgtggaggagg

SEQ ID NO: 7770829 - DNA, 22 bp, Homo sapiens
tcctgcctgcaatcccagcact

SEQ ID NO: 7770830 - DNA, 22 bp, Homo sapiens
tcctgcctgcaatcccagcact

SEQ ID NO: 7770831 - DNA, 22 bp, Homo sapiens
tcctgcctgcaatcccagcact

SEQ ID NO: 7770832 - DNA, 22 bp, Homo sapiens
tcctgcctcttgccttcttcac

SEQ ID NO: 7770833 - DNA, 22 bp, Homo sapiens
tcctgcctcttgccttcttcac

SEQ ID NO: 7770834 - DNA, 22 bp, Homo sapiens
tcctgcctcttttcttattcca

SEQ ID NO: 7770835 - DNA, 22 bp, Homo sapiens
tcctgcctcttttcttattcca

SEQ ID NO: 7770836 - DNA, 22 bp, Homo sapiens
tcctgagatgagacagtgctgc

SEQ ID NO: 7770837 - DNA, 23 bp, Homo sapiens
tcctgagatgagacagtgctgcc

SEQ ID NO: 7770838 - DNA, 22 bp, Homo sapiens
tcctgaaatgtgcacatgacat

SEQ ID NO: 7770839 - DNA, 22 bp, Homo sapiens
tcctgaaaaattacatgttcag

SEQ ID NO: 7770840 - DNA, 19 bp, Homo sapiens
tcctgaaaacttctggaat

SEQ ID NO: 7770841 - DNA, 22 bp, Homo sapiens
tcctcaggtgactaggtatctt

SEQ ID NO: 7770842 - DNA, 22 bp, Homo sapiens
tcctctggggcgtggtcctgga

SEQ ID NO: 7770843 - DNA, 22 bp, Homo sapiens
tcctctttctcaacattagtta

SEQ ID NO: 7770844 - DNA, 22 bp, Homo sapiens
tcctcttctgcccatcagaggc

SEQ ID NO: 7770845 - DNA, 22 bp, Homo sapiens
tcctcttctaagctcattcagg

SEQ ID NO: 7770846 - DNA, 22 bp, Homo sapiens
tcagaattggacaatagaagca

SEQ ID NO: 7770847 - DNA, 22 bp, Homo sapiens
tcagaattgtctggggaatgtt

SEQ ID NO: 7770848 - DNA, 22 bp, Homo sapiens
tcagaattggaacgtgaagatt

SEQ ID NO: 7770849 - DNA, 22 bp, Homo sapiens
tcagaattgtggagaaagggga

SEQ ID NO: 7770850 - DNA, 22 bp, Homo sapiens
tcagaatttaaaatgtgtagat

SEQ ID NO: 7770851 - DNA, 22 bp, Homo sapiens
tcagaattttggtttggttggt

SEQ ID NO: 7770852 - DNA, 22 bp, Homo sapiens
tcagaattttctggaatggagc

SEQ ID NO: 7770853 - DNA, 22 bp, Homo sapiens
tcagaattttaaaccaaggaaa

SEQ ID NO: 7770854 - DNA, 22 bp, Homo sapiens
tcagaattttctggaatggagc

SEQ ID NO: 7770855 - DNA, 22 bp, Homo sapiens
tcagaattcagagggagtgggg

SEQ ID NO: 7770856 - DNA, 22 bp, Homo sapiens
tcagaattctgaagggcacaaa

SEQ ID NO: 7770857 - DNA, 21 bp, Homo sapiens
tcagaattacccctggatctg

SEQ ID NO: 7770858 - DNA, 22 bp, Homo sapiens
tcagagttcctcatagatccag

SEQ ID NO: 7770859 - DNA, 18 bp, Homo sapiens
tcagacaagttagacagg

SEQ ID NO: 7770860 - DNA, 22 bp, Homo sapiens
tcagatggtactaatttaagga

SEQ ID NO: 7770861 - DNA, 22 bp, Homo sapiens
tcagatgttgaaaaggaaaagt

SEQ ID NO: 7770862 - DNA, 17 bp, Homo sapiens
tcagcaggggccaagct

SEQ ID NO: 7770863 - DNA, 22 bp, Homo sapiens
tcagcaggggccgttgggtgga

SEQ ID NO: 7770864 - DNA, 22 bp, Homo sapiens
tcagcagggctgggagctgtga

SEQ ID NO: 7770865 - DNA, 22 bp, Homo sapiens
tcagcagggctgggagctgtga

SEQ ID NO: 7770866 - DNA, 22 bp, Homo sapiens
tcagcagggctgtggtgtggct

SEQ ID NO: 7770867 - DNA, 22 bp, Homo sapiens
tcagcagggcatactgagccta

SEQ ID NO: 7770868 - DNA, 22 bp, Homo sapiens
tcagcagggcatactgagccta

SEQ ID NO: 7770869 - DNA, 22 bp, Homo sapiens
tcagcagggccatgctctctct

SEQ ID NO: 7770870 - DNA, 22 bp, Homo sapiens
tcagcagggcctccttgtgcag

SEQ ID NO: 7770871 - DNA, 22 bp, Homo sapiens
tcagcagggagaggagaatgca

SEQ ID NO: 7770872 - DNA, 22 bp, Homo sapiens
tcagcagggaggctctgtgccc

SEQ ID NO: 7770873 - DNA, 22 bp, Homo sapiens
tcagcaggcggttccttgtggg

SEQ ID NO: 7770874 - DNA, 22 bp, Homo sapiens
tcagcaggcccatcctccaggc

SEQ ID NO: 7770875 - DNA, 22 bp, Homo sapiens
tcagcaggcagtgggtcacaat

SEQ ID NO: 7770876 - DNA, 22 bp, Homo sapiens
tcagcaggctctggttgaccat

SEQ ID NO: 7770877 - DNA, 22 bp, Homo sapiens
tcagcaggctgtcagcaggggc

SEQ ID NO: 7770878 - DNA, 22 bp, Homo sapiens
tcagcaactatttatcaaattc

SEQ ID NO: 7770879 - DNA, 22 bp, Homo sapiens
tcagcaggcaggaggcatgcca

SEQ ID NO: 7770880 - DNA, 22 bp, Homo sapiens
tcagctgctctgttgagctgaa

SEQ ID NO: 7770881 - DNA, 22 bp, Homo sapiens
tcagcattgtggcagagaatgg

SEQ ID NO: 7770882 - DNA, 22 bp, Homo sapiens
tcagccagaggcttcttggttt

SEQ ID NO: 7770883 - DNA, 19 bp, Homo sapiens
tcagcatcaatttggtcct

SEQ ID NO: 7770884 - DNA, 18 bp, Homo sapiens
tcaggagacacagacgca

SEQ ID NO: 7770885 - DNA, 22 bp, Homo sapiens
tcaggacatttgtcagcaggag

SEQ ID NO: 7770886 - DNA, 22 bp, Homo sapiens
tcaggacagttccctgcaaatt

SEQ ID NO: 7770887 - DNA, 22 bp, Homo sapiens
tcaggacagggatcacatcatc

SEQ ID NO: 7770888 - DNA, 22 bp, Homo sapiens
tcaggacaggttcgggtgggta

SEQ ID NO: 7770889 - DNA, 22 bp, Homo sapiens
tcaggacagccagggtgcagac

SEQ ID NO: 7770890 - DNA, 22 bp, Homo sapiens
tcaggacagagatcagaacttc

SEQ ID NO: 7770891 - DNA, 22 bp, Homo sapiens
tcaggacagactagactagcgt

SEQ ID NO: 7770892 - DNA, 22 bp, Homo sapiens
tcaggacaccctgtgcttcctt

SEQ ID NO: 7770893 - DNA, 22 bp, Homo sapiens
tcaggacaatagtgatttttac

SEQ ID NO: 7770894 - DNA, 22 bp, Homo sapiens
tcaggacaacatgttgctaatc

SEQ ID NO: 7770895 - DNA, 22 bp, Homo sapiens
tcaggacaacaagacttgttta

SEQ ID NO: 7770896 - DNA, 22 bp, Homo sapiens
tcaggacaacctgttttcagac

SEQ ID NO: 7770897 - DNA, 22 bp, Homo sapiens
tcaggacacttggcacaaggtc

SEQ ID NO: 7770898 - DNA, 22 bp, Homo sapiens
tcaggacagaaggctgccaggg

SEQ ID NO: 7770899 - DNA, 22 bp, Homo sapiens
tcaggaagggtggtccacaggg

SEQ ID NO: 7770900 - DNA, 21 bp, Homo sapiens
tcagctgtagagattacattc

SEQ ID NO: 7770901 - DNA, 22 bp, Homo sapiens
tcactgcaacctccacctcctg

SEQ ID NO: 7770902 - DNA, 22 bp, Homo sapiens
tcactgcgcttcagcctgggtg

SEQ ID NO: 7770903 - DNA, 22 bp, Homo sapiens
tcactgcaacctccacctcctg

SEQ ID NO: 7770904 - DNA, 22 bp, Homo sapiens
tcactgcaacctccacctcctg

SEQ ID NO: 7770905 - DNA, 22 bp, Homo sapiens
tcactgcaacctccacctcccg

SEQ ID NO: 7770906 - DNA, 23 bp, Homo sapiens
tcactgctactcagcctgagatt

SEQ ID NO: 7770907 - DNA, 22 bp, Homo sapiens
tcagaaaatgaaatggactctc

SEQ ID NO: 7770908 - DNA, 22 bp, Homo sapiens
tcactgcaacctccacctcccg

SEQ ID NO: 7770909 - DNA, 22 bp, Homo sapiens
tcactgcaacctccacctcccg

SEQ ID NO: 7770910 - DNA, 22 bp, Homo sapiens
tcactgcaacctccacctcccg

SEQ ID NO: 7770911 - DNA, 22 bp, Homo sapiens
tcacattttatctattttaagt

SEQ ID NO: 7770912 - DNA, 22 bp, Homo sapiens
tcacattttatatctctggttt

SEQ ID NO: 7770913 - DNA, 22 bp, Homo sapiens
tcacatttggagaaagcctgcc

SEQ ID NO: 7770914 - DNA, 22 bp, Homo sapiens
tcacatttgctatcccactcct

SEQ ID NO: 7770915 - DNA, 22 bp, Homo sapiens
tcacatttgcaattgcattgtt

SEQ ID NO: 7770916 - DNA, 22 bp, Homo sapiens
tcacatttgttcttgaatctaa

SEQ ID NO: 7770917 - DNA, 22 bp, Homo sapiens
tcacattttagtaccatgattt

SEQ ID NO: 7770918 - DNA, 22 bp, Homo sapiens
tcacatttgtgttttattagag

SEQ ID NO: 7770919 - DNA, 22 bp, Homo sapiens
tcacatttgttcctctgcactt

SEQ ID NO: 7770920 - DNA, 22 bp, Homo sapiens
tcagaaagacgaaacagatggg

SEQ ID NO: 7770921 - DNA, 22 bp, Homo sapiens
tcagaaaggagttagaggtctc

SEQ ID NO: 7770922 - DNA, 22 bp, Homo sapiens
tcagaaaggccacatggtgcag

SEQ ID NO: 7770923 - DNA, 22 bp, Homo sapiens
tcagaatctttctagagtctag

SEQ ID NO: 7770924 - DNA, 22 bp, Homo sapiens
tcagaatctgcatttaacaaaa

SEQ ID NO: 7770925 - DNA, 22 bp, Homo sapiens
tcagaatctgaaaagcgcttgg

SEQ ID NO: 7770926 - DNA, 22 bp, Homo sapiens
tcagaatctctggaggcttggc

SEQ ID NO: 7770927 - DNA, 22 bp, Homo sapiens
tcagaatctaaataggctccag

SEQ ID NO: 7770928 - DNA, 22 bp, Homo sapiens
tcagaatatgctaatgacattt

SEQ ID NO: 7770929 - DNA, 22 bp, Homo sapiens
tcagaatatattcatgttgtca

SEQ ID NO: 7770930 - DNA, 22 bp, Homo sapiens
tcagaagtttcaatcccagctg

SEQ ID NO: 7770931 - DNA, 22 bp, Homo sapiens
tcagaagttgataaagtagttg

SEQ ID NO: 7770932 - DNA, 22 bp, Homo sapiens
tcagaagccggaagtgctcctc

SEQ ID NO: 7770933 - DNA, 22 bp, Homo sapiens
tcagaagccggaagtgctcctc

SEQ ID NO: 7770934 - DNA, 22 bp, Homo sapiens
tcagaagctaaatttgatattt

SEQ ID NO: 7770935 - DNA, 22 bp, Homo sapiens
tcagaagttaatacgaggagaa

SEQ ID NO: 7770936 - DNA, 22 bp, Homo sapiens
tcaaatgaggctgatgaatgtg

SEQ ID NO: 7770937 - DNA, 22 bp, Homo sapiens
tcaaatgaggctgatgaatgtg

SEQ ID NO: 7770938 - DNA, 22 bp, Homo sapiens
tcaacactaaagaataatcttt

SEQ ID NO: 7770939 - DNA, 22 bp, Homo sapiens
tcaacagaagtgatagctatta

SEQ ID NO: 7770940 - DNA, 22 bp, Homo sapiens
tcaagaaactgtgctacagagt

SEQ ID NO: 7770941 - DNA, 22 bp, Homo sapiens
tcaagaaactgtgctacagagt

SEQ ID NO: 7770942 - DNA, 22 bp, Homo sapiens
tcaacttggctttttaaagtcc

SEQ ID NO: 7770943 - DNA, 22 bp, Homo sapiens
tcacagtatcacacaaggatta

SEQ ID NO: 7770944 - DNA, 22 bp, Homo sapiens
tcaagaaatgtgcttggatata

SEQ ID NO: 7770945 - DNA, 22 bp, Homo sapiens
tcaagaaagggcttcaccagga

SEQ ID NO: 7770946 - DNA, 22 bp, Homo sapiens
tcacagtattcatgaacatgga

SEQ ID NO: 7770947 - DNA, 23 bp, Homo sapiens
tcacataatccttcatccacagg

SEQ ID NO: 7770948 - DNA, 22 bp, Homo sapiens
tcacatactgaaagtccagtga

SEQ ID NO: 7770949 - DNA, 22 bp, Homo sapiens
tcacatacactaggatattttt

SEQ ID NO: 7770950 - DNA, 22 bp, Homo sapiens
tcacataaattatacaatttca

SEQ ID NO: 7770951 - DNA, 22 bp, Homo sapiens
tcacataaattatacaatttca

SEQ ID NO: 7770952 - DNA, 22 bp, Homo sapiens
tcacagttttagaaaatagata

SEQ ID NO: 7770953 - DNA, 22 bp, Homo sapiens
tcacagtttcttttctgataaa

SEQ ID NO: 7770954 - DNA, 18 bp, Homo sapiens
tcacagtgctcttgccta

SEQ ID NO: 7770955 - DNA, 22 bp, Homo sapiens
tcacatgcttgaggaaagaaaa

SEQ ID NO: 7770956 - DNA, 22 bp, Homo sapiens
tcacatttatttcaaagttact

SEQ ID NO: 7770957 - DNA, 23 bp, Homo sapiens
tcacatttaacccctcagacctc

SEQ ID NO: 7770958 - DNA, 22 bp, Homo sapiens
tcacatttatactccatttgca

SEQ ID NO: 7770959 - DNA, 22 bp, Homo sapiens
tcacatttaaacaggaggatta

SEQ ID NO: 7770960 - DNA, 22 bp, Homo sapiens
tcacatttctttatgtagtctt

SEQ ID NO: 7770961 - DNA, 22 bp, Homo sapiens
tcacatttgataatgcccattg

SEQ ID NO: 7770962 - DNA, 22 bp, Homo sapiens
tcacatttctgattataccaaa

SEQ ID NO: 7770963 - DNA, 21 bp, Homo sapiens
tcacatttctcatgggtaaat

SEQ ID NO: 7770964 - DNA, 21 bp, Homo sapiens
tcacatttctcatgggtaaat

SEQ ID NO: 7770965 - DNA, 22 bp, Homo sapiens
tcacatttcacatgggaggagg

SEQ ID NO: 7770966 - DNA, 22 bp, Homo sapiens
tcacatttcgcatcagtccgat

SEQ ID NO: 7770967 - DNA, 22 bp, Homo sapiens
tcacatttctcagcactgatga

SEQ ID NO: 7770968 - DNA, 22 bp, Homo sapiens
tcacatttcaagtgctcaaaag

SEQ ID NO: 7770969 - DNA, 22 bp, Homo sapiens
tcacatttatttcaaagttact

SEQ ID NO: 7770970 - DNA, 22 bp, Homo sapiens
tcacatttatttcaaagttact

SEQ ID NO: 7770971 - DNA, 18 bp, Homo sapiens
tcagtattacctcaggca

SEQ ID NO: 7770972 - DNA, 22 bp, Homo sapiens
tcagtattcctggaaatacaag

SEQ ID NO: 7770973 - DNA, 22 bp, Homo sapiens
tcagtgttcttatttaattagg

SEQ ID NO: 7770974 - DNA, 22 bp, Homo sapiens
tcagtgtttattcaatgttatt

SEQ ID NO: 7770975 - DNA, 22 bp, Homo sapiens
tcagtgttggtcaagaatcagt

SEQ ID NO: 7770976 - DNA, 22 bp, Homo sapiens
tcataaagttacccaaatttta

SEQ ID NO: 7770977 - DNA, 22 bp, Homo sapiens
tcataaagttctaagaattgta

SEQ ID NO: 7770978 - DNA, 22 bp, Homo sapiens
tcataaagttgttttaatggga

SEQ ID NO: 7770979 - DNA, 22 bp, Homo sapiens
tcataaagttacccaaatttta

SEQ ID NO: 7770980 - DNA, 22 bp, Homo sapiens
tcataaatcatactccatttgc

SEQ ID NO: 7770981 - DNA, 22 bp, Homo sapiens
tcataaatcatactccatttgc

SEQ ID NO: 7770982 - DNA, 23 bp, Homo sapiens
tcataaatattagcacagtagga

SEQ ID NO: 7770983 - DNA, 22 bp, Homo sapiens
tcataaatcatactccatttgc

SEQ ID NO: 7770984 - DNA, 22 bp, Homo sapiens
tcagtgtttgtggcaaatgtta

SEQ ID NO: 7770985 - DNA, 18 bp, Homo sapiens
tcatagaagtgaatcaga

SEQ ID NO: 7770986 - DNA, 22 bp, Homo sapiens
tcatagaatgagttaatgaact

SEQ ID NO: 7770987 - DNA, 22 bp, Homo sapiens
tcatacattcagcagatatttg

SEQ ID NO: 7770988 - DNA, 22 bp, Homo sapiens
tcatacattcagcagatatttg

SEQ ID NO: 7770989 - DNA, 22 bp, Homo sapiens
tcatagaaatggaaagtatatt

SEQ ID NO: 7770990 - DNA, 22 bp, Homo sapiens
tcatacatcttgtatatctatc

SEQ ID NO: 7770991 - DNA, 22 bp, Homo sapiens
tcataaattgattatgtgcttt

SEQ ID NO: 7770992 - DNA, 22 bp, Homo sapiens
tcataaattgattatgtgcttt

SEQ ID NO: 7770993 - DNA, 22 bp, Homo sapiens
tcataaattatctatttggcta

SEQ ID NO: 7770994 - DNA, 22 bp, Homo sapiens
tcataaattgattatgtgcttt

SEQ ID NO: 7770995 - DNA, 22 bp, Homo sapiens
tcataaattctggtgctgtgag

SEQ ID NO: 7770996 - DNA, 22 bp, Homo sapiens
tcataaattagctgtctttgaa

SEQ ID NO: 7770997 - DNA, 22 bp, Homo sapiens
tcatcttctattaatagggaga

SEQ ID NO: 7770998 - DNA, 22 bp, Homo sapiens
tcatctgggagcttgttagaaa

SEQ ID NO: 7770999 - DNA, 22 bp, Homo sapiens
tcatgaaaatagatcagaaatt

SEQ ID NO: 7771000 - DNA, 22 bp, Homo sapiens
tcatctttcctcaaaagatcca

SEQ ID NO: 7771001 - DNA, 22 bp, Homo sapiens
tcatcttgctgccattgcttta

SEQ ID NO: 7771002 - DNA, 22 bp, Homo sapiens
tcagggctgcatacaggagata

SEQ ID NO: 7771003 - DNA, 22 bp, Homo sapiens
tcagggcatactcttcaaggtc

SEQ ID NO: 7771004 - DNA, 22 bp, Homo sapiens
tcagtaaatgaatgaatatatg

SEQ ID NO: 7771005 - DNA, 22 bp, Homo sapiens
tcagtaaatgagcaaaaatttc

SEQ ID NO: 7771006 - DNA, 22 bp, Homo sapiens
tcagtaaaattacagatctaca

SEQ ID NO: 7771007 - DNA, 22 bp, Homo sapiens
tcagtaaataactcagatgctc

SEQ ID NO: 7771008 - DNA, 22 bp, Homo sapiens
tcagtagttcagcaaatatttt

SEQ ID NO: 7771009 - DNA, 23 bp, Homo sapiens
tcagtagtgcattgaataagtgc

SEQ ID NO: 7771010 - DNA, 22 bp, Homo sapiens
tcagggcaggcgagcagctgct

SEQ ID NO: 7771011 - DNA, 18 bp, Homo sapiens
tcaggctttgagagaatc

SEQ ID NO: 7771012 - DNA, 22 bp, Homo sapiens
tcagggcaggttaacttgggtg

SEQ ID NO: 7771013 - DNA, 21 bp, Homo sapiens
tcagggcagtgggaggttcct

SEQ ID NO: 7771014 - DNA, 19 bp, Homo sapiens
tcagggcagtccggtcccc

SEQ ID NO: 7771015 - DNA, 22 bp, Homo sapiens
tcaggcttgtctctagagcaat

SEQ ID NO: 7771016 - DNA, 22 bp, Homo sapiens
tcaggctgtagggcccctggag

SEQ ID NO: 7771017 - DNA, 22 bp, Homo sapiens
tcaggcttccaacaatgatgtt

SEQ ID NO: 7771018 - DNA, 22 bp, Homo sapiens
tcaggctgttcctgtccaaaat

SEQ ID NO: 7771019 - DNA, 22 bp, Homo sapiens
tcaggctgtatatcttgcactc

SEQ ID NO: 7771020 - DNA, 17 bp, Homo sapiens
tcaggctgggtgcagtg

SEQ ID NO: 7771021 - DNA, 21 bp, Homo sapiens
tcaggagagcccatctacaaa

SEQ ID NO: 7771022 - DNA, 17 bp, Homo sapiens
tcaggctgggtgcagtg

SEQ ID NO: 7771023 - DNA, 22 bp, Homo sapiens
tcaggagacttatgtcacagtg

SEQ ID NO: 7771024 - DNA, 22 bp, Homo sapiens
tcaggctgtaaatggtgtgggt

SEQ ID NO: 7771025 - DNA, 22 bp, Homo sapiens
tcaggctggtggtcagatggct

SEQ ID NO: 7771026 - DNA, 22 bp, Homo sapiens
tcaggctggtggtcagatggct

SEQ ID NO: 7771027 - DNA, 20 bp, Homo sapiens
tcaggctggtgggctttccc

SEQ ID NO: 7771028 - DNA, 22 bp, Homo sapiens
tcaggctggtccccacagtgga

SEQ ID NO: 7771029 - DNA, 22 bp, Homo sapiens
tcatttacacttcacaaatgga

SEQ ID NO: 7771030 - DNA, 22 bp, Homo sapiens
tcatttaattggttttgctcgt

SEQ ID NO: 7771031 - DNA, 22 bp, Homo sapiens
tcatttacagactgtgtgggtg

SEQ ID NO: 7771032 - DNA, 22 bp, Homo sapiens
tcatttacttctatgacaacat

SEQ ID NO: 7771033 - DNA, 22 bp, Homo sapiens
tcatttatagctaaccttgaat

SEQ ID NO: 7771034 - DNA, 22 bp, Homo sapiens
tcattgtattcagaactgaaga

SEQ ID NO: 7771035 - DNA, 22 bp, Homo sapiens
tcattgtattaaaatattggtt

SEQ ID NO: 7771036 - DNA, 22 bp, Homo sapiens
tcattgtatactttatttatga

SEQ ID NO: 7771037 - DNA, 22 bp, Homo sapiens
tcattgtagggcatttagagag

SEQ ID NO: 7771038 - DNA, 22 bp, Homo sapiens
tcatttatcatttgtgctgtag

SEQ ID NO: 7771039 - DNA, 22 bp, Homo sapiens
tcatttatcatttgtgctgtag

SEQ ID NO: 7771040 - DNA, 22 bp, Homo sapiens
tcatttatcatttgtgctgtag

SEQ ID NO: 7771041 - DNA, 22 bp, Homo sapiens
tcatttcagccatttttaaatg

SEQ ID NO: 7771042 - DNA, 22 bp, Homo sapiens
tcatttcagccatttttaaatg

SEQ ID NO: 7771043 - DNA, 22 bp, Homo sapiens
tcatttctatctatgcagcttc

SEQ ID NO: 7771044 - DNA, 22 bp, Homo sapiens
tcatttgggtcagttttccata

SEQ ID NO: 7771045 - DNA, 22 bp, Homo sapiens
tcatttcttaactagagtgaac

SEQ ID NO: 7771046 - DNA, 22 bp, Homo sapiens
tcatttctgttgtgcatcactg

SEQ ID NO: 7771047 - DNA, 22 bp, Homo sapiens
tcatttctgttgtgcatcactg

SEQ ID NO: 7771048 - DNA, 22 bp, Homo sapiens
tcatttctgttgtgcatcactg

SEQ ID NO: 7771049 - DNA, 22 bp, Homo sapiens
tcatttctcctaagtgaaatat

SEQ ID NO: 7771050 - DNA, 22 bp, Homo sapiens
tcatttctccgacctgctgtcc

SEQ ID NO: 7771051 - DNA, 22 bp, Homo sapiens
tcatttctattgctactgtctg

SEQ ID NO: 7771052 - DNA, 22 bp, Homo sapiens
tccaatatttctcatatatgga

SEQ ID NO: 7771053 - DNA, 20 bp, Homo sapiens
tccaattaaaaattgtatgc

SEQ ID NO: 7771054 - DNA, 22 bp, Homo sapiens
tccaaggacgctggacccctgc

SEQ ID NO: 7771055 - DNA, 22 bp, Homo sapiens
tcattttttgcatacctgtgtc

SEQ ID NO: 7771056 - DNA, 22 bp, Homo sapiens
tcatttttcacacagggtcacc

SEQ ID NO: 7771057 - DNA, 22 bp, Homo sapiens
tcatttgtgctgtcagcatgca

SEQ ID NO: 7771058 - DNA, 22 bp, Homo sapiens
tcatttgttacagccacatacc

SEQ ID NO: 7771059 - DNA, 21 bp, Homo sapiens
tcatttttattgctaccttgc

SEQ ID NO: 7771060 - DNA, 21 bp, Homo sapiens
tcatttttattgctaccttgc

SEQ ID NO: 7771061 - DNA, 22 bp, Homo sapiens
tcatttttagcgcgcaaaagtt

SEQ ID NO: 7771062 - DNA, 22 bp, Homo sapiens
tccaaagccgactgacatctga

SEQ ID NO: 7771063 - DNA, 22 bp, Homo sapiens
tccaaatacatttactgtattt

SEQ ID NO: 7771064 - DNA, 22 bp, Homo sapiens
tccaaaggaagaggctgtcagt

SEQ ID NO: 7771065 - DNA, 22 bp, Homo sapiens
gtgaaaaatgatttgttaactg

SEQ ID NO: 7771066 - DNA, 22 bp, Homo sapiens
gtgaaaaatcatcatgacttga

SEQ ID NO: 7771067 - DNA, 22 bp, Homo sapiens
gtctttatttgagattgtcatt

SEQ ID NO: 7771068 - DNA, 22 bp, Homo sapiens
gtgagcatatatgtaatcgttt

SEQ ID NO: 7771069 - DNA, 22 bp, Homo sapiens
gtgagccaataccatgctgttc

SEQ ID NO: 7771070 - DNA, 22 bp, Homo sapiens
gtgaggagggctggtcccaggc

SEQ ID NO: 7771071 - DNA, 22 bp, Homo sapiens
gtgaggagctgacactggggtg

SEQ ID NO: 7771072 - DNA, 22 bp, Homo sapiens
gtctccagatatcctacacaac

SEQ ID NO: 7771073 - DNA, 22 bp, Homo sapiens
gtctccagcccactctagatat

SEQ ID NO: 7771074 - DNA, 22 bp, Homo sapiens
gtctccagaattcttgggaggg

SEQ ID NO: 7771075 - DNA, 22 bp, Homo sapiens
gtctatgatattttgttatagc

SEQ ID NO: 7771076 - DNA, 22 bp, Homo sapiens
gtctatgatattttgttatagc

SEQ ID NO: 7771077 - DNA, 22 bp, Homo sapiens
gtctagggctcctcagtgacaa

SEQ ID NO: 7771078 - DNA, 22 bp, Homo sapiens
gtctacaaagcatataaaagag

SEQ ID NO: 7771079 - DNA, 22 bp, Homo sapiens
gtctaaactttacagagtcaag

SEQ ID NO: 7771080 - DNA, 22 bp, Homo sapiens
gtctaaacttagggatcgaaca

SEQ ID NO: 7771081 - DNA, 22 bp, Homo sapiens
gtctcccaatccgggacagcct

SEQ ID NO: 7771082 - DNA, 22 bp, Homo sapiens
gtctccagggctgctggcgcct

SEQ ID NO: 7771083 - DNA, 22 bp, Homo sapiens
gtctccagtgttcaggtgactg

SEQ ID NO: 7771084 - DNA, 22 bp, Homo sapiens
gtctttatatttactaaagaat

SEQ ID NO: 7771085 - DNA, 21 bp, Homo sapiens
gtctttaaaaaaggctgatac

SEQ ID NO: 7771086 - DNA, 22 bp, Homo sapiens
gtctttagttgaaacatgtggt

SEQ ID NO: 7771087 - DNA, 22 bp, Homo sapiens
gtctttagagctcctggcatct

SEQ ID NO: 7771088 - DNA, 17 bp, Homo sapiens
gtgcagggatgaaggat

SEQ ID NO: 7771089 - DNA, 22 bp, Homo sapiens
gtgcagggcagccgaatgggct

SEQ ID NO: 7771090 - DNA, 22 bp, Homo sapiens
gtgccagagtttgaggacaatt

SEQ ID NO: 7771091 - DNA, 22 bp, Homo sapiens
gtgccagaggccccaaacaagt

SEQ ID NO: 7771092 - DNA, 22 bp, Homo sapiens
gtgccagagacatgactagctg

SEQ ID NO: 7771093 - DNA, 22 bp, Homo sapiens
gtgccagagattcctaaacttt

SEQ ID NO: 7771094 - DNA, 22 bp, Homo sapiens
gtgccagaaggttcccgctgca

SEQ ID NO: 7771095 - DNA, 23 bp, Homo sapiens
gtgctgcaaaatcggccactgca

SEQ ID NO: 7771096 - DNA, 22 bp, Homo sapiens
gtgctgcagggtcagcaccctc

SEQ ID NO: 7771097 - DNA, 20 bp, Homo sapiens
gtgctggagttaggaaaggt

SEQ ID NO: 7771098 - DNA, 22 bp, Homo sapiens
gtgctggaccctggaaggtggt

SEQ ID NO: 7771099 - DNA, 22 bp, Homo sapiens
gtgctggaactgtgctaagaga

SEQ ID NO: 7771100 - DNA, 22 bp, Homo sapiens
gtgccagggggcactgaacaga

SEQ ID NO: 7771101 - DNA, 22 bp, Homo sapiens
gtgccaggtgctaagctgtgct

SEQ ID NO: 7771102 - DNA, 22 bp, Homo sapiens
gtgccaggtgctaagctgtgct

SEQ ID NO: 7771103 - DNA, 22 bp, Homo sapiens
gtgcccagctccacctcacaga

SEQ ID NO: 7771104 - DNA, 22 bp, Homo sapiens
gtgcccagctccacctcacaga

SEQ ID NO: 7771105 - DNA, 22 bp, Homo sapiens
gtgccagccgcaccccaggaga

SEQ ID NO: 7771106 - DNA, 22 bp, Homo sapiens
gtgccagcctggtgcgcctggg

SEQ ID NO: 7771107 - DNA, 22 bp, Homo sapiens
gtgccagccgcaccccaggaga

SEQ ID NO: 7771108 - DNA, 22 bp, Homo sapiens
gtgccagctctccccacatctg

SEQ ID NO: 7771109 - DNA, 22 bp, Homo sapiens
gtgccagctctccccacatctg

SEQ ID NO: 7771110 - DNA, 22 bp, Homo sapiens
gtagttctgcagtgtcacctga

SEQ ID NO: 7771111 - DNA, 22 bp, Homo sapiens
gtatacagatacttagacgtgc

SEQ ID NO: 7771112 - DNA, 22 bp, Homo sapiens
gtatacaactattgttgggtaa

SEQ ID NO: 7771113 - DNA, 22 bp, Homo sapiens
gtattttatggcctggggccta

SEQ ID NO: 7771114 - DNA, 22 bp, Homo sapiens
gtattttcaagagcagtagtat

SEQ ID NO: 7771115 - DNA, 22 bp, Homo sapiens
gtatttttaggtaaggaaagta

SEQ ID NO: 7771116 - DNA, 22 bp, Homo sapiens
gtatttttaggtaaggaaagta

SEQ ID NO: 7771117 - DNA, 22 bp, Homo sapiens
gtatttttaggtaaggaaagta

SEQ ID NO: 7771118 - DNA, 22 bp, Homo sapiens
gtcaaataattttctcaatagt

SEQ ID NO: 7771119 - DNA, 22 bp, Homo sapiens
gtcaaataattttctcaatagt

SEQ ID NO: 7771120 - DNA, 22 bp, Homo sapiens
gtcaaatatactaagaggtaaa

SEQ ID NO: 7771121 - DNA, 22 bp, Homo sapiens
gtcaaatatactaagaggtaaa

SEQ ID NO: 7771122 - DNA, 22 bp, Homo sapiens
gtcaaatatatgcaaaactatt

SEQ ID NO: 7771123 - DNA, 22 bp, Homo sapiens
gtcaaatattatgcagcttgga

SEQ ID NO: 7771124 - DNA, 22 bp, Homo sapiens
gtcaaatattatgcagcttgga

SEQ ID NO: 7771125 - DNA, 22 bp, Homo sapiens
gtcaaatattatgcagcttgga

SEQ ID NO: 7771126 - DNA, 22 bp, Homo sapiens
gtcaaatatatgcaaaactatt

SEQ ID NO: 7771127 - DNA, 22 bp, Homo sapiens
gtcaaatatatgcaaaactatt

SEQ ID NO: 7771128 - DNA, 22 bp, Homo sapiens
gtcaacaaagaaaattgttaat

SEQ ID NO: 7771129 - DNA, 22 bp, Homo sapiens
gtcaccattgcccactccatgg

SEQ ID NO: 7771130 - DNA, 22 bp, Homo sapiens
gtcaccatggataagaatcact

SEQ ID NO: 7771131 - DNA, 22 bp, Homo sapiens
gtcaaaaagtagtcatttctgt

SEQ ID NO: 7771132 - DNA, 22 bp, Homo sapiens
gtatttttcattccaagtgaga

SEQ ID NO: 7771133 - DNA, 22 bp, Homo sapiens
gtatttttagtagagtcggggt

SEQ ID NO: 7771134 - DNA, 22 bp, Homo sapiens
gtatttttaggtaaggaaagta

SEQ ID NO: 7771135 - DNA, 22 bp, Homo sapiens
gtagtctgaacagtaattttgt

SEQ ID NO: 7771136 - DNA, 22 bp, Homo sapiens
gtagtctgaacagtaattttgt

SEQ ID NO: 7771137 - DNA, 22 bp, Homo sapiens
gtacaataactagtcttatagt

SEQ ID NO: 7771138 - DNA, 22 bp, Homo sapiens
gtacaattaagtgcacaaatag

SEQ ID NO: 7771139 - DNA, 22 bp, Homo sapiens
gtacaattatttaaatggtgaa

SEQ ID NO: 7771140 - DNA, 22 bp, Homo sapiens
gtaggagcattgagggtatgga

SEQ ID NO: 7771141 - DNA, 22 bp, Homo sapiens
gtacaagtgtatttggcttgat

SEQ ID NO: 7771142 - DNA, 22 bp, Homo sapiens
gtacaagttgcctaccttaagt

SEQ ID NO: 7771143 - DNA, 22 bp, Homo sapiens
gtacaataactagtcttatagt

SEQ ID NO: 7771144 - DNA, 22 bp, Homo sapiens
gtacaaatacattctgaaggta

SEQ ID NO: 7771145 - DNA, 22 bp, Homo sapiens
gtacaaaagttattgcggtttt

SEQ ID NO: 7771146 - DNA, 22 bp, Homo sapiens
gtacaaaagttattgcggtttt

SEQ ID NO: 7771147 - DNA, 22 bp, Homo sapiens
gtcctctgtccctggggcacgg

SEQ ID NO: 7771148 - DNA, 22 bp, Homo sapiens
gtcctctgggctttgagcagtc

SEQ ID NO: 7771149 - DNA, 22 bp, Homo sapiens
gtcctggagtggcatggcatgg

SEQ ID NO: 7771150 - DNA, 22 bp, Homo sapiens
gtcctgcacatggagggcaatg

SEQ ID NO: 7771151 - DNA, 22 bp, Homo sapiens
gtcctgcggcctcagtggtgag

SEQ ID NO: 7771152 - DNA, 22 bp, Homo sapiens
gtcctggcccactggcaggctg

SEQ ID NO: 7771153 - DNA, 22 bp, Homo sapiens
gtcctgggaactggacagctaa

SEQ ID NO: 7771154 - DNA, 22 bp, Homo sapiens
gtctaaacctcaaatcagtgtc

SEQ ID NO: 7771155 - DNA, 22 bp, Homo sapiens
gtctaaacacaatgcaagaagt

SEQ ID NO: 7771156 - DNA, 22 bp, Homo sapiens
gtccaggctgcccagggtcctg

SEQ ID NO: 7771157 - DNA, 22 bp, Homo sapiens
gtccagggaaatagcgacaggg

SEQ ID NO: 7771158 - DNA, 23 bp, Homo sapiens
gtcctctggagagaaaggcagta

SEQ ID NO: 7771159 - DNA, 22 bp, Homo sapiens
gtccaggccatggtggacacag

SEQ ID NO: 7771160 - DNA, 22 bp, Homo sapiens
gtccaggccatggtggacacag

SEQ ID NO: 7771161 - DNA, 22 bp, Homo sapiens
gtccaggagctcagggcttatt

SEQ ID NO: 7771162 - DNA, 22 bp, Homo sapiens
gtccagcctgaagagtgggggc

SEQ ID NO: 7771163 - DNA, 22 bp, Homo sapiens
gtccagccaggctgcagcaccc

SEQ ID NO: 7771164 - DNA, 22 bp, Homo sapiens
gtccagcccctgactcccaggc

SEQ ID NO: 7771165 - DNA, 22 bp, Homo sapiens
gtccagcccctgactcccaggc

SEQ ID NO: 7771166 - DNA, 22 bp, Homo sapiens
gtccagcccgggctccgccagc

SEQ ID NO: 7771167 - DNA, 22 bp, Homo sapiens
gtccagcccgggctccgccagc

SEQ ID NO: 7771168 - DNA, 22 bp, Homo sapiens
gtccagccctctgcctccaggt

SEQ ID NO: 7771169 - DNA, 22 bp, Homo sapiens
gtccagccctctgcctccaggt

SEQ ID NO: 7771170 - DNA, 21 bp, Homo sapiens
gtcagagatgcccaactgcct

SEQ ID NO: 7771171 - DNA, 22 bp, Homo sapiens
gtcagaggaatggatgagtgat

SEQ ID NO: 7771172 - DNA, 20 bp, Homo sapiens
gtcagaggaccctagagcga

SEQ ID NO: 7771173 - DNA, 22 bp, Homo sapiens
gtcagaggaggctgagtaggaa

SEQ ID NO: 7771174 - DNA, 22 bp, Homo sapiens
gtcagaggaggctgagtaggaa

SEQ ID NO: 7771175 - DNA, 22 bp, Homo sapiens
gtccagagagatcttctgatag

SEQ ID NO: 7771176 - DNA, 21 bp, Homo sapiens
gtccagagagccggctcctga

SEQ ID NO: 7771177 - DNA, 19 bp, Homo sapiens
gtcaccatttccaaatgcc

SEQ ID NO: 7771178 - DNA, 22 bp, Homo sapiens
gtcactgtatccaggttccagc

SEQ ID NO: 7771179 - DNA, 22 bp, Homo sapiens
gtcactggggccacatgcagaa

SEQ ID NO: 7771180 - DNA, 22 bp, Homo sapiens
gtcactggaattacaggcatgc

SEQ ID NO: 7771181 - DNA, 22 bp, Homo sapiens
gtcactttggcctctacagcca

SEQ ID NO: 7771182 - DNA, 22 bp, Homo sapiens
gtcagaagcatttgtggctgaa

SEQ ID NO: 7771183 - DNA, 22 bp, Homo sapiens
ggtccccgtggaggctggagcg

SEQ ID NO: 7771184 - DNA, 22 bp, Homo sapiens
ggtccccccatggtgagcactg

SEQ ID NO: 7771185 - DNA, 22 bp, Homo sapiens
ggtccccccatggtgagcactg

SEQ ID NO: 7771186 - DNA, 22 bp, Homo sapiens
ggtcccagttgcccaggtcagg

SEQ ID NO: 7771187 - DNA, 23 bp, Homo sapiens
ggtcccagtggagaggcctcacc

SEQ ID NO: 7771188 - DNA, 22 bp, Homo sapiens
ggtcccagttgcccaggtcagg

SEQ ID NO: 7771189 - DNA, 23 bp, Homo sapiens
ggtcccagtggagaggcctcacc

SEQ ID NO: 7771190 - DNA, 23 bp, Homo sapiens
ggtcccagtggagaggcctcacc

SEQ ID NO: 7771191 - DNA, 22 bp, Homo sapiens
ggtcccagtcctctccctgcta

SEQ ID NO: 7771192 - DNA, 22 bp, Homo sapiens
ggtcccagctggtcactgtcag

SEQ ID NO: 7771193 - DNA, 22 bp, Homo sapiens
ggtcccagctggtcactgtcag

SEQ ID NO: 7771194 - DNA, 22 bp, Homo sapiens
gggttggatcctggtggctgcc

SEQ ID NO: 7771195 - DNA, 22 bp, Homo sapiens
gggttggattacttagggagaa

SEQ ID NO: 7771196 - DNA, 22 bp, Homo sapiens
gggtgtccagggcgtgtctgga

SEQ ID NO: 7771197 - DNA, 18 bp, Homo sapiens
gggtggtgtgctcttcgc

SEQ ID NO: 7771198 - DNA, 22 bp, Homo sapiens
ggtgagggagtggaacgaggtg

SEQ ID NO: 7771199 - DNA, 18 bp, Homo sapiens
ggtgagggagctggaagc

SEQ ID NO: 7771200 - DNA, 22 bp, Homo sapiens
ggtgaggcctgtacaaagctgc

SEQ ID NO: 7771201 - DNA, 21 bp, Homo sapiens
ggtgacacgtggccccgctct

SEQ ID NO: 7771202 - DNA, 22 bp, Homo sapiens
ggtgagcaaagcttcatctgta

SEQ ID NO: 7771203 - DNA, 22 bp, Homo sapiens
gtaattacatgagtactgtaag

SEQ ID NO: 7771204 - DNA, 22 bp, Homo sapiens
ggttggtaactccctgtgcagt

SEQ ID NO: 7771205 - DNA, 22 bp, Homo sapiens
ggttcagtttacattaaaatct

SEQ ID NO: 7771206 - DNA, 22 bp, Homo sapiens
ggttagagggcatgcgatcttt

SEQ ID NO: 7771207 - DNA, 22 bp, Homo sapiens
ggttagagggcatgcgatcttt

SEQ ID NO: 7771208 - DNA, 22 bp, Homo sapiens
ggttcacactaagcttaagtgg

SEQ ID NO: 7771209 - DNA, 22 bp, Homo sapiens
ggttcacatattgagagtattc

SEQ ID NO: 7771210 - DNA, 22 bp, Homo sapiens
ggtggtgggagagctttctgga

SEQ ID NO: 7771211 - DNA, 22 bp, Homo sapiens
ggtggtgggagagctttctgga

SEQ ID NO: 7771212 - DNA, 22 bp, Homo sapiens
ggttaaaaataatttacttggc

SEQ ID NO: 7771213 - DNA, 22 bp, Homo sapiens
ggttaaaactgatattatgggt

SEQ ID NO: 7771214 - DNA, 21 bp, Homo sapiens
ggttaaaagacacatctgttt

SEQ ID NO: 7771215 - DNA, 22 bp, Homo sapiens
ggttaaaatctaaaatgtgact

SEQ ID NO: 7771216 - DNA, 22 bp, Homo sapiens
ggtggtggagccagctgggagt

SEQ ID NO: 7771217 - DNA, 22 bp, Homo sapiens
ggtggtgaagacaagtggaagt

SEQ ID NO: 7771218 - DNA, 22 bp, Homo sapiens
ggtggtgactgtcctagggatg

SEQ ID NO: 7771219 - DNA, 22 bp, Homo sapiens
ggtggcagagacataggacata

SEQ ID NO: 7771220 - DNA, 22 bp, Homo sapiens
ggtggcagagacataggacata

SEQ ID NO: 7771221 - DNA, 22 bp, Homo sapiens
ggtggcagagaggaggtagttt

SEQ ID NO: 7771222 - DNA, 22 bp, Homo sapiens
ggtggcagagacataggacata

SEQ ID NO: 7771223 - DNA, 22 bp, Homo sapiens
ggtgggtggaaacagcatgtac

SEQ ID NO: 7771224 - DNA, 22 bp, Homo sapiens
ggtggggcccaggcatctgatg

SEQ ID NO: 7771225 - DNA, 22 bp, Homo sapiens
ggtggggccagggctccaacct

SEQ ID NO: 7771226 - DNA, 22 bp, Homo sapiens
ggtgggccaggaaggccgccag

SEQ ID NO: 7771227 - DNA, 22 bp, Homo sapiens
ggggtgggagtgccatccttga

SEQ ID NO: 7771228 - DNA, 22 bp, Homo sapiens
gggtgcagcagagctcctctgt

SEQ ID NO: 7771229 - DNA, 22 bp, Homo sapiens
gggtgaggccttgctgccatca

SEQ ID NO: 7771230 - DNA, 18 bp, Homo sapiens
gggtgcaggcactgactg

SEQ ID NO: 7771231 - DNA, 22 bp, Homo sapiens
gggtggaagccagagaggtcat

SEQ ID NO: 7771232 - DNA, 22 bp, Homo sapiens
gggtggagaggctaagtccagt

SEQ ID NO: 7771233 - DNA, 22 bp, Homo sapiens
gggtggaattgttggcatcgga

SEQ ID NO: 7771234 - DNA, 22 bp, Homo sapiens
gggtggtcatctgaaggtctgg

SEQ ID NO: 7771235 - DNA, 22 bp, Homo sapiens
gggtggtgagatgtagctgatg

SEQ ID NO: 7771236 - DNA, 22 bp, Homo sapiens
gggtggtgagatgtagctgatg

SEQ ID NO: 7771237 - DNA, 22 bp, Homo sapiens
gggtggtggccagcagtgggca

SEQ ID NO: 7771238 - DNA, 21 bp, Homo sapiens
gggtggtctgctgaagaggga

SEQ ID NO: 7771239 - DNA, 22 bp, Homo sapiens
gggtggtgggcacagaatctgg

SEQ ID NO: 7771240 - DNA, 22 bp, Homo sapiens
gggtggtgtattagagctgcag

SEQ ID NO: 7771241 - DNA, 22 bp, Homo sapiens
gggtggtggcggaggctccagg

SEQ ID NO: 7771242 - DNA, 22 bp, Homo sapiens
ggggtgagttagcgtcggcttg

SEQ ID NO: 7771243 - DNA, 22 bp, Homo sapiens
ggggtagggcgattgctgcttt

SEQ ID NO: 7771244 - DNA, 22 bp, Homo sapiens
ggggcccagggcagcagtgcag

SEQ ID NO: 7771245 - DNA, 22 bp, Homo sapiens
ggggccaggtccagcttccaaa

SEQ ID NO: 7771246 - DNA, 22 bp, Homo sapiens
ggggccagcactgtgcctttgt

SEQ ID NO: 7771247 - DNA, 22 bp, Homo sapiens
ggggccagcaatgttgaggaat

SEQ ID NO: 7771248 - DNA, 22 bp, Homo sapiens
ggggccagcaatgttgaggaat

SEQ ID NO: 7771249 - DNA, 22 bp, Homo sapiens
ggggtggagctaaatgtctact

SEQ ID NO: 7771250 - DNA, 22 bp, Homo sapiens
ggggtggatttcaggcggtgtc

SEQ ID NO: 7771251 - DNA, 19 bp, Homo sapiens
ggggtggctggggctccag

SEQ ID NO: 7771252 - DNA, 22 bp, Homo sapiens
gggctctgggattcagagcaag

SEQ ID NO: 7771253 - DNA, 22 bp, Homo sapiens
gggcttcagggtacttcctcct

SEQ ID NO: 7771254 - DNA, 22 bp, Homo sapiens
gggcttcaggagggtcagccca

SEQ ID NO: 7771255 - DNA, 22 bp, Homo sapiens
gggcttcaaaattggcactctt

SEQ ID NO: 7771256 - DNA, 23 bp, Homo sapiens
gggcttcattttaattcagctgc

SEQ ID NO: 7771257 - DNA, 22 bp, Homo sapiens
gggcttctccctaaggactctg

SEQ ID NO: 7771258 - DNA, 22 bp, Homo sapiens
ggggaggctgatgtgggcaaag

SEQ ID NO: 7771259 - DNA, 22 bp, Homo sapiens
ggggaggcaagatgaagtgagg

SEQ ID NO: 7771260 - DNA, 22 bp, Homo sapiens
ggggaggccagtggaccgtccc

SEQ ID NO: 7771261 - DNA, 22 bp, Homo sapiens
ggggaggacctttccaaggctt

SEQ ID NO: 7771262 - DNA, 22 bp, Homo sapiens
ggggaggcaagatgaagtgagg

SEQ ID NO: 7771263 - DNA, 22 bp, Homo sapiens
ggggaggagtgtacaggtttat

SEQ ID NO: 7771264 - DNA, 22 bp, Homo sapiens
ggggcagggaggttatcgccga

SEQ ID NO: 7771265 - DNA, 22 bp, Homo sapiens
ggggccactggcaggaccttgg

SEQ ID NO: 7771266 - DNA, 22 bp, Homo sapiens
ggggccagagaggacccaggtg

SEQ ID NO: 7771267 - DNA, 21 bp, Homo sapiens
ggggcatcaagacagagttag

SEQ ID NO: 7771268 - DNA, 17 bp, Homo sapiens
gggcagggactcctggg

SEQ ID NO: 7771269 - DNA, 17 bp, Homo sapiens
gggcagggactcctggg

SEQ ID NO: 7771270 - DNA, 22 bp, Homo sapiens
gggcactgtgctaggtgctgag

SEQ ID NO: 7771271 - DNA, 20 bp, Homo sapiens
gggcagagccagccagtccc

SEQ ID NO: 7771272 - DNA, 20 bp, Homo sapiens
gggcagagccagccagtccc

SEQ ID NO: 7771273 - DNA, 22 bp, Homo sapiens
gggcagaggctctggcccatcc

SEQ ID NO: 7771274 - DNA, 22 bp, Homo sapiens
gggagtcagagaggtaatggga

SEQ ID NO: 7771275 - DNA, 22 bp, Homo sapiens
gggaggttgaggctgcagtgag

SEQ ID NO: 7771276 - DNA, 22 bp, Homo sapiens
gggagctgaatggcaatggaga

SEQ ID NO: 7771277 - DNA, 22 bp, Homo sapiens
gggagctctccctgaggcctgg

SEQ ID NO: 7771278 - DNA, 22 bp, Homo sapiens
gggagccttgggagtgccagcc

SEQ ID NO: 7771279 - DNA, 22 bp, Homo sapiens
gggagtgggtttggcctaggcc

SEQ ID NO: 7771280 - DNA, 19 bp, Homo sapiens
gggatcagcccagggctct

SEQ ID NO: 7771281 - DNA, 22 bp, Homo sapiens
gggataggagattgggagtgtt

SEQ ID NO: 7771282 - DNA, 22 bp, Homo sapiens
gggcccctgggaattctgtgat

SEQ ID NO: 7771283 - DNA, 22 bp, Homo sapiens
gggccccactggggctgcctgc

SEQ ID NO: 7771284 - DNA, 22 bp, Homo sapiens
gggcccaggcctccttccttcc

SEQ ID NO: 7771285 - DNA, 22 bp, Homo sapiens
gggcccagtaccctctgccaag

SEQ ID NO: 7771286 - DNA, 22 bp, Homo sapiens
gggcaggtgtgcagagctgttg

SEQ ID NO: 7771287 - DNA, 22 bp, Homo sapiens
gggccctgatctgtgagcgcag

SEQ ID NO: 7771288 - DNA, 22 bp, Homo sapiens
gggccctctgcagctgcccagg

SEQ ID NO: 7771289 - DNA, 22 bp, Homo sapiens
gggccctgggattcagagcaag

SEQ ID NO: 7771290 - DNA, 22 bp, Homo sapiens
gggccctggggatgtggacgcg

SEQ ID NO: 7771291 - DNA, 22 bp, Homo sapiens
gggccctgggattcagagcaag

SEQ ID NO: 7771292 - DNA, 22 bp, Homo sapiens
gggccctgcctaaggaacacac

SEQ ID NO: 7771293 - DNA, 22 bp, Homo sapiens
gggccctgccccgtggctctga

SEQ ID NO: 7771294 - DNA, 22 bp, Homo sapiens
gggctaggtctgatcagagaag

SEQ ID NO: 7771295 - DNA, 22 bp, Homo sapiens
gggcctcacctctccaccgcct

SEQ ID NO: 7771296 - DNA, 19 bp, Homo sapiens
gggcctcacccacacctcc

SEQ ID NO: 7771297 - DNA, 22 bp, Homo sapiens
gggccctggggcctgatttgca

SEQ ID NO: 7771298 - DNA, 22 bp, Homo sapiens
gggccctgtgatttcttgagga

SEQ ID NO: 7771299 - DNA, 22 bp, Homo sapiens
gggccggagctgggtcccgcgc

SEQ ID NO: 7771300 - DNA, 22 bp, Homo sapiens
gggctcagaggagtggcctggg

SEQ ID NO: 7771301 - DNA, 21 bp, Homo sapiens
gggctcagcgctcggctcctc

SEQ ID NO: 7771302 - DNA, 22 bp, Homo sapiens
gggctcagctccttccttccta

SEQ ID NO: 7771303 - DNA, 21 bp, Homo sapiens
gggctcagtggaaaagagtgt

SEQ ID NO: 7771304 - DNA, 22 bp, Homo sapiens
gggctcagttctgcttcatgct

SEQ ID NO: 7771305 - DNA, 22 bp, Homo sapiens
gggaaggccggtccagtcaggt

SEQ ID NO: 7771306 - DNA, 22 bp, Homo sapiens
gggagccacagtagcagctact

SEQ ID NO: 7771307 - DNA, 22 bp, Homo sapiens
gggagccacagtagcagctact

SEQ ID NO: 7771308 - DNA, 22 bp, Homo sapiens
gggagccacagtgaggtgcatg

SEQ ID NO: 7771309 - DNA, 22 bp, Homo sapiens
gggagccagcagggcatggagc

SEQ ID NO: 7771310 - DNA, 19 bp, Homo sapiens
gggagccagaccctttgct

SEQ ID NO: 7771311 - DNA, 22 bp, Homo sapiens
gggagccagagtcacctagaga

SEQ ID NO: 7771312 - DNA, 22 bp, Homo sapiens
gggagccactcagctgagagtt

SEQ ID NO: 7771313 - DNA, 22 bp, Homo sapiens
gggagccactcagctgagagtt

SEQ ID NO: 7771314 - DNA, 23 bp, Homo sapiens
gggagccaggacctcgcgcccca

SEQ ID NO: 7771315 - DNA, 23 bp, Homo sapiens
gggagccaggacctcgcgcccca

SEQ ID NO: 7771316 - DNA, 22 bp, Homo sapiens
gggagccagcctttgcctataa

SEQ ID NO: 7771317 - DNA, 23 bp, Homo sapiens
gggagccatgggtggtcatggag

SEQ ID NO: 7771318 - DNA, 22 bp, Homo sapiens
gggagccatgctggtcttcttt

SEQ ID NO: 7771319 - DNA, 22 bp, Homo sapiens
gggaagatagtgttgagggccc

SEQ ID NO: 7771320 - DNA, 22 bp, Homo sapiens
gggaagcaggtgcagctcgcct

SEQ ID NO: 7771321 - DNA, 22 bp, Homo sapiens
gggaagagtgtcggttgaagtg

SEQ ID NO: 7771322 - DNA, 22 bp, Homo sapiens
gggaagagtaactagcccatgt

SEQ ID NO: 7771323 - DNA, 22 bp, Homo sapiens
gggaaggcagtgtctggttgaa

SEQ ID NO: 7771324 - DNA, 22 bp, Homo sapiens
gggaaggcagtgggaggaactg

SEQ ID NO: 7771325 - DNA, 22 bp, Homo sapiens
gggaaggcatacctgagggaga

SEQ ID NO: 7771326 - DNA, 22 bp, Homo sapiens
gggaaggcatacctgagggaga

SEQ ID NO: 7771327 - DNA, 22 bp, Homo sapiens
gggaaggcaccatggtgttcca

SEQ ID NO: 7771328 - DNA, 22 bp, Homo sapiens
gggaaggcaccatggtgttcca

SEQ ID NO: 7771329 - DNA, 22 bp, Homo sapiens
gggaaggcaggcctctgttgga

SEQ ID NO: 7771330 - DNA, 22 bp, Homo sapiens
gggaaggcaggattctctggtg

SEQ ID NO: 7771331 - DNA, 22 bp, Homo sapiens
gggaagcatctgagggtccact

SEQ ID NO: 7771332 - DNA, 22 bp, Homo sapiens
ggctgtggacactgagctcaga

SEQ ID NO: 7771333 - DNA, 22 bp, Homo sapiens
ggctggccagggccctcgctgg

SEQ ID NO: 7771334 - DNA, 22 bp, Homo sapiens
ggctgtggcattaggtgaggcc

SEQ ID NO: 7771335 - DNA, 22 bp, Homo sapiens
ggctgtggcattaggtgaggcc

SEQ ID NO: 7771336 - DNA, 22 bp, Homo sapiens
ggctgtggagctgcagagttgg

SEQ ID NO: 7771337 - DNA, 21 bp, Homo sapiens
ggctgtggagccatgactcac

SEQ ID NO: 7771338 - DNA, 22 bp, Homo sapiens
ggctgtggcagctggaagtggt

SEQ ID NO: 7771339 - DNA, 22 bp, Homo sapiens
ggctgtggcagctggaagtggt

SEQ ID NO: 7771340 - DNA, 22 bp, Homo sapiens
ggctgtggcagctggaagtggt

SEQ ID NO: 7771341 - DNA, 22 bp, Homo sapiens
ggctgtggggccgggtacagtg

SEQ ID NO: 7771342 - DNA, 22 bp, Homo sapiens
ggctgtggccagcggggctgag

SEQ ID NO: 7771343 - DNA, 22 bp, Homo sapiens
ggctgtggtctgggtgctcccc

SEQ ID NO: 7771344 - DNA, 22 bp, Homo sapiens
ggctgtggtctgggtgctcccc

SEQ ID NO: 7771345 - DNA, 22 bp, Homo sapiens
ggctgtggtctcatctagcctt

SEQ ID NO: 7771346 - DNA, 22 bp, Homo sapiens
gggaagagggagctggaatgat

SEQ ID NO: 7771347 - DNA, 22 bp, Homo sapiens
ggctgcaggttggttggcagct

SEQ ID NO: 7771348 - DNA, 22 bp, Homo sapiens
ggctgcaggttggttggcagct

SEQ ID NO: 7771349 - DNA, 22 bp, Homo sapiens
ggctgcaggcttccctccagca

SEQ ID NO: 7771350 - DNA, 22 bp, Homo sapiens
ggctgcagtttgtcttttgctt

SEQ ID NO: 7771351 - DNA, 22 bp, Homo sapiens
ggctgcctcagatttgctgact

SEQ ID NO: 7771352 - DNA, 22 bp, Homo sapiens
ggctgcctcctcgagacaggat

SEQ ID NO: 7771353 - DNA, 22 bp, Homo sapiens
ggctgcctctatttaggatcaa

SEQ ID NO: 7771354 - DNA, 19 bp, Homo sapiens
ggctgcctcctgggagatt

SEQ ID NO: 7771355 - DNA, 19 bp, Homo sapiens
ggctgcctcctgggagatt

SEQ ID NO: 7771356 - DNA, 22 bp, Homo sapiens
ggctgcctcctgctgggctgga

SEQ ID NO: 7771357 - DNA, 22 bp, Homo sapiens
ggctggataccaggagacaggg

SEQ ID NO: 7771358 - DNA, 22 bp, Homo sapiens
ggctggagtgggctccagagtt

SEQ ID NO: 7771359 - DNA, 22 bp, Homo sapiens
ggctggagtgggctccagagtt

SEQ ID NO: 7771360 - DNA, 17 bp, Homo sapiens
ggctggaggggacccgg

SEQ ID NO: 7771361 - DNA, 17 bp, Homo sapiens
ggctggaggggacccgg

SEQ ID NO: 7771362 - DNA, 22 bp, Homo sapiens
ggctggcaggggatgtcagatg

SEQ ID NO: 7771363 - DNA, 22 bp, Homo sapiens
ggctggcagtgtgagagaggga

SEQ ID NO: 7771364 - DNA, 22 bp, Homo sapiens
ggctggcagaagtgtgctggct

SEQ ID NO: 7771365 - DNA, 22 bp, Homo sapiens
ggctggcagaggggagtctgtg

SEQ ID NO: 7771366 - DNA, 22 bp, Homo sapiens
ggctggcaggcacagtatgcaa

SEQ ID NO: 7771367 - DNA, 17 bp, Homo sapiens
ggctggagcagctcccc

SEQ ID NO: 7771368 - DNA, 17 bp, Homo sapiens
ggctggagcagctcccc

SEQ ID NO: 7771369 - DNA, 22 bp, Homo sapiens
ggctggagatatgtctggaaca

SEQ ID NO: 7771370 - DNA, 22 bp, Homo sapiens
ggctgcctgctcctcctgcacg

SEQ ID NO: 7771371 - DNA, 22 bp, Homo sapiens
ggctgcctgctcctcctgcacg

SEQ ID NO: 7771372 - DNA, 22 bp, Homo sapiens
ggctgcctgcctccaagccggg

SEQ ID NO: 7771373 - DNA, 22 bp, Homo sapiens
ggctgcctgaggctgaggcccg

SEQ ID NO: 7771374 - DNA, 22 bp, Homo sapiens
ggctgcctgaggctgaggcccg

SEQ ID NO: 7771375 - DNA, 22 bp, Homo sapiens
ggctgcctgaggctgaggcccg

SEQ ID NO: 7771376 - DNA, 22 bp, Homo sapiens
ggctgcctgaactttggggaaa

SEQ ID NO: 7771377 - DNA, 22 bp, Homo sapiens
ggctgcctctgatgtgcagacg

SEQ ID NO: 7771378 - DNA, 22 bp, Homo sapiens
ggcccagctctattgaattaca

SEQ ID NO: 7771379 - DNA, 22 bp, Homo sapiens
ggccagctggatgtgggtgacg

SEQ ID NO: 7771380 - DNA, 22 bp, Homo sapiens
ggccagctgggccaccaggtgc

SEQ ID NO: 7771381 - DNA, 22 bp, Homo sapiens
ggccagctggatgtgggtgacg

SEQ ID NO: 7771382 - DNA, 22 bp, Homo sapiens
ggccagctgccaccagccctat

SEQ ID NO: 7771383 - DNA, 21 bp, Homo sapiens
ggccagctgcatatgtcactg

SEQ ID NO: 7771384 - DNA, 19 bp, Homo sapiens
ggccagccacctcgcctgg

SEQ ID NO: 7771385 - DNA, 22 bp, Homo sapiens
ggccagctgagctgctgcacag

SEQ ID NO: 7771386 - DNA, 22 bp, Homo sapiens
ggccagctcttgtccacggagg

SEQ ID NO: 7771387 - DNA, 22 bp, Homo sapiens
ggccagcccagtggtcctctct

SEQ ID NO: 7771388 - DNA, 22 bp, Homo sapiens
ggcccagtgctgttcacccagt

SEQ ID NO: 7771389 - DNA, 20 bp, Homo sapiens
ggcccagtgaaccaggacgg

SEQ ID NO: 7771390 - DNA, 22 bp, Homo sapiens
ggcccaggtccagcgagtacct

SEQ ID NO: 7771391 - DNA, 22 bp, Homo sapiens
ggcccagtgtaccccaggcagt

SEQ ID NO: 7771392 - DNA, 22 bp, Homo sapiens
ggcccaggctggagtgcagtgg

SEQ ID NO: 7771393 - DNA, 22 bp, Homo sapiens
ggcccaggatgcaagaactgaa

SEQ ID NO: 7771394 - DNA, 22 bp, Homo sapiens
ggcccagctgggcggggacacg

SEQ ID NO: 7771395 - DNA, 22 bp, Homo sapiens
ggcccagctgtatattacagtt

SEQ ID NO: 7771396 - DNA, 22 bp, Homo sapiens
ggcccagctttcattccttgct

SEQ ID NO: 7771397 - DNA, 22 bp, Homo sapiens
ggcccagctgtgcttccagccc

SEQ ID NO: 7771398 - DNA, 22 bp, Homo sapiens
ggccacagcagatgcttcagat

SEQ ID NO: 7771399 - DNA, 17 bp, Homo sapiens
ggccacagagcttgggg

SEQ ID NO: 7771400 - DNA, 22 bp, Homo sapiens
ggcagtgggtggatctcaggga

SEQ ID NO: 7771401 - DNA, 22 bp, Homo sapiens
ggcagtggcatgtgggtagtgg

SEQ ID NO: 7771402 - DNA, 22 bp, Homo sapiens
ggcagtggcatgtgggtagtgg

SEQ ID NO: 7771403 - DNA, 22 bp, Homo sapiens
ggccacagtgggaaatcctggg

SEQ ID NO: 7771404 - DNA, 21 bp, Homo sapiens
ggccacagttagggctcagga

SEQ ID NO: 7771405 - DNA, 21 bp, Homo sapiens
ggccacagttagggctcagga

SEQ ID NO: 7771406 - DNA, 22 bp, Homo sapiens
ggccaccaaagtcctgtggctt

SEQ ID NO: 7771407 - DNA, 22 bp, Homo sapiens
ggccacatgaattcttggacag

SEQ ID NO: 7771408 - DNA, 22 bp, Homo sapiens
ggccaccagtcctctggcaggg

SEQ ID NO: 7771409 - DNA, 22 bp, Homo sapiens
ggccaccaaagtcctgtggctt

SEQ ID NO: 7771410 - DNA, 19 bp, Homo sapiens
ggccagcacagggctctgt

SEQ ID NO: 7771411 - DNA, 22 bp, Homo sapiens
ggccagcagacctcagggactc

SEQ ID NO: 7771412 - DNA, 22 bp, Homo sapiens
ggcctctgcttatgctgatgac

SEQ ID NO: 7771413 - DNA, 22 bp, Homo sapiens
ggctagggaaaatgattggata

SEQ ID NO: 7771414 - DNA, 22 bp, Homo sapiens
ggctagggacacagctctgctc

SEQ ID NO: 7771415 - DNA, 22 bp, Homo sapiens
ggctagggaaatcctgatccaa

SEQ ID NO: 7771416 - DNA, 22 bp, Homo sapiens
ggctagggacacagctctgctc

SEQ ID NO: 7771417 - DNA, 22 bp, Homo sapiens
ggctagggactcctcctcaggg

SEQ ID NO: 7771418 - DNA, 22 bp, Homo sapiens
ggctcactgcaacttccgcctc

SEQ ID NO: 7771419 - DNA, 22 bp, Homo sapiens
ggctcactacaacctccgcctt

SEQ ID NO: 7771420 - DNA, 22 bp, Homo sapiens
ggcccatgcatcctgtgcagcc

SEQ ID NO: 7771421 - DNA, 22 bp, Homo sapiens
ggcctccatcttatcttactct

SEQ ID NO: 7771422 - DNA, 22 bp, Homo sapiens
ggcctctcttgggacagctgtc

SEQ ID NO: 7771423 - DNA, 22 bp, Homo sapiens
ggctctgccgtgtgctcacatg

SEQ ID NO: 7771424 - DNA, 22 bp, Homo sapiens
ggctctgcctgcccagcagcac

SEQ ID NO: 7771425 - DNA, 22 bp, Homo sapiens
ggctctctgaggaaacccttcc

SEQ ID NO: 7771426 - DNA, 22 bp, Homo sapiens
ggctctctccttggctttcaga

SEQ ID NO: 7771427 - DNA, 22 bp, Homo sapiens
ggctcagcaatgatgagcccct

SEQ ID NO: 7771428 - DNA, 22 bp, Homo sapiens
ggctcagattccgagtggccct

SEQ ID NO: 7771429 - DNA, 22 bp, Homo sapiens
ggctcactgcaagctccgcctc

SEQ ID NO: 7771430 - DNA, 22 bp, Homo sapiens
ggcagtgcaaggcagcctggat

SEQ ID NO: 7771431 - DNA, 22 bp, Homo sapiens
ggcagtgagtcccggagaggcc

SEQ ID NO: 7771432 - DNA, 22 bp, Homo sapiens
ggcagtgagtcccggagaggcc

SEQ ID NO: 7771433 - DNA, 22 bp, Homo sapiens
ggcagtggaggaccctgtgtct

SEQ ID NO: 7771434 - DNA, 18 bp, Homo sapiens
ggcagtgcagtctcaggg

SEQ ID NO: 7771435 - DNA, 22 bp, Homo sapiens
ggcagtgccactaagctctgct

SEQ ID NO: 7771436 - DNA, 22 bp, Homo sapiens
ggcagtgccactaagctctgct

SEQ ID NO: 7771437 - DNA, 22 bp, Homo sapiens
ggcagggaaacagctgatccca

SEQ ID NO: 7771438 - DNA, 22 bp, Homo sapiens
ggcagggagagcatgctgataa

SEQ ID NO: 7771439 - DNA, 22 bp, Homo sapiens
ggcagggactttgcaaatcttt

SEQ ID NO: 7771440 - DNA, 22 bp, Homo sapiens
ggcagggactatgtttcatgga

SEQ ID NO: 7771441 - DNA, 22 bp, Homo sapiens
ggcagggacaggatagggtttt

SEQ ID NO: 7771442 - DNA, 22 bp, Homo sapiens
ggcaggggtcctggtgttgact

SEQ ID NO: 7771443 - DNA, 22 bp, Homo sapiens
ggcagggcttgtctctgtgatg

SEQ ID NO: 7771444 - DNA, 20 bp, Homo sapiens
ggcagggcatcaacagctct

SEQ ID NO: 7771445 - DNA, 20 bp, Homo sapiens
ggcagggcatcaacagctct

SEQ ID NO: 7771446 - DNA, 18 bp, Homo sapiens
ggcagggaaaagataggg

SEQ ID NO: 7771447 - DNA, 22 bp, Homo sapiens
ggcaggctttgagaaagagcat

SEQ ID NO: 7771448 - DNA, 20 bp, Homo sapiens
ggcaggctttatatggaggg

SEQ ID NO: 7771449 - DNA, 22 bp, Homo sapiens
ggcaggcttggtggcaccggtt

SEQ ID NO: 7771450 - DNA, 20 bp, Homo sapiens
ggcaggctttatatggaggg

SEQ ID NO: 7771451 - DNA, 20 bp, Homo sapiens
ggcaggctttatatggaggg

SEQ ID NO: 7771452 - DNA, 22 bp, Homo sapiens
ggcaggcttgatatggggggac

SEQ ID NO: 7771453 - DNA, 22 bp, Homo sapiens
ggcaggcttgatatggggggac

SEQ ID NO: 7771454 - DNA, 22 bp, Homo sapiens
ggcaggctgttcacctgctttt

SEQ ID NO: 7771455 - DNA, 22 bp, Homo sapiens
ggcagccttgagggaggcctgg

SEQ ID NO: 7771456 - DNA, 22 bp, Homo sapiens
ggcagcgcccgagtccgcagct

SEQ ID NO: 7771457 - DNA, 21 bp, Homo sapiens
ggcagcgtgtggacaggaagg

SEQ ID NO: 7771458 - DNA, 22 bp, Homo sapiens
ggcagctcacctctggtccagg

SEQ ID NO: 7771459 - DNA, 22 bp, Homo sapiens
ggcagctcacgggcatggggtg

SEQ ID NO: 7771460 - DNA, 22 bp, Homo sapiens
ggcagcctccagggcactggtg

SEQ ID NO: 7771461 - DNA, 22 bp, Homo sapiens
ggcagccatgtcccagggcttc

SEQ ID NO: 7771462 - DNA, 22 bp, Homo sapiens
ggcagccatgtgggcagcgagt

SEQ ID NO: 7771463 - DNA, 22 bp, Homo sapiens
ggcagccccagaaacagttcag

SEQ ID NO: 7771464 - DNA, 22 bp, Homo sapiens
ggcagcccaccagcccacgtct

SEQ ID NO: 7771465 - DNA, 21 bp, Homo sapiens
ggcagcccgccctctcctggc

SEQ ID NO: 7771466 - DNA, 22 bp, Homo sapiens
ggcagccctttctggccagctc

SEQ ID NO: 7771467 - DNA, 22 bp, Homo sapiens
ggcagccctttctggccagctc

SEQ ID NO: 7771468 - DNA, 17 bp, Homo sapiens
ggcagcctcaggcgttt

SEQ ID NO: 7771469 - DNA, 22 bp, Homo sapiens
ggcagcactgcagcttgttggg

SEQ ID NO: 7771470 - DNA, 22 bp, Homo sapiens
ggcagcagaactggccctgtat

SEQ ID NO: 7771471 - DNA, 22 bp, Homo sapiens
ggcagcactgcagcttgttggg

SEQ ID NO: 7771472 - DNA, 22 bp, Homo sapiens
ggcagatgttgcagtgagcaga

SEQ ID NO: 7771473 - DNA, 22 bp, Homo sapiens
ggcagcaactcggagagaagag

SEQ ID NO: 7771474 - DNA, 22 bp, Homo sapiens
ggcagatggagaagcagcaggt

SEQ ID NO: 7771475 - DNA, 22 bp, Homo sapiens
ggcagatggggtgacaagagag

SEQ ID NO: 7771476 - DNA, 22 bp, Homo sapiens
ggcagatgttatatgatctgag

SEQ ID NO: 7771477 - DNA, 22 bp, Homo sapiens
ggcagatggggtgacaagagag

SEQ ID NO: 7771478 - DNA, 22 bp, Homo sapiens
ggcagaggtgacagtgtctttt

SEQ ID NO: 7771479 - DNA, 22 bp, Homo sapiens
ggcagaggtgacagtgtctttt

SEQ ID NO: 7771480 - DNA, 22 bp, Homo sapiens
ggcaccaggctgggcataggcc

SEQ ID NO: 7771481 - DNA, 22 bp, Homo sapiens
ggcacctggtaagtgctcagta

SEQ ID NO: 7771482 - DNA, 22 bp, Homo sapiens
ggcacctggatgtagcagtgaa

SEQ ID NO: 7771483 - DNA, 22 bp, Homo sapiens
ggaggatgagctacgaggagct

SEQ ID NO: 7771484 - DNA, 22 bp, Homo sapiens
ggaggaggtgggttaagttgta

SEQ ID NO: 7771485 - DNA, 22 bp, Homo sapiens
ggaggaggtgggttaagttgta

SEQ ID NO: 7771486 - DNA, 22 bp, Homo sapiens
ggaggaggggtttacattggaa

SEQ ID NO: 7771487 - DNA, 22 bp, Homo sapiens
ggaggcaaagcactttgcttgg

SEQ ID NO: 7771488 - DNA, 22 bp, Homo sapiens
gcccaaggtcccatggcagcac

SEQ ID NO: 7771489 - DNA, 22 bp, Homo sapiens
gccccaggggaggtgccctgca

SEQ ID NO: 7771490 - DNA, 22 bp, Homo sapiens
gccccaggtggtaaacctaaga

SEQ ID NO: 7771491 - DNA, 22 bp, Homo sapiens
gcccctcccagtcaggagcact

SEQ ID NO: 7771492 - DNA, 22 bp, Homo sapiens
gcccctcccagtcaggagcact

SEQ ID NO: 7771493 - DNA, 22 bp, Homo sapiens
gcccctccgggcgcgtcatagc

SEQ ID NO: 7771494 - DNA, 22 bp, Homo sapiens
gcccctggctggccagctcctc

SEQ ID NO: 7771495 - DNA, 22 bp, Homo sapiens
gcccctgggagcagagccacca

SEQ ID NO: 7771496 - DNA, 22 bp, Homo sapiens
gcccgcagagatctttaacaaa

SEQ ID NO: 7771497 - DNA, 22 bp, Homo sapiens
gcccggccaggaacagagtata

SEQ ID NO: 7771498 - DNA, 22 bp, Homo sapiens
gccctagcgccagctcagcacc

SEQ ID NO: 7771499 - DNA, 22 bp, Homo sapiens
gccctcagaggacagctgactt

SEQ ID NO: 7771500 - DNA, 22 bp, Homo sapiens
gccctcagagttccccacagtg

SEQ ID NO: 7771501 - DNA, 22 bp, Homo sapiens
gccctgagtggtacctgtgggt

SEQ ID NO: 7771502 - DNA, 22 bp, Homo sapiens
gccctagggggaaccgaggact

SEQ ID NO: 7771503 - DNA, 21 bp, Homo sapiens
gccctaggctacctggagcgc

SEQ ID NO: 7771504 - DNA, 22 bp, Homo sapiens
gcctcaggtgcatctctcattc

SEQ ID NO: 7771505 - DNA, 22 bp, Homo sapiens
gcctcagtctcccgagtagctg

SEQ ID NO: 7771506 - DNA, 18 bp, Homo sapiens
gcctccaccatggagggt

SEQ ID NO: 7771507 - DNA, 22 bp, Homo sapiens
gccctggagagggatatggcat

SEQ ID NO: 7771508 - DNA, 22 bp, Homo sapiens
gcctcagggggagaggccagct

SEQ ID NO: 7771509 - DNA, 22 bp, Homo sapiens
gccctggacagtgacggtgacc

SEQ ID NO: 7771510 - DNA, 22 bp, Homo sapiens
gccctggaatctctccatggga

SEQ ID NO: 7771511 - DNA, 22 bp, Homo sapiens
gccctggaatctctccatggga

SEQ ID NO: 7771512 - DNA, 22 bp, Homo sapiens
gcctggagaagatggaactagc

SEQ ID NO: 7771513 - DNA, 22 bp, Homo sapiens
gcctggagacaaggacaaaggg

SEQ ID NO: 7771514 - DNA, 22 bp, Homo sapiens
gcctggagtgcagtggcgtgat

SEQ ID NO: 7771515 - DNA, 22 bp, Homo sapiens
gcctgcagaggtgctgctagct

SEQ ID NO: 7771516 - DNA, 22 bp, Homo sapiens
gcctcccctgcaattgtccttg

SEQ ID NO: 7771517 - DNA, 22 bp, Homo sapiens
gcctccctccaccactgcaggt

SEQ ID NO: 7771518 - DNA, 22 bp, Homo sapiens
gcctccacccctggggagtgga

SEQ ID NO: 7771519 - DNA, 22 bp, Homo sapiens
gcctccccaggggtgtcatgag

SEQ ID NO: 7771520 - DNA, 22 bp, Homo sapiens
gcctgaggaattgagggggtaa

SEQ ID NO: 7771521 - DNA, 22 bp, Homo sapiens
gcctgagggctcctagcaggct

SEQ ID NO: 7771522 - DNA, 18 bp, Homo sapiens
gcctccctggctacactt

SEQ ID NO: 7771523 - DNA, 22 bp, Homo sapiens
gcctccctgtagaggccagcct

SEQ ID NO: 7771524 - DNA, 22 bp, Homo sapiens
gcattaatgtaagacccactcc

SEQ ID NO: 7771525 - DNA, 22 bp, Homo sapiens
gcagtttggaaaatgtgcctct

SEQ ID NO: 7771526 - DNA, 22 bp, Homo sapiens
gcagtttgaaagtatgagtcca

SEQ ID NO: 7771527 - DNA, 22 bp, Homo sapiens
gcagtttgaggttttctgatgt

SEQ ID NO: 7771528 - DNA, 21 bp, Homo sapiens
gcagtttatgtaatatgcact

SEQ ID NO: 7771529 - DNA, 18 bp, Homo sapiens
gcattctgttaatgtgga

SEQ ID NO: 7771530 - DNA, 22 bp, Homo sapiens
gcattcttcacagtattcctcc

SEQ ID NO: 7771531 - DNA, 22 bp, Homo sapiens
gcattcttggtggagtgctaaa

SEQ ID NO: 7771532 - DNA, 22 bp, Homo sapiens
gcagtgtttttcaatgcttcca

SEQ ID NO: 7771533 - DNA, 23 bp, Homo sapiens
gcagtgtttgcttcatcttatcc

SEQ ID NO: 7771534 - DNA, 22 bp, Homo sapiens
gcatttaaatttgaacttcaga

SEQ ID NO: 7771535 - DNA, 23 bp, Homo sapiens
gcattgtagaatgtttagcagca

SEQ ID NO: 7771536 - DNA, 22 bp, Homo sapiens
gccaccctggaccaccctgggc

SEQ ID NO: 7771537 - DNA, 22 bp, Homo sapiens
gccaccctgcaaatgcccagga

SEQ ID NO: 7771538 - DNA, 22 bp, Homo sapiens
gccaccctgagctgggccaggg

SEQ ID NO: 7771539 - DNA, 18 bp, Homo sapiens
gccaccctcctcgtctcc

SEQ ID NO: 7771540 - DNA, 22 bp, Homo sapiens
gccaccctgacgccgcagaccc

SEQ ID NO: 7771541 - DNA, 22 bp, Homo sapiens
gccaccctggacgcactgttcg

SEQ ID NO: 7771542 - DNA, 22 bp, Homo sapiens
gccaccctggacgcactgttcg

SEQ ID NO: 7771543 - DNA, 22 bp, Homo sapiens
gccacccttatcccatgcttct

SEQ ID NO: 7771544 - DNA, 22 bp, Homo sapiens
gccacctctctcttgactcgag

SEQ ID NO: 7771545 - DNA, 22 bp, Homo sapiens
gccaggaatgcataaatgacct

SEQ ID NO: 7771546 - DNA, 22 bp, Homo sapiens
gccaggaaggctccctggtcac

SEQ ID NO: 7771547 - DNA, 22 bp, Homo sapiens
gccaggaaggctgaagccagaa

SEQ ID NO: 7771548 - DNA, 18 bp, Homo sapiens
gccaggaagaggaatgtg

SEQ ID NO: 7771549 - DNA, 19 bp, Homo sapiens
gccaggaaagaatcaggcg

SEQ ID NO: 7771550 - DNA, 22 bp, Homo sapiens
gccagctttggcacagggtggt

SEQ ID NO: 7771551 - DNA, 22 bp, Homo sapiens
gccagctttggcacagggtggt

SEQ ID NO: 7771552 - DNA, 22 bp, Homo sapiens
gccagcttggcatgtgaggagt

SEQ ID NO: 7771553 - DNA, 22 bp, Homo sapiens
gccagctgtgcttttcctaaaa

SEQ ID NO: 7771554 - DNA, 22 bp, Homo sapiens
gccagaaacatacacatcactt

SEQ ID NO: 7771555 - DNA, 22 bp, Homo sapiens
gccagaagactggagtcagctg

SEQ ID NO: 7771556 - DNA, 22 bp, Homo sapiens
gccagctgagaaatcattgata

SEQ ID NO: 7771557 - DNA, 22 bp, Homo sapiens
gccagctgaggccgtgcaggct

SEQ ID NO: 7771558 - DNA, 22 bp, Homo sapiens
gccagctgagcaaattccagct

SEQ ID NO: 7771559 - DNA, 22 bp, Homo sapiens
gccagctgagcaaattccagct

SEQ ID NO: 7771560 - DNA, 22 bp, Homo sapiens
gccagctgagcaaattccagct

SEQ ID NO: 7771561 - DNA, 22 bp, Homo sapiens
gccagctggtaggcacctagcc

SEQ ID NO: 7771562 - DNA, 22 bp, Homo sapiens
gccagctgtatctttggccagc

SEQ ID NO: 7771563 - DNA, 22 bp, Homo sapiens
gccagctgtaagctggggtgat

SEQ ID NO: 7771564 - DNA, 22 bp, Homo sapiens
gccagctgtaagctggggtgat

SEQ ID NO: 7771565 - DNA, 22 bp, Homo sapiens
gccaggctcagcagtcaacctg

SEQ ID NO: 7771566 - DNA, 22 bp, Homo sapiens
gccaggctcagcagtcaacctg

SEQ ID NO: 7771567 - DNA, 22 bp, Homo sapiens
gccaggctaagaaaggtgtgat

SEQ ID NO: 7771568 - DNA, 22 bp, Homo sapiens
gccaggcgggtctcaaactcct

SEQ ID NO: 7771569 - DNA, 22 bp, Homo sapiens
gccaggcattattccgatccct

SEQ ID NO: 7771570 - DNA, 22 bp, Homo sapiens
gccaggctccaggccctcctga

SEQ ID NO: 7771571 - DNA, 22 bp, Homo sapiens
gccaggctccaggccctcctga

SEQ ID NO: 7771572 - DNA, 19 bp, Homo sapiens
gccaggctccatagccggc

SEQ ID NO: 7771573 - DNA, 23 bp, Homo sapiens
gccaggctccggtctgtggccac

SEQ ID NO: 7771574 - DNA, 23 bp, Homo sapiens
gccaggctccggtctgtggccac

SEQ ID NO: 7771575 - DNA, 22 bp, Homo sapiens
gccaggctccccggatccctgg

SEQ ID NO: 7771576 - DNA, 22 bp, Homo sapiens
gccaggctccccggatccctgg

SEQ ID NO: 7771577 - DNA, 22 bp, Homo sapiens
gccaggctctcagtgactgccc

SEQ ID NO: 7771578 - DNA, 22 bp, Homo sapiens
gccaggctctcagtgactgccc

SEQ ID NO: 7771579 - DNA, 22 bp, Homo sapiens
gcccaaagccagtgtgctctcc

SEQ ID NO: 7771580 - DNA, 22 bp, Homo sapiens
gcccaagcagcttcccgagctt

SEQ ID NO: 7771581 - DNA, 22 bp, Homo sapiens
gcccaaggtatatcagagacag

SEQ ID NO: 7771582 - DNA, 22 bp, Homo sapiens
gcccaaggtcacacacaggaag

SEQ ID NO: 7771583 - DNA, 22 bp, Homo sapiens
gcccaagccgccttccagagac

SEQ ID NO: 7771584 - DNA, 22 bp, Homo sapiens
gcccaagctccgcctcctgtcg

SEQ ID NO: 7771585 - DNA, 20 bp, Homo sapiens
gcccaagcgccggccgcaga

SEQ ID NO: 7771586 - DNA, 22 bp, Homo sapiens
gcagccattgagcgaaaaaatc

SEQ ID NO: 7771587 - DNA, 17 bp, Homo sapiens
gcagccagtgcagcagg

SEQ ID NO: 7771588 - DNA, 22 bp, Homo sapiens
gcagctggctcagagaggtggg

SEQ ID NO: 7771589 - DNA, 22 bp, Homo sapiens
gcagctgggacactgaggccag

SEQ ID NO: 7771590 - DNA, 22 bp, Homo sapiens
gcagctgggacactgaggccag

SEQ ID NO: 7771591 - DNA, 22 bp, Homo sapiens
gcagctgggacactgaggccag

SEQ ID NO: 7771592 - DNA, 22 bp, Homo sapiens
gcagcccaatggactgagacag

SEQ ID NO: 7771593 - DNA, 22 bp, Homo sapiens
gcagcccaagcctgagcatcct

SEQ ID NO: 7771594 - DNA, 22 bp, Homo sapiens
gcagctggctcagagaggtggg

SEQ ID NO: 7771595 - DNA, 22 bp, Homo sapiens
gcagctggttaatgggagaatt

SEQ ID NO: 7771596 - DNA, 23 bp, Homo sapiens
gcagctggttagaagggaaggag

SEQ ID NO: 7771597 - DNA, 22 bp, Homo sapiens
gcagctggtctggcctagagta

SEQ ID NO: 7771598 - DNA, 22 bp, Homo sapiens
gcagctggtgcaaatgtcactc

SEQ ID NO: 7771599 - DNA, 22 bp, Homo sapiens
gcagctggggaggtcgtgggga

SEQ ID NO: 7771600 - DNA, 22 bp, Homo sapiens
gcagctggggaggtcgtgggga

SEQ ID NO: 7771601 - DNA, 22 bp, Homo sapiens
gcagctgggtctgtgtgggctg

SEQ ID NO: 7771602 - DNA, 22 bp, Homo sapiens
gcagctgggtctgtgtgggctg

SEQ ID NO: 7771603 - DNA, 22 bp, Homo sapiens
gcagcagcaggcgctcggccgt

SEQ ID NO: 7771604 - DNA, 22 bp, Homo sapiens
gcagcaccaaccagggcctgtt

SEQ ID NO: 7771605 - DNA, 22 bp, Homo sapiens
gcagcagcccagggctctcaga

SEQ ID NO: 7771606 - DNA, 22 bp, Homo sapiens
gcagccaggaaagctggaccct

SEQ ID NO: 7771607 - DNA, 22 bp, Homo sapiens
gcagccagcccctctgacctct

SEQ ID NO: 7771608 - DNA, 22 bp, Homo sapiens
gcagggcagggcaagaactggg

SEQ ID NO: 7771609 - DNA, 22 bp, Homo sapiens
gcagggcatgggccctgtctgc

SEQ ID NO: 7771610 - DNA, 22 bp, Homo sapiens
gcagggccagggctcaggctgt

SEQ ID NO: 7771611 - DNA, 22 bp, Homo sapiens
gcagggccaggtacaagaagca

SEQ ID NO: 7771612 - DNA, 22 bp, Homo sapiens
gcagggccagtgcagagaggaa

SEQ ID NO: 7771613 - DNA, 22 bp, Homo sapiens
gcagggccagtgcagagaggaa

SEQ ID NO: 7771614 - DNA, 19 bp, Homo sapiens
gcagggtgttgactgtccc

SEQ ID NO: 7771615 - DNA, 19 bp, Homo sapiens
gcagggtggcagagctctt

SEQ ID NO: 7771616 - DNA, 22 bp, Homo sapiens
gcaggtgatgtgatgtgagcat

SEQ ID NO: 7771617 - DNA, 22 bp, Homo sapiens
gcaggtcttgaaggtgtgattt

SEQ ID NO: 7771618 - DNA, 22 bp, Homo sapiens
gcaggtctatcaggctgcaggt

SEQ ID NO: 7771619 - DNA, 22 bp, Homo sapiens
gcaggtctcaatctgagcaggc

SEQ ID NO: 7771620 - DNA, 22 bp, Homo sapiens
gcaggtctagaagctgcctctg

SEQ ID NO: 7771621 - DNA, 22 bp, Homo sapiens
gcagggttggtgtcctctgcgg

SEQ ID NO: 7771622 - DNA, 22 bp, Homo sapiens
gcagggttctcagcagtgatgg

SEQ ID NO: 7771623 - DNA, 21 bp, Homo sapiens
gcagggtttgtgctgtgagtt

SEQ ID NO: 7771624 - DNA, 22 bp, Homo sapiens
gcaggcctcccctgctggagct

SEQ ID NO: 7771625 - DNA, 18 bp, Homo sapiens
gcaggcctagaacttggt

SEQ ID NO: 7771626 - DNA, 22 bp, Homo sapiens
gcagggcagctgaagctaggtg

SEQ ID NO: 7771627 - DNA, 22 bp, Homo sapiens
gcagggcagcttagtccctgtc

SEQ ID NO: 7771628 - DNA, 22 bp, Homo sapiens
gcagggcagctcactgtggttc

SEQ ID NO: 7771629 - DNA, 22 bp, Homo sapiens
gcagggcagctgaagctaggtg

SEQ ID NO: 7771630 - DNA, 22 bp, Homo sapiens
gcaggccacagtggagtctctg

SEQ ID NO: 7771631 - DNA, 22 bp, Homo sapiens
gcaggcatggtcgctgccaggt

SEQ ID NO: 7771632 - DNA, 22 bp, Homo sapiens
gcagctgtactggcagcattgt

SEQ ID NO: 7771633 - DNA, 22 bp, Homo sapiens
gcacagcacagcaacatgtttt

SEQ ID NO: 7771634 - DNA, 22 bp, Homo sapiens
gcacatggcggccagcaggtga

SEQ ID NO: 7771635 - DNA, 22 bp, Homo sapiens
gcacagaaccagacatgaggca

SEQ ID NO: 7771636 - DNA, 22 bp, Homo sapiens
gcacagaataacactctgggct

SEQ ID NO: 7771637 - DNA, 22 bp, Homo sapiens
gcacagagagcagtgggggaca

SEQ ID NO: 7771638 - DNA, 20 bp, Homo sapiens
gcaaggcacagtgaggaggg

SEQ ID NO: 7771639 - DNA, 20 bp, Homo sapiens
gcaaggcacagtgaggaggg

SEQ ID NO: 7771640 - DNA, 22 bp, Homo sapiens
gcaaggcagcgcggagtagcta

SEQ ID NO: 7771641 - DNA, 22 bp, Homo sapiens
gcaaggcagcgcggagtagcta

SEQ ID NO: 7771642 - DNA, 18 bp, Homo sapiens
gcaaggctcaggccaggc

SEQ ID NO: 7771643 - DNA, 22 bp, Homo sapiens
gcaataaagtagcagctcatca

SEQ ID NO: 7771644 - DNA, 22 bp, Homo sapiens
gcaataaataacatggaagaca

SEQ ID NO: 7771645 - DNA, 22 bp, Homo sapiens
gcaataaagattttactgtcag

SEQ ID NO: 7771646 - DNA, 22 bp, Homo sapiens
gcaataaacatgtttgatgcgc

SEQ ID NO: 7771647 - DNA, 22 bp, Homo sapiens
gcaataaacatgtttgatgcgc

SEQ ID NO: 7771648 - DNA, 22 bp, Homo sapiens
gcaataaactctctcaagccac

SEQ ID NO: 7771649 - DNA, 22 bp, Homo sapiens
gcaataaaatgtaatgattggg

SEQ ID NO: 7771650 - DNA, 22 bp, Homo sapiens
gcaataaaatgtaatgattggg

SEQ ID NO: 7771651 - DNA, 22 bp, Homo sapiens
gcaaggagactgtagggccaag

SEQ ID NO: 7771652 - DNA, 22 bp, Homo sapiens
gagtattcctcagtcattttgt

SEQ ID NO: 7771653 - DNA, 22 bp, Homo sapiens
gagtagttgctgcagagaatac

SEQ ID NO: 7771654 - DNA, 22 bp, Homo sapiens
gcacccagaggtcagcagtgct

SEQ ID NO: 7771655 - DNA, 22 bp, Homo sapiens
gcacccagcccagggcgtgatg

SEQ ID NO: 7771656 - DNA, 22 bp, Homo sapiens
gcacccagagggcagggtctcc

SEQ ID NO: 7771657 - DNA, 22 bp, Homo sapiens
gcacatttaactgagctcagga

SEQ ID NO: 7771658 - DNA, 22 bp, Homo sapiens
gcacatttctcaaagaattgtc

SEQ ID NO: 7771659 - DNA, 22 bp, Homo sapiens
gcacatttgagacatccaggca

SEQ ID NO: 7771660 - DNA, 22 bp, Homo sapiens
gcacatttctcaaagaattgtc

SEQ ID NO: 7771661 - DNA, 22 bp, Homo sapiens
gcacatttgccactgagctcct

SEQ ID NO: 7771662 - DNA, 22 bp, Homo sapiens
gcagaggtgctcagtggcagaa

SEQ ID NO: 7771663 - DNA, 22 bp, Homo sapiens
gcagaggtggcatctgggctct

SEQ ID NO: 7771664 - DNA, 22 bp, Homo sapiens
gcagcaaacttccacaagtaga

SEQ ID NO: 7771665 - DNA, 22 bp, Homo sapiens
gcagcaaaaaagtaatatttat

SEQ ID NO: 7771666 - DNA, 22 bp, Homo sapiens
gcagatgttgttgctgggagtt

SEQ ID NO: 7771667 - DNA, 22 bp, Homo sapiens
gctaggaagctggggagaagtc

SEQ ID NO: 7771668 - DNA, 22 bp, Homo sapiens
gctaggaggccctgcacgctta

SEQ ID NO: 7771669 - DNA, 22 bp, Homo sapiens
gctagctgggtttcactgtgga

SEQ ID NO: 7771670 - DNA, 22 bp, Homo sapiens
gctagaaatcgacttcagaatt

SEQ ID NO: 7771671 - DNA, 22 bp, Homo sapiens
gctagcctgcagtggctatggt

SEQ ID NO: 7771672 - DNA, 22 bp, Homo sapiens
gctagcctgcagtggctatggt

SEQ ID NO: 7771673 - DNA, 22 bp, Homo sapiens
gctagcctgcagtggctatggt

SEQ ID NO: 7771674 - DNA, 22 bp, Homo sapiens
gctaggctcggaagcagcaggg

SEQ ID NO: 7771675 - DNA, 22 bp, Homo sapiens
gctaggctcggaagcagcaggg

SEQ ID NO: 7771676 - DNA, 22 bp, Homo sapiens
gctaggcttcaaaatctccctg

SEQ ID NO: 7771677 - DNA, 23 bp, Homo sapiens
gctcatcaggcttagagtcaagg

SEQ ID NO: 7771678 - DNA, 22 bp, Homo sapiens
gctcagggagagagggcagccg

SEQ ID NO: 7771679 - DNA, 19 bp, Homo sapiens
gctaggtgaccagctggat

SEQ ID NO: 7771680 - DNA, 23 bp, Homo sapiens
gctaggtgcttccacacgtgctg

SEQ ID NO: 7771681 - DNA, 22 bp, Homo sapiens
gctaggtgcagcagacagctta

SEQ ID NO: 7771682 - DNA, 22 bp, Homo sapiens
gctcagggccatggaccagcag

SEQ ID NO: 7771683 - DNA, 22 bp, Homo sapiens
gctcagggagtttcacagtgta

SEQ ID NO: 7771684 - DNA, 22 bp, Homo sapiens
gctcagggagtttcacagtgta

SEQ ID NO: 7771685 - DNA, 22 bp, Homo sapiens
gctcagggcctggctgcggact

SEQ ID NO: 7771686 - DNA, 20 bp, Homo sapiens
gctcagggcctgggtctgga

SEQ ID NO: 7771687 - DNA, 22 bp, Homo sapiens
gctcagggcgcgagggacgtgg

SEQ ID NO: 7771688 - DNA, 22 bp, Homo sapiens
gctctctccctaggcaagtgag

SEQ ID NO: 7771689 - DNA, 22 bp, Homo sapiens
gctccctccatgaggcagaccg

SEQ ID NO: 7771690 - DNA, 20 bp, Homo sapiens
gctccccttctctgggcctc

SEQ ID NO: 7771691 - DNA, 22 bp, Homo sapiens
gctctgtccagcgtgcacagaa

SEQ ID NO: 7771692 - DNA, 22 bp, Homo sapiens
gctggcagtgtattgttagctg

SEQ ID NO: 7771693 - DNA, 22 bp, Homo sapiens
gctggcagtcccatcagctggg

SEQ ID NO: 7771694 - DNA, 22 bp, Homo sapiens
gctggcagtcccatcagctggg

SEQ ID NO: 7771695 - DNA, 22 bp, Homo sapiens
gctggcagtaaagggtttggca

SEQ ID NO: 7771696 - DNA, 22 bp, Homo sapiens
gctggcagtcccatcagctggg

SEQ ID NO: 7771697 - DNA, 22 bp, Homo sapiens
gctggcagtttcctcaccgagg

SEQ ID NO: 7771698 - DNA, 22 bp, Homo sapiens
gctggcagtgtgaatgacaagc

SEQ ID NO: 7771699 - DNA, 22 bp, Homo sapiens
gctggcatcactggcttcggtg

SEQ ID NO: 7771700 - DNA, 22 bp, Homo sapiens
gctggcatggagactctgggtc

SEQ ID NO: 7771701 - DNA, 22 bp, Homo sapiens
gctggcatggagactctgggtc

SEQ ID NO: 7771702 - DNA, 22 bp, Homo sapiens
gctggcattacaggagagaacc

SEQ ID NO: 7771703 - DNA, 22 bp, Homo sapiens
gctggcattacaggagagaacc

SEQ ID NO: 7771704 - DNA, 22 bp, Homo sapiens
gctggcaggtccaagatagagc

SEQ ID NO: 7771705 - DNA, 22 bp, Homo sapiens
gctggcagggttctcactgaaa

SEQ ID NO: 7771706 - DNA, 22 bp, Homo sapiens
gctggcaggtaaagccccgggg

SEQ ID NO: 7771707 - DNA, 22 bp, Homo sapiens
gctggcagggtggttgagagag

SEQ ID NO: 7771708 - DNA, 22 bp, Homo sapiens
gctggcagggtggttgagagag

SEQ ID NO: 7771709 - DNA, 22 bp, Homo sapiens
gctggatccctgtgggagtggt

SEQ ID NO: 7771710 - DNA, 22 bp, Homo sapiens
gctggagttaggtgggcttgaa

SEQ ID NO: 7771711 - DNA, 22 bp, Homo sapiens
gctggagttggcaaggcatgta

SEQ ID NO: 7771712 - DNA, 22 bp, Homo sapiens
gctggagttggcaaggcatgta

SEQ ID NO: 7771713 - DNA, 22 bp, Homo sapiens
gctggagttgtgggtttactaa

SEQ ID NO: 7771714 - DNA, 22 bp, Homo sapiens
gctggaggtagggaggtcctgt

SEQ ID NO: 7771715 - DNA, 22 bp, Homo sapiens
gctggagtatctggggaaggag

SEQ ID NO: 7771716 - DNA, 22 bp, Homo sapiens
gctggagtccagtggcatgatc

SEQ ID NO: 7771717 - DNA, 22 bp, Homo sapiens
gctggagtccagtggcatgatc

SEQ ID NO: 7771718 - DNA, 22 bp, Homo sapiens
gctggagtaggaccatgcttga

SEQ ID NO: 7771719 - DNA, 22 bp, Homo sapiens
gctggagtacatctttggcggc

SEQ ID NO: 7771720 - DNA, 22 bp, Homo sapiens
gctggaggtttcacctgagttt

SEQ ID NO: 7771721 - DNA, 22 bp, Homo sapiens
gctggagtgctgaggtgcagtg

SEQ ID NO: 7771722 - DNA, 22 bp, Homo sapiens
gctggagtgcagttgcacagtc

SEQ ID NO: 7771723 - DNA, 22 bp, Homo sapiens
gctggagttagaactagcctgg

SEQ ID NO: 7771724 - DNA, 22 bp, Homo sapiens
gctggagtgctggagtgcagtg

SEQ ID NO: 7771725 - DNA, 22 bp, Homo sapiens
gctggagtgctggagtgcagtg

SEQ ID NO: 7771726 - DNA, 22 bp, Homo sapiens
gctggagttaggtgggcttgaa

SEQ ID NO: 7771727 - DNA, 22 bp, Homo sapiens
gctggagtccctgcctttcctt

SEQ ID NO: 7771728 - DNA, 22 bp, Homo sapiens
gctggagtctggaggtgtgcca

SEQ ID NO: 7771729 - DNA, 22 bp, Homo sapiens
gctggagtgatgcctgtgtctc

SEQ ID NO: 7771730 - DNA, 22 bp, Homo sapiens
gctggagtgagtatgtgtagtc

SEQ ID NO: 7771731 - DNA, 22 bp, Homo sapiens
gctgctggaacaaatcacccca

SEQ ID NO: 7771732 - DNA, 22 bp, Homo sapiens
gctgctggaagcatgcgatgaa

SEQ ID NO: 7771733 - DNA, 22 bp, Homo sapiens
gctgctggaagcatgcgatgaa

SEQ ID NO: 7771734 - DNA, 22 bp, Homo sapiens
gctgcctgaagtgtctacactg

SEQ ID NO: 7771735 - DNA, 23 bp, Homo sapiens
gctgcctctgttggtcttcagtt

SEQ ID NO: 7771736 - DNA, 22 bp, Homo sapiens
gctgcctctgtagctttggacc

SEQ ID NO: 7771737 - DNA, 22 bp, Homo sapiens
gctgcctctgtagctttggacc

SEQ ID NO: 7771738 - DNA, 22 bp, Homo sapiens
gctgctggggccttccctcggg

SEQ ID NO: 7771739 - DNA, 22 bp, Homo sapiens
gctgctgggatcctgggtctca

SEQ ID NO: 7771740 - DNA, 22 bp, Homo sapiens
gctgctggggtcacatggtaag

SEQ ID NO: 7771741 - DNA, 22 bp, Homo sapiens
gctgctggggtcacatggtaag

SEQ ID NO: 7771742 - DNA, 22 bp, Homo sapiens
gctgctgggatcctgggtctca

SEQ ID NO: 7771743 - DNA, 19 bp, Homo sapiens
gctgctggctctggctgga

SEQ ID NO: 7771744 - DNA, 19 bp, Homo sapiens
gctgctggctctggctgga

SEQ ID NO: 7771745 - DNA, 22 bp, Homo sapiens
gctggaggggtaataggatggg

SEQ ID NO: 7771746 - DNA, 22 bp, Homo sapiens
gctggaggggtaataggatggg

SEQ ID NO: 7771747 - DNA, 22 bp, Homo sapiens
gctgctgtccttcaagtctgcg

SEQ ID NO: 7771748 - DNA, 22 bp, Homo sapiens
gctgctggtcctcagagctcat

SEQ ID NO: 7771749 - DNA, 22 bp, Homo sapiens
gctgctggtcctcagagctcat

SEQ ID NO: 7771750 - DNA, 22 bp, Homo sapiens
gctgctgggtccctctgtgcca

SEQ ID NO: 7771751 - DNA, 22 bp, Homo sapiens
gctgctgtcacccacatctgtc

SEQ ID NO: 7771752 - DNA, 18 bp, Homo sapiens
gctgctggtggagggagc

SEQ ID NO: 7771753 - DNA, 18 bp, Homo sapiens
gctgctggtggagggagc

SEQ ID NO: 7771754 - DNA, 22 bp, Homo sapiens
gctgcagggctctcacaggggg

SEQ ID NO: 7771755 - DNA, 22 bp, Homo sapiens
gctgcaggggggtctggacttg

SEQ ID NO: 7771756 - DNA, 22 bp, Homo sapiens
gctgcaggggggtctggacttg

SEQ ID NO: 7771757 - DNA, 22 bp, Homo sapiens
gctgcaggctctgcaggaattg

SEQ ID NO: 7771758 - DNA, 22 bp, Homo sapiens
gctgcaggctgtggcaggggag

SEQ ID NO: 7771759 - DNA, 22 bp, Homo sapiens
gctgcagggagctggaaggctc

SEQ ID NO: 7771760 - DNA, 22 bp, Homo sapiens
gctgcagggagctggaaggctc

SEQ ID NO: 7771761 - DNA, 22 bp, Homo sapiens
gctgcctcccagagccctgcag

SEQ ID NO: 7771762 - DNA, 22 bp, Homo sapiens
gctgcctccactggctcccagt

SEQ ID NO: 7771763 - DNA, 22 bp, Homo sapiens
gctgcctccactggctcccagt

SEQ ID NO: 7771764 - DNA, 22 bp, Homo sapiens
gctgcctccactggctcccagt

SEQ ID NO: 7771765 - DNA, 23 bp, Homo sapiens
gctgcctcctacaaaagcccagc

SEQ ID NO: 7771766 - DNA, 22 bp, Homo sapiens
gctgcctccgccggctccacag

SEQ ID NO: 7771767 - DNA, 22 bp, Homo sapiens
gctgcctccgccggctccacag

SEQ ID NO: 7771768 - DNA, 22 bp, Homo sapiens
gctgcctcccccatggctggaa

SEQ ID NO: 7771769 - DNA, 22 bp, Homo sapiens
gctgcctcccccatggctggaa

SEQ ID NO: 7771770 - DNA, 22 bp, Homo sapiens
gctgcctcctgaaagcgctctg

SEQ ID NO: 7771771 - DNA, 22 bp, Homo sapiens
gctgcctctcctgagttgacag

SEQ ID NO: 7771772 - DNA, 23 bp, Homo sapiens
gctgcctcctacaaaagcccagc

SEQ ID NO: 7771773 - DNA, 22 bp, Homo sapiens
gctgcctcctgaaagcgctctg

SEQ ID NO: 7771774 - DNA, 22 bp, Homo sapiens
gctgcctcctgagatttgggca

SEQ ID NO: 7771775 - DNA, 22 bp, Homo sapiens
gctgcctcctgagatttgggca

SEQ ID NO: 7771776 - DNA, 22 bp, Homo sapiens
gctgcctctgcacagctcactc

SEQ ID NO: 7771777 - DNA, 22 bp, Homo sapiens
gctgcctctgcgactctgggcg

SEQ ID NO: 7771778 - DNA, 22 bp, Homo sapiens
gctgcaggcgcctgcggtctct

SEQ ID NO: 7771779 - DNA, 22 bp, Homo sapiens
gctgcaggcagaatctcccaat

SEQ ID NO: 7771780 - DNA, 22 bp, Homo sapiens
gctgcaggcattttcctgggca

SEQ ID NO: 7771781 - DNA, 22 bp, Homo sapiens
gctgaggttttctgcctgctca

SEQ ID NO: 7771782 - DNA, 22 bp, Homo sapiens
gctgagtcttgagcactgagca

SEQ ID NO: 7771783 - DNA, 18 bp, Homo sapiens
gctgaggtggtgtcagag

SEQ ID NO: 7771784 - DNA, 22 bp, Homo sapiens
gcttaaaagccacttagtctat

SEQ ID NO: 7771785 - DNA, 22 bp, Homo sapiens
gcttaaaatccatgatttttac

SEQ ID NO: 7771786 - DNA, 22 bp, Homo sapiens
gctgtgtgctgggcatggcact

SEQ ID NO: 7771787 - DNA, 22 bp, Homo sapiens
gctgttggggccagcaggtcat

SEQ ID NO: 7771788 - DNA, 22 bp, Homo sapiens
gctttaatgaagtcacgcaaag

SEQ ID NO: 7771789 - DNA, 22 bp, Homo sapiens
gcttgtttgtgatttctccaga

SEQ ID NO: 7771790 - DNA, 23 bp, Homo sapiens
gcttgtgtatacaggaggccacc

SEQ ID NO: 7771791 - DNA, 22 bp, Homo sapiens
gcttgtttgtgcctctgcagaa

SEQ ID NO: 7771792 - DNA, 22 bp, Homo sapiens
gcttgtttgtgatttctccaga

SEQ ID NO: 7771793 - DNA, 22 bp, Homo sapiens
gcttggggtcatgaggctgctg

SEQ ID NO: 7771794 - DNA, 23 bp, Homo sapiens
gcttgtctagtgaattcatatct

SEQ ID NO: 7771795 - DNA, 22 bp, Homo sapiens
gcttgtctctcagccccagtca

SEQ ID NO: 7771796 - DNA, 22 bp, Homo sapiens
gcttaaattgtttgtggatagt

SEQ ID NO: 7771797 - DNA, 22 bp, Homo sapiens
gcttaaatcccaatgctagacc

SEQ ID NO: 7771798 - DNA, 22 bp, Homo sapiens
gcttaaagttgtaaattagaga

SEQ ID NO: 7771799 - DNA, 22 bp, Homo sapiens
gcttttcatagataaaattcta

SEQ ID NO: 7771800 - DNA, 20 bp, Homo sapiens
gctttttctaatagcagtcc

SEQ ID NO: 7771801 - DNA, 22 bp, Homo sapiens
gctttttcaaatgaaagctggt

SEQ ID NO: 7771802 - DNA, 22 bp, Homo sapiens
gcttttgtggctgtcttcattg

SEQ ID NO: 7771803 - DNA, 22 bp, Homo sapiens
gctttggtcttctagctgtgag

SEQ ID NO: 7771804 - DNA, 22 bp, Homo sapiens
gctttggatgtgtgcctgaggt

SEQ ID NO: 7771805 - DNA, 22 bp, Homo sapiens
gctggccaggaagagtctcaga

SEQ ID NO: 7771806 - DNA, 22 bp, Homo sapiens
gctggtcagagagaaaggaggc

SEQ ID NO: 7771807 - DNA, 22 bp, Homo sapiens
gctggtcagagagaaaggaggc

SEQ ID NO: 7771808 - DNA, 22 bp, Homo sapiens
gctggtcccaatgtgtttcctt

SEQ ID NO: 7771809 - DNA, 22 bp, Homo sapiens
gctggccacactgctgatggag

SEQ ID NO: 7771810 - DNA, 22 bp, Homo sapiens
gctggccaaagtgtacctggag

SEQ ID NO: 7771811 - DNA, 22 bp, Homo sapiens
gctggccacactgctgatggag

SEQ ID NO: 7771812 - DNA, 22 bp, Homo sapiens
gctgtattcctgcactgtatag

SEQ ID NO: 7771813 - DNA, 22 bp, Homo sapiens
gctgtatttattttctagggtt

SEQ ID NO: 7771814 - DNA, 22 bp, Homo sapiens
gctgtatttaacaactggctca

SEQ ID NO: 7771815 - DNA, 18 bp, Homo sapiens
gctgtgtgcacctgataa

SEQ ID NO: 7771816 - DNA, 22 bp, Homo sapiens
gctgtctggcatggcgtggctg

SEQ ID NO: 7771817 - DNA, 22 bp, Homo sapiens
gctgtccttcctggctggggtg

SEQ ID NO: 7771818 - DNA, 22 bp, Homo sapiens
ggagaagaggagctggaagcct

SEQ ID NO: 7771819 - DNA, 22 bp, Homo sapiens
ggagaaagggactgatctgctc

SEQ ID NO: 7771820 - DNA, 22 bp, Homo sapiens
ggagccaggggaccttcacaga

SEQ ID NO: 7771821 - DNA, 22 bp, Homo sapiens
ggagccagtttagacctcagtt

SEQ ID NO: 7771822 - DNA, 18 bp, Homo sapiens
ggagccagtctgtctctg

SEQ ID NO: 7771823 - DNA, 22 bp, Homo sapiens
ggagccagtatttagtggtctt

SEQ ID NO: 7771824 - DNA, 22 bp, Homo sapiens
ggagccagtatttagtggtctt

SEQ ID NO: 7771825 - DNA, 18 bp, Homo sapiens
ggagcccacggcgtccca

SEQ ID NO: 7771826 - DNA, 18 bp, Homo sapiens
ggagcccagaggacagga

SEQ ID NO: 7771827 - DNA, 22 bp, Homo sapiens
ggagcccaagtctgcactcggc

SEQ ID NO: 7771828 - DNA, 22 bp, Homo sapiens
ggagccatgttttcagcatgat

SEQ ID NO: 7771829 - DNA, 18 bp, Homo sapiens
ggagcccacggcgtccca

SEQ ID NO: 7771830 - DNA, 22 bp, Homo sapiens
ggagcccaagtctgcactcggc

SEQ ID NO: 7771831 - DNA, 18 bp, Homo sapiens
ggagcccacggcgtccca

SEQ ID NO: 7771832 - DNA, 19 bp, Homo sapiens
ggagcctggcaggggcgtg

SEQ ID NO: 7771833 - DNA, 22 bp, Homo sapiens
ggagcctggcccggcccttggc

SEQ ID NO: 7771834 - DNA, 22 bp, Homo sapiens
ggagccccaattgagcagtacg

SEQ ID NO: 7771835 - DNA, 22 bp, Homo sapiens
ggagcccaggttgtttgtgcag

SEQ ID NO: 7771836 - DNA, 22 bp, Homo sapiens
ggagccctcaccggcgagtgcc

SEQ ID NO: 7771837 - DNA, 22 bp, Homo sapiens
ggagctgtgggacgctgtccca

SEQ ID NO: 7771838 - DNA, 21 bp, Homo sapiens
ggagctggggagctggcccca

SEQ ID NO: 7771839 - DNA, 22 bp, Homo sapiens
ggaggaggggtgactgaatgct

SEQ ID NO: 7771840 - DNA, 22 bp, Homo sapiens
ggaggaggggtgactgaatgct

SEQ ID NO: 7771841 - DNA, 22 bp, Homo sapiens
ggaggaggcggcagaagttcct

SEQ ID NO: 7771842 - DNA, 22 bp, Homo sapiens
ggagctgttggcagctatcttg

SEQ ID NO: 7771843 - DNA, 22 bp, Homo sapiens
ggagctgggaactatgtagtat

SEQ ID NO: 7771844 - DNA, 18 bp, Homo sapiens
ggagctgggcctggttcc

SEQ ID NO: 7771845 - DNA, 22 bp, Homo sapiens
ggagctgggaccctgtcatctg

SEQ ID NO: 7771846 - DNA, 22 bp, Homo sapiens
ggagctggctacagagaactcc

SEQ ID NO: 7771847 - DNA, 22 bp, Homo sapiens
ggagcctgggcctcctgccctt

SEQ ID NO: 7771848 - DNA, 22 bp, Homo sapiens
ggacagagggttgacagagtat

SEQ ID NO: 7771849 - DNA, 22 bp, Homo sapiens
ggacaggataagagacactgcc

SEQ ID NO: 7771850 - DNA, 22 bp, Homo sapiens
ggacaggatgctgaagatgaag

SEQ ID NO: 7771851 - DNA, 18 bp, Homo sapiens
ggacaggagacatgggtg

SEQ ID NO: 7771852 - DNA, 22 bp, Homo sapiens
ggacaggagtgaggcgggttcc

SEQ ID NO: 7771853 - DNA, 22 bp, Homo sapiens
ggaaggctttctgttctgtgac

SEQ ID NO: 7771854 - DNA, 22 bp, Homo sapiens
ggaaggctctgttccttgactt

SEQ ID NO: 7771855 - DNA, 19 bp, Homo sapiens
ggaaggccacggcaggctt

SEQ ID NO: 7771856 - DNA, 22 bp, Homo sapiens
ggaaggaattccaagactaaag

SEQ ID NO: 7771857 - DNA, 19 bp, Homo sapiens
ggaaggagagaaatgcatg

SEQ ID NO: 7771858 - DNA, 22 bp, Homo sapiens
ggaaaaatgacacatatctcaa

SEQ ID NO: 7771859 - DNA, 22 bp, Homo sapiens
ggacttggggaaggcacagtta

SEQ ID NO: 7771860 - DNA, 22 bp, Homo sapiens
ggagaaagctgtagtggaatgt

SEQ ID NO: 7771861 - DNA, 22 bp, Homo sapiens
ggagaaagctatgtgggggagt

SEQ ID NO: 7771862 - DNA, 22 bp, Homo sapiens
ggagaaaggcatagcagaacct

SEQ ID NO: 7771863 - DNA, 22 bp, Homo sapiens
ggagaaaggcatagcagaacct

SEQ ID NO: 7771864 - DNA, 22 bp, Homo sapiens
ggacagggtaagtactagtgtg

SEQ ID NO: 7771865 - DNA, 21 bp, Homo sapiens
ggacttggatggtggcagtag

SEQ ID NO: 7771866 - DNA, 22 bp, Homo sapiens
ggacaggcccggggagcctgga

SEQ ID NO: 7771867 - DNA, 22 bp, Homo sapiens
gacaaataggtcaacaggaggg

SEQ ID NO: 7771868 - DNA, 22 bp, Homo sapiens
gacaaagtgctaaaccacagag

SEQ ID NO: 7771869 - DNA, 22 bp, Homo sapiens
gacagcagggaaagtccagacc

SEQ ID NO: 7771870 - DNA, 20 bp, Homo sapiens
gacaacacagcttcaggtcc

SEQ ID NO: 7771871 - DNA, 22 bp, Homo sapiens
gacaaactgaagtatatttaga

SEQ ID NO: 7771872 - DNA, 21 bp, Homo sapiens
gacaaacatttcatagcttta

SEQ ID NO: 7771873 - DNA, 22 bp, Homo sapiens
gacaaaactgagatcacactgt

SEQ ID NO: 7771874 - DNA, 22 bp, Homo sapiens
gaatttatctacgttaagtatg

SEQ ID NO: 7771875 - DNA, 20 bp, Homo sapiens
gaattttatgaacactacca

SEQ ID NO: 7771876 - DNA, 22 bp, Homo sapiens
gacaaaacacattagtttaaaa

SEQ ID NO: 7771877 - DNA, 22 bp, Homo sapiens
gaattttattactagtcaactg

SEQ ID NO: 7771878 - DNA, 22 bp, Homo sapiens
gaagaatattcttgatcttaga

SEQ ID NO: 7771879 - DNA, 22 bp, Homo sapiens
gaagaatatataatgattttgt

SEQ ID NO: 7771880 - DNA, 22 bp, Homo sapiens
gaatgcagtgacggaggcttac

SEQ ID NO: 7771881 - DNA, 22 bp, Homo sapiens
gaatgcagtgacggaggcttac

SEQ ID NO: 7771882 - DNA, 22 bp, Homo sapiens
gaattacagccagaagaatgaa

SEQ ID NO: 7771883 - DNA, 22 bp, Homo sapiens
gaatttaaggaccaagcatttt

SEQ ID NO: 7771884 - DNA, 22 bp, Homo sapiens
gaattacatagtttctaggttc

SEQ ID NO: 7771885 - DNA, 22 bp, Homo sapiens
gaattacataataaaatgagag

SEQ ID NO: 7771886 - DNA, 22 bp, Homo sapiens
gaatgtaagtgggcagaagaca

SEQ ID NO: 7771887 - DNA, 19 bp, Homo sapiens
gaatgtttgtattcagcgc

SEQ ID NO: 7771888 - DNA, 22 bp, Homo sapiens
gaatgctttgggaattcagaat

SEQ ID NO: 7771889 - DNA, 22 bp, Homo sapiens
gaatgcttggaacctgaagttc

SEQ ID NO: 7771890 - DNA, 22 bp, Homo sapiens
gacctgcccactctgaggacat

SEQ ID NO: 7771891 - DNA, 22 bp, Homo sapiens
gacctgctccacgacaagtggt

SEQ ID NO: 7771892 - DNA, 22 bp, Homo sapiens
gacattagactaatgtagcatt

SEQ ID NO: 7771893 - DNA, 22 bp, Homo sapiens
gacatgcagttctcaagggtag

SEQ ID NO: 7771894 - DNA, 22 bp, Homo sapiens
gactatttagtttcagattagt

SEQ ID NO: 7771895 - DNA, 22 bp, Homo sapiens
gaccttgtgatccacccgcctt

SEQ ID NO: 7771896 - DNA, 22 bp, Homo sapiens
gacctggggtggaaggaaggca

SEQ ID NO: 7771897 - DNA, 22 bp, Homo sapiens
gaccttccatgccttcttccaa

SEQ ID NO: 7771898 - DNA, 22 bp, Homo sapiens
gaccttctgttggaggcattta

SEQ ID NO: 7771899 - DNA, 22 bp, Homo sapiens
gaccttccttctttgctccggg

SEQ ID NO: 7771900 - DNA, 22 bp, Homo sapiens
gacatcaattcagcattttaag

SEQ ID NO: 7771901 - DNA, 22 bp, Homo sapiens
gacagctgtacactcctggtta

SEQ ID NO: 7771902 - DNA, 22 bp, Homo sapiens
gacagtgattagttactataaa

SEQ ID NO: 7771903 - DNA, 22 bp, Homo sapiens
gacagccatcagcacacgctgc

SEQ ID NO: 7771904 - DNA, 22 bp, Homo sapiens
gagaacctctccacaagtctgg

SEQ ID NO: 7771905 - DNA, 22 bp, Homo sapiens
gagagaagggggatatgagcct

SEQ ID NO: 7771906 - DNA, 22 bp, Homo sapiens
gagagaagaatgttccgaggcc

SEQ ID NO: 7771907 - DNA, 22 bp, Homo sapiens
gagaagccgagtcagctgagcc

SEQ ID NO: 7771908 - DNA, 22 bp, Homo sapiens
gagagaagaaagccatggtcct

SEQ ID NO: 7771909 - DNA, 22 bp, Homo sapiens
gagaagccgagtcagctgagcc

SEQ ID NO: 7771910 - DNA, 22 bp, Homo sapiens
gagaagcaatcgtgacatctcc

SEQ ID NO: 7771911 - DNA, 22 bp, Homo sapiens
gagaagcaatcagtggccaccc

SEQ ID NO: 7771912 - DNA, 18 bp, Homo sapiens
gagaggagccagaatttt

SEQ ID NO: 7771913 - DNA, 22 bp, Homo sapiens
gagaggagtaggctgatggtgc

SEQ ID NO: 7771914 - DNA, 22 bp, Homo sapiens
gagagctgtccggctgagcagc

SEQ ID NO: 7771915 - DNA, 22 bp, Homo sapiens
gagagctgtcagcgtagcaccg

SEQ ID NO: 7771916 - DNA, 22 bp, Homo sapiens
gagaggagacttatccagattg

SEQ ID NO: 7771917 - DNA, 22 bp, Homo sapiens
gagaggagaagcctgcgcttca

SEQ ID NO: 7771918 - DNA, 22 bp, Homo sapiens
gagagccctacaaggcgttttg

SEQ ID NO: 7771919 - DNA, 22 bp, Homo sapiens
gagaggcaggaatcctgggtga

SEQ ID NO: 7771920 - DNA, 22 bp, Homo sapiens
gagaggcagaggcctgaaaccg

SEQ ID NO: 7771921 - DNA, 22 bp, Homo sapiens
gagaggcaggaatcctgggtga

SEQ ID NO: 7771922 - DNA, 22 bp, Homo sapiens
gagcaacagtttatggtttttc

SEQ ID NO: 7771923 - DNA, 22 bp, Homo sapiens
gagcaaagcttttagggccttt

SEQ ID NO: 7771924 - DNA, 22 bp, Homo sapiens
gagcaaatggagcttgtctact

SEQ ID NO: 7771925 - DNA, 22 bp, Homo sapiens
gagcaatggaagatagataaca

SEQ ID NO: 7771926 - DNA, 22 bp, Homo sapiens
gagcacagatcctggagccaca

SEQ ID NO: 7771927 - DNA, 20 bp, Homo sapiens
gagcacagtaatgactgcta

SEQ ID NO: 7771928 - DNA, 19 bp, Homo sapiens
gagcagcttcctatctggt

SEQ ID NO: 7771929 - DNA, 22 bp, Homo sapiens
gagcaggaactgaaaatgagac

SEQ ID NO: 7771930 - DNA, 22 bp, Homo sapiens
gagcaggaaggccagaagggtc

SEQ ID NO: 7771931 - DNA, 22 bp, Homo sapiens
gagcaggaaggccagaagggtc

SEQ ID NO: 7771932 - DNA, 22 bp, Homo sapiens
gaggacctttagtagaagtgca

SEQ ID NO: 7771933 - DNA, 22 bp, Homo sapiens
gaggaccacagatgagcctgca

SEQ ID NO: 7771934 - DNA, 22 bp, Homo sapiens
gaggaccacagatgagcctgca

SEQ ID NO: 7771935 - DNA, 17 bp, Homo sapiens
gaggacagggaagtagg

SEQ ID NO: 7771936 - DNA, 22 bp, Homo sapiens
gaggacagtgtgatctgccagc

SEQ ID NO: 7771937 - DNA, 22 bp, Homo sapiens
gaggagagaagctaacggtgct

SEQ ID NO: 7771938 - DNA, 22 bp, Homo sapiens
gaggactgcagatgggtgcatc

SEQ ID NO: 7771939 - DNA, 22 bp, Homo sapiens
gaggagaaagcagtgatttgtg

SEQ ID NO: 7771940 - DNA, 18 bp, Homo sapiens
gaggatggaaggagatgc

SEQ ID NO: 7771941 - DNA, 18 bp, Homo sapiens
gaggatggaaggagatgc

SEQ ID NO: 7771942 - DNA, 22 bp, Homo sapiens
gaggatggaggcagttagggcc

SEQ ID NO: 7771943 - DNA, 22 bp, Homo sapiens
gaggagagaagctaacggtgct

SEQ ID NO: 7771944 - DNA, 22 bp, Homo sapiens
gaggagagagggactgtctgca

SEQ ID NO: 7771945 - DNA, 22 bp, Homo sapiens
gaggagagagggactgtctgca

SEQ ID NO: 7771946 - DNA, 22 bp, Homo sapiens
gaggcatggcctgaggctagga

SEQ ID NO: 7771947 - DNA, 21 bp, Homo sapiens
gaggccactaataggggcaga

SEQ ID NO: 7771948 - DNA, 22 bp, Homo sapiens
gaggatggtgagcaggacccag

SEQ ID NO: 7771949 - DNA, 22 bp, Homo sapiens
gaggcaagaaaggactttctag

SEQ ID NO: 7771950 - DNA, 22 bp, Homo sapiens
gaggccagaagtgcctcgggct

SEQ ID NO: 7771951 - DNA, 22 bp, Homo sapiens
gaggccagaagtgcctcgggct

SEQ ID NO: 7771952 - DNA, 22 bp, Homo sapiens
gaggccagagttccccgagtca

SEQ ID NO: 7771953 - DNA, 22 bp, Homo sapiens
gaggcctggaccagccacagag

SEQ ID NO: 7771954 - DNA, 22 bp, Homo sapiens
gagctcattgtggatggatggg

SEQ ID NO: 7771955 - DNA, 22 bp, Homo sapiens
gagctcagcccaaagagcagtg

SEQ ID NO: 7771956 - DNA, 22 bp, Homo sapiens
gagctcaggagcatcagaagaa

SEQ ID NO: 7771957 - DNA, 22 bp, Homo sapiens
gagcaggcctggggtgaggcct

SEQ ID NO: 7771958 - DNA, 22 bp, Homo sapiens
gagcaggcctggggtgaggcct

SEQ ID NO: 7771959 - DNA, 22 bp, Homo sapiens
gagcaggccagcaatggaaggg

SEQ ID NO: 7771960 - DNA, 22 bp, Homo sapiens
gagctcagagcctatagttggt

SEQ ID NO: 7771961 - DNA, 22 bp, Homo sapiens
gagcaggctctgcctgtgtgtc

SEQ ID NO: 7771962 - DNA, 22 bp, Homo sapiens
gagcaggctctgcctgtgtgtc

SEQ ID NO: 7771963 - DNA, 22 bp, Homo sapiens
gagcaggcaactctgcagtgcc

SEQ ID NO: 7771964 - DNA, 22 bp, Homo sapiens
gagcaggcaactctgcagtgcc

SEQ ID NO: 7771965 - DNA, 22 bp, Homo sapiens
gagcaggcattctagtggctga

SEQ ID NO: 7771966 - DNA, 19 bp, Homo sapiens
gagcaggccacacatgtgt

SEQ ID NO: 7771967 - DNA, 19 bp, Homo sapiens
gagcaggccacacatgtgt

SEQ ID NO: 7771968 - DNA, 22 bp, Homo sapiens
gagcaggcattctagtggctga

SEQ ID NO: 7771969 - DNA, 22 bp, Homo sapiens
gagcaggcaaagatgaaaggag

SEQ ID NO: 7771970 - DNA, 22 bp, Homo sapiens
gagcaggcaaagatgaaaggag

SEQ ID NO: 7771971 - DNA, 22 bp, Homo sapiens
gagctgtgcttataccaattca

SEQ ID NO: 7771972 - DNA, 22 bp, Homo sapiens
gaggacaggagactcactgttt

SEQ ID NO: 7771973 - DNA, 17 bp, Homo sapiens
gaggacagggaagtagg

SEQ ID NO: 7771974 - DNA, 22 bp, Homo sapiens
gaggcctgtagtcatggatgta

SEQ ID NO: 7771975 - DNA, 22 bp, Homo sapiens
gaggcctggtttgcatgagaat

SEQ ID NO: 7771976 - DNA, 22 bp, Homo sapiens
gaggcctggtttgcatgagaat

SEQ ID NO: 7771977 - DNA, 22 bp, Homo sapiens
gaggcctggtgctgtgtccaca

SEQ ID NO: 7771978 - DNA, 19 bp, Homo sapiens
gaggcgaggcgtgcaggag

SEQ ID NO: 7771979 - DNA, 19 bp, Homo sapiens
gaggcgaggcgtgcaggag

SEQ ID NO: 7771980 - DNA, 19 bp, Homo sapiens
gaggcgaggcgtgcaggag

SEQ ID NO: 7771981 - DNA, 22 bp, Homo sapiens
gaggctagagcaggggctcaat

SEQ ID NO: 7771982 - DNA, 22 bp, Homo sapiens
gaggcggcggccgagcctggct

SEQ ID NO: 7771983 - DNA, 22 bp, Homo sapiens
gaggctggtaggaaaggaaaca

SEQ ID NO: 7771984 - DNA, 22 bp, Homo sapiens
gaggctggtaggaaaggaaaca

SEQ ID NO: 7771985 - DNA, 22 bp, Homo sapiens
gaggctggggtctgcctttctg

SEQ ID NO: 7771986 - DNA, 22 bp, Homo sapiens
gaggctggggtctgcctttctg

SEQ ID NO: 7771987 - DNA, 22 bp, Homo sapiens
gaggctggttctgaagtactgt

SEQ ID NO: 7771988 - DNA, 22 bp, Homo sapiens
gaggctggttctgaagtactgt

SEQ ID NO: 7771989 - DNA, 22 bp, Homo sapiens
gaggctggttcccttgatcttt

SEQ ID NO: 7771990 - DNA, 22 bp, Homo sapiens
gaggctggttcccttgatcttt

SEQ ID NO: 7771991 - DNA, 22 bp, Homo sapiens
gaggctggtggttagttccatt

SEQ ID NO: 7771992 - DNA, 22 bp, Homo sapiens
gaggctggtggttagttccatt

SEQ ID NO: 7771993 - DNA, 22 bp, Homo sapiens
gaggctggtcagccctaagatc

SEQ ID NO: 7771994 - DNA, 22 bp, Homo sapiens
gaggctggtcagccctaagatc

SEQ ID NO: 7771995 - DNA, 22 bp, Homo sapiens
gaggctggtttgccttttggca

SEQ ID NO: 7771996 - DNA, 22 bp, Homo sapiens
gaggctggtttgccttttggca

SEQ ID NO: 7771997 - DNA, 22 bp, Homo sapiens
gagggaagattccccatatggg

SEQ ID NO: 7771998 - DNA, 22 bp, Homo sapiens
gagggaccccaggctggccctt

SEQ ID NO: 7771999 - DNA, 22 bp, Homo sapiens
gagggagaaggactatcaggct

SEQ ID NO: 7772000 - DNA, 22 bp, Homo sapiens
gagggccagaaagttattgaga

SEQ ID NO: 7772001 - DNA, 22 bp, Homo sapiens
gagggccacttgaatgttttca

SEQ ID NO: 7772002 - DNA, 22 bp, Homo sapiens
gagggcctactggacatgtcag

SEQ ID NO: 7772003 - DNA, 22 bp, Homo sapiens
gagggccaggcagcaagaaggc

SEQ ID NO: 7772004 - DNA, 22 bp, Homo sapiens
gagggccaggcagcaagaaggc

SEQ ID NO: 7772005 - DNA, 22 bp, Homo sapiens
gagggccagcagcctcagcatg

SEQ ID NO: 7772006 - DNA, 22 bp, Homo sapiens
gagggccagatcccaggaggaa

SEQ ID NO: 7772007 - DNA, 22 bp, Homo sapiens
gagggccagagtcctggggtca

SEQ ID NO: 7772008 - DNA, 22 bp, Homo sapiens
gaggtggctccttcagggaata

SEQ ID NO: 7772009 - DNA, 22 bp, Homo sapiens
gaggtggctggctcagagccag

SEQ ID NO: 7772010 - DNA, 22 bp, Homo sapiens
gaggtggctgcttgctgggaaa

SEQ ID NO: 7772011 - DNA, 22 bp, Homo sapiens
gaggtgagaagggggtcagatg

SEQ ID NO: 7772012 - DNA, 22 bp, Homo sapiens
gaggtgagtggatcacgaggtc

SEQ ID NO: 7772013 - DNA, 22 bp, Homo sapiens
gaggtgagtggatcacgaggtc

SEQ ID NO: 7772014 - DNA, 22 bp, Homo sapiens
gagtaaaagttggattacaaag

SEQ ID NO: 7772015 - DNA, 22 bp, Homo sapiens
gaggtgggagggcagtccctaa

SEQ ID NO: 7772016 - DNA, 22 bp, Homo sapiens
gagtaaggctgctgatggagtg

SEQ ID NO: 7772017 - DNA, 22 bp, Homo sapiens
gagtaatattctgtactggagg

SEQ ID NO: 7772018 - DNA, 22 bp, Homo sapiens
gagtaaggctgctgatggagtg

SEQ ID NO: 7772019 - DNA, 22 bp, Homo sapiens
gagggtggcctttagagcccat

SEQ ID NO: 7772020 - DNA, 22 bp, Homo sapiens
gagggtggctcctccctgggcc

SEQ ID NO: 7772021 - DNA, 22 bp, Homo sapiens
gagggtggggaatagactgcta

SEQ ID NO: 7772022 - DNA, 22 bp, Homo sapiens
gagggtggggaatagactgcta

SEQ ID NO: 7772023 - DNA, 22 bp, Homo sapiens
ctggttcatcgcggccacttat

SEQ ID NO: 7772024 - DNA, 22 bp, Homo sapiens
ctggttcatataggcaagttta

SEQ ID NO: 7772025 - DNA, 22 bp, Homo sapiens
ctggttcatggtggaatgacat

SEQ ID NO: 7772026 - DNA, 22 bp, Homo sapiens
ctggttcatccccttccaggaa

SEQ ID NO: 7772027 - DNA, 22 bp, Homo sapiens
ctggttcattaggtattagtgg

SEQ ID NO: 7772028 - DNA, 23 bp, Homo sapiens
ctggttcatagtcaagagattga

SEQ ID NO: 7772029 - DNA, 22 bp, Homo sapiens
ctggttcagtgaaaggcatggg

SEQ ID NO: 7772030 - DNA, 22 bp, Homo sapiens
ctggttcacatctgtttatctg

SEQ ID NO: 7772031 - DNA, 23 bp, Homo sapiens
ctggttcatagtcaagagattga

SEQ ID NO: 7772032 - DNA, 22 bp, Homo sapiens
ctggttcaatggggctgagccc

SEQ ID NO: 7772033 - DNA, 22 bp, Homo sapiens
ctggttcagtgaaaggcatggg

SEQ ID NO: 7772034 - DNA, 22 bp, Homo sapiens
ctggttcaatactaaacttctt

SEQ ID NO: 7772035 - DNA, 22 bp, Homo sapiens
ctggttcaatactaaacttctt

SEQ ID NO: 7772036 - DNA, 22 bp, Homo sapiens
ctgtcccagatgttctcagcac

SEQ ID NO: 7772037 - DNA, 19 bp, Homo sapiens
ctgtcccagactctgctct

SEQ ID NO: 7772038 - DNA, 19 bp, Homo sapiens
ctgtcccagactctgctct

SEQ ID NO: 7772039 - DNA, 22 bp, Homo sapiens
ctgtcccaggatcctgactcca

SEQ ID NO: 7772040 - DNA, 22 bp, Homo sapiens
ctgtcccctgtgctttcacttg

SEQ ID NO: 7772041 - DNA, 18 bp, Homo sapiens
ctgtcccatcctcaggtt

SEQ ID NO: 7772042 - DNA, 22 bp, Homo sapiens
ctgtcccaggatcctgactcca

SEQ ID NO: 7772043 - DNA, 22 bp, Homo sapiens
ctgtcccatccttactctaccc

SEQ ID NO: 7772044 - DNA, 22 bp, Homo sapiens
ctgtgacttttgccctgtacca

SEQ ID NO: 7772045 - DNA, 22 bp, Homo sapiens
ctgtgagagtggtggcctaggc

SEQ ID NO: 7772046 - DNA, 22 bp, Homo sapiens
ctgtgagatttttaaataactt

SEQ ID NO: 7772047 - DNA, 22 bp, Homo sapiens
ctgtgactgggtgacagtcctc

SEQ ID NO: 7772048 - DNA, 22 bp, Homo sapiens
ctgtgactggaatctggctctt

SEQ ID NO: 7772049 - DNA, 22 bp, Homo sapiens
ctgtgactgtgttggatgcaca

SEQ ID NO: 7772050 - DNA, 22 bp, Homo sapiens
ctgtgacttgccaaaggtcatt

SEQ ID NO: 7772051 - DNA, 22 bp, Homo sapiens
ctgtgactgcagcaccaagtaa

SEQ ID NO: 7772052 - DNA, 22 bp, Homo sapiens
ctgtgacagtttctcagaattt

SEQ ID NO: 7772053 - DNA, 22 bp, Homo sapiens
ctgtgacagtttctcagacttt

SEQ ID NO: 7772054 - DNA, 21 bp, Homo sapiens
ctgtccctctttgcttccctc

SEQ ID NO: 7772055 - DNA, 22 bp, Homo sapiens
ctgtctgttgaccatagtttgc

SEQ ID NO: 7772056 - DNA, 19 bp, Homo sapiens
ctgtgggtgtgcaagggtg

SEQ ID NO: 7772057 - DNA, 22 bp, Homo sapiens
ctgtgggtgaagacaagggaga

SEQ ID NO: 7772058 - DNA, 20 bp, Homo sapiens
ctgtggtgagcaggagagta

SEQ ID NO: 7772059 - DNA, 22 bp, Homo sapiens
ctgtggtgagcaactgactgaa

SEQ ID NO: 7772060 - DNA, 22 bp, Homo sapiens
ctgtgtttttggtctgatctat

SEQ ID NO: 7772061 - DNA, 22 bp, Homo sapiens
ctgtgtttctaagtaaaggagc

SEQ ID NO: 7772062 - DNA, 17 bp, Homo sapiens
ctgtggccacctggatg

SEQ ID NO: 7772063 - DNA, 22 bp, Homo sapiens
ctgtgggagggaaggcgcggcc

SEQ ID NO: 7772064 - DNA, 22 bp, Homo sapiens
ctgtggcaccaatacatttttc

SEQ ID NO: 7772065 - DNA, 22 bp, Homo sapiens
ctgtggcaggaagggactagca

SEQ ID NO: 7772066 - DNA, 22 bp, Homo sapiens
ctgggggcagcaagaagccatg

SEQ ID NO: 7772067 - DNA, 22 bp, Homo sapiens
ctgggggcagcaagaagccatg

SEQ ID NO: 7772068 - DNA, 22 bp, Homo sapiens
ctgggggccttacggaactcca

SEQ ID NO: 7772069 - DNA, 22 bp, Homo sapiens
ctggggggagctgcgtccagca

SEQ ID NO: 7772070 - DNA, 22 bp, Homo sapiens
ctgggctctagaaaggaaagaa

SEQ ID NO: 7772071 - DNA, 22 bp, Homo sapiens
ctggggctggtgaggcaggctc

SEQ ID NO: 7772072 - DNA, 22 bp, Homo sapiens
ctggggctggtgaggcaggctc

SEQ ID NO: 7772073 - DNA, 22 bp, Homo sapiens
ctgggggtcttgaaagggagag

SEQ ID NO: 7772074 - DNA, 22 bp, Homo sapiens
ctggggggctactgacagagga

SEQ ID NO: 7772075 - DNA, 22 bp, Homo sapiens
ctggggggctactgacagagga

SEQ ID NO: 7772076 - DNA, 22 bp, Homo sapiens
ctggggtgaaggattacctgag

SEQ ID NO: 7772077 - DNA, 22 bp, Homo sapiens
ctggggtcagggatcagagagc

SEQ ID NO: 7772078 - DNA, 22 bp, Homo sapiens
ctgggggtgagcagcagcgacg

SEQ ID NO: 7772079 - DNA, 22 bp, Homo sapiens
ctggggtggtgcaggcctcatg

SEQ ID NO: 7772080 - DNA, 22 bp, Homo sapiens
ctggggtggtgcaggcctcatg

SEQ ID NO: 7772081 - DNA, 22 bp, Homo sapiens
ctggggtgtctcgtctgccatt

SEQ ID NO: 7772082 - DNA, 22 bp, Homo sapiens
ctgggtggaaagtgctgagaat

SEQ ID NO: 7772083 - DNA, 22 bp, Homo sapiens
ctggggtggagattggcaatct

SEQ ID NO: 7772084 - DNA, 22 bp, Homo sapiens
ctggggtgagcagaaacagggg

SEQ ID NO: 7772085 - DNA, 22 bp, Homo sapiens
ctggtgtggactccgcgcggag

SEQ ID NO: 7772086 - DNA, 22 bp, Homo sapiens
ctggttcaagtcctggctctgt

SEQ ID NO: 7772087 - DNA, 22 bp, Homo sapiens
ctggtcaccaggtagcattgta

SEQ ID NO: 7772088 - DNA, 22 bp, Homo sapiens
ctggtaggggtgactgttatcg

SEQ ID NO: 7772089 - DNA, 22 bp, Homo sapiens
ctggtagggccccacatcctta

SEQ ID NO: 7772090 - DNA, 22 bp, Homo sapiens
ctggtcacctccttcccagcta

SEQ ID NO: 7772091 - DNA, 22 bp, Homo sapiens
ctggtgcctcctctcccaggtc

SEQ ID NO: 7772092 - DNA, 22 bp, Homo sapiens
ctgggttgcaaagcgctggctg

SEQ ID NO: 7772093 - DNA, 22 bp, Homo sapiens
ctgggttgccctgggcctgtga

SEQ ID NO: 7772094 - DNA, 22 bp, Homo sapiens
ctgggtgttcacccgaggcgct

SEQ ID NO: 7772095 - DNA, 22 bp, Homo sapiens
ctgggtggctgtccagccagcc

SEQ ID NO: 7772096 - DNA, 22 bp, Homo sapiens
ctgggtggaaagtgctgagaat

SEQ ID NO: 7772097 - DNA, 22 bp, Homo sapiens
ctgggatccacgggctcccaag

SEQ ID NO: 7772098 - DNA, 22 bp, Homo sapiens
ctgggagtttctagagaaagac

SEQ ID NO: 7772099 - DNA, 22 bp, Homo sapiens
ctgggagtgtccctctggtaat

SEQ ID NO: 7772100 - DNA, 22 bp, Homo sapiens
ctgggagtgttctaggtcacat

SEQ ID NO: 7772101 - DNA, 19 bp, Homo sapiens
ctgggagttcactgctgcc

SEQ ID NO: 7772102 - DNA, 19 bp, Homo sapiens
ctgggagttcactgctgcc

SEQ ID NO: 7772103 - DNA, 22 bp, Homo sapiens
ctgggccaggaccagggttgaa

SEQ ID NO: 7772104 - DNA, 22 bp, Homo sapiens
ctgggccagcaactgcaatgga

SEQ ID NO: 7772105 - DNA, 22 bp, Homo sapiens
ctgggccagcaactgcaatgga

SEQ ID NO: 7772106 - DNA, 22 bp, Homo sapiens
ctgggcccacgagggctctggg

SEQ ID NO: 7772107 - DNA, 22 bp, Homo sapiens
ctgggccagcaactgcaatgga

SEQ ID NO: 7772108 - DNA, 22 bp, Homo sapiens
ctgggccagatccagcctcaca

SEQ ID NO: 7772109 - DNA, 22 bp, Homo sapiens
ctgggagtgaaaggagggctgc

SEQ ID NO: 7772110 - DNA, 22 bp, Homo sapiens
ctgggagtggtgacagctctcg

SEQ ID NO: 7772111 - DNA, 22 bp, Homo sapiens
ctgggagtctaagctagcaccg

SEQ ID NO: 7772112 - DNA, 22 bp, Homo sapiens
ctgggagtctggcctctggtcc

SEQ ID NO: 7772113 - DNA, 22 bp, Homo sapiens
ctgggagtctggaattttggta

SEQ ID NO: 7772114 - DNA, 22 bp, Homo sapiens
ctgggagtcaccaggagcaagg

SEQ ID NO: 7772115 - DNA, 22 bp, Homo sapiens
ctgggagtccctggaatagctc

SEQ ID NO: 7772116 - DNA, 22 bp, Homo sapiens
ctgggagtactgggggatgtca

SEQ ID NO: 7772117 - DNA, 22 bp, Homo sapiens
ctgggagtcaccaggagcaagg

SEQ ID NO: 7772118 - DNA, 22 bp, Homo sapiens
ctggagctccagggtctcctct

SEQ ID NO: 7772119 - DNA, 22 bp, Homo sapiens
ctggagctcagcccaggttcca

SEQ ID NO: 7772120 - DNA, 22 bp, Homo sapiens
ctggagctaataatccatctga

SEQ ID NO: 7772121 - DNA, 22 bp, Homo sapiens
ctggagccttcaccaggggaaa

SEQ ID NO: 7772122 - DNA, 22 bp, Homo sapiens
ctggagccttcaccaggggaaa

SEQ ID NO: 7772123 - DNA, 22 bp, Homo sapiens
cttgctttatctggtttctcat

SEQ ID NO: 7772124 - DNA, 22 bp, Homo sapiens
cttgcttacctagttagctcca

SEQ ID NO: 7772125 - DNA, 22 bp, Homo sapiens
cttgctgttgtgggagactggg

SEQ ID NO: 7772126 - DNA, 22 bp, Homo sapiens
ctttccttaataagcaggtata

SEQ ID NO: 7772127 - DNA, 22 bp, Homo sapiens
ctttccttctcgtggttctcac

SEQ ID NO: 7772128 - DNA, 22 bp, Homo sapiens
ctttcctctggcactgtctggt

SEQ ID NO: 7772129 - DNA, 22 bp, Homo sapiens
ctttcctccactccctaggctt

SEQ ID NO: 7772130 - DNA, 22 bp, Homo sapiens
cttggaggatgtgcggctgccc

SEQ ID NO: 7772131 - DNA, 22 bp, Homo sapiens
ctttccaatgtcactatgaatc

SEQ ID NO: 7772132 - DNA, 22 bp, Homo sapiens
cttggagtgaatgggggcaggt

SEQ ID NO: 7772133 - DNA, 22 bp, Homo sapiens
ctttctcagtgttaattacttt

SEQ ID NO: 7772134 - DNA, 22 bp, Homo sapiens
ctttctcaatgccggaaggcac

SEQ ID NO: 7772135 - DNA, 22 bp, Homo sapiens
ctttctcagtgttaattacttt

SEQ ID NO: 7772136 - DNA, 22 bp, Homo sapiens
ctttctctgtgtttcacatgct

SEQ ID NO: 7772137 - DNA, 22 bp, Homo sapiens
ctttgcatgggtctgaaggctt

SEQ ID NO: 7772138 - DNA, 22 bp, Homo sapiens
ctttctcttcactgtcatgatc

SEQ ID NO: 7772139 - DNA, 19 bp, Homo sapiens
cttcccctgttacctcact

SEQ ID NO: 7772140 - DNA, 19 bp, Homo sapiens
cttcccctgttacctcact

SEQ ID NO: 7772141 - DNA, 22 bp, Homo sapiens
cttccctgataagagcctcaga

SEQ ID NO: 7772142 - DNA, 22 bp, Homo sapiens
cttccctgagctttctcaggct

SEQ ID NO: 7772143 - DNA, 22 bp, Homo sapiens
cttccctttctggtgacttctc

SEQ ID NO: 7772144 - DNA, 22 bp, Homo sapiens
cttcttcaagagaatgggagac

SEQ ID NO: 7772145 - DNA, 22 bp, Homo sapiens
cttcttcaacctgaaagtttca

SEQ ID NO: 7772146 - DNA, 22 bp, Homo sapiens
cttcttcagaggccagcctctg

SEQ ID NO: 7772147 - DNA, 22 bp, Homo sapiens
cttcttcaatagcaagcgcata

SEQ ID NO: 7772148 - DNA, 22 bp, Homo sapiens
cttcttcagcacaatattgatg

SEQ ID NO: 7772149 - DNA, 20 bp, Homo sapiens
cttcttcagcctatgcttca

SEQ ID NO: 7772150 - DNA, 22 bp, Homo sapiens
cttcttcatctgtaaaacttgg

SEQ ID NO: 7772151 - DNA, 22 bp, Homo sapiens
cttcttcataggcagtcctgtt

SEQ ID NO: 7772152 - DNA, 22 bp, Homo sapiens
cttcactgtttggttcacagca

SEQ ID NO: 7772153 - DNA, 22 bp, Homo sapiens
cttcagaaccagccagaagagg

SEQ ID NO: 7772154 - DNA, 22 bp, Homo sapiens
cttcagaaataacaacaattac

SEQ ID NO: 7772155 - DNA, 22 bp, Homo sapiens
cttccaggacaccagggtagta

SEQ ID NO: 7772156 - DNA, 22 bp, Homo sapiens
cttcactgcagtcatggctctg

SEQ ID NO: 7772157 - DNA, 22 bp, Homo sapiens
cttcacatttgcgaaggccaaa

SEQ ID NO: 7772158 - DNA, 22 bp, Homo sapiens
cttcacattagtttggatcaaa

SEQ ID NO: 7772159 - DNA, 22 bp, Homo sapiens
cttcacattagtttggatcaaa

SEQ ID NO: 7772160 - DNA, 22 bp, Homo sapiens
cttcacattgggcttgatatga

SEQ ID NO: 7772161 - DNA, 22 bp, Homo sapiens
cttcacattgggcttgatatga

SEQ ID NO: 7772162 - DNA, 22 bp, Homo sapiens
cttcacataaacaaagggccat

SEQ ID NO: 7772163 - DNA, 22 bp, Homo sapiens
cttcacatctccctaaaacagc

SEQ ID NO: 7772164 - DNA, 22 bp, Homo sapiens
cttcacatctccctaaaacagc

SEQ ID NO: 7772165 - DNA, 22 bp, Homo sapiens
cttcacatgggtactgctgatc

SEQ ID NO: 7772166 - DNA, 22 bp, Homo sapiens
cttcacatgatgtccgtgctgt

SEQ ID NO: 7772167 - DNA, 19 bp, Homo sapiens
cttcacatctgtgagggga

SEQ ID NO: 7772168 - DNA, 22 bp, Homo sapiens
cttcacatgttggagtcctttg

SEQ ID NO: 7772169 - DNA, 22 bp, Homo sapiens
cttcacatgttggagtcctttg

SEQ ID NO: 7772170 - DNA, 22 bp, Homo sapiens
cttcaaatgtgattttaataac

SEQ ID NO: 7772171 - DNA, 20 bp, Homo sapiens
ctgttaaaaggtatgaattc

SEQ ID NO: 7772172 - DNA, 22 bp, Homo sapiens
cttcaaatccccctgagtttga

SEQ ID NO: 7772173 - DNA, 22 bp, Homo sapiens
cttcaaatacaagtagattatg

SEQ ID NO: 7772174 - DNA, 22 bp, Homo sapiens
cttcaaagggtcactatttatc

SEQ ID NO: 7772175 - DNA, 22 bp, Homo sapiens
ctgttaaatgagaaagcagact

SEQ ID NO: 7772176 - DNA, 22 bp, Homo sapiens
gaaatacaggaatgccacacag

SEQ ID NO: 7772177 - DNA, 22 bp, Homo sapiens
gaaatatacattgcaggaagag

SEQ ID NO: 7772178 - DNA, 22 bp, Homo sapiens
gaaatacagaaagggctgaatg

SEQ ID NO: 7772179 - DNA, 22 bp, Homo sapiens
gaaatacagaaagggctgaatg

SEQ ID NO: 7772180 - DNA, 22 bp, Homo sapiens
gaaatattcttgtcttgttttc

SEQ ID NO: 7772181 - DNA, 22 bp, Homo sapiens
gaaatattacagtggaggggat

SEQ ID NO: 7772182 - DNA, 22 bp, Homo sapiens
gaaatattgtactggagatgtt

SEQ ID NO: 7772183 - DNA, 22 bp, Homo sapiens
gaaatattgtactggagatgtt

SEQ ID NO: 7772184 - DNA, 22 bp, Homo sapiens
gaagaagacatggaacaatagt

SEQ ID NO: 7772185 - DNA, 22 bp, Homo sapiens
gaagaagacatggaacaatagt

SEQ ID NO: 7772186 - DNA, 22 bp, Homo sapiens
gaagaaggaagatcatgcttga

SEQ ID NO: 7772187 - DNA, 19 bp, Homo sapiens
gaagaagcttgagaagtag

SEQ ID NO: 7772188 - DNA, 22 bp, Homo sapiens
gaacttgttgtaagaaaatatg

SEQ ID NO: 7772189 - DNA, 22 bp, Homo sapiens
gaagaaattgaattcatgagct

SEQ ID NO: 7772190 - DNA, 22 bp, Homo sapiens
gaaatgttcctgatccctgatt

SEQ ID NO: 7772191 - DNA, 22 bp, Homo sapiens
gaaatgttatgagatatgtact

SEQ ID NO: 7772192 - DNA, 23 bp, Homo sapiens
gaaatgtttcttgattaatccta

SEQ ID NO: 7772193 - DNA, 22 bp, Homo sapiens
gaaattcaaaatgtcagtatag

SEQ ID NO: 7772194 - DNA, 22 bp, Homo sapiens
gaaattcaaaatgtcagtatag

SEQ ID NO: 7772195 - DNA, 22 bp, Homo sapiens
gaaattcaggacaaagactctt

SEQ ID NO: 7772196 - DNA, 22 bp, Homo sapiens
gaaattcactgtatttcttggg

SEQ ID NO: 7772197 - DNA, 22 bp, Homo sapiens
gaaacttttaaacctcatgagt

SEQ ID NO: 7772198 - DNA, 22 bp, Homo sapiens
gaaacttacttactcacatttc

SEQ ID NO: 7772199 - DNA, 22 bp, Homo sapiens
gaaactgtttctggctttggtg

SEQ ID NO: 7772200 - DNA, 22 bp, Homo sapiens
gaaacccaaactaagacagtag

SEQ ID NO: 7772201 - DNA, 22 bp, Homo sapiens
gaaacctcttagcctctctttg

SEQ ID NO: 7772202 - DNA, 22 bp, Homo sapiens
gaaactctcgcatcctgggaac

SEQ ID NO: 7772203 - DNA, 22 bp, Homo sapiens
gaaactctcgcatcctgggaac

SEQ ID NO: 7772204 - DNA, 22 bp, Homo sapiens
gaaaaagtgaccttggtagcta

SEQ ID NO: 7772205 - DNA, 22 bp, Homo sapiens
cttttttaaggtagctcctcct

SEQ ID NO: 7772206 - DNA, 22 bp, Homo sapiens
ctttttgttgtataagcccttt

SEQ ID NO: 7772207 - DNA, 22 bp, Homo sapiens
gaaaaatgagctgatgtcaggg

SEQ ID NO: 7772208 - DNA, 22 bp, Homo sapiens
cttttgcagccattattgctgc

SEQ ID NO: 7772209 - DNA, 22 bp, Homo sapiens
cttttgttaggagaaaacatca

SEQ ID NO: 7772210 - DNA, 22 bp, Homo sapiens
cttttgttctacagctggggaa

SEQ ID NO: 7772211 - DNA, 22 bp, Homo sapiens
ctttttcccaggtggagagagg

SEQ ID NO: 7772212 - DNA, 22 bp, Homo sapiens
ctttttcctcgtagagcctaat

SEQ ID NO: 7772213 - DNA, 22 bp, Homo sapiens
ctttggaggtcatagccaagag

SEQ ID NO: 7772214 - DNA, 22 bp, Homo sapiens
ctttggatttttatcaggcaat

SEQ ID NO: 7772215 - DNA, 22 bp, Homo sapiens
ctttggatggctgtgtgtttat

SEQ ID NO: 7772216 - DNA, 20 bp, Homo sapiens
ctttggagaaagctaacaga

SEQ ID NO: 7772217 - DNA, 20 bp, Homo sapiens
ctttggagaaagatgcaata

SEQ ID NO: 7772218 - DNA, 22 bp, Homo sapiens
ctttggaggacctatgtgcaat

SEQ ID NO: 7772219 - DNA, 22 bp, Homo sapiens
ctttggaggaaaattgaggtca

SEQ ID NO: 7772220 - DNA, 19 bp, Homo sapiens
ctttggaggatgaggctgg

SEQ ID NO: 7772221 - DNA, 22 bp, Homo sapiens
ctttggaatcattgcttattca

SEQ ID NO: 7772222 - DNA, 22 bp, Homo sapiens
ttaaattccagcctcataatag

SEQ ID NO: 7772223 - DNA, 22 bp, Homo sapiens
ttaaatttctacgtgatccagg

SEQ ID NO: 7772224 - DNA, 22 bp, Homo sapiens
ttaaattttagaaacagactct

SEQ ID NO: 7772225 - DNA, 22 bp, Homo sapiens
ttaagaggtggtcgtgtctgtg

SEQ ID NO: 7772226 - DNA, 22 bp, Homo sapiens
ttaagattttcttcagtattat

SEQ ID NO: 7772227 - DNA, 22 bp, Homo sapiens
ttaaattttagaaacagactct

SEQ ID NO: 7772228 - DNA, 21 bp, Homo sapiens
tgtcagagcttgtaggacatt

SEQ ID NO: 7772229 - DNA, 20 bp, Homo sapiens
tgtcaatagcactgaggctg

SEQ ID NO: 7772230 - DNA, 22 bp, Homo sapiens
ttaaattattgagggattgtca

SEQ ID NO: 7772231 - DNA, 22 bp, Homo sapiens
ttaaatagtaggtctattttgg

SEQ ID NO: 7772232 - DNA, 23 bp, Homo sapiens
ccttaaatatctaccctgtggca

SEQ ID NO: 7772233 - DNA, 22 bp, Homo sapiens
ccttaaaagaactatctcttct

SEQ ID NO: 7772234 - DNA, 22 bp, Homo sapiens
ccttaaattctccatttgaaag

SEQ ID NO: 7772235 - DNA, 22 bp, Homo sapiens
ccttaaattctccatttgaaag

SEQ ID NO: 7772236 - DNA, 22 bp, Homo sapiens
ttacaaagagtgttcttttcca

SEQ ID NO: 7772237 - DNA, 21 bp, Homo sapiens
ttacaaagcaagtgctgtgtc

SEQ ID NO: 7772238 - DNA, 22 bp, Homo sapiens
ttacaaagattatattcagtta

SEQ ID NO: 7772239 - DNA, 22 bp, Homo sapiens
ttacaaagagtgttcttttcca

SEQ ID NO: 7772240 - DNA, 22 bp, Homo sapiens
ttacaaagagtgttcttttcca

SEQ ID NO: 7772241 - DNA, 22 bp, Homo sapiens
ttacaaagattatattcagtta

SEQ ID NO: 7772242 - DNA, 22 bp, Homo sapiens
ttacaaagcgctttacctctga

SEQ ID NO: 7772243 - DNA, 22 bp, Homo sapiens
ttacaaagcaggtcagctgaaa

SEQ ID NO: 7772244 - DNA, 22 bp, Homo sapiens
ccttgaaagccaggcagaggaa

SEQ ID NO: 7772245 - DNA, 22 bp, Homo sapiens
ttacataaaagttcacgtaggc

SEQ ID NO: 7772246 - DNA, 22 bp, Homo sapiens
ttacataaaagttcacgtaggc

SEQ ID NO: 7772247 - DNA, 22 bp, Homo sapiens
ttacataacggtatgaaaaatg

SEQ ID NO: 7772248 - DNA, 22 bp, Homo sapiens
ttacataacggtatgaaaaatg

SEQ ID NO: 7772249 - DNA, 22 bp, Homo sapiens
ttagttttctcatctatctcac

SEQ ID NO: 7772250 - DNA, 22 bp, Homo sapiens
ttataaagattgttatgtatct

SEQ ID NO: 7772251 - DNA, 20 bp, Homo sapiens
ccttgccagtagggctggga

SEQ ID NO: 7772252 - DNA, 22 bp, Homo sapiens
ccttgactgtaatggagtaggg

SEQ ID NO: 7772253 - DNA, 22 bp, Homo sapiens
ccttgaatctctgctctagaac

SEQ ID NO: 7772254 - DNA, 22 bp, Homo sapiens
ttataacatcaatcagagttaa

SEQ ID NO: 7772255 - DNA, 22 bp, Homo sapiens
ttataaagtgagaagtgctatg

SEQ ID NO: 7772256 - DNA, 22 bp, Homo sapiens
ttataaaggtttgtgcatattt

SEQ ID NO: 7772257 - DNA, 23 bp, Homo sapiens
ttataaatattttcaggtgtgtt

SEQ ID NO: 7772258 - DNA, 22 bp, Homo sapiens
ttatattgtgtaataagtgaag

SEQ ID NO: 7772259 - DNA, 22 bp, Homo sapiens
ttatatttctggtagccttcag

SEQ ID NO: 7772260 - DNA, 22 bp, Homo sapiens
cggaggttgaggctgcagtgag

SEQ ID NO: 7772261 - DNA, 22 bp, Homo sapiens
cggagtcttgctatgttgccca

SEQ ID NO: 7772262 - DNA, 22 bp, Homo sapiens
ttcaaattaccacatttgctta

SEQ ID NO: 7772263 - DNA, 22 bp, Homo sapiens
ttcaaattaccacatttgctta

SEQ ID NO: 7772264 - DNA, 22 bp, Homo sapiens
ttcaaatctctcctaatccact

SEQ ID NO: 7772265 - DNA, 22 bp, Homo sapiens
ttcaaatacattctttgccact

SEQ ID NO: 7772266 - DNA, 22 bp, Homo sapiens
ttcaaatacattctttgccact

SEQ ID NO: 7772267 - DNA, 22 bp, Homo sapiens
ttcaaagttgcatgacagctta

SEQ ID NO: 7772268 - DNA, 22 bp, Homo sapiens
ttcaaagtgtgacctgacaagc

SEQ ID NO: 7772269 - DNA, 22 bp, Homo sapiens
ttcaaagtgctgttcaaagtag

SEQ ID NO: 7772270 - DNA, 22 bp, Homo sapiens
ttcaaagtgcatgttcctcaga

SEQ ID NO: 7772271 - DNA, 20 bp, Homo sapiens
ttcaaagtgtatgatatgca

SEQ ID NO: 7772272 - DNA, 22 bp, Homo sapiens
ttcaaagtgcttttaaccttta

SEQ ID NO: 7772273 - DNA, 22 bp, Homo sapiens
cggcacagccgggcaaggctgg

SEQ ID NO: 7772274 - DNA, 22 bp, Homo sapiens
cggatcctcagtcgtgcgggag

SEQ ID NO: 7772275 - DNA, 22 bp, Homo sapiens
cggcagggttggttttctctga

SEQ ID NO: 7772276 - DNA, 22 bp, Homo sapiens
cggcagggctccatgcatttct

SEQ ID NO: 7772277 - DNA, 22 bp, Homo sapiens
cggggcaccgacctcctgccgc

SEQ ID NO: 7772278 - DNA, 22 bp, Homo sapiens
cggggccctggggctgaaggtc

SEQ ID NO: 7772279 - DNA, 21 bp, Homo sapiens
cgtgactgggtccgtctggct

SEQ ID NO: 7772280 - DNA, 22 bp, Homo sapiens
cggggctgcgctcttcctgccg

SEQ ID NO: 7772281 - DNA, 22 bp, Homo sapiens
ccttttgctctcccatccagaa

SEQ ID NO: 7772282 - DNA, 22 bp, Homo sapiens
ccttttgctctcccatccagaa

SEQ ID NO: 7772283 - DNA, 22 bp, Homo sapiens
cctttttcaatatagaattgca

SEQ ID NO: 7772284 - DNA, 22 bp, Homo sapiens
cctttttccctggagggacagc

SEQ ID NO: 7772285 - DNA, 21 bp, Homo sapiens
cgacaggagaggcagccagcc

SEQ ID NO: 7772286 - DNA, 22 bp, Homo sapiens
cgagaggctggacagggctggg

SEQ ID NO: 7772287 - DNA, 22 bp, Homo sapiens
cgaaaatagatctgtttcccag

SEQ ID NO: 7772288 - DNA, 22 bp, Homo sapiens
cgaaacatctatgatcattaat

SEQ ID NO: 7772289 - DNA, 19 bp, Homo sapiens
ccttttttaacttcagcaa

SEQ ID NO: 7772290 - DNA, 22 bp, Homo sapiens
ttattcagctctctagaggcac

SEQ ID NO: 7772291 - DNA, 22 bp, Homo sapiens
ttattcagcatttagaggaagg

SEQ ID NO: 7772292 - DNA, 22 bp, Homo sapiens
ttattgagttgtaagagctctt

SEQ ID NO: 7772293 - DNA, 22 bp, Homo sapiens
ttattgagtatctgcttggtgt

SEQ ID NO: 7772294 - DNA, 16 bp, Homo sapiens
cgcctccctccctcgc

SEQ ID NO: 7772295 - DNA, 22 bp, Homo sapiens
ttatttcatgtaaaatttatgt

SEQ ID NO: 7772296 - DNA, 22 bp, Homo sapiens
cgctggcattagggcagtggcc

SEQ ID NO: 7772297 - DNA, 22 bp, Homo sapiens
cgctggcttcctcctggggcca

SEQ ID NO: 7772298 - DNA, 22 bp, Homo sapiens
ttcaaagtcagccatctggcta

SEQ ID NO: 7772299 - DNA, 22 bp, Homo sapiens
cgctgccttcatcccacgccta

SEQ ID NO: 7772300 - DNA, 22 bp, Homo sapiens
cgctgcctctctggggccctgg

SEQ ID NO: 7772301 - DNA, 22 bp, Homo sapiens
ttatttattgtgtacctactgt

SEQ ID NO: 7772302 - DNA, 20 bp, Homo sapiens
ttatttcagttgctagattg

SEQ ID NO: 7772303 - DNA, 22 bp, Homo sapiens
ttatttcatataatgttatcaa

SEQ ID NO: 7772304 - DNA, 22 bp, Homo sapiens
ttattgcagatggtgtgagaga

SEQ ID NO: 7772305 - DNA, 22 bp, Homo sapiens
ctatacactttttgaaaataga

SEQ ID NO: 7772306 - DNA, 22 bp, Homo sapiens
ttctggctcatatgctaagaag

SEQ ID NO: 7772307 - DNA, 22 bp, Homo sapiens
ttctggatgttgtagtctgaga

SEQ ID NO: 7772308 - DNA, 22 bp, Homo sapiens
ttctggattatgtgtaagtgaa

SEQ ID NO: 7772309 - DNA, 22 bp, Homo sapiens
ctcacccctgtaattccagcac

SEQ ID NO: 7772310 - DNA, 22 bp, Homo sapiens
ctcactgcaacctctgcctccc

SEQ ID NO: 7772311 - DNA, 22 bp, Homo sapiens
ctcacaggttctgcagctcaca

SEQ ID NO: 7772312 - DNA, 22 bp, Homo sapiens
ctatagaaacaacctctctttc

SEQ ID NO: 7772313 - DNA, 22 bp, Homo sapiens
ctcagagaaatgtcacaacaat

SEQ ID NO: 7772314 - DNA, 22 bp, Homo sapiens
ctcagagaaaaggagcaagggt

SEQ ID NO: 7772315 - DNA, 22 bp, Homo sapiens
ctcagagaaaaggagcaagggt

SEQ ID NO: 7772316 - DNA, 22 bp, Homo sapiens
ctcagagagtgaattcctgcct

SEQ ID NO: 7772317 - DNA, 22 bp, Homo sapiens
ctcagagaggttgaacaacttg

SEQ ID NO: 7772318 - DNA, 19 bp, Homo sapiens
ctcagagaggggcagtgcc

SEQ ID NO: 7772319 - DNA, 22 bp, Homo sapiens
ttctgaagctcccttttgtagt

SEQ ID NO: 7772320 - DNA, 22 bp, Homo sapiens
ttctgcagtgttaacaatgtca

SEQ ID NO: 7772321 - DNA, 22 bp, Homo sapiens
ttctgcagtgttaacaatgtca

SEQ ID NO: 7772322 - DNA, 22 bp, Homo sapiens
ttctatgtacctagcgttgtat

SEQ ID NO: 7772323 - DNA, 20 bp, Homo sapiens
ttctatggaccagtatattt

SEQ ID NO: 7772324 - DNA, 22 bp, Homo sapiens
ttctatgtgaacgttatagttt

SEQ ID NO: 7772325 - DNA, 22 bp, Homo sapiens
ttctatgtgctggagaatattt

SEQ ID NO: 7772326 - DNA, 22 bp, Homo sapiens
ttctatgtggatatagaactgc

SEQ ID NO: 7772327 - DNA, 22 bp, Homo sapiens
ttctattgcacacaaataatta

SEQ ID NO: 7772328 - DNA, 22 bp, Homo sapiens
ttctattgacattcactgtaac

SEQ ID NO: 7772329 - DNA, 22 bp, Homo sapiens
ttctattaatatgttaattctg

SEQ ID NO: 7772330 - DNA, 22 bp, Homo sapiens
ttctattgaatgataatctata

SEQ ID NO: 7772331 - DNA, 22 bp, Homo sapiens
ttctattgacattcactgtaac

SEQ ID NO: 7772332 - DNA, 22 bp, Homo sapiens
ttctatttccagtccttcagag

SEQ ID NO: 7772333 - DNA, 22 bp, Homo sapiens
ttctatttccagtccttcagag

SEQ ID NO: 7772334 - DNA, 22 bp, Homo sapiens
ttctattgtaccttttctctca

SEQ ID NO: 7772335 - DNA, 22 bp, Homo sapiens
ttctattgggcagcattgcttc

SEQ ID NO: 7772336 - DNA, 23 bp, Homo sapiens
ttctggatgttctagtctgagag

SEQ ID NO: 7772337 - DNA, 22 bp, Homo sapiens
ttctggatgctgttaagatgta

SEQ ID NO: 7772338 - DNA, 22 bp, Homo sapiens
ttctggatgctgttaagatgta

SEQ ID NO: 7772339 - DNA, 22 bp, Homo sapiens
ttctggaagggtggagtagctt

SEQ ID NO: 7772340 - DNA, 23 bp, Homo sapiens
ttctggaagatttacttgagaca

SEQ ID NO: 7772341 - DNA, 22 bp, Homo sapiens
ttctggaagccccagagtcaga

SEQ ID NO: 7772342 - DNA, 22 bp, Homo sapiens
ttctgcatgatattaaatgtaa

SEQ ID NO: 7772343 - DNA, 22 bp, Homo sapiens
ctaaaaatccacactaggtgaa

SEQ ID NO: 7772344 - DNA, 22 bp, Homo sapiens
ctaaaaatccacactaggtgaa

SEQ ID NO: 7772345 - DNA, 22 bp, Homo sapiens
cgttgtttgagattttcagaat

SEQ ID NO: 7772346 - DNA, 22 bp, Homo sapiens
cgtgtacagtctatcttttttc

SEQ ID NO: 7772347 - DNA, 18 bp, Homo sapiens
ctagatgagcttggcaag

SEQ ID NO: 7772348 - DNA, 18 bp, Homo sapiens
ctagatgagcttggcaag

SEQ ID NO: 7772349 - DNA, 22 bp, Homo sapiens
ctagagaattgtcttgagagtt

SEQ ID NO: 7772350 - DNA, 22 bp, Homo sapiens
ctaaaaatccacactaggtgaa

SEQ ID NO: 7772351 - DNA, 22 bp, Homo sapiens
ctagagaaaatgttaatacagt

SEQ ID NO: 7772352 - DNA, 22 bp, Homo sapiens
ctcagtcatgacgctcaggacc

SEQ ID NO: 7772353 - DNA, 22 bp, Homo sapiens
ttggaaggagcctaaaagagac

SEQ ID NO: 7772354 - DNA, 22 bp, Homo sapiens
ttggagtccttgctgcttcact

SEQ ID NO: 7772355 - DNA, 22 bp, Homo sapiens
ttggagtcattggcctgggtga

SEQ ID NO: 7772356 - DNA, 22 bp, Homo sapiens
ttggagtcatatggaattcaca

SEQ ID NO: 7772357 - DNA, 22 bp, Homo sapiens
ttggagtcagatgactgtagga

SEQ ID NO: 7772358 - DNA, 22 bp, Homo sapiens
ttggagtcacaggagaagaatg

SEQ ID NO: 7772359 - DNA, 22 bp, Homo sapiens
ctccactcaccagatgccagga

SEQ ID NO: 7772360 - DNA, 22 bp, Homo sapiens
ttggagggtcttccacagccat

SEQ ID NO: 7772361 - DNA, 22 bp, Homo sapiens
ttggaggggccactgcagagct

SEQ ID NO: 7772362 - DNA, 22 bp, Homo sapiens
ttggagggactgagcttcagtc

SEQ ID NO: 7772363 - DNA, 22 bp, Homo sapiens
ctccaggaccagggctcctgga

SEQ ID NO: 7772364 - DNA, 22 bp, Homo sapiens
ctccaggacccagtggctccag

SEQ ID NO: 7772365 - DNA, 22 bp, Homo sapiens
ctccaggactgaggacagagct

SEQ ID NO: 7772366 - DNA, 22 bp, Homo sapiens
ctccagcctcatctcctggctg

SEQ ID NO: 7772367 - DNA, 22 bp, Homo sapiens
ttggctgaccagaacctgcccc

SEQ ID NO: 7772368 - DNA, 22 bp, Homo sapiens
ttggctctgtgtctccactcaa

SEQ ID NO: 7772369 - DNA, 22 bp, Homo sapiens
ttggctctgaaacccaagctct

SEQ ID NO: 7772370 - DNA, 22 bp, Homo sapiens
ctccagaggtccccgcggcact

SEQ ID NO: 7772371 - DNA, 22 bp, Homo sapiens
ctccagaggatgcaggtgaggg

SEQ ID NO: 7772372 - DNA, 22 bp, Homo sapiens
ctccagaggatgcaggtgaggg

SEQ ID NO: 7772373 - DNA, 22 bp, Homo sapiens
ctccagaggaaagcacatagtg

SEQ ID NO: 7772374 - DNA, 18 bp, Homo sapiens
ctccagagctgtgagaca

SEQ ID NO: 7772375 - DNA, 22 bp, Homo sapiens
ctcaggagtagttcagcagctg

SEQ ID NO: 7772376 - DNA, 22 bp, Homo sapiens
ctcaggaggaggaagttcattg

SEQ ID NO: 7772377 - DNA, 22 bp, Homo sapiens
ctcaggaggccattctcaaggt

SEQ ID NO: 7772378 - DNA, 22 bp, Homo sapiens
ctcaggagtagttcagcagctg

SEQ ID NO: 7772379 - DNA, 22 bp, Homo sapiens
ctcaggacccggtccaggtggg

SEQ ID NO: 7772380 - DNA, 22 bp, Homo sapiens
ctcaggacttggttagtgtttt

SEQ ID NO: 7772381 - DNA, 22 bp, Homo sapiens
ctcaggagacagtgtccacatg

SEQ ID NO: 7772382 - DNA, 22 bp, Homo sapiens
ctcaggagagtcttatatctcc

SEQ ID NO: 7772383 - DNA, 22 bp, Homo sapiens
ctcaggagacagtgtccacatg

SEQ ID NO: 7772384 - DNA, 22 bp, Homo sapiens
ctcagctggcaattctggctcc

SEQ ID NO: 7772385 - DNA, 19 bp, Homo sapiens
ctcagctgtagctcatgtg

SEQ ID NO: 7772386 - DNA, 21 bp, Homo sapiens
ctcaggggattttgagattag

SEQ ID NO: 7772387 - DNA, 22 bp, Homo sapiens
ctcagggggaatcaggtcacag

SEQ ID NO: 7772388 - DNA, 22 bp, Homo sapiens
ctcaggggacctggctccgagt

SEQ ID NO: 7772389 - DNA, 21 bp, Homo sapiens
ctcagggcttggtgtcctcat

SEQ ID NO: 7772390 - DNA, 22 bp, Homo sapiens
ctcaggtcttagttctgtcatc

SEQ ID NO: 7772391 - DNA, 22 bp, Homo sapiens
ctcagtcagtttttgtgagaga

SEQ ID NO: 7772392 - DNA, 22 bp, Homo sapiens
ctcagggccaaggatgctgttg

SEQ ID NO: 7772393 - DNA, 22 bp, Homo sapiens
ctcagggagtagcacatgtgga

SEQ ID NO: 7772394 - DNA, 22 bp, Homo sapiens
ttgcatatcctccaacacatgg

SEQ ID NO: 7772395 - DNA, 22 bp, Homo sapiens
ttgcatatgaagctgacttaaa

SEQ ID NO: 7772396 - DNA, 22 bp, Homo sapiens
ttgcatcaggtagacaactata

SEQ ID NO: 7772397 - DNA, 22 bp, Homo sapiens
ctgagcagtggttcttgagcgc

SEQ ID NO: 7772398 - DNA, 22 bp, Homo sapiens
ctgagcagtgctttgcagtggg

SEQ ID NO: 7772399 - DNA, 22 bp, Homo sapiens
ctgagcagtctagccaggtgtt

SEQ ID NO: 7772400 - DNA, 22 bp, Homo sapiens
ctgagcaggcggtggagcggct

SEQ ID NO: 7772401 - DNA, 22 bp, Homo sapiens
ctgagcaggacagtgggagacc

SEQ ID NO: 7772402 - DNA, 22 bp, Homo sapiens
ctgagcagcgtggggagctggc

SEQ ID NO: 7772403 - DNA, 22 bp, Homo sapiens
ctgagcagcgtggggagctggc

SEQ ID NO: 7772404 - DNA, 22 bp, Homo sapiens
ctgagcagaccatggcagaggt

SEQ ID NO: 7772405 - DNA, 22 bp, Homo sapiens
ctcttcctctcatgcggtcata

SEQ ID NO: 7772406 - DNA, 22 bp, Homo sapiens
ttttgcttttgtaacacagtgt

SEQ ID NO: 7772407 - DNA, 22 bp, Homo sapiens
ctgaggctaacctcgagagaca

SEQ ID NO: 7772408 - DNA, 22 bp, Homo sapiens
ctgagccaaaaagcagagcttg

SEQ ID NO: 7772409 - DNA, 22 bp, Homo sapiens
ctgagccaaaaagcagagcttg

SEQ ID NO: 7772410 - DNA, 18 bp, Homo sapiens
ctgaggctggcaggagcc

SEQ ID NO: 7772411 - DNA, 22 bp, Homo sapiens
ctgaggctctgggtgtcactgt

SEQ ID NO: 7772412 - DNA, 22 bp, Homo sapiens
ctgaggctccctcgggtctgct

SEQ ID NO: 7772413 - DNA, 22 bp, Homo sapiens
ctgaggctgcccagggccaggt

SEQ ID NO: 7772414 - DNA, 22 bp, Homo sapiens
ctgaggctgcccagggccaggt

SEQ ID NO: 7772415 - DNA, 22 bp, Homo sapiens
ctgaggctgcccagggccaggt

SEQ ID NO: 7772416 - DNA, 22 bp, Homo sapiens
ctgaggctgaagagggcctacg

SEQ ID NO: 7772417 - DNA, 22 bp, Homo sapiens
ctgcaggatttcatgggctgac

SEQ ID NO: 7772418 - DNA, 22 bp, Homo sapiens
ctgcaggcatctaactgtgggc

SEQ ID NO: 7772419 - DNA, 22 bp, Homo sapiens
ctgcccccaggctgcatggctg

SEQ ID NO: 7772420 - DNA, 22 bp, Homo sapiens
ctgcccctgccaggcagctgtc

SEQ ID NO: 7772421 - DNA, 22 bp, Homo sapiens
ctgcaggactgaaagatgaggt

SEQ ID NO: 7772422 - DNA, 22 bp, Homo sapiens
ctgcagctttttgtgcttgtaa

SEQ ID NO: 7772423 - DNA, 22 bp, Homo sapiens
ctgcagctttttgtgcttgtaa

SEQ ID NO: 7772424 - DNA, 22 bp, Homo sapiens
ctgcagcttatttgctgtgtga

SEQ ID NO: 7772425 - DNA, 22 bp, Homo sapiens
ctgcagctttcgctccatcagc

SEQ ID NO: 7772426 - DNA, 22 bp, Homo sapiens
ctgcagctttggaaacctgttt

SEQ ID NO: 7772427 - DNA, 22 bp, Homo sapiens
ctgcagctttggaaacctgttt

SEQ ID NO: 7772428 - DNA, 22 bp, Homo sapiens
ctgcagctgggccagggccacc

SEQ ID NO: 7772429 - DNA, 22 bp, Homo sapiens
ctgcagctgtctctactgggca

SEQ ID NO: 7772430 - DNA, 22 bp, Homo sapiens
ctgcagctgtctctactgggca

SEQ ID NO: 7772431 - DNA, 22 bp, Homo sapiens
ctgcagctgtctctactgggca

SEQ ID NO: 7772432 - DNA, 22 bp, Homo sapiens
ctgcagctgtagaggacagtgg

SEQ ID NO: 7772433 - DNA, 22 bp, Homo sapiens
ctgcagcttaagggaggggttg

SEQ ID NO: 7772434 - DNA, 22 bp, Homo sapiens
ctgcagcttatttgctgtgtga

SEQ ID NO: 7772435 - DNA, 22 bp, Homo sapiens
ctgcagcttaaaggagttcaat

SEQ ID NO: 7772436 - DNA, 22 bp, Homo sapiens
ctgcagctgtgagtgctggatg

SEQ ID NO: 7772437 - DNA, 22 bp, Homo sapiens
ctgaggtgtgagccacttcccc

SEQ ID NO: 7772438 - DNA, 22 bp, Homo sapiens
ctgaggtgggagtttttctcat

SEQ ID NO: 7772439 - DNA, 22 bp, Homo sapiens
ctgaggtggcatcctagctcta

SEQ ID NO: 7772440 - DNA, 22 bp, Homo sapiens
ctgaggtgagaggaggccatgt

SEQ ID NO: 7772441 - DNA, 22 bp, Homo sapiens
ctgcctgtttcctcttgctccc

SEQ ID NO: 7772442 - DNA, 22 bp, Homo sapiens
ctgccttccaaccccagactcc

SEQ ID NO: 7772443 - DNA, 22 bp, Homo sapiens
ctgcctgtggtctgtgatctaa

SEQ ID NO: 7772444 - DNA, 22 bp, Homo sapiens
ctgctgaaaacaataatgatga

SEQ ID NO: 7772445 - DNA, 22 bp, Homo sapiens
ctgctgagactggctttgtgtc

SEQ ID NO: 7772446 - DNA, 22 bp, Homo sapiens
ctgctgagaaaagactgaggga

SEQ ID NO: 7772447 - DNA, 22 bp, Homo sapiens
ctgctgggcagaggctgcatga

SEQ ID NO: 7772448 - DNA, 22 bp, Homo sapiens
ctgctgagagctgaaggctgta

SEQ ID NO: 7772449 - DNA, 20 bp, Homo sapiens
ctgctgagagcctggcttgc

SEQ ID NO: 7772450 - DNA, 19 bp, Homo sapiens
ctgctgggtgctgagggag

SEQ ID NO: 7772451 - DNA, 19 bp, Homo sapiens
ctgctgggtgctgagggag

SEQ ID NO: 7772452 - DNA, 22 bp, Homo sapiens
ctgctgggtctatgcaagtgga

SEQ ID NO: 7772453 - DNA, 22 bp, Homo sapiens
ctgctgggtccccctgctgatt

SEQ ID NO: 7772454 - DNA, 22 bp, Homo sapiens
ctgctggtgcagagtggggctg

SEQ ID NO: 7772455 - DNA, 22 bp, Homo sapiens
ctgctgtcaaaaatcactccat

SEQ ID NO: 7772456 - DNA, 22 bp, Homo sapiens
ctgctgtccaacctgcactcgc

SEQ ID NO: 7772457 - DNA, 22 bp, Homo sapiens
ctgctgtccaggagtgccctgt

SEQ ID NO: 7772458 - DNA, 22 bp, Homo sapiens
ctggaaggttctttgtgtgcct

SEQ ID NO: 7772459 - DNA, 22 bp, Homo sapiens
ctggaaggttcctcccagctcc

SEQ ID NO: 7772460 - DNA, 22 bp, Homo sapiens
ctggaagggtcagagtgatgag

SEQ ID NO: 7772461 - DNA, 22 bp, Homo sapiens
ctggaaggtggatggcgaggcc

SEQ ID NO: 7772462 - DNA, 22 bp, Homo sapiens
ctggaagggagcactgtagaga

SEQ ID NO: 7772463 - DNA, 22 bp, Homo sapiens
ctggaagggtcagagtgatgag

SEQ ID NO: 7772464 - DNA, 22 bp, Homo sapiens
ctggaaggcagaggttgcagtg

SEQ ID NO: 7772465 - DNA, 22 bp, Homo sapiens
ctggaaggcggaggttgtagtg

SEQ ID NO: 7772466 - DNA, 22 bp, Homo sapiens
ctggaaggcggaggttgtagtg

SEQ ID NO: 7772467 - DNA, 19 bp, Homo sapiens
ctggaaggagggactgttc

SEQ ID NO: 7772468 - DNA, 22 bp, Homo sapiens
ctggaaggagaaggaggctgtg

SEQ ID NO: 7772469 - DNA, 22 bp, Homo sapiens
ctgctgtctagtatcttaaaaa

SEQ ID NO: 7772470 - DNA, 22 bp, Homo sapiens
ctgctgtctcactggtgtggtt

SEQ ID NO: 7772471 - DNA, 22 bp, Homo sapiens
ctgctgtgagtttggaggtcta

SEQ ID NO: 7772472 - DNA, 22 bp, Homo sapiens
ctggaaagtgctgagacaattg

SEQ ID NO: 7772473 - DNA, 22 bp, Homo sapiens
ctggaagcttgtttgccagtct

SEQ ID NO: 7772474 - DNA, 22 bp, Homo sapiens
ctggaaggagaaggaggctgtg

SEQ ID NO: 7772475 - DNA, 22 bp, Homo sapiens
ctggagagggagccctggcagt

SEQ ID NO: 7772476 - DNA, 22 bp, Homo sapiens
ctggagagtaatctctgtgtta

SEQ ID NO: 7772477 - DNA, 22 bp, Homo sapiens
ctggagagggagctgttggaag

SEQ ID NO: 7772478 - DNA, 22 bp, Homo sapiens
ctggagatgtccgggtgctgtt

SEQ ID NO: 7772479 - DNA, 22 bp, Homo sapiens
ctggagataagcagtcccaggc

SEQ ID NO: 7772480 - DNA, 22 bp, Homo sapiens
ctggagccggaccagggacggt

SEQ ID NO: 7772481 - DNA, 22 bp, Homo sapiens
ctggagccggaccagggacggt

SEQ ID NO: 7772482 - DNA, 22 bp, Homo sapiens
ctggagccggcgagccccagcc

SEQ ID NO: 7772483 - DNA, 22 bp, Homo sapiens
ctggagccctgaatgggcagga

SEQ ID NO: 7772484 - DNA, 22 bp, Homo sapiens
ctggagccgcatggagcaggga

SEQ ID NO: 7772485 - DNA, 18 bp, Homo sapiens
tttccaagaagagagctc

SEQ ID NO: 7772486 - DNA, 22 bp, Homo sapiens
tttcattacttgttaagggtag

SEQ ID NO: 7772487 - DNA, 22 bp, Homo sapiens
tttcattacgtgtttgacttgt

SEQ ID NO: 7772488 - DNA, 22 bp, Homo sapiens
tttcattaaagtcaaatctggt

SEQ ID NO: 7772489 - DNA, 22 bp, Homo sapiens
tttcatgttttcttaaatggca

SEQ ID NO: 7772490 - DNA, 22 bp, Homo sapiens
tttcatgtttatggaaaatgag

SEQ ID NO: 7772491 - DNA, 22 bp, Homo sapiens
tttcatgttacatttaaaatgt

SEQ ID NO: 7772492 - DNA, 22 bp, Homo sapiens
tttcatgttacatttaaaatgt

SEQ ID NO: 7772493 - DNA, 22 bp, Homo sapiens
tttcatgttagttggttcttgg

SEQ ID NO: 7772494 - DNA, 22 bp, Homo sapiens
tttcatgttattaatagtgctg

SEQ ID NO: 7772495 - DNA, 22 bp, Homo sapiens
tttcatgttacatttaaaatgt

SEQ ID NO: 7772496 - DNA, 22 bp, Homo sapiens
tttcatgtttatggaaaatgag

SEQ ID NO: 7772497 - DNA, 22 bp, Homo sapiens
tttccacatcaccatgaggtga

SEQ ID NO: 7772498 - DNA, 22 bp, Homo sapiens
tttccacagctgtataaaataa

SEQ ID NO: 7772499 - DNA, 22 bp, Homo sapiens
tttctacagaagatacactgct

SEQ ID NO: 7772500 - DNA, 22 bp, Homo sapiens
ctctctttgatgtataaataat

SEQ ID NO: 7772501 - DNA, 22 bp, Homo sapiens
ctctcttcccgtgagtgttgca

SEQ ID NO: 7772502 - DNA, 18 bp, Homo sapiens
ctctctttccactctttg

SEQ ID NO: 7772503 - DNA, 18 bp, Homo sapiens
tttctcaaggctgacatt

SEQ ID NO: 7772504 - DNA, 22 bp, Homo sapiens
tttctcaacctcaacactattt

SEQ ID NO: 7772505 - DNA, 22 bp, Homo sapiens
tttctacatgtcaatccaaacc

SEQ ID NO: 7772506 - DNA, 22 bp, Homo sapiens
tttctattttaaaggcatatgg

SEQ ID NO: 7772507 - DNA, 22 bp, Homo sapiens
tttctacatgtcagtaactgat

SEQ ID NO: 7772508 - DNA, 22 bp, Homo sapiens
tttctcaaattgcatgagtagc

SEQ ID NO: 7772509 - DNA, 22 bp, Homo sapiens
ctccaggccagggaagtggaca

SEQ ID NO: 7772510 - DNA, 23 bp, Homo sapiens
tttatattcctaatgtcttgagc

SEQ ID NO: 7772511 - DNA, 23 bp, Homo sapiens
tttatattcctaatgtcttgagc

SEQ ID NO: 7772512 - DNA, 22 bp, Homo sapiens
tttatgattattttaaagcagc

SEQ ID NO: 7772513 - DNA, 22 bp, Homo sapiens
tttatgattaatccaattctgt

SEQ ID NO: 7772514 - DNA, 22 bp, Homo sapiens
ctccaggagggcttcctgtgat

SEQ ID NO: 7772515 - DNA, 22 bp, Homo sapiens
ctccaggatgttagacgtccag

SEQ ID NO: 7772516 - DNA, 22 bp, Homo sapiens
tttattcactcattcagccagt

SEQ ID NO: 7772517 - DNA, 22 bp, Homo sapiens
tttattcactggggtctgcccg

SEQ ID NO: 7772518 - DNA, 22 bp, Homo sapiens
tttattcacttcagtgccaaag

SEQ ID NO: 7772519 - DNA, 22 bp, Homo sapiens
tttattcagcagcagcagtggt

SEQ ID NO: 7772520 - DNA, 22 bp, Homo sapiens
tttattcagcagcagcagtggt

SEQ ID NO: 7772521 - DNA, 22 bp, Homo sapiens
tttatgcagatttgtacagtga

SEQ ID NO: 7772522 - DNA, 22 bp, Homo sapiens
tttatgcatctctaggaagggc

SEQ ID NO: 7772523 - DNA, 22 bp, Homo sapiens
tttatgctactcaatagtcagt

SEQ ID NO: 7772524 - DNA, 22 bp, Homo sapiens
tttatggcacacaaatatcaaa

SEQ ID NO: 7772525 - DNA, 22 bp, Homo sapiens
tttcatgttacagtgtaaaagt

SEQ ID NO: 7772526 - DNA, 22 bp, Homo sapiens
tttcagaatagcaaagcaagct

SEQ ID NO: 7772527 - DNA, 22 bp, Homo sapiens
ctccttcatgtcatgtgtccgg

SEQ ID NO: 7772528 - DNA, 22 bp, Homo sapiens
ctccttaagtatgggctgtgca

SEQ ID NO: 7772529 - DNA, 22 bp, Homo sapiens
ctccttaaagggagcagcagct

SEQ ID NO: 7772530 - DNA, 22 bp, Homo sapiens
tttcacatatcaactctatcct

SEQ ID NO: 7772531 - DNA, 22 bp, Homo sapiens
tttcagaaatggcactgaaatc

SEQ ID NO: 7772532 - DNA, 22 bp, Homo sapiens
tttcacatataggggaagctac

SEQ ID NO: 7772533 - DNA, 22 bp, Homo sapiens
tttcacatataggggaagctac

SEQ ID NO: 7772534 - DNA, 22 bp, Homo sapiens
tttattcattgtttcgtcgcag

SEQ ID NO: 7772535 - DNA, 22 bp, Homo sapiens
tttattcatcatctgttcatat

SEQ ID NO: 7772536 - DNA, 20 bp, Homo sapiens
tttattcagcctaccctctt

SEQ ID NO: 7772537 - DNA, 22 bp, Homo sapiens
tttcagaaccaagagagacatc

SEQ ID NO: 7772538 - DNA, 22 bp, Homo sapiens
tttcacatatcaactctatcct

SEQ ID NO: 7772539 - DNA, 21 bp, Homo sapiens
tttgttcaggcaagttacagt

SEQ ID NO: 7772540 - DNA, 21 bp, Homo sapiens
tttgttcatagctcactcttt

SEQ ID NO: 7772541 - DNA, 22 bp, Homo sapiens
tttgttcatgcctatattctca

SEQ ID NO: 7772542 - DNA, 22 bp, Homo sapiens
ctctgggtgagacagacctggt

SEQ ID NO: 7772543 - DNA, 22 bp, Homo sapiens
tttggaatcatagatatattca

SEQ ID NO: 7772544 - DNA, 22 bp, Homo sapiens
tttggaatattaaaatgtctca

SEQ ID NO: 7772545 - DNA, 17 bp, Homo sapiens
tttgttcattgaagaga

SEQ ID NO: 7772546 - DNA, 22 bp, Homo sapiens
ctctgtgggcctgtgctttagt

SEQ ID NO: 7772547 - DNA, 22 bp, Homo sapiens
ctctgtggcttgcctttctgtc

SEQ ID NO: 7772548 - DNA, 22 bp, Homo sapiens
ctctgtgttcagcctagcagaa

SEQ ID NO: 7772549 - DNA, 22 bp, Homo sapiens
ttttgcctgcactgtatatata

SEQ ID NO: 7772550 - DNA, 22 bp, Homo sapiens
ttttgcctaagaatctctctga

SEQ ID NO: 7772551 - DNA, 22 bp, Homo sapiens
ctctgcagaggcccaaggctga

SEQ ID NO: 7772552 - DNA, 22 bp, Homo sapiens
ctctgcactgtccggctttctt

SEQ ID NO: 7772553 - DNA, 22 bp, Homo sapiens
ctctgcaccttgtaggaggcaa

SEQ ID NO: 7772554 - DNA, 22 bp, Homo sapiens
ctctgcacctacacaacaggaa

SEQ ID NO: 7772555 - DNA, 22 bp, Homo sapiens
ctctgcagaatttgagctgctc

SEQ ID NO: 7772556 - DNA, 22 bp, Homo sapiens
ctctgcacacaagtaatttcat

SEQ ID NO: 7772557 - DNA, 23 bp, Homo sapiens
ctctgcaccaggtggttttcagc

SEQ ID NO: 7772558 - DNA, 22 bp, Homo sapiens
ctctgcacccccggctcctcgt

SEQ ID NO: 7772559 - DNA, 22 bp, Homo sapiens
ctctgatttatattataaagtg

SEQ ID NO: 7772560 - DNA, 22 bp, Homo sapiens
ctctgcaacttctagcagtgtc

SEQ ID NO: 7772561 - DNA, 22 bp, Homo sapiens
tttgaaaacttaatttggtcgt

SEQ ID NO: 7772562 - DNA, 22 bp, Homo sapiens
tttgaaaagaaccatcgcctta

SEQ ID NO: 7772563 - DNA, 22 bp, Homo sapiens
tttgaaaaaggcctttggtatg

SEQ ID NO: 7772564 - DNA, 22 bp, Homo sapiens
tttgacttctatctagtaagaa

SEQ ID NO: 7772565 - DNA, 22 bp, Homo sapiens
tttgagaaaaagtgatgatgat

SEQ ID NO: 7772566 - DNA, 22 bp, Homo sapiens
tttgagaagagtttgaggtatt

SEQ ID NO: 7772567 - DNA, 22 bp, Homo sapiens
tttgcaaacacttaagaagaga

SEQ ID NO: 7772568 - DNA, 22 bp, Homo sapiens
tttgcaaacacttaagaagaga

SEQ ID NO: 7772569 - DNA, 22 bp, Homo sapiens
tttgcaaaccggagctctgcaa

SEQ ID NO: 7772570 - DNA, 22 bp, Homo sapiens
tttgcaaacattcagggctcca

SEQ ID NO: 7772571 - DNA, 22 bp, Homo sapiens
tttgcaaactttcctctggacc

SEQ ID NO: 7772572 - DNA, 22 bp, Homo sapiens
tttgcaaacggccctgagtccc

SEQ ID NO: 7772573 - DNA, 22 bp, Homo sapiens
tttgcaaagtgcttgcagagta

SEQ ID NO: 7772574 - DNA, 22 bp, Homo sapiens
tttgcaaagaaattattgctgt

SEQ ID NO: 7772575 - DNA, 22 bp, Homo sapiens
tttgcaaagaaattattgctgt

SEQ ID NO: 7772576 - DNA, 22 bp, Homo sapiens
tttgcaaagaaattattgctgt

SEQ ID NO: 7772577 - DNA, 18 bp, Homo sapiens
tttgcaaaggaagtatgg

SEQ ID NO: 7772578 - DNA, 22 bp, Homo sapiens
tttgcaaagaaattattgctgt

SEQ ID NO: 7772579 - DNA, 22 bp, Homo sapiens
tttgcaaagtccattgaagtta

SEQ ID NO: 7772580 - DNA, 22 bp, Homo sapiens
tgagagtattttggcattatca

SEQ ID NO: 7772581 - DNA, 22 bp, Homo sapiens
tgagagtacttatatgaacatt

SEQ ID NO: 7772582 - DNA, 22 bp, Homo sapiens
tgagagtgaaatgtcacatgtc

SEQ ID NO: 7772583 - DNA, 22 bp, Homo sapiens
ccaggtctatcaagttgggctc

SEQ ID NO: 7772584 - DNA, 22 bp, Homo sapiens
tgagaggtgaggcatgaggcat

SEQ ID NO: 7772585 - DNA, 22 bp, Homo sapiens
tgagagtagagtcttcatctgt

SEQ ID NO: 7772586 - DNA, 22 bp, Homo sapiens
ccagggtggggtccaggaacca

SEQ ID NO: 7772587 - DNA, 22 bp, Homo sapiens
ccagggtgtgggcgtcggcacg

SEQ ID NO: 7772588 - DNA, 22 bp, Homo sapiens
ccagggtgtagggattccagat

SEQ ID NO: 7772589 - DNA, 22 bp, Homo sapiens
ccagggtgtagggattccagat

SEQ ID NO: 7772590 - DNA, 22 bp, Homo sapiens
ccagggtgggaggctgaaggcg

SEQ ID NO: 7772591 - DNA, 22 bp, Homo sapiens
ccagggtggcgtagatgctggg

SEQ ID NO: 7772592 - DNA, 22 bp, Homo sapiens
tgaggaagttgtttctcttcta

SEQ ID NO: 7772593 - DNA, 23 bp, Homo sapiens
tgagctggtattgtccatctcca

SEQ ID NO: 7772594 - DNA, 22 bp, Homo sapiens
tgagctgggctgggctgagctg

SEQ ID NO: 7772595 - DNA, 23 bp, Homo sapiens
tgagctgggcctgcaggggtctc

SEQ ID NO: 7772596 - DNA, 22 bp, Homo sapiens
tgagcagaaaagaatgctgagc

SEQ ID NO: 7772597 - DNA, 22 bp, Homo sapiens
tgagcagacttgatgaggcagc

SEQ ID NO: 7772598 - DNA, 22 bp, Homo sapiens
tgagctggcaggggctcaggga

SEQ ID NO: 7772599 - DNA, 19 bp, Homo sapiens
tgagctggctgagcctctc

SEQ ID NO: 7772600 - DNA, 22 bp, Homo sapiens
tgagctggcttgtcaaccaggg

SEQ ID NO: 7772601 - DNA, 22 bp, Homo sapiens
tgagctgggaagagcagccaga

SEQ ID NO: 7772602 - DNA, 22 bp, Homo sapiens
tgaccaggatactgcagggatg

SEQ ID NO: 7772603 - DNA, 22 bp, Homo sapiens
tgaccatttgatctacattcca

SEQ ID NO: 7772604 - DNA, 22 bp, Homo sapiens
ccagggcccacggccagaatag

SEQ ID NO: 7772605 - DNA, 22 bp, Homo sapiens
ccagggccaagagacctcgagg

SEQ ID NO: 7772606 - DNA, 20 bp, Homo sapiens
tgacatctgttgaggaggaa

SEQ ID NO: 7772607 - DNA, 22 bp, Homo sapiens
tgaccccactgtgctcagaggt

SEQ ID NO: 7772608 - DNA, 22 bp, Homo sapiens
tgactttggactagtgatttaa

SEQ ID NO: 7772609 - DNA, 17 bp, Homo sapiens
tgactttatttgcttgg

SEQ ID NO: 7772610 - DNA, 22 bp, Homo sapiens
ccagggtcttcgaggcagcaat

SEQ ID NO: 7772611 - DNA, 22 bp, Homo sapiens
tgactttgtgccatttttataa

SEQ ID NO: 7772612 - DNA, 22 bp, Homo sapiens
tgactttgtgccatttttataa

SEQ ID NO: 7772613 - DNA, 22 bp, Homo sapiens
tgacagagccaagatcagtact

SEQ ID NO: 7772614 - DNA, 22 bp, Homo sapiens
ccagggcatgtaactaatggtg

SEQ ID NO: 7772615 - DNA, 22 bp, Homo sapiens
ccagggccaagagacctcgagg

SEQ ID NO: 7772616 - DNA, 22 bp, Homo sapiens
ccaggcttttagctgcatggca

SEQ ID NO: 7772617 - DNA, 22 bp, Homo sapiens
ccaggctttcccagcctctcca

SEQ ID NO: 7772618 - DNA, 21 bp, Homo sapiens
ccagcctcagatcagggagct

SEQ ID NO: 7772619 - DNA, 21 bp, Homo sapiens
tcttgtattggatctgtgtgt

SEQ ID NO: 7772620 - DNA, 22 bp, Homo sapiens
tcttgttaaagtgaagatactg

SEQ ID NO: 7772621 - DNA, 22 bp, Homo sapiens
tcttgtgtggtggaagatatgg

SEQ ID NO: 7772622 - DNA, 21 bp, Homo sapiens
tcttgtgtgggaaacaatttg

SEQ ID NO: 7772623 - DNA, 22 bp, Homo sapiens
tctttaaagttggagcttgcaa

SEQ ID NO: 7772624 - DNA, 22 bp, Homo sapiens
ccagcctcactggcatcaccta

SEQ ID NO: 7772625 - DNA, 22 bp, Homo sapiens
ccaggctcaggtgcgagagaca

SEQ ID NO: 7772626 - DNA, 22 bp, Homo sapiens
ccaggctcagcgcgcacgtctg

SEQ ID NO: 7772627 - DNA, 22 bp, Homo sapiens
ccaggctcaggcctgctcgttg

SEQ ID NO: 7772628 - DNA, 22 bp, Homo sapiens
ccaggctcacctggagcccctg

SEQ ID NO: 7772629 - DNA, 22 bp, Homo sapiens
tctttattttatgcttgtgcaa

SEQ ID NO: 7772630 - DNA, 22 bp, Homo sapiens
tctttaagccaagatatattta

SEQ ID NO: 7772631 - DNA, 22 bp, Homo sapiens
tctttaagagttcatttgcatg

SEQ ID NO: 7772632 - DNA, 22 bp, Homo sapiens
tctttatttaagtctgttgtaa

SEQ ID NO: 7772633 - DNA, 17 bp, Homo sapiens
tgaaggaaggatgatgt

SEQ ID NO: 7772634 - DNA, 22 bp, Homo sapiens
tgaaggaatgagggagtgggtc

SEQ ID NO: 7772635 - DNA, 22 bp, Homo sapiens
tgaagatgtcagcaggggtggt

SEQ ID NO: 7772636 - DNA, 17 bp, Homo sapiens
tgaagatgcatggcagc

SEQ ID NO: 7772637 - DNA, 22 bp, Homo sapiens
tgaaggaaagagggaacatccc

SEQ ID NO: 7772638 - DNA, 22 bp, Homo sapiens
tgaagctttaggatgggttcat

SEQ ID NO: 7772639 - DNA, 19 bp, Homo sapiens
tgaacagagaggactctgg

SEQ ID NO: 7772640 - DNA, 22 bp, Homo sapiens
tgaagaggccgtgtgcaggtga

SEQ ID NO: 7772641 - DNA, 22 bp, Homo sapiens
ccaggctgcagtcaaggggcat

SEQ ID NO: 7772642 - DNA, 22 bp, Homo sapiens
ccaggctgcagtcaaggggcat

SEQ ID NO: 7772643 - DNA, 22 bp, Homo sapiens
ccaggctgagcatgattggagc

SEQ ID NO: 7772644 - DNA, 22 bp, Homo sapiens
ccaggctgccgaggaaagaaag

SEQ ID NO: 7772645 - DNA, 22 bp, Homo sapiens
ccaggctgccgaggaaagaaag

SEQ ID NO: 7772646 - DNA, 22 bp, Homo sapiens
ccaggctgctcacaagctgccc

SEQ ID NO: 7772647 - DNA, 22 bp, Homo sapiens
ccaggctgctcacaagctgccc

SEQ ID NO: 7772648 - DNA, 22 bp, Homo sapiens
ccaggctgctcacaagctgccc

SEQ ID NO: 7772649 - DNA, 22 bp, Homo sapiens
tgaaatgattatatggtgtttg

SEQ ID NO: 7772650 - DNA, 22 bp, Homo sapiens
ccaggctccccaggaggccctt

SEQ ID NO: 7772651 - DNA, 21 bp, Homo sapiens
tgaaacagatggaagtatttg

SEQ ID NO: 7772652 - DNA, 22 bp, Homo sapiens
tgaaagctgtccactaggctgt

SEQ ID NO: 7772653 - DNA, 22 bp, Homo sapiens
tgaaagcttgttggaaatgtag

SEQ ID NO: 7772654 - DNA, 22 bp, Homo sapiens
tgattcaagagagttggggtat

SEQ ID NO: 7772655 - DNA, 22 bp, Homo sapiens
tgattcaactttcttgaatgca

SEQ ID NO: 7772656 - DNA, 22 bp, Homo sapiens
cccacagaatgccaatgagacc

SEQ ID NO: 7772657 - DNA, 22 bp, Homo sapiens
cccacaggcaggggcagagaca

SEQ ID NO: 7772658 - DNA, 22 bp, Homo sapiens
cccacaggcaggtgcatgggct

SEQ ID NO: 7772659 - DNA, 22 bp, Homo sapiens
cccacaggtggaagcctcggaa

SEQ ID NO: 7772660 - DNA, 22 bp, Homo sapiens
cccacaggtggaagcctcggaa

SEQ ID NO: 7772661 - DNA, 22 bp, Homo sapiens
cccacaggtccccatgaactcg

SEQ ID NO: 7772662 - DNA, 22 bp, Homo sapiens
cccacagggctgctgatggcag

SEQ ID NO: 7772663 - DNA, 21 bp, Homo sapiens
cccaccccataaggcagaacc

SEQ ID NO: 7772664 - DNA, 22 bp, Homo sapiens
tgcagagatagaactactttct

SEQ ID NO: 7772665 - DNA, 22 bp, Homo sapiens
cccacccagcctggctgagggg

SEQ ID NO: 7772666 - DNA, 23 bp, Homo sapiens
cccacatgtctgagtcagtgcca

SEQ ID NO: 7772667 - DNA, 22 bp, Homo sapiens
cccaccacgtgctttgctggag

SEQ ID NO: 7772668 - DNA, 22 bp, Homo sapiens
tgcagaggtgttgctgagataa

SEQ ID NO: 7772669 - DNA, 22 bp, Homo sapiens
tgcagaggtgaaagactagcaa

SEQ ID NO: 7772670 - DNA, 22 bp, Homo sapiens
tgcagaggtgaaagactagcaa

SEQ ID NO: 7772671 - DNA, 22 bp, Homo sapiens
tgcagaggtttccaggcaagtt

SEQ ID NO: 7772672 - DNA, 22 bp, Homo sapiens
tgcagcagtcagtcaggcctgg

SEQ ID NO: 7772673 - DNA, 22 bp, Homo sapiens
cccagcagccagaatgaggagc

SEQ ID NO: 7772674 - DNA, 22 bp, Homo sapiens
cccagcagatggctatgtgcta

SEQ ID NO: 7772675 - DNA, 23 bp, Homo sapiens
cccagcagagatgaggaggggtc

SEQ ID NO: 7772676 - DNA, 22 bp, Homo sapiens
cccagcactttgaatatgtcac

SEQ ID NO: 7772677 - DNA, 22 bp, Homo sapiens
cccagcagaatctgatgagggc

SEQ ID NO: 7772678 - DNA, 22 bp, Homo sapiens
tgcagaggtttgtggtgttgct

SEQ ID NO: 7772679 - DNA, 22 bp, Homo sapiens
cccagagaagtgaagtgacttg

SEQ ID NO: 7772680 - DNA, 22 bp, Homo sapiens
cccagcactcagcaggctcata

SEQ ID NO: 7772681 - DNA, 22 bp, Homo sapiens
cccagagagcacaggtggtggg

SEQ ID NO: 7772682 - DNA, 22 bp, Homo sapiens
ccatggccgccgctgctcagga

SEQ ID NO: 7772683 - DNA, 22 bp, Homo sapiens
ccattgtagtatctgttttagt

SEQ ID NO: 7772684 - DNA, 22 bp, Homo sapiens
ccatggcagccatgggagccac

SEQ ID NO: 7772685 - DNA, 22 bp, Homo sapiens
ccatggcaatggtcagtctatt

SEQ ID NO: 7772686 - DNA, 22 bp, Homo sapiens
ccatggcaactggcgtccaggg

SEQ ID NO: 7772687 - DNA, 19 bp, Homo sapiens
ccatggcaatgatctgatg

SEQ ID NO: 7772688 - DNA, 22 bp, Homo sapiens
tgattcaactttcataacaaaa

SEQ ID NO: 7772689 - DNA, 22 bp, Homo sapiens
tgattatattctaacttcataa

SEQ ID NO: 7772690 - DNA, 22 bp, Homo sapiens
tgattcaaatattgtgtatgat

SEQ ID NO: 7772691 - DNA, 17 bp, Homo sapiens
tgattcaactagaaact

SEQ ID NO: 7772692 - DNA, 22 bp, Homo sapiens
cccaagccagaccctgaccctg

SEQ ID NO: 7772693 - DNA, 22 bp, Homo sapiens
cccaaccagaaattgacagaca

SEQ ID NO: 7772694 - DNA, 22 bp, Homo sapiens
cccaacactcacctccggatta

SEQ ID NO: 7772695 - DNA, 23 bp, Homo sapiens
cccaacacattccttttcttctg

SEQ ID NO: 7772696 - DNA, 22 bp, Homo sapiens
cccaaccagaaattgacagaga

SEQ ID NO: 7772697 - DNA, 22 bp, Homo sapiens
cccagcatctccaggcatggcc

SEQ ID NO: 7772698 - DNA, 22 bp, Homo sapiens
tgcagcagtttaatgcagggtt

SEQ ID NO: 7772699 - DNA, 22 bp, Homo sapiens
cccaggaaatagccaggaggtg

SEQ ID NO: 7772700 - DNA, 22 bp, Homo sapiens
cccagctcccatgttctccaat

SEQ ID NO: 7772701 - DNA, 22 bp, Homo sapiens
cccagctcccatgttctccaat

SEQ ID NO: 7772702 - DNA, 22 bp, Homo sapiens
cccagctccagagccagaaaca

SEQ ID NO: 7772703 - DNA, 22 bp, Homo sapiens
cccaggacccttcaatggctcc

SEQ ID NO: 7772704 - DNA, 21 bp, Homo sapiens
cccaggagaagaaaagatgca

SEQ ID NO: 7772705 - DNA, 22 bp, Homo sapiens
tgcagtggaagaggtggagatc

SEQ ID NO: 7772706 - DNA, 22 bp, Homo sapiens
tgcagtcttccagctgcacaaa

SEQ ID NO: 7772707 - DNA, 22 bp, Homo sapiens
tgcagtcttccagctgcacaaa

SEQ ID NO: 7772708 - DNA, 22 bp, Homo sapiens
tgcagtggaggccgtgagacag

SEQ ID NO: 7772709 - DNA, 22 bp, Homo sapiens
cccaggagttagaggttgtggt

SEQ ID NO: 7772710 - DNA, 19 bp, Homo sapiens
cccaggagtctggctggtt

SEQ ID NO: 7772711 - DNA, 22 bp, Homo sapiens
cccaggaggttgaggctgcagt

SEQ ID NO: 7772712 - DNA, 22 bp, Homo sapiens
cccaggaggttgaggctgcagt

SEQ ID NO: 7772713 - DNA, 22 bp, Homo sapiens
cccaggaggttggggctacagt

SEQ ID NO: 7772714 - DNA, 22 bp, Homo sapiens
cccaggagtaagtgacattgtt

SEQ ID NO: 7772715 - DNA, 19 bp, Homo sapiens
cccaggagtctggctggtt

SEQ ID NO: 7772716 - DNA, 22 bp, Homo sapiens
tgccctccacagtggctccacc

SEQ ID NO: 7772717 - DNA, 22 bp, Homo sapiens
tgccctctgcaggccgccatgg

SEQ ID NO: 7772718 - DNA, 22 bp, Homo sapiens
tgccctcttaggtctgcgcagc

SEQ ID NO: 7772719 - DNA, 22 bp, Homo sapiens
tgcccagcttcttacttttaaa

SEQ ID NO: 7772720 - DNA, 21 bp, Homo sapiens
cccaggaggctgagaagagca

SEQ ID NO: 7772721 - DNA, 22 bp, Homo sapiens
tgccctcagcagcagctcctgc

SEQ ID NO: 7772722 - DNA, 22 bp, Homo sapiens
cccaggaggcggaggttgtggt

SEQ ID NO: 7772723 - DNA, 22 bp, Homo sapiens
cccaggaggcagaagttgcagt

SEQ ID NO: 7772724 - DNA, 22 bp, Homo sapiens
cccaggaggaggaaaaagctcg

SEQ ID NO: 7772725 - DNA, 22 bp, Homo sapiens
cccaggaggaggaaaaagctcg

SEQ ID NO: 7772726 - DNA, 22 bp, Homo sapiens
cccaggaggcagagcttgcagt

SEQ ID NO: 7772727 - DNA, 22 bp, Homo sapiens
cccaggaggcagagatagcagt

SEQ ID NO: 7772728 - DNA, 22 bp, Homo sapiens
cccaggaggcgcaggttgcggt

SEQ ID NO: 7772729 - DNA, 22 bp, Homo sapiens
cccaggaggcctgcctggccgg

SEQ ID NO: 7772730 - DNA, 22 bp, Homo sapiens
cccaggaggcagaggttggagc

SEQ ID NO: 7772731 - DNA, 22 bp, Homo sapiens
cccaggaggcagaggttggagc

SEQ ID NO: 7772732 - DNA, 22 bp, Homo sapiens
tgcatatttgtatgatgtttag

SEQ ID NO: 7772733 - DNA, 22 bp, Homo sapiens
cccaggagcttctctctgcctc

SEQ ID NO: 7772734 - DNA, 21 bp, Homo sapiens
tgcatatataagtgcatacac

SEQ ID NO: 7772735 - DNA, 19 bp, Homo sapiens
tgcatatatctatgaaaga

SEQ ID NO: 7772736 - DNA, 22 bp, Homo sapiens
cctgctgtgtgacgggatgtta

SEQ ID NO: 7772737 - DNA, 20 bp, Homo sapiens
cctgctgtttccatggggcc

SEQ ID NO: 7772738 - DNA, 22 bp, Homo sapiens
cctgcttcagggatgatggcac

SEQ ID NO: 7772739 - DNA, 22 bp, Homo sapiens
tgtaatattgtagtgacagtac

SEQ ID NO: 7772740 - DNA, 22 bp, Homo sapiens
tgtaatatatataactgtgtgc

SEQ ID NO: 7772741 - DNA, 22 bp, Homo sapiens
tgtaatataagcattaatagtt

SEQ ID NO: 7772742 - DNA, 22 bp, Homo sapiens
tgtacatacatagatatacaca

SEQ ID NO: 7772743 - DNA, 22 bp, Homo sapiens
tgtacatacatagatatacaca

SEQ ID NO: 7772744 - DNA, 22 bp, Homo sapiens
tgtaatttcctgatgttagaac

SEQ ID NO: 7772745 - DNA, 22 bp, Homo sapiens
tgtcaacacacctatctcaatt

SEQ ID NO: 7772746 - DNA, 22 bp, Homo sapiens
tgtcaacagatactagagagct

SEQ ID NO: 7772747 - DNA, 22 bp, Homo sapiens
tgtcaacatttatcaagttatt

SEQ ID NO: 7772748 - DNA, 22 bp, Homo sapiens
tgtcaacaggctttctaaggca

SEQ ID NO: 7772749 - DNA, 22 bp, Homo sapiens
tgtcaacattggctgacagttg

SEQ ID NO: 7772750 - DNA, 22 bp, Homo sapiens
tgtcaagagtgcacacatctgc

SEQ ID NO: 7772751 - DNA, 22 bp, Homo sapiens
cctggagcttttccatcctgga

SEQ ID NO: 7772752 - DNA, 18 bp, Homo sapiens
cctggagctccacagcaa

SEQ ID NO: 7772753 - DNA, 18 bp, Homo sapiens
cctggagctccacagcaa

SEQ ID NO: 7772754 - DNA, 22 bp, Homo sapiens
cctggaggcggaggttgcagtg

SEQ ID NO: 7772755 - DNA, 23 bp, Homo sapiens
tgggtcactgtttcaccattgct

SEQ ID NO: 7772756 - DNA, 22 bp, Homo sapiens
tgggtcactctatcctgcttag

SEQ ID NO: 7772757 - DNA, 22 bp, Homo sapiens
tgggtcactatttgcagagacg

SEQ ID NO: 7772758 - DNA, 22 bp, Homo sapiens
tgggtcaccacttcagaggaga

SEQ ID NO: 7772759 - DNA, 22 bp, Homo sapiens
tgggtcacaaaggccagatgat

SEQ ID NO: 7772760 - DNA, 22 bp, Homo sapiens
cctgccaggctttgggcttctg

SEQ ID NO: 7772761 - DNA, 18 bp, Homo sapiens
cctgccagtctggagcag

SEQ ID NO: 7772762 - DNA, 22 bp, Homo sapiens
tggtctgcctggatcacagccc

SEQ ID NO: 7772763 - DNA, 22 bp, Homo sapiens
cctgctggacgtggaggagggg

SEQ ID NO: 7772764 - DNA, 22 bp, Homo sapiens
cctgctggacctcaacacattt

SEQ ID NO: 7772765 - DNA, 22 bp, Homo sapiens
cctgctcggggtgcagtgggct

SEQ ID NO: 7772766 - DNA, 22 bp, Homo sapiens
cctgctgctatgaaggtgacag

SEQ ID NO: 7772767 - DNA, 17 bp, Homo sapiens
tggtctggaagaactga

SEQ ID NO: 7772768 - DNA, 22 bp, Homo sapiens
tggtctggggaccgagggttac

SEQ ID NO: 7772769 - DNA, 22 bp, Homo sapiens
cctgctggccagtggagggctg

SEQ ID NO: 7772770 - DNA, 22 bp, Homo sapiens
cctgctggcgcttgtctgggag

SEQ ID NO: 7772771 - DNA, 22 bp, Homo sapiens
cctgctggcggggacccagtga

SEQ ID NO: 7772772 - DNA, 22 bp, Homo sapiens
cctgctggcagagggggttact

SEQ ID NO: 7772773 - DNA, 22 bp, Homo sapiens
cctgctgggacgtgtggttgcc

SEQ ID NO: 7772774 - DNA, 22 bp, Homo sapiens
cctgctgggcctgagcaatgag

SEQ ID NO: 7772775 - DNA, 22 bp, Homo sapiens
cctgctgtcagtggggcaggca

SEQ ID NO: 7772776 - DNA, 22 bp, Homo sapiens
cctgctggtttttacaaagatg

SEQ ID NO: 7772777 - DNA, 22 bp, Homo sapiens
cctgctgtgaccggggagcagg

SEQ ID NO: 7772778 - DNA, 22 bp, Homo sapiens
cctgctgtgaaactggcatatg

SEQ ID NO: 7772779 - DNA, 22 bp, Homo sapiens
cctgctgtctctgggcaggcag

SEQ ID NO: 7772780 - DNA, 22 bp, Homo sapiens
cctgagacatgaaccaggctcc

SEQ ID NO: 7772781 - DNA, 22 bp, Homo sapiens
cctgacagttaattgtcctgta

SEQ ID NO: 7772782 - DNA, 22 bp, Homo sapiens
cctgacaggcggaggctgcagt

SEQ ID NO: 7772783 - DNA, 22 bp, Homo sapiens
cctgacagtggtagccttggca

SEQ ID NO: 7772784 - DNA, 22 bp, Homo sapiens
cctgacaggagaagcgcagcat

SEQ ID NO: 7772785 - DNA, 22 bp, Homo sapiens
cctgacagcgtgtccctggccc

SEQ ID NO: 7772786 - DNA, 22 bp, Homo sapiens
cctgacctatttttctcagctg

SEQ ID NO: 7772787 - DNA, 22 bp, Homo sapiens
cctgaggctggcccttccatcc

SEQ ID NO: 7772788 - DNA, 22 bp, Homo sapiens
cctgagggaaggatgctaccca

SEQ ID NO: 7772789 - DNA, 22 bp, Homo sapiens
cctgaggggctgcaggccagct

SEQ ID NO: 7772790 - DNA, 22 bp, Homo sapiens
cctgccagagcagcttgtcctc

SEQ ID NO: 7772791 - DNA, 22 bp, Homo sapiens
cctgccaggagctggtgctgca

SEQ ID NO: 7772792 - DNA, 22 bp, Homo sapiens
cctgccaggccagtgagcttcc

SEQ ID NO: 7772793 - DNA, 22 bp, Homo sapiens
cctgcacttctcacagctgctg

SEQ ID NO: 7772794 - DNA, 22 bp, Homo sapiens
cctgatggctgtctgggcctga

SEQ ID NO: 7772795 - DNA, 22 bp, Homo sapiens
cctgcaccaggcccagcatggt

SEQ ID NO: 7772796 - DNA, 22 bp, Homo sapiens
tggggtaggagtcagcgagaga

SEQ ID NO: 7772797 - DNA, 22 bp, Homo sapiens
tgggggtggttcttgcctccag

SEQ ID NO: 7772798 - DNA, 22 bp, Homo sapiens
tgggggtgtcctggtgcacaca

SEQ ID NO: 7772799 - DNA, 21 bp, Homo sapiens
cctgagggtggttgtgaagat

SEQ ID NO: 7772800 - DNA, 21 bp, Homo sapiens
cctgagggtggttgtgaagat

SEQ ID NO: 7772801 - DNA, 22 bp, Homo sapiens
cctctggatctttctccacact

SEQ ID NO: 7772802 - DNA, 23 bp, Homo sapiens
tgggagctcaagggaggctgccc

SEQ ID NO: 7772803 - DNA, 22 bp, Homo sapiens
tgggagcccaagggagctgccg

SEQ ID NO: 7772804 - DNA, 22 bp, Homo sapiens
tgggagcctggcaggccagagg

SEQ ID NO: 7772805 - DNA, 22 bp, Homo sapiens
tgggagcccaagggagctgccg

SEQ ID NO: 7772806 - DNA, 22 bp, Homo sapiens
tgggagcccaagggagctgccg

SEQ ID NO: 7772807 - DNA, 22 bp, Homo sapiens
tgggagccattttagaggctgc

SEQ ID NO: 7772808 - DNA, 22 bp, Homo sapiens
tgggagccattttagaggctgc

SEQ ID NO: 7772809 - DNA, 22 bp, Homo sapiens
tgggagcagttcaggtgtggct

SEQ ID NO: 7772810 - DNA, 22 bp, Homo sapiens
tgggagcaggtgtgctagggaa

SEQ ID NO: 7772811 - DNA, 22 bp, Homo sapiens
tgggagcaggtgtgctagggaa

SEQ ID NO: 7772812 - DNA, 22 bp, Homo sapiens
tggctctcagctcccagcagcc

SEQ ID NO: 7772813 - DNA, 22 bp, Homo sapiens
tggctctcccaatacctttctg

SEQ ID NO: 7772814 - DNA, 22 bp, Homo sapiens
tggctctcagctcccagcagcc

SEQ ID NO: 7772815 - DNA, 22 bp, Homo sapiens
cctctggccacatgggacatag

SEQ ID NO: 7772816 - DNA, 22 bp, Homo sapiens
cctctggcctaggccgggagag

SEQ ID NO: 7772817 - DNA, 22 bp, Homo sapiens
tgggccactgctgcggaaggcg

SEQ ID NO: 7772818 - DNA, 22 bp, Homo sapiens
tgggccactcttccctgggtct

SEQ ID NO: 7772819 - DNA, 21 bp, Homo sapiens
tgggccagatctgagtttcta

SEQ ID NO: 7772820 - DNA, 22 bp, Homo sapiens
tgggccagcaattgctgctcag

SEQ ID NO: 7772821 - DNA, 22 bp, Homo sapiens
tgggccagatccatggcaataa

SEQ ID NO: 7772822 - DNA, 22 bp, Homo sapiens
tgggccagaggcatggagctat

SEQ ID NO: 7772823 - DNA, 22 bp, Homo sapiens
tgggccagagagtaagaaaggt

SEQ ID NO: 7772824 - DNA, 22 bp, Homo sapiens
tgggccagaagtatgcatgttt

SEQ ID NO: 7772825 - DNA, 22 bp, Homo sapiens
tgggccagaagtatgcatgttt

SEQ ID NO: 7772826 - DNA, 22 bp, Homo sapiens
cctgaatactggtgctgaaagt

SEQ ID NO: 7772827 - DNA, 22 bp, Homo sapiens
cctctttaatcccatccatgtg

SEQ ID NO: 7772828 - DNA, 22 bp, Homo sapiens
tgggccagcaattgctgctcag

SEQ ID NO: 7772829 - DNA, 22 bp, Homo sapiens
ccctgccttggggtccacaccg

SEQ ID NO: 7772830 - DNA, 22 bp, Homo sapiens
ccctgccttggggtccacaccg

SEQ ID NO: 7772831 - DNA, 22 bp, Homo sapiens
ccctgccttcttggcctttaaa

SEQ ID NO: 7772832 - DNA, 22 bp, Homo sapiens
ccctgccttcttggcctttaaa

SEQ ID NO: 7772833 - DNA, 22 bp, Homo sapiens
ccctgccttgttggagcctatg

SEQ ID NO: 7772834 - DNA, 22 bp, Homo sapiens
ccctgccttgttggagcctatg

SEQ ID NO: 7772835 - DNA, 22 bp, Homo sapiens
ccctgccttgtctgggctaggt

SEQ ID NO: 7772836 - DNA, 22 bp, Homo sapiens
ccctgccttgtctgggctaggt

SEQ ID NO: 7772837 - DNA, 22 bp, Homo sapiens
ccctgctgaatcccatggagtc

SEQ ID NO: 7772838 - DNA, 22 bp, Homo sapiens
tggagggtcaccccttgctgag

SEQ ID NO: 7772839 - DNA, 22 bp, Homo sapiens
tggaggtgaaatgagattttgt

SEQ ID NO: 7772840 - DNA, 23 bp, Homo sapiens
ccctggagctagtctgagcagag

SEQ ID NO: 7772841 - DNA, 22 bp, Homo sapiens
ccctgcctctgaagctgctcag

SEQ ID NO: 7772842 - DNA, 22 bp, Homo sapiens
ccctgcctgtgggcatcaacat

SEQ ID NO: 7772843 - DNA, 22 bp, Homo sapiens
ccctgcctgtgggcatcaacat

SEQ ID NO: 7772844 - DNA, 22 bp, Homo sapiens
ccctgcctctgaagctgctcag

SEQ ID NO: 7772845 - DNA, 22 bp, Homo sapiens
ccctgcctacagggttttcttt

SEQ ID NO: 7772846 - DNA, 22 bp, Homo sapiens
ccctgcctacagggttttcttt

SEQ ID NO: 7772847 - DNA, 22 bp, Homo sapiens
ccctgcagtcctttcttggctc

SEQ ID NO: 7772848 - DNA, 22 bp, Homo sapiens
tggacagttactgagcttgagt

SEQ ID NO: 7772849 - DNA, 22 bp, Homo sapiens
tggacaggttgagtaggaggag

SEQ ID NO: 7772850 - DNA, 22 bp, Homo sapiens
tggacaggtttgggtgcctgtt

SEQ ID NO: 7772851 - DNA, 22 bp, Homo sapiens
tggacaggttgagtaggaggag

SEQ ID NO: 7772852 - DNA, 22 bp, Homo sapiens
tggacaggtgcacacagcagcc

SEQ ID NO: 7772853 - DNA, 17 bp, Homo sapiens
ccctgcaccctactctc

SEQ ID NO: 7772854 - DNA, 17 bp, Homo sapiens
ccctgcaccctactctc

SEQ ID NO: 7772855 - DNA, 22 bp, Homo sapiens
ccctgcagaaccacagacaaac

SEQ ID NO: 7772856 - DNA, 23 bp, Homo sapiens
ccctgcactaagaggagaaggtg

SEQ ID NO: 7772857 - DNA, 22 bp, Homo sapiens
ccctgcagagggatgggggcag

SEQ ID NO: 7772858 - DNA, 20 bp, Homo sapiens
ccctgcagccatgggagtgg

SEQ ID NO: 7772859 - DNA, 22 bp, Homo sapiens
ccctgcagccggccagctcatt

SEQ ID NO: 7772860 - DNA, 22 bp, Homo sapiens
tgcctgcctgcatagtcccacg

SEQ ID NO: 7772861 - DNA, 22 bp, Homo sapiens
tgcctgccctttccacacagcc

SEQ ID NO: 7772862 - DNA, 18 bp, Homo sapiens
tgcctgccccgtaagggt

SEQ ID NO: 7772863 - DNA, 22 bp, Homo sapiens
tgcctcagtttcatctgcagaa

SEQ ID NO: 7772864 - DNA, 22 bp, Homo sapiens
tgcctcattaactgtccttaat

SEQ ID NO: 7772865 - DNA, 17 bp, Homo sapiens
tgcctccagcagggtga

SEQ ID NO: 7772866 - DNA, 23 bp, Homo sapiens
tgcctccaccgagggccaggcat

SEQ ID NO: 7772867 - DNA, 22 bp, Homo sapiens
tgcctccaggaggggcagctct

SEQ ID NO: 7772868 - DNA, 22 bp, Homo sapiens
tgctttcagctggtaaagaaac

SEQ ID NO: 7772869 - DNA, 22 bp, Homo sapiens
tgctttcaatgaattgtatact

SEQ ID NO: 7772870 - DNA, 20 bp, Homo sapiens
tggaaggcatctgcattatt

SEQ ID NO: 7772871 - DNA, 17 bp, Homo sapiens
tggaaggcttcaatatt

SEQ ID NO: 7772872 - DNA, 22 bp, Homo sapiens
tggaaggcttggaatacttcca

SEQ ID NO: 7772873 - DNA, 21 bp, Homo sapiens
tggaaggctgctctgccaggg

SEQ ID NO: 7772874 - DNA, 22 bp, Homo sapiens
tggaaggcgcagtgatgatgct

SEQ ID NO: 7772875 - DNA, 22 bp, Homo sapiens
cctcccctcagacagagactgg

SEQ ID NO: 7772876 - DNA, 22 bp, Homo sapiens
cctcccctcagacagagactgg

SEQ ID NO: 7772877 - DNA, 22 bp, Homo sapiens
cctcccctgctcagaactctgg

SEQ ID NO: 7772878 - DNA, 23 bp, Homo sapiens
tggctcagctagttttccatttc

SEQ ID NO: 7772879 - DNA, 22 bp, Homo sapiens
tggctcagcggtggcagcagac

SEQ ID NO: 7772880 - DNA, 22 bp, Homo sapiens
tggctcagcggtggcagcagac

SEQ ID NO: 7772881 - DNA, 22 bp, Homo sapiens
cctccctctttcagtcccacag

SEQ ID NO: 7772882 - DNA, 22 bp, Homo sapiens
cctccctctgttagagctgtct

SEQ ID NO: 7772883 - DNA, 22 bp, Homo sapiens
cctccctccctcttatggttta

SEQ ID NO: 7772884 - DNA, 19 bp, Homo sapiens
cctccccttggaccagcaa

SEQ ID NO: 7772885 - DNA, 19 bp, Homo sapiens
cctccccttggaccagcaa

SEQ ID NO: 7772886 - DNA, 22 bp, Homo sapiens
tggctcagcgcggcctggtctt

SEQ ID NO: 7772887 - DNA, 22 bp, Homo sapiens
tggctagatttattgctgagca

SEQ ID NO: 7772888 - DNA, 22 bp, Homo sapiens
tggctaggctggtgtcaagctc

SEQ ID NO: 7772889 - DNA, 22 bp, Homo sapiens
tggctacagcaagaggaaagaa

SEQ ID NO: 7772890 - DNA, 22 bp, Homo sapiens
cctcagctgcttccctggagcc

SEQ ID NO: 7772891 - DNA, 22 bp, Homo sapiens
cctcagctgcttccctggagcc

SEQ ID NO: 7772892 - DNA, 23 bp, Homo sapiens
cctcagcatggcaggagcccagc

SEQ ID NO: 7772893 - DNA, 22 bp, Homo sapiens
cctcagccttggccccaggcag

SEQ ID NO: 7772894 - DNA, 22 bp, Homo sapiens
tggcctcggcatccagcaagag

SEQ ID NO: 7772895 - DNA, 22 bp, Homo sapiens
tggcctcggcatccagcaagag

SEQ ID NO: 7772896 - DNA, 22 bp, Homo sapiens
tggcctctctaccaggcagcct

SEQ ID NO: 7772897 - DNA, 22 bp, Homo sapiens
tggcctctcctggcagcatcca

SEQ ID NO: 7772898 - DNA, 22 bp, Homo sapiens
tggcctcaatctgtcctccagc

SEQ ID NO: 7772899 - DNA, 22 bp, Homo sapiens
tggcctcaatctgtcctccagc

SEQ ID NO: 7772900 - DNA, 22 bp, Homo sapiens
tggccctgcttatgtctctctt

SEQ ID NO: 7772901 - DNA, 19 bp, Homo sapiens
cctcaccctgcagaggagg

SEQ ID NO: 7772902 - DNA, 22 bp, Homo sapiens
ccctttccatggctctcctagg

SEQ ID NO: 7772903 - DNA, 22 bp, Homo sapiens
ccctgtggcaggaggaggagca

SEQ ID NO: 7772904 - DNA, 22 bp, Homo sapiens
ccctgtggatttcagtttgtgt

SEQ ID NO: 7772905 - DNA, 22 bp, Homo sapiens
ccggagagtcagagcgcggccc

SEQ ID NO: 7772906 - DNA, 22 bp, Homo sapiens
ccctgtgatgtagctagagtag

SEQ ID NO: 7772907 - DNA, 22 bp, Homo sapiens
ccctgtggaggcagcatcctgc

SEQ ID NO: 7772908 - DNA, 22 bp, Homo sapiens
ccctgtggaggaggagagcagt

SEQ ID NO: 7772909 - DNA, 22 bp, Homo sapiens
ccctggtggtacggcactggca

SEQ ID NO: 7772910 - DNA, 22 bp, Homo sapiens
ccctggagctgcttgcatgttg

SEQ ID NO: 7772911 - DNA, 22 bp, Homo sapiens
ccctgtccttggctgtgaggct

SEQ ID NO: 7772912 - DNA, 22 bp, Homo sapiens
ccctggtgtggatgtgattggc

SEQ ID NO: 7772913 - DNA, 22 bp, Homo sapiens
ccctggtggtacggcactggca

SEQ ID NO: 7772914 - DNA, 22 bp, Homo sapiens
ccctggtgtccactggaggaag

SEQ ID NO: 7772915 - DNA, 22 bp, Homo sapiens
cctaaatagagtcagatgtaat

SEQ ID NO: 7772916 - DNA, 22 bp, Homo sapiens
cctatttgtaggctgggccagt

SEQ ID NO: 7772917 - DNA, 22 bp, Homo sapiens
cctcacccagtcacctaggtgg

SEQ ID NO: 7772918 - DNA, 22 bp, Homo sapiens
cctcacccactacactcaaggg

SEQ ID NO: 7772919 - DNA, 22 bp, Homo sapiens
cctcacatgaatgtaagctcca

SEQ ID NO: 7772920 - DNA, 22 bp, Homo sapiens
ccggggtgcgaggagcgtcttt

SEQ ID NO: 7772921 - DNA, 21 bp, Homo sapiens
ccgtgctcggctatggaccac

SEQ ID NO: 7772922 - DNA, 22 bp, Homo sapiens
ccgtctgcagcctccaggagtt

SEQ ID NO: 7772923 - DNA, 22 bp, Homo sapiens
ccgggcctcgggacaccgggta

SEQ ID NO: 7772924 - DNA, 22 bp, Homo sapiens
ccgggagcaggcgccaccgcca

SEQ ID NO: 7772925 - DNA, 22 bp, Homo sapiens
ccagaaaactctacatgcttgt

SEQ ID NO: 7772926 - DNA, 19 bp, Homo sapiens
ccactttgcttctctgggt

SEQ ID NO: 7772927 - DNA, 22 bp, Homo sapiens
ccactttgaaccactgaggtgg

SEQ ID NO: 7772928 - DNA, 22 bp, Homo sapiens
tctcaaatttgttagataaaat

SEQ ID NO: 7772929 - DNA, 22 bp, Homo sapiens
tctcaaatttatacagagttca

SEQ ID NO: 7772930 - DNA, 22 bp, Homo sapiens
tctcaaatttatacagagttca

SEQ ID NO: 7772931 - DNA, 22 bp, Homo sapiens
tctcaagagggaggcaatcatg

SEQ ID NO: 7772932 - DNA, 22 bp, Homo sapiens
tctcaagagggaggcaatcatg

SEQ ID NO: 7772933 - DNA, 22 bp, Homo sapiens
tctcaagcttgttggtatgttt

SEQ ID NO: 7772934 - DNA, 22 bp, Homo sapiens
tctcaagatctcaagatggccc

SEQ ID NO: 7772935 - DNA, 22 bp, Homo sapiens
ccacctcctaggcctggagaag

SEQ ID NO: 7772936 - DNA, 22 bp, Homo sapiens
ccacctgagataagagagctca

SEQ ID NO: 7772937 - DNA, 16 bp, Homo sapiens
ccacctgcagctctca

SEQ ID NO: 7772938 - DNA, 22 bp, Homo sapiens
tctcaaatgtaaagcatgattt

SEQ ID NO: 7772939 - DNA, 22 bp, Homo sapiens
tctcaaattcccttttcctcct

SEQ ID NO: 7772940 - DNA, 22 bp, Homo sapiens
tctcccacggtacaggataaac

SEQ ID NO: 7772941 - DNA, 22 bp, Homo sapiens
tctccctctcagatttattcac

SEQ ID NO: 7772942 - DNA, 22 bp, Homo sapiens
tctcctggccctgtcgccatct

SEQ ID NO: 7772943 - DNA, 22 bp, Homo sapiens
tctccgggtggcggcgaaggga

SEQ ID NO: 7772944 - DNA, 22 bp, Homo sapiens
tctccctctttgtctgctttgg

SEQ ID NO: 7772945 - DNA, 20 bp, Homo sapiens
tctccctgcccatctcagat

SEQ ID NO: 7772946 - DNA, 22 bp, Homo sapiens
tctccagaaatggggctgggga

SEQ ID NO: 7772947 - DNA, 18 bp, Homo sapiens
tcctctctttccccaggg

SEQ ID NO: 7772948 - DNA, 21 bp, Homo sapiens
tcctctgcagtgaggtggcct

SEQ ID NO: 7772949 - DNA, 22 bp, Homo sapiens
tcctctgccaaagggagttgcc

SEQ ID NO: 7772950 - DNA, 22 bp, Homo sapiens
ccacattcagtccaggcttgga

SEQ ID NO: 7772951 - DNA, 22 bp, Homo sapiens
ccacatttcttcacttgtccca

SEQ ID NO: 7772952 - DNA, 22 bp, Homo sapiens
ccacatttggagaagatacttt

SEQ ID NO: 7772953 - DNA, 22 bp, Homo sapiens
ccacatttactggatgctcagg

SEQ ID NO: 7772954 - DNA, 22 bp, Homo sapiens
ccacatttactgatgtatgtat

SEQ ID NO: 7772955 - DNA, 22 bp, Homo sapiens
ccacagtgatccctgcctgcga

SEQ ID NO: 7772956 - DNA, 22 bp, Homo sapiens
ccacatgatgaggaagctgaac

SEQ ID NO: 7772957 - DNA, 22 bp, Homo sapiens
ccacagtgattcacttttgaag

SEQ ID NO: 7772958 - DNA, 22 bp, Homo sapiens
tcgggtgcttttagatatgtag

SEQ ID NO: 7772959 - DNA, 22 bp, Homo sapiens
tcggaaggggccgcgctcggac

SEQ ID NO: 7772960 - DNA, 22 bp, Homo sapiens
tcggagagctcacagctgtggc

SEQ ID NO: 7772961 - DNA, 22 bp, Homo sapiens
ccaccgctgaaggcactggcat

SEQ ID NO: 7772962 - DNA, 22 bp, Homo sapiens
tcgcgcccccaagcgtcattgg

SEQ ID NO: 7772963 - DNA, 22 bp, Homo sapiens
tcgctggcctggaggggagcca

SEQ ID NO: 7772964 - DNA, 22 bp, Homo sapiens
ccaccagctttgccaccctgct

SEQ ID NO: 7772965 - DNA, 22 bp, Homo sapiens
tcctttccagcctcacctcagc

SEQ ID NO: 7772966 - DNA, 22 bp, Homo sapiens
ccaccaggacagccctgagggg

SEQ ID NO: 7772967 - DNA, 22 bp, Homo sapiens
ccaccagcttcagcagccgcgg

SEQ ID NO: 7772968 - DNA, 20 bp, Homo sapiens
ccacattttactgtttgcca

SEQ ID NO: 7772969 - DNA, 22 bp, Homo sapiens
ccacattttgctttgcctaggt

SEQ ID NO: 7772970 - DNA, 22 bp, Homo sapiens
ccacatttttgatactctcact

SEQ ID NO: 7772971 - DNA, 22 bp, Homo sapiens
ccagccctgtcaccaactggag

SEQ ID NO: 7772972 - DNA, 22 bp, Homo sapiens
ccagccctgcctctcagggccc

SEQ ID NO: 7772973 - DNA, 22 bp, Homo sapiens
ccagcccttcccaactggccag

SEQ ID NO: 7772974 - DNA, 22 bp, Homo sapiens
ccagccctgtttatgtgtcact

SEQ ID NO: 7772975 - DNA, 22 bp, Homo sapiens
ccagccctgcctctcagggccc

SEQ ID NO: 7772976 - DNA, 22 bp, Homo sapiens
ccagccctcactgaggcctctc

SEQ ID NO: 7772977 - DNA, 22 bp, Homo sapiens
ccagccacagcttccagctcct

SEQ ID NO: 7772978 - DNA, 20 bp, Homo sapiens
ccagcatgtacacatgtgga

SEQ ID NO: 7772979 - DNA, 22 bp, Homo sapiens
ccagcccttcccaactggccag

SEQ ID NO: 7772980 - DNA, 22 bp, Homo sapiens
tctgagagtctctgaggcagat

SEQ ID NO: 7772981 - DNA, 19 bp, Homo sapiens
tctgcagaaggcatacatg

SEQ ID NO: 7772982 - DNA, 22 bp, Homo sapiens
tctgcagaaggaatcagctgag

SEQ ID NO: 7772983 - DNA, 22 bp, Homo sapiens
tctgaatgtatcgaattgaggc

SEQ ID NO: 7772984 - DNA, 19 bp, Homo sapiens
tctgaagtccagggcatac

SEQ ID NO: 7772985 - DNA, 22 bp, Homo sapiens
ccagcatccatgctccctcggg

SEQ ID NO: 7772986 - DNA, 19 bp, Homo sapiens
ccagcaggttcatttcagg

SEQ ID NO: 7772987 - DNA, 22 bp, Homo sapiens
ccagcaggtgtagggctcatgg

SEQ ID NO: 7772988 - DNA, 22 bp, Homo sapiens
ccagcagggttggtttcttctg

SEQ ID NO: 7772989 - DNA, 22 bp, Homo sapiens
ccagcaggggaatatttttagg

SEQ ID NO: 7772990 - DNA, 22 bp, Homo sapiens
ccagcagggcagtgccctggac

SEQ ID NO: 7772991 - DNA, 22 bp, Homo sapiens
ccagcagctttattggctctcc

SEQ ID NO: 7772992 - DNA, 22 bp, Homo sapiens
ccagcagctttattggctctcc

SEQ ID NO: 7772993 - DNA, 22 bp, Homo sapiens
ccagcagctccctcagggtccg

SEQ ID NO: 7772994 - DNA, 22 bp, Homo sapiens
ccagcagctgcaaagcctgggt

SEQ ID NO: 7772995 - DNA, 22 bp, Homo sapiens
ccagcagagggtcttggccatt

SEQ ID NO: 7772996 - DNA, 22 bp, Homo sapiens
ccagcactgctctcagactgag

SEQ ID NO: 7772997 - DNA, 17 bp, Homo sapiens
tctcctggctctatcag

SEQ ID NO: 7772998 - DNA, 23 bp, Homo sapiens
tctcctggctgcactgtggccac

SEQ ID NO: 7772999 - DNA, 17 bp, Homo sapiens
tctcctggctctatcag

SEQ ID NO: 7773000 - DNA, 22 bp, Homo sapiens
tctcctggctctaaaaggctgt

SEQ ID NO: 7773001 - DNA, 22 bp, Homo sapiens
tctcctggctcaccaggctgga

SEQ ID NO: 7773002 - DNA, 22 bp, Homo sapiens
tctcctggcctttaggttaagg

SEQ ID NO: 7773003 - DNA, 22 bp, Homo sapiens
tctcctggccgggctgtcccct

SEQ ID NO: 7773004 - DNA, 22 bp, Homo sapiens
tctctgcatccccagggctctc

SEQ ID NO: 7773005 - DNA, 19 bp, Homo sapiens
tctctgcagcgcgcccggc

SEQ ID NO: 7773006 - DNA, 22 bp, Homo sapiens
tctctgagttgtaaaaaatagt

SEQ ID NO: 7773007 - DNA, 22 bp, Homo sapiens
tctctgcccatcctcagtccac

SEQ ID NO: 7773008 - DNA, 22 bp, Homo sapiens
cattcattcacattttgtctat

SEQ ID NO: 7773009 - DNA, 22 bp, Homo sapiens
cattcacattcttcttactgtt

SEQ ID NO: 7773010 - DNA, 22 bp, Homo sapiens
cattcagagctttcttatcata

SEQ ID NO: 7773011 - DNA, 21 bp, Homo sapiens
cattcacagtctggctcttga

SEQ ID NO: 7773012 - DNA, 22 bp, Homo sapiens
cattcacatcttgttccatcac

SEQ ID NO: 7773013 - DNA, 22 bp, Homo sapiens
cattcacagagggggaagcatc

SEQ ID NO: 7773014 - DNA, 22 bp, Homo sapiens
cattcacaatggattgcttcaa

SEQ ID NO: 7773015 - DNA, 22 bp, Homo sapiens
cattcacagcaggtcagctgaa

SEQ ID NO: 7773016 - DNA, 22 bp, Homo sapiens
cattcacagcaggtcagctgaa

SEQ ID NO: 7773017 - DNA, 22 bp, Homo sapiens
cattcacaatagttgaaaggtg

SEQ ID NO: 7773018 - DNA, 22 bp, Homo sapiens
cattcacaactgagcattgttg

SEQ ID NO: 7773019 - DNA, 22 bp, Homo sapiens
cattcacaaagctgattgatgg

SEQ ID NO: 7773020 - DNA, 22 bp, Homo sapiens
cattcacaaaaccacatgccat

SEQ ID NO: 7773021 - DNA, 22 bp, Homo sapiens
cattcaaattaagattttgtta

SEQ ID NO: 7773022 - DNA, 22 bp, Homo sapiens
cattatattacagcactgttaa

SEQ ID NO: 7773023 - DNA, 22 bp, Homo sapiens
catgttttctaggctttcacaa

SEQ ID NO: 7773024 - DNA, 22 bp, Homo sapiens
catgttggtgtgctgcacccat

SEQ ID NO: 7773025 - DNA, 22 bp, Homo sapiens
catgttggtgtgctgcacccgt

SEQ ID NO: 7773026 - DNA, 22 bp, Homo sapiens
catgttggcactgtctctgcct

SEQ ID NO: 7773027 - DNA, 22 bp, Homo sapiens
cattcattcagcaactgttatt

SEQ ID NO: 7773028 - DNA, 22 bp, Homo sapiens
tcccagagcccaagttggagag

SEQ ID NO: 7773029 - DNA, 22 bp, Homo sapiens
tcccagccacaggtgtagccct

SEQ ID NO: 7773030 - DNA, 22 bp, Homo sapiens
tcccagccacagtttccacctg

SEQ ID NO: 7773031 - DNA, 22 bp, Homo sapiens
tcccagccaggctctaccactt

SEQ ID NO: 7773032 - DNA, 22 bp, Homo sapiens
tcccagccaggctctaccactt

SEQ ID NO: 7773033 - DNA, 22 bp, Homo sapiens
tcccagccattcctttaggtgt

SEQ ID NO: 7773034 - DNA, 22 bp, Homo sapiens
tcccagcccagacttctccagt

SEQ ID NO: 7773035 - DNA, 22 bp, Homo sapiens
tcccagcccagatttgtgtgac

SEQ ID NO: 7773036 - DNA, 22 bp, Homo sapiens
tcccaggaattgaagccagtgt

SEQ ID NO: 7773037 - DNA, 22 bp, Homo sapiens
tcccagcccaggtatgatgata

SEQ ID NO: 7773038 - DNA, 22 bp, Homo sapiens
tcccaggacaggccacatggaa

SEQ ID NO: 7773039 - DNA, 22 bp, Homo sapiens
tcctcaggatctaggagtgctt

SEQ ID NO: 7773040 - DNA, 22 bp, Homo sapiens
tcctcaggagagctcctatgcc

SEQ ID NO: 7773041 - DNA, 22 bp, Homo sapiens
tcctcaggatgtggagtagaat

SEQ ID NO: 7773042 - DNA, 22 bp, Homo sapiens
tcctcaggatgtggggtagaat

SEQ ID NO: 7773043 - DNA, 22 bp, Homo sapiens
tcctcaggcggtgaggaggggc

SEQ ID NO: 7773044 - DNA, 22 bp, Homo sapiens
tccctcactggttctgcatccc

SEQ ID NO: 7773045 - DNA, 22 bp, Homo sapiens
tccctcactggttctgcatccc

SEQ ID NO: 7773046 - DNA, 22 bp, Homo sapiens
tccctcagaaattctctctgaa

SEQ ID NO: 7773047 - DNA, 22 bp, Homo sapiens
tccctagtcgcatctgtggaga

SEQ ID NO: 7773048 - DNA, 22 bp, Homo sapiens
tccctagtcgcatctgtggaga

SEQ ID NO: 7773049 - DNA, 22 bp, Homo sapiens
tccctaggtcctagtcacagta

SEQ ID NO: 7773050 - DNA, 20 bp, Homo sapiens
tccctaggcaggagggcact

SEQ ID NO: 7773051 - DNA, 22 bp, Homo sapiens
catttgtaatactgacttgcag

SEQ ID NO: 7773052 - DNA, 22 bp, Homo sapiens
catttgtactgttcaatgtcat

SEQ ID NO: 7773053 - DNA, 22 bp, Homo sapiens
catttggaccaaaatagccaac

SEQ ID NO: 7773054 - DNA, 22 bp, Homo sapiens
catttggattttgaagagagta

SEQ ID NO: 7773055 - DNA, 22 bp, Homo sapiens
tcctcaggctgcctggaagact

SEQ ID NO: 7773056 - DNA, 22 bp, Homo sapiens
catttggaaagagactagagaa

SEQ ID NO: 7773057 - DNA, 22 bp, Homo sapiens
tcctcagggaagatgagcctca

SEQ ID NO: 7773058 - DNA, 22 bp, Homo sapiens
catttgtatagtgcttagacca

SEQ ID NO: 7773059 - DNA, 22 bp, Homo sapiens
catttgtagttaaaaatgtctc

SEQ ID NO: 7773060 - DNA, 22 bp, Homo sapiens
catttgtatctgggctgctgtg

SEQ ID NO: 7773061 - DNA, 17 bp, Homo sapiens
tcctccccgcagttgca

SEQ ID NO: 7773062 - DNA, 22 bp, Homo sapiens
tcctcccctcagggcaacggat

SEQ ID NO: 7773063 - DNA, 22 bp, Homo sapiens
tcctctccatattttctgattt

SEQ ID NO: 7773064 - DNA, 18 bp, Homo sapiens
cattgacagtatatcttt

SEQ ID NO: 7773065 - DNA, 22 bp, Homo sapiens
tcccaggaggtgcttcctagga

SEQ ID NO: 7773066 - DNA, 22 bp, Homo sapiens
tcccagggtcctcttctggaat

SEQ ID NO: 7773067 - DNA, 22 bp, Homo sapiens
cattgcaacttcaaactcctgg

SEQ ID NO: 7773068 - DNA, 22 bp, Homo sapiens
cattgcaacttcaaactcctgg

SEQ ID NO: 7773069 - DNA, 22 bp, Homo sapiens
cattgcaacttcaaactcctgg

SEQ ID NO: 7773070 - DNA, 22 bp, Homo sapiens
cattgagaatctgggctacagc

SEQ ID NO: 7773071 - DNA, 22 bp, Homo sapiens
cattgagagaatcacatagaag

SEQ ID NO: 7773072 - DNA, 22 bp, Homo sapiens
cattgagagtgacttggacaat

SEQ ID NO: 7773073 - DNA, 22 bp, Homo sapiens
cattgagaggctgcctgcctga

SEQ ID NO: 7773074 - DNA, 21 bp, Homo sapiens
cattgagataggagagattgt

SEQ ID NO: 7773075 - DNA, 22 bp, Homo sapiens
tcccgttgatgacggtgcatcc

SEQ ID NO: 7773076 - DNA, 22 bp, Homo sapiens
tcccgtcttgctgttgtctgcg

SEQ ID NO: 7773077 - DNA, 22 bp, Homo sapiens
catgaaaaatttactgttaaca

SEQ ID NO: 7773078 - DNA, 22 bp, Homo sapiens
catgaaaaatttactgttaaca

SEQ ID NO: 7773079 - DNA, 22 bp, Homo sapiens
tcatgcaatgagtcaggaggca

SEQ ID NO: 7773080 - DNA, 22 bp, Homo sapiens
tcatgcaatgttagtttgaaag

SEQ ID NO: 7773081 - DNA, 22 bp, Homo sapiens
tcatgcaatctcttgttcagga

SEQ ID NO: 7773082 - DNA, 22 bp, Homo sapiens
tcatgcactacataacgatgtt

SEQ ID NO: 7773083 - DNA, 22 bp, Homo sapiens
tcatcatccttttttgaagagt

SEQ ID NO: 7773084 - DNA, 22 bp, Homo sapiens
tcatcatcactctggcaagcat

SEQ ID NO: 7773085 - DNA, 22 bp, Homo sapiens
tcatgaaaatagatcagaaatt

SEQ ID NO: 7773086 - DNA, 20 bp, Homo sapiens
tcatgaagcctacaaacatc

SEQ ID NO: 7773087 - DNA, 22 bp, Homo sapiens
tcatgaagtccaaactaaagca

SEQ ID NO: 7773088 - DNA, 22 bp, Homo sapiens
tcatgcaagcaggcactgggaa

SEQ ID NO: 7773089 - DNA, 20 bp, Homo sapiens
tcatgcaagattcataaagg

SEQ ID NO: 7773090 - DNA, 22 bp, Homo sapiens
tcatgcaagaataataggaagg

SEQ ID NO: 7773091 - DNA, 19 bp, Homo sapiens
tcatgcaatcagtgaactg

SEQ ID NO: 7773092 - DNA, 22 bp, Homo sapiens
tcatgcaaggctgaaacatggt

SEQ ID NO: 7773093 - DNA, 22 bp, Homo sapiens
tcatgcaaactctagtccttta

SEQ ID NO: 7773094 - DNA, 22 bp, Homo sapiens
tcatgcaaaagacttgaacttt

SEQ ID NO: 7773095 - DNA, 22 bp, Homo sapiens
tcatgcaaagccaattccagct

SEQ ID NO: 7773096 - DNA, 18 bp, Homo sapiens
tcatgcaaacgcttcata

SEQ ID NO: 7773097 - DNA, 22 bp, Homo sapiens
tcatgcaaatactgttccagaa

SEQ ID NO: 7773098 - DNA, 22 bp, Homo sapiens
tcatgcaacggctcgctgagcc

SEQ ID NO: 7773099 - DNA, 22 bp, Homo sapiens
tcatgcaacgatcctccaaatg

SEQ ID NO: 7773100 - DNA, 22 bp, Homo sapiens
tcatgcaacaacacattctggc

SEQ ID NO: 7773101 - DNA, 22 bp, Homo sapiens
tccacatagtcattaatttctg

SEQ ID NO: 7773102 - DNA, 22 bp, Homo sapiens
tccacagggcctttctggtgtg

SEQ ID NO: 7773103 - DNA, 22 bp, Homo sapiens
tcatttatttgactttggagtg

SEQ ID NO: 7773104 - DNA, 22 bp, Homo sapiens
tccacaggtatttctccttgct

SEQ ID NO: 7773105 - DNA, 22 bp, Homo sapiens
tccacaggtatgaggccccacc

SEQ ID NO: 7773106 - DNA, 22 bp, Homo sapiens
tcattctcagactcttggcctc

SEQ ID NO: 7773107 - DNA, 22 bp, Homo sapiens
tcattcttgatcactagttagt

SEQ ID NO: 7773108 - DNA, 22 bp, Homo sapiens
tcatttatcgctgccttttaaa

SEQ ID NO: 7773109 - DNA, 19 bp, Homo sapiens
tccaggctccattggcaga

SEQ ID NO: 7773110 - DNA, 22 bp, Homo sapiens
catgtgtgtggctgacaatttt

SEQ ID NO: 7773111 - DNA, 20 bp, Homo sapiens
tccagctgggaacagctgat

SEQ ID NO: 7773112 - DNA, 22 bp, Homo sapiens
tccagctggcccggccatgaat

SEQ ID NO: 7773113 - DNA, 22 bp, Homo sapiens
tccaggcccctgcctgggcctg

SEQ ID NO: 7773114 - DNA, 22 bp, Homo sapiens
tccaggcccgagatgggctgga

SEQ ID NO: 7773115 - DNA, 22 bp, Homo sapiens
tccagcctcctatttaccctaa

SEQ ID NO: 7773116 - DNA, 17 bp, Homo sapiens
tccagcctcctctgctg

SEQ ID NO: 7773117 - DNA, 17 bp, Homo sapiens
tccagcctcctctgctg

SEQ ID NO: 7773118 - DNA, 22 bp, Homo sapiens
tccagcctaatgttcttcccac

SEQ ID NO: 7773119 - DNA, 22 bp, Homo sapiens
tccagcctaggggaacagctgc

SEQ ID NO: 7773120 - DNA, 22 bp, Homo sapiens
tccagcctcatttctcctgctt

SEQ ID NO: 7773121 - DNA, 21 bp, Homo sapiens
tccagctgcacaagcatgggg

SEQ ID NO: 7773122 - DNA, 22 bp, Homo sapiens
tccagctgcaaggggcacagct

SEQ ID NO: 7773123 - DNA, 22 bp, Homo sapiens
tccagctgacagttcaaaatga

SEQ ID NO: 7773124 - DNA, 22 bp, Homo sapiens
tccagagacttgcatgtgcttg

SEQ ID NO: 7773125 - DNA, 22 bp, Homo sapiens
tccagagagaaaaacaagcttt

SEQ ID NO: 7773126 - DNA, 22 bp, Homo sapiens
tccagagaacgatgaaagctgg

SEQ ID NO: 7773127 - DNA, 22 bp, Homo sapiens
tccagagaaatctagtcttaca

SEQ ID NO: 7773128 - DNA, 22 bp, Homo sapiens
tccagagaattctacgcagtgc

SEQ ID NO: 7773129 - DNA, 22 bp, Homo sapiens
tccagagaattctacgcagtgc

SEQ ID NO: 7773130 - DNA, 22 bp, Homo sapiens
tccagagaggcatatttacaag

SEQ ID NO: 7773131 - DNA, 22 bp, Homo sapiens
tccagagagccacggacagggg

SEQ ID NO: 7773132 - DNA, 22 bp, Homo sapiens
tccagagagatagtggctaata

SEQ ID NO: 7773133 - DNA, 22 bp, Homo sapiens
tatcaggagttgacagttgcta

SEQ ID NO: 7773134 - DNA, 22 bp, Homo sapiens
tatcagtccagggttttgtgac

SEQ ID NO: 7773135 - DNA, 22 bp, Homo sapiens
tatcatcactgtaatccgttga

SEQ ID NO: 7773136 - DNA, 22 bp, Homo sapiens
tatcatttaacagaatcattgc

SEQ ID NO: 7773137 - DNA, 22 bp, Homo sapiens
tatcattctaattctcctcgta

SEQ ID NO: 7773138 - DNA, 22 bp, Homo sapiens
cagggtggccctgtggtctcat

SEQ ID NO: 7773139 - DNA, 22 bp, Homo sapiens
cagggtggccaggtagataata

SEQ ID NO: 7773140 - DNA, 22 bp, Homo sapiens
cagggtggcaggcaccatggcc

SEQ ID NO: 7773141 - DNA, 22 bp, Homo sapiens
cagggtggcactcagcgcatct

SEQ ID NO: 7773142 - DNA, 22 bp, Homo sapiens
caggggagttttatgcaacaga

SEQ ID NO: 7773143 - DNA, 22 bp, Homo sapiens
tagtcttttgagaagtatatct

SEQ ID NO: 7773144 - DNA, 22 bp, Homo sapiens
tagtctttcatttggagcattt

SEQ ID NO: 7773145 - DNA, 22 bp, Homo sapiens
tagtcttttgagaagtatatct

SEQ ID NO: 7773146 - DNA, 19 bp, Homo sapiens
tagtctttattcttaattt

SEQ ID NO: 7773147 - DNA, 22 bp, Homo sapiens
tagtctttcatttggagcattt

SEQ ID NO: 7773148 - DNA, 19 bp, Homo sapiens
tagtctttattcttaattt

SEQ ID NO: 7773149 - DNA, 22 bp, Homo sapiens
tagtctttttaataaataatgc

SEQ ID NO: 7773150 - DNA, 22 bp, Homo sapiens
tagtctttttaataaataatgc

SEQ ID NO: 7773151 - DNA, 22 bp, Homo sapiens
tagtgaaatgataacagagcag

SEQ ID NO: 7773152 - DNA, 22 bp, Homo sapiens
tagtgaaagtcaaagacagcta

SEQ ID NO: 7773153 - DNA, 22 bp, Homo sapiens
tatcaggacttcattcctttta

SEQ ID NO: 7773154 - DNA, 22 bp, Homo sapiens
tatcaggaggaaatttccattg

SEQ ID NO: 7773155 - DNA, 22 bp, Homo sapiens
tatattgtaggtgctatttgaa

SEQ ID NO: 7773156 - DNA, 22 bp, Homo sapiens
caggggaagatgccaagggaga

SEQ ID NO: 7773157 - DNA, 22 bp, Homo sapiens
cagggctttgtaatatgagcac

SEQ ID NO: 7773158 - DNA, 22 bp, Homo sapiens
taggtaggtgcaattaaaagta

SEQ ID NO: 7773159 - DNA, 22 bp, Homo sapiens
taggtagctttggcgtttcttg

SEQ ID NO: 7773160 - DNA, 22 bp, Homo sapiens
tagggtggttagaaggagtatg

SEQ ID NO: 7773161 - DNA, 22 bp, Homo sapiens
tagggtcctgcctacagagaca

SEQ ID NO: 7773162 - DNA, 22 bp, Homo sapiens
tagggtggagactggaagcagg

SEQ ID NO: 7773163 - DNA, 21 bp, Homo sapiens
tagggcaggcattggaagaga

SEQ ID NO: 7773164 - DNA, 22 bp, Homo sapiens
tagggcaggggaggaatctgaa

SEQ ID NO: 7773165 - DNA, 22 bp, Homo sapiens
tagggcaggtgaagaaaagcta

SEQ ID NO: 7773166 - DNA, 21 bp, Homo sapiens
cagggctagagagaatgacaa

SEQ ID NO: 7773167 - DNA, 22 bp, Homo sapiens
cagggccttgttcaggagtgaa

SEQ ID NO: 7773168 - DNA, 22 bp, Homo sapiens
cagggctcactcggctggcgtc

SEQ ID NO: 7773169 - DNA, 22 bp, Homo sapiens
cagggctcaccactgggatcct

SEQ ID NO: 7773170 - DNA, 22 bp, Homo sapiens
cagggctcaggctctgggattc

SEQ ID NO: 7773171 - DNA, 22 bp, Homo sapiens
taggagagctgaactattgtct

SEQ ID NO: 7773172 - DNA, 19 bp, Homo sapiens
taggaccctggtggccccc

SEQ ID NO: 7773173 - DNA, 19 bp, Homo sapiens
taggaccctggtggccccc

SEQ ID NO: 7773174 - DNA, 22 bp, Homo sapiens
taggaacagtcctagaaatctg

SEQ ID NO: 7773175 - DNA, 22 bp, Homo sapiens
taggaacagtttcaggatgttt

SEQ ID NO: 7773176 - DNA, 22 bp, Homo sapiens
taggaacacagggacttgatga

SEQ ID NO: 7773177 - DNA, 22 bp, Homo sapiens
taggaaattttactggtctggg

SEQ ID NO: 7773178 - DNA, 22 bp, Homo sapiens
taggaaattggaaactcttcac

SEQ ID NO: 7773179 - DNA, 22 bp, Homo sapiens
taggaaatttcatttgaggtct

SEQ ID NO: 7773180 - DNA, 22 bp, Homo sapiens
taggaaatttatagaggtgttt

SEQ ID NO: 7773181 - DNA, 22 bp, Homo sapiens
taggaaatttgaaatatgtggg

SEQ ID NO: 7773182 - DNA, 22 bp, Homo sapiens
taggaaattaagtctcttttgt

SEQ ID NO: 7773183 - DNA, 22 bp, Homo sapiens
taggaaattgccaatatatgac

SEQ ID NO: 7773184 - DNA, 22 bp, Homo sapiens
taggaaattagaacttggaaac

SEQ ID NO: 7773185 - DNA, 22 bp, Homo sapiens
taggaaattctcttgctaagtt

SEQ ID NO: 7773186 - DNA, 22 bp, Homo sapiens
taggaaattgacacctgcttga

SEQ ID NO: 7773187 - DNA, 22 bp, Homo sapiens
cagggcagagccaggatttcaa

SEQ ID NO: 7773188 - DNA, 22 bp, Homo sapiens
cagggcagagggaaactccttt

SEQ ID NO: 7773189 - DNA, 22 bp, Homo sapiens
cagggcagagggaaactccttt

SEQ ID NO: 7773190 - DNA, 22 bp, Homo sapiens
cagggcagccaggccccgtggg

SEQ ID NO: 7773191 - DNA, 22 bp, Homo sapiens
cagggcagccaggccccgtggg

SEQ ID NO: 7773192 - DNA, 22 bp, Homo sapiens
tagaggaaccaggcaggctgag

SEQ ID NO: 7773193 - DNA, 22 bp, Homo sapiens
tagataaattagaaagtttact

SEQ ID NO: 7773194 - DNA, 22 bp, Homo sapiens
tagataaaagggcaaagggcat

SEQ ID NO: 7773195 - DNA, 22 bp, Homo sapiens
tagagctggaaaactgcaggta

SEQ ID NO: 7773196 - DNA, 17 bp, Homo sapiens
tagagctggttcaggag

SEQ ID NO: 7773197 - DNA, 22 bp, Homo sapiens
tagaggaaatttccaaggtgag

SEQ ID NO: 7773198 - DNA, 22 bp, Homo sapiens
caggctgggctccggagataaa

SEQ ID NO: 7773199 - DNA, 22 bp, Homo sapiens
caggctgggctccggagataaa

SEQ ID NO: 7773200 - DNA, 22 bp, Homo sapiens
caggctgggctccggagataaa

SEQ ID NO: 7773201 - DNA, 22 bp, Homo sapiens
caggctgggctggtgttagagt

SEQ ID NO: 7773202 - DNA, 22 bp, Homo sapiens
caggctgggctggtgttagagt

SEQ ID NO: 7773203 - DNA, 22 bp, Homo sapiens
caggctggtcccagagcattgc

SEQ ID NO: 7773204 - DNA, 22 bp, Homo sapiens
caggctggtcccagagcattgc

SEQ ID NO: 7773205 - DNA, 21 bp, Homo sapiens
tagaatcactaataagatgta

SEQ ID NO: 7773206 - DNA, 22 bp, Homo sapiens
caggctgggcagcctccccggc

SEQ ID NO: 7773207 - DNA, 22 bp, Homo sapiens
caggctgggcagcctccccggc

SEQ ID NO: 7773208 - DNA, 22 bp, Homo sapiens
caggctgggcagcctccccggc

SEQ ID NO: 7773209 - DNA, 22 bp, Homo sapiens
tagaatatgtggtgtatacttt

SEQ ID NO: 7773210 - DNA, 22 bp, Homo sapiens
tagataaattagaaagtttact

SEQ ID NO: 7773211 - DNA, 22 bp, Homo sapiens
tagataaattagaaagtttact

SEQ ID NO: 7773212 - DNA, 22 bp, Homo sapiens
cagggcaaagagagcacatgct

SEQ ID NO: 7773213 - DNA, 21 bp, Homo sapiens
cagggcaaccaagtccagaga

SEQ ID NO: 7773214 - DNA, 22 bp, Homo sapiens
cagggcacagatcggggcgcac

SEQ ID NO: 7773215 - DNA, 20 bp, Homo sapiens
cagggcacactgcagcctcg

SEQ ID NO: 7773216 - DNA, 22 bp, Homo sapiens
cagggcagaaggcactctactc

SEQ ID NO: 7773217 - DNA, 22 bp, Homo sapiens
cagggcagaaggcactctactc

SEQ ID NO: 7773218 - DNA, 22 bp, Homo sapiens
caggctggagtgcaatgacgcc

SEQ ID NO: 7773219 - DNA, 22 bp, Homo sapiens
caggctggagtgcaatgacgcc

SEQ ID NO: 7773220 - DNA, 22 bp, Homo sapiens
caggctggagtgcaatggcaca

SEQ ID NO: 7773221 - DNA, 22 bp, Homo sapiens
caggctggagtgcaatggcaca

SEQ ID NO: 7773222 - DNA, 22 bp, Homo sapiens
caggctggagtgcagtggcgcc

SEQ ID NO: 7773223 - DNA, 22 bp, Homo sapiens
caggctggagtgcagtggcgcc

SEQ ID NO: 7773224 - DNA, 22 bp, Homo sapiens
caggctggagtgcaatggtgct

SEQ ID NO: 7773225 - DNA, 22 bp, Homo sapiens
caggctggagtgcaatggtgct

SEQ ID NO: 7773226 - DNA, 22 bp, Homo sapiens
caggctggagtgagtgtagtgg

SEQ ID NO: 7773227 - DNA, 22 bp, Homo sapiens
caggctggagtgagtgtagtgg

SEQ ID NO: 7773228 - DNA, 22 bp, Homo sapiens
caggctgccgtggggtccaggc

SEQ ID NO: 7773229 - DNA, 22 bp, Homo sapiens
caggctggagtgcagtggcgct

SEQ ID NO: 7773230 - DNA, 22 bp, Homo sapiens
caggctggagtgcagtggcgct

SEQ ID NO: 7773231 - DNA, 22 bp, Homo sapiens
caggctggagtgcagtggggcg

SEQ ID NO: 7773232 - DNA, 22 bp, Homo sapiens
caggctggagtgcagtggggcg

SEQ ID NO: 7773233 - DNA, 22 bp, Homo sapiens
tactcaaactcactaagacaga

SEQ ID NO: 7773234 - DNA, 22 bp, Homo sapiens
tactcaaactcactaagacaga

SEQ ID NO: 7773235 - DNA, 22 bp, Homo sapiens
tactcaaaaagttatgaatcat

SEQ ID NO: 7773236 - DNA, 22 bp, Homo sapiens
tactatttttgcaacgtataca

SEQ ID NO: 7773237 - DNA, 22 bp, Homo sapiens
tactcaatttcttatgggtttc

SEQ ID NO: 7773238 - DNA, 22 bp, Homo sapiens
tactcaatgaagtagcctggtt

SEQ ID NO: 7773239 - DNA, 22 bp, Homo sapiens
tactcaatctaggtggcttacc

SEQ ID NO: 7773240 - DNA, 20 bp, Homo sapiens
tactcacaaatggtttagca

SEQ ID NO: 7773241 - DNA, 22 bp, Homo sapiens
tactcacattctgtttcttgct

SEQ ID NO: 7773242 - DNA, 22 bp, Homo sapiens
tactcatttcaaacagcacaaa

SEQ ID NO: 7773243 - DNA, 22 bp, Homo sapiens
tactgtctaataagattgatgg

SEQ ID NO: 7773244 - DNA, 22 bp, Homo sapiens
tactgtctatacacttgattac

SEQ ID NO: 7773245 - DNA, 22 bp, Homo sapiens
tactgtctggcaattaagaatc

SEQ ID NO: 7773246 - DNA, 22 bp, Homo sapiens
tactgtattgttggctcttttg

SEQ ID NO: 7773247 - DNA, 20 bp, Homo sapiens
cagccctgtgacctggccct

SEQ ID NO: 7773248 - DNA, 22 bp, Homo sapiens
gtgaggggtggctgagcagttt

SEQ ID NO: 7773249 - DNA, 22 bp, Homo sapiens
gtgaggggtggctgagcagttt

SEQ ID NO: 7773250 - DNA, 22 bp, Homo sapiens
gtgaggggccaagagtagggca

SEQ ID NO: 7773251 - DNA, 22 bp, Homo sapiens
tactatttggaattttaaattg

SEQ ID NO: 7773252 - DNA, 22 bp, Homo sapiens
caggtttcattggcagcttcat

SEQ ID NO: 7773253 - DNA, 22 bp, Homo sapiens
caggttctggagatgcagagat

SEQ ID NO: 7773254 - DNA, 22 bp, Homo sapiens
tatttcattctttatcaggagc

SEQ ID NO: 7773255 - DNA, 22 bp, Homo sapiens
cagtaaaaatgttgtcaaggca

SEQ ID NO: 7773256 - DNA, 22 bp, Homo sapiens
caggtgtttcaaatgtgaaact

SEQ ID NO: 7773257 - DNA, 22 bp, Homo sapiens
caggtgttggaagggcagtggg

SEQ ID NO: 7773258 - DNA, 22 bp, Homo sapiens
cagggtggccctgtggtctcat

SEQ ID NO: 7773259 - DNA, 22 bp, Homo sapiens
cagggtgggcacccagcctcca

SEQ ID NO: 7773260 - DNA, 22 bp, Homo sapiens
cagggtgggcacccagcctcca

SEQ ID NO: 7773261 - DNA, 22 bp, Homo sapiens
cagtagggaatgtgggaggctg

SEQ ID NO: 7773262 - DNA, 22 bp, Homo sapiens
cagtaggaaggatgcagaaaaa

SEQ ID NO: 7773263 - DNA, 22 bp, Homo sapiens
cagtataagagtgaggaagggc

SEQ ID NO: 7773264 - DNA, 21 bp, Homo sapiens
tatttctttgactctctccct

SEQ ID NO: 7773265 - DNA, 22 bp, Homo sapiens
tatttctttcaggtatgtgttg

SEQ ID NO: 7773266 - DNA, 22 bp, Homo sapiens
tatttctttcaggtatgtgttg

SEQ ID NO: 7773267 - DNA, 22 bp, Homo sapiens
tatttctttcaggtatgtgttg

SEQ ID NO: 7773268 - DNA, 22 bp, Homo sapiens
cagtcccagacccagaaggtgg

SEQ ID NO: 7773269 - DNA, 22 bp, Homo sapiens
cagtcccagacatagtaaggga

SEQ ID NO: 7773270 - DNA, 22 bp, Homo sapiens
cagtcccagaagagcctgggag

SEQ ID NO: 7773271 - DNA, 22 bp, Homo sapiens
cagtcccagaagagcctgggag

SEQ ID NO: 7773272 - DNA, 20 bp, Homo sapiens
cagtcccaatccagggccag

SEQ ID NO: 7773273 - DNA, 20 bp, Homo sapiens
cagtcccaatccagggccag

SEQ ID NO: 7773274 - DNA, 20 bp, Homo sapiens
cagtcccaatccagggccag

SEQ ID NO: 7773275 - DNA, 22 bp, Homo sapiens
cagtcccactagtgccaatacc

SEQ ID NO: 7773276 - DNA, 22 bp, Homo sapiens
cagtcccacaagatctccacaa

SEQ ID NO: 7773277 - DNA, 22 bp, Homo sapiens
cagtcccaccaggatcgctctt

SEQ ID NO: 7773278 - DNA, 22 bp, Homo sapiens
cagtcccaaggaggaagcagtc

SEQ ID NO: 7773279 - DNA, 19 bp, Homo sapiens
cagtcccaaattcttgtca

SEQ ID NO: 7773280 - DNA, 22 bp, Homo sapiens
cagtccagagcccaccagagga

SEQ ID NO: 7773281 - DNA, 22 bp, Homo sapiens
tcacagagaaaagctatcacaa

SEQ ID NO: 7773282 - DNA, 22 bp, Homo sapiens
tcacagagaaaagctatcacaa

SEQ ID NO: 7773283 - DNA, 22 bp, Homo sapiens
tcacagagaaatgtggcacaaa

SEQ ID NO: 7773284 - DNA, 22 bp, Homo sapiens
tcacagagaaatgtggcacaaa

SEQ ID NO: 7773285 - DNA, 22 bp, Homo sapiens
tcacagagaaatgtggcacaaa

SEQ ID NO: 7773286 - DNA, 22 bp, Homo sapiens
tcacaggacagccttccacccg

SEQ ID NO: 7773287 - DNA, 22 bp, Homo sapiens
tcacaggaagggtaaatattta

SEQ ID NO: 7773288 - DNA, 22 bp, Homo sapiens
tcacaggaaccatcagagaaat

SEQ ID NO: 7773289 - DNA, 22 bp, Homo sapiens
tcacaggaagaggtgtctatct

SEQ ID NO: 7773290 - DNA, 22 bp, Homo sapiens
tcacaggagcccaggggagctg

SEQ ID NO: 7773291 - DNA, 22 bp, Homo sapiens
tcacaggaccctgagggtggcg

SEQ ID NO: 7773292 - DNA, 22 bp, Homo sapiens
tcacagttcatctgataaacta

SEQ ID NO: 7773293 - DNA, 22 bp, Homo sapiens
tcacagttatagtctgtagaat

SEQ ID NO: 7773294 - DNA, 17 bp, Homo sapiens
tcacagttggtctcagt

SEQ ID NO: 7773295 - DNA, 22 bp, Homo sapiens
tcacaggaggactgaaagatat

SEQ ID NO: 7773296 - DNA, 20 bp, Homo sapiens
tcacaggagggaaggcaggt

SEQ ID NO: 7773297 - DNA, 22 bp, Homo sapiens
tcacaggagtcaaggaatagta

SEQ ID NO: 7773298 - DNA, 22 bp, Homo sapiens
cagtgagataccacagagcaaa

SEQ ID NO: 7773299 - DNA, 22 bp, Homo sapiens
cagtgagctcctgtctgtccct

SEQ ID NO: 7773300 - DNA, 22 bp, Homo sapiens
tcacacttatcccactcagtca

SEQ ID NO: 7773301 - DNA, 22 bp, Homo sapiens
cagtgacgtaaactgcatgtgc

SEQ ID NO: 7773302 - DNA, 22 bp, Homo sapiens
tcacaagactgagcttgcttga

SEQ ID NO: 7773303 - DNA, 22 bp, Homo sapiens
tatttcttttcgtgacttattg

SEQ ID NO: 7773304 - DNA, 22 bp, Homo sapiens
tcacaagacaagacaaattgca

SEQ ID NO: 7773305 - DNA, 22 bp, Homo sapiens
tcacaagaatttgtagatgaaa

SEQ ID NO: 7773306 - DNA, 22 bp, Homo sapiens
cagtgggatatgggggcagcat

SEQ ID NO: 7773307 - DNA, 22 bp, Homo sapiens
cagtgggaagggcagaggcttt

SEQ ID NO: 7773308 - DNA, 22 bp, Homo sapiens
cagtgccatgtctgagccccta

SEQ ID NO: 7773309 - DNA, 22 bp, Homo sapiens
cagtggcagttagaaaatattc

SEQ ID NO: 7773310 - DNA, 22 bp, Homo sapiens
cagtgtttgttgagaaaggcaa

SEQ ID NO: 7773311 - DNA, 22 bp, Homo sapiens
cagtgttttgagaagggcacgt

SEQ ID NO: 7773312 - DNA, 22 bp, Homo sapiens
cagtgtttgtatagaatatgca

SEQ ID NO: 7773313 - DNA, 22 bp, Homo sapiens
cagtgtttagcacagtgcttgg

SEQ ID NO: 7773314 - DNA, 22 bp, Homo sapiens
tcagagaaatgctgagctcatg

SEQ ID NO: 7773315 - DNA, 22 bp, Homo sapiens
tcagagaacacagaggtgatgt

SEQ ID NO: 7773316 - DNA, 22 bp, Homo sapiens
tcagagaaaggccaaaatatca

SEQ ID NO: 7773317 - DNA, 22 bp, Homo sapiens
tcagagaaaggccaaaatatca

SEQ ID NO: 7773318 - DNA, 22 bp, Homo sapiens
tcagagaaatgctgagctcatg

SEQ ID NO: 7773319 - DNA, 22 bp, Homo sapiens
tcagagaaatgacaatatatag

SEQ ID NO: 7773320 - DNA, 22 bp, Homo sapiens
tcagagaaatgacaatatatag

SEQ ID NO: 7773321 - DNA, 21 bp, Homo sapiens
tcagaagtgcagcccaggaat

SEQ ID NO: 7773322 - DNA, 20 bp, Homo sapiens
tcagaagtgcagctgcccct

SEQ ID NO: 7773323 - DNA, 23 bp, Homo sapiens
tcagaagtgggatacaaagctga

SEQ ID NO: 7773324 - DNA, 22 bp, Homo sapiens
tcagagaaaatggaaactttta

SEQ ID NO: 7773325 - DNA, 21 bp, Homo sapiens
tcaggaaacacctcttaagga

SEQ ID NO: 7773326 - DNA, 19 bp, Homo sapiens
cataaatgtacaagataca

SEQ ID NO: 7773327 - DNA, 19 bp, Homo sapiens
cataaatgtacaagataca

SEQ ID NO: 7773328 - DNA, 22 bp, Homo sapiens
cagtttatatataagcacattg

SEQ ID NO: 7773329 - DNA, 22 bp, Homo sapiens
cagtttaagtgtgttgaaggta

SEQ ID NO: 7773330 - DNA, 21 bp, Homo sapiens
cagtttaataacaaagaagga

SEQ ID NO: 7773331 - DNA, 22 bp, Homo sapiens
cagtttaaggcaggacatggga

SEQ ID NO: 7773332 - DNA, 22 bp, Homo sapiens
cagtttaagtagaactgagaat

SEQ ID NO: 7773333 - DNA, 22 bp, Homo sapiens
cagttaaacgggccatgtgagt

SEQ ID NO: 7773334 - DNA, 18 bp, Homo sapiens
cagttacaccttcattca

SEQ ID NO: 7773335 - DNA, 22 bp, Homo sapiens
cagtttaaatgagtgactgcag

SEQ ID NO: 7773336 - DNA, 22 bp, Homo sapiens
cagtttaaagaaggatgggagt

SEQ ID NO: 7773337 - DNA, 22 bp, Homo sapiens
cagttgttcccagcaatgaaag

SEQ ID NO: 7773338 - DNA, 22 bp, Homo sapiens
cagttgttcccagcaatgaaag

SEQ ID NO: 7773339 - DNA, 20 bp, Homo sapiens
cagtttaactttgagcagtt

SEQ ID NO: 7773340 - DNA, 22 bp, Homo sapiens
cagtttaagacaagggggtgta

SEQ ID NO: 7773341 - DNA, 22 bp, Homo sapiens
cagtttaacctatccattatgt

SEQ ID NO: 7773342 - DNA, 19 bp, Homo sapiens
cagtttaactaattttatc

SEQ ID NO: 7773343 - DNA, 22 bp, Homo sapiens
ttgtaaactgttaaaagccaga

SEQ ID NO: 7773344 - DNA, 22 bp, Homo sapiens
ttgtaaatagtagtaagatgcc

SEQ ID NO: 7773345 - DNA, 22 bp, Homo sapiens
ttgtaagaatatgaatacaaat

SEQ ID NO: 7773346 - DNA, 22 bp, Homo sapiens
ttgtacacaattcttaacatac

SEQ ID NO: 7773347 - DNA, 21 bp, Homo sapiens
ttgtacacccacagatcagcc

SEQ ID NO: 7773348 - DNA, 22 bp, Homo sapiens
ttgtaccagctcatttcagaac

SEQ ID NO: 7773349 - DNA, 23 bp, Homo sapiens
ttgtatttttagtagagacaggg

SEQ ID NO: 7773350 - DNA, 22 bp, Homo sapiens
ttgtattttttcctggcggtgg

SEQ ID NO: 7773351 - DNA, 22 bp, Homo sapiens
ttgtattttttcctggcggtgg

SEQ ID NO: 7773352 - DNA, 22 bp, Homo sapiens
ttgtatttctccactttctgtt

SEQ ID NO: 7773353 - DNA, 22 bp, Homo sapiens
ttgtcacacccttttttatacc

SEQ ID NO: 7773354 - DNA, 22 bp, Homo sapiens
ttggagatatcacaccttcaca

SEQ ID NO: 7773355 - DNA, 22 bp, Homo sapiens
ttggagaatgttttcctgcagt

SEQ ID NO: 7773356 - DNA, 22 bp, Homo sapiens
ttggcaggaggcttcagttcct

SEQ ID NO: 7773357 - DNA, 22 bp, Homo sapiens
ttggcagggccaggctctctct

SEQ ID NO: 7773358 - DNA, 22 bp, Homo sapiens
ttggcagggctgcttgtctagg

SEQ ID NO: 7773359 - DNA, 21 bp, Homo sapiens
ttggcagtcagaaatgtgagg

SEQ ID NO: 7773360 - DNA, 22 bp, Homo sapiens
ttgggagatggggagataatat

SEQ ID NO: 7773361 - DNA, 22 bp, Homo sapiens
ttgggagatattgttctttaca

SEQ ID NO: 7773362 - DNA, 17 bp, Homo sapiens
ttgggagagaaaggtat

SEQ ID NO: 7773363 - DNA, 22 bp, Homo sapiens
ttgggcccatggggctaagcta

SEQ ID NO: 7773364 - DNA, 22 bp, Homo sapiens
ttggcccactctcagaatgtgg

SEQ ID NO: 7773365 - DNA, 22 bp, Homo sapiens
ttggcccacagtaccatgctgt

SEQ ID NO: 7773366 - DNA, 22 bp, Homo sapiens
ttggcatcagtgtaggacctgt

SEQ ID NO: 7773367 - DNA, 22 bp, Homo sapiens
ttggcataccttagtggtggag

SEQ ID NO: 7773368 - DNA, 22 bp, Homo sapiens
ttggccatctaagcccagccac

SEQ ID NO: 7773369 - DNA, 22 bp, Homo sapiens
ttggaacacaatgtttctttca

SEQ ID NO: 7773370 - DNA, 22 bp, Homo sapiens
ttggaaacgtcaccttttcctt

SEQ ID NO: 7773371 - DNA, 22 bp, Homo sapiens
ttgcttcagaagttctgcttgt

SEQ ID NO: 7773372 - DNA, 22 bp, Homo sapiens
ttgcttcagagggagacacttt

SEQ ID NO: 7773373 - DNA, 22 bp, Homo sapiens
ttgcttatttgattaaatgtct

SEQ ID NO: 7773374 - DNA, 22 bp, Homo sapiens
ttggaaactttcaagcataatg

SEQ ID NO: 7773375 - DNA, 22 bp, Homo sapiens
ttgctgaaagtggcaagaagta

SEQ ID NO: 7773376 - DNA, 22 bp, Homo sapiens
ttgctgaagttgctcagctcca

SEQ ID NO: 7773377 - DNA, 21 bp, Homo sapiens
ttgcttatggcactgctttgc

SEQ ID NO: 7773378 - DNA, 22 bp, Homo sapiens
ttgcattacatttgctcagtct

SEQ ID NO: 7773379 - DNA, 22 bp, Homo sapiens
ttgcatgtgtaatttttctaaa

SEQ ID NO: 7773380 - DNA, 22 bp, Homo sapiens
ttgcatgtgtaaggttgtttat

SEQ ID NO: 7773381 - DNA, 22 bp, Homo sapiens
ttgcatgtgactctatttatgc

SEQ ID NO: 7773382 - DNA, 22 bp, Homo sapiens
ttgcatgtgtgcatatatttgc

SEQ ID NO: 7773383 - DNA, 22 bp, Homo sapiens
ttgcatgttatttaatctgtat

SEQ ID NO: 7773384 - DNA, 22 bp, Homo sapiens
ttgcatgttgtttaatttcgag

SEQ ID NO: 7773385 - DNA, 22 bp, Homo sapiens
ttgctctgattaggtggaaaca

SEQ ID NO: 7773386 - DNA, 22 bp, Homo sapiens
ttgctcttgaaaattgatgctg

SEQ ID NO: 7773387 - DNA, 22 bp, Homo sapiens
ttgcagcttcttgcatcagaaa

SEQ ID NO: 7773388 - DNA, 22 bp, Homo sapiens
ttgcagcttctaccactgtttc

SEQ ID NO: 7773389 - DNA, 22 bp, Homo sapiens
ttgcagcttctaacagcttcag

SEQ ID NO: 7773390 - DNA, 22 bp, Homo sapiens
ttgcagcttcgagtctatctgt

SEQ ID NO: 7773391 - DNA, 22 bp, Homo sapiens
ttgcagctgaggaaattgaagc

SEQ ID NO: 7773392 - DNA, 22 bp, Homo sapiens
ttgcagctctgatccagggacc

SEQ ID NO: 7773393 - DNA, 22 bp, Homo sapiens
ttgcagctctctgaaggttgca

SEQ ID NO: 7773394 - DNA, 22 bp, Homo sapiens
ttgcagctccattttaatggct

SEQ ID NO: 7773395 - DNA, 22 bp, Homo sapiens
ttgcagctagaagattcactgt

SEQ ID NO: 7773396 - DNA, 22 bp, Homo sapiens
ttgcagattaaaacactgagct

SEQ ID NO: 7773397 - DNA, 22 bp, Homo sapiens
ttgcagctgttgcaaagtctct

SEQ ID NO: 7773398 - DNA, 22 bp, Homo sapiens
ttgcagcttcaagcaggttgac

SEQ ID NO: 7773399 - DNA, 22 bp, Homo sapiens
ttgcagcttagtgatgttatct

SEQ ID NO: 7773400 - DNA, 22 bp, Homo sapiens
ttgcagctgctgttcctcatgg

SEQ ID NO: 7773401 - DNA, 22 bp, Homo sapiens
ttgcagctgcagtaaatgttca

SEQ ID NO: 7773402 - DNA, 22 bp, Homo sapiens
ttgcagctggtggtggccgtgt

SEQ ID NO: 7773403 - DNA, 22 bp, Homo sapiens
ttgcagctgttactgatagata

SEQ ID NO: 7773404 - DNA, 22 bp, Homo sapiens
ttgcagctgtgagctttacacg

SEQ ID NO: 7773405 - DNA, 23 bp, Homo sapiens
ttgcatgtagcccatgagtaact

SEQ ID NO: 7773406 - DNA, 22 bp, Homo sapiens
ttgcatgtatgtgatctgttca

SEQ ID NO: 7773407 - DNA, 22 bp, Homo sapiens
ttgcatgtccagggtattgtgg

SEQ ID NO: 7773408 - DNA, 22 bp, Homo sapiens
ttgcatgtcctacatctgtgtc

SEQ ID NO: 7773409 - DNA, 22 bp, Homo sapiens
ttgcagaacttaaagacagagt

SEQ ID NO: 7773410 - DNA, 22 bp, Homo sapiens
ttgcagagatcagcaggtttga

SEQ ID NO: 7773411 - DNA, 22 bp, Homo sapiens
ttgcaattgctatggagagcgt

SEQ ID NO: 7773412 - DNA, 22 bp, Homo sapiens
ttgacacattagagcttgtaaa

SEQ ID NO: 7773413 - DNA, 22 bp, Homo sapiens
ttgacacagtcaacttgatttt

SEQ ID NO: 7773414 - DNA, 22 bp, Homo sapiens
ttgacacagttttctcattaag

SEQ ID NO: 7773415 - DNA, 22 bp, Homo sapiens
ttgacacagatcaatattcaac

SEQ ID NO: 7773416 - DNA, 22 bp, Homo sapiens
ttgacacaatgtatattttcaa

SEQ ID NO: 7773417 - DNA, 22 bp, Homo sapiens
ttgacaatgtcctttgaatttc

SEQ ID NO: 7773418 - DNA, 22 bp, Homo sapiens
ttgacaaagatatattcatgct

SEQ ID NO: 7773419 - DNA, 22 bp, Homo sapiens
ttgacaaaacaacacagatttc

SEQ ID NO: 7773420 - DNA, 22 bp, Homo sapiens
ttgacaaaaacctcatttcacc

SEQ ID NO: 7773421 - DNA, 22 bp, Homo sapiens
ttgacaaaaacctcatttcacc

SEQ ID NO: 7773422 - DNA, 23 bp, Homo sapiens
tttaatgaccaatagaaggaaca

SEQ ID NO: 7773423 - DNA, 22 bp, Homo sapiens
tttaatgaggtctctcgctggc

SEQ ID NO: 7773424 - DNA, 22 bp, Homo sapiens
tttaatgatagctgtttcacat

SEQ ID NO: 7773425 - DNA, 22 bp, Homo sapiens
tttaatgatagctgtttcacat

SEQ ID NO: 7773426 - DNA, 22 bp, Homo sapiens
tttaatgatagtcttacgaaaa

SEQ ID NO: 7773427 - DNA, 22 bp, Homo sapiens
tttaatgatagtcttacgaaaa

SEQ ID NO: 7773428 - DNA, 22 bp, Homo sapiens
tttacagcttctatactatgtg

SEQ ID NO: 7773429 - DNA, 22 bp, Homo sapiens
tttaaggtggacatctaagtca

SEQ ID NO: 7773430 - DNA, 22 bp, Homo sapiens
tttaaggcttcactggagtggg

SEQ ID NO: 7773431 - DNA, 21 bp, Homo sapiens
tttaaggccagcaggaggtga

SEQ ID NO: 7773432 - DNA, 22 bp, Homo sapiens
tttaagtgatgaaatgcagata

SEQ ID NO: 7773433 - DNA, 22 bp, Homo sapiens
tttaatgaataattcaaatctg

SEQ ID NO: 7773434 - DNA, 22 bp, Homo sapiens
tttaatcttcaaaatagtctta

SEQ ID NO: 7773435 - DNA, 22 bp, Homo sapiens
tttaagcacagggataaagtta

SEQ ID NO: 7773436 - DNA, 22 bp, Homo sapiens
tttaagatggtattttataaag

SEQ ID NO: 7773437 - DNA, 22 bp, Homo sapiens
tttaagattcagtaaggcaaac

SEQ ID NO: 7773438 - DNA, 22 bp, Homo sapiens
tttaaagagaatgtgaaggagt

SEQ ID NO: 7773439 - DNA, 21 bp, Homo sapiens
tttaaagaataggaagggagg

SEQ ID NO: 7773440 - DNA, 22 bp, Homo sapiens
tttaaagagaatgtgaaggagt

SEQ ID NO: 7773441 - DNA, 22 bp, Homo sapiens
tttaaacatcttgttgccttaa

SEQ ID NO: 7773442 - DNA, 22 bp, Homo sapiens
tttaaataggactcctgggggt

SEQ ID NO: 7773443 - DNA, 22 bp, Homo sapiens
tttatctgaggaaagcagacaa

SEQ ID NO: 7773444 - DNA, 22 bp, Homo sapiens
tttattcaagatgaggttcatg

SEQ ID NO: 7773445 - DNA, 22 bp, Homo sapiens
tttatcacagaataagaagtca

SEQ ID NO: 7773446 - DNA, 22 bp, Homo sapiens
tttatcatcttgtttttaaagc

SEQ ID NO: 7773447 - DNA, 22 bp, Homo sapiens
tttatcatcttgtttttaaagc

SEQ ID NO: 7773448 - DNA, 22 bp, Homo sapiens
tttatattgtaaaaatggttct

SEQ ID NO: 7773449 - DNA, 22 bp, Homo sapiens
tttatatatggctggtctggat

SEQ ID NO: 7773450 - DNA, 23 bp, Homo sapiens
tttatattcctaatgtcttgagc

SEQ ID NO: 7773451 - DNA, 22 bp, Homo sapiens
tttatattgggagtcgttttga

SEQ ID NO: 7773452 - DNA, 22 bp, Homo sapiens
tttatatagagatttgtgcatg

SEQ ID NO: 7773453 - DNA, 22 bp, Homo sapiens
tttatataacagagactgctat

SEQ ID NO: 7773454 - DNA, 22 bp, Homo sapiens
tttaccaagctttaattacata

SEQ ID NO: 7773455 - DNA, 22 bp, Homo sapiens
tttaccaaggcatagtaatctc

SEQ ID NO: 7773456 - DNA, 22 bp, Homo sapiens
tttaccacagaaaaaagtaact

SEQ ID NO: 7773457 - DNA, 22 bp, Homo sapiens
tttaccacaattttaaacaatg

SEQ ID NO: 7773458 - DNA, 22 bp, Homo sapiens
tttaccaaagtactctgaggca

SEQ ID NO: 7773459 - DNA, 20 bp, Homo sapiens
tttacattttgaaacagtga

SEQ ID NO: 7773460 - DNA, 22 bp, Homo sapiens
tttagattgtgacctcccccca

SEQ ID NO: 7773461 - DNA, 22 bp, Homo sapiens
tttagagagaaataaatgagat

SEQ ID NO: 7773462 - DNA, 22 bp, Homo sapiens
tttagagaccctctgctatttt

SEQ ID NO: 7773463 - DNA, 22 bp, Homo sapiens
tttcatgattaacttagtgaat

SEQ ID NO: 7773464 - DNA, 22 bp, Homo sapiens
tttcatgctcatggaacacagc

SEQ ID NO: 7773465 - DNA, 22 bp, Homo sapiens
tttcatgaggggcaaaatctca

SEQ ID NO: 7773466 - DNA, 22 bp, Homo sapiens
tttcagagctcagcagctagag

SEQ ID NO: 7773467 - DNA, 22 bp, Homo sapiens
tttcatgttacagtgtaaaagt

SEQ ID NO: 7773468 - DNA, 22 bp, Homo sapiens
tttcatgtgttgaatgtgtaca

SEQ ID NO: 7773469 - DNA, 22 bp, Homo sapiens
tttcatgtgttgaatgtgtaca

SEQ ID NO: 7773470 - DNA, 22 bp, Homo sapiens
tttcatgtgttgaatgtgtaca

SEQ ID NO: 7773471 - DNA, 22 bp, Homo sapiens
tttcatgtggcgatgtctctgg

SEQ ID NO: 7773472 - DNA, 22 bp, Homo sapiens
tttcatgtggcgatgtctctgg

SEQ ID NO: 7773473 - DNA, 22 bp, Homo sapiens
tttcatgtgcatttaggttcat

SEQ ID NO: 7773474 - DNA, 22 bp, Homo sapiens
tttcatgtgcaattagcaatat

SEQ ID NO: 7773475 - DNA, 22 bp, Homo sapiens
tttcatgtacttttttgataga

SEQ ID NO: 7773476 - DNA, 22 bp, Homo sapiens
tttcatgtcattccatttcaga

SEQ ID NO: 7773477 - DNA, 22 bp, Homo sapiens
tttcatgtctgaattctttagt

SEQ ID NO: 7773478 - DNA, 22 bp, Homo sapiens
tttcatgtctgaattctttagt

SEQ ID NO: 7773479 - DNA, 22 bp, Homo sapiens
tttcatgtctgaattctttagt

SEQ ID NO: 7773480 - DNA, 22 bp, Homo sapiens
tttcattcattatacagtagag

SEQ ID NO: 7773481 - DNA, 22 bp, Homo sapiens
tttcattgaactaaagaatctg

SEQ ID NO: 7773482 - DNA, 22 bp, Homo sapiens
tttcattgacagttgggggaaa

SEQ ID NO: 7773483 - DNA, 22 bp, Homo sapiens
tttcattgagaatataagattt

SEQ ID NO: 7773484 - DNA, 21 bp, Homo sapiens
tttcattgaatgagataaggt

SEQ ID NO: 7773485 - DNA, 18 bp, Homo sapiens
tttcattgagtgtgatat

SEQ ID NO: 7773486 - DNA, 22 bp, Homo sapiens
tttcattgatgggtgatagaaa

SEQ ID NO: 7773487 - DNA, 22 bp, Homo sapiens
tttcattgagactatagacatc

SEQ ID NO: 7773488 - DNA, 22 bp, Homo sapiens
tttcattgagactatagacatc

SEQ ID NO: 7773489 - DNA, 22 bp, Homo sapiens
tttcattgatgggtgatagaaa

SEQ ID NO: 7773490 - DNA, 19 bp, Homo sapiens
tttcccagcccttgctgtg

SEQ ID NO: 7773491 - DNA, 22 bp, Homo sapiens
tttcacattttatacttaagcc

SEQ ID NO: 7773492 - DNA, 22 bp, Homo sapiens
tttcacattttatacttaagcc

SEQ ID NO: 7773493 - DNA, 22 bp, Homo sapiens
tttcacagcttccacttaagga

SEQ ID NO: 7773494 - DNA, 22 bp, Homo sapiens
tttcagaaatggcactgaaatc

SEQ ID NO: 7773495 - DNA, 22 bp, Homo sapiens
tttcagaaagctgaacatatga

SEQ ID NO: 7773496 - DNA, 22 bp, Homo sapiens
tttcagaaagcatcatcaaagt

SEQ ID NO: 7773497 - DNA, 22 bp, Homo sapiens
tttcagagaactgagtccttgc

SEQ ID NO: 7773498 - DNA, 22 bp, Homo sapiens
tttcagagcctttatctctcta

SEQ ID NO: 7773499 - DNA, 22 bp, Homo sapiens
tttcagagatgcagaattcagg

SEQ ID NO: 7773500 - DNA, 22 bp, Homo sapiens
tttcagagatgtctagcctatt

SEQ ID NO: 7773501 - DNA, 22 bp, Homo sapiens
tttcagagagatcaacatagct

SEQ ID NO: 7773502 - DNA, 22 bp, Homo sapiens
tttcagagaactgagtccttgc

SEQ ID NO: 7773503 - DNA, 22 bp, Homo sapiens
tttcacagaaaggataacatta

SEQ ID NO: 7773504 - DNA, 22 bp, Homo sapiens
tttcacagagaaatataacagg

SEQ ID NO: 7773505 - DNA, 22 bp, Homo sapiens
tttcacagaggaggaagctgag

SEQ ID NO: 7773506 - DNA, 22 bp, Homo sapiens
tttcacagaggaggaagctgag

SEQ ID NO: 7773507 - DNA, 22 bp, Homo sapiens
tttcaagcataactgggaagag

SEQ ID NO: 7773508 - DNA, 22 bp, Homo sapiens
tttcacacaacgtgaatatact

SEQ ID NO: 7773509 - DNA, 22 bp, Homo sapiens
tttcacaattttaaggagcaaa

SEQ ID NO: 7773510 - DNA, 22 bp, Homo sapiens
tttcaagagggaactgaacaca

SEQ ID NO: 7773511 - DNA, 22 bp, Homo sapiens
tttcaacttgtttgcttccata

SEQ ID NO: 7773512 - DNA, 22 bp, Homo sapiens
tttcaacagctctcaaatgatc

SEQ ID NO: 7773513 - DNA, 22 bp, Homo sapiens
tttcaacatataccataatgcc

SEQ ID NO: 7773514 - DNA, 22 bp, Homo sapiens
tttattctctagttggtcagat

SEQ ID NO: 7773515 - DNA, 22 bp, Homo sapiens
tttattctgtgctacatgaaga

SEQ ID NO: 7773516 - DNA, 19 bp, Homo sapiens
tttattcacctttaccttg

SEQ ID NO: 7773517 - DNA, 22 bp, Homo sapiens
tttattctagctcagaatagtt

SEQ ID NO: 7773518 - DNA, 20 bp, Homo sapiens
tttattcacagagaagagtt

SEQ ID NO: 7773519 - DNA, 22 bp, Homo sapiens
tttattctataggcattaagca

SEQ ID NO: 7773520 - DNA, 22 bp, Homo sapiens
tttattgacttcagtgagtctt

SEQ ID NO: 7773521 - DNA, 22 bp, Homo sapiens
tttattgacttcagtgagtctt

SEQ ID NO: 7773522 - DNA, 22 bp, Homo sapiens
tttattgacccaaagcgagagt

SEQ ID NO: 7773523 - DNA, 22 bp, Homo sapiens
tttattgagtatctactatgtg

SEQ ID NO: 7773524 - DNA, 19 bp, Homo sapiens
tttcaaagggcataagcct

SEQ ID NO: 7773525 - DNA, 22 bp, Homo sapiens
tttcaacagaatatgatcagag

SEQ ID NO: 7773526 - DNA, 23 bp, Homo sapiens
tttcaacaatgcttagagaaaac

SEQ ID NO: 7773527 - DNA, 23 bp, Homo sapiens
tttcaacaatgcttagagaaaac

SEQ ID NO: 7773528 - DNA, 22 bp, Homo sapiens
ttgaaatgagcaaactgtcagc

SEQ ID NO: 7773529 - DNA, 22 bp, Homo sapiens
ttgaaatgatctatttcagtag

SEQ ID NO: 7773530 - DNA, 22 bp, Homo sapiens
ttgaaatgatctatttcagtag

SEQ ID NO: 7773531 - DNA, 22 bp, Homo sapiens
ttgaaatgcatcatcatttaga

SEQ ID NO: 7773532 - DNA, 22 bp, Homo sapiens
ttgaaatggcagcagctgacct

SEQ ID NO: 7773533 - DNA, 22 bp, Homo sapiens
ttcttttggactcaaagagaac

SEQ ID NO: 7773534 - DNA, 22 bp, Homo sapiens
ttcttttcttggcaggagtaga

SEQ ID NO: 7773535 - DNA, 22 bp, Homo sapiens
ttcttttgcaagactattgatt

SEQ ID NO: 7773536 - DNA, 22 bp, Homo sapiens
ttgaacaatcaaaagaattcat

SEQ ID NO: 7773537 - DNA, 22 bp, Homo sapiens
ttgaacaatttggtatacaaac

SEQ ID NO: 7773538 - DNA, 22 bp, Homo sapiens
ttgaacaatttggtatacaaac

SEQ ID NO: 7773539 - DNA, 22 bp, Homo sapiens
ttgaacattaacttcagtctat

SEQ ID NO: 7773540 - DNA, 22 bp, Homo sapiens
ttgaaatgtagtcctgccttca

SEQ ID NO: 7773541 - DNA, 20 bp, Homo sapiens
ttgaaattggatggtagcta

SEQ ID NO: 7773542 - DNA, 22 bp, Homo sapiens
ttgaaatggcagcagctgacct

SEQ ID NO: 7773543 - DNA, 19 bp, Homo sapiens
ttgaaattgtttgatatgg

SEQ ID NO: 7773544 - DNA, 22 bp, Homo sapiens
ttgaaattgggtgtggctgtca

SEQ ID NO: 7773545 - DNA, 18 bp, Homo sapiens
ttgaattcttctacatgt

SEQ ID NO: 7773546 - DNA, 22 bp, Homo sapiens
ttgaacattagaataagtaatt

SEQ ID NO: 7773547 - DNA, 22 bp, Homo sapiens
ttcttattcttgaaatgtggga

SEQ ID NO: 7773548 - DNA, 22 bp, Homo sapiens
ttcttatttcccccttcatcat

SEQ ID NO: 7773549 - DNA, 22 bp, Homo sapiens
ttcttattgggagaccttttct

SEQ ID NO: 7773550 - DNA, 23 bp, Homo sapiens
ttcttatttactttggaatctcc

SEQ ID NO: 7773551 - DNA, 22 bp, Homo sapiens
ttcttcaaaatccagcatgatt

SEQ ID NO: 7773552 - DNA, 22 bp, Homo sapiens
ttcttcaattattggaaagaaa

SEQ ID NO: 7773553 - DNA, 22 bp, Homo sapiens
ttcttcagactactgatgattg

SEQ ID NO: 7773554 - DNA, 19 bp, Homo sapiens
ttctttggtggtggtgacc

SEQ ID NO: 7773555 - DNA, 22 bp, Homo sapiens
ttcttcaaccatctacataaac

SEQ ID NO: 7773556 - DNA, 22 bp, Homo sapiens
ttcttcaaccatctacataaac

SEQ ID NO: 7773557 - DNA, 22 bp, Homo sapiens
ttcttttaatgtctggctttca

SEQ ID NO: 7773558 - DNA, 22 bp, Homo sapiens
ttctttgtagcaaaacgtgtat

SEQ ID NO: 7773559 - DNA, 22 bp, Homo sapiens
ttctttgtgcatccaattttct

SEQ ID NO: 7773560 - DNA, 22 bp, Homo sapiens
ttctttggtgttacccagctca

SEQ ID NO: 7773561 - DNA, 22 bp, Homo sapiens
ttctttggtgttacccagctca

SEQ ID NO: 7773562 - DNA, 19 bp, Homo sapiens
ttctttggtggtggtgacc

SEQ ID NO: 7773563 - DNA, 22 bp, Homo sapiens
ttcttttaaaagagagcagaaa

SEQ ID NO: 7773564 - DNA, 22 bp, Homo sapiens
ttcttacattagtctgtgcttt

SEQ ID NO: 7773565 - DNA, 22 bp, Homo sapiens
ttctgttacaagtgaaaaaatg

SEQ ID NO: 7773566 - DNA, 22 bp, Homo sapiens
ttcttatagaagcaaccattgt

SEQ ID NO: 7773567 - DNA, 22 bp, Homo sapiens
ttcttatattgggtcatggata

SEQ ID NO: 7773568 - DNA, 22 bp, Homo sapiens
ttcttatattgggtcatggata

SEQ ID NO: 7773569 - DNA, 22 bp, Homo sapiens
ttcttataagttaatatttcca

SEQ ID NO: 7773570 - DNA, 22 bp, Homo sapiens
ttctgtcttctcggttgtttac

SEQ ID NO: 7773571 - DNA, 22 bp, Homo sapiens
ttctggaattcttgcagccact

SEQ ID NO: 7773572 - DNA, 22 bp, Homo sapiens
ttctggagacccagcaacaggg

SEQ ID NO: 7773573 - DNA, 22 bp, Homo sapiens
ttctggagattgagaaggcatt

SEQ ID NO: 7773574 - DNA, 22 bp, Homo sapiens
ttctggagaggaacagaaaggt

SEQ ID NO: 7773575 - DNA, 22 bp, Homo sapiens
ttctggagccccaagatctgta

SEQ ID NO: 7773576 - DNA, 22 bp, Homo sapiens
ttctgtaagctaccaagtttgt

SEQ ID NO: 7773577 - DNA, 22 bp, Homo sapiens
ttctctgggttaggggaactat

SEQ ID NO: 7773578 - DNA, 22 bp, Homo sapiens
ttctctgggacaggaacagttt

SEQ ID NO: 7773579 - DNA, 22 bp, Homo sapiens
ttctggaaatgcacaactaatt

SEQ ID NO: 7773580 - DNA, 22 bp, Homo sapiens
ttctggaacatagcaagaagtt

SEQ ID NO: 7773581 - DNA, 22 bp, Homo sapiens
ttctggaagtggaatttttgta

SEQ ID NO: 7773582 - DNA, 22 bp, Homo sapiens
ttctggaagtgttagaatctgg

SEQ ID NO: 7773583 - DNA, 22 bp, Homo sapiens
ttctggaatactaagttccttt

SEQ ID NO: 7773584 - DNA, 22 bp, Homo sapiens
ttctggaatatttgacacaatt

SEQ ID NO: 7773585 - DNA, 22 bp, Homo sapiens
ttctctcccatgaagcttctat

SEQ ID NO: 7773586 - DNA, 22 bp, Homo sapiens
ttctctaggttttagatgaaga

SEQ ID NO: 7773587 - DNA, 22 bp, Homo sapiens
ttctctcttccagttcccactt

SEQ ID NO: 7773588 - DNA, 22 bp, Homo sapiens
ttctctctgtgtcattatggac

SEQ ID NO: 7773589 - DNA, 22 bp, Homo sapiens
ttctctctgtggtcccattttg

SEQ ID NO: 7773590 - DNA, 22 bp, Homo sapiens
ttctctcttactgccatgctgt

SEQ ID NO: 7773591 - DNA, 22 bp, Homo sapiens
ttctcaggctgtggagccgtct

SEQ ID NO: 7773592 - DNA, 22 bp, Homo sapiens
ttctcagggtctggatggcctg

SEQ ID NO: 7773593 - DNA, 22 bp, Homo sapiens
ttctcaggaactcagtgtcagc

SEQ ID NO: 7773594 - DNA, 22 bp, Homo sapiens
ttctcaggcccctgcctggact

SEQ ID NO: 7773595 - DNA, 22 bp, Homo sapiens
ttctcaggtcaccagggtgcca

SEQ ID NO: 7773596 - DNA, 22 bp, Homo sapiens
ttctcaggtagtgctgatgctg

SEQ ID NO: 7773597 - DNA, 22 bp, Homo sapiens
ttctccaagtagaagctaagtt

SEQ ID NO: 7773598 - DNA, 22 bp, Homo sapiens
ttcctggaaattatgctcacct

SEQ ID NO: 7773599 - DNA, 22 bp, Homo sapiens
ttcctggagagttttcccaaag

SEQ ID NO: 7773600 - DNA, 21 bp, Homo sapiens
ttcctggggacttccgtggga

SEQ ID NO: 7773601 - DNA, 17 bp, Homo sapiens
ttccagtttagtattgt

SEQ ID NO: 7773602 - DNA, 22 bp, Homo sapiens
ttcctgcagcaaggagaagctg

SEQ ID NO: 7773603 - DNA, 22 bp, Homo sapiens
ttcctggggcttagcaatggag

SEQ ID NO: 7773604 - DNA, 22 bp, Homo sapiens
ttcctggggcttagcaatggag

SEQ ID NO: 7773605 - DNA, 22 bp, Homo sapiens
ttcctgggttgtgcattgtaca

SEQ ID NO: 7773606 - DNA, 22 bp, Homo sapiens
ttcctgggtttacgtattgggt

SEQ ID NO: 7773607 - DNA, 22 bp, Homo sapiens
ttcctggtctatttagaattgc

SEQ ID NO: 7773608 - DNA, 22 bp, Homo sapiens
ttcctggtcctattatatacac

SEQ ID NO: 7773609 - DNA, 22 bp, Homo sapiens
ttcctggtttatggaaagcatg

SEQ ID NO: 7773610 - DNA, 22 bp, Homo sapiens
ttccttcttccaaacccatcat

SEQ ID NO: 7773611 - DNA, 20 bp, Homo sapiens
ttcatttgttgagcaccttc

SEQ ID NO: 7773612 - DNA, 22 bp, Homo sapiens
ttcatttgtgtgcctgatgcaa

SEQ ID NO: 7773613 - DNA, 21 bp, Homo sapiens
ttcatttgttatagacaaagt

SEQ ID NO: 7773614 - DNA, 22 bp, Homo sapiens
ttccaggaagctctcggcctct

SEQ ID NO: 7773615 - DNA, 22 bp, Homo sapiens
ttccaggaagcagttagcagcc

SEQ ID NO: 7773616 - DNA, 22 bp, Homo sapiens
ttccaggaagacatctcaggaa

SEQ ID NO: 7773617 - DNA, 22 bp, Homo sapiens
ttcatttggcctctgcttaaaa

SEQ ID NO: 7773618 - DNA, 20 bp, Homo sapiens
ttcatttgggaaaatctgcg

SEQ ID NO: 7773619 - DNA, 19 bp, Homo sapiens
ttcatttgtatctgctcac

SEQ ID NO: 7773620 - DNA, 22 bp, Homo sapiens
ttcatttgggatgagtcagaag

SEQ ID NO: 7773621 - DNA, 22 bp, Homo sapiens
ttcatttgtaactctgttaggg

SEQ ID NO: 7773622 - DNA, 22 bp, Homo sapiens
ttcatttgtccaaatactatgt

SEQ ID NO: 7773623 - DNA, 22 bp, Homo sapiens
ttcatttgtctgctatagatcc

SEQ ID NO: 7773624 - DNA, 22 bp, Homo sapiens
ttcatttgtctgctatagatcc

SEQ ID NO: 7773625 - DNA, 22 bp, Homo sapiens
ttcatttgtggttatttacaat

SEQ ID NO: 7773626 - DNA, 22 bp, Homo sapiens
ttcattgatttccttggaataa

SEQ ID NO: 7773627 - DNA, 22 bp, Homo sapiens
ttcattgcattccagcctgggt

SEQ ID NO: 7773628 - DNA, 22 bp, Homo sapiens
ttcataatcaccaaaaactgga

SEQ ID NO: 7773629 - DNA, 22 bp, Homo sapiens
ttcatacaatgggatattatga

SEQ ID NO: 7773630 - DNA, 22 bp, Homo sapiens
ttcatttaatcagaatctctaa

SEQ ID NO: 7773631 - DNA, 22 bp, Homo sapiens
ttcattgtctctgtttgccttc

SEQ ID NO: 7773632 - DNA, 22 bp, Homo sapiens
ttcattgtagcttgactaatta

SEQ ID NO: 7773633 - DNA, 22 bp, Homo sapiens
ttcatttgccatcagtgtaatg

SEQ ID NO: 7773634 - DNA, 22 bp, Homo sapiens
ttcatttgagtttatagttgct

SEQ ID NO: 7773635 - DNA, 22 bp, Homo sapiens
ttcatttaatcagaatctctaa

SEQ ID NO: 7773636 - DNA, 22 bp, Homo sapiens
ttcatttaatcagaatctctaa

SEQ ID NO: 7773637 - DNA, 22 bp, Homo sapiens
ttcagtgtttgtagagataact

SEQ ID NO: 7773638 - DNA, 22 bp, Homo sapiens
ttcagtgttactcaaggggcag

SEQ ID NO: 7773639 - DNA, 22 bp, Homo sapiens
ttcagtgttcttttctgttagc

SEQ ID NO: 7773640 - DNA, 22 bp, Homo sapiens
ttcagtgttaatcttgggagaa

SEQ ID NO: 7773641 - DNA, 22 bp, Homo sapiens
ttcagtgtgtcagtttcagcag

SEQ ID NO: 7773642 - DNA, 22 bp, Homo sapiens
ttcagtgtgtgatacctgctgt

SEQ ID NO: 7773643 - DNA, 22 bp, Homo sapiens
ttcagtgttaaattcaaagagt

SEQ ID NO: 7773644 - DNA, 22 bp, Homo sapiens
ttcagtgtggcccatgaagagg

SEQ ID NO: 7773645 - DNA, 22 bp, Homo sapiens
ttcagtgtggtgcacagttttg

SEQ ID NO: 7773646 - DNA, 22 bp, Homo sapiens
ttcagtgtggaatgtgaactgc

SEQ ID NO: 7773647 - DNA, 22 bp, Homo sapiens
ttcataaacaaattaaggcctg

SEQ ID NO: 7773648 - DNA, 22 bp, Homo sapiens
ttcagttttgcttttaatcatg

SEQ ID NO: 7773649 - DNA, 22 bp, Homo sapiens
ttcagcactgttatggatttgc

SEQ ID NO: 7773650 - DNA, 22 bp, Homo sapiens
ttcagtgtccctagtagaagtt

SEQ ID NO: 7773651 - DNA, 22 bp, Homo sapiens
ttcagtgtgaagcttctgaaag

SEQ ID NO: 7773652 - DNA, 22 bp, Homo sapiens
ttcagtgtgcctaagtcagttg

SEQ ID NO: 7773653 - DNA, 19 bp, Homo sapiens
ttcagtgtgctggctcctg

SEQ ID NO: 7773654 - DNA, 22 bp, Homo sapiens
ttcagtgtgcttcaggacgtta

SEQ ID NO: 7773655 - DNA, 22 bp, Homo sapiens
ttcagaggacaaccagccatct

SEQ ID NO: 7773656 - DNA, 22 bp, Homo sapiens
ttcagagaaactgaggtttaga

SEQ ID NO: 7773657 - DNA, 22 bp, Homo sapiens
ttcagagaaagcagatttactc

SEQ ID NO: 7773658 - DNA, 22 bp, Homo sapiens
ttcagagcatctctaaagccag

SEQ ID NO: 7773659 - DNA, 22 bp, Homo sapiens
ttcagagccacttcaagtctaa

SEQ ID NO: 7773660 - DNA, 22 bp, Homo sapiens
ttcagagacatgttctagatca

SEQ ID NO: 7773661 - DNA, 22 bp, Homo sapiens
ttcacaattaactttatactta

SEQ ID NO: 7773662 - DNA, 23 bp, Homo sapiens
ttcaaagcttaagctctttccac

SEQ ID NO: 7773663 - DNA, 22 bp, Homo sapiens
ttcacaataggagcatgcaaat

SEQ ID NO: 7773664 - DNA, 22 bp, Homo sapiens
ttcaaagattttcccaaagctc

SEQ ID NO: 7773665 - DNA, 23 bp, Homo sapiens
ttcaaagatcttctgaaatctgt

SEQ ID NO: 7773666 - DNA, 22 bp, Homo sapiens
ttcaaagaattttgagacctga

SEQ ID NO: 7773667 - DNA, 22 bp, Homo sapiens
ttcaaacttaaggagcagcaga

SEQ ID NO: 7773668 - DNA, 22 bp, Homo sapiens
ttcaaactgtgtaatttataaa

SEQ ID NO: 7773669 - DNA, 22 bp, Homo sapiens
ttcaaagaccttacttggcaaa

SEQ ID NO: 7773670 - DNA, 22 bp, Homo sapiens
ttcaaagagaaattgtattttc

SEQ ID NO: 7773671 - DNA, 21 bp, Homo sapiens
ttcaaagagtgggcattgtca

SEQ ID NO: 7773672 - DNA, 22 bp, Homo sapiens
ttcaaagataatgtagcatttt

SEQ ID NO: 7773673 - DNA, 22 bp, Homo sapiens
ttcaaagataatgtagcatttt

SEQ ID NO: 7773674 - DNA, 22 bp, Homo sapiens
ttcaaagagttgggtgtctggg

SEQ ID NO: 7773675 - DNA, 22 bp, Homo sapiens
ttcaaagataattaccaaacat

SEQ ID NO: 7773676 - DNA, 22 bp, Homo sapiens
ttcaaagataattaccaaacat

SEQ ID NO: 7773677 - DNA, 22 bp, Homo sapiens
ttcacagatttccctgcacatg

SEQ ID NO: 7773678 - DNA, 22 bp, Homo sapiens
tcctgccttagagcaaggaaaa

SEQ ID NO: 7773679 - DNA, 21 bp, Homo sapiens
tcctgctgagaaacagatggt

SEQ ID NO: 7773680 - DNA, 22 bp, Homo sapiens
tcctgctgaccagtaaatgaat

SEQ ID NO: 7773681 - DNA, 20 bp, Homo sapiens
tcctgctgaccttcacaagc

SEQ ID NO: 7773682 - DNA, 22 bp, Homo sapiens
tcctgctgccatttcaagtgct

SEQ ID NO: 7773683 - DNA, 18 bp, Homo sapiens
tcctgcctgtgccccagg

SEQ ID NO: 7773684 - DNA, 18 bp, Homo sapiens
tcctgcctgtgccccagg

SEQ ID NO: 7773685 - DNA, 22 bp, Homo sapiens
tcctgcctgtttacctgtactt

SEQ ID NO: 7773686 - DNA, 22 bp, Homo sapiens
tcctgcctgtttacctgtactt

SEQ ID NO: 7773687 - DNA, 19 bp, Homo sapiens
tcctgcctggggccgcctg

SEQ ID NO: 7773688 - DNA, 19 bp, Homo sapiens
tcctgcctggggccgcctg

SEQ ID NO: 7773689 - DNA, 18 bp, Homo sapiens
tcctgcctgcgggctccc

SEQ ID NO: 7773690 - DNA, 18 bp, Homo sapiens
tcctgcctgcgggctccc

SEQ ID NO: 7773691 - DNA, 22 bp, Homo sapiens
ttagctttcagcctttctcacc

SEQ ID NO: 7773692 - DNA, 22 bp, Homo sapiens
ttagctttagagccattactgg

SEQ ID NO: 7773693 - DNA, 22 bp, Homo sapiens
ttagctgtcaaggtggctgcag

SEQ ID NO: 7773694 - DNA, 22 bp, Homo sapiens
ttagctaaactgtaactagaat

SEQ ID NO: 7773695 - DNA, 22 bp, Homo sapiens
tcctgctggaagtagggaatga

SEQ ID NO: 7773696 - DNA, 22 bp, Homo sapiens
tcctgctggaatggaaaatgaa

SEQ ID NO: 7773697 - DNA, 22 bp, Homo sapiens
ttagccaaacaggtgaaattga

SEQ ID NO: 7773698 - DNA, 22 bp, Homo sapiens
tcctgctgctcttgggaaacct

SEQ ID NO: 7773699 - DNA, 22 bp, Homo sapiens
ttagctttcatgaacctggtcg

SEQ ID NO: 7773700 - DNA, 22 bp, Homo sapiens
ttagcttttaagtgtgctacat

SEQ ID NO: 7773701 - DNA, 22 bp, Homo sapiens
ttagcttttcacttgcattatc

SEQ ID NO: 7773702 - DNA, 22 bp, Homo sapiens
ttatacatgtgttttgagatga

SEQ ID NO: 7773703 - DNA, 21 bp, Homo sapiens
ttataggctggggtttgcttt

SEQ ID NO: 7773704 - DNA, 22 bp, Homo sapiens
ttataggcttagttctgtgtgt

SEQ ID NO: 7773705 - DNA, 22 bp, Homo sapiens
ttatataaagataacttttctt

SEQ ID NO: 7773706 - DNA, 22 bp, Homo sapiens
ttatataaagataacttttctt

SEQ ID NO: 7773707 - DNA, 22 bp, Homo sapiens
ttatagaatgtttccaatgcct

SEQ ID NO: 7773708 - DNA, 22 bp, Homo sapiens
ttattacaatgcagaaaataga

SEQ ID NO: 7773709 - DNA, 22 bp, Homo sapiens
ttattataatgagggataaaaa

SEQ ID NO: 7773710 - DNA, 22 bp, Homo sapiens
ttattctttaaacatatatgtt

SEQ ID NO: 7773711 - DNA, 22 bp, Homo sapiens
ttattctttaaacatatatgtt

SEQ ID NO: 7773712 - DNA, 22 bp, Homo sapiens
ttattatagattatgcaagatt

SEQ ID NO: 7773713 - DNA, 22 bp, Homo sapiens
ttattaatgagtacaagttatt

SEQ ID NO: 7773714 - DNA, 22 bp, Homo sapiens
ttattaatcttatctttggaaa

SEQ ID NO: 7773715 - DNA, 22 bp, Homo sapiens
ttattaatgagtacaagttatt

SEQ ID NO: 7773716 - DNA, 22 bp, Homo sapiens
ttattaataaagtggcatagcc

SEQ ID NO: 7773717 - DNA, 22 bp, Homo sapiens
ttattaataaagtggcatagcc

SEQ ID NO: 7773718 - DNA, 22 bp, Homo sapiens
ttattaatacatgcacctgcat

SEQ ID NO: 7773719 - DNA, 22 bp, Homo sapiens
ttattaagtgcctacaataaag

SEQ ID NO: 7773720 - DNA, 22 bp, Homo sapiens
ttatatatatgtagaggtcacg

SEQ ID NO: 7773721 - DNA, 22 bp, Homo sapiens
ttatatatatgtagaggtcacg

SEQ ID NO: 7773722 - DNA, 22 bp, Homo sapiens
ttatatatatgtagaggtcacg

SEQ ID NO: 7773723 - DNA, 22 bp, Homo sapiens
ttatatatcttgatttgttcca

SEQ ID NO: 7773724 - DNA, 22 bp, Homo sapiens
ttatatgagtatcatatcactt

SEQ ID NO: 7773725 - DNA, 22 bp, Homo sapiens
ttatatgattgaagtgcataag

SEQ ID NO: 7773726 - DNA, 22 bp, Homo sapiens
ttatatgagtatcatatcactt

SEQ ID NO: 7773727 - DNA, 22 bp, Homo sapiens
ttcaaactcttgctctgctagt

SEQ ID NO: 7773728 - DNA, 22 bp, Homo sapiens
ttcaaactctgagtagttctgc

SEQ ID NO: 7773729 - DNA, 22 bp, Homo sapiens
ttcaaacattcaaataaaccgg

SEQ ID NO: 7773730 - DNA, 22 bp, Homo sapiens
ttcaaacagtgtagaatatatg

SEQ ID NO: 7773731 - DNA, 22 bp, Homo sapiens
ttcaaacagttgcacaacttat

SEQ ID NO: 7773732 - DNA, 22 bp, Homo sapiens
ttcaaacagttgcacaacttat

SEQ ID NO: 7773733 - DNA, 22 bp, Homo sapiens
ttcaaacattcaaataaaccgg

SEQ ID NO: 7773734 - DNA, 22 bp, Homo sapiens
ttcaaacagttgcacaacttat

SEQ ID NO: 7773735 - DNA, 22 bp, Homo sapiens
ttcaaacactggcttagccaat

SEQ ID NO: 7773736 - DNA, 22 bp, Homo sapiens
ttcaaacagatgactctgctct

SEQ ID NO: 7773737 - DNA, 22 bp, Homo sapiens
ttcaaacagatgactctgctct

SEQ ID NO: 7773738 - DNA, 22 bp, Homo sapiens
ttattgacttgtttgtcctggt

SEQ ID NO: 7773739 - DNA, 22 bp, Homo sapiens
ttattgagaccgtaagtcaggt

SEQ ID NO: 7773740 - DNA, 22 bp, Homo sapiens
ttattgtcaaaaacaggacact

SEQ ID NO: 7773741 - DNA, 22 bp, Homo sapiens
ttattgctggcaccttcaattc

SEQ ID NO: 7773742 - DNA, 22 bp, Homo sapiens
ttattgctgctaacattttatg

SEQ ID NO: 7773743 - DNA, 22 bp, Homo sapiens
ttattgagcacctactatgtgt

SEQ ID NO: 7773744 - DNA, 22 bp, Homo sapiens
ttattgagcacatagtatgtgg

SEQ ID NO: 7773745 - DNA, 22 bp, Homo sapiens
ttattgctgctaacattttatg

SEQ ID NO: 7773746 - DNA, 22 bp, Homo sapiens
ttattgctgatagtgtttataa

SEQ ID NO: 7773747 - DNA, 22 bp, Homo sapiens
tttggtcagggtaggacagttg

SEQ ID NO: 7773748 - DNA, 22 bp, Homo sapiens
tttggtcaaatattatcctgag

SEQ ID NO: 7773749 - DNA, 22 bp, Homo sapiens
tttggtgagctgcgagtgagga

SEQ ID NO: 7773750 - DNA, 22 bp, Homo sapiens
tttggttaatttaggcttgcat

SEQ ID NO: 7773751 - DNA, 22 bp, Homo sapiens
tttggtttgcctgagtaccctc

SEQ ID NO: 7773752 - DNA, 22 bp, Homo sapiens
tttgctttgtttaaaagtggta

SEQ ID NO: 7773753 - DNA, 22 bp, Homo sapiens
tttgatagttgattaaattcca

SEQ ID NO: 7773754 - DNA, 19 bp, Homo sapiens
tttgatagggcataatata

SEQ ID NO: 7773755 - DNA, 22 bp, Homo sapiens
tttgatctcccagactaaggag

SEQ ID NO: 7773756 - DNA, 22 bp, Homo sapiens
tttgatctatgcgtggtttccc

SEQ ID NO: 7773757 - DNA, 22 bp, Homo sapiens
tttgatatcttggtatacagat

SEQ ID NO: 7773758 - DNA, 22 bp, Homo sapiens
tttgatatcttggtatacagat

SEQ ID NO: 7773759 - DNA, 19 bp, Homo sapiens
tttgatatctgaattatgc

SEQ ID NO: 7773760 - DNA, 19 bp, Homo sapiens
tttgatatctgaattatgc

SEQ ID NO: 7773761 - DNA, 22 bp, Homo sapiens
tttgatatgcaaaattatggac

SEQ ID NO: 7773762 - DNA, 22 bp, Homo sapiens
tttgaggacattttagaaagtt

SEQ ID NO: 7773763 - DNA, 18 bp, Homo sapiens
tttgaggaaatgtcctga

SEQ ID NO: 7773764 - DNA, 22 bp, Homo sapiens
tttgagtagtgagactaggcag

SEQ ID NO: 7773765 - DNA, 22 bp, Homo sapiens
tttgataatacacaagagaaag

SEQ ID NO: 7773766 - DNA, 22 bp, Homo sapiens
tttgataatacacaagagaaag

SEQ ID NO: 7773767 - DNA, 22 bp, Homo sapiens
tttgatttactataagcagcac

SEQ ID NO: 7773768 - DNA, 22 bp, Homo sapiens
tttgatgaaagctactatttac

SEQ ID NO: 7773769 - DNA, 22 bp, Homo sapiens
tttgctttcttgattcagatta

SEQ ID NO: 7773770 - DNA, 22 bp, Homo sapiens
tttgctttgactgtcagcaagt

SEQ ID NO: 7773771 - DNA, 22 bp, Homo sapiens
tttgctttgggaggttgtctgg

SEQ ID NO: 7773772 - DNA, 22 bp, Homo sapiens
tttgctttgggaggttgtctgg

SEQ ID NO: 7773773 - DNA, 18 bp, Homo sapiens
tttgctttccttcttcag

SEQ ID NO: 7773774 - DNA, 22 bp, Homo sapiens
tttgctttctgttgaacagagt

SEQ ID NO: 7773775 - DNA, 22 bp, Homo sapiens
tttgaagactactgggagtgaa

SEQ ID NO: 7773776 - DNA, 19 bp, Homo sapiens
tttgaatataatgcagcta

SEQ ID NO: 7773777 - DNA, 22 bp, Homo sapiens
tttgaatatcacaaactttcaa

SEQ ID NO: 7773778 - DNA, 22 bp, Homo sapiens
tttgacaataattgcatttata

SEQ ID NO: 7773779 - DNA, 22 bp, Homo sapiens
tttgacaaaggaaaaatgcaca

SEQ ID NO: 7773780 - DNA, 22 bp, Homo sapiens
tttgacaaataggggaataagg

SEQ ID NO: 7773781 - DNA, 22 bp, Homo sapiens
tttgacaaaggaaaaatgcaca

SEQ ID NO: 7773782 - DNA, 22 bp, Homo sapiens
tttccctttgcactctacaatt

SEQ ID NO: 7773783 - DNA, 22 bp, Homo sapiens
tttccctttgcactctacaatt

SEQ ID NO: 7773784 - DNA, 22 bp, Homo sapiens
tttccctttagcctgagaatcc

SEQ ID NO: 7773785 - DNA, 22 bp, Homo sapiens
tttcccttgttccttcctctga

SEQ ID NO: 7773786 - DNA, 22 bp, Homo sapiens
tttcccttctttcctgagtaat

SEQ ID NO: 7773787 - DNA, 22 bp, Homo sapiens
tttcccttgaataaagatatct

SEQ ID NO: 7773788 - DNA, 22 bp, Homo sapiens
tttcccttctttcctgagtaat

SEQ ID NO: 7773789 - DNA, 22 bp, Homo sapiens
tttccctctgtgccagcttctc

SEQ ID NO: 7773790 - DNA, 17 bp, Homo sapiens
tttccctccttccactc

SEQ ID NO: 7773791 - DNA, 22 bp, Homo sapiens
tttcctctgactgctcccctgc

SEQ ID NO: 7773792 - DNA, 22 bp, Homo sapiens
tttcctctccaccaggaggtct

SEQ ID NO: 7773793 - DNA, 22 bp, Homo sapiens
tttcctctccggggcctccagg

SEQ ID NO: 7773794 - DNA, 22 bp, Homo sapiens
tttcttttgccctgtgggttag

SEQ ID NO: 7773795 - DNA, 22 bp, Homo sapiens
tttctttgttgttatcacatca

SEQ ID NO: 7773796 - DNA, 22 bp, Homo sapiens
tttctttgtagtagcataatca

SEQ ID NO: 7773797 - DNA, 22 bp, Homo sapiens
tttctttgagtctcagtttgct

SEQ ID NO: 7773798 - DNA, 22 bp, Homo sapiens
tttcctctgatgctgacttgga

SEQ ID NO: 7773799 - DNA, 22 bp, Homo sapiens
ttttcatctctgctttgtacct

SEQ ID NO: 7773800 - DNA, 22 bp, Homo sapiens
ttttcagtttgcactgcagtgc

SEQ ID NO: 7773801 - DNA, 22 bp, Homo sapiens
ttttcattgttcctcgagcatt

SEQ ID NO: 7773802 - DNA, 22 bp, Homo sapiens
ttttcattgttactatgagcta

SEQ ID NO: 7773803 - DNA, 22 bp, Homo sapiens
ttttcattagaatgactgagaa

SEQ ID NO: 7773804 - DNA, 22 bp, Homo sapiens
ttttcatgttccttgttaagtg

SEQ ID NO: 7773805 - DNA, 22 bp, Homo sapiens
ttttcattgagcacctgagtaa

SEQ ID NO: 7773806 - DNA, 22 bp, Homo sapiens
ttttcattgtaaatcaggaaac

SEQ ID NO: 7773807 - DNA, 22 bp, Homo sapiens
ttttattggagtgataccaagc

SEQ ID NO: 7773808 - DNA, 22 bp, Homo sapiens
ttttattagtggctagatgggg

SEQ ID NO: 7773809 - DNA, 22 bp, Homo sapiens
ttttatgttcctgaagctatct

SEQ ID NO: 7773810 - DNA, 22 bp, Homo sapiens
ttttatgttcctgaagctatct

SEQ ID NO: 7773811 - DNA, 22 bp, Homo sapiens
ttttatgttgctataataggta

SEQ ID NO: 7773812 - DNA, 22 bp, Homo sapiens
ttttatgtgtgaaatgctgtct

SEQ ID NO: 7773813 - DNA, 22 bp, Homo sapiens
ttttatgtgtgaaatgctgtct

SEQ ID NO: 7773814 - DNA, 22 bp, Homo sapiens
ttttatgttcctgaagctatct

SEQ ID NO: 7773815 - DNA, 22 bp, Homo sapiens
ttttctgaagtttaagacattt

SEQ ID NO: 7773816 - DNA, 22 bp, Homo sapiens
ttttctgacctatctacattta

SEQ ID NO: 7773817 - DNA, 22 bp, Homo sapiens
ttttctcttgttaatgtactga

SEQ ID NO: 7773818 - DNA, 22 bp, Homo sapiens
ttttcatttacattagggaaga

SEQ ID NO: 7773819 - DNA, 22 bp, Homo sapiens
ttttcatttacattagggaaga

SEQ ID NO: 7773820 - DNA, 22 bp, Homo sapiens
ttttcattgttcctcgagcatt

SEQ ID NO: 7773821 - DNA, 22 bp, Homo sapiens
ttttcatttttgtagatgcaag

SEQ ID NO: 7773822 - DNA, 22 bp, Homo sapiens
ttttcatttttgtagatgcaag

SEQ ID NO: 7773823 - DNA, 22 bp, Homo sapiens
ttttccaccttctagagattgt

SEQ ID NO: 7773824 - DNA, 22 bp, Homo sapiens
ttttctattcattgtctatggt

SEQ ID NO: 7773825 - DNA, 22 bp, Homo sapiens
ttttccaaagtaccatgtccct

SEQ ID NO: 7773826 - DNA, 19 bp, Homo sapiens
ttttccacagaaatatgtt

SEQ ID NO: 7773827 - DNA, 22 bp, Homo sapiens
ttttccaaattagaagtagaga

SEQ ID NO: 7773828 - DNA, 22 bp, Homo sapiens
ttttcttactgtctgtgatcct

SEQ ID NO: 7773829 - DNA, 22 bp, Homo sapiens
ttttctgtgattctgaggttgg

SEQ ID NO: 7773830 - DNA, 22 bp, Homo sapiens
ttttctgttacaaagtacagcg

SEQ ID NO: 7773831 - DNA, 22 bp, Homo sapiens
ttttctgtattattgtgcttca

SEQ ID NO: 7773832 - DNA, 22 bp, Homo sapiens
ttttctgtaagaggactttaat

SEQ ID NO: 7773833 - DNA, 22 bp, Homo sapiens
ttttctgactctattgaggtat

SEQ ID NO: 7773834 - DNA, 22 bp, Homo sapiens
ttttctgacctatctacattta

SEQ ID NO: 7773835 - DNA, 22 bp, Homo sapiens
ttttaaagagatgctgtgcata

SEQ ID NO: 7773836 - DNA, 22 bp, Homo sapiens
ttttaaaggatactcttgtcta

SEQ ID NO: 7773837 - DNA, 22 bp, Homo sapiens
ttttaaactgcagaatttagaa

SEQ ID NO: 7773838 - DNA, 22 bp, Homo sapiens
ttttaaactgcagaatttagaa

SEQ ID NO: 7773839 - DNA, 21 bp, Homo sapiens
ttttaacaaggatttccctag

SEQ ID NO: 7773840 - DNA, 22 bp, Homo sapiens
ttttaatgtgctctgcaatgat

SEQ ID NO: 7773841 - DNA, 22 bp, Homo sapiens
ttttaattcaaagtgaatagtg

SEQ ID NO: 7773842 - DNA, 22 bp, Homo sapiens
ttttaatgggcgactattatgg

SEQ ID NO: 7773843 - DNA, 22 bp, Homo sapiens
ttttaatgggcgactattatgg

SEQ ID NO: 7773844 - DNA, 22 bp, Homo sapiens
ttttaagaaatgtatgactgtc

SEQ ID NO: 7773845 - DNA, 22 bp, Homo sapiens
ttttaatactgctattgtagga

SEQ ID NO: 7773846 - DNA, 23 bp, Homo sapiens
ttttaatttggacataagaagat

SEQ ID NO: 7773847 - DNA, 22 bp, Homo sapiens
ttttatgtcataaggacactca

SEQ ID NO: 7773848 - DNA, 22 bp, Homo sapiens
ttttatgtaatccttactgtcg

SEQ ID NO: 7773849 - DNA, 22 bp, Homo sapiens
tttgtaaagtctgttctgagtt

SEQ ID NO: 7773850 - DNA, 22 bp, Homo sapiens
tttgtaaaaggaggaagcatgg

SEQ ID NO: 7773851 - DNA, 22 bp, Homo sapiens
tttgtaaaaggaggaagcatgg

SEQ ID NO: 7773852 - DNA, 22 bp, Homo sapiens
tttgtaaaaggaggaagcatgg

SEQ ID NO: 7773853 - DNA, 22 bp, Homo sapiens
tttgtaaaattagggaattcaa

SEQ ID NO: 7773854 - DNA, 22 bp, Homo sapiens
tttgtaagtggtagatctaaga

SEQ ID NO: 7773855 - DNA, 22 bp, Homo sapiens
tttgtgtggatggaaggcagta

SEQ ID NO: 7773856 - DNA, 22 bp, Homo sapiens
tttgtgtggcgttggccggcgg

SEQ ID NO: 7773857 - DNA, 22 bp, Homo sapiens
tttgtgtttgtacaatgcacta

SEQ ID NO: 7773858 - DNA, 22 bp, Homo sapiens
tttgtgttgttttaagccacta

SEQ ID NO: 7773859 - DNA, 22 bp, Homo sapiens
tttgtgtttaatacaaggacct

SEQ ID NO: 7773860 - DNA, 22 bp, Homo sapiens
tttgtgttttagctggtgaggc

SEQ ID NO: 7773861 - DNA, 22 bp, Homo sapiens
tttttataactcttttgtgaca

SEQ ID NO: 7773862 - DNA, 22 bp, Homo sapiens
tttttataactcttttgtgaca

SEQ ID NO: 7773863 - DNA, 22 bp, Homo sapiens
tttttataccacctctcactta

SEQ ID NO: 7773864 - DNA, 22 bp, Homo sapiens
tttttataccacctctcactta

SEQ ID NO: 7773865 - DNA, 22 bp, Homo sapiens
tttttacagtcatggtcactca

SEQ ID NO: 7773866 - DNA, 22 bp, Homo sapiens
tttttacacttagcattgagcg

SEQ ID NO: 7773867 - DNA, 22 bp, Homo sapiens
tttttcacacatgtggcttgat

SEQ ID NO: 7773868 - DNA, 22 bp, Homo sapiens
tttttcatattcccctctctgg

SEQ ID NO: 7773869 - DNA, 22 bp, Homo sapiens
tttttcatctgattgataactc

SEQ ID NO: 7773870 - DNA, 22 bp, Homo sapiens
tttttataccacctctcactta

SEQ ID NO: 7773871 - DNA, 22 bp, Homo sapiens
tttttatactttgctcaagatt

SEQ ID NO: 7773872 - DNA, 22 bp, Homo sapiens
tttttataggtcagggcaagtc

SEQ ID NO: 7773873 - DNA, 22 bp, Homo sapiens
tttttatctacagattctcagc

SEQ ID NO: 7773874 - DNA, 22 bp, Homo sapiens
tttttatatgaaggatagtgcg

SEQ ID NO: 7773875 - DNA, 22 bp, Homo sapiens
tttttcaagacaacctgcatgt

SEQ ID NO: 7773876 - DNA, 22 bp, Homo sapiens
cacagagaattcccatatgtga

SEQ ID NO: 7773877 - DNA, 22 bp, Homo sapiens
cacagagacagatctattttgc

SEQ ID NO: 7773878 - DNA, 22 bp, Homo sapiens
cacagcaaagacactctcaact

SEQ ID NO: 7773879 - DNA, 22 bp, Homo sapiens
cacagcaaaggcttcggctgat

SEQ ID NO: 7773880 - DNA, 22 bp, Homo sapiens
cacagagaatgatgagtcactg

SEQ ID NO: 7773881 - DNA, 22 bp, Homo sapiens
ggacagcatatcagcagggcag

SEQ ID NO: 7773882 - DNA, 22 bp, Homo sapiens
ggagagctgaagcatggacagg

SEQ ID NO: 7773883 - DNA, 22 bp, Homo sapiens
ggagagtctgagcctgctggag

SEQ ID NO: 7773884 - DNA, 23 bp, Homo sapiens
ggacacagagataagtgagacaa

SEQ ID NO: 7773885 - DNA, 22 bp, Homo sapiens
ggacagagggttgacagagtat

SEQ ID NO: 7773886 - DNA, 22 bp, Homo sapiens
ggacacagataatcacacagat

SEQ ID NO: 7773887 - DNA, 19 bp, Homo sapiens
ggacacagaaagctgcatt

SEQ ID NO: 7773888 - DNA, 22 bp, Homo sapiens
ggacaagcctcagacaaaactc

SEQ ID NO: 7773889 - DNA, 22 bp, Homo sapiens
ggacaagcctgtgagtgggttt

SEQ ID NO: 7773890 - DNA, 22 bp, Homo sapiens
ggaacagggatttggcctggtt

SEQ ID NO: 7773891 - DNA, 22 bp, Homo sapiens
ggaacagggatttggcctggtt

SEQ ID NO: 7773892 - DNA, 22 bp, Homo sapiens
cacaggagaaaggggaagctcg

SEQ ID NO: 7773893 - DNA, 22 bp, Homo sapiens
cacaggagagctgggaggtgcc

SEQ ID NO: 7773894 - DNA, 22 bp, Homo sapiens
cacaggagaacccacagattct

SEQ ID NO: 7773895 - DNA, 18 bp, Homo sapiens
cacaggagatgacctgac

SEQ ID NO: 7773896 - DNA, 22 bp, Homo sapiens
cacagctgaagtagccatgtgg

SEQ ID NO: 7773897 - DNA, 22 bp, Homo sapiens
ggagggcaacttttcagtaggt

SEQ ID NO: 7773898 - DNA, 22 bp, Homo sapiens
cacagcctcctctggctcacgg

SEQ ID NO: 7773899 - DNA, 22 bp, Homo sapiens
cacagcagggatgaatggagtg

SEQ ID NO: 7773900 - DNA, 22 bp, Homo sapiens
cacagcagggcatggctgttgt

SEQ ID NO: 7773901 - DNA, 22 bp, Homo sapiens
cacagcagtctttcactaaata

SEQ ID NO: 7773902 - DNA, 21 bp, Homo sapiens
cacagcagggttcctgggctc

SEQ ID NO: 7773903 - DNA, 22 bp, Homo sapiens
ggaggagcacttgacggggtct

SEQ ID NO: 7773904 - DNA, 22 bp, Homo sapiens
ggaggagcacttctgagctcag

SEQ ID NO: 7773905 - DNA, 22 bp, Homo sapiens
ggagcagcttgcatgctcaggg

SEQ ID NO: 7773906 - DNA, 22 bp, Homo sapiens
ggagcagcttgcatgctcaggg

SEQ ID NO: 7773907 - DNA, 22 bp, Homo sapiens
gctggcagccaagtgaagaggg

SEQ ID NO: 7773908 - DNA, 22 bp, Homo sapiens
gctggcagccaagtgaagaggg

SEQ ID NO: 7773909 - DNA, 19 bp, Homo sapiens
gctggcagatgtggccgtg

SEQ ID NO: 7773910 - DNA, 22 bp, Homo sapiens
gctggcagcattagaccctggg

SEQ ID NO: 7773911 - DNA, 22 bp, Homo sapiens
gctggcagcattagaccctggg

SEQ ID NO: 7773912 - DNA, 22 bp, Homo sapiens
gctggcagcattagaccctggg

SEQ ID NO: 7773913 - DNA, 19 bp, Homo sapiens
gctggcagatgtggccgtg

SEQ ID NO: 7773914 - DNA, 19 bp, Homo sapiens
gctggcagatgtggccgtg

SEQ ID NO: 7773915 - DNA, 20 bp, Homo sapiens
gctggcagatgtcttgagat

SEQ ID NO: 7773916 - DNA, 20 bp, Homo sapiens
gctggcagatgtcttgagat

SEQ ID NO: 7773917 - DNA, 22 bp, Homo sapiens
gctggcagagagctggtgagga

SEQ ID NO: 7773918 - DNA, 22 bp, Homo sapiens
gctggcagagctctgggctggg

SEQ ID NO: 7773919 - DNA, 22 bp, Homo sapiens
gctggcagagctctgggctggg

SEQ ID NO: 7773920 - DNA, 22 bp, Homo sapiens
gctggcagagctctgggctggg

SEQ ID NO: 7773921 - DNA, 22 bp, Homo sapiens
gctggcagagagctggtgagga

SEQ ID NO: 7773922 - DNA, 22 bp, Homo sapiens
gctggcagagagctggtgagga

SEQ ID NO: 7773923 - DNA, 16 bp, Homo sapiens
gctggagggaggggtt

SEQ ID NO: 7773924 - DNA, 22 bp, Homo sapiens
gctggaggctggagtgcagtgg

SEQ ID NO: 7773925 - DNA, 22 bp, Homo sapiens
gctgaggtaggaggttgcagtg

SEQ ID NO: 7773926 - DNA, 22 bp, Homo sapiens
caaatttaggtaacagtctgta

SEQ ID NO: 7773927 - DNA, 23 bp, Homo sapiens
caaattctaggcaggctcttttg

SEQ ID NO: 7773928 - DNA, 18 bp, Homo sapiens
caaattctcattgatttc

SEQ ID NO: 7773929 - DNA, 22 bp, Homo sapiens
caaattctcaccctgtttgatt

SEQ ID NO: 7773930 - DNA, 22 bp, Homo sapiens
caaattctcttactgtttgaca

SEQ ID NO: 7773931 - DNA, 20 bp, Homo sapiens
caaattctgttgaatacacc

SEQ ID NO: 7773932 - DNA, 20 bp, Homo sapiens
caaattctgttgaatacacc

SEQ ID NO: 7773933 - DNA, 22 bp, Homo sapiens
caaatttaagttagaaagcaat

SEQ ID NO: 7773934 - DNA, 22 bp, Homo sapiens
gctgggccccttgaaaggcgtc

SEQ ID NO: 7773935 - DNA, 22 bp, Homo sapiens
gctgggaggaatttggggaata

SEQ ID NO: 7773936 - DNA, 22 bp, Homo sapiens
gctgggaggaatttggggaata

SEQ ID NO: 7773937 - DNA, 22 bp, Homo sapiens
gctgggagccgtacctgtcacg

SEQ ID NO: 7773938 - DNA, 22 bp, Homo sapiens
gctgggccagagcagcagcact

SEQ ID NO: 7773939 - DNA, 22 bp, Homo sapiens
gctgggagccccgagccagcgc

SEQ ID NO: 7773940 - DNA, 22 bp, Homo sapiens
gctgggagccccgagccagcgc

SEQ ID NO: 7773941 - DNA, 22 bp, Homo sapiens
gctgggagccccgagccagcgc

SEQ ID NO: 7773942 - DNA, 19 bp, Homo sapiens
gctgggagcagaccctccc

SEQ ID NO: 7773943 - DNA, 22 bp, Homo sapiens
gctgggagcaagtactcatctt

SEQ ID NO: 7773944 - DNA, 22 bp, Homo sapiens
gctggctgtgattttgccaaca

SEQ ID NO: 7773945 - DNA, 21 bp, Homo sapiens
gctggctgtctcttacacggt

SEQ ID NO: 7773946 - DNA, 22 bp, Homo sapiens
gctgggagcaaagccatgcata

SEQ ID NO: 7773947 - DNA, 22 bp, Homo sapiens
gctggccatggggagtgaggag

SEQ ID NO: 7773948 - DNA, 22 bp, Homo sapiens
gctggccatatattttgctgtt

SEQ ID NO: 7773949 - DNA, 22 bp, Homo sapiens
gctggccatggcctgcgccatc

SEQ ID NO: 7773950 - DNA, 22 bp, Homo sapiens
gctggccagtgtggtgaccacc

SEQ ID NO: 7773951 - DNA, 22 bp, Homo sapiens
gctggccatagaagccaaagag

SEQ ID NO: 7773952 - DNA, 19 bp, Homo sapiens
gcttccagcactgcaggag

SEQ ID NO: 7773953 - DNA, 22 bp, Homo sapiens
gcttccagcaccagcagagggg

SEQ ID NO: 7773954 - DNA, 22 bp, Homo sapiens
gcttccagcaccagcagagggg

SEQ ID NO: 7773955 - DNA, 22 bp, Homo sapiens
ggaacacaaatgggagagctgg

SEQ ID NO: 7773956 - DNA, 22 bp, Homo sapiens
ggaaatggtggaggaaggctta

SEQ ID NO: 7773957 - DNA, 22 bp, Homo sapiens
caatggcctcccaagcaggggg

SEQ ID NO: 7773958 - DNA, 22 bp, Homo sapiens
caatgcttctgagggaattaca

SEQ ID NO: 7773959 - DNA, 22 bp, Homo sapiens
gctggtggcagagacatcaggt

SEQ ID NO: 7773960 - DNA, 22 bp, Homo sapiens
gctggtgattgcctcaggaggc

SEQ ID NO: 7773961 - DNA, 22 bp, Homo sapiens
gctgggctcaccaggccactag

SEQ ID NO: 7773962 - DNA, 22 bp, Homo sapiens
caagtgatcctcccatcttggc

SEQ ID NO: 7773963 - DNA, 22 bp, Homo sapiens
caagtgcatggtggcaaagaat

SEQ ID NO: 7773964 - DNA, 22 bp, Homo sapiens
caagttaattggtattttgatc

SEQ ID NO: 7773965 - DNA, 22 bp, Homo sapiens
caagttattcctttacactata

SEQ ID NO: 7773966 - DNA, 22 bp, Homo sapiens
caagttcattgtagcattattg

SEQ ID NO: 7773967 - DNA, 22 bp, Homo sapiens
caagttgtttaggaggtgttgt

SEQ ID NO: 7773968 - DNA, 22 bp, Homo sapiens
caagttgtgaatgacagacttc

SEQ ID NO: 7773969 - DNA, 22 bp, Homo sapiens
ggctgcagcggattggggattg

SEQ ID NO: 7773970 - DNA, 22 bp, Homo sapiens
cactgcctccccaggctccaca

SEQ ID NO: 7773971 - DNA, 22 bp, Homo sapiens
ggctgcagatagccagccacca

SEQ ID NO: 7773972 - DNA, 22 bp, Homo sapiens
ggctgcctttagaacggatgct

SEQ ID NO: 7773973 - DNA, 22 bp, Homo sapiens
cactgtctgcttcgactcttca

SEQ ID NO: 7773974 - DNA, 22 bp, Homo sapiens
ggctgcctcagatttgctgact

SEQ ID NO: 7773975 - DNA, 22 bp, Homo sapiens
ggctgccttgaccctggctccg

SEQ ID NO: 7773976 - DNA, 22 bp, Homo sapiens
cactgaggctgggggagaaggt

SEQ ID NO: 7773977 - DNA, 22 bp, Homo sapiens
cactgagggcggagcccaggga

SEQ ID NO: 7773978 - DNA, 22 bp, Homo sapiens
cactgagggggtggtttcagga

SEQ ID NO: 7773979 - DNA, 22 bp, Homo sapiens
cactgagggagggtttcttctg

SEQ ID NO: 7773980 - DNA, 22 bp, Homo sapiens
cactgagggagggtttcttctg

SEQ ID NO: 7773981 - DNA, 22 bp, Homo sapiens
cactgaggcttccttaggcaat

SEQ ID NO: 7773982 - DNA, 22 bp, Homo sapiens
cactgcaaaggggaaagaagca

SEQ ID NO: 7773983 - DNA, 20 bp, Homo sapiens
cactgaggtgcagctcatgc

SEQ ID NO: 7773984 - DNA, 19 bp, Homo sapiens
ggctcctggggctcagccc

SEQ ID NO: 7773985 - DNA, 22 bp, Homo sapiens
ggctcctgtcccctcagctgct

SEQ ID NO: 7773986 - DNA, 19 bp, Homo sapiens
ggctcctgtggctgcagcc

SEQ ID NO: 7773987 - DNA, 19 bp, Homo sapiens
ggctcctgtggctgcagcc

SEQ ID NO: 7773988 - DNA, 19 bp, Homo sapiens
ggctcctgtggctgcagcc

SEQ ID NO: 7773989 - DNA, 20 bp, Homo sapiens
ggcttcttcaggtgtctatt

SEQ ID NO: 7773990 - DNA, 22 bp, Homo sapiens
ggctgggagctggacaggccgg

SEQ ID NO: 7773991 - DNA, 22 bp, Homo sapiens
ggcttgcacacagcctcagttt

SEQ ID NO: 7773992 - DNA, 22 bp, Homo sapiens
ggcttggagtcatactgagaat

SEQ ID NO: 7773993 - DNA, 22 bp, Homo sapiens
cagaacagacttaacagggctg

SEQ ID NO: 7773994 - DNA, 22 bp, Homo sapiens
cagaaatgtactgacatgcagt

SEQ ID NO: 7773995 - DNA, 23 bp, Homo sapiens
cagaaatgacagtaagcaccctg

SEQ ID NO: 7773996 - DNA, 22 bp, Homo sapiens
ggctgctggtaggggtaggaag

SEQ ID NO: 7773997 - DNA, 22 bp, Homo sapiens
ggctgggagccccacagagtca

SEQ ID NO: 7773998 - DNA, 22 bp, Homo sapiens
ggagtctgggaattggagagaa

SEQ ID NO: 7773999 - DNA, 22 bp, Homo sapiens
cacaggagattgatctattggt

SEQ ID NO: 7774000 - DNA, 22 bp, Homo sapiens
ggagtgactctcggggccacta

SEQ ID NO: 7774001 - DNA, 22 bp, Homo sapiens
ggagtgactcacagctgggaca

SEQ ID NO: 7774002 - DNA, 22 bp, Homo sapiens
ggcaggaacacagatggtgccg

SEQ ID NO: 7774003 - DNA, 22 bp, Homo sapiens
ggcaggaagaggagggtgaact

SEQ ID NO: 7774004 - DNA, 22 bp, Homo sapiens
ggcaggaaatgggataagggct

SEQ ID NO: 7774005 - DNA, 22 bp, Homo sapiens
ggcagcttttatccctgacaga

SEQ ID NO: 7774006 - DNA, 22 bp, Homo sapiens
ggcaggaaaacaatgagccagg

SEQ ID NO: 7774007 - DNA, 22 bp, Homo sapiens
ggcagctgcaaatctgctctgt

SEQ ID NO: 7774008 - DNA, 22 bp, Homo sapiens
cacatgctcattggcactgttc

SEQ ID NO: 7774009 - DNA, 22 bp, Homo sapiens
ggcaggtgtggtgaccagagat

SEQ ID NO: 7774010 - DNA, 22 bp, Homo sapiens
ggcagtagccagggactggcag

SEQ ID NO: 7774011 - DNA, 22 bp, Homo sapiens
cacatttctgtgagtcaatatt

SEQ ID NO: 7774012 - DNA, 22 bp, Homo sapiens
cacatttctctacctcacacaa

SEQ ID NO: 7774013 - DNA, 22 bp, Homo sapiens
cacatgcattggcaaaagtgta

SEQ ID NO: 7774014 - DNA, 22 bp, Homo sapiens
cacatgcatctgtcatgtttgg

SEQ ID NO: 7774015 - DNA, 21 bp, Homo sapiens
cacatgcatgcacaggttgta

SEQ ID NO: 7774016 - DNA, 22 bp, Homo sapiens
cacatgcagttttccagcagtc

SEQ ID NO: 7774017 - DNA, 20 bp, Homo sapiens
ggcaggaccccagtggcatc

SEQ ID NO: 7774018 - DNA, 22 bp, Homo sapiens
ggcaggaataaattatggactt

SEQ ID NO: 7774019 - DNA, 22 bp, Homo sapiens
ggcaggacaggggaatgtttgg

SEQ ID NO: 7774020 - DNA, 22 bp, Homo sapiens
ggcaggacagtcccagttcaaa

SEQ ID NO: 7774021 - DNA, 22 bp, Homo sapiens
ggcaggactctcaggaccaagc

SEQ ID NO: 7774022 - DNA, 20 bp, Homo sapiens
ggcaggacccggtagggagc

SEQ ID NO: 7774023 - DNA, 22 bp, Homo sapiens
ggcgagggagcagtgcggtggg

SEQ ID NO: 7774024 - DNA, 22 bp, Homo sapiens
ggcgccagcggtaagtaagaca

SEQ ID NO: 7774025 - DNA, 22 bp, Homo sapiens
ggcgccagcggtaagtaagaca

SEQ ID NO: 7774026 - DNA, 22 bp, Homo sapiens
ggcgccagcactgcagcgcctc

SEQ ID NO: 7774027 - DNA, 22 bp, Homo sapiens
ggcgccagcactgcagcgcctc

SEQ ID NO: 7774028 - DNA, 22 bp, Homo sapiens
ggccccaggcctttggtctggc

SEQ ID NO: 7774029 - DNA, 22 bp, Homo sapiens
ggccccagggattaggccaacc

SEQ ID NO: 7774030 - DNA, 22 bp, Homo sapiens
ggccccagcctcagtcccctga

SEQ ID NO: 7774031 - DNA, 22 bp, Homo sapiens
ggccccagcagaccctcctctg

SEQ ID NO: 7774032 - DNA, 22 bp, Homo sapiens
ggcccagcccgagtcagccttc

SEQ ID NO: 7774033 - DNA, 22 bp, Homo sapiens
ggcccagcatcttgtgaagttt

SEQ ID NO: 7774034 - DNA, 22 bp, Homo sapiens
ggcccagcatcttgtgaagttt

SEQ ID NO: 7774035 - DNA, 22 bp, Homo sapiens
ggcccagcacagtgcttggggg

SEQ ID NO: 7774036 - DNA, 22 bp, Homo sapiens
ggcccagagctccctggcacct

SEQ ID NO: 7774037 - DNA, 22 bp, Homo sapiens
ggccagctcagggtccttgggc

SEQ ID NO: 7774038 - DNA, 22 bp, Homo sapiens
cacccaggcaggtggctgagaa

SEQ ID NO: 7774039 - DNA, 22 bp, Homo sapiens
cacccaggctagagtgcagtgg

SEQ ID NO: 7774040 - DNA, 22 bp, Homo sapiens
cacccaggacaggccagatgtg

SEQ ID NO: 7774041 - DNA, 22 bp, Homo sapiens
cacccaggcaaggattctgcaa

SEQ ID NO: 7774042 - DNA, 19 bp, Homo sapiens
cacattttgagtctgagat

SEQ ID NO: 7774043 - DNA, 22 bp, Homo sapiens
cacatttttactgccaacttaa

SEQ ID NO: 7774044 - DNA, 23 bp, Homo sapiens
ggccactttgtgtcagtatgtgc

SEQ ID NO: 7774045 - DNA, 18 bp, Homo sapiens
ggccagccccaggccagc

SEQ ID NO: 7774046 - DNA, 22 bp, Homo sapiens
ggccagcctggggctcccagac

SEQ ID NO: 7774047 - DNA, 22 bp, Homo sapiens
ggccagcctggggctcccagac

SEQ ID NO: 7774048 - DNA, 22 bp, Homo sapiens
ggccagcctggggctcccagac

SEQ ID NO: 7774049 - DNA, 22 bp, Homo sapiens
gtcctctgtgtaggctgcagac

SEQ ID NO: 7774050 - DNA, 22 bp, Homo sapiens
gtcctgagtcaagtgtgggcag

SEQ ID NO: 7774051 - DNA, 22 bp, Homo sapiens
cagcatcttcatgtgcatctcc

SEQ ID NO: 7774052 - DNA, 22 bp, Homo sapiens
gtctcaaactcctaggctaaag

SEQ ID NO: 7774053 - DNA, 22 bp, Homo sapiens
gtctcaaactcctaggctaaag

SEQ ID NO: 7774054 - DNA, 20 bp, Homo sapiens
gtctcaagtatctcacagtc

SEQ ID NO: 7774055 - DNA, 22 bp, Homo sapiens
gtcctgtgggcccaccatgagc

SEQ ID NO: 7774056 - DNA, 22 bp, Homo sapiens
gtcctgtgtaagccaggacaat

SEQ ID NO: 7774057 - DNA, 22 bp, Homo sapiens
cagcaggtgggctttgcggatg

SEQ ID NO: 7774058 - DNA, 22 bp, Homo sapiens
cagcaggtgtctagcaagggtc

SEQ ID NO: 7774059 - DNA, 22 bp, Homo sapiens
cagcagtggaactacccaggga

SEQ ID NO: 7774060 - DNA, 22 bp, Homo sapiens
gtgcagctactccttggtccta

SEQ ID NO: 7774061 - DNA, 22 bp, Homo sapiens
gtgcaaatgtaattgccattga

SEQ ID NO: 7774062 - DNA, 22 bp, Homo sapiens
gtgcaaatgattctaatgggta

SEQ ID NO: 7774063 - DNA, 22 bp, Homo sapiens
gtgcaaatgtaattgcagtttt

SEQ ID NO: 7774064 - DNA, 22 bp, Homo sapiens
gtgcaaatacatatgctgtgga

SEQ ID NO: 7774065 - DNA, 18 bp, Homo sapiens
gtgcaaatacttgctgac

SEQ ID NO: 7774066 - DNA, 22 bp, Homo sapiens
gtgcaaatgagatggattcaag

SEQ ID NO: 7774067 - DNA, 22 bp, Homo sapiens
gtgcaaaatttggccaataaca

SEQ ID NO: 7774068 - DNA, 22 bp, Homo sapiens
gtgcaggagccaggggtaggaa

SEQ ID NO: 7774069 - DNA, 22 bp, Homo sapiens
gtgcaggagcaggagccatgtc

SEQ ID NO: 7774070 - DNA, 22 bp, Homo sapiens
gtgcaggagcaggagccatgtc

SEQ ID NO: 7774071 - DNA, 22 bp, Homo sapiens
gtgcagctgtggtggagccagg

SEQ ID NO: 7774072 - DNA, 22 bp, Homo sapiens
gtgcagcttcctggtctcagcc

SEQ ID NO: 7774073 - DNA, 22 bp, Homo sapiens
gtgcagctgtgtgagagctcca

SEQ ID NO: 7774074 - DNA, 22 bp, Homo sapiens
gtgcagctgcttgcctggttag

SEQ ID NO: 7774075 - DNA, 16 bp, Homo sapiens
gtgcagctgcctggta

SEQ ID NO: 7774076 - DNA, 22 bp, Homo sapiens
gtgcagctgccgatcagatagg

SEQ ID NO: 7774077 - DNA, 22 bp, Homo sapiens
gtgcagctgggcgctgaccttc

SEQ ID NO: 7774078 - DNA, 22 bp, Homo sapiens
gtgcagctggtggagtctgggg

SEQ ID NO: 7774079 - DNA, 22 bp, Homo sapiens
gtgcagctcagttgaaatgcag

SEQ ID NO: 7774080 - DNA, 22 bp, Homo sapiens
gtgcagctgaaggctggccagc

SEQ ID NO: 7774081 - DNA, 22 bp, Homo sapiens
gtgcagctgcccaagcctgagc

SEQ ID NO: 7774082 - DNA, 22 bp, Homo sapiens
gtgcagctgcaggagtcaggtc

SEQ ID NO: 7774083 - DNA, 22 bp, Homo sapiens
gtgcagctgagggcctcttcta

SEQ ID NO: 7774084 - DNA, 22 bp, Homo sapiens
gtctccacagcccagctgccac

SEQ ID NO: 7774085 - DNA, 22 bp, Homo sapiens
gtctcttagaatcgcatattgt

SEQ ID NO: 7774086 - DNA, 22 bp, Homo sapiens
gtctttggaaagacaaagttca

SEQ ID NO: 7774087 - DNA, 22 bp, Homo sapiens
gtctttggaaagacaaagttca

SEQ ID NO: 7774088 - DNA, 18 bp, Homo sapiens
gtctttggagtggaggta

SEQ ID NO: 7774089 - DNA, 22 bp, Homo sapiens
gtctttggaggcactgttgagt

SEQ ID NO: 7774090 - DNA, 22 bp, Homo sapiens
gtctttggagaggtgccatttc

SEQ ID NO: 7774091 - DNA, 22 bp, Homo sapiens
gtctttggagaggtgccatttc

SEQ ID NO: 7774092 - DNA, 22 bp, Homo sapiens
gtctttggatgtaagataaagt

SEQ ID NO: 7774093 - DNA, 22 bp, Homo sapiens
gtctttggaggcactgttgagt

SEQ ID NO: 7774094 - DNA, 18 bp, Homo sapiens
gtctttggagtggaggta

SEQ ID NO: 7774095 - DNA, 18 bp, Homo sapiens
gtctttggagtggaggta

SEQ ID NO: 7774096 - DNA, 22 bp, Homo sapiens
gtctttggatgtaagataaagt

SEQ ID NO: 7774097 - DNA, 22 bp, Homo sapiens
gtctttcttaaacaacagaaca

SEQ ID NO: 7774098 - DNA, 22 bp, Homo sapiens
gtctttctgctgcacggactgc

SEQ ID NO: 7774099 - DNA, 22 bp, Homo sapiens
gtctttcttaaacaacagaaca

SEQ ID NO: 7774100 - DNA, 22 bp, Homo sapiens
gtctttctatgcatagagcaga

SEQ ID NO: 7774101 - DNA, 22 bp, Homo sapiens
gtctttctctggaacagtaaaa

SEQ ID NO: 7774102 - DNA, 19 bp, Homo sapiens
gtcttacaggcaacatgag

SEQ ID NO: 7774103 - DNA, 22 bp, Homo sapiens
gtcttagatttcaccgataatg

SEQ ID NO: 7774104 - DNA, 22 bp, Homo sapiens
gtctgttagtgataactgtttt

SEQ ID NO: 7774105 - DNA, 22 bp, Homo sapiens
gtctcttagtcaatattttctg

SEQ ID NO: 7774106 - DNA, 22 bp, Homo sapiens
gtctcttagtctcattttctgc

SEQ ID NO: 7774107 - DNA, 22 bp, Homo sapiens
cagctcctagatcggcgaagtg

SEQ ID NO: 7774108 - DNA, 22 bp, Homo sapiens
cagctcccctctgtggggcagt

SEQ ID NO: 7774109 - DNA, 22 bp, Homo sapiens
cagctctgaggaacactccttt

SEQ ID NO: 7774110 - DNA, 22 bp, Homo sapiens
cagctcagcttcctgggtgtgt

SEQ ID NO: 7774111 - DNA, 21 bp, Homo sapiens
cagctccactaaagcagctgt

SEQ ID NO: 7774112 - DNA, 22 bp, Homo sapiens
gtgctgagcatcatgaggcact

SEQ ID NO: 7774113 - DNA, 22 bp, Homo sapiens
gtgctgagattggagtgagcag

SEQ ID NO: 7774114 - DNA, 22 bp, Homo sapiens
gtgcctggtatgtaggtagcgg

SEQ ID NO: 7774115 - DNA, 22 bp, Homo sapiens
gtgcctggggttgagctatgaa

SEQ ID NO: 7774116 - DNA, 22 bp, Homo sapiens
gtgcattagtttcctattgctg

SEQ ID NO: 7774117 - DNA, 22 bp, Homo sapiens
gtgcattacatgtaataaaata

SEQ ID NO: 7774118 - DNA, 22 bp, Homo sapiens
gtgcattaacaacccagaactc

SEQ ID NO: 7774119 - DNA, 22 bp, Homo sapiens
gtgcattaggctggaatgttga

SEQ ID NO: 7774120 - DNA, 22 bp, Homo sapiens
gtgcattattcttacctttctt

SEQ ID NO: 7774121 - DNA, 22 bp, Homo sapiens
cagccctgtgcggagggccctg

SEQ ID NO: 7774122 - DNA, 22 bp, Homo sapiens
gtgcatctgaatttgaaaatct

SEQ ID NO: 7774123 - DNA, 22 bp, Homo sapiens
cagaggaaggctctgggaatgt

SEQ ID NO: 7774124 - DNA, 22 bp, Homo sapiens
cagaggaagctgggtgtggagt

SEQ ID NO: 7774125 - DNA, 22 bp, Homo sapiens
cagaggaagcagacacatcttg

SEQ ID NO: 7774126 - DNA, 22 bp, Homo sapiens
cagaggacctgtgtggccagag

SEQ ID NO: 7774127 - DNA, 22 bp, Homo sapiens
cagaggcaggaagatgggcagt

SEQ ID NO: 7774128 - DNA, 22 bp, Homo sapiens
cagaggcagccgggggagaacg

SEQ ID NO: 7774129 - DNA, 22 bp, Homo sapiens
cagaggcagaggtcatctctgg

SEQ ID NO: 7774130 - DNA, 22 bp, Homo sapiens
cagagctttggctagatggttg

SEQ ID NO: 7774131 - DNA, 22 bp, Homo sapiens
cagaggaaatgggaaggagata

SEQ ID NO: 7774132 - DNA, 22 bp, Homo sapiens
cagaggaagagatacaagccct

SEQ ID NO: 7774133 - DNA, 22 bp, Homo sapiens
cagaggaagagatacaagccct

SEQ ID NO: 7774134 - DNA, 22 bp, Homo sapiens
cagagctgtcatttgccagtga

SEQ ID NO: 7774135 - DNA, 22 bp, Homo sapiens
gggctcaggcctggcctctcac

SEQ ID NO: 7774136 - DNA, 22 bp, Homo sapiens
cagagagcttagtgtgctgcat

SEQ ID NO: 7774137 - DNA, 22 bp, Homo sapiens
cagagagagtggggtgtggatt

SEQ ID NO: 7774138 - DNA, 22 bp, Homo sapiens
gggccctgcgactcgcggcgga

SEQ ID NO: 7774139 - DNA, 22 bp, Homo sapiens
gggccagctctgtgatgtaggg

SEQ ID NO: 7774140 - DNA, 22 bp, Homo sapiens
gggccaggagtggagatatggg

SEQ ID NO: 7774141 - DNA, 22 bp, Homo sapiens
gggccctgcgtccggaagtctg

SEQ ID NO: 7774142 - DNA, 22 bp, Homo sapiens
gggccctggacgtggcggcaga

SEQ ID NO: 7774143 - DNA, 22 bp, Homo sapiens
gggccctggacgtggcggcaga

SEQ ID NO: 7774144 - DNA, 22 bp, Homo sapiens
gggccctggccgaatccctctg

SEQ ID NO: 7774145 - DNA, 22 bp, Homo sapiens
gggccctggatttaagcatgga

SEQ ID NO: 7774146 - DNA, 18 bp, Homo sapiens
gggccctggcgtccgccc

SEQ ID NO: 7774147 - DNA, 22 bp, Homo sapiens
gggccctggctttcctgttctt

SEQ ID NO: 7774148 - DNA, 22 bp, Homo sapiens
cagagcagcctccagggggagc

SEQ ID NO: 7774149 - DNA, 22 bp, Homo sapiens
cagaagcagaacactagattta

SEQ ID NO: 7774150 - DNA, 22 bp, Homo sapiens
cagaagcagattctaaagcaag

SEQ ID NO: 7774151 - DNA, 22 bp, Homo sapiens
cagaagcacatgtttacatgta

SEQ ID NO: 7774152 - DNA, 23 bp, Homo sapiens
cagaagcacctgttgactgctgc

SEQ ID NO: 7774153 - DNA, 22 bp, Homo sapiens
cagaagcaagtagtgattcttt

SEQ ID NO: 7774154 - DNA, 22 bp, Homo sapiens
cagaagcaagggccaaagtctt

SEQ ID NO: 7774155 - DNA, 22 bp, Homo sapiens
cagaagcaaatgccttgctgag

SEQ ID NO: 7774156 - DNA, 18 bp, Homo sapiens
cagaagcaggcagtgcag

SEQ ID NO: 7774157 - DNA, 22 bp, Homo sapiens
cagagagaatatgtagtatgga

SEQ ID NO: 7774158 - DNA, 22 bp, Homo sapiens
cagagagagtcaaatctttgct

SEQ ID NO: 7774159 - DNA, 22 bp, Homo sapiens
cagagagaggccactgctatta

SEQ ID NO: 7774160 - DNA, 22 bp, Homo sapiens
ggggtgagatcaaggaagccct

SEQ ID NO: 7774161 - DNA, 22 bp, Homo sapiens
ggggtcacactgtggtgactgg

SEQ ID NO: 7774162 - DNA, 22 bp, Homo sapiens
ggggtcggggcatagccactta

SEQ ID NO: 7774163 - DNA, 22 bp, Homo sapiens
ggggtcctggaggccagctgga

SEQ ID NO: 7774164 - DNA, 22 bp, Homo sapiens
cagagtggtgcaagggcagtgt

SEQ ID NO: 7774165 - DNA, 22 bp, Homo sapiens
cagagtttaaacaaatgaaata

SEQ ID NO: 7774166 - DNA, 22 bp, Homo sapiens
cagagtttcggtaagcatagaa

SEQ ID NO: 7774167 - DNA, 22 bp, Homo sapiens
cagaggcctttctacagtgata

SEQ ID NO: 7774168 - DNA, 21 bp, Homo sapiens
cagaggctgagagggcaatct

SEQ ID NO: 7774169 - DNA, 22 bp, Homo sapiens
cagaggctgatgtgggatgggc

SEQ ID NO: 7774170 - DNA, 22 bp, Homo sapiens
ggggtagggtgattgtgaagta

SEQ ID NO: 7774171 - DNA, 22 bp, Homo sapiens
cagaggctgctctgggtggcat

SEQ ID NO: 7774172 - DNA, 22 bp, Homo sapiens
cagaggctgccagccatgtgca

SEQ ID NO: 7774173 - DNA, 22 bp, Homo sapiens
cagaggctgccagccatgtgca

SEQ ID NO: 7774174 - DNA, 22 bp, Homo sapiens
ggtgcagaggagccagctgggg

SEQ ID NO: 7774175 - DNA, 22 bp, Homo sapiens
ggtgcagagcagtgtcagagca

SEQ ID NO: 7774176 - DNA, 22 bp, Homo sapiens
ggtgcagaaggaagggagctgg

SEQ ID NO: 7774177 - DNA, 22 bp, Homo sapiens
ggtgcagaagaaagcagtcatt

SEQ ID NO: 7774178 - DNA, 20 bp, Homo sapiens
cagatgctggatcttggtcc

SEQ ID NO: 7774179 - DNA, 22 bp, Homo sapiens
cagataaatagatagataaact

SEQ ID NO: 7774180 - DNA, 22 bp, Homo sapiens
cagataaatagacttggtcaga

SEQ ID NO: 7774181 - DNA, 20 bp, Homo sapiens
cagataaacgggaaagaagc

SEQ ID NO: 7774182 - DNA, 20 bp, Homo sapiens
cagataaacgggaaagaagc

SEQ ID NO: 7774183 - DNA, 22 bp, Homo sapiens
cagataaaggcttactagtagt

SEQ ID NO: 7774184 - DNA, 22 bp, Homo sapiens
cagataaaggcttactagtagt

SEQ ID NO: 7774185 - DNA, 22 bp, Homo sapiens
cagatatattttatttggtcaa

SEQ ID NO: 7774186 - DNA, 22 bp, Homo sapiens
ggtgagaggcagaggacagctt

SEQ ID NO: 7774187 - DNA, 21 bp, Homo sapiens
cagcagaagcatctatggaag

SEQ ID NO: 7774188 - DNA, 22 bp, Homo sapiens
cagcagaagtccgactccagtc

SEQ ID NO: 7774189 - DNA, 20 bp, Homo sapiens
cagcagagacccatggggag

SEQ ID NO: 7774190 - DNA, 22 bp, Homo sapiens
gtaaacatcagccactctattt

SEQ ID NO: 7774191 - DNA, 20 bp, Homo sapiens
cagcagagacccatggggag

SEQ ID NO: 7774192 - DNA, 22 bp, Homo sapiens
ggtggcagtcttaagagatctt

SEQ ID NO: 7774193 - DNA, 22 bp, Homo sapiens
ggtggcagtagcactgggcctg

SEQ ID NO: 7774194 - DNA, 22 bp, Homo sapiens
ggtggcagggagtgtccctggg

SEQ ID NO: 7774195 - DNA, 22 bp, Homo sapiens
ggtgctggttcagggtggctgt

SEQ ID NO: 7774196 - DNA, 22 bp, Homo sapiens
ggtgctggttcagggtggctgt

SEQ ID NO: 7774197 - DNA, 22 bp, Homo sapiens
cagatgcttttgattctggggt

SEQ ID NO: 7774198 - DNA, 22 bp, Homo sapiens
ggtgggaaggccactgaaggtt

SEQ ID NO: 7774199 - DNA, 22 bp, Homo sapiens
ggtgggaaggccactgaaggtt

SEQ ID NO: 7774200 - DNA, 22 bp, Homo sapiens
cagcagaagcaacattcaggct

SEQ ID NO: 7774201 - DNA, 22 bp, Homo sapiens
cagcactgctgctgtacacaca

SEQ ID NO: 7774202 - DNA, 22 bp, Homo sapiens
ggtggcagttacaggggcaaat

SEQ ID NO: 7774203 - DNA, 22 bp, Homo sapiens
ggtggctggaggagctgatgga

SEQ ID NO: 7774204 - DNA, 18 bp, Homo sapiens
ggtgggaagccagggcct

SEQ ID NO: 7774205 - DNA, 22 bp, Homo sapiens
atgaatgagaaagctgaaatct

SEQ ID NO: 7774206 - DNA, 22 bp, Homo sapiens
atgaatgcagcactgtttttct

SEQ ID NO: 7774207 - DNA, 22 bp, Homo sapiens
atgaatgcatgcttattttgca

SEQ ID NO: 7774208 - DNA, 22 bp, Homo sapiens
atgaatgctgggacaaatatat

SEQ ID NO: 7774209 - DNA, 22 bp, Homo sapiens
atgaattgaggaaaacagtcgt

SEQ ID NO: 7774210 - DNA, 22 bp, Homo sapiens
ctttttccagcttcagggtggg

SEQ ID NO: 7774211 - DNA, 22 bp, Homo sapiens
atgaatgtacctgaaatagcct

SEQ ID NO: 7774212 - DNA, 22 bp, Homo sapiens
gaaaaccacctcccatcaagca

SEQ ID NO: 7774213 - DNA, 22 bp, Homo sapiens
ctttttccagcttcagggtggg

SEQ ID NO: 7774214 - DNA, 19 bp, Homo sapiens
gaaaacatgggtgagggtc

SEQ ID NO: 7774215 - DNA, 22 bp, Homo sapiens
gaaaatagttcatcacaatgat

SEQ ID NO: 7774216 - DNA, 22 bp, Homo sapiens
gaaaataggctgcatctccttc

SEQ ID NO: 7774217 - DNA, 22 bp, Homo sapiens
gaaaactaacggaaaagttagg

SEQ ID NO: 7774218 - DNA, 22 bp, Homo sapiens
gaaaacttggatctctagaatg

SEQ ID NO: 7774219 - DNA, 22 bp, Homo sapiens
gaaaacttggatctctagaatg

SEQ ID NO: 7774220 - DNA, 22 bp, Homo sapiens
atgaataaaacattttaatcag

SEQ ID NO: 7774221 - DNA, 22 bp, Homo sapiens
atcttcaattgaaaactagcct

SEQ ID NO: 7774222 - DNA, 22 bp, Homo sapiens
atcttcatcaagttcacagtgg

SEQ ID NO: 7774223 - DNA, 22 bp, Homo sapiens
atcttcaactttggggctgcct

SEQ ID NO: 7774224 - DNA, 22 bp, Homo sapiens
gaacatttgatgatgacattgg

SEQ ID NO: 7774225 - DNA, 22 bp, Homo sapiens
gaacattattgtacaaatgtct

SEQ ID NO: 7774226 - DNA, 22 bp, Homo sapiens
gaacatcatgaagaaaacatat

SEQ ID NO: 7774227 - DNA, 22 bp, Homo sapiens
atgcaatatgtgtttctgttta

SEQ ID NO: 7774228 - DNA, 22 bp, Homo sapiens
atgcaatttactgtacataaat

SEQ ID NO: 7774229 - DNA, 22 bp, Homo sapiens
atgcaatgttacagaatgtact

SEQ ID NO: 7774230 - DNA, 22 bp, Homo sapiens
atgcaatagtaattctagtctg

SEQ ID NO: 7774231 - DNA, 22 bp, Homo sapiens
atgcaataccttctgaaaataa

SEQ ID NO: 7774232 - DNA, 22 bp, Homo sapiens
atgcaatatagggaagatagat

SEQ ID NO: 7774233 - DNA, 22 bp, Homo sapiens
atgcaataaatactttccagct

SEQ ID NO: 7774234 - DNA, 18 bp, Homo sapiens
atgcaagctatggatttg

SEQ ID NO: 7774235 - DNA, 22 bp, Homo sapiens
atgcaagacccagaaatcatta

SEQ ID NO: 7774236 - DNA, 22 bp, Homo sapiens
atgcaaatgcagccattgcaga

SEQ ID NO: 7774237 - DNA, 22 bp, Homo sapiens
atgcaaatgctagagaatgttg

SEQ ID NO: 7774238 - DNA, 23 bp, Homo sapiens
atgcaagagtttctcaaactgga

SEQ ID NO: 7774239 - DNA, 22 bp, Homo sapiens
gaagaaacaggggcttggggag

SEQ ID NO: 7774240 - DNA, 22 bp, Homo sapiens
gaagaaactgaaaggggttggt

SEQ ID NO: 7774241 - DNA, 22 bp, Homo sapiens
gaaatgaactgattatcattgc

SEQ ID NO: 7774242 - DNA, 23 bp, Homo sapiens
gaaatctagtcatttttagtctg

SEQ ID NO: 7774243 - DNA, 22 bp, Homo sapiens
gaacataattaaatgtcctggg

SEQ ID NO: 7774244 - DNA, 22 bp, Homo sapiens
gaacataactattgtgaatagt

SEQ ID NO: 7774245 - DNA, 22 bp, Homo sapiens
gacccgtggcaggctgcctgct

SEQ ID NO: 7774246 - DNA, 22 bp, Homo sapiens
gaccctccactcactgctgtgt

SEQ ID NO: 7774247 - DNA, 22 bp, Homo sapiens
gaccccagaggaaggggcgccg

SEQ ID NO: 7774248 - DNA, 22 bp, Homo sapiens
gaccctgagcaaaagcagttct

SEQ ID NO: 7774249 - DNA, 22 bp, Homo sapiens
gaccctctagatggaagcactg

SEQ ID NO: 7774250 - DNA, 22 bp, Homo sapiens
gactttggattcattatctgga

SEQ ID NO: 7774251 - DNA, 22 bp, Homo sapiens
atgctttcttctttcctgtaag

SEQ ID NO: 7774252 - DNA, 22 bp, Homo sapiens
atgcttttccaggagaaatata

SEQ ID NO: 7774253 - DNA, 22 bp, Homo sapiens
atgctttatacaaaacacttaa

SEQ ID NO: 7774254 - DNA, 22 bp, Homo sapiens
atgcttaacttcctagtctata

SEQ ID NO: 7774255 - DNA, 22 bp, Homo sapiens
gacagggcatggtgcagagttc

SEQ ID NO: 7774256 - DNA, 22 bp, Homo sapiens
gacagtttaagcacctaatatt

SEQ ID NO: 7774257 - DNA, 23 bp, Homo sapiens
gacagggctgacttggcagctgc

SEQ ID NO: 7774258 - DNA, 22 bp, Homo sapiens
gaagcacatggctgtgagcaac

SEQ ID NO: 7774259 - DNA, 22 bp, Homo sapiens
atgcacaagaggctagaaaaga

SEQ ID NO: 7774260 - DNA, 22 bp, Homo sapiens
gaatgtaatagtcagtagaaca

SEQ ID NO: 7774261 - DNA, 22 bp, Homo sapiens
gaagcagagcctaaggcagaca

SEQ ID NO: 7774262 - DNA, 22 bp, Homo sapiens
atgcatacagatttaaaatttt

SEQ ID NO: 7774263 - DNA, 22 bp, Homo sapiens
atgcatataaggcacatgtatt

SEQ ID NO: 7774264 - DNA, 22 bp, Homo sapiens
atgcatatatacatacacagtc

SEQ ID NO: 7774265 - DNA, 22 bp, Homo sapiens
gacaggaaaggggtctgttttc

SEQ ID NO: 7774266 - DNA, 22 bp, Homo sapiens
gacaggaaatatgggggttgtt

SEQ ID NO: 7774267 - DNA, 22 bp, Homo sapiens
atgcctggactgacatgcactg

SEQ ID NO: 7774268 - DNA, 22 bp, Homo sapiens
atgcctctgctcttggtcctca

SEQ ID NO: 7774269 - DNA, 22 bp, Homo sapiens
atgcccccatctctgttggctc

SEQ ID NO: 7774270 - DNA, 22 bp, Homo sapiens
atgccccaggaggtgccatcca

SEQ ID NO: 7774271 - DNA, 22 bp, Homo sapiens
gaggctgctttgatgacaggag

SEQ ID NO: 7774272 - DNA, 22 bp, Homo sapiens
gaggctgtgtttcagtgaggcc

SEQ ID NO: 7774273 - DNA, 22 bp, Homo sapiens
gaggccacagtcctgaggcatc

SEQ ID NO: 7774274 - DNA, 22 bp, Homo sapiens
gagggaagaaagaattgatgcg

SEQ ID NO: 7774275 - DNA, 22 bp, Homo sapiens
gaggctgttagggcctgaggta

SEQ ID NO: 7774276 - DNA, 22 bp, Homo sapiens
gagggaaaataaaattgcagta

SEQ ID NO: 7774277 - DNA, 22 bp, Homo sapiens
gagggcagaaaattatgcggtg

SEQ ID NO: 7774278 - DNA, 22 bp, Homo sapiens
gagggggcgtgcaaggctccgc

SEQ ID NO: 7774279 - DNA, 22 bp, Homo sapiens
gagggggctccctgaagccagt

SEQ ID NO: 7774280 - DNA, 22 bp, Homo sapiens
gagggggctagcgcagtgccca

SEQ ID NO: 7774281 - DNA, 22 bp, Homo sapiens
gaggggggcgccctgcagtgca

SEQ ID NO: 7774282 - DNA, 22 bp, Homo sapiens
gagggggctctgccaacctgtc

SEQ ID NO: 7774283 - DNA, 22 bp, Homo sapiens
gagtccaggctgttgctcatct

SEQ ID NO: 7774284 - DNA, 22 bp, Homo sapiens
gagtccaggatttgagctctgt

SEQ ID NO: 7774285 - DNA, 22 bp, Homo sapiens
gaggtaattactatgttcagat

SEQ ID NO: 7774286 - DNA, 22 bp, Homo sapiens
gatctgggagcctcatggagac

SEQ ID NO: 7774287 - DNA, 22 bp, Homo sapiens
atgtttccatcaaatttgatga

SEQ ID NO: 7774288 - DNA, 22 bp, Homo sapiens
gatctgcactctgagaggcttg

SEQ ID NO: 7774289 - DNA, 22 bp, Homo sapiens
gagttaatactgagtttattaa

SEQ ID NO: 7774290 - DNA, 22 bp, Homo sapiens
gagttaatgtgtacacaaaggg

SEQ ID NO: 7774291 - DNA, 22 bp, Homo sapiens
gagttaattcgaatattctagc

SEQ ID NO: 7774292 - DNA, 21 bp, Homo sapiens
gagtgcaggtctgatgccatc

SEQ ID NO: 7774293 - DNA, 22 bp, Homo sapiens
atgtttatgttgggctatattt

SEQ ID NO: 7774294 - DNA, 22 bp, Homo sapiens
atgtttattttgcagagtaggg

SEQ ID NO: 7774295 - DNA, 22 bp, Homo sapiens
atgtttcaccagcaaattacct

SEQ ID NO: 7774296 - DNA, 22 bp, Homo sapiens
atgtttcaccagttttataaga

SEQ ID NO: 7774297 - DNA, 22 bp, Homo sapiens
atgtttcaaatatatagagttg

SEQ ID NO: 7774298 - DNA, 22 bp, Homo sapiens
atgtttcagatacagatcaaat

SEQ ID NO: 7774299 - DNA, 22 bp, Homo sapiens
atgtttcaggaaatcagctaga

SEQ ID NO: 7774300 - DNA, 22 bp, Homo sapiens
atgtttcaggcgaactaacatg

SEQ ID NO: 7774301 - DNA, 22 bp, Homo sapiens
gagttaaatgacttggttaagg

SEQ ID NO: 7774302 - DNA, 22 bp, Homo sapiens
gagttaaatagcttaggattca

SEQ ID NO: 7774303 - DNA, 22 bp, Homo sapiens
atgtttcatcagtaaggttttg

SEQ ID NO: 7774304 - DNA, 22 bp, Homo sapiens
atgtttcatgactgagcaaaat

SEQ ID NO: 7774305 - DNA, 22 bp, Homo sapiens
gagtccaggctgttgctcatct

SEQ ID NO: 7774306 - DNA, 22 bp, Homo sapiens
gagtccaggctggtcaaatagc

SEQ ID NO: 7774307 - DNA, 23 bp, Homo sapiens
gagtgcagaatagacatgcagtg

SEQ ID NO: 7774308 - DNA, 22 bp, Homo sapiens
gagtgcagatgaacagaagatt

SEQ ID NO: 7774309 - DNA, 22 bp, Homo sapiens
gagaggctggcagtgccaggtt

SEQ ID NO: 7774310 - DNA, 22 bp, Homo sapiens
gagaggctgatcctgcagagaa

SEQ ID NO: 7774311 - DNA, 22 bp, Homo sapiens
gagaggctgactggctgtcctg

SEQ ID NO: 7774312 - DNA, 22 bp, Homo sapiens
gagaggctgaaatcacaggagc

SEQ ID NO: 7774313 - DNA, 22 bp, Homo sapiens
gagaggctctgaggactggggt

SEQ ID NO: 7774314 - DNA, 22 bp, Homo sapiens
gagaggctctgaggactggggt

SEQ ID NO: 7774315 - DNA, 22 bp, Homo sapiens
gagaggctctgaggactggggt

SEQ ID NO: 7774316 - DNA, 22 bp, Homo sapiens
gagcagctaaaattctcatgca

SEQ ID NO: 7774317 - DNA, 22 bp, Homo sapiens
gagcagctagataaagcccttc

SEQ ID NO: 7774318 - DNA, 22 bp, Homo sapiens
gagcagctccagccgcatgact

SEQ ID NO: 7774319 - DNA, 22 bp, Homo sapiens
gagcagctcgagaaggaagcag

SEQ ID NO: 7774320 - DNA, 22 bp, Homo sapiens
gagcggaggcttggaggccagc

SEQ ID NO: 7774321 - DNA, 22 bp, Homo sapiens
gagcctgggactgggggtcatg

SEQ ID NO: 7774322 - DNA, 22 bp, Homo sapiens
gagcctggattgtcaccgactt

SEQ ID NO: 7774323 - DNA, 22 bp, Homo sapiens
gagcagctctgtgcctggagac

SEQ ID NO: 7774324 - DNA, 22 bp, Homo sapiens
gagcagctctgggtgacccagt

SEQ ID NO: 7774325 - DNA, 22 bp, Homo sapiens
gagcagggagacaactctggtg

SEQ ID NO: 7774326 - DNA, 22 bp, Homo sapiens
gagcagggagacaactctggtg

SEQ ID NO: 7774327 - DNA, 22 bp, Homo sapiens
gagcagggagacaactctggtg

SEQ ID NO: 7774328 - DNA, 17 bp, Homo sapiens
gagcagggatgcggttc

SEQ ID NO: 7774329 - DNA, 22 bp, Homo sapiens
atgtacaagctgttttactgca

SEQ ID NO: 7774330 - DNA, 22 bp, Homo sapiens
atgtacaaaatgttttgaaatg

SEQ ID NO: 7774331 - DNA, 22 bp, Homo sapiens
atgtacaaaatgttttgaaatg

SEQ ID NO: 7774332 - DNA, 22 bp, Homo sapiens
atgtcacagttgcaacatgaat

SEQ ID NO: 7774333 - DNA, 22 bp, Homo sapiens
atgtatttgaaatttgagacat

SEQ ID NO: 7774334 - DNA, 22 bp, Homo sapiens
atgtatttgaaatttgagacat

SEQ ID NO: 7774335 - DNA, 22 bp, Homo sapiens
atgtaatttatgttatccataa

SEQ ID NO: 7774336 - DNA, 22 bp, Homo sapiens
atgtaaggagccacagtggggg

SEQ ID NO: 7774337 - DNA, 22 bp, Homo sapiens
atgtaaattgtactgacacacg

SEQ ID NO: 7774338 - DNA, 22 bp, Homo sapiens
gaggaaggatttagtttgaggg

SEQ ID NO: 7774339 - DNA, 20 bp, Homo sapiens
atggttcaggccagctgtct

SEQ ID NO: 7774340 - DNA, 22 bp, Homo sapiens
atggttcatattatgcatctga

SEQ ID NO: 7774341 - DNA, 22 bp, Homo sapiens
gaggaaggaatgcagtgtatgc

SEQ ID NO: 7774342 - DNA, 22 bp, Homo sapiens
gaggaaggaatgcagtgtatgc

SEQ ID NO: 7774343 - DNA, 22 bp, Homo sapiens
gaggaaggagggaaagcgcgcg

SEQ ID NO: 7774344 - DNA, 22 bp, Homo sapiens
gaggaagccccattgaagccag

SEQ ID NO: 7774345 - DNA, 22 bp, Homo sapiens
gaggaagctgcgtggcatttca

SEQ ID NO: 7774346 - DNA, 22 bp, Homo sapiens
gagcttttactgctgtattgaa

SEQ ID NO: 7774347 - DNA, 22 bp, Homo sapiens
gaggaagcagggcttggctgag

SEQ ID NO: 7774348 - DNA, 22 bp, Homo sapiens
gagctttgcattattcagaagc

SEQ ID NO: 7774349 - DNA, 22 bp, Homo sapiens
gagctttgcctaaaactagaat

SEQ ID NO: 7774350 - DNA, 22 bp, Homo sapiens
gagctttggggaagaatacaga

SEQ ID NO: 7774351 - DNA, 22 bp, Homo sapiens
gagctttgctggaagcctgggg

SEQ ID NO: 7774352 - DNA, 22 bp, Homo sapiens
gagctttgtctcctggagaccc

SEQ ID NO: 7774353 - DNA, 22 bp, Homo sapiens
gagctttgtgctggtaggtggt

SEQ ID NO: 7774354 - DNA, 22 bp, Homo sapiens
gagctttgttccgtggtggcac

SEQ ID NO: 7774355 - DNA, 22 bp, Homo sapiens
gagctttgtaaaaaacttgcac

SEQ ID NO: 7774356 - DNA, 22 bp, Homo sapiens
gagctttggtgccaagtatttg

SEQ ID NO: 7774357 - DNA, 22 bp, Homo sapiens
gagctttgtagcaggaaggaag

SEQ ID NO: 7774358 - DNA, 22 bp, Homo sapiens
gagctttgtcccttgggggctc

SEQ ID NO: 7774359 - DNA, 22 bp, Homo sapiens
gagcttggtgctgcctgttgtc

SEQ ID NO: 7774360 - DNA, 22 bp, Homo sapiens
gagctttgatcgctaagcctca

SEQ ID NO: 7774361 - DNA, 22 bp, Homo sapiens
gagctttgagattcttatggta

SEQ ID NO: 7774362 - DNA, 22 bp, Homo sapiens
gagcttggtgatgcctcctggt

SEQ ID NO: 7774363 - DNA, 22 bp, Homo sapiens
gagcttgggtgccatgctgagc

SEQ ID NO: 7774364 - DNA, 22 bp, Homo sapiens
gcccagccagagctgtgtgatg

SEQ ID NO: 7774365 - DNA, 22 bp, Homo sapiens
gcccagcccagaaaggttcgga

SEQ ID NO: 7774366 - DNA, 22 bp, Homo sapiens
gcccagcaggacagagtggttt

SEQ ID NO: 7774367 - DNA, 22 bp, Homo sapiens
gcccagcaggggatggcagctc

SEQ ID NO: 7774368 - DNA, 22 bp, Homo sapiens
gcccagccacagtcactttcat

SEQ ID NO: 7774369 - DNA, 22 bp, Homo sapiens
gccagaggtatcaaagatagta

SEQ ID NO: 7774370 - DNA, 20 bp, Homo sapiens
gcccactctaatccactgtc

SEQ ID NO: 7774371 - DNA, 22 bp, Homo sapiens
gccagaggggctcgaaggcgcg

SEQ ID NO: 7774372 - DNA, 18 bp, Homo sapiens
gccagaggtactactgat

SEQ ID NO: 7774373 - DNA, 18 bp, Homo sapiens
gccagagggcccaaggtc

SEQ ID NO: 7774374 - DNA, 22 bp, Homo sapiens
gccagagggattcctggtgtgt

SEQ ID NO: 7774375 - DNA, 18 bp, Homo sapiens
gccagagggaagcaggtg

SEQ ID NO: 7774376 - DNA, 22 bp, Homo sapiens
atttactaatgtcatatcgcgt

SEQ ID NO: 7774377 - DNA, 22 bp, Homo sapiens
atttacatttatttgagaaggt

SEQ ID NO: 7774378 - DNA, 22 bp, Homo sapiens
atttaccatatgtactgagtat

SEQ ID NO: 7774379 - DNA, 22 bp, Homo sapiens
atttaccatatgtactgagtat

SEQ ID NO: 7774380 - DNA, 22 bp, Homo sapiens
atttaccagctgtgcactgata

SEQ ID NO: 7774381 - DNA, 23 bp, Homo sapiens
atttacaggttaaatgaaatcag

SEQ ID NO: 7774382 - DNA, 22 bp, Homo sapiens
atttacataatagactttaggt

SEQ ID NO: 7774383 - DNA, 23 bp, Homo sapiens
gccctccctcccaggtgggtgtt

SEQ ID NO: 7774384 - DNA, 22 bp, Homo sapiens
gccctcccctctgggtggtgag

SEQ ID NO: 7774385 - DNA, 23 bp, Homo sapiens
gccctgcccttagcacactcaca

SEQ ID NO: 7774386 - DNA, 22 bp, Homo sapiens
gccctgccctgagccgtagacc

SEQ ID NO: 7774387 - DNA, 22 bp, Homo sapiens
gccctgccctgagccgtagacc

SEQ ID NO: 7774388 - DNA, 22 bp, Homo sapiens
gccctgccctctcggcactcgc

SEQ ID NO: 7774389 - DNA, 22 bp, Homo sapiens
gccctccaccagagcccttctc

SEQ ID NO: 7774390 - DNA, 22 bp, Homo sapiens
gccctccagctgttgcgcgtcg

SEQ ID NO: 7774391 - DNA, 22 bp, Homo sapiens
gcccaggagttcaagtctagtg

SEQ ID NO: 7774392 - DNA, 22 bp, Homo sapiens
gcccagcccctgggtggacgtg

SEQ ID NO: 7774393 - DNA, 22 bp, Homo sapiens
gcccaggagttcaaggctgcag

SEQ ID NO: 7774394 - DNA, 22 bp, Homo sapiens
gcccaggagttcaagtctagtg

SEQ ID NO: 7774395 - DNA, 22 bp, Homo sapiens
atttgcatttagaaagatcact

SEQ ID NO: 7774396 - DNA, 22 bp, Homo sapiens
atttgccttgtgatttgtaagt

SEQ ID NO: 7774397 - DNA, 22 bp, Homo sapiens
atttgcatgcttctattgtgaa

SEQ ID NO: 7774398 - DNA, 21 bp, Homo sapiens
atttgcattaaaatattacgc

SEQ ID NO: 7774399 - DNA, 21 bp, Homo sapiens
atttgcattaaaatattacgc

SEQ ID NO: 7774400 - DNA, 22 bp, Homo sapiens
atttgcatttacatagcataga

SEQ ID NO: 7774401 - DNA, 22 bp, Homo sapiens
atttgcatttacatagcataga

SEQ ID NO: 7774402 - DNA, 23 bp, Homo sapiens
atttgacagagcatagcatttct

SEQ ID NO: 7774403 - DNA, 23 bp, Homo sapiens
atttgacagagcatagcatttct

SEQ ID NO: 7774404 - DNA, 22 bp, Homo sapiens
atttgacattgacacacctatg

SEQ ID NO: 7774405 - DNA, 22 bp, Homo sapiens
atttgattagctgtgtaatttt

SEQ ID NO: 7774406 - DNA, 22 bp, Homo sapiens
atttgcaattttactttgcagt

SEQ ID NO: 7774407 - DNA, 22 bp, Homo sapiens
atttgcataaggatgctactgt

SEQ ID NO: 7774408 - DNA, 22 bp, Homo sapiens
atttgcataatagtgatttgta

SEQ ID NO: 7774409 - DNA, 22 bp, Homo sapiens
gcctgcctagaattgcagcttt

SEQ ID NO: 7774410 - DNA, 22 bp, Homo sapiens
gcctgcctagaattgcagcttt

SEQ ID NO: 7774411 - DNA, 22 bp, Homo sapiens
gcctgcctagaattgcagcttt

SEQ ID NO: 7774412 - DNA, 22 bp, Homo sapiens
gcctgccctgaaagaggtgaag

SEQ ID NO: 7774413 - DNA, 21 bp, Homo sapiens
gcctgccctctgtgatggcca

SEQ ID NO: 7774414 - DNA, 21 bp, Homo sapiens
gcctgccctctgtgatggcca

SEQ ID NO: 7774415 - DNA, 22 bp, Homo sapiens
gcctgcccacggggctggcata

SEQ ID NO: 7774416 - DNA, 22 bp, Homo sapiens
attttacataaggaaggtttaa

SEQ ID NO: 7774417 - DNA, 22 bp, Homo sapiens
attttgaaaccaagttatttcc

SEQ ID NO: 7774418 - DNA, 22 bp, Homo sapiens
gcctggctcctaagagcacaac

SEQ ID NO: 7774419 - DNA, 22 bp, Homo sapiens
gctccaggcgagctggaccaga

SEQ ID NO: 7774420 - DNA, 23 bp, Homo sapiens
gctctatcaggaacaagccaggt

SEQ ID NO: 7774421 - DNA, 21 bp, Homo sapiens
gctctatcaggccaaaatgtc

SEQ ID NO: 7774422 - DNA, 22 bp, Homo sapiens
gctcctggatgttcaagtcggc

SEQ ID NO: 7774423 - DNA, 22 bp, Homo sapiens
gcctggctcctaaggactggct

SEQ ID NO: 7774424 - DNA, 22 bp, Homo sapiens
gcctggctcctaaggactggct

SEQ ID NO: 7774425 - DNA, 22 bp, Homo sapiens
gcctggctctgagggagctcct

SEQ ID NO: 7774426 - DNA, 22 bp, Homo sapiens
gcgttggggaccccgaagctgg

SEQ ID NO: 7774427 - DNA, 22 bp, Homo sapiens
gctaagggaggcatgccgtggt

SEQ ID NO: 7774428 - DNA, 22 bp, Homo sapiens
gctcaaagcataagacatctaa

SEQ ID NO: 7774429 - DNA, 22 bp, Homo sapiens
gctatttttgagccatttataa

SEQ ID NO: 7774430 - DNA, 22 bp, Homo sapiens
gctcaaagaccagacagaggag

SEQ ID NO: 7774431 - DNA, 22 bp, Homo sapiens
gctcaaagaatattcagaatga

SEQ ID NO: 7774432 - DNA, 22 bp, Homo sapiens
gctaatcaatgttaaggctgtg

SEQ ID NO: 7774433 - DNA, 17 bp, Homo sapiens
caaatcctaggatgtct

SEQ ID NO: 7774434 - DNA, 22 bp, Homo sapiens
caaatctaggatgcatgtagtg

SEQ ID NO: 7774435 - DNA, 22 bp, Homo sapiens
caaatcatggctctagcttaca

SEQ ID NO: 7774436 - DNA, 22 bp, Homo sapiens
gctctgagaggtgcagcagtaa

SEQ ID NO: 7774437 - DNA, 22 bp, Homo sapiens
caaatagacttcaatctcttga

SEQ ID NO: 7774438 - DNA, 22 bp, Homo sapiens
caaattaccctcaacatctaga

SEQ ID NO: 7774439 - DNA, 22 bp, Homo sapiens
gctgaggaagtcaggtggccca

SEQ ID NO: 7774440 - DNA, 22 bp, Homo sapiens
gctgagctgggacagtcctggg

SEQ ID NO: 7774441 - DNA, 22 bp, Homo sapiens
gctgagctgaggcagggctggg

SEQ ID NO: 7774442 - DNA, 22 bp, Homo sapiens
gctgagaaatgcagacatgctg

SEQ ID NO: 7774443 - DNA, 22 bp, Homo sapiens
attgtaaagtactgtgtacaat

SEQ ID NO: 7774444 - DNA, 22 bp, Homo sapiens
attgtaaatagtgccacaataa

SEQ ID NO: 7774445 - DNA, 22 bp, Homo sapiens
attgtaaaagtattctaagatt

SEQ ID NO: 7774446 - DNA, 22 bp, Homo sapiens
gcaggtggatcacctgaggtca

SEQ ID NO: 7774447 - DNA, 22 bp, Homo sapiens
gcaggtggatcacctgaggtca

SEQ ID NO: 7774448 - DNA, 22 bp, Homo sapiens
gcagggattgtgcagggggcta

SEQ ID NO: 7774449 - DNA, 21 bp, Homo sapiens
gcagggtcctttccattccta

SEQ ID NO: 7774450 - DNA, 22 bp, Homo sapiens
gcagggtacattgggatgggat

SEQ ID NO: 7774451 - DNA, 22 bp, Homo sapiens
gcagggtctgaggccacagagg

SEQ ID NO: 7774452 - DNA, 14 bp, Homo sapiens
gcaggcggatcact

SEQ ID NO: 7774453 - DNA, 22 bp, Homo sapiens
gcaggatgagtgagtacattta

SEQ ID NO: 7774454 - DNA, 22 bp, Homo sapiens
gcaggagcagtcaggggcagct

SEQ ID NO: 7774455 - DNA, 22 bp, Homo sapiens
gcaggagcagtcaggggcagct

SEQ ID NO: 7774456 - DNA, 22 bp, Homo sapiens
gcaggagccacttcagggatgc

SEQ ID NO: 7774457 - DNA, 22 bp, Homo sapiens
gcaggagcaaactgcagtgtgg

SEQ ID NO: 7774458 - DNA, 22 bp, Homo sapiens
gcaggagcaatggcctatcaga

SEQ ID NO: 7774459 - DNA, 22 bp, Homo sapiens
gcaggagcaatggcctatcaga

SEQ ID NO: 7774460 - DNA, 22 bp, Homo sapiens
gcaggagcagtcaggggcagct

SEQ ID NO: 7774461 - DNA, 22 bp, Homo sapiens
gcaggctgtctaaagttagagt

SEQ ID NO: 7774462 - DNA, 22 bp, Homo sapiens
gcaggctgtagacaccaaacta

SEQ ID NO: 7774463 - DNA, 22 bp, Homo sapiens
gcaggctgtctaaagttagagt

SEQ ID NO: 7774464 - DNA, 22 bp, Homo sapiens
gcaggctgtgaggctcagatgg

SEQ ID NO: 7774465 - DNA, 22 bp, Homo sapiens
gcaggctgtgaggctcagatgg

SEQ ID NO: 7774466 - DNA, 22 bp, Homo sapiens
gcaggctgtggtatgttgggca

SEQ ID NO: 7774467 - DNA, 22 bp, Homo sapiens
gcagggacgccagggacagcaa

SEQ ID NO: 7774468 - DNA, 22 bp, Homo sapiens
gcagggactttggcaacaggtg

SEQ ID NO: 7774469 - DNA, 22 bp, Homo sapiens
gcattcctacaggctgctatga

SEQ ID NO: 7774470 - DNA, 22 bp, Homo sapiens
gcattcctgtacctctctgcta

SEQ ID NO: 7774471 - DNA, 20 bp, Homo sapiens
gccacagttttctcactgca

SEQ ID NO: 7774472 - DNA, 22 bp, Homo sapiens
gcattccttgttagcatttgat

SEQ ID NO: 7774473 - DNA, 22 bp, Homo sapiens
gccacagtcaggacggggagag

SEQ ID NO: 7774474 - DNA, 16 bp, Homo sapiens
attgttttcaattaga

SEQ ID NO: 7774475 - DNA, 22 bp, Homo sapiens
attgttttccaaagatgctgct

SEQ ID NO: 7774476 - DNA, 23 bp, Homo sapiens
attgtttttggctctcagggaat

SEQ ID NO: 7774477 - DNA, 22 bp, Homo sapiens
attgttttgtttcccagtgact

SEQ ID NO: 7774478 - DNA, 22 bp, Homo sapiens
attgttttgtagaatgaccctt

SEQ ID NO: 7774479 - DNA, 22 bp, Homo sapiens
atttacagaagcatgtaatagc

SEQ ID NO: 7774480 - DNA, 22 bp, Homo sapiens
atttaaatgcttaagagggttt

SEQ ID NO: 7774481 - DNA, 20 bp, Homo sapiens
gccactgggcaccagcaggg

SEQ ID NO: 7774482 - DNA, 22 bp, Homo sapiens
attgttttattaaatgagccct

SEQ ID NO: 7774483 - DNA, 22 bp, Homo sapiens
attgttttaattccattgtgaa

SEQ ID NO: 7774484 - DNA, 22 bp, Homo sapiens
attgttttaattccattgtgaa

SEQ ID NO: 7774485 - DNA, 22 bp, Homo sapiens
attgtttccccggaattattca

SEQ ID NO: 7774486 - DNA, 22 bp, Homo sapiens
attgtttctgctttatttaggg

SEQ ID NO: 7774487 - DNA, 20 bp, Homo sapiens
attgtttcatttaatgtaca

SEQ ID NO: 7774488 - DNA, 22 bp, Homo sapiens
attgttcattgtacacctagta

SEQ ID NO: 7774489 - DNA, 22 bp, Homo sapiens
attgttcaatgtaataattttg

SEQ ID NO: 7774490 - DNA, 22 bp, Homo sapiens
gcagtgctaaggattctgcctt

SEQ ID NO: 7774491 - DNA, 22 bp, Homo sapiens
gcagtgctaagtagctggccca

SEQ ID NO: 7774492 - DNA, 22 bp, Homo sapiens
gcagtgattggatcagagatgg

SEQ ID NO: 7774493 - DNA, 20 bp, Homo sapiens
gcagtgatttgtctatgttt

SEQ ID NO: 7774494 - DNA, 22 bp, Homo sapiens
attgtaacatgttcagatcact

SEQ ID NO: 7774495 - DNA, 22 bp, Homo sapiens
gcacacaggggagttctcagaa

SEQ ID NO: 7774496 - DNA, 22 bp, Homo sapiens
gcacacagggatttttgaatgg

SEQ ID NO: 7774497 - DNA, 21 bp, Homo sapiens
gcaaccagaccacagggcagt

SEQ ID NO: 7774498 - DNA, 22 bp, Homo sapiens
gcaacagcattctcattgacat

SEQ ID NO: 7774499 - DNA, 22 bp, Homo sapiens
gcaacagcccaggttctgtgtg

SEQ ID NO: 7774500 - DNA, 22 bp, Homo sapiens
gcaacattaaaccaataattgt

SEQ ID NO: 7774501 - DNA, 22 bp, Homo sapiens
gcaaattcttaactggactgtg

SEQ ID NO: 7774502 - DNA, 22 bp, Homo sapiens
gcaaattcaacagcacattctc

SEQ ID NO: 7774503 - DNA, 22 bp, Homo sapiens
gcaaacaagctgcctgaagatt

SEQ ID NO: 7774504 - DNA, 22 bp, Homo sapiens
gcaaatgctctccagcctgggt

SEQ ID NO: 7774505 - DNA, 22 bp, Homo sapiens
gcaaatgctctccttggtcagg

SEQ ID NO: 7774506 - DNA, 22 bp, Homo sapiens
gatttctgggctttatttcaga

SEQ ID NO: 7774507 - DNA, 22 bp, Homo sapiens
atgtttctacagcgtccactga

SEQ ID NO: 7774508 - DNA, 20 bp, Homo sapiens
gcaaaataggctctgttggt

SEQ ID NO: 7774509 - DNA, 22 bp, Homo sapiens
gcaaaagtacagccggatttct

SEQ ID NO: 7774510 - DNA, 23 bp, Homo sapiens
gcactgggctctcagcaaggtgt

SEQ ID NO: 7774511 - DNA, 22 bp, Homo sapiens
gcacagggccctgtgcgtaggt

SEQ ID NO: 7774512 - DNA, 22 bp, Homo sapiens
gcacagggccctgtgcgtaggt

SEQ ID NO: 7774513 - DNA, 22 bp, Homo sapiens
gcacagggaggctggcctggcc

SEQ ID NO: 7774514 - DNA, 22 bp, Homo sapiens
gcacagggaggctggcctggcc

SEQ ID NO: 7774515 - DNA, 22 bp, Homo sapiens
gcacagggcaacaggtctgtta

SEQ ID NO: 7774516 - DNA, 22 bp, Homo sapiens
gcacagggaggctggcctggcc

SEQ ID NO: 7774517 - DNA, 22 bp, Homo sapiens
gcacagggcaacaggtctgtta

SEQ ID NO: 7774518 - DNA, 22 bp, Homo sapiens
gcactgggtgggagatctgaat

SEQ ID NO: 7774519 - DNA, 22 bp, Homo sapiens
gcactgggtgtgaggcagcgtc

SEQ ID NO: 7774520 - DNA, 22 bp, Homo sapiens
gcactgggtgggagatctgaat

SEQ ID NO: 7774521 - DNA, 22 bp, Homo sapiens
gcactggggtcatagcctccag

SEQ ID NO: 7774522 - DNA, 22 bp, Homo sapiens
gcactgggggcagcagtgaggg

SEQ ID NO: 7774523 - DNA, 22 bp, Homo sapiens
gcacagggagacagccgtggcc

SEQ ID NO: 7774524 - DNA, 22 bp, Homo sapiens
gcacagggagacagccgtggcc

SEQ ID NO: 7774525 - DNA, 22 bp, Homo sapiens
gcacagggagacagccgtggcc

SEQ ID NO: 7774526 - DNA, 22 bp, Homo sapiens
gcagaaggttgtttgggaaagg

SEQ ID NO: 7774527 - DNA, 22 bp, Homo sapiens
gcagaagtacctcgttctagtt

SEQ ID NO: 7774528 - DNA, 22 bp, Homo sapiens
gcagaagtggattctacaattt

SEQ ID NO: 7774529 - DNA, 22 bp, Homo sapiens
gcagaagtcagaccatctgaat

SEQ ID NO: 7774530 - DNA, 22 bp, Homo sapiens
gcagaaggtcaaagcaagatgt

SEQ ID NO: 7774531 - DNA, 22 bp, Homo sapiens
gcagaatacattttgttttcct

SEQ ID NO: 7774532 - DNA, 22 bp, Homo sapiens
gcagaagttaatcgaaggccat

SEQ ID NO: 7774533 - DNA, 22 bp, Homo sapiens
gcagaggcctaggtggaaggcc

SEQ ID NO: 7774534 - DNA, 22 bp, Homo sapiens
gcagaggcctaggtggaaggcc

SEQ ID NO: 7774535 - DNA, 21 bp, Homo sapiens
gcagaggaatggtatacataa

SEQ ID NO: 7774536 - DNA, 22 bp, Homo sapiens
gcagatagggtattaggagtaa

SEQ ID NO: 7774537 - DNA, 20 bp, Homo sapiens
gcagatgagactcacagagg

SEQ ID NO: 7774538 - DNA, 19 bp, Homo sapiens
gcagatgatgaggctggtc

SEQ ID NO: 7774539 - DNA, 22 bp, Homo sapiens
gcagaggggaagctgaggaatt

SEQ ID NO: 7774540 - DNA, 22 bp, Homo sapiens
gcagagggcaggggtgtttgtt

SEQ ID NO: 7774541 - DNA, 22 bp, Homo sapiens
gcagaggctgggtgtcccagtc

SEQ ID NO: 7774542 - DNA, 22 bp, Homo sapiens
gcagaggctgggtgtcccagtc

SEQ ID NO: 7774543 - DNA, 22 bp, Homo sapiens
gcagaggctgtagggaaggttg

SEQ ID NO: 7774544 - DNA, 22 bp, Homo sapiens
gcagaggcctgaaggtggcggg

SEQ ID NO: 7774545 - DNA, 22 bp, Homo sapiens
gcagaggcctgaaggtggcggg

SEQ ID NO: 7774546 - DNA, 22 bp, Homo sapiens
gcagatgccactaggtgaagtg

SEQ ID NO: 7774547 - DNA, 22 bp, Homo sapiens
gcagccagggctaagctgggga

SEQ ID NO: 7774548 - DNA, 19 bp, Homo sapiens
gcagccaggtgctctacct

SEQ ID NO: 7774549 - DNA, 22 bp, Homo sapiens
gcagccaggggctgtgacctgt

SEQ ID NO: 7774550 - DNA, 19 bp, Homo sapiens
gcagccaggtgctctacct

SEQ ID NO: 7774551 - DNA, 22 bp, Homo sapiens
gcagccttccgtggacctggac

SEQ ID NO: 7774552 - DNA, 22 bp, Homo sapiens
gcagccttccgtggacctggac

SEQ ID NO: 7774553 - DNA, 22 bp, Homo sapiens
gcagcctttggaattagagact

SEQ ID NO: 7774554 - DNA, 22 bp, Homo sapiens
gcaggagagtctgtgccaggtt

SEQ ID NO: 7774555 - DNA, 22 bp, Homo sapiens
gcagccaggtttgaggaccact

SEQ ID NO: 7774556 - DNA, 17 bp, Homo sapiens
gcagcctcttggtagtg

SEQ ID NO: 7774557 - DNA, 22 bp, Homo sapiens
gcagcctgttgtaccagcctgt

SEQ ID NO: 7774558 - DNA, 20 bp, Homo sapiens
catcagaaatcctgacccac

SEQ ID NO: 7774559 - DNA, 22 bp, Homo sapiens
catcagaagaaagacaaatgat

SEQ ID NO: 7774560 - DNA, 22 bp, Homo sapiens
aggaggctgcaaccctgaggcc

SEQ ID NO: 7774561 - DNA, 22 bp, Homo sapiens
aggaggctgggcacagtggcct

SEQ ID NO: 7774562 - DNA, 22 bp, Homo sapiens
aggaggctgggcacagtggcct

SEQ ID NO: 7774563 - DNA, 22 bp, Homo sapiens
aggaggctgcaaccctgaggcc

SEQ ID NO: 7774564 - DNA, 19 bp, Homo sapiens
catcagagggcataggatg

SEQ ID NO: 7774565 - DNA, 22 bp, Homo sapiens
cagttattatgaggtcattagg

SEQ ID NO: 7774566 - DNA, 22 bp, Homo sapiens
cagttataggagccattgtata

SEQ ID NO: 7774567 - DNA, 22 bp, Homo sapiens
cagttattttgaggattaaatg

SEQ ID NO: 7774568 - DNA, 22 bp, Homo sapiens
cagttctcttgatcgtctcttg

SEQ ID NO: 7774569 - DNA, 22 bp, Homo sapiens
catcacatttaattaaaatgtc

SEQ ID NO: 7774570 - DNA, 22 bp, Homo sapiens
aggaggctggttcaggccatat

SEQ ID NO: 7774571 - DNA, 22 bp, Homo sapiens
aggaggctggttcaggccatat

SEQ ID NO: 7774572 - DNA, 21 bp, Homo sapiens
aggaggctgtctctttcagct

SEQ ID NO: 7774573 - DNA, 22 bp, Homo sapiens
aggagggttctctggacagagg

SEQ ID NO: 7774574 - DNA, 22 bp, Homo sapiens
aggagggttctctggacagagg

SEQ ID NO: 7774575 - DNA, 22 bp, Homo sapiens
aggaggtgagcggtcatgtggt

SEQ ID NO: 7774576 - DNA, 22 bp, Homo sapiens
aggaggtgacagcctgcatctg

SEQ ID NO: 7774577 - DNA, 23 bp, Homo sapiens
catcattgttatgggtgctacta

SEQ ID NO: 7774578 - DNA, 22 bp, Homo sapiens
catcattttattaaccaagaaa

SEQ ID NO: 7774579 - DNA, 22 bp, Homo sapiens
catcatttgtttgcatgcagga

SEQ ID NO: 7774580 - DNA, 22 bp, Homo sapiens
catcatttgttcacttgattcc

SEQ ID NO: 7774581 - DNA, 22 bp, Homo sapiens
catcattttattaaccaagaaa

SEQ ID NO: 7774582 - DNA, 22 bp, Homo sapiens
aggagtggtgcaggacctgcca

SEQ ID NO: 7774583 - DNA, 22 bp, Homo sapiens
aggagccaaattactagctctg

SEQ ID NO: 7774584 - DNA, 22 bp, Homo sapiens
aggagccaaattactagctctg

SEQ ID NO: 7774585 - DNA, 21 bp, Homo sapiens
aggagcattgttgtggtggag

SEQ ID NO: 7774586 - DNA, 17 bp, Homo sapiens
cagtgcttctgcttctt

SEQ ID NO: 7774587 - DNA, 22 bp, Homo sapiens
cagtgctttgggaggctgagga

SEQ ID NO: 7774588 - DNA, 22 bp, Homo sapiens
cagtgcttggggagcggagaga

SEQ ID NO: 7774589 - DNA, 22 bp, Homo sapiens
cagtgcttttttaccttccaac

SEQ ID NO: 7774590 - DNA, 22 bp, Homo sapiens
cagtgcttttcaaagttctatg

SEQ ID NO: 7774591 - DNA, 22 bp, Homo sapiens
aggagccaagatgctgtctggc

SEQ ID NO: 7774592 - DNA, 22 bp, Homo sapiens
aggagctgggcccaaggatgct

SEQ ID NO: 7774593 - DNA, 22 bp, Homo sapiens
aggagctgggctgctgctggga

SEQ ID NO: 7774594 - DNA, 22 bp, Homo sapiens
aggagctgggctgctgctggga

SEQ ID NO: 7774595 - DNA, 17 bp, Homo sapiens
aggagctgggggtggtg

SEQ ID NO: 7774596 - DNA, 22 bp, Homo sapiens
aggagctggcctagaaaggaga

SEQ ID NO: 7774597 - DNA, 22 bp, Homo sapiens
aggagctggcctagaaaggaga

SEQ ID NO: 7774598 - DNA, 22 bp, Homo sapiens
aggagctggccactaggatgca

SEQ ID NO: 7774599 - DNA, 22 bp, Homo sapiens
aggagctgatagtctatggaga

SEQ ID NO: 7774600 - DNA, 22 bp, Homo sapiens
aggagctgatagtctatggaga

SEQ ID NO: 7774601 - DNA, 22 bp, Homo sapiens
aggagctgatagtctatggaga

SEQ ID NO: 7774602 - DNA, 23 bp, Homo sapiens
cagtggagactcatgcttcctta

SEQ ID NO: 7774603 - DNA, 22 bp, Homo sapiens
cagtgcaggcttgtggccgcag

SEQ ID NO: 7774604 - DNA, 22 bp, Homo sapiens
cagtgcagccaaggacaggcac

SEQ ID NO: 7774605 - DNA, 22 bp, Homo sapiens
cagtgcagctgccccgctggta

SEQ ID NO: 7774606 - DNA, 22 bp, Homo sapiens
cagtgcaggaagtgagatgcct

SEQ ID NO: 7774607 - DNA, 22 bp, Homo sapiens
cagtgaggctctgctgagcggt

SEQ ID NO: 7774608 - DNA, 22 bp, Homo sapiens
aggaattcaagaccagctgggc

SEQ ID NO: 7774609 - DNA, 22 bp, Homo sapiens
aggaattatttgtcttagtctt

SEQ ID NO: 7774610 - DNA, 22 bp, Homo sapiens
aggaattaacaatatatttagg

SEQ ID NO: 7774611 - DNA, 22 bp, Homo sapiens
aggaatttggggttacatgatg

SEQ ID NO: 7774612 - DNA, 22 bp, Homo sapiens
cagtgaggagtccagggcagag

SEQ ID NO: 7774613 - DNA, 22 bp, Homo sapiens
aggcagcttaagccctggccca

SEQ ID NO: 7774614 - DNA, 22 bp, Homo sapiens
aggcagctttcagtgtctctca

SEQ ID NO: 7774615 - DNA, 22 bp, Homo sapiens
aggcagctttctgtaggggtgt

SEQ ID NO: 7774616 - DNA, 22 bp, Homo sapiens
aggcaggaaaatcgcttgaacc

SEQ ID NO: 7774617 - DNA, 22 bp, Homo sapiens
aggcagcgtagcaaggctagta

SEQ ID NO: 7774618 - DNA, 22 bp, Homo sapiens
aggcagctggcagcacccaggg

SEQ ID NO: 7774619 - DNA, 21 bp, Homo sapiens
aggcagcgtgagggccactca

SEQ ID NO: 7774620 - DNA, 22 bp, Homo sapiens
aggcagagctgatgttctgtga

SEQ ID NO: 7774621 - DNA, 20 bp, Homo sapiens
aggcagagcgcacttttaga

SEQ ID NO: 7774622 - DNA, 22 bp, Homo sapiens
aggcagaggagaatgatcttcc

SEQ ID NO: 7774623 - DNA, 22 bp, Homo sapiens
ccaaacaaatccccattcttag

SEQ ID NO: 7774624 - DNA, 22 bp, Homo sapiens
ccaaaatattagtgcttaagta

SEQ ID NO: 7774625 - DNA, 22 bp, Homo sapiens
ccaaaataacagcccaattcac

SEQ ID NO: 7774626 - DNA, 18 bp, Homo sapiens
aggcaggatcctggcctc

SEQ ID NO: 7774627 - DNA, 21 bp, Homo sapiens
ccaaagaactgccatttgtca

SEQ ID NO: 7774628 - DNA, 23 bp, Homo sapiens
aggcaggcagttcagctgttgtt

SEQ ID NO: 7774629 - DNA, 22 bp, Homo sapiens
aggcaggcccctgagaatagac

SEQ ID NO: 7774630 - DNA, 22 bp, Homo sapiens
aggcaggctctgggtatgtgca

SEQ ID NO: 7774631 - DNA, 22 bp, Homo sapiens
aggcaggctgctatggagtaga

SEQ ID NO: 7774632 - DNA, 22 bp, Homo sapiens
aggcaggctagtcgcttgagcc

SEQ ID NO: 7774633 - DNA, 22 bp, Homo sapiens
aggcaggctagtcgcttgagcc

SEQ ID NO: 7774634 - DNA, 22 bp, Homo sapiens
aggcaggctcaggcccatgctt

SEQ ID NO: 7774635 - DNA, 22 bp, Homo sapiens
aggcaggctcaatgcccagtct

SEQ ID NO: 7774636 - DNA, 22 bp, Homo sapiens
aggcaggccctctggaaaggta

SEQ ID NO: 7774637 - DNA, 22 bp, Homo sapiens
aggcaggccgtgtccctcctca

SEQ ID NO: 7774638 - DNA, 22 bp, Homo sapiens
aggcaggccctgggccatcccg

SEQ ID NO: 7774639 - DNA, 22 bp, Homo sapiens
aggcaggcctacacaatgggag

SEQ ID NO: 7774640 - DNA, 22 bp, Homo sapiens
aggatcagtgaatactcagggt

SEQ ID NO: 7774641 - DNA, 22 bp, Homo sapiens
aggcacaggtggacttcacagt

SEQ ID NO: 7774642 - DNA, 22 bp, Homo sapiens
aggcacagggatgcggagccag

SEQ ID NO: 7774643 - DNA, 22 bp, Homo sapiens
aggcacagggatgcggagccag

SEQ ID NO: 7774644 - DNA, 22 bp, Homo sapiens
aggatgaatatttagtgggata

SEQ ID NO: 7774645 - DNA, 22 bp, Homo sapiens
aggcacagtgcctggaatcaaa

SEQ ID NO: 7774646 - DNA, 20 bp, Homo sapiens
aggcacagttcctagttggg

SEQ ID NO: 7774647 - DNA, 19 bp, Homo sapiens
aggcacaggttgtctggac

SEQ ID NO: 7774648 - DNA, 19 bp, Homo sapiens
aggcacaggttgtctggac

SEQ ID NO: 7774649 - DNA, 20 bp, Homo sapiens
aggcacagttcctagttggg

SEQ ID NO: 7774650 - DNA, 22 bp, Homo sapiens
aggcactttccttgaggagttt

SEQ ID NO: 7774651 - DNA, 22 bp, Homo sapiens
aggcactttgaaatttggagct

SEQ ID NO: 7774652 - DNA, 22 bp, Homo sapiens
aggcactgacagattctgtgtc

SEQ ID NO: 7774653 - DNA, 22 bp, Homo sapiens
caggtcctctgagatgggaggt

SEQ ID NO: 7774654 - DNA, 20 bp, Homo sapiens
aggaagtattgtcatgaagg

SEQ ID NO: 7774655 - DNA, 22 bp, Homo sapiens
aggaaggggagaagttaaagct

SEQ ID NO: 7774656 - DNA, 22 bp, Homo sapiens
aggaagggttctttctgtttat

SEQ ID NO: 7774657 - DNA, 22 bp, Homo sapiens
aggaagagtgttacctatgggt

SEQ ID NO: 7774658 - DNA, 22 bp, Homo sapiens
aggaagaggtgtgcaatggtgt

SEQ ID NO: 7774659 - DNA, 22 bp, Homo sapiens
aggaagcactggaaggggttgg

SEQ ID NO: 7774660 - DNA, 22 bp, Homo sapiens
aggaagaggtagctgtcaaggg

SEQ ID NO: 7774661 - DNA, 22 bp, Homo sapiens
cagggtttcaccatgttagcag

SEQ ID NO: 7774662 - DNA, 22 bp, Homo sapiens
aggaaacagttggtaatgcata

SEQ ID NO: 7774663 - DNA, 22 bp, Homo sapiens
aggaaacagagtgaagcttggg

SEQ ID NO: 7774664 - DNA, 22 bp, Homo sapiens
aggaaacaggcagcctttgaac

SEQ ID NO: 7774665 - DNA, 22 bp, Homo sapiens
aggaaacattgatattgggaaa

SEQ ID NO: 7774666 - DNA, 17 bp, Homo sapiens
aggaaacattttctttc

SEQ ID NO: 7774667 - DNA, 22 bp, Homo sapiens
aggaaacatgaatctgccttga

SEQ ID NO: 7774668 - DNA, 22 bp, Homo sapiens
aggaaacatccttatctattct

SEQ ID NO: 7774669 - DNA, 22 bp, Homo sapiens
aggaaacatgaatctgccttga

SEQ ID NO: 7774670 - DNA, 22 bp, Homo sapiens
aggaaacatgaatctgccttga

SEQ ID NO: 7774671 - DNA, 22 bp, Homo sapiens
cagggtggtaccagcatctagt

SEQ ID NO: 7774672 - DNA, 22 bp, Homo sapiens
cagggtggggctggctatcaaa

SEQ ID NO: 7774673 - DNA, 22 bp, Homo sapiens
cagggttctggaatataatgtg

SEQ ID NO: 7774674 - DNA, 22 bp, Homo sapiens
cagggttcagtgggccctcttg

SEQ ID NO: 7774675 - DNA, 22 bp, Homo sapiens
cagggtggtgaatagctatagt

SEQ ID NO: 7774676 - DNA, 22 bp, Homo sapiens
cagggtggtaccagcatctagt

SEQ ID NO: 7774677 - DNA, 22 bp, Homo sapiens
caggcttcgctctgtgggcagg

SEQ ID NO: 7774678 - DNA, 22 bp, Homo sapiens
caggcttgctgctagagcactt

SEQ ID NO: 7774679 - DNA, 22 bp, Homo sapiens
caggctgtgttcctggaacccc

SEQ ID NO: 7774680 - DNA, 22 bp, Homo sapiens
caggctgtggatcaggagcctt

SEQ ID NO: 7774681 - DNA, 22 bp, Homo sapiens
caggctgtgaaactgagatgcg

SEQ ID NO: 7774682 - DNA, 22 bp, Homo sapiens
caggctgtggatcaggagcctt

SEQ ID NO: 7774683 - DNA, 22 bp, Homo sapiens
caggctgtggatcaggagcctt

SEQ ID NO: 7774684 - DNA, 22 bp, Homo sapiens
agctttctaccaggtcctgtct

SEQ ID NO: 7774685 - DNA, 22 bp, Homo sapiens
agctttcagttactaatgaagg

SEQ ID NO: 7774686 - DNA, 22 bp, Homo sapiens
agctttcactgatatgctttga

SEQ ID NO: 7774687 - DNA, 22 bp, Homo sapiens
agctttcagtctctgaaggaac

SEQ ID NO: 7774688 - DNA, 22 bp, Homo sapiens
aggaaaatcgagtctggaggca

SEQ ID NO: 7774689 - DNA, 22 bp, Homo sapiens
aggaaaatgaaacagcaactgt

SEQ ID NO: 7774690 - DNA, 22 bp, Homo sapiens
aggaaaatggaccagagttgtt

SEQ ID NO: 7774691 - DNA, 22 bp, Homo sapiens
aggaaaatggaccagagttgtt

SEQ ID NO: 7774692 - DNA, 20 bp, Homo sapiens
aggaaaagggtggtggtaga

SEQ ID NO: 7774693 - DNA, 22 bp, Homo sapiens
aggaaaagtgtgaagtatggag

SEQ ID NO: 7774694 - DNA, 22 bp, Homo sapiens
aggaaaacagaccaaggagctc

SEQ ID NO: 7774695 - DNA, 22 bp, Homo sapiens
cagggacattggtggccaggtt

SEQ ID NO: 7774696 - DNA, 22 bp, Homo sapiens
cagggacccgcacaggtagcat

SEQ ID NO: 7774697 - DNA, 22 bp, Homo sapiens
cagggacattggtggccaggtt

SEQ ID NO: 7774698 - DNA, 22 bp, Homo sapiens
cagggacattggtggccaggtt

SEQ ID NO: 7774699 - DNA, 22 bp, Homo sapiens
agctttctggttacagtcttca

SEQ ID NO: 7774700 - DNA, 20 bp, Homo sapiens
agctttctccttggagctcc

SEQ ID NO: 7774701 - DNA, 22 bp, Homo sapiens
agctggtatgaacaggatagga

SEQ ID NO: 7774702 - DNA, 22 bp, Homo sapiens
agctggtaagtggcagagattc

SEQ ID NO: 7774703 - DNA, 22 bp, Homo sapiens
caggcagaggtaccaagattga

SEQ ID NO: 7774704 - DNA, 22 bp, Homo sapiens
caggcagaggcttttcatggct

SEQ ID NO: 7774705 - DNA, 22 bp, Homo sapiens
caggcagagtcagattagactt

SEQ ID NO: 7774706 - DNA, 22 bp, Homo sapiens
caggcagagtgagaagcccttg

SEQ ID NO: 7774707 - DNA, 22 bp, Homo sapiens
caggcagagtgagaagcccttg

SEQ ID NO: 7774708 - DNA, 22 bp, Homo sapiens
caggcagaggaagtctgggtct

SEQ ID NO: 7774709 - DNA, 22 bp, Homo sapiens
caggcagaggaggccttctcct

SEQ ID NO: 7774710 - DNA, 22 bp, Homo sapiens
caggcagaggaagtctgggtct

SEQ ID NO: 7774711 - DNA, 20 bp, Homo sapiens
caggcagaggatgctgacca

SEQ ID NO: 7774712 - DNA, 19 bp, Homo sapiens
agctggggcggtgtgtgtt

SEQ ID NO: 7774713 - DNA, 22 bp, Homo sapiens
agctggagccagtgtgaggctt

SEQ ID NO: 7774714 - DNA, 22 bp, Homo sapiens
agctggagcttcaagcaggtaa

SEQ ID NO: 7774715 - DNA, 20 bp, Homo sapiens
agctggagaagggcccttcc

SEQ ID NO: 7774716 - DNA, 22 bp, Homo sapiens
agctggagaatgtggatgatcc

SEQ ID NO: 7774717 - DNA, 22 bp, Homo sapiens
agctggagatcatgctgatact

SEQ ID NO: 7774718 - DNA, 22 bp, Homo sapiens
agctggagatgcccagcaccgg

SEQ ID NO: 7774719 - DNA, 21 bp, Homo sapiens
agctgggcctcagcctgcagt

SEQ ID NO: 7774720 - DNA, 22 bp, Homo sapiens
agctgggcctgagctggaagct

SEQ ID NO: 7774721 - DNA, 22 bp, Homo sapiens
agctggaggataactcacttct

SEQ ID NO: 7774722 - DNA, 22 bp, Homo sapiens
agctggaggagtttctcctagc

SEQ ID NO: 7774723 - DNA, 22 bp, Homo sapiens
caggaaatatctcaacacttta

SEQ ID NO: 7774724 - DNA, 22 bp, Homo sapiens
caggaaatataggaaaaggaac

SEQ ID NO: 7774725 - DNA, 22 bp, Homo sapiens
caggaaatcagaactcaagtgg

SEQ ID NO: 7774726 - DNA, 21 bp, Homo sapiens
caggaaatcagtgtgaattag

SEQ ID NO: 7774727 - DNA, 22 bp, Homo sapiens
caggaaatcactctgattttgg

SEQ ID NO: 7774728 - DNA, 23 bp, Homo sapiens
caggaaatcaattcttccagcat

SEQ ID NO: 7774729 - DNA, 22 bp, Homo sapiens
caggaaatatctcctggcagag

SEQ ID NO: 7774730 - DNA, 22 bp, Homo sapiens
agctgaaattctttgtcctcag

SEQ ID NO: 7774731 - DNA, 22 bp, Homo sapiens
agctgaaagggtgttggagtgt

SEQ ID NO: 7774732 - DNA, 22 bp, Homo sapiens
agctgaaattttactgagtata

SEQ ID NO: 7774733 - DNA, 22 bp, Homo sapiens
agctgaaagcttgactggggct

SEQ ID NO: 7774734 - DNA, 22 bp, Homo sapiens
agctgaaacttcccattaattg

SEQ ID NO: 7774735 - DNA, 22 bp, Homo sapiens
agctgaaaattagtgatagttt

SEQ ID NO: 7774736 - DNA, 21 bp, Homo sapiens
agctgaaaagttgtttacaag

SEQ ID NO: 7774737 - DNA, 20 bp, Homo sapiens
agctctttttagctaaggta

SEQ ID NO: 7774738 - DNA, 22 bp, Homo sapiens
agctcttttgtgagcatttggc

SEQ ID NO: 7774739 - DNA, 22 bp, Homo sapiens
agctcttttgctctccaagttt

SEQ ID NO: 7774740 - DNA, 22 bp, Homo sapiens
agctcttttatcatgaggagag

SEQ ID NO: 7774741 - DNA, 22 bp, Homo sapiens
caggaaccaggagagtccctga

SEQ ID NO: 7774742 - DNA, 22 bp, Homo sapiens
caggaaccaggagagtccctga

SEQ ID NO: 7774743 - DNA, 23 bp, Homo sapiens
caggaaatgcttggaggggctgg

SEQ ID NO: 7774744 - DNA, 22 bp, Homo sapiens
caggaacccccactctcagctc

SEQ ID NO: 7774745 - DNA, 22 bp, Homo sapiens
caggaaccattttctctttata

SEQ ID NO: 7774746 - DNA, 22 bp, Homo sapiens
caggaaatgaaagctagctaat

SEQ ID NO: 7774747 - DNA, 22 bp, Homo sapiens
caggaaatgaacaggaatgaac

SEQ ID NO: 7774748 - DNA, 23 bp, Homo sapiens
caggaaatgaatccaggaggatg

SEQ ID NO: 7774749 - DNA, 22 bp, Homo sapiens
caggaaatgcgtagttgaactt

SEQ ID NO: 7774750 - DNA, 22 bp, Homo sapiens
caggaaatgctatcatagctga

SEQ ID NO: 7774751 - DNA, 22 bp, Homo sapiens
caggaaatgcgtagttgaactt

SEQ ID NO: 7774752 - DNA, 22 bp, Homo sapiens
caggaaatgaggctgaagggtg

SEQ ID NO: 7774753 - DNA, 15 bp, Homo sapiens
caggaaatgaatctg

SEQ ID NO: 7774754 - DNA, 22 bp, Homo sapiens
caggaagaagggtggtgagtcc

SEQ ID NO: 7774755 - DNA, 22 bp, Homo sapiens
caggaagaaagaggtgaggtgt

SEQ ID NO: 7774756 - DNA, 22 bp, Homo sapiens
agctgccagatgacagtgctat

SEQ ID NO: 7774757 - DNA, 22 bp, Homo sapiens
agctgcccttaataggcattca

SEQ ID NO: 7774758 - DNA, 22 bp, Homo sapiens
agctgccctgtggggagggttg

SEQ ID NO: 7774759 - DNA, 21 bp, Homo sapiens
agctgcctccacttctgaggc

SEQ ID NO: 7774760 - DNA, 22 bp, Homo sapiens
agctgcctcagtcactcatggc

SEQ ID NO: 7774761 - DNA, 22 bp, Homo sapiens
agctgccgatgcccagctgcat

SEQ ID NO: 7774762 - DNA, 22 bp, Homo sapiens
agctgcctgccatgccgctggt

SEQ ID NO: 7774763 - DNA, 21 bp, Homo sapiens
agctgcctgctctggacctgg

SEQ ID NO: 7774764 - DNA, 22 bp, Homo sapiens
agctgcctgctgcactcggtgc

SEQ ID NO: 7774765 - DNA, 17 bp, Homo sapiens
agctgcctctcccacca

SEQ ID NO: 7774766 - DNA, 22 bp, Homo sapiens
agctgcctcctggtgccccatc

SEQ ID NO: 7774767 - DNA, 21 bp, Homo sapiens
agctgctttcagctcctagag

SEQ ID NO: 7774768 - DNA, 22 bp, Homo sapiens
agctgcctgcttatgagctcca

SEQ ID NO: 7774769 - DNA, 22 bp, Homo sapiens
aggggtgaaggcccgataggag

SEQ ID NO: 7774770 - DNA, 22 bp, Homo sapiens
agggtcaccagttcataggcac

SEQ ID NO: 7774771 - DNA, 22 bp, Homo sapiens
agggtcacaatgtgtgaattgg

SEQ ID NO: 7774772 - DNA, 22 bp, Homo sapiens
agggtcacctgcttgccagggc

SEQ ID NO: 7774773 - DNA, 22 bp, Homo sapiens
cctgagagccctagccaggcgc

SEQ ID NO: 7774774 - DNA, 22 bp, Homo sapiens
cctgaagatgctgtggcctggt

SEQ ID NO: 7774775 - DNA, 22 bp, Homo sapiens
cctgaagagcactctagagttg

SEQ ID NO: 7774776 - DNA, 22 bp, Homo sapiens
aggggagcaacatagtcactct

SEQ ID NO: 7774777 - DNA, 22 bp, Homo sapiens
agggctggctaggtgcgttccc

SEQ ID NO: 7774778 - DNA, 22 bp, Homo sapiens
agggctggcatctctaatgctg

SEQ ID NO: 7774779 - DNA, 22 bp, Homo sapiens
agggctggccacatgatttggt

SEQ ID NO: 7774780 - DNA, 22 bp, Homo sapiens
aggggatggagctggaaggcag

SEQ ID NO: 7774781 - DNA, 22 bp, Homo sapiens
aggggatggagctggaaggcag

SEQ ID NO: 7774782 - DNA, 22 bp, Homo sapiens
aggggatggagctggaaggcag

SEQ ID NO: 7774783 - DNA, 22 bp, Homo sapiens
cctcttccactgggccccatcc

SEQ ID NO: 7774784 - DNA, 22 bp, Homo sapiens
agggctggagccacagctggga

SEQ ID NO: 7774785 - DNA, 22 bp, Homo sapiens
agggctggagccacagctggga

SEQ ID NO: 7774786 - DNA, 22 bp, Homo sapiens
agggctggagccacagctggga

SEQ ID NO: 7774787 - DNA, 22 bp, Homo sapiens
agggctggagccacagctggga

SEQ ID NO: 7774788 - DNA, 22 bp, Homo sapiens
cctcaggatacaggagccacag

SEQ ID NO: 7774789 - DNA, 22 bp, Homo sapiens
cctcaggcaggaaactgtcccg

SEQ ID NO: 7774790 - DNA, 22 bp, Homo sapiens
cctcaggccagggggcggccag

SEQ ID NO: 7774791 - DNA, 22 bp, Homo sapiens
agggcctgcatcaggagcttgg

SEQ ID NO: 7774792 - DNA, 19 bp, Homo sapiens
agggcctgcagctcaagct

SEQ ID NO: 7774793 - DNA, 22 bp, Homo sapiens
agggcctgaggctgacggggag

SEQ ID NO: 7774794 - DNA, 22 bp, Homo sapiens
ccctggaaatgaggcatgtgcg

SEQ ID NO: 7774795 - DNA, 22 bp, Homo sapiens
agggcctccagggcagcagtgg

SEQ ID NO: 7774796 - DNA, 20 bp, Homo sapiens
agggcctgctctgtggtgtc

SEQ ID NO: 7774797 - DNA, 22 bp, Homo sapiens
agggcctggaactgtgggcagg

SEQ ID NO: 7774798 - DNA, 22 bp, Homo sapiens
cctcagcttgatttctgcagag

SEQ ID NO: 7774799 - DNA, 22 bp, Homo sapiens
ccctcccagatgggcttgaggt

SEQ ID NO: 7774800 - DNA, 22 bp, Homo sapiens
ccctcccaggagtggccagaga

SEQ ID NO: 7774801 - DNA, 22 bp, Homo sapiens
ccctcccaggagtggccagaga

SEQ ID NO: 7774802 - DNA, 22 bp, Homo sapiens
ccctcccaggagtggccagaga

SEQ ID NO: 7774803 - DNA, 22 bp, Homo sapiens
ccctgcacagcctggctctctt

SEQ ID NO: 7774804 - DNA, 18 bp, Homo sapiens
ccctgccagctcccagca

SEQ ID NO: 7774805 - DNA, 22 bp, Homo sapiens
ccctccattaaaacagacctat

SEQ ID NO: 7774806 - DNA, 22 bp, Homo sapiens
ccctcccaagcactctgacata

SEQ ID NO: 7774807 - DNA, 22 bp, Homo sapiens
ccctcccaagcactctgacata

SEQ ID NO: 7774808 - DNA, 20 bp, Homo sapiens
ccctcccagatgcttcccaa

SEQ ID NO: 7774809 - DNA, 22 bp, Homo sapiens
ccctgctgtgtagcggaggaac

SEQ ID NO: 7774810 - DNA, 22 bp, Homo sapiens
ccctgctgcaggcttcaggagg

SEQ ID NO: 7774811 - DNA, 22 bp, Homo sapiens
ccctgctgtcaggtgctgggag

SEQ ID NO: 7774812 - DNA, 22 bp, Homo sapiens
ccctcaccaggctccaggcatg

SEQ ID NO: 7774813 - DNA, 22 bp, Homo sapiens
ccctcaccaggctccaggcatg

SEQ ID NO: 7774814 - DNA, 22 bp, Homo sapiens
ccctagggtttggccagagccc

SEQ ID NO: 7774815 - DNA, 22 bp, Homo sapiens
ccctagggtttggccagagccc

SEQ ID NO: 7774816 - DNA, 22 bp, Homo sapiens
ccctaggctgaggccagggtgc

SEQ ID NO: 7774817 - DNA, 22 bp, Homo sapiens
ccctaggctgggctcttggctt

SEQ ID NO: 7774818 - DNA, 22 bp, Homo sapiens
ccccagcacttggagtggggag

SEQ ID NO: 7774819 - DNA, 22 bp, Homo sapiens
ccccagcacaggctcctcagat

SEQ ID NO: 7774820 - DNA, 22 bp, Homo sapiens
cccatggcaataaggtcacagg

SEQ ID NO: 7774821 - DNA, 22 bp, Homo sapiens
cccatgggttttcctccctgcc

SEQ ID NO: 7774822 - DNA, 22 bp, Homo sapiens
cccatgcaccctctaagaagga

SEQ ID NO: 7774823 - DNA, 22 bp, Homo sapiens
cccattcatcctcgcttccttc

SEQ ID NO: 7774824 - DNA, 22 bp, Homo sapiens
ccccactttgagtagcacttga

SEQ ID NO: 7774825 - DNA, 22 bp, Homo sapiens
ccccacttgctcagcatgtcca

SEQ ID NO: 7774826 - DNA, 22 bp, Homo sapiens
ccccagaaagcctggcactagg

SEQ ID NO: 7774827 - DNA, 22 bp, Homo sapiens
ccccagaaagcctggcactagg

SEQ ID NO: 7774828 - DNA, 22 bp, Homo sapiens
ccccagagaaagtcagcagcat

SEQ ID NO: 7774829 - DNA, 22 bp, Homo sapiens
ccccagagaaagtcagcagcat

SEQ ID NO: 7774830 - DNA, 22 bp, Homo sapiens
cccaggagatgcactccattgg

SEQ ID NO: 7774831 - DNA, 22 bp, Homo sapiens
cccaggagatgcactccattgg

SEQ ID NO: 7774832 - DNA, 22 bp, Homo sapiens
cccaggagatggtgcgtggtct

SEQ ID NO: 7774833 - DNA, 20 bp, Homo sapiens
cccaggagctgtgccccatc

SEQ ID NO: 7774834 - DNA, 20 bp, Homo sapiens
cccaggagctgtgccccatc

SEQ ID NO: 7774835 - DNA, 23 bp, Homo sapiens
cccaggagcctgagtcctctctg

SEQ ID NO: 7774836 - DNA, 22 bp, Homo sapiens
cccaggagggtggcctctgccc

SEQ ID NO: 7774837 - DNA, 22 bp, Homo sapiens
aggctggtctatacggagacga

SEQ ID NO: 7774838 - DNA, 22 bp, Homo sapiens
aggctggtgattagaagcagcc

SEQ ID NO: 7774839 - DNA, 22 bp, Homo sapiens
aggctgtagatctagacatgta

SEQ ID NO: 7774840 - DNA, 22 bp, Homo sapiens
aggctggtgcttcctagggcag

SEQ ID NO: 7774841 - DNA, 22 bp, Homo sapiens
aggctgtgaaatgtggcaagga

SEQ ID NO: 7774842 - DNA, 22 bp, Homo sapiens
aggctgtgaactctatgctgaa

SEQ ID NO: 7774843 - DNA, 22 bp, Homo sapiens
aggctgtcttcctccctcttgg

SEQ ID NO: 7774844 - DNA, 21 bp, Homo sapiens
aggctgtcctttgccagccct

SEQ ID NO: 7774845 - DNA, 22 bp, Homo sapiens
aggctgtccaaggtggcgaagt

SEQ ID NO: 7774846 - DNA, 22 bp, Homo sapiens
cccaggcttttctcttgcccca

SEQ ID NO: 7774847 - DNA, 22 bp, Homo sapiens
cccagtcatcctgcaggtgaaa

SEQ ID NO: 7774848 - DNA, 22 bp, Homo sapiens
cccaggctggaattccaggcct

SEQ ID NO: 7774849 - DNA, 22 bp, Homo sapiens
cccaggctgtctgtcctttgct

SEQ ID NO: 7774850 - DNA, 22 bp, Homo sapiens
cccaggctgatgttcagcgggt

SEQ ID NO: 7774851 - DNA, 22 bp, Homo sapiens
cccaggcctggtctgggccagt

SEQ ID NO: 7774852 - DNA, 22 bp, Homo sapiens
cccaggaggtggagcttgcagt

SEQ ID NO: 7774853 - DNA, 22 bp, Homo sapiens
cccaggaggtcgaagctgcagt

SEQ ID NO: 7774854 - DNA, 22 bp, Homo sapiens
cccaggaggtcgaagctgcagt

SEQ ID NO: 7774855 - DNA, 22 bp, Homo sapiens
cccaggaggtcaaggctgcagt

SEQ ID NO: 7774856 - DNA, 22 bp, Homo sapiens
cccaggaggtcaaggctgcagt

SEQ ID NO: 7774857 - DNA, 22 bp, Homo sapiens
ccaggctgggctacaagttgag

SEQ ID NO: 7774858 - DNA, 22 bp, Homo sapiens
ccaggctgggcggggaacctgg

SEQ ID NO: 7774859 - DNA, 22 bp, Homo sapiens
ccaggctgggcggggaacctgg

SEQ ID NO: 7774860 - DNA, 22 bp, Homo sapiens
ccaggctgggctacaagttgag

SEQ ID NO: 7774861 - DNA, 15 bp, Homo sapiens
ccaggctgggtgagc

SEQ ID NO: 7774862 - DNA, 22 bp, Homo sapiens
ccaggctggtctgaatttctag

SEQ ID NO: 7774863 - DNA, 22 bp, Homo sapiens
ccaggctggagtatagtggcgc

SEQ ID NO: 7774864 - DNA, 22 bp, Homo sapiens
ccaggctggagtatagtggcgc

SEQ ID NO: 7774865 - DNA, 22 bp, Homo sapiens
ccaggctggagtatagtggcgc

SEQ ID NO: 7774866 - DNA, 22 bp, Homo sapiens
ccaggctgcttagccttatctt

SEQ ID NO: 7774867 - DNA, 22 bp, Homo sapiens
ccaggctgctttattactctgt

SEQ ID NO: 7774868 - DNA, 22 bp, Homo sapiens
ccaggctggaatcaatattctg

SEQ ID NO: 7774869 - DNA, 22 bp, Homo sapiens
aggcgtggttgaggcgagcata

SEQ ID NO: 7774870 - DNA, 22 bp, Homo sapiens
aggctacagatacagaggctac

SEQ ID NO: 7774871 - DNA, 22 bp, Homo sapiens
aggctacatgttggggtggaag

SEQ ID NO: 7774872 - DNA, 22 bp, Homo sapiens
ccaggctctgcgctggacatgg

SEQ ID NO: 7774873 - DNA, 22 bp, Homo sapiens
ccaggctgcttagccttatctt

SEQ ID NO: 7774874 - DNA, 22 bp, Homo sapiens
aggctgaggcaagaggatcact

SEQ ID NO: 7774875 - DNA, 22 bp, Homo sapiens
aggctgaggcaagaggatcact

SEQ ID NO: 7774876 - DNA, 22 bp, Homo sapiens
ccagggctggtgggagatgctg

SEQ ID NO: 7774877 - DNA, 22 bp, Homo sapiens
ccagggctggtgggagatgctg

SEQ ID NO: 7774878 - DNA, 22 bp, Homo sapiens
ccaggctgtaaacaccttcaaa

SEQ ID NO: 7774879 - DNA, 22 bp, Homo sapiens
ccagggcctcgtgttctgagtg

SEQ ID NO: 7774880 - DNA, 22 bp, Homo sapiens
ccagggcctgagggcgacgccc

SEQ ID NO: 7774881 - DNA, 22 bp, Homo sapiens
ccagggcctgagggcgacgccc

SEQ ID NO: 7774882 - DNA, 19 bp, Homo sapiens
ccagggctccaagctgagt

SEQ ID NO: 7774883 - DNA, 22 bp, Homo sapiens
ccagggctcaggctcccagtgg

SEQ ID NO: 7774884 - DNA, 19 bp, Homo sapiens
aggctggagacaccaggcc

SEQ ID NO: 7774885 - DNA, 22 bp, Homo sapiens
aggctggaaagggaccagagtg

SEQ ID NO: 7774886 - DNA, 22 bp, Homo sapiens
aggctgctcagtagatggagct

SEQ ID NO: 7774887 - DNA, 22 bp, Homo sapiens
aggctggagtgtagcagtgcag

SEQ ID NO: 7774888 - DNA, 22 bp, Homo sapiens
aggctggcccacctcttgtctt

SEQ ID NO: 7774889 - DNA, 22 bp, Homo sapiens
aggctggcccacctcttgtctt

SEQ ID NO: 7774890 - DNA, 22 bp, Homo sapiens
aggctggccagtgctgcagtgg

SEQ ID NO: 7774891 - DNA, 22 bp, Homo sapiens
aggctggaggtttgttgcggct

SEQ ID NO: 7774892 - DNA, 22 bp, Homo sapiens
aggctggagacccgccaagaaa

SEQ ID NO: 7774893 - DNA, 22 bp, Homo sapiens
aggctggagagtgcagtggcgt

SEQ ID NO: 7774894 - DNA, 22 bp, Homo sapiens
aggctggagagtgcagtggcgt

SEQ ID NO: 7774895 - DNA, 22 bp, Homo sapiens
aggctggctggggatgcgtctt

SEQ ID NO: 7774896 - DNA, 22 bp, Homo sapiens
ccatttgttgtgtattaatatt

SEQ ID NO: 7774897 - DNA, 22 bp, Homo sapiens
aggctggggaattgaatttgct

SEQ ID NO: 7774898 - DNA, 22 bp, Homo sapiens
ccatttcacccactgctttagg

SEQ ID NO: 7774899 - DNA, 22 bp, Homo sapiens
ccatttagtaaggaagaacagc

SEQ ID NO: 7774900 - DNA, 22 bp, Homo sapiens
ccatttaacacagagttttcca

SEQ ID NO: 7774901 - DNA, 22 bp, Homo sapiens
aggctggcgtcaggggctgtac

SEQ ID NO: 7774902 - DNA, 22 bp, Homo sapiens
ccatttggaggtcattaggaca

SEQ ID NO: 7774903 - DNA, 22 bp, Homo sapiens
ccatttggcaaacattttacag

SEQ ID NO: 7774904 - DNA, 22 bp, Homo sapiens
ccatttggcaagaaagagtcat

SEQ ID NO: 7774905 - DNA, 22 bp, Homo sapiens
aggctggccctactggctgcct

SEQ ID NO: 7774906 - DNA, 22 bp, Homo sapiens
aggctggccctactggctgcct

SEQ ID NO: 7774907 - DNA, 17 bp, Homo sapiens
aggctggccttcacagt

SEQ ID NO: 7774908 - DNA, 22 bp, Homo sapiens
aggctggcctatttctttatcg

SEQ ID NO: 7774909 - DNA, 22 bp, Homo sapiens
aggctggcggtgactgctctga

SEQ ID NO: 7774910 - DNA, 22 bp, Homo sapiens
aggctggcgacatctggcgggc

SEQ ID NO: 7774911 - DNA, 22 bp, Homo sapiens
aggctggcgacatctggcgggc

SEQ ID NO: 7774912 - DNA, 22 bp, Homo sapiens
aggccacagttgaggccagcaa

SEQ ID NO: 7774913 - DNA, 22 bp, Homo sapiens
ccagaaaatatggctaaggtga

SEQ ID NO: 7774914 - DNA, 22 bp, Homo sapiens
ccagaaaatatggctaaggtga

SEQ ID NO: 7774915 - DNA, 18 bp, Homo sapiens
aggcaggctggagtgact

SEQ ID NO: 7774916 - DNA, 22 bp, Homo sapiens
ccagaacacagtggaagaatat

SEQ ID NO: 7774917 - DNA, 22 bp, Homo sapiens
aggcccagactcagcggggcgg

SEQ ID NO: 7774918 - DNA, 22 bp, Homo sapiens
ccagcaggaaagtgacgtttga

SEQ ID NO: 7774919 - DNA, 22 bp, Homo sapiens
ccagcaggactttggaaatatg

SEQ ID NO: 7774920 - DNA, 22 bp, Homo sapiens
ccagcaggagactagcaacata

SEQ ID NO: 7774921 - DNA, 22 bp, Homo sapiens
aggccagtggttctctgtgtcc

SEQ ID NO: 7774922 - DNA, 22 bp, Homo sapiens
aggccagtgcagctggaacaga

SEQ ID NO: 7774923 - DNA, 22 bp, Homo sapiens
aggccacagttgaggccagcaa

SEQ ID NO: 7774924 - DNA, 22 bp, Homo sapiens
aggccacatagcttgcatgtag

SEQ ID NO: 7774925 - DNA, 22 bp, Homo sapiens
aggccagaaatgtcagggagtg

SEQ ID NO: 7774926 - DNA, 22 bp, Homo sapiens
ccagagctgagggagcctgagc

SEQ ID NO: 7774927 - DNA, 22 bp, Homo sapiens
ccagagctgaggagatgggctt

SEQ ID NO: 7774928 - DNA, 22 bp, Homo sapiens
ccagagctccagggctacagaa

SEQ ID NO: 7774929 - DNA, 22 bp, Homo sapiens
ccagcaggagagaacatttccc

SEQ ID NO: 7774930 - DNA, 22 bp, Homo sapiens
ccagcaggagatgcctgtgtct

SEQ ID NO: 7774931 - DNA, 22 bp, Homo sapiens
ccagcaggcagtcatatccttt

SEQ ID NO: 7774932 - DNA, 22 bp, Homo sapiens
ccagctgagaagtgtaaagtga

SEQ ID NO: 7774933 - DNA, 22 bp, Homo sapiens
ccagctgacgatgcctggtctc

SEQ ID NO: 7774934 - DNA, 22 bp, Homo sapiens
ccagctggaagagtgcagaact

SEQ ID NO: 7774935 - DNA, 22 bp, Homo sapiens
aggcctctggaggtggcagtgt

SEQ ID NO: 7774936 - DNA, 22 bp, Homo sapiens
ccaggaaggcgttgttcctctc

SEQ ID NO: 7774937 - DNA, 22 bp, Homo sapiens
aggcctgggacgggagccgtga

SEQ ID NO: 7774938 - DNA, 22 bp, Homo sapiens
ccaggaaggcaggcctccccgc

SEQ ID NO: 7774939 - DNA, 18 bp, Homo sapiens
aggcctgggaagctgagg

SEQ ID NO: 7774940 - DNA, 22 bp, Homo sapiens
aggcctggccccagttgctagg

SEQ ID NO: 7774941 - DNA, 22 bp, Homo sapiens
aggcctggcatgagacctgaga

SEQ ID NO: 7774942 - DNA, 22 bp, Homo sapiens
aggcctggcatgagacctgaga

SEQ ID NO: 7774943 - DNA, 22 bp, Homo sapiens
aggcctggcctttatgttcaag

SEQ ID NO: 7774944 - DNA, 22 bp, Homo sapiens
aggcctggctttggtttgctga

SEQ ID NO: 7774945 - DNA, 22 bp, Homo sapiens
ccaggacaagccagagggacag

SEQ ID NO: 7774946 - DNA, 22 bp, Homo sapiens
ccaggaagtatgacccaacaga

SEQ ID NO: 7774947 - DNA, 22 bp, Homo sapiens
ccaggaagtatgacccaacaga

SEQ ID NO: 7774948 - DNA, 22 bp, Homo sapiens
ccaggaaggtgtttaactagag

SEQ ID NO: 7774949 - DNA, 22 bp, Homo sapiens
aggcctgtcccagctgaggacg

SEQ ID NO: 7774950 - DNA, 22 bp, Homo sapiens
aggcctgtagttcctctttcca

SEQ ID NO: 7774951 - DNA, 22 bp, Homo sapiens
ccaggacaagccagagggacag

SEQ ID NO: 7774952 - DNA, 22 bp, Homo sapiens
aggcgctgtgcttggggctgga

SEQ ID NO: 7774953 - DNA, 22 bp, Homo sapiens
ctggcctcatagccaagctgtg

SEQ ID NO: 7774954 - DNA, 22 bp, Homo sapiens
ctggcctcggcagcaggaacag

SEQ ID NO: 7774955 - DNA, 22 bp, Homo sapiens
ctggcctaaaaatacagaacaa

SEQ ID NO: 7774956 - DNA, 22 bp, Homo sapiens
ctggccggtatttgcctctggg

SEQ ID NO: 7774957 - DNA, 22 bp, Homo sapiens
ctggcccttctcttgcttcctg

SEQ ID NO: 7774958 - DNA, 22 bp, Homo sapiens
ctggcaggtttggtgtctggtg

SEQ ID NO: 7774959 - DNA, 22 bp, Homo sapiens
ctggcaggtttggtgtctggtg

SEQ ID NO: 7774960 - DNA, 22 bp, Homo sapiens
ctggcaggttatagagctgccc

SEQ ID NO: 7774961 - DNA, 22 bp, Homo sapiens
ctggcaggtttggtgtctggtg

SEQ ID NO: 7774962 - DNA, 22 bp, Homo sapiens
ctggcaggtttggtgtctggtg

SEQ ID NO: 7774963 - DNA, 22 bp, Homo sapiens
ctggcaggttatagagctgccc

SEQ ID NO: 7774964 - DNA, 22 bp, Homo sapiens
ctggcaggtggatggggactcc

SEQ ID NO: 7774965 - DNA, 22 bp, Homo sapiens
ctggcaggtggatggggactcc

SEQ ID NO: 7774966 - DNA, 22 bp, Homo sapiens
ctggcaggtggaggttgcagtg

SEQ ID NO: 7774967 - DNA, 22 bp, Homo sapiens
ctggcaggtccagctggactca

SEQ ID NO: 7774968 - DNA, 22 bp, Homo sapiens
ctggcaggtccagctggactca

SEQ ID NO: 7774969 - DNA, 22 bp, Homo sapiens
ctggcaggtccagctggactca

SEQ ID NO: 7774970 - DNA, 22 bp, Homo sapiens
ctggcaggtctcgctgacgtgt

SEQ ID NO: 7774971 - DNA, 22 bp, Homo sapiens
ctggcaggtggaggttgcagtg

SEQ ID NO: 7774972 - DNA, 22 bp, Homo sapiens
ctggcaggtggaggttgcagtg

SEQ ID NO: 7774973 - DNA, 20 bp, Homo sapiens
atacacattcatagaaaaat

SEQ ID NO: 7774974 - DNA, 22 bp, Homo sapiens
ctggcaagtactgggccagctc

SEQ ID NO: 7774975 - DNA, 20 bp, Homo sapiens
atacacattcatagaaaaat

SEQ ID NO: 7774976 - DNA, 22 bp, Homo sapiens
atacacattactttctgtctga

SEQ ID NO: 7774977 - DNA, 22 bp, Homo sapiens
ctggcacacagaggccctcggg

SEQ ID NO: 7774978 - DNA, 22 bp, Homo sapiens
ctggcacacagaggccctcggg

SEQ ID NO: 7774979 - DNA, 22 bp, Homo sapiens
ctggcacagccactgcaggcag

SEQ ID NO: 7774980 - DNA, 22 bp, Homo sapiens
ctggcacacagcaggctctcag

SEQ ID NO: 7774981 - DNA, 22 bp, Homo sapiens
ctggcacagccactgcaggcag

SEQ ID NO: 7774982 - DNA, 22 bp, Homo sapiens
ctggcacagttaacatatgcta

SEQ ID NO: 7774983 - DNA, 23 bp, Homo sapiens
atacatggccggatatgatgttc

SEQ ID NO: 7774984 - DNA, 22 bp, Homo sapiens
atacatggaagatgcttagcac

SEQ ID NO: 7774985 - DNA, 22 bp, Homo sapiens
atacatgtcatcatatgtttgt

SEQ ID NO: 7774986 - DNA, 22 bp, Homo sapiens
ctggcagcttagcactctggtt

SEQ ID NO: 7774987 - DNA, 22 bp, Homo sapiens
atacatgtgtccctgatttatt

SEQ ID NO: 7774988 - DNA, 22 bp, Homo sapiens
atacatgtgggtctaaacatat

SEQ ID NO: 7774989 - DNA, 22 bp, Homo sapiens
ctggcctctctgagcagggagc

SEQ ID NO: 7774990 - DNA, 19 bp, Homo sapiens
ctggcctgtgtcctgtgct

SEQ ID NO: 7774991 - DNA, 23 bp, Homo sapiens
atataaacaccagatagattgta

SEQ ID NO: 7774992 - DNA, 22 bp, Homo sapiens
atagttttaaaacctcaggaag

SEQ ID NO: 7774993 - DNA, 22 bp, Homo sapiens
atagttttatagatattgtgta

SEQ ID NO: 7774994 - DNA, 23 bp, Homo sapiens
atataaacaccagatagattgta

SEQ ID NO: 7774995 - DNA, 23 bp, Homo sapiens
atagttttccctggttcttgcca

SEQ ID NO: 7774996 - DNA, 22 bp, Homo sapiens
atagttttctatgcactgttat

SEQ ID NO: 7774997 - DNA, 22 bp, Homo sapiens
ctgggagctgtcaggagcgtgt

SEQ ID NO: 7774998 - DNA, 22 bp, Homo sapiens
ctgggagctggatgccctgccc

SEQ ID NO: 7774999 - DNA, 22 bp, Homo sapiens
ctgggagctggaatgggagaag

SEQ ID NO: 7775000 - DNA, 22 bp, Homo sapiens
atatacttggagactatcattg

SEQ ID NO: 7775001 - DNA, 20 bp, Homo sapiens
atataccatcccacaacagg

SEQ ID NO: 7775002 - DNA, 22 bp, Homo sapiens
atatactgtaggccactataag

SEQ ID NO: 7775003 - DNA, 22 bp, Homo sapiens
atatacttgatttaactgagca

SEQ ID NO: 7775004 - DNA, 22 bp, Homo sapiens
atatacttccccattatggggg

SEQ ID NO: 7775005 - DNA, 22 bp, Homo sapiens
atatacagggagaaacagctta

SEQ ID NO: 7775006 - DNA, 22 bp, Homo sapiens
atatacacatttgcttatgtgt

SEQ ID NO: 7775007 - DNA, 22 bp, Homo sapiens
atatacacatgtgtatacattt

SEQ ID NO: 7775008 - DNA, 19 bp, Homo sapiens
ctggctgcaatgccagggt

SEQ ID NO: 7775009 - DNA, 22 bp, Homo sapiens
ataaaaaggacagatgtggtct

SEQ ID NO: 7775010 - DNA, 22 bp, Homo sapiens
ataaaaatgagggcggtagcta

SEQ ID NO: 7775011 - DNA, 22 bp, Homo sapiens
ataaaaactgacccatcctttg

SEQ ID NO: 7775012 - DNA, 17 bp, Homo sapiens
agttttgatataatggc

SEQ ID NO: 7775013 - DNA, 22 bp, Homo sapiens
ataaaacttgggtatgatccct

SEQ ID NO: 7775014 - DNA, 22 bp, Homo sapiens
ataaaagaagttttggtacttg

SEQ ID NO: 7775015 - DNA, 22 bp, Homo sapiens
agttctggtggtttggagatct

SEQ ID NO: 7775016 - DNA, 22 bp, Homo sapiens
agttctcattgcatgagacaga

SEQ ID NO: 7775017 - DNA, 22 bp, Homo sapiens
agttcgagatctgctgatgaga

SEQ ID NO: 7775018 - DNA, 22 bp, Homo sapiens
ctgcagggacccaagtctttgg

SEQ ID NO: 7775019 - DNA, 22 bp, Homo sapiens
ataaaatcagagttggattgga

SEQ ID NO: 7775020 - DNA, 22 bp, Homo sapiens
ataaactgaagggaacactgag

SEQ ID NO: 7775021 - DNA, 21 bp, Homo sapiens
ataaactgcatcaagttggtg

SEQ ID NO: 7775022 - DNA, 22 bp, Homo sapiens
ataaactgggtatcaagaggcc

SEQ ID NO: 7775023 - DNA, 22 bp, Homo sapiens
ataaactctgcctcagaagagc

SEQ ID NO: 7775024 - DNA, 22 bp, Homo sapiens
ataaactgaagggaacactgag

SEQ ID NO: 7775025 - DNA, 22 bp, Homo sapiens
ataaactatgtaatttgctcta

SEQ ID NO: 7775026 - DNA, 22 bp, Homo sapiens
ataaactcatgccaagaaatga

SEQ ID NO: 7775027 - DNA, 22 bp, Homo sapiens
ataaagatttctttttctctac

SEQ ID NO: 7775028 - DNA, 22 bp, Homo sapiens
ataaagcaaataggactattgc

SEQ ID NO: 7775029 - DNA, 22 bp, Homo sapiens
ataaactgtgctggatgatgag

SEQ ID NO: 7775030 - DNA, 22 bp, Homo sapiens
ataaactggtaggaaaacagta

SEQ ID NO: 7775031 - DNA, 22 bp, Homo sapiens
ataaactggtaggaaaacagta

SEQ ID NO: 7775032 - DNA, 23 bp, Homo sapiens
ataaactgtcaaaagccagccct

SEQ ID NO: 7775033 - DNA, 22 bp, Homo sapiens
atacacatctatttaagagaca

SEQ ID NO: 7775034 - DNA, 20 bp, Homo sapiens
atacacatattcttgcaact

SEQ ID NO: 7775035 - DNA, 22 bp, Homo sapiens
atacacatatgtgtgtatatgt

SEQ ID NO: 7775036 - DNA, 21 bp, Homo sapiens
atacacatacacataaatgtg

SEQ ID NO: 7775037 - DNA, 22 bp, Homo sapiens
atacaagttgcccaaatgatta

SEQ ID NO: 7775038 - DNA, 22 bp, Homo sapiens
ctgctgtgcttgtggccacccg

SEQ ID NO: 7775039 - DNA, 18 bp, Homo sapiens
ctgctgtgtcgtctgggc

SEQ ID NO: 7775040 - DNA, 22 bp, Homo sapiens
ctgctgtgtcagagtccagggg

SEQ ID NO: 7775041 - DNA, 22 bp, Homo sapiens
ctgcctggtctcaggcatgggg

SEQ ID NO: 7775042 - DNA, 22 bp, Homo sapiens
ctgcctggtctcaggcatgggg

SEQ ID NO: 7775043 - DNA, 22 bp, Homo sapiens
ctgcctgggttcaagtcctgtt

SEQ ID NO: 7775044 - DNA, 22 bp, Homo sapiens
ctgcctgggttcaagtcctgtt

SEQ ID NO: 7775045 - DNA, 22 bp, Homo sapiens
ctgcctggaaggagcaagggga

SEQ ID NO: 7775046 - DNA, 22 bp, Homo sapiens
ctgcctggaaggagcaagggga

SEQ ID NO: 7775047 - DNA, 22 bp, Homo sapiens
ctgcctggaaggagcaagggga

SEQ ID NO: 7775048 - DNA, 22 bp, Homo sapiens
ctgcctggaaggagcaagggga

SEQ ID NO: 7775049 - DNA, 22 bp, Homo sapiens
ctgcctggggcatcagtcaagg

SEQ ID NO: 7775050 - DNA, 22 bp, Homo sapiens
ataaaggataatccattagact

SEQ ID NO: 7775051 - DNA, 22 bp, Homo sapiens
ataaagcttctgagtctagatc

SEQ ID NO: 7775052 - DNA, 22 bp, Homo sapiens
ataaagctttgaaatggagata

SEQ ID NO: 7775053 - DNA, 22 bp, Homo sapiens
ctgcctgtgatttttctctagt

SEQ ID NO: 7775054 - DNA, 22 bp, Homo sapiens
ctgcctggtgcggtgcccaccc

SEQ ID NO: 7775055 - DNA, 22 bp, Homo sapiens
ctgcctgtgccaccgcctcatt

SEQ ID NO: 7775056 - DNA, 22 bp, Homo sapiens
ctgcctgtgccaatgctccttt

SEQ ID NO: 7775057 - DNA, 22 bp, Homo sapiens
ctgctgggctcctcatgtgact

SEQ ID NO: 7775058 - DNA, 22 bp, Homo sapiens
ctgctgggcctggtctctgagg

SEQ ID NO: 7775059 - DNA, 22 bp, Homo sapiens
ctgctagggttcagcagtgcct

SEQ ID NO: 7775060 - DNA, 22 bp, Homo sapiens
atcacacagagcattaggggcc

SEQ ID NO: 7775061 - DNA, 22 bp, Homo sapiens
atcacaatgtacgttaaaatgt

SEQ ID NO: 7775062 - DNA, 22 bp, Homo sapiens
atcacaatcttcaaatcgattc

SEQ ID NO: 7775063 - DNA, 22 bp, Homo sapiens
atcaagaattgggagctattga

SEQ ID NO: 7775064 - DNA, 22 bp, Homo sapiens
atcacagatttgatacttttgt

SEQ ID NO: 7775065 - DNA, 22 bp, Homo sapiens
atcacagagattgcttttaaaa

SEQ ID NO: 7775066 - DNA, 22 bp, Homo sapiens
ctgtaaatatgaagaatatatg

SEQ ID NO: 7775067 - DNA, 22 bp, Homo sapiens
atcagctgaaaaacaggcagca

SEQ ID NO: 7775068 - DNA, 22 bp, Homo sapiens
ctgtaatcccagctacctggga

SEQ ID NO: 7775069 - DNA, 22 bp, Homo sapiens
ctgtaatcccagctactcggga

SEQ ID NO: 7775070 - DNA, 22 bp, Homo sapiens
ctgtaatcccagctacctggga

SEQ ID NO: 7775071 - DNA, 22 bp, Homo sapiens
atcataaaattgcaccatttct

SEQ ID NO: 7775072 - DNA, 22 bp, Homo sapiens
atcataaaattgcaccatttct

SEQ ID NO: 7775073 - DNA, 22 bp, Homo sapiens
atcataaaattgcaccatttct

SEQ ID NO: 7775074 - DNA, 22 bp, Homo sapiens
atcataaaattgcaccatttct

SEQ ID NO: 7775075 - DNA, 22 bp, Homo sapiens
atcataaaattgcaccatttct

SEQ ID NO: 7775076 - DNA, 22 bp, Homo sapiens
atcataagacccagccagtatt

SEQ ID NO: 7775077 - DNA, 22 bp, Homo sapiens
atcataagacccagccagtatt

SEQ ID NO: 7775078 - DNA, 22 bp, Homo sapiens
atcataattgctccagtgatat

SEQ ID NO: 7775079 - DNA, 22 bp, Homo sapiens
atcatacactcacataaacaga

SEQ ID NO: 7775080 - DNA, 22 bp, Homo sapiens
atcataaagtgctatctgattg

SEQ ID NO: 7775081 - DNA, 22 bp, Homo sapiens
atcataaagtgctatctgattg

SEQ ID NO: 7775082 - DNA, 22 bp, Homo sapiens
atcataaagtgctatctgattg

SEQ ID NO: 7775083 - DNA, 22 bp, Homo sapiens
atcataaagtgctatctgattg

SEQ ID NO: 7775084 - DNA, 22 bp, Homo sapiens
atcataaaccactttgtaatct

SEQ ID NO: 7775085 - DNA, 22 bp, Homo sapiens
ctgtctcaagactgcaggcact

SEQ ID NO: 7775086 - DNA, 22 bp, Homo sapiens
ctgtctcagcaggaagtcatca

SEQ ID NO: 7775087 - DNA, 22 bp, Homo sapiens
ctgtctctgtcttaactcccag

SEQ ID NO: 7775088 - DNA, 22 bp, Homo sapiens
atattattctagctcttgtgtg

SEQ ID NO: 7775089 - DNA, 22 bp, Homo sapiens
ctgggggcaatggtcagagtgt

SEQ ID NO: 7775090 - DNA, 22 bp, Homo sapiens
atattattctagtaacagtgat

SEQ ID NO: 7775091 - DNA, 22 bp, Homo sapiens
atattattctagtaacagtgat

SEQ ID NO: 7775092 - DNA, 22 bp, Homo sapiens
atattattctagtaacagtgat

SEQ ID NO: 7775093 - DNA, 22 bp, Homo sapiens
ctgggggcaagcagacagctgt

SEQ ID NO: 7775094 - DNA, 19 bp, Homo sapiens
ctggggctttggtactgcc

SEQ ID NO: 7775095 - DNA, 19 bp, Homo sapiens
ctggggctttggtactgcc

SEQ ID NO: 7775096 - DNA, 22 bp, Homo sapiens
ctggggcttcaatgcttcggtg

SEQ ID NO: 7775097 - DNA, 22 bp, Homo sapiens
ctggggctgtgggagacaaggc

SEQ ID NO: 7775098 - DNA, 22 bp, Homo sapiens
ctgggagcttgttaggaatgca

SEQ ID NO: 7775099 - DNA, 22 bp, Homo sapiens
ctgggaggacaacttggagctc

SEQ ID NO: 7775100 - DNA, 22 bp, Homo sapiens
ctgggaggattcattgaggtga

SEQ ID NO: 7775101 - DNA, 22 bp, Homo sapiens
ctgggaggcggaggttgtagtg

SEQ ID NO: 7775102 - DNA, 22 bp, Homo sapiens
atattattttccctggagttgt

SEQ ID NO: 7775103 - DNA, 22 bp, Homo sapiens
atattattttccctggagttgt

SEQ ID NO: 7775104 - DNA, 22 bp, Homo sapiens
atattcaaattacatttactaa

SEQ ID NO: 7775105 - DNA, 22 bp, Homo sapiens
atattcactgagcataaagcca

SEQ ID NO: 7775106 - DNA, 18 bp, Homo sapiens
atattcaagaagacagag

SEQ ID NO: 7775107 - DNA, 22 bp, Homo sapiens
atattcacactgtttagttaca

SEQ ID NO: 7775108 - DNA, 20 bp, Homo sapiens
ctgggtggcaagcaaggggg

SEQ ID NO: 7775109 - DNA, 22 bp, Homo sapiens
ctggtcccagcagagctctgag

SEQ ID NO: 7775110 - DNA, 22 bp, Homo sapiens
atcaagaaaagtgctttcggct

SEQ ID NO: 7775111 - DNA, 22 bp, Homo sapiens
atcaagaacttattttggaaat

SEQ ID NO: 7775112 - DNA, 22 bp, Homo sapiens
ctgggtggcgtctggggccagt

SEQ ID NO: 7775113 - DNA, 22 bp, Homo sapiens
ctgggtggcgtctggggccagt

SEQ ID NO: 7775114 - DNA, 22 bp, Homo sapiens
ctgggtggcgtctggggccagt

SEQ ID NO: 7775115 - DNA, 22 bp, Homo sapiens
ctggtcaggaaggtggggacag

SEQ ID NO: 7775116 - DNA, 22 bp, Homo sapiens
ctggtcaggggatggggctcag

SEQ ID NO: 7775117 - DNA, 22 bp, Homo sapiens
ctggtcagggctctttgggagc

SEQ ID NO: 7775118 - DNA, 22 bp, Homo sapiens
ctggtcaggggatggggctcag

SEQ ID NO: 7775119 - DNA, 22 bp, Homo sapiens
ctggtcaggggatggggctcag

SEQ ID NO: 7775120 - DNA, 22 bp, Homo sapiens
cttcttaatgacagattaaaat

SEQ ID NO: 7775121 - DNA, 22 bp, Homo sapiens
cttcttaaagttgtcacagctg

SEQ ID NO: 7775122 - DNA, 22 bp, Homo sapiens
atctggttcttcttaggcatca

SEQ ID NO: 7775123 - DNA, 22 bp, Homo sapiens
atctgtaaagataatcatatgt

SEQ ID NO: 7775124 - DNA, 22 bp, Homo sapiens
atctgtcatcagcaccacaggt

SEQ ID NO: 7775125 - DNA, 22 bp, Homo sapiens
atctgtaattttgaatgcaaat

SEQ ID NO: 7775126 - DNA, 22 bp, Homo sapiens
atctgtgagaaaggcttgtgct

SEQ ID NO: 7775127 - DNA, 22 bp, Homo sapiens
atctccgccatcgcgaacgcct

SEQ ID NO: 7775128 - DNA, 23 bp, Homo sapiens
atctcctgagaacccacagtggt

SEQ ID NO: 7775129 - DNA, 20 bp, Homo sapiens
atctcctgctaccacccatt

SEQ ID NO: 7775130 - DNA, 18 bp, Homo sapiens
atctcccattggccaagg

SEQ ID NO: 7775131 - DNA, 19 bp, Homo sapiens
cttctgcagggtgacagtg

SEQ ID NO: 7775132 - DNA, 22 bp, Homo sapiens
cttctgcaggccctgtctgacc

SEQ ID NO: 7775133 - DNA, 22 bp, Homo sapiens
cttctgagatgttgttttacag

SEQ ID NO: 7775134 - DNA, 22 bp, Homo sapiens
cttcaattgccaccagctagca

SEQ ID NO: 7775135 - DNA, 20 bp, Homo sapiens
cttcaagttatggttggcaa

SEQ ID NO: 7775136 - DNA, 22 bp, Homo sapiens
cttcaaggcttattccagttgt

SEQ ID NO: 7775137 - DNA, 22 bp, Homo sapiens
cttcaagtccagctcatgctct

SEQ ID NO: 7775138 - DNA, 22 bp, Homo sapiens
cttcctctatgttcaggtagaa

SEQ ID NO: 7775139 - DNA, 22 bp, Homo sapiens
cttatggaagaaacctcagaga

SEQ ID NO: 7775140 - DNA, 22 bp, Homo sapiens
cttatggcctgcccacagtagt

SEQ ID NO: 7775141 - DNA, 22 bp, Homo sapiens
cttatctgagaaagatgctaca

SEQ ID NO: 7775142 - DNA, 22 bp, Homo sapiens
cttattcaatgctggaaatgtt

SEQ ID NO: 7775143 - DNA, 22 bp, Homo sapiens
cttattcagaaggagaaatgga

SEQ ID NO: 7775144 - DNA, 22 bp, Homo sapiens
atcatacatgtaactaagtaaa

SEQ ID NO: 7775145 - DNA, 22 bp, Homo sapiens
atcatacatgtaactaagtaaa

SEQ ID NO: 7775146 - DNA, 22 bp, Homo sapiens
ctgtttctccacactcttccca

SEQ ID NO: 7775147 - DNA, 22 bp, Homo sapiens
cttaagaagcaagtctcagcaa

SEQ ID NO: 7775148 - DNA, 22 bp, Homo sapiens
atccatttcctccactataaag

SEQ ID NO: 7775149 - DNA, 22 bp, Homo sapiens
cttagatgaagtcacagaaccc

SEQ ID NO: 7775150 - DNA, 23 bp, Homo sapiens
atccatgcttaagtaatcatttg

SEQ ID NO: 7775151 - DNA, 22 bp, Homo sapiens
atccatgaccctctcaacaacc

SEQ ID NO: 7775152 - DNA, 21 bp, Homo sapiens
atccatccatcttggcctaac

SEQ ID NO: 7775153 - DNA, 22 bp, Homo sapiens
cttaataataggtgaggctatg

SEQ ID NO: 7775154 - DNA, 22 bp, Homo sapiens
cttaataaatggtagctgttat

SEQ ID NO: 7775155 - DNA, 22 bp, Homo sapiens
cttaaggcttcagcacaggtat

SEQ ID NO: 7775156 - DNA, 20 bp, Homo sapiens
agtcacatgcatacacaagt

SEQ ID NO: 7775157 - DNA, 22 bp, Homo sapiens
agtcacagaatgatggctccag

SEQ ID NO: 7775158 - DNA, 22 bp, Homo sapiens
agtcacagaatgatggctccag

SEQ ID NO: 7775159 - DNA, 22 bp, Homo sapiens
agtcacagaaacccaggtgtgg

SEQ ID NO: 7775160 - DNA, 22 bp, Homo sapiens
agtcacaggcaagagggctcca

SEQ ID NO: 7775161 - DNA, 19 bp, Homo sapiens
agtcacagaccttgtctcc

SEQ ID NO: 7775162 - DNA, 22 bp, Homo sapiens
agtcacatggactcaggatgac

SEQ ID NO: 7775163 - DNA, 22 bp, Homo sapiens
agtcacatgggattagaaccca

SEQ ID NO: 7775164 - DNA, 22 bp, Homo sapiens
ctagcttagggaaactgacaga

SEQ ID NO: 7775165 - DNA, 22 bp, Homo sapiens
ctagctgtaagagggatgtggc

SEQ ID NO: 7775166 - DNA, 22 bp, Homo sapiens
ctaggaccactgtaacaaagta

SEQ ID NO: 7775167 - DNA, 22 bp, Homo sapiens
ctaggcaaagtattaatgagtg

SEQ ID NO: 7775168 - DNA, 18 bp, Homo sapiens
ctatccctggagcttggg

SEQ ID NO: 7775169 - DNA, 22 bp, Homo sapiens
ctatctgtaaatttgaggttct

SEQ ID NO: 7775170 - DNA, 22 bp, Homo sapiens
agtcaggaagctggagctgggg

SEQ ID NO: 7775171 - DNA, 22 bp, Homo sapiens
agtcagcttggctcctcccatg

SEQ ID NO: 7775172 - DNA, 22 bp, Homo sapiens
agtcagcagtgaaagcacagcc

SEQ ID NO: 7775173 - DNA, 22 bp, Homo sapiens
agtcagcagcctggccaggaga

SEQ ID NO: 7775174 - DNA, 22 bp, Homo sapiens
ctatatatatcatcttccagtt

SEQ ID NO: 7775175 - DNA, 22 bp, Homo sapiens
ccttctctctgaagaccccaaa

SEQ ID NO: 7775176 - DNA, 22 bp, Homo sapiens
ccttctctaccatgtgaggaaa

SEQ ID NO: 7775177 - DNA, 22 bp, Homo sapiens
ccttctcctgccttgggttcat

SEQ ID NO: 7775178 - DNA, 22 bp, Homo sapiens
agtaaataacagagaaaatggg

SEQ ID NO: 7775179 - DNA, 22 bp, Homo sapiens
agtaaataacagagaaaatggg

SEQ ID NO: 7775180 - DNA, 22 bp, Homo sapiens
agtaaattatttagcttccaga

SEQ ID NO: 7775181 - DNA, 22 bp, Homo sapiens
agtaaatgattattttgccaac

SEQ ID NO: 7775182 - DNA, 22 bp, Homo sapiens
agtaaatggtggtttttatcat

SEQ ID NO: 7775183 - DNA, 22 bp, Homo sapiens
agtaaacataatttacctgtag

SEQ ID NO: 7775184 - DNA, 22 bp, Homo sapiens
agtaaacatttcagatttattt

SEQ ID NO: 7775185 - DNA, 22 bp, Homo sapiens
agtagcacaattttgtccctaa

SEQ ID NO: 7775186 - DNA, 22 bp, Homo sapiens
agtagaaatgtaagaaggatta

SEQ ID NO: 7775187 - DNA, 22 bp, Homo sapiens
agtagcatgtgcacagtaattt

SEQ ID NO: 7775188 - DNA, 18 bp, Homo sapiens
agtaggcactgtggggtt

SEQ ID NO: 7775189 - DNA, 22 bp, Homo sapiens
agtagcagaaggtcttgaaggg

SEQ ID NO: 7775190 - DNA, 20 bp, Homo sapiens
agtagcagtaatatggaaga

SEQ ID NO: 7775191 - DNA, 22 bp, Homo sapiens
agtagcagtttggctgaattta

SEQ ID NO: 7775192 - DNA, 22 bp, Homo sapiens
agtagcagtgacagctgaggta

SEQ ID NO: 7775193 - DNA, 22 bp, Homo sapiens
agtcaatattcaagtgtaaata

SEQ ID NO: 7775194 - DNA, 23 bp, Homo sapiens
agtcaagatgcatctgtgaggaa

SEQ ID NO: 7775195 - DNA, 22 bp, Homo sapiens
agtcaagattctggcactagca

SEQ ID NO: 7775196 - DNA, 22 bp, Homo sapiens
agtcaaggctattatgtgggaa

SEQ ID NO: 7775197 - DNA, 22 bp, Homo sapiens
cctgtttatctatctagagatg

SEQ ID NO: 7775198 - DNA, 22 bp, Homo sapiens
cctgtttaccactgaggggcag

SEQ ID NO: 7775199 - DNA, 22 bp, Homo sapiens
aggtggcagccgagacataagg

SEQ ID NO: 7775200 - DNA, 22 bp, Homo sapiens
aggtggcaggaggtcagagaaa

SEQ ID NO: 7775201 - DNA, 22 bp, Homo sapiens
ccttccagaggcgtgacaccct

SEQ ID NO: 7775202 - DNA, 22 bp, Homo sapiens
cctgtgggaggttctgtgagtc

SEQ ID NO: 7775203 - DNA, 22 bp, Homo sapiens
cctgtgggagcccaggcagata

SEQ ID NO: 7775204 - DNA, 22 bp, Homo sapiens
cctgtgggagggagcggctgga

SEQ ID NO: 7775205 - DNA, 22 bp, Homo sapiens
cctgtgggcgcagctggagtca

SEQ ID NO: 7775206 - DNA, 22 bp, Homo sapiens
cctgtgggccctggacagagac

SEQ ID NO: 7775207 - DNA, 22 bp, Homo sapiens
cctgtgggccctggacagagac

SEQ ID NO: 7775208 - DNA, 20 bp, Homo sapiens
cctggggtacactggcatgt

SEQ ID NO: 7775209 - DNA, 22 bp, Homo sapiens
cctggggtatataggtgaatat

SEQ ID NO: 7775210 - DNA, 22 bp, Homo sapiens
cctggggtatataggtgaatat

SEQ ID NO: 7775211 - DNA, 22 bp, Homo sapiens
cctggggctctgcacagagcag

SEQ ID NO: 7775212 - DNA, 22 bp, Homo sapiens
cctggggctctgcacagagcag

SEQ ID NO: 7775213 - DNA, 22 bp, Homo sapiens
cctggggctctgcacagagcag

SEQ ID NO: 7775214 - DNA, 22 bp, Homo sapiens
cctggggctccagagcagcgga

SEQ ID NO: 7775215 - DNA, 22 bp, Homo sapiens
cctgggctttgagggcaggatg

SEQ ID NO: 7775216 - DNA, 20 bp, Homo sapiens
aggtcctggttctctgggat

SEQ ID NO: 7775217 - DNA, 22 bp, Homo sapiens
aggtcctggtgaccatggagtt

SEQ ID NO: 7775218 - DNA, 22 bp, Homo sapiens
aggtcctggtgaccatggagtt

SEQ ID NO: 7775219 - DNA, 22 bp, Homo sapiens
aggtcctggtcttgagtcttaa

SEQ ID NO: 7775220 - DNA, 22 bp, Homo sapiens
aggtcctgggagttctagtgtg

SEQ ID NO: 7775221 - DNA, 20 bp, Homo sapiens
aggtcctgggactggcagag

SEQ ID NO: 7775222 - DNA, 22 bp, Homo sapiens
aggtcctggactgctcttgtta

SEQ ID NO: 7775223 - DNA, 22 bp, Homo sapiens
aggtcctgatgatctctgagag

SEQ ID NO: 7775224 - DNA, 22 bp, Homo sapiens
cctgggtcactcaggcaggcgg

SEQ ID NO: 7775225 - DNA, 22 bp, Homo sapiens
cctgggtcaccaggcccaggca

SEQ ID NO: 7775226 - DNA, 22 bp, Homo sapiens
cctggggtcagggacgctgtgc

SEQ ID NO: 7775227 - DNA, 22 bp, Homo sapiens
cctgtgccagctgggccctgcc

SEQ ID NO: 7775228 - DNA, 22 bp, Homo sapiens
aggtgcagctgacaccatgtgg

SEQ ID NO: 7775229 - DNA, 22 bp, Homo sapiens
aggtaaggtttggaggcagtgg

SEQ ID NO: 7775230 - DNA, 22 bp, Homo sapiens
aggtaaggtttggaggcagtgg

SEQ ID NO: 7775231 - DNA, 22 bp, Homo sapiens
aggtaatgcatataaagtgctt

SEQ ID NO: 7775232 - DNA, 22 bp, Homo sapiens
aggtcacacaactgtcagaggc

SEQ ID NO: 7775233 - DNA, 22 bp, Homo sapiens
aggtaaggctgtaagctaagcc

SEQ ID NO: 7775234 - DNA, 22 bp, Homo sapiens
aggtaagggtcacagttcatat

SEQ ID NO: 7775235 - DNA, 22 bp, Homo sapiens
aggtaaggaaattgaggcaatt

SEQ ID NO: 7775236 - DNA, 22 bp, Homo sapiens
cctgagtcccataatgttgcca

SEQ ID NO: 7775237 - DNA, 22 bp, Homo sapiens
aggtcagaaaaggagagcattg

SEQ ID NO: 7775238 - DNA, 22 bp, Homo sapiens
aggtcagatgggagatgggatg

SEQ ID NO: 7775239 - DNA, 22 bp, Homo sapiens
cctgggaggctgtttccagcct

SEQ ID NO: 7775240 - DNA, 22 bp, Homo sapiens
cctgggagggcaagtgctgatg

SEQ ID NO: 7775241 - DNA, 18 bp, Homo sapiens
agtgccagctctgctttc

SEQ ID NO: 7775242 - DNA, 22 bp, Homo sapiens
agtgattctttaaagtggtatt

SEQ ID NO: 7775243 - DNA, 20 bp, Homo sapiens
agtgatttatctttttccac

SEQ ID NO: 7775244 - DNA, 22 bp, Homo sapiens
agtgatttcatcattttatcaa

SEQ ID NO: 7775245 - DNA, 22 bp, Homo sapiens
agtgattaattgtaaaaattct

SEQ ID NO: 7775246 - DNA, 19 bp, Homo sapiens
agtgcattttatgtttcaa

SEQ ID NO: 7775247 - DNA, 22 bp, Homo sapiens
agtgccagctccacacagcagc

SEQ ID NO: 7775248 - DNA, 22 bp, Homo sapiens
agtgccaaggtattaatttata

SEQ ID NO: 7775249 - DNA, 22 bp, Homo sapiens
agtgcatttggggtagtggaag

SEQ ID NO: 7775250 - DNA, 22 bp, Homo sapiens
agtgcattgcatctctgcttca

SEQ ID NO: 7775251 - DNA, 22 bp, Homo sapiens
agtgcattctgtcatcttggtt

SEQ ID NO: 7775252 - DNA, 22 bp, Homo sapiens
agtgcattctccatcatctagg

SEQ ID NO: 7775253 - DNA, 22 bp, Homo sapiens
agtgcattctggcagaacaggt

SEQ ID NO: 7775254 - DNA, 22 bp, Homo sapiens
agtgcattctctaattacaggt

SEQ ID NO: 7775255 - DNA, 22 bp, Homo sapiens
agtgcattcagtattcataggc

SEQ ID NO: 7775256 - DNA, 22 bp, Homo sapiens
agtgcattcctggggaagaagc

SEQ ID NO: 7775257 - DNA, 22 bp, Homo sapiens
agtgcattatatgtttcaatgg

SEQ ID NO: 7775258 - DNA, 22 bp, Homo sapiens
agtggagaccccacttctacat

SEQ ID NO: 7775259 - DNA, 22 bp, Homo sapiens
agtggagaagaggatggtctcc

SEQ ID NO: 7775260 - DNA, 22 bp, Homo sapiens
agtggcaatgtagagagtgatc

SEQ ID NO: 7775261 - DNA, 22 bp, Homo sapiens
agtggcaatgggagtggagaca

SEQ ID NO: 7775262 - DNA, 22 bp, Homo sapiens
agtggcaagtcaatgatagtga

SEQ ID NO: 7775263 - DNA, 22 bp, Homo sapiens
agtggcaagagggtctattgtt

SEQ ID NO: 7775264 - DNA, 22 bp, Homo sapiens
agtggagttgagttgatggatt

SEQ ID NO: 7775265 - DNA, 22 bp, Homo sapiens
agtggagtgagtggcagaagga

SEQ ID NO: 7775266 - DNA, 20 bp, Homo sapiens
agtggccactgcagagatgc

SEQ ID NO: 7775267 - DNA, 22 bp, Homo sapiens
agtctagcttaggagcctagct

SEQ ID NO: 7775268 - DNA, 22 bp, Homo sapiens
agtctatattgtgaaagtaaaa

SEQ ID NO: 7775269 - DNA, 22 bp, Homo sapiens
agtctattgcctaacagagagg

SEQ ID NO: 7775270 - DNA, 22 bp, Homo sapiens
agtctacagttccctcaggtcc

SEQ ID NO: 7775271 - DNA, 22 bp, Homo sapiens
agtctattttagctgcatatgt

SEQ ID NO: 7775272 - DNA, 22 bp, Homo sapiens
agtctattttcagaagcagttt

SEQ ID NO: 7775273 - DNA, 23 bp, Homo sapiens
agtctcaagctggagaattacct

SEQ ID NO: 7775274 - DNA, 22 bp, Homo sapiens
agtctcaagtgttagtattatt

SEQ ID NO: 7775275 - DNA, 18 bp, Homo sapiens
agtctttatttctttcat

SEQ ID NO: 7775276 - DNA, 22 bp, Homo sapiens
agtctttattgtcgtcactaga

SEQ ID NO: 7775277 - DNA, 22 bp, Homo sapiens
agtctttatttagagttaggac

SEQ ID NO: 7775278 - DNA, 22 bp, Homo sapiens
agtctttccttttggaagaaaa

SEQ ID NO: 7775279 - DNA, 22 bp, Homo sapiens
agtctttggttataagagacag

SEQ ID NO: 7775280 - DNA, 22 bp, Homo sapiens
agtctttatacagaaatatatg

SEQ ID NO: 7775281 - DNA, 22 bp, Homo sapiens
agtcttctgctctgtcactaac

SEQ ID NO: 7775282 - DNA, 22 bp, Homo sapiens
agtctttattcactattgataa

SEQ ID NO: 7775283 - DNA, 22 bp, Homo sapiens
agtctttatgattgtcaaagta

SEQ ID NO: 7775284 - DNA, 22 bp, Homo sapiens
agtctttatacagaaatatatg

SEQ ID NO: 7775285 - DNA, 22 bp, Homo sapiens
agtgagtcaaacatatcctgac

SEQ ID NO: 7775286 - DNA, 22 bp, Homo sapiens
agtgagtggagagctctaggtt

SEQ ID NO: 7775287 - DNA, 22 bp, Homo sapiens
agtgagtggatgtaggaattgg

SEQ ID NO: 7775288 - DNA, 22 bp, Homo sapiens
agtgaggggcagctgagtgggc

SEQ ID NO: 7775289 - DNA, 22 bp, Homo sapiens
agtgaggggcagctgagtgggc

SEQ ID NO: 7775290 - DNA, 22 bp, Homo sapiens
agtgagggactccatgactcct

SEQ ID NO: 7775291 - DNA, 20 bp, Homo sapiens
agtgagttatcagctacagt

SEQ ID NO: 7775292 - DNA, 22 bp, Homo sapiens
agtgatcttttaaaaagaagtg

SEQ ID NO: 7775293 - DNA, 23 bp, Homo sapiens
agtgatctgtgtttgaagaatgc

SEQ ID NO: 7775294 - DNA, 22 bp, Homo sapiens
agtgatcttttaaaaagaagtg

SEQ ID NO: 7775295 - DNA, 22 bp, Homo sapiens
agtgaggctaataggcaatggt

SEQ ID NO: 7775296 - DNA, 22 bp, Homo sapiens
agtgaaattcctggtctttgtt

SEQ ID NO: 7775297 - DNA, 22 bp, Homo sapiens
agtgaaatgattctgagcaaga

SEQ ID NO: 7775298 - DNA, 19 bp, Homo sapiens
agtgaaatggagtattcaa

SEQ ID NO: 7775299 - DNA, 22 bp, Homo sapiens
agtgaaaacactagttcttgcc

SEQ ID NO: 7775300 - DNA, 22 bp, Homo sapiens
agtgaaaacctaatcatgcagt

SEQ ID NO: 7775301 - DNA, 22 bp, Homo sapiens
agtgaaaacctaatcatgcagt

SEQ ID NO: 7775302 - DNA, 17 bp, Homo sapiens
agtgttctgggttgccc

SEQ ID NO: 7775303 - DNA, 22 bp, Homo sapiens
agtgtgagtgctcatgtccatc

SEQ ID NO: 7775304 - DNA, 20 bp, Homo sapiens
agtgtgcatttagagtctgc

SEQ ID NO: 7775305 - DNA, 22 bp, Homo sapiens
agttaaatgtcagtagcttaac

SEQ ID NO: 7775306 - DNA, 22 bp, Homo sapiens
agttaaatgtcagtagcttaac

SEQ ID NO: 7775307 - DNA, 22 bp, Homo sapiens
agtgtttttgggtagggtgagt

SEQ ID NO: 7775308 - DNA, 22 bp, Homo sapiens
agtgttttggagtgggaaggca

SEQ ID NO: 7775309 - DNA, 22 bp, Homo sapiens
agtgtttttacaagcactctgg

SEQ ID NO: 7775310 - DNA, 22 bp, Homo sapiens
agtgttttgctaatcctattaa

SEQ ID NO: 7775311 - DNA, 22 bp, Homo sapiens
agtgttttatttcagcactttg

SEQ ID NO: 7775312 - DNA, 22 bp, Homo sapiens
agtgtttctggcaaatgaaagt

SEQ ID NO: 7775313 - DNA, 17 bp, Homo sapiens
agtgtttccttatcatt

SEQ ID NO: 7775314 - DNA, 22 bp, Homo sapiens
ctgagctgcggcaggcacctgg

SEQ ID NO: 7775315 - DNA, 22 bp, Homo sapiens
agttccctggatgagctaaaaa

SEQ ID NO: 7775316 - DNA, 22 bp, Homo sapiens
agttccatgtctgggtttgtga

SEQ ID NO: 7775317 - DNA, 19 bp, Homo sapiens
ctgagcagcggcagcactt

SEQ ID NO: 7775318 - DNA, 22 bp, Homo sapiens
ctgagccactgcttgttcagtg

SEQ ID NO: 7775319 - DNA, 22 bp, Homo sapiens
ctgagccaccggcagggacatc

SEQ ID NO: 7775320 - DNA, 22 bp, Homo sapiens
ctgagccaaggggacagtgaca

SEQ ID NO: 7775321 - DNA, 19 bp, Homo sapiens
ctgagcagcggcagcactt

SEQ ID NO: 7775322 - DNA, 22 bp, Homo sapiens
ctgagccagcgggctcactttt

SEQ ID NO: 7775323 - DNA, 22 bp, Homo sapiens
ctgagccagctggcatgtgcta

SEQ ID NO: 7775324 - DNA, 22 bp, Homo sapiens
ctgagccagggccacacatgga

SEQ ID NO: 7775325 - DNA, 22 bp, Homo sapiens
ctgagccagggccacacatgga

SEQ ID NO: 7775326 - DNA, 22 bp, Homo sapiens
agtgtgagatgattgaggagca

SEQ ID NO: 7775327 - DNA, 22 bp, Homo sapiens
agtgtgactacattacaagagt

SEQ ID NO: 7775328 - DNA, 22 bp, Homo sapiens
agtgtgacattttcatgaattt

SEQ ID NO: 7775329 - DNA, 22 bp, Homo sapiens
agtgtatttgcctataaaaatg

SEQ ID NO: 7775330 - DNA, 22 bp, Homo sapiens
agtgtcaaatgtgtgccaagct

SEQ ID NO: 7775331 - DNA, 22 bp, Homo sapiens
agtgtcaaatcagcatctgggt

SEQ ID NO: 7775332 - DNA, 22 bp, Homo sapiens
agtgtcaactcggaataaggat

SEQ ID NO: 7775333 - DNA, 22 bp, Homo sapiens
agtgtcaaattaaataatctgg

SEQ ID NO: 7775334 - DNA, 22 bp, Homo sapiens
agtgtattatgcagcggaggtc

SEQ ID NO: 7775335 - DNA, 22 bp, Homo sapiens
agtgtattctgcatgggagact

SEQ ID NO: 7775336 - DNA, 22 bp, Homo sapiens
agtgtcatttccacgacattca

SEQ ID NO: 7775337 - DNA, 22 bp, Homo sapiens
agtgtcatgaatcaaagattat

SEQ ID NO: 7775338 - DNA, 22 bp, Homo sapiens
agtgtcataaggagaaattaca

SEQ ID NO: 7775339 - DNA, 22 bp, Homo sapiens
agtgtcaatgctctgttaaaaa

SEQ ID NO: 7775340 - DNA, 22 bp, Homo sapiens
agtgtcaatgccaacagtatat

SEQ ID NO: 7775341 - DNA, 22 bp, Homo sapiens
agtgtcaataatttctttttgg

SEQ ID NO: 7775342 - DNA, 22 bp, Homo sapiens
agtgtcaagtgaggagggaaag

SEQ ID NO: 7775343 - DNA, 22 bp, Homo sapiens
agtgtcaagtacatggtagtga

SEQ ID NO: 7775344 - DNA, 22 bp, Homo sapiens
agtgtcaaggttgagaaaccct

SEQ ID NO: 7775345 - DNA, 22 bp, Homo sapiens
agtgtcaactgtctacagggag

SEQ ID NO: 7775346 - DNA, 22 bp, Homo sapiens
agtgtcaattctcaaatctcgg

SEQ ID NO: 7775347 - DNA, 22 bp, Homo sapiens
agtggctatgcatgactggaat

SEQ ID NO: 7775348 - DNA, 22 bp, Homo sapiens
agtggctatgcatgactggaat

SEQ ID NO: 7775349 - DNA, 22 bp, Homo sapiens
agtggccagtgctgctctgggg

SEQ ID NO: 7775350 - DNA, 20 bp, Homo sapiens
agtgggtgatgaaggaatag

SEQ ID NO: 7775351 - DNA, 21 bp, Homo sapiens
ctctggagtttgaaggctggg

SEQ ID NO: 7775352 - DNA, 22 bp, Homo sapiens
agtggtctagtctgaggattat

SEQ ID NO: 7775353 - DNA, 22 bp, Homo sapiens
actttacaatatcctgtgactt

SEQ ID NO: 7775354 - DNA, 22 bp, Homo sapiens
actttacaagcttatagcctag

SEQ ID NO: 7775355 - DNA, 22 bp, Homo sapiens
actttacacatcttttctcatt

SEQ ID NO: 7775356 - DNA, 22 bp, Homo sapiens
atacatcacctatatattcaca

SEQ ID NO: 7775357 - DNA, 22 bp, Homo sapiens
acttctcttcataggtggcaat

SEQ ID NO: 7775358 - DNA, 22 bp, Homo sapiens
atacaaaaattagccgggagta

SEQ ID NO: 7775359 - DNA, 22 bp, Homo sapiens
atacaaaaattagccgggagta

SEQ ID NO: 7775360 - DNA, 22 bp, Homo sapiens
atacaaaaattagccgggagta

SEQ ID NO: 7775361 - DNA, 22 bp, Homo sapiens
ataatttttgtttgatgtccaa

SEQ ID NO: 7775362 - DNA, 22 bp, Homo sapiens
atacaaagacaaatctcaatct

SEQ ID NO: 7775363 - DNA, 22 bp, Homo sapiens
actttaaagcagaatggctatg

SEQ ID NO: 7775364 - DNA, 22 bp, Homo sapiens
atacaaaatatatactggagac

SEQ ID NO: 7775365 - DNA, 22 bp, Homo sapiens
atacaaaatatatactggagac

SEQ ID NO: 7775366 - DNA, 22 bp, Homo sapiens
atacaaaatatatactggagac

SEQ ID NO: 7775367 - DNA, 22 bp, Homo sapiens
atacaaaatatatactggagac

SEQ ID NO: 7775368 - DNA, 23 bp, Homo sapiens
acttttcaattagctatgcttaa

SEQ ID NO: 7775369 - DNA, 23 bp, Homo sapiens
acttttcaattagctatgcttaa

SEQ ID NO: 7775370 - DNA, 22 bp, Homo sapiens
acttttcaaatgggaaactcag

SEQ ID NO: 7775371 - DNA, 22 bp, Homo sapiens
atagatattagcaaaattttat

SEQ ID NO: 7775372 - DNA, 22 bp, Homo sapiens
atagatatttgagttgtttcca

SEQ ID NO: 7775373 - DNA, 22 bp, Homo sapiens
atagatacattgttatatttgt

SEQ ID NO: 7775374 - DNA, 22 bp, Homo sapiens
atagagttttattttccaataa

SEQ ID NO: 7775375 - DNA, 22 bp, Homo sapiens
actttggacgccatgctgtttg

SEQ ID NO: 7775376 - DNA, 22 bp, Homo sapiens
actttggacaatttattactgt

SEQ ID NO: 7775377 - DNA, 22 bp, Homo sapiens
actttggcacagaacttccatt

SEQ ID NO: 7775378 - DNA, 22 bp, Homo sapiens
actttctgtcatctagacaagt

SEQ ID NO: 7775379 - DNA, 22 bp, Homo sapiens
atacatcatttatggaataagg

SEQ ID NO: 7775380 - DNA, 22 bp, Homo sapiens
actgttttcctaatgagcaaga

SEQ ID NO: 7775381 - DNA, 22 bp, Homo sapiens
actgtttgctgatagatattta

SEQ ID NO: 7775382 - DNA, 22 bp, Homo sapiens
actgttttgtgccttagtttcc

SEQ ID NO: 7775383 - DNA, 22 bp, Homo sapiens
acttaaaaacagatccagcagg

SEQ ID NO: 7775384 - DNA, 22 bp, Homo sapiens
acttaaaaacagatccagcagg

SEQ ID NO: 7775385 - DNA, 22 bp, Homo sapiens
acttaaaaagaatcttttcacg

SEQ ID NO: 7775386 - DNA, 18 bp, Homo sapiens
ataaagtgctaataatgg

SEQ ID NO: 7775387 - DNA, 22 bp, Homo sapiens
acttaaaaccagacagcgtcat

SEQ ID NO: 7775388 - DNA, 22 bp, Homo sapiens
acttaaaaccagacagcgtcat

SEQ ID NO: 7775389 - DNA, 22 bp, Homo sapiens
acttccttgtcaggtgcatcat

SEQ ID NO: 7775390 - DNA, 22 bp, Homo sapiens
acttcctgtatttatccatagc

SEQ ID NO: 7775391 - DNA, 22 bp, Homo sapiens
acttccagcacctcaagcggaa

SEQ ID NO: 7775392 - DNA, 19 bp, Homo sapiens
ataaataaaaagtgggaga

SEQ ID NO: 7775393 - DNA, 22 bp, Homo sapiens
agttttatggctcaacctaata

SEQ ID NO: 7775394 - DNA, 22 bp, Homo sapiens
agttttatgcagtgttctgata

SEQ ID NO: 7775395 - DNA, 22 bp, Homo sapiens
agttttatgcagtgttctgata

SEQ ID NO: 7775396 - DNA, 22 bp, Homo sapiens
agttttatctgtaagctgttca

SEQ ID NO: 7775397 - DNA, 22 bp, Homo sapiens
agttttatgcagtgttctgata

SEQ ID NO: 7775398 - DNA, 22 bp, Homo sapiens
agttttatatcttccattggtt

SEQ ID NO: 7775399 - DNA, 21 bp, Homo sapiens
agttttatattataagctaaa

SEQ ID NO: 7775400 - DNA, 22 bp, Homo sapiens
agtttctaccggtacattcagg

SEQ ID NO: 7775401 - DNA, 22 bp, Homo sapiens
agtttctaccggtacattcagg

SEQ ID NO: 7775402 - DNA, 22 bp, Homo sapiens
agttttatgtagacaattcatt

SEQ ID NO: 7775403 - DNA, 23 bp, Homo sapiens
agtttttaatggtcatagctgag

SEQ ID NO: 7775404 - DNA, 21 bp, Homo sapiens
agtttttactcttaactgtgg

SEQ ID NO: 7775405 - DNA, 22 bp, Homo sapiens
agtttttcctgattttacagaa

SEQ ID NO: 7775406 - DNA, 22 bp, Homo sapiens
agtttttctcccctggcttcat

SEQ ID NO: 7775407 - DNA, 21 bp, Homo sapiens
actgttattcccattttcacc

SEQ ID NO: 7775408 - DNA, 22 bp, Homo sapiens
atcccagatggaggctggtcac

SEQ ID NO: 7775409 - DNA, 21 bp, Homo sapiens
atcccagcacccaggagtgca

SEQ ID NO: 7775410 - DNA, 22 bp, Homo sapiens
atcccaggcggcacaggttgca

SEQ ID NO: 7775411 - DNA, 22 bp, Homo sapiens
atcccaggcggcacaggttgca

SEQ ID NO: 7775412 - DNA, 19 bp, Homo sapiens
atcccatctggtttttccc

SEQ ID NO: 7775413 - DNA, 22 bp, Homo sapiens
agaaatctgactgctgtgcaca

SEQ ID NO: 7775414 - DNA, 22 bp, Homo sapiens
agaacatatctgttttctaact

SEQ ID NO: 7775415 - DNA, 22 bp, Homo sapiens
agaacatagatacctaagacag

SEQ ID NO: 7775416 - DNA, 22 bp, Homo sapiens
agaacataattatcataaactg

SEQ ID NO: 7775417 - DNA, 22 bp, Homo sapiens
agaacatggattgtcaaaggta

SEQ ID NO: 7775418 - DNA, 22 bp, Homo sapiens
agaacatttgtcgatcaatttg

SEQ ID NO: 7775419 - DNA, 22 bp, Homo sapiens
agaaccattttgacagatatac

SEQ ID NO: 7775420 - DNA, 22 bp, Homo sapiens
atctcagggctggagccctgga

SEQ ID NO: 7775421 - DNA, 20 bp, Homo sapiens
agaacctaagttaaaacaca

SEQ ID NO: 7775422 - DNA, 22 bp, Homo sapiens
agaagccacaggaaagcagctt

SEQ ID NO: 7775423 - DNA, 22 bp, Homo sapiens
agaagccacaggaaagcagctt

SEQ ID NO: 7775424 - DNA, 22 bp, Homo sapiens
agaagccaattctgtgtgagtc

SEQ ID NO: 7775425 - DNA, 22 bp, Homo sapiens
agaagccacaggaaagcagctt

SEQ ID NO: 7775426 - DNA, 22 bp, Homo sapiens
agaagccaagaacagacagtgc

SEQ ID NO: 7775427 - DNA, 22 bp, Homo sapiens
agaagccaagaacagacagtgc

SEQ ID NO: 7775428 - DNA, 22 bp, Homo sapiens
agaagccaacagggcaggagag

SEQ ID NO: 7775429 - DNA, 21 bp, Homo sapiens
agaaggcaaaagcagacatct

SEQ ID NO: 7775430 - DNA, 22 bp, Homo sapiens
agaagctgtggtatgaaatgtg

SEQ ID NO: 7775431 - DNA, 22 bp, Homo sapiens
agaaggcagatgggacggagca

SEQ ID NO: 7775432 - DNA, 22 bp, Homo sapiens
agaaggcatcagaagtgtgtag

SEQ ID NO: 7775433 - DNA, 22 bp, Homo sapiens
atcagtcatatccaaattagca

SEQ ID NO: 7775434 - DNA, 22 bp, Homo sapiens
atcagtgtaccttatggatttt

SEQ ID NO: 7775435 - DNA, 22 bp, Homo sapiens
atcagtgtattcatagggaata

SEQ ID NO: 7775436 - DNA, 22 bp, Homo sapiens
atcagtgtgtcaaaagcacaaa

SEQ ID NO: 7775437 - DNA, 22 bp, Homo sapiens
atcagtgttccttgagactgcc

SEQ ID NO: 7775438 - DNA, 22 bp, Homo sapiens
atcagtgttgttgattggatag

SEQ ID NO: 7775439 - DNA, 22 bp, Homo sapiens
agaaatcaggaacagtaaggag

SEQ ID NO: 7775440 - DNA, 22 bp, Homo sapiens
agaaatcaggaacagtaaggag

SEQ ID NO: 7775441 - DNA, 22 bp, Homo sapiens
atcagtgtttgcatgggagctt

SEQ ID NO: 7775442 - DNA, 22 bp, Homo sapiens
atcagtgtttcaaatgtaatct

SEQ ID NO: 7775443 - DNA, 22 bp, Homo sapiens
atcaaaatgctccagtgatggt

SEQ ID NO: 7775444 - DNA, 22 bp, Homo sapiens
atcaaaatgctccagtgatggt

SEQ ID NO: 7775445 - DNA, 22 bp, Homo sapiens
atcaaaatgctccagtgatggt

SEQ ID NO: 7775446 - DNA, 22 bp, Homo sapiens
agaaagcactctgtcttttacc

SEQ ID NO: 7775447 - DNA, 22 bp, Homo sapiens
acttttcccttggtagagttgc

SEQ ID NO: 7775448 - DNA, 23 bp, Homo sapiens
acttttcaattagctatgcttaa

SEQ ID NO: 7775449 - DNA, 22 bp, Homo sapiens
acttttctccctcctgccttca

SEQ ID NO: 7775450 - DNA, 22 bp, Homo sapiens
acttttgaagaattatgcaaaa

SEQ ID NO: 7775451 - DNA, 22 bp, Homo sapiens
actttttctcagaaggattggt

SEQ ID NO: 7775452 - DNA, 21 bp, Homo sapiens
agaaaaacacgatataagccc

SEQ ID NO: 7775453 - DNA, 21 bp, Homo sapiens
agaaaaacacgatataagccc

SEQ ID NO: 7775454 - DNA, 22 bp, Homo sapiens
atattttgtaacttggaatagg

SEQ ID NO: 7775455 - DNA, 22 bp, Homo sapiens
atattttgtaacttggaatagg

SEQ ID NO: 7775456 - DNA, 22 bp, Homo sapiens
atatttttccatgtgggactct

SEQ ID NO: 7775457 - DNA, 21 bp, Homo sapiens
atatttttgtttggactgtca

SEQ ID NO: 7775458 - DNA, 22 bp, Homo sapiens
agaaaaagaaagtggatttgtc

SEQ ID NO: 7775459 - DNA, 21 bp, Homo sapiens
agaaaaaccagcatgttttca

SEQ ID NO: 7775460 - DNA, 22 bp, Homo sapiens
atatttctccaaatgttttcaa

SEQ ID NO: 7775461 - DNA, 22 bp, Homo sapiens
atattttggtagctctcaatga

SEQ ID NO: 7775462 - DNA, 22 bp, Homo sapiens
atattttggggtgatgtgcatc

SEQ ID NO: 7775463 - DNA, 22 bp, Homo sapiens
atatttctccaaatgttttcaa

SEQ ID NO: 7775464 - DNA, 22 bp, Homo sapiens
agaaaaagtcaaggaattggac

SEQ ID NO: 7775465 - DNA, 22 bp, Homo sapiens
actgcactcctgcctgggtaac

SEQ ID NO: 7775466 - DNA, 22 bp, Homo sapiens
actgcacttacatagaggaggc

SEQ ID NO: 7775467 - DNA, 22 bp, Homo sapiens
actgcactccagcctgggtgat

SEQ ID NO: 7775468 - DNA, 22 bp, Homo sapiens
actgcactccagcctgggtgat

SEQ ID NO: 7775469 - DNA, 22 bp, Homo sapiens
actgcactccagcctgggtgac

SEQ ID NO: 7775470 - DNA, 22 bp, Homo sapiens
agtgaagatatactgttgtcct

SEQ ID NO: 7775471 - DNA, 22 bp, Homo sapiens
actgcagccccctattaggact

SEQ ID NO: 7775472 - DNA, 22 bp, Homo sapiens
actgcagcaggtaagagcattt

SEQ ID NO: 7775473 - DNA, 22 bp, Homo sapiens
actgccaatggtagtttgatgg

SEQ ID NO: 7775474 - DNA, 22 bp, Homo sapiens
actgcagcctagggaccacagt

SEQ ID NO: 7775475 - DNA, 23 bp, Homo sapiens
actgcagcctccgcctgccgggt

SEQ ID NO: 7775476 - DNA, 22 bp, Homo sapiens
actgcacttcaccctgggtgac

SEQ ID NO: 7775477 - DNA, 22 bp, Homo sapiens
actgcacttcaccctgggtgac

SEQ ID NO: 7775478 - DNA, 22 bp, Homo sapiens
agtgctcatgcacatttatagt

SEQ ID NO: 7775479 - DNA, 22 bp, Homo sapiens
agtgaaatttgtttagataggt

SEQ ID NO: 7775480 - DNA, 22 bp, Homo sapiens
actctgcctttcagcagatgaa

SEQ ID NO: 7775481 - DNA, 22 bp, Homo sapiens
actctgccatcccaggtgctgt

SEQ ID NO: 7775482 - DNA, 22 bp, Homo sapiens
actctgccccgagttctgggaa

SEQ ID NO: 7775483 - DNA, 22 bp, Homo sapiens
actgcctcttggtgctgagaga

SEQ ID NO: 7775484 - DNA, 22 bp, Homo sapiens
actgccctggagacagcagagt

SEQ ID NO: 7775485 - DNA, 22 bp, Homo sapiens
actgcctgctcctggctccaca

SEQ ID NO: 7775486 - DNA, 22 bp, Homo sapiens
actgcctgtagccctgagatgt

SEQ ID NO: 7775487 - DNA, 22 bp, Homo sapiens
actgcctggcctggcctcactg

SEQ ID NO: 7775488 - DNA, 18 bp, Homo sapiens
actgcctggcgaagatag

SEQ ID NO: 7775489 - DNA, 22 bp, Homo sapiens
actgcctgccttccaggtactg

SEQ ID NO: 7775490 - DNA, 23 bp, Homo sapiens
actgcctgctactatgcccacgg

SEQ ID NO: 7775491 - DNA, 22 bp, Homo sapiens
actgcctgccttccaggtactg

SEQ ID NO: 7775492 - DNA, 19 bp, Homo sapiens
actgcctgaggctcacagg

SEQ ID NO: 7775493 - DNA, 19 bp, Homo sapiens
actgcctgaggctcacagg

SEQ ID NO: 7775494 - DNA, 22 bp, Homo sapiens
actggctgatcacctgcctcag

SEQ ID NO: 7775495 - DNA, 22 bp, Homo sapiens
actggctgcctccaaagtgtgc

SEQ ID NO: 7775496 - DNA, 22 bp, Homo sapiens
actggctgatcacctgcctcag

SEQ ID NO: 7775497 - DNA, 21 bp, Homo sapiens
actggctgccatgatccaggg

SEQ ID NO: 7775498 - DNA, 22 bp, Homo sapiens
actggctggagttgccaaggct

SEQ ID NO: 7775499 - DNA, 22 bp, Homo sapiens
actggctggactctgacctctt

SEQ ID NO: 7775500 - DNA, 22 bp, Homo sapiens
actggctgcgttcctgtgagac

SEQ ID NO: 7775501 - DNA, 22 bp, Homo sapiens
actggctggactctgacctctt

SEQ ID NO: 7775502 - DNA, 22 bp, Homo sapiens
actggctgcggggtggaagaag

SEQ ID NO: 7775503 - DNA, 20 bp, Homo sapiens
actggctgcctggaatgcgc

SEQ ID NO: 7775504 - DNA, 20 bp, Homo sapiens
actggctgcctggaatgcgc

SEQ ID NO: 7775505 - DNA, 22 bp, Homo sapiens
actggctgcgatcttggcgctt

SEQ ID NO: 7775506 - DNA, 22 bp, Homo sapiens
actggctgcgttcctgtgagac

SEQ ID NO: 7775507 - DNA, 22 bp, Homo sapiens
actggctgtgtaacctcaggca

SEQ ID NO: 7775508 - DNA, 22 bp, Homo sapiens
actggctgtggccacggctgct

SEQ ID NO: 7775509 - DNA, 21 bp, Homo sapiens
actggctgtcttcctactggt

SEQ ID NO: 7775510 - DNA, 21 bp, Homo sapiens
actggctgtcttcctactggt

SEQ ID NO: 7775511 - DNA, 22 bp, Homo sapiens
actggctgtgcagagggcagta

SEQ ID NO: 7775512 - DNA, 22 bp, Homo sapiens
actggctgtgcccatagagctc

SEQ ID NO: 7775513 - DNA, 22 bp, Homo sapiens
actggctgtgcagagggcagta

SEQ ID NO: 7775514 - DNA, 22 bp, Homo sapiens
actggctggccgcgctcttcgc

SEQ ID NO: 7775515 - DNA, 22 bp, Homo sapiens
actggctggccacaccctggta

SEQ ID NO: 7775516 - DNA, 21 bp, Homo sapiens
actggctggctgagtttcctg

SEQ ID NO: 7775517 - DNA, 21 bp, Homo sapiens
actggctggtggctaagaatc

SEQ ID NO: 7775518 - DNA, 21 bp, Homo sapiens
actggctggtggctaagaatc

SEQ ID NO: 7775519 - DNA, 22 bp, Homo sapiens
agtgtccttgttattactgctc

SEQ ID NO: 7775520 - DNA, 22 bp, Homo sapiens
actgggaggcaaagagcaagga

SEQ ID NO: 7775521 - DNA, 22 bp, Homo sapiens
actgggaggcaaagagcaagga

SEQ ID NO: 7775522 - DNA, 22 bp, Homo sapiens
actgggcattttgaacgttctt

SEQ ID NO: 7775523 - DNA, 22 bp, Homo sapiens
actcctgggtgctgaccagcgt

SEQ ID NO: 7775524 - DNA, 22 bp, Homo sapiens
actcctgggtgctgaccagcgt

SEQ ID NO: 7775525 - DNA, 22 bp, Homo sapiens
actcctggaaaagaacgcaggg

SEQ ID NO: 7775526 - DNA, 22 bp, Homo sapiens
actcctggggatccattccttt

SEQ ID NO: 7775527 - DNA, 22 bp, Homo sapiens
actcctgggtgcatttctgatt

SEQ ID NO: 7775528 - DNA, 22 bp, Homo sapiens
actcctggggctgccatcacag

SEQ ID NO: 7775529 - DNA, 22 bp, Homo sapiens
actctcccttggagcctcaggc

SEQ ID NO: 7775530 - DNA, 22 bp, Homo sapiens
agtcactgtttaatctagctaa

SEQ ID NO: 7775531 - DNA, 22 bp, Homo sapiens
agtcactggttctgtaattaat

SEQ ID NO: 7775532 - DNA, 22 bp, Homo sapiens
agtcactgttctgtcatgtcaa

SEQ ID NO: 7775533 - DNA, 21 bp, Homo sapiens
agtagtttagcacagggtttg

SEQ ID NO: 7775534 - DNA, 22 bp, Homo sapiens
agtataaagtggttttcagcac

SEQ ID NO: 7775535 - DNA, 22 bp, Homo sapiens
agtatacaaataaatgtgtaat

SEQ ID NO: 7775536 - DNA, 22 bp, Homo sapiens
agtatacatatattagccttcg

SEQ ID NO: 7775537 - DNA, 20 bp, Homo sapiens
agtaccttttgtatgttacc

SEQ ID NO: 7775538 - DNA, 22 bp, Homo sapiens
agtagtcagcagataatatagg

SEQ ID NO: 7775539 - DNA, 22 bp, Homo sapiens
agtagaaagaaggcactgggcc

SEQ ID NO: 7775540 - DNA, 21 bp, Homo sapiens
aggtgggcaggtggagtggcc

SEQ ID NO: 7775541 - DNA, 22 bp, Homo sapiens
aggtgggcgctgctcccgctgg

SEQ ID NO: 7775542 - DNA, 22 bp, Homo sapiens
aggtgggcccagtgggctccag

SEQ ID NO: 7775543 - DNA, 22 bp, Homo sapiens
agtaataatagctgtaaagtgc

SEQ ID NO: 7775544 - DNA, 22 bp, Homo sapiens
agtaccattatccagtaaagga

SEQ ID NO: 7775545 - DNA, 22 bp, Homo sapiens
aggtgggcaccaggcttgtggt

SEQ ID NO: 7775546 - DNA, 22 bp, Homo sapiens
actacagtactatatctatagg

SEQ ID NO: 7775547 - DNA, 22 bp, Homo sapiens
actacagtccctcatatgttgg

SEQ ID NO: 7775548 - DNA, 22 bp, Homo sapiens
actactttgggccatttgttta

SEQ ID NO: 7775549 - DNA, 22 bp, Homo sapiens
aggtgaagttaaaaaccagtct

SEQ ID NO: 7775550 - DNA, 22 bp, Homo sapiens
aggtgaagttgaggaggcagaa

SEQ ID NO: 7775551 - DNA, 22 bp, Homo sapiens
aggtgacatcccggcagcagag

SEQ ID NO: 7775552 - DNA, 22 bp, Homo sapiens
acctttttgttctgttctcagc

SEQ ID NO: 7775553 - DNA, 22 bp, Homo sapiens
acgaggttggagagttgtttgg

SEQ ID NO: 7775554 - DNA, 22 bp, Homo sapiens
accttttttcagaactctaaag

SEQ ID NO: 7775555 - DNA, 22 bp, Homo sapiens
acgaataaatctatttcacaca

SEQ ID NO: 7775556 - DNA, 22 bp, Homo sapiens
aggtcaaggccaaaagagtggt

SEQ ID NO: 7775557 - DNA, 22 bp, Homo sapiens
aggtcaagattctacatttgta

SEQ ID NO: 7775558 - DNA, 22 bp, Homo sapiens
aggtcaaggctgcagtgagctg

SEQ ID NO: 7775559 - DNA, 22 bp, Homo sapiens
aggtcaagggagctgagggcca

SEQ ID NO: 7775560 - DNA, 22 bp, Homo sapiens
aggtcaagggcaagagtgaggt

SEQ ID NO: 7775561 - DNA, 22 bp, Homo sapiens
aggtcaagggcaagagtgaggt

SEQ ID NO: 7775562 - DNA, 22 bp, Homo sapiens
aggtcaaggttcacaggggatc

SEQ ID NO: 7775563 - DNA, 22 bp, Homo sapiens
acccttggttttgcagagctgt

SEQ ID NO: 7775564 - DNA, 22 bp, Homo sapiens
aggtccagaggttgaacggtgg

SEQ ID NO: 7775565 - DNA, 19 bp, Homo sapiens
acctttcctttctcagatg

SEQ ID NO: 7775566 - DNA, 22 bp, Homo sapiens
acctttcctggctgaccgagga

SEQ ID NO: 7775567 - DNA, 22 bp, Homo sapiens
acctttccaagtatcaggtggt

SEQ ID NO: 7775568 - DNA, 22 bp, Homo sapiens
acctttcacggtatcagacatc

SEQ ID NO: 7775569 - DNA, 22 bp, Homo sapiens
acctttcacggtatcagacatc

SEQ ID NO: 7775570 - DNA, 22 bp, Homo sapiens
acattcctcagtgccagttgag

SEQ ID NO: 7775571 - DNA, 22 bp, Homo sapiens
acattcctttcttgagcacagt

SEQ ID NO: 7775572 - DNA, 22 bp, Homo sapiens
acattcttggactccactctag

SEQ ID NO: 7775573 - DNA, 22 bp, Homo sapiens
acattctttgagttttgttaaa

SEQ ID NO: 7775574 - DNA, 22 bp, Homo sapiens
acattcatgggttttacattat

SEQ ID NO: 7775575 - DNA, 22 bp, Homo sapiens
acattcaaggccttctgacaca

SEQ ID NO: 7775576 - DNA, 22 bp, Homo sapiens
acattcaaggccttctgacaca

SEQ ID NO: 7775577 - DNA, 22 bp, Homo sapiens
acattcacaagcctacaaggtt

SEQ ID NO: 7775578 - DNA, 22 bp, Homo sapiens
acattcaagatgcattcactta

SEQ ID NO: 7775579 - DNA, 22 bp, Homo sapiens
acattaatgaggtgatgacaca

SEQ ID NO: 7775580 - DNA, 22 bp, Homo sapiens
aggccctgcaggaagcaggatg

SEQ ID NO: 7775581 - DNA, 22 bp, Homo sapiens
aggctgtgcaattagggtaaga

SEQ ID NO: 7775582 - DNA, 22 bp, Homo sapiens
aggcttcagcagccctctcttg

SEQ ID NO: 7775583 - DNA, 22 bp, Homo sapiens
aggcttcagcctagagctggag

SEQ ID NO: 7775584 - DNA, 22 bp, Homo sapiens
aggcttcaggaagtctcctggg

SEQ ID NO: 7775585 - DNA, 22 bp, Homo sapiens
aggctccaggcaaaatttcgga

SEQ ID NO: 7775586 - DNA, 22 bp, Homo sapiens
aggcttcccagctgagctcagc

SEQ ID NO: 7775587 - DNA, 22 bp, Homo sapiens
aggcttcagtagggagcatgtc

SEQ ID NO: 7775588 - DNA, 22 bp, Homo sapiens
aggcttcatgtagatggttccc

SEQ ID NO: 7775589 - DNA, 19 bp, Homo sapiens
aggcttcatcctgggcagc

SEQ ID NO: 7775590 - DNA, 22 bp, Homo sapiens
aggcttcagttgtaccttcttg

SEQ ID NO: 7775591 - DNA, 22 bp, Homo sapiens
acattgagagttttgaagagta

SEQ ID NO: 7775592 - DNA, 22 bp, Homo sapiens
aggccagcagacgtgggactga

SEQ ID NO: 7775593 - DNA, 22 bp, Homo sapiens
aggccagcaccagagtcaagaa

SEQ ID NO: 7775594 - DNA, 22 bp, Homo sapiens
aggccacagtactttgcagacc

SEQ ID NO: 7775595 - DNA, 22 bp, Homo sapiens
aggccacagcctgggaggtgac

SEQ ID NO: 7775596 - DNA, 18 bp, Homo sapiens
aggccacactccagaaca

SEQ ID NO: 7775597 - DNA, 22 bp, Homo sapiens
aggccacagagagtgcatgtgc

SEQ ID NO: 7775598 - DNA, 22 bp, Homo sapiens
aggcatgggtagaagagaagcc

SEQ ID NO: 7775599 - DNA, 22 bp, Homo sapiens
acatacatgggattaaaaaatt

SEQ ID NO: 7775600 - DNA, 22 bp, Homo sapiens
acatacatggattcatggattc

SEQ ID NO: 7775601 - DNA, 22 bp, Homo sapiens
acatacatgggattaaaaaatt

SEQ ID NO: 7775602 - DNA, 22 bp, Homo sapiens
acatacatgggattaaaaaatt

SEQ ID NO: 7775603 - DNA, 22 bp, Homo sapiens
acatacatggtgctttcttggt

SEQ ID NO: 7775604 - DNA, 22 bp, Homo sapiens
aggcagtgttcttctaagggca

SEQ ID NO: 7775605 - DNA, 22 bp, Homo sapiens
acatacatgtaaaggaaattat

SEQ ID NO: 7775606 - DNA, 20 bp, Homo sapiens
aggcatgggatgcccagatt

SEQ ID NO: 7775607 - DNA, 20 bp, Homo sapiens
aggcatgggatgcccagatt

SEQ ID NO: 7775608 - DNA, 19 bp, Homo sapiens
aggcatgggaagagaagtc

SEQ ID NO: 7775609 - DNA, 22 bp, Homo sapiens
aggcatggctttaggcaggcgt

SEQ ID NO: 7775610 - DNA, 22 bp, Homo sapiens
aggccagcatgcagttctaagg

SEQ ID NO: 7775611 - DNA, 22 bp, Homo sapiens
aggccagccctgggctgagaga

SEQ ID NO: 7775612 - DNA, 18 bp, Homo sapiens
aggccagccctgctactg

SEQ ID NO: 7775613 - DNA, 22 bp, Homo sapiens
aggccagcctcaggcagggacc

SEQ ID NO: 7775614 - DNA, 22 bp, Homo sapiens
aggcccagggctgctctctgaa

SEQ ID NO: 7775615 - DNA, 23 bp, Homo sapiens
aggcccaggtatgtttgttttgg

SEQ ID NO: 7775616 - DNA, 22 bp, Homo sapiens
aggcccagggctgctctctgaa

SEQ ID NO: 7775617 - DNA, 21 bp, Homo sapiens
aggcccagctttcctcttgct

SEQ ID NO: 7775618 - DNA, 21 bp, Homo sapiens
aggcccaggaatatgcatttt

SEQ ID NO: 7775619 - DNA, 23 bp, Homo sapiens
aggcccaggtatgtttgttttgg

SEQ ID NO: 7775620 - DNA, 22 bp, Homo sapiens
aggcccagtagtcgacggcgct

SEQ ID NO: 7775621 - DNA, 22 bp, Homo sapiens
aggccctgagcatccgagggca

SEQ ID NO: 7775622 - DNA, 22 bp, Homo sapiens
aggcccagctgggccaggaaca

SEQ ID NO: 7775623 - DNA, 22 bp, Homo sapiens
aggcccagcttgaagtgggaag

SEQ ID NO: 7775624 - DNA, 22 bp, Homo sapiens
aggcccagcttgaagtgggaag

SEQ ID NO: 7775625 - DNA, 21 bp, Homo sapiens
aggcccagctttcctcttgct

SEQ ID NO: 7775626 - DNA, 20 bp, Homo sapiens
acatgaaaggaaacaggaaa

SEQ ID NO: 7775627 - DNA, 20 bp, Homo sapiens
acatgaaaggaaacaggaaa

SEQ ID NO: 7775628 - DNA, 22 bp, Homo sapiens
aggccaggtggtcatgcttgct

SEQ ID NO: 7775629 - DNA, 22 bp, Homo sapiens
accccaagacagtagaagagaa

SEQ ID NO: 7775630 - DNA, 22 bp, Homo sapiens
accccagcgcatatggtctgcg

SEQ ID NO: 7775631 - DNA, 22 bp, Homo sapiens
accctggagcttttctggccct

SEQ ID NO: 7775632 - DNA, 22 bp, Homo sapiens
accctggagcaataatccctgg

SEQ ID NO: 7775633 - DNA, 22 bp, Homo sapiens
accctgggcttggcctgctcag

SEQ ID NO: 7775634 - DNA, 22 bp, Homo sapiens
acccacgaagatgagcggcatg

SEQ ID NO: 7775635 - DNA, 23 bp, Homo sapiens
agggcctctgtcccccagcactc

SEQ ID NO: 7775636 - DNA, 21 bp, Homo sapiens
agggcctctcatttgtgccag

SEQ ID NO: 7775637 - DNA, 22 bp, Homo sapiens
agggcctctctgggcctttcct

SEQ ID NO: 7775638 - DNA, 22 bp, Homo sapiens
agggcctctgagccagttctgg

SEQ ID NO: 7775639 - DNA, 22 bp, Homo sapiens
acccagggtagagtgcagtggc

SEQ ID NO: 7775640 - DNA, 22 bp, Homo sapiens
acccaggctggcgtgcagtggc

SEQ ID NO: 7775641 - DNA, 22 bp, Homo sapiens
acccaggctggcgtgcagtggc

SEQ ID NO: 7775642 - DNA, 22 bp, Homo sapiens
acccagagatggacctggctgc

SEQ ID NO: 7775643 - DNA, 22 bp, Homo sapiens
acccagggtcaccccgtagggt

SEQ ID NO: 7775644 - DNA, 23 bp, Homo sapiens
agggcccaagcctggacagcagg

SEQ ID NO: 7775645 - DNA, 23 bp, Homo sapiens
agggcccaagcctggacagcagg

SEQ ID NO: 7775646 - DNA, 22 bp, Homo sapiens
accagtttctgggggaggttgg

SEQ ID NO: 7775647 - DNA, 22 bp, Homo sapiens
accagtttatagcgatctgtca

SEQ ID NO: 7775648 - DNA, 22 bp, Homo sapiens
accagtttaataactgctcaag

SEQ ID NO: 7775649 - DNA, 22 bp, Homo sapiens
accagtttgtaacctgttttca

SEQ ID NO: 7775650 - DNA, 21 bp, Homo sapiens
accagtttggggggcttcctg

SEQ ID NO: 7775651 - DNA, 22 bp, Homo sapiens
accagttttttatacatcttct

SEQ ID NO: 7775652 - DNA, 22 bp, Homo sapiens
accagttttttatacatcttct

SEQ ID NO: 7775653 - DNA, 22 bp, Homo sapiens
accatacattaaatgactttca

SEQ ID NO: 7775654 - DNA, 22 bp, Homo sapiens
accagggttgagtcagctgcgt

SEQ ID NO: 7775655 - DNA, 22 bp, Homo sapiens
accagggcttacagcagtagct

SEQ ID NO: 7775656 - DNA, 22 bp, Homo sapiens
accagggcttacagcagtagct

SEQ ID NO: 7775657 - DNA, 22 bp, Homo sapiens
accaggagggaccctggtggcc

SEQ ID NO: 7775658 - DNA, 19 bp, Homo sapiens
accaggagacagtgagctt

SEQ ID NO: 7775659 - DNA, 22 bp, Homo sapiens
accaggagaggcacttgcaatg

SEQ ID NO: 7775660 - DNA, 22 bp, Homo sapiens
accaggagccacaggaggagcc

SEQ ID NO: 7775661 - DNA, 22 bp, Homo sapiens
accagctgagtaggggagggcc

SEQ ID NO: 7775662 - DNA, 22 bp, Homo sapiens
accacaggaattgctctgtggt

SEQ ID NO: 7775663 - DNA, 22 bp, Homo sapiens
accaatataagtataggtaagt

SEQ ID NO: 7775664 - DNA, 22 bp, Homo sapiens
accacactggctagtgaagaag

SEQ ID NO: 7775665 - DNA, 22 bp, Homo sapiens
accaaatgcttggctgctgtga

SEQ ID NO: 7775666 - DNA, 23 bp, Homo sapiens
aggcttcctatcttagagctggg

SEQ ID NO: 7775667 - DNA, 22 bp, Homo sapiens
aggcttcctcgtgccttagata

SEQ ID NO: 7775668 - DNA, 22 bp, Homo sapiens
accaagctgtatattattggtt

SEQ ID NO: 7775669 - DNA, 22 bp, Homo sapiens
acatacatatgacaactttcct

SEQ ID NO: 7775670 - DNA, 22 bp, Homo sapiens
acatacatatgtttaaatgcat

SEQ ID NO: 7775671 - DNA, 22 bp, Homo sapiens
acatacatatgtttaaatgcat

SEQ ID NO: 7775672 - DNA, 22 bp, Homo sapiens
acatacatcaagtatcacaaga

SEQ ID NO: 7775673 - DNA, 23 bp, Homo sapiens
acatacatggagataaagtgatg

SEQ ID NO: 7775674 - DNA, 23 bp, Homo sapiens
acatacatggagataaagtgatg

SEQ ID NO: 7775675 - DNA, 22 bp, Homo sapiens
acatacatcaagtatcacaaga

SEQ ID NO: 7775676 - DNA, 23 bp, Homo sapiens
acatacatggagataaagtgatg

SEQ ID NO: 7775677 - DNA, 22 bp, Homo sapiens
acatacacaagcgtacatgaac

SEQ ID NO: 7775678 - DNA, 23 bp, Homo sapiens
acatacataagcaccacattttg

SEQ ID NO: 7775679 - DNA, 22 bp, Homo sapiens
aggcacagatttggggaaagca

SEQ ID NO: 7775680 - DNA, 22 bp, Homo sapiens
aggcacagaatggcattcagtg

SEQ ID NO: 7775681 - DNA, 22 bp, Homo sapiens
aggcacagaatggcattcagtg

SEQ ID NO: 7775682 - DNA, 22 bp, Homo sapiens
aggcaaattgtgagaaaatgaa

SEQ ID NO: 7775683 - DNA, 22 bp, Homo sapiens
aggaggccgatttcagaggtcg

SEQ ID NO: 7775684 - DNA, 22 bp, Homo sapiens
aggaggccgctgatgggctccc

SEQ ID NO: 7775685 - DNA, 22 bp, Homo sapiens
aggaggctgtggagcactccat

SEQ ID NO: 7775686 - DNA, 20 bp, Homo sapiens
aggagggacctggattggcg

SEQ ID NO: 7775687 - DNA, 20 bp, Homo sapiens
aggagggacctggattggcg

SEQ ID NO: 7775688 - DNA, 20 bp, Homo sapiens
aggatggcaagcaagtgcat

SEQ ID NO: 7775689 - DNA, 22 bp, Homo sapiens
aggagggtacaatgggtggaaa

SEQ ID NO: 7775690 - DNA, 21 bp, Homo sapiens
aggaggggtctttcccactga

SEQ ID NO: 7775691 - DNA, 22 bp, Homo sapiens
aggaggggttctcgggtgctga

SEQ ID NO: 7775692 - DNA, 22 bp, Homo sapiens
aggatggcgattcgagcacctc

SEQ ID NO: 7775693 - DNA, 22 bp, Homo sapiens
aggcaaaagaatgtcataaatg

SEQ ID NO: 7775694 - DNA, 21 bp, Homo sapiens
aggattttgttgaagtttctg

SEQ ID NO: 7775695 - DNA, 22 bp, Homo sapiens
aggcaaagaagttggtcaggag

SEQ ID NO: 7775696 - DNA, 22 bp, Homo sapiens
aggcaaatctcagttggcctct

SEQ ID NO: 7775697 - DNA, 22 bp, Homo sapiens
aggcaaattattgtatgcagtt

SEQ ID NO: 7775698 - DNA, 22 bp, Homo sapiens
aggcaaattattgtatgcagtt

SEQ ID NO: 7775699 - DNA, 22 bp, Homo sapiens
aggcaaagcgataccagagcta

SEQ ID NO: 7775700 - DNA, 22 bp, Homo sapiens
aggagctgcatggatacctggt

SEQ ID NO: 7775701 - DNA, 22 bp, Homo sapiens
aggagctgcagattctgccttg

SEQ ID NO: 7775702 - DNA, 22 bp, Homo sapiens
aggagcctgaatcagagggtga

SEQ ID NO: 7775703 - DNA, 22 bp, Homo sapiens
aggagccctgcgggaggcagag

SEQ ID NO: 7775704 - DNA, 22 bp, Homo sapiens
aggagccattttccaagggcga

SEQ ID NO: 7775705 - DNA, 22 bp, Homo sapiens
acaggggctccgaaggtgaggg

SEQ ID NO: 7775706 - DNA, 22 bp, Homo sapiens
acagggtgactttgtgacagat

SEQ ID NO: 7775707 - DNA, 22 bp, Homo sapiens
acagggtgaatgtgacattatc

SEQ ID NO: 7775708 - DNA, 22 bp, Homo sapiens
acaggggctccgaaggtgaggg

SEQ ID NO: 7775709 - DNA, 17 bp, Homo sapiens
aggaagcgagctggcct

SEQ ID NO: 7775710 - DNA, 22 bp, Homo sapiens
aggaagctaaccagggagtgag

SEQ ID NO: 7775711 - DNA, 22 bp, Homo sapiens
aggaagggatacataggatagt

SEQ ID NO: 7775712 - DNA, 20 bp, Homo sapiens
aggaaggctgttggccttgc

SEQ ID NO: 7775713 - DNA, 22 bp, Homo sapiens
aggaaggcatgaggtgttcaca

SEQ ID NO: 7775714 - DNA, 22 bp, Homo sapiens
aggaagagcattcacatggtag

SEQ ID NO: 7775715 - DNA, 22 bp, Homo sapiens
aggaagccaagcctgacactca

SEQ ID NO: 7775716 - DNA, 18 bp, Homo sapiens
aggaagcaggaggaaggc

SEQ ID NO: 7775717 - DNA, 23 bp, Homo sapiens
aggaaactgaaggggccctctat

SEQ ID NO: 7775718 - DNA, 22 bp, Homo sapiens
aggaaagaaaggaggtgcattt

SEQ ID NO: 7775719 - DNA, 23 bp, Homo sapiens
agcttcatcttgctgtgtctcag

SEQ ID NO: 7775720 - DNA, 22 bp, Homo sapiens
agcttcatgcctaaagacagcg

SEQ ID NO: 7775721 - DNA, 23 bp, Homo sapiens
agcttcattattttccatgatct

SEQ ID NO: 7775722 - DNA, 23 bp, Homo sapiens
agcttttaggtggaaatggcact

SEQ ID NO: 7775723 - DNA, 22 bp, Homo sapiens
aggaaaaaagtctgtgattata

SEQ ID NO: 7775724 - DNA, 22 bp, Homo sapiens
agcttttagtacgttaaaattg

SEQ ID NO: 7775725 - DNA, 22 bp, Homo sapiens
agctgtggttagatagagtcct

SEQ ID NO: 7775726 - DNA, 22 bp, Homo sapiens
agctgtggtcttcaagttgcct

SEQ ID NO: 7775727 - DNA, 22 bp, Homo sapiens
agctgtggtgttttcaagccct

SEQ ID NO: 7775728 - DNA, 22 bp, Homo sapiens
agctgtggggaggaggctagca

SEQ ID NO: 7775729 - DNA, 22 bp, Homo sapiens
agctgtggggaggaggctagca

SEQ ID NO: 7775730 - DNA, 19 bp, Homo sapiens
agctgtggggcctagcacc

SEQ ID NO: 7775731 - DNA, 22 bp, Homo sapiens
agctgtggtacttgattcacaa

SEQ ID NO: 7775732 - DNA, 22 bp, Homo sapiens
agcttcaaggttcaaggatgct

SEQ ID NO: 7775733 - DNA, 22 bp, Homo sapiens
agcttcaacttactaaaagata

SEQ ID NO: 7775734 - DNA, 22 bp, Homo sapiens
agcttagtcactcttaaattta

SEQ ID NO: 7775735 - DNA, 22 bp, Homo sapiens
agctgtgggagaatctctgggt

SEQ ID NO: 7775736 - DNA, 22 bp, Homo sapiens
agctgggatgataacctcagtc

SEQ ID NO: 7775737 - DNA, 22 bp, Homo sapiens
agctgggaggtgggcagtgaga

SEQ ID NO: 7775738 - DNA, 22 bp, Homo sapiens
agctgggagctgaaggctgatt

SEQ ID NO: 7775739 - DNA, 22 bp, Homo sapiens
agctgctgtcctaggcactgta

SEQ ID NO: 7775740 - DNA, 22 bp, Homo sapiens
agctgctggtttaagggatggg

SEQ ID NO: 7775741 - DNA, 23 bp, Homo sapiens
agctgctgggcctgccgtggcct

SEQ ID NO: 7775742 - DNA, 22 bp, Homo sapiens
agctgctgtgtgctcaggcagg

SEQ ID NO: 7775743 - DNA, 22 bp, Homo sapiens
agctgctgtttcttgcacgtat

SEQ ID NO: 7775744 - DNA, 22 bp, Homo sapiens
agctgctgtttggtgagtcttg

SEQ ID NO: 7775745 - DNA, 22 bp, Homo sapiens
agctgcttagagtctcttctta

SEQ ID NO: 7775746 - DNA, 22 bp, Homo sapiens
acagcccagaaagcctaagggg

SEQ ID NO: 7775747 - DNA, 20 bp, Homo sapiens
agctggcctgtcctaggcct

SEQ ID NO: 7775748 - DNA, 22 bp, Homo sapiens
acagcctgcagccccaggtcgc

SEQ ID NO: 7775749 - DNA, 21 bp, Homo sapiens
agctggctatagttagtgatg

SEQ ID NO: 7775750 - DNA, 22 bp, Homo sapiens
agctggctatgccctgtgaacc

SEQ ID NO: 7775751 - DNA, 22 bp, Homo sapiens
agctggctatgccctgtgaacc

SEQ ID NO: 7775752 - DNA, 21 bp, Homo sapiens
agctggctctctctggagaga

SEQ ID NO: 7775753 - DNA, 22 bp, Homo sapiens
agctggctcagccgggtggtct

SEQ ID NO: 7775754 - DNA, 21 bp, Homo sapiens
agctggctctctctggagaga

SEQ ID NO: 7775755 - DNA, 22 bp, Homo sapiens
agctggctatacttgaaaagtc

SEQ ID NO: 7775756 - DNA, 22 bp, Homo sapiens
acagccagtcatctcagcaggg

SEQ ID NO: 7775757 - DNA, 22 bp, Homo sapiens
agctgcaggcccatgctcagtc

SEQ ID NO: 7775758 - DNA, 22 bp, Homo sapiens
agctgctcattactttctgttg

SEQ ID NO: 7775759 - DNA, 22 bp, Homo sapiens
agctgcagccgcagctgtggcc

SEQ ID NO: 7775760 - DNA, 22 bp, Homo sapiens
agctgcagccctcctgcatggc

SEQ ID NO: 7775761 - DNA, 23 bp, Homo sapiens
agatcacatgctgatggaaaatg

SEQ ID NO: 7775762 - DNA, 22 bp, Homo sapiens
agatattgtttgtttcaccaat

SEQ ID NO: 7775763 - DNA, 22 bp, Homo sapiens
agatatttaaatcagacaaaga

SEQ ID NO: 7775764 - DNA, 22 bp, Homo sapiens
agatattaggaggattcataat

SEQ ID NO: 7775765 - DNA, 22 bp, Homo sapiens
agatattaatcgtacataaggt

SEQ ID NO: 7775766 - DNA, 22 bp, Homo sapiens
agatataataatttacaagtgt

SEQ ID NO: 7775767 - DNA, 22 bp, Homo sapiens
attggtagttttgtatttctct

SEQ ID NO: 7775768 - DNA, 22 bp, Homo sapiens
attggtagttttgtatttctct

SEQ ID NO: 7775769 - DNA, 22 bp, Homo sapiens
attgggatgccggctgataaga

SEQ ID NO: 7775770 - DNA, 22 bp, Homo sapiens
agagtggcagcaagtcaggtag

SEQ ID NO: 7775771 - DNA, 22 bp, Homo sapiens
agatggagaccttggatgaact

SEQ ID NO: 7775772 - DNA, 22 bp, Homo sapiens
agatggagtggagatgagtaaa

SEQ ID NO: 7775773 - DNA, 19 bp, Homo sapiens
agatggcaaaatgcaaaga

SEQ ID NO: 7775774 - DNA, 17 bp, Homo sapiens
agatggcaggaggcaga

SEQ ID NO: 7775775 - DNA, 17 bp, Homo sapiens
agatggcaggaggcaga

SEQ ID NO: 7775776 - DNA, 17 bp, Homo sapiens
agatggcaggaggcaga

SEQ ID NO: 7775777 - DNA, 22 bp, Homo sapiens
agatggcaggggtacctggaag

SEQ ID NO: 7775778 - DNA, 22 bp, Homo sapiens
agatggcaggccctgtgggggt

SEQ ID NO: 7775779 - DNA, 22 bp, Homo sapiens
agatgggccttcgagcatgccc

SEQ ID NO: 7775780 - DNA, 22 bp, Homo sapiens
agatgctggggcccctcggatg

SEQ ID NO: 7775781 - DNA, 22 bp, Homo sapiens
agatggaaaatatagacagaga

SEQ ID NO: 7775782 - DNA, 22 bp, Homo sapiens
agatcagaaatgtaatggcagt

SEQ ID NO: 7775783 - DNA, 22 bp, Homo sapiens
attttcaagggagaggcctctg

SEQ ID NO: 7775784 - DNA, 22 bp, Homo sapiens
attttcaagggagaggcctctg

SEQ ID NO: 7775785 - DNA, 22 bp, Homo sapiens
attttcaccctgaatatattga

SEQ ID NO: 7775786 - DNA, 22 bp, Homo sapiens
agatgtggccggctagggagag

SEQ ID NO: 7775787 - DNA, 22 bp, Homo sapiens
attttagatttaagaataaggt

SEQ ID NO: 7775788 - DNA, 22 bp, Homo sapiens
attttatccccactggattaca

SEQ ID NO: 7775789 - DNA, 22 bp, Homo sapiens
attttcaaaacatctgctgtgt

SEQ ID NO: 7775790 - DNA, 22 bp, Homo sapiens
agcaaattcagaagcagaatgg

SEQ ID NO: 7775791 - DNA, 22 bp, Homo sapiens
agcaaattaggtcaaggagatg

SEQ ID NO: 7775792 - DNA, 22 bp, Homo sapiens
agcaaatgggtttatatttgac

SEQ ID NO: 7775793 - DNA, 22 bp, Homo sapiens
agcaacagccctgtttcattag

SEQ ID NO: 7775794 - DNA, 22 bp, Homo sapiens
agcaacagcaacgacatttctc

SEQ ID NO: 7775795 - DNA, 22 bp, Homo sapiens
agatgtttataactcatgagtg

SEQ ID NO: 7775796 - DNA, 22 bp, Homo sapiens
agatgtgggcaatggaatggag

SEQ ID NO: 7775797 - DNA, 22 bp, Homo sapiens
caaagattttagaatttgcaat

SEQ ID NO: 7775798 - DNA, 22 bp, Homo sapiens
caaacattttgagtggtttctg

SEQ ID NO: 7775799 - DNA, 20 bp, Homo sapiens
agcaagagtaaggacagcga

SEQ ID NO: 7775800 - DNA, 22 bp, Homo sapiens
caaagcaagggctgaagactcc

SEQ ID NO: 7775801 - DNA, 22 bp, Homo sapiens
caaagcaaggctcagtttgaac

SEQ ID NO: 7775802 - DNA, 22 bp, Homo sapiens
caaagcagacctttacccttta

SEQ ID NO: 7775803 - DNA, 22 bp, Homo sapiens
caaagcagaaggttctgtggta

SEQ ID NO: 7775804 - DNA, 22 bp, Homo sapiens
caaagcaagggctgaagactcc

SEQ ID NO: 7775805 - DNA, 22 bp, Homo sapiens
agcaactatattgaaagccacc

SEQ ID NO: 7775806 - DNA, 22 bp, Homo sapiens
agcaacagggtggtcttcagaa

SEQ ID NO: 7775807 - DNA, 22 bp, Homo sapiens
agcaacaggcataatgtgttga

SEQ ID NO: 7775808 - DNA, 22 bp, Homo sapiens
agagtccaggggcctggtgtgt

SEQ ID NO: 7775809 - DNA, 22 bp, Homo sapiens
agagtgagggggcactgagacg

SEQ ID NO: 7775810 - DNA, 22 bp, Homo sapiens
agagtgctcagatgcatgtctt

SEQ ID NO: 7775811 - DNA, 20 bp, Homo sapiens
agagtgctggactgaggagc

SEQ ID NO: 7775812 - DNA, 22 bp, Homo sapiens
agagtccaccctggggtcaggc

SEQ ID NO: 7775813 - DNA, 22 bp, Homo sapiens
agagtcagcttatgacacagtc

SEQ ID NO: 7775814 - DNA, 22 bp, Homo sapiens
agagtcagaaagcagacagggg

SEQ ID NO: 7775815 - DNA, 22 bp, Homo sapiens
agagtcagaaccaagatgaggc

SEQ ID NO: 7775816 - DNA, 22 bp, Homo sapiens
agagtcaacatcgagccactgg

SEQ ID NO: 7775817 - DNA, 22 bp, Homo sapiens
agagtcaagggtgcagaggaag

SEQ ID NO: 7775818 - DNA, 22 bp, Homo sapiens
agagtcaaggtggcatttagct

SEQ ID NO: 7775819 - DNA, 22 bp, Homo sapiens
agagtcaagtagggcatgggct

SEQ ID NO: 7775820 - DNA, 22 bp, Homo sapiens
agagtatgcatctattgtacct

SEQ ID NO: 7775821 - DNA, 22 bp, Homo sapiens
agaggctgggtacgggccacct

SEQ ID NO: 7775822 - DNA, 22 bp, Homo sapiens
agaggctgggcaggacccacag

SEQ ID NO: 7775823 - DNA, 22 bp, Homo sapiens
agaggctgggtacgggccacct

SEQ ID NO: 7775824 - DNA, 22 bp, Homo sapiens
agaggctgtcccttgctattcc

SEQ ID NO: 7775825 - DNA, 23 bp, Homo sapiens
agaggggagcatctgctggctga

SEQ ID NO: 7775826 - DNA, 22 bp, Homo sapiens
agaggccaggcagcccaaggtg

SEQ ID NO: 7775827 - DNA, 22 bp, Homo sapiens
agaggccaggctgcagagggat

SEQ ID NO: 7775828 - DNA, 22 bp, Homo sapiens
agaggctgcacttgctcatgat

SEQ ID NO: 7775829 - DNA, 22 bp, Homo sapiens
agaggctgcacttgctcatgat

SEQ ID NO: 7775830 - DNA, 22 bp, Homo sapiens
agaggctgcacttgctcatgat

SEQ ID NO: 7775831 - DNA, 18 bp, Homo sapiens
agaggctggacaggggat

SEQ ID NO: 7775832 - DNA, 23 bp, Homo sapiens
agaggctgcagggtattgagaat

SEQ ID NO: 7775833 - DNA, 22 bp, Homo sapiens
agaggctgcaggctggaaatca

SEQ ID NO: 7775834 - DNA, 22 bp, Homo sapiens
agaggctgcaggctggaaatca

SEQ ID NO: 7775835 - DNA, 22 bp, Homo sapiens
agaggctggattgagcatagac

SEQ ID NO: 7775836 - DNA, 18 bp, Homo sapiens
agaggctggacaggggat

SEQ ID NO: 7775837 - DNA, 22 bp, Homo sapiens
agaggccagcagtgcctatctg

SEQ ID NO: 7775838 - DNA, 22 bp, Homo sapiens
agaggccagcactgcagggaag

SEQ ID NO: 7775839 - DNA, 22 bp, Homo sapiens
agaggccagcaaccacagtaaa

SEQ ID NO: 7775840 - DNA, 22 bp, Homo sapiens
agaggccagatcatcatagatg

SEQ ID NO: 7775841 - DNA, 22 bp, Homo sapiens
agaggccagcaaccacagtaaa

SEQ ID NO: 7775842 - DNA, 23 bp, Homo sapiens
agaggccagcctttggagacacc

SEQ ID NO: 7775843 - DNA, 23 bp, Homo sapiens
agaggccagcctttggagacacc

SEQ ID NO: 7775844 - DNA, 22 bp, Homo sapiens
agaggccagcagtgcctatctg

SEQ ID NO: 7775845 - DNA, 22 bp, Homo sapiens
agaggccagcccaggccaccga

SEQ ID NO: 7775846 - DNA, 22 bp, Homo sapiens
agaggccaccactgtcagggac

SEQ ID NO: 7775847 - DNA, 22 bp, Homo sapiens
agaggccaccagaggtggtgcc

SEQ ID NO: 7775848 - DNA, 22 bp, Homo sapiens
agaggccaccagaggtggtgcc

SEQ ID NO: 7775849 - DNA, 22 bp, Homo sapiens
agaggccaccttctcttgagaa

SEQ ID NO: 7775850 - DNA, 22 bp, Homo sapiens
agaggccagaaagtatgccacc

SEQ ID NO: 7775851 - DNA, 22 bp, Homo sapiens
agaggccagaaggcgcaccccg

SEQ ID NO: 7775852 - DNA, 22 bp, Homo sapiens
agaggccactttgcctgtgatg

SEQ ID NO: 7775853 - DNA, 22 bp, Homo sapiens
attacactaatgtgacaacaat

SEQ ID NO: 7775854 - DNA, 22 bp, Homo sapiens
attacagtaacagctacaatgc

SEQ ID NO: 7775855 - DNA, 22 bp, Homo sapiens
attacagatagactttgaagct

SEQ ID NO: 7775856 - DNA, 22 bp, Homo sapiens
agaggcacaacagtcccattgt

SEQ ID NO: 7775857 - DNA, 22 bp, Homo sapiens
agaggcaagttcagagctagga

SEQ ID NO: 7775858 - DNA, 19 bp, Homo sapiens
agaggcaagggtggaagta

SEQ ID NO: 7775859 - DNA, 22 bp, Homo sapiens
agagctggctgtgggtgacttt

SEQ ID NO: 7775860 - DNA, 22 bp, Homo sapiens
agactgggtttgagacttagca

SEQ ID NO: 7775861 - DNA, 22 bp, Homo sapiens
agactgtaattgacatgtcagc

SEQ ID NO: 7775862 - DNA, 22 bp, Homo sapiens
agacccaggattggggctgccg

SEQ ID NO: 7775863 - DNA, 22 bp, Homo sapiens
agaccccatacctcagcaggta

SEQ ID NO: 7775864 - DNA, 22 bp, Homo sapiens
atgccaaattctactttcagca

SEQ ID NO: 7775865 - DNA, 22 bp, Homo sapiens
atgccaaatttctttctgttct

SEQ ID NO: 7775866 - DNA, 22 bp, Homo sapiens
atgccacataaccagttcactt

SEQ ID NO: 7775867 - DNA, 22 bp, Homo sapiens
atgccaaagggagcactttggg

SEQ ID NO: 7775868 - DNA, 22 bp, Homo sapiens
atgccaaattctactttcagca

SEQ ID NO: 7775869 - DNA, 22 bp, Homo sapiens
atgccaaattctcagcctcttt

SEQ ID NO: 7775870 - DNA, 22 bp, Homo sapiens
atgccaaagcccaagttcatca

SEQ ID NO: 7775871 - DNA, 22 bp, Homo sapiens
atgccaaagcccaagttcatca

SEQ ID NO: 7775872 - DNA, 21 bp, Homo sapiens
atgccaaacttcttctgccct

SEQ ID NO: 7775873 - DNA, 22 bp, Homo sapiens
atgccaaagatgtttgatagaa

SEQ ID NO: 7775874 - DNA, 22 bp, Homo sapiens
atgccaaagatgtttgatagaa

SEQ ID NO: 7775875 - DNA, 22 bp, Homo sapiens
atgccaaaatgttacatttctt

SEQ ID NO: 7775876 - DNA, 22 bp, Homo sapiens
atgccaaaatgttacatttctt

SEQ ID NO: 7775877 - DNA, 22 bp, Homo sapiens
atgcatattgattatagattca

SEQ ID NO: 7775878 - DNA, 20 bp, Homo sapiens
agacagaatcagagataaag

SEQ ID NO: 7775879 - DNA, 22 bp, Homo sapiens
agacagaatttgtcagataaat

SEQ ID NO: 7775880 - DNA, 22 bp, Homo sapiens
atgatacatcttcatgtcagtg

SEQ ID NO: 7775881 - DNA, 22 bp, Homo sapiens
atgatacatcttgtttatttca

SEQ ID NO: 7775882 - DNA, 22 bp, Homo sapiens
agacaaatttcctgcaatgaag

SEQ ID NO: 7775883 - DNA, 22 bp, Homo sapiens
atgagggaggcaaggagatgct

SEQ ID NO: 7775884 - DNA, 22 bp, Homo sapiens
agacaaatttcctgcaatgaag

SEQ ID NO: 7775885 - DNA, 22 bp, Homo sapiens
atctgcctccaagtccatgtgt

SEQ ID NO: 7775886 - DNA, 22 bp, Homo sapiens
atctgcctcttcttcattgcga

SEQ ID NO: 7775887 - DNA, 17 bp, Homo sapiens
atctgcttcacccagca

SEQ ID NO: 7775888 - DNA, 22 bp, Homo sapiens
atctgcttcctgggctccatga

SEQ ID NO: 7775889 - DNA, 22 bp, Homo sapiens
atgaaggcagttttataagatt

SEQ ID NO: 7775890 - DNA, 22 bp, Homo sapiens
agaatatagttaccaaattctg

SEQ ID NO: 7775891 - DNA, 22 bp, Homo sapiens
agagattgctagctggctttaa

SEQ ID NO: 7775892 - DNA, 22 bp, Homo sapiens
agagccaggccaggccggggca

SEQ ID NO: 7775893 - DNA, 22 bp, Homo sapiens
agagcccaggtcctggagaggg

SEQ ID NO: 7775894 - DNA, 22 bp, Homo sapiens
agagcccctggtggagtgagaa

SEQ ID NO: 7775895 - DNA, 22 bp, Homo sapiens
agagcccagtctttgtgtgaag

SEQ ID NO: 7775896 - DNA, 22 bp, Homo sapiens
agagcagatggagctggaagag

SEQ ID NO: 7775897 - DNA, 22 bp, Homo sapiens
agagcagatggagctggaagag

SEQ ID NO: 7775898 - DNA, 22 bp, Homo sapiens
agagccctgaagcagagctaaa

SEQ ID NO: 7775899 - DNA, 22 bp, Homo sapiens
agagccctgccaatggatgagg

SEQ ID NO: 7775900 - DNA, 22 bp, Homo sapiens
agagccctgtggttctggtaag

SEQ ID NO: 7775901 - DNA, 22 bp, Homo sapiens
agagcctgagcctgatcttgaa

SEQ ID NO: 7775902 - DNA, 21 bp, Homo sapiens
agagcctgagatcttccagca

SEQ ID NO: 7775903 - DNA, 21 bp, Homo sapiens
agagctggcctgccaggccct

SEQ ID NO: 7775904 - DNA, 22 bp, Homo sapiens
agagctggctggtagccctgat

SEQ ID NO: 7775905 - DNA, 22 bp, Homo sapiens
agagctggatggtcaagatggc

SEQ ID NO: 7775906 - DNA, 22 bp, Homo sapiens
agagctggatggtcaagatggc

SEQ ID NO: 7775907 - DNA, 22 bp, Homo sapiens
agagaggttggctaggatgttt

SEQ ID NO: 7775908 - DNA, 22 bp, Homo sapiens
agagaggttggctaggatgttt

SEQ ID NO: 7775909 - DNA, 22 bp, Homo sapiens
agagagggaatatttggggtat

SEQ ID NO: 7775910 - DNA, 19 bp, Homo sapiens
agagaggctgtgtgaggga

SEQ ID NO: 7775911 - DNA, 19 bp, Homo sapiens
agagaggctgtgtgaggga

SEQ ID NO: 7775912 - DNA, 19 bp, Homo sapiens
agagaggctgtgtgaggga

SEQ ID NO: 7775913 - DNA, 22 bp, Homo sapiens
agagaggctgggcgtagggctt

SEQ ID NO: 7775914 - DNA, 22 bp, Homo sapiens
agagaggctgggcgtagggctt

SEQ ID NO: 7775915 - DNA, 22 bp, Homo sapiens
agagaggctgctggactatatg

SEQ ID NO: 7775916 - DNA, 22 bp, Homo sapiens
agagaggcattcggtgatccca

SEQ ID NO: 7775917 - DNA, 22 bp, Homo sapiens
agagaggatttgtttttctcct

SEQ ID NO: 7775918 - DNA, 22 bp, Homo sapiens
agagaattaattaggagcactg

SEQ ID NO: 7775919 - DNA, 22 bp, Homo sapiens
agagaattggagcagtgacagg

SEQ ID NO: 7775920 - DNA, 22 bp, Homo sapiens
agagagcccgggccagggcaca

SEQ ID NO: 7775921 - DNA, 22 bp, Homo sapiens
agagagcagtggatcacctagc

SEQ ID NO: 7775922 - DNA, 21 bp, Homo sapiens
agagagaaggccatatggtcc

SEQ ID NO: 7775923 - DNA, 22 bp, Homo sapiens
agagaaaagagttcaggctttg

SEQ ID NO: 7775924 - DNA, 22 bp, Homo sapiens
agagaaaagagttcaggctttg

SEQ ID NO: 7775925 - DNA, 22 bp, Homo sapiens
agagaaaagagttcaggctttg

SEQ ID NO: 7775926 - DNA, 22 bp, Homo sapiens
agagaaaagagttcaggctttg

SEQ ID NO: 7775927 - DNA, 22 bp, Homo sapiens
agagaaaactcattgaggtgtc

SEQ ID NO: 7775928 - DNA, 22 bp, Homo sapiens
agagaaaactcattgaggtgtc

SEQ ID NO: 7775929 - DNA, 22 bp, Homo sapiens
agagaaaactcattgaggtgtc

SEQ ID NO: 7775930 - DNA, 23 bp, Homo sapiens
agagaaaaatatctgggcacatt

SEQ ID NO: 7775931 - DNA, 22 bp, Homo sapiens
agagaatacagggtaacaggaa

SEQ ID NO: 7775932 - DNA, 22 bp, Homo sapiens
agagaagggtgtagcctgggcc

SEQ ID NO: 7775933 - DNA, 22 bp, Homo sapiens
agagaaggtcactaaggaccca

SEQ ID NO: 7775934 - DNA, 22 bp, Homo sapiens
agagaaggtcactaaggaccca

SEQ ID NO: 7775935 - DNA, 22 bp, Homo sapiens
agacttcttgagctggcacttc

SEQ ID NO: 7775936 - DNA, 22 bp, Homo sapiens
agactttaatgtgcaaatgaaa

SEQ ID NO: 7775937 - DNA, 21 bp, Homo sapiens
agactttgcttgcagagagtc

SEQ ID NO: 7775938 - DNA, 22 bp, Homo sapiens
agcactgtgatttataacattt

SEQ ID NO: 7775939 - DNA, 22 bp, Homo sapiens
agcagagcggggcctccggaag

SEQ ID NO: 7775940 - DNA, 22 bp, Homo sapiens
agcagagctgcagtggcctgct

SEQ ID NO: 7775941 - DNA, 22 bp, Homo sapiens
agcagagctgcagtggcctgct

SEQ ID NO: 7775942 - DNA, 22 bp, Homo sapiens
agcagagctttttggactcaga

SEQ ID NO: 7775943 - DNA, 21 bp, Homo sapiens
agcagaggcagaatgtatgca

SEQ ID NO: 7775944 - DNA, 21 bp, Homo sapiens
agcagaggctgcctggtgact

SEQ ID NO: 7775945 - DNA, 21 bp, Homo sapiens
agcagaggctgcctggtgact

SEQ ID NO: 7775946 - DNA, 22 bp, Homo sapiens
agcagagtcttcaagggcaggc

SEQ ID NO: 7775947 - DNA, 22 bp, Homo sapiens
caataatatcctgtgctgtttg

SEQ ID NO: 7775948 - DNA, 22 bp, Homo sapiens
caataatatcctgtgctgtttg

SEQ ID NO: 7775949 - DNA, 22 bp, Homo sapiens
caagtgatcagacactgaagtc

SEQ ID NO: 7775950 - DNA, 20 bp, Homo sapiens
caataatttacttccctatt

SEQ ID NO: 7775951 - DNA, 22 bp, Homo sapiens
caataattgctttccagagtta

SEQ ID NO: 7775952 - DNA, 22 bp, Homo sapiens
caataatttacattggatacca

SEQ ID NO: 7775953 - DNA, 22 bp, Homo sapiens
agcactctaagtgcaagacact

SEQ ID NO: 7775954 - DNA, 22 bp, Homo sapiens
agcactcctgtctttccccttt

SEQ ID NO: 7775955 - DNA, 22 bp, Homo sapiens
agcactgtagttatagctaaca

SEQ ID NO: 7775956 - DNA, 22 bp, Homo sapiens
agcactggagtttagtgggatt

SEQ ID NO: 7775957 - DNA, 22 bp, Homo sapiens
agcacctgtgtggtagggaggt

SEQ ID NO: 7775958 - DNA, 22 bp, Homo sapiens
agcacctgtgccctgatggaga

SEQ ID NO: 7775959 - DNA, 22 bp, Homo sapiens
agcacctgtgtgagctagatgt

SEQ ID NO: 7775960 - DNA, 22 bp, Homo sapiens
caaaggcctgagaactgagggg

SEQ ID NO: 7775961 - DNA, 22 bp, Homo sapiens
caaagggaaaagccatgtgggc

SEQ ID NO: 7775962 - DNA, 22 bp, Homo sapiens
caaagggcatggcctgagcact

SEQ ID NO: 7775963 - DNA, 17 bp, Homo sapiens
caaagggagcccaccaa

SEQ ID NO: 7775964 - DNA, 22 bp, Homo sapiens
agcacctggagggctgggacct

SEQ ID NO: 7775965 - DNA, 22 bp, Homo sapiens
agcacctgcttaatgtgcagtg

SEQ ID NO: 7775966 - DNA, 23 bp, Homo sapiens
agcacctgtgatttcctagctct

SEQ ID NO: 7775967 - DNA, 22 bp, Homo sapiens
agcacctggtctcctggcgctg

SEQ ID NO: 7775968 - DNA, 22 bp, Homo sapiens
caatactattcggaccatctct

SEQ ID NO: 7775969 - DNA, 19 bp, Homo sapiens
agcagcagaagtgtgcctt

SEQ ID NO: 7775970 - DNA, 22 bp, Homo sapiens
caatacaattaccagttaatca

SEQ ID NO: 7775971 - DNA, 22 bp, Homo sapiens
caatacaattaccagttaatca

SEQ ID NO: 7775972 - DNA, 22 bp, Homo sapiens
agcagcagagctctggtctgca

SEQ ID NO: 7775973 - DNA, 21 bp, Homo sapiens
agcagcagatctggtgagggc

SEQ ID NO: 7775974 - DNA, 22 bp, Homo sapiens
agcagcccctcggcgggtgcgc

SEQ ID NO: 7775975 - DNA, 22 bp, Homo sapiens
agcagcccagttgtactgagtg

SEQ ID NO: 7775976 - DNA, 22 bp, Homo sapiens
agcagcccctcggcgggtgcgc

SEQ ID NO: 7775977 - DNA, 23 bp, Homo sapiens
agcagcccaatggcaagctctgg

SEQ ID NO: 7775978 - DNA, 22 bp, Homo sapiens
agcagccagagaatgatgcagt

SEQ ID NO: 7775979 - DNA, 20 bp, Homo sapiens
agcagcagatgttggaggtg

SEQ ID NO: 7775980 - DNA, 23 bp, Homo sapiens
agcagccctgggacctggcctgc

SEQ ID NO: 7775981 - DNA, 22 bp, Homo sapiens
agcagccttaggtattgtgatt

SEQ ID NO: 7775982 - DNA, 22 bp, Homo sapiens
agcagccttgcaggggtcgcac

SEQ ID NO: 7775983 - DNA, 17 bp, Homo sapiens
agcagctggcacaggag

SEQ ID NO: 7775984 - DNA, 19 bp, Homo sapiens
agcagctggaggtggagtg

SEQ ID NO: 7775985 - DNA, 22 bp, Homo sapiens
cacagagatcggaacagaagta

SEQ ID NO: 7775986 - DNA, 22 bp, Homo sapiens
cacagaacatttttagatgcag

SEQ ID NO: 7775987 - DNA, 22 bp, Homo sapiens
cacagaacatccttagctcatg

SEQ ID NO: 7775988 - DNA, 22 bp, Homo sapiens
cacagaacatccttagctcatg

SEQ ID NO: 7775989 - DNA, 19 bp, Homo sapiens
agcagctcagggaggcacc

SEQ ID NO: 7775990 - DNA, 22 bp, Homo sapiens
agcagctcatggagtaggcact

SEQ ID NO: 7775991 - DNA, 22 bp, Homo sapiens
agcagctcaacagtgtctctat

SEQ ID NO: 7775992 - DNA, 23 bp, Homo sapiens
agcagtaacttcagaaacatcag

SEQ ID NO: 7775993 - DNA, 22 bp, Homo sapiens
agcagtccttctttagagagcc

SEQ ID NO: 7775994 - DNA, 22 bp, Homo sapiens
agcagggctgcggccccaccac

SEQ ID NO: 7775995 - DNA, 22 bp, Homo sapiens
agcagggctggggcacgagcca

SEQ ID NO: 7775996 - DNA, 22 bp, Homo sapiens
agcagtgctatggccaggctaa

SEQ ID NO: 7775997 - DNA, 22 bp, Homo sapiens
agcatgaaagcataggacagtc

SEQ ID NO: 7775998 - DNA, 22 bp, Homo sapiens
cactgtgggtcccagactggag

SEQ ID NO: 7775999 - DNA, 22 bp, Homo sapiens
cactgtggtgtgagggctgatg

SEQ ID NO: 7776000 - DNA, 22 bp, Homo sapiens
cactgtggggtttggctggaac

SEQ ID NO: 7776001 - DNA, 22 bp, Homo sapiens
cactgtggggtttggctggaac

SEQ ID NO: 7776002 - DNA, 22 bp, Homo sapiens
cactgttcacattttagtctat

SEQ ID NO: 7776003 - DNA, 22 bp, Homo sapiens
cactttactatctataaaataa

SEQ ID NO: 7776004 - DNA, 22 bp, Homo sapiens
cactttactatctataaaataa

SEQ ID NO: 7776005 - DNA, 22 bp, Homo sapiens
cacttaaaactcctggaattgt

SEQ ID NO: 7776006 - DNA, 22 bp, Homo sapiens
agcatggacagtggcagcagtg

SEQ ID NO: 7776007 - DNA, 19 bp, Homo sapiens
agcatggcctacagtgtgc

SEQ ID NO: 7776008 - DNA, 22 bp, Homo sapiens
agcatggggcaatgcatgtgct

SEQ ID NO: 7776009 - DNA, 22 bp, Homo sapiens
agcatggggcaatgcatgtgct

SEQ ID NO: 7776010 - DNA, 22 bp, Homo sapiens
agcagggctctgccatgggccc

SEQ ID NO: 7776011 - DNA, 22 bp, Homo sapiens
caccagccccctcacgctgtca

SEQ ID NO: 7776012 - DNA, 22 bp, Homo sapiens
agcagggctctgtggagggtgg

SEQ ID NO: 7776013 - DNA, 22 bp, Homo sapiens
caccagcagaagactgagggtg

SEQ ID NO: 7776014 - DNA, 22 bp, Homo sapiens
caccagcagaagactgagggtg

SEQ ID NO: 7776015 - DNA, 20 bp, Homo sapiens
caccagcagcagctgccacc

SEQ ID NO: 7776016 - DNA, 20 bp, Homo sapiens
caccagcagcagctgccacc

SEQ ID NO: 7776017 - DNA, 23 bp, Homo sapiens
caccactttctccttctccttgg

SEQ ID NO: 7776018 - DNA, 22 bp, Homo sapiens
agcagggcagctgatgcgcacg

SEQ ID NO: 7776019 - DNA, 22 bp, Homo sapiens
agcagggcactggaaggcactg

SEQ ID NO: 7776020 - DNA, 22 bp, Homo sapiens
agcagggcaaagtcaggctaac

SEQ ID NO: 7776021 - DNA, 22 bp, Homo sapiens
agcagggcaaagtcaggctaac

SEQ ID NO: 7776022 - DNA, 22 bp, Homo sapiens
agcagggcagtgatcagaaagg

SEQ ID NO: 7776023 - DNA, 22 bp, Homo sapiens
agcagggcagcttttttcagaa

SEQ ID NO: 7776024 - DNA, 22 bp, Homo sapiens
agcagggcaggtaaggatcaga

SEQ ID NO: 7776025 - DNA, 22 bp, Homo sapiens
agcaggaagtagtctgtaagca

SEQ ID NO: 7776026 - DNA, 22 bp, Homo sapiens
agcagcttctttcactcctgga

SEQ ID NO: 7776027 - DNA, 22 bp, Homo sapiens
agcagcttgaggctggattcca

SEQ ID NO: 7776028 - DNA, 22 bp, Homo sapiens
agcagcttgaggctggattcca

SEQ ID NO: 7776029 - DNA, 20 bp, Homo sapiens
agcaggaatgatgctttcat

SEQ ID NO: 7776030 - DNA, 22 bp, Homo sapiens
agcaggacacgatgcggcagga

SEQ ID NO: 7776031 - DNA, 22 bp, Homo sapiens
agcaggaccaagaaggggaaaa

SEQ ID NO: 7776032 - DNA, 22 bp, Homo sapiens
cacagcaatagctaactgatac

SEQ ID NO: 7776033 - DNA, 22 bp, Homo sapiens
cacagcaagagctaaatgacca

SEQ ID NO: 7776034 - DNA, 22 bp, Homo sapiens
cacagcagacagggaggcggct

SEQ ID NO: 7776035 - DNA, 22 bp, Homo sapiens
cacagcagagggagccattgaa

SEQ ID NO: 7776036 - DNA, 22 bp, Homo sapiens
agcaggctgggcaatatgggca

SEQ ID NO: 7776037 - DNA, 22 bp, Homo sapiens
agcaggctgggcaatatgggca

SEQ ID NO: 7776038 - DNA, 22 bp, Homo sapiens
cacagcagaaagtgtaggagga

SEQ ID NO: 7776039 - DNA, 22 bp, Homo sapiens
cacagcagaaagtgtaggagga

SEQ ID NO: 7776040 - DNA, 22 bp, Homo sapiens
agcaggcttatggttgaaggga

SEQ ID NO: 7776041 - DNA, 22 bp, Homo sapiens
agcaggcttactttctgattag

SEQ ID NO: 7776042 - DNA, 22 bp, Homo sapiens
agcagggaggcccagggcactg

SEQ ID NO: 7776043 - DNA, 22 bp, Homo sapiens
agcagggaggtctagcacgtgg

SEQ ID NO: 7776044 - DNA, 22 bp, Homo sapiens
cagagctcagagctgccaggca

SEQ ID NO: 7776045 - DNA, 18 bp, Homo sapiens
cagagctcctggatgcag

SEQ ID NO: 7776046 - DNA, 22 bp, Homo sapiens
agccaggccttagggagaggca

SEQ ID NO: 7776047 - DNA, 22 bp, Homo sapiens
cagagacccttctcagtggcca

SEQ ID NO: 7776048 - DNA, 20 bp, Homo sapiens
cagagacccaggcttcagct

SEQ ID NO: 7776049 - DNA, 21 bp, Homo sapiens
agccagctatcacacagcatt

SEQ ID NO: 7776050 - DNA, 22 bp, Homo sapiens
cagagaaagggtgaattccttc

SEQ ID NO: 7776051 - DNA, 19 bp, Homo sapiens
agccagccagcaggtatgc

SEQ ID NO: 7776052 - DNA, 22 bp, Homo sapiens
agccagcccctgactgtgtcct

SEQ ID NO: 7776053 - DNA, 22 bp, Homo sapiens
agccagctaccggggctcctgg

SEQ ID NO: 7776054 - DNA, 22 bp, Homo sapiens
agccagctaagggaagcatgat

SEQ ID NO: 7776055 - DNA, 22 bp, Homo sapiens
agccagagagtgttggagatgt

SEQ ID NO: 7776056 - DNA, 22 bp, Homo sapiens
cactttctcatgaatttggccc

SEQ ID NO: 7776057 - DNA, 22 bp, Homo sapiens
agccctgggcgttactgggatg

SEQ ID NO: 7776058 - DNA, 22 bp, Homo sapiens
cagatggctgccaagatgggct

SEQ ID NO: 7776059 - DNA, 22 bp, Homo sapiens
agccctgggcacctgtgagggg

SEQ ID NO: 7776060 - DNA, 22 bp, Homo sapiens
agccctggctcccagcagcgct

SEQ ID NO: 7776061 - DNA, 22 bp, Homo sapiens
agccctggcagagccaggtagt

SEQ ID NO: 7776062 - DNA, 22 bp, Homo sapiens
agccctggattctgaggtccaa

SEQ ID NO: 7776063 - DNA, 22 bp, Homo sapiens
agccctggagcaaaggtgtctt

SEQ ID NO: 7776064 - DNA, 22 bp, Homo sapiens
agccccagtccgctgcgggcgg

SEQ ID NO: 7776065 - DNA, 22 bp, Homo sapiens
agccctgagctggcctgggctt

SEQ ID NO: 7776066 - DNA, 22 bp, Homo sapiens
agccccagcccctctctcacaa

SEQ ID NO: 7776067 - DNA, 22 bp, Homo sapiens
agccccagcccctctctcacaa

SEQ ID NO: 7776068 - DNA, 20 bp, Homo sapiens
agccccacccttgtcctggc

SEQ ID NO: 7776069 - DNA, 22 bp, Homo sapiens
agccccaggatgggccgcagga

SEQ ID NO: 7776070 - DNA, 22 bp, Homo sapiens
agccccaggcccggacgcctct

SEQ ID NO: 7776071 - DNA, 22 bp, Homo sapiens
agccccaggatgggccgcagga

SEQ ID NO: 7776072 - DNA, 22 bp, Homo sapiens
agccccagtaagggagggcctg

SEQ ID NO: 7776073 - DNA, 22 bp, Homo sapiens
agcccaggttgaggctgcagtg

SEQ ID NO: 7776074 - DNA, 22 bp, Homo sapiens
agcccaggttgaggctgcagtg

SEQ ID NO: 7776075 - DNA, 22 bp, Homo sapiens
agcccaggttgaggctgcagtg

SEQ ID NO: 7776076 - DNA, 22 bp, Homo sapiens
agcccagggacagggcggatgt

SEQ ID NO: 7776077 - DNA, 22 bp, Homo sapiens
agcccaggttctaaagccaaac

SEQ ID NO: 7776078 - DNA, 22 bp, Homo sapiens
agcccaggttgaggctgcagtg

SEQ ID NO: 7776079 - DNA, 22 bp, Homo sapiens
agcccaggttgaggctgcagtg

SEQ ID NO: 7776080 - DNA, 22 bp, Homo sapiens
agctcctgtggctgaaagagga

SEQ ID NO: 7776081 - DNA, 22 bp, Homo sapiens
agctctttatgggtaaatgcca

SEQ ID NO: 7776082 - DNA, 22 bp, Homo sapiens
agctctttctacaagcaggcag

SEQ ID NO: 7776083 - DNA, 22 bp, Homo sapiens
agctctttgagcaaggcagctc

SEQ ID NO: 7776084 - DNA, 22 bp, Homo sapiens
agctctttgagaaggcagtgtg

SEQ ID NO: 7776085 - DNA, 22 bp, Homo sapiens
agctctttggcactgagcagca

SEQ ID NO: 7776086 - DNA, 22 bp, Homo sapiens
agctctttgactaatcttgctt

SEQ ID NO: 7776087 - DNA, 22 bp, Homo sapiens
agctctttgctggcagtaggct

SEQ ID NO: 7776088 - DNA, 22 bp, Homo sapiens
agctcctggctttcctctcacc

SEQ ID NO: 7776089 - DNA, 22 bp, Homo sapiens
agctcctggcaaggtcatggtg

SEQ ID NO: 7776090 - DNA, 22 bp, Homo sapiens
agctcctggtctttgtccagag

SEQ ID NO: 7776091 - DNA, 22 bp, Homo sapiens
agctcctgtctcaagggagcct

SEQ ID NO: 7776092 - DNA, 22 bp, Homo sapiens
agctcctgggggttccaagcag

SEQ ID NO: 7776093 - DNA, 20 bp, Homo sapiens
agctcctggtataggtgcct

SEQ ID NO: 7776094 - DNA, 22 bp, Homo sapiens
agctcctggacgaacagggagt

SEQ ID NO: 7776095 - DNA, 20 bp, Homo sapiens
agctcctggactagagagtg

SEQ ID NO: 7776096 - DNA, 22 bp, Homo sapiens
agctccagggaaagagtggatc

SEQ ID NO: 7776097 - DNA, 22 bp, Homo sapiens
agctccaggataagacaggtgc

SEQ ID NO: 7776098 - DNA, 23 bp, Homo sapiens
agctccagctgacgtgggcagcc

SEQ ID NO: 7776099 - DNA, 22 bp, Homo sapiens
agctaggaaattgaggctgaga

SEQ ID NO: 7776100 - DNA, 22 bp, Homo sapiens
agctaggaaattgaggctgaga

SEQ ID NO: 7776101 - DNA, 22 bp, Homo sapiens
agctagcctaggcagagtgcat

SEQ ID NO: 7776102 - DNA, 22 bp, Homo sapiens
agctagcttagcctgtgaggta

SEQ ID NO: 7776103 - DNA, 22 bp, Homo sapiens
cagatgtgattcttccctcagc

SEQ ID NO: 7776104 - DNA, 22 bp, Homo sapiens
cagatgtgcatgatgggaaggg

SEQ ID NO: 7776105 - DNA, 22 bp, Homo sapiens
cagatgtgagctggggagagtg

SEQ ID NO: 7776106 - DNA, 23 bp, Homo sapiens
cagatgtgcaactctaggcaatg

SEQ ID NO: 7776107 - DNA, 20 bp, Homo sapiens
cagatgggacgtggaggagt

SEQ ID NO: 7776108 - DNA, 22 bp, Homo sapiens
cagcaaatgagtggcagggcag

SEQ ID NO: 7776109 - DNA, 21 bp, Homo sapiens
cagcaaatcattgggcagact

SEQ ID NO: 7776110 - DNA, 22 bp, Homo sapiens
cagcaaatactactagttttta

SEQ ID NO: 7776111 - DNA, 20 bp, Homo sapiens
cagcaactttggactgagtt

SEQ ID NO: 7776112 - DNA, 22 bp, Homo sapiens
cagcaacttggacagcagtctt

SEQ ID NO: 7776113 - DNA, 22 bp, Homo sapiens
cagcaactgtgcctgacacaca

SEQ ID NO: 7776114 - DNA, 22 bp, Homo sapiens
cagcaactctcctgtgctcaaa

SEQ ID NO: 7776115 - DNA, 21 bp, Homo sapiens
agcctgggaggcggaggttgc

SEQ ID NO: 7776116 - DNA, 22 bp, Homo sapiens
agcctgggaatttagagttcgg

SEQ ID NO: 7776117 - DNA, 22 bp, Homo sapiens
agcctgggcatgggacgggagg

SEQ ID NO: 7776118 - DNA, 22 bp, Homo sapiens
agcctgggcaacagagcaaaac

SEQ ID NO: 7776119 - DNA, 22 bp, Homo sapiens
agcctgggcaacaacacagcga

SEQ ID NO: 7776120 - DNA, 22 bp, Homo sapiens
agcctggccactcagggcctga

SEQ ID NO: 7776121 - DNA, 22 bp, Homo sapiens
agcctggccactcagggcctga

SEQ ID NO: 7776122 - DNA, 22 bp, Homo sapiens
agcctggcttagctctctcact

SEQ ID NO: 7776123 - DNA, 17 bp, Homo sapiens
agcctgggaaggagtga

SEQ ID NO: 7776124 - DNA, 19 bp, Homo sapiens
agcctggctttgctctgct

SEQ ID NO: 7776125 - DNA, 19 bp, Homo sapiens
agcctggctttgctctgct

SEQ ID NO: 7776126 - DNA, 18 bp, Homo sapiens
agcctgggctctgcctgg

SEQ ID NO: 7776127 - DNA, 22 bp, Homo sapiens
agcctgggtgggggttcggaga

SEQ ID NO: 7776128 - DNA, 22 bp, Homo sapiens
agcctgggtttttattaaggag

SEQ ID NO: 7776129 - DNA, 20 bp, Homo sapiens
agctacaatgcgaagctggc

SEQ ID NO: 7776130 - DNA, 22 bp, Homo sapiens
agctacaacttttccatgagca

SEQ ID NO: 7776131 - DNA, 23 bp, Homo sapiens
agctaaggaagctgaggcacagt

SEQ ID NO: 7776132 - DNA, 22 bp, Homo sapiens
agctagagctgagaagcacttg

SEQ ID NO: 7776133 - DNA, 22 bp, Homo sapiens
aactccagggcattgtctcctg

SEQ ID NO: 7776134 - DNA, 22 bp, Homo sapiens
aactccagtgtcagctgcaatg

SEQ ID NO: 7776135 - DNA, 22 bp, Homo sapiens
aactccaggcagggaggccact

SEQ ID NO: 7776136 - DNA, 22 bp, Homo sapiens
aactccagcaggaaggtgagaa

SEQ ID NO: 7776137 - DNA, 22 bp, Homo sapiens
aactcatttgcatttttcctgt

SEQ ID NO: 7776138 - DNA, 22 bp, Homo sapiens
aaccagtttcaaagaaaattgc

SEQ ID NO: 7776139 - DNA, 22 bp, Homo sapiens
aaccagtttagtcatgctgtaa

SEQ ID NO: 7776140 - DNA, 22 bp, Homo sapiens
aaccagttgtatgtcctccagc

SEQ ID NO: 7776141 - DNA, 22 bp, Homo sapiens
aaccagttggcaaccagcagtt

SEQ ID NO: 7776142 - DNA, 22 bp, Homo sapiens
aaccagtttaagcaaataactg

SEQ ID NO: 7776143 - DNA, 20 bp, Homo sapiens
aaccagtacccaagtaggaa

SEQ ID NO: 7776144 - DNA, 22 bp, Homo sapiens
aactatacatatttacatagac

SEQ ID NO: 7776145 - DNA, 22 bp, Homo sapiens
aaccattagtcaatcagcaaga

SEQ ID NO: 7776146 - DNA, 22 bp, Homo sapiens
aaccagagtgacactctacaga

SEQ ID NO: 7776147 - DNA, 22 bp, Homo sapiens
aatcagaaaattcagtggaatt

SEQ ID NO: 7776148 - DNA, 22 bp, Homo sapiens
aatcacattacagcatatctgt

SEQ ID NO: 7776149 - DNA, 22 bp, Homo sapiens
aatcacattacagcatatctgt

SEQ ID NO: 7776150 - DNA, 22 bp, Homo sapiens
aatcacattacagcatatctgt

SEQ ID NO: 7776151 - DNA, 22 bp, Homo sapiens
aatcacatttacattgctaatt

SEQ ID NO: 7776152 - DNA, 22 bp, Homo sapiens
aacatttcagcacctgattcct

SEQ ID NO: 7776153 - DNA, 22 bp, Homo sapiens
aacatttatggtagtcattgca

SEQ ID NO: 7776154 - DNA, 22 bp, Homo sapiens
aacattgttttgcacaactctt

SEQ ID NO: 7776155 - DNA, 22 bp, Homo sapiens
aacattgttttccctatatcca

SEQ ID NO: 7776156 - DNA, 20 bp, Homo sapiens
aacattgcttcaatgtaacc

SEQ ID NO: 7776157 - DNA, 22 bp, Homo sapiens
aacattgccatggttaatttta

SEQ ID NO: 7776158 - DNA, 22 bp, Homo sapiens
aacattctggttctaaaaacct

SEQ ID NO: 7776159 - DNA, 22 bp, Homo sapiens
aacattctgtcaattgatgacc

SEQ ID NO: 7776160 - DNA, 22 bp, Homo sapiens
aacattcttcaaatatcactct

SEQ ID NO: 7776161 - DNA, 22 bp, Homo sapiens
aacattcttaagatttgtgtct

SEQ ID NO: 7776162 - DNA, 22 bp, Homo sapiens
aacattcttcaaatatcactct

SEQ ID NO: 7776163 - DNA, 22 bp, Homo sapiens
aataaacaaaggacaaggaggt

SEQ ID NO: 7776164 - DNA, 22 bp, Homo sapiens
aataaacaaaggacaaggaggt

SEQ ID NO: 7776165 - DNA, 22 bp, Homo sapiens
aataaaatggtcagttttctca

SEQ ID NO: 7776166 - DNA, 22 bp, Homo sapiens
aataaaatggtcagttttctca

SEQ ID NO: 7776167 - DNA, 22 bp, Homo sapiens
aataaaatggtcagttttctca

SEQ ID NO: 7776168 - DNA, 22 bp, Homo sapiens
aagtttgagagcctttagtata

SEQ ID NO: 7776169 - DNA, 22 bp, Homo sapiens
aagtttgagaagcttatagata

SEQ ID NO: 7776170 - DNA, 20 bp, Homo sapiens
aagtttctggtttatatctt

SEQ ID NO: 7776171 - DNA, 22 bp, Homo sapiens
aagtttctttattagcttgtcc

SEQ ID NO: 7776172 - DNA, 22 bp, Homo sapiens
aagtttctgatattgttaaagc

SEQ ID NO: 7776173 - DNA, 22 bp, Homo sapiens
aagtttctgggcaagacaaggc

SEQ ID NO: 7776174 - DNA, 22 bp, Homo sapiens
aagtttctgggcaagacaaggc

SEQ ID NO: 7776175 - DNA, 22 bp, Homo sapiens
aagtttctgccatactgtggtg

SEQ ID NO: 7776176 - DNA, 22 bp, Homo sapiens
aataaactgctcaattgcatca

SEQ ID NO: 7776177 - DNA, 22 bp, Homo sapiens
aataaactgctcaattgcatca

SEQ ID NO: 7776178 - DNA, 20 bp, Homo sapiens
aataaactactgagagatgt

SEQ ID NO: 7776179 - DNA, 22 bp, Homo sapiens
aataaacaaatctttcctgtgg

SEQ ID NO: 7776180 - DNA, 22 bp, Homo sapiens
aataaacaaatccttccttccc

SEQ ID NO: 7776181 - DNA, 22 bp, Homo sapiens
aataaacaaatccttccttccc

SEQ ID NO: 7776182 - DNA, 22 bp, Homo sapiens
aataaacaaatccttccttccc

SEQ ID NO: 7776183 - DNA, 22 bp, Homo sapiens
aacagtttgcctgaaatgtatt

SEQ ID NO: 7776184 - DNA, 22 bp, Homo sapiens
aagttgagatgtcataggagac

SEQ ID NO: 7776185 - DNA, 20 bp, Homo sapiens
aagttacattgtattgtacc

SEQ ID NO: 7776186 - DNA, 22 bp, Homo sapiens
aagttctggggtaatgagaatt

SEQ ID NO: 7776187 - DNA, 22 bp, Homo sapiens
aagtcaaaccttgctcacagga

SEQ ID NO: 7776188 - DNA, 22 bp, Homo sapiens
aagtatttcgttctgaaaaagt

SEQ ID NO: 7776189 - DNA, 22 bp, Homo sapiens
aagtcaaagctttcagaggaaa

SEQ ID NO: 7776190 - DNA, 22 bp, Homo sapiens
aagtcaagataaaggtgctggc

SEQ ID NO: 7776191 - DNA, 21 bp, Homo sapiens
aagtcaatacagataagtctt

SEQ ID NO: 7776192 - DNA, 22 bp, Homo sapiens
aacactgctccaaaaaaggctt

SEQ ID NO: 7776193 - DNA, 22 bp, Homo sapiens
aaggagaaggcatcattcaagt

SEQ ID NO: 7776194 - DNA, 22 bp, Homo sapiens
aaggagaaggcatcattcaagt

SEQ ID NO: 7776195 - DNA, 22 bp, Homo sapiens
aaggactgaataattctctttc

SEQ ID NO: 7776196 - DNA, 22 bp, Homo sapiens
aaattgttgatctacagtaagg

SEQ ID NO: 7776197 - DNA, 22 bp, Homo sapiens
aaatttaaaaagcagcattgca

SEQ ID NO: 7776198 - DNA, 22 bp, Homo sapiens
aaattattacaagctagttggc

SEQ ID NO: 7776199 - DNA, 22 bp, Homo sapiens
aaggacaggttggggcttcagg

SEQ ID NO: 7776200 - DNA, 22 bp, Homo sapiens
aaggacagggatggttgattgt

SEQ ID NO: 7776201 - DNA, 22 bp, Homo sapiens
aaattataggtgccaccttgga

SEQ ID NO: 7776202 - DNA, 22 bp, Homo sapiens
aaattagtcatgttgtattact

SEQ ID NO: 7776203 - DNA, 22 bp, Homo sapiens
aaattagtcggtttaggaattt

SEQ ID NO: 7776204 - DNA, 22 bp, Homo sapiens
aaattagtcggtttaggaattt

SEQ ID NO: 7776205 - DNA, 22 bp, Homo sapiens
aaattagtacattgcaaagtcc

SEQ ID NO: 7776206 - DNA, 22 bp, Homo sapiens
aaatgttttgctcccatgtggt

SEQ ID NO: 7776207 - DNA, 22 bp, Homo sapiens
aagccagtgtggtctgcccatt

SEQ ID NO: 7776208 - DNA, 22 bp, Homo sapiens
aagccagtgtttttgagagttg

SEQ ID NO: 7776209 - DNA, 22 bp, Homo sapiens
aagccagtgtgacaggaaactt

SEQ ID NO: 7776210 - DNA, 22 bp, Homo sapiens
aagccagttagcacatcattgc

SEQ ID NO: 7776211 - DNA, 16 bp, Homo sapiens
aagccagttcagcatt

SEQ ID NO: 7776212 - DNA, 22 bp, Homo sapiens
aagccagtggcttctccctgct

SEQ ID NO: 7776213 - DNA, 22 bp, Homo sapiens
aagccagtgggcatagcagttg

SEQ ID NO: 7776214 - DNA, 22 bp, Homo sapiens
aagccagtcctctactgggcac

SEQ ID NO: 7776215 - DNA, 22 bp, Homo sapiens
aagccagtgtccagaatgggca

SEQ ID NO: 7776216 - DNA, 22 bp, Homo sapiens
aagccagtggtgagaagatagc

SEQ ID NO: 7776217 - DNA, 22 bp, Homo sapiens
aagccagtattcaatggggcta

SEQ ID NO: 7776218 - DNA, 22 bp, Homo sapiens
aagccagtaagtttttgtcatt

SEQ ID NO: 7776219 - DNA, 22 bp, Homo sapiens
aagctggcaattatcaaaactg

SEQ ID NO: 7776220 - DNA, 18 bp, Homo sapiens
aagctgggaaggagacag

SEQ ID NO: 7776221 - DNA, 22 bp, Homo sapiens
aagctggcctcaaactcctagc

SEQ ID NO: 7776222 - DNA, 20 bp, Homo sapiens
aagctgggtaggagaggagc

SEQ ID NO: 7776223 - DNA, 22 bp, Homo sapiens
aagctgtagaggcagtacattt

SEQ ID NO: 7776224 - DNA, 22 bp, Homo sapiens
aagctttagagatgagttcctt

SEQ ID NO: 7776225 - DNA, 22 bp, Homo sapiens
aagctttgttcttcacagagtg

SEQ ID NO: 7776226 - DNA, 22 bp, Homo sapiens
aagctttgggcagaagaggatt

SEQ ID NO: 7776227 - DNA, 22 bp, Homo sapiens
aagctttgtccaaggccatgca

SEQ ID NO: 7776228 - DNA, 22 bp, Homo sapiens
aagctttgcaccggtggctgga

SEQ ID NO: 7776229 - DNA, 22 bp, Homo sapiens
aagctttggaagggcagggttg

SEQ ID NO: 7776230 - DNA, 22 bp, Homo sapiens
aagctttggagaggcgggcagg

SEQ ID NO: 7776231 - DNA, 22 bp, Homo sapiens
aagctttgcaatgcttcattat

SEQ ID NO: 7776232 - DNA, 22 bp, Homo sapiens
aagctttgataattggattact

SEQ ID NO: 7776233 - DNA, 22 bp, Homo sapiens
aagctttgactactgcctcttg

SEQ ID NO: 7776234 - DNA, 22 bp, Homo sapiens
aagctttatgacttggagacag

SEQ ID NO: 7776235 - DNA, 22 bp, Homo sapiens
aagctttatgatctctcagcta

SEQ ID NO: 7776236 - DNA, 22 bp, Homo sapiens
aaggggcatgcttttgccagga

SEQ ID NO: 7776237 - DNA, 22 bp, Homo sapiens
aaggggcctcacagatgggctt

SEQ ID NO: 7776238 - DNA, 22 bp, Homo sapiens
aagtatgctaattaactagcac

SEQ ID NO: 7776239 - DNA, 22 bp, Homo sapiens
aagtacagaaatagcaggtgca

SEQ ID NO: 7776240 - DNA, 22 bp, Homo sapiens
aacaatgaggatctgttctgag

SEQ ID NO: 7776241 - DNA, 22 bp, Homo sapiens
aacaatcaagtttctaaatgac

SEQ ID NO: 7776242 - DNA, 22 bp, Homo sapiens
aacaatcaagtttctaaatgac

SEQ ID NO: 7776243 - DNA, 22 bp, Homo sapiens
aacaagatgggagaaggacctc

SEQ ID NO: 7776244 - DNA, 22 bp, Homo sapiens
aacaagatagatatcacttagg

SEQ ID NO: 7776245 - DNA, 22 bp, Homo sapiens
aacaagcagatgcaatgcactt

SEQ ID NO: 7776246 - DNA, 22 bp, Homo sapiens
aacaagcagatgcaatgcactt

SEQ ID NO: 7776247 - DNA, 22 bp, Homo sapiens
aacaagtgatatataatggaag

SEQ ID NO: 7776248 - DNA, 22 bp, Homo sapiens
aacaagtgtattaatggaaata

SEQ ID NO: 7776249 - DNA, 19 bp, Homo sapiens
aacaagtaggaatggaaga

SEQ ID NO: 7776250 - DNA, 22 bp, Homo sapiens
aacaagtaagtttatatatatt

SEQ ID NO: 7776251 - DNA, 22 bp, Homo sapiens
aacaataattgcggttctctat

SEQ ID NO: 7776252 - DNA, 22 bp, Homo sapiens
aacaagttgttgaaaataatta

SEQ ID NO: 7776253 - DNA, 22 bp, Homo sapiens
aacaataactagacatgccatg

SEQ ID NO: 7776254 - DNA, 22 bp, Homo sapiens
aacaagttagggtcttttactt

SEQ ID NO: 7776255 - DNA, 22 bp, Homo sapiens
aacaagttagattttgtgtctt

SEQ ID NO: 7776256 - DNA, 22 bp, Homo sapiens
aacaagttctaagtgtctactt

SEQ ID NO: 7776257 - DNA, 22 bp, Homo sapiens
aacaaatgtaaaatgcagatgc

SEQ ID NO: 7776258 - DNA, 22 bp, Homo sapiens
aaggccaaggctgcagtgagcc

SEQ ID NO: 7776259 - DNA, 22 bp, Homo sapiens
aaatttcagttacctttacgtt

SEQ ID NO: 7776260 - DNA, 22 bp, Homo sapiens
aaatttcagttggaatgagctc

SEQ ID NO: 7776261 - DNA, 22 bp, Homo sapiens
aaatttcaagcaaagtagctat

SEQ ID NO: 7776262 - DNA, 22 bp, Homo sapiens
aaatttcaagcaaagtagctat

SEQ ID NO: 7776263 - DNA, 22 bp, Homo sapiens
acacacagcgcctaccatgtgc

SEQ ID NO: 7776264 - DNA, 22 bp, Homo sapiens
acacacagcgcctaccatgtgc

SEQ ID NO: 7776265 - DNA, 22 bp, Homo sapiens
acacacagcgcctaccatgtgc

SEQ ID NO: 7776266 - DNA, 22 bp, Homo sapiens
acacacagagtttatacaggca

SEQ ID NO: 7776267 - DNA, 22 bp, Homo sapiens
acacacaggtaaaggagcctgg

SEQ ID NO: 7776268 - DNA, 21 bp, Homo sapiens
aagaggtcaaattataaatgg

SEQ ID NO: 7776269 - DNA, 19 bp, Homo sapiens
aagagggaaagtgctatgc

SEQ ID NO: 7776270 - DNA, 22 bp, Homo sapiens
aagaggcataaaatttatatgg

SEQ ID NO: 7776271 - DNA, 22 bp, Homo sapiens
aagaggcataaaatttatatgg

SEQ ID NO: 7776272 - DNA, 22 bp, Homo sapiens
aagaggagtagatgtggttggt

SEQ ID NO: 7776273 - DNA, 22 bp, Homo sapiens
aagaggagggcagattcaaggc

SEQ ID NO: 7776274 - DNA, 22 bp, Homo sapiens
aagaggaagtctccatggagag

SEQ ID NO: 7776275 - DNA, 22 bp, Homo sapiens
aagaggaggattgatgtgggag

SEQ ID NO: 7776276 - DNA, 22 bp, Homo sapiens
aagacatttatttgaatcaatt

SEQ ID NO: 7776277 - DNA, 22 bp, Homo sapiens
aagagtttaattttgtctagac

SEQ ID NO: 7776278 - DNA, 22 bp, Homo sapiens
aagagtcactccataaatccca

SEQ ID NO: 7776279 - DNA, 22 bp, Homo sapiens
aagagtcagcttctgtatgggt

SEQ ID NO: 7776280 - DNA, 22 bp, Homo sapiens
aagaggttgtctgtgatgagtt

SEQ ID NO: 7776281 - DNA, 22 bp, Homo sapiens
acactacaatctcagaactata

SEQ ID NO: 7776282 - DNA, 22 bp, Homo sapiens
acactacagggccgggatggaa

SEQ ID NO: 7776283 - DNA, 22 bp, Homo sapiens
acactacagggagaagactcac

SEQ ID NO: 7776284 - DNA, 22 bp, Homo sapiens
acactagagagcaggcattccc

SEQ ID NO: 7776285 - DNA, 22 bp, Homo sapiens
acactagatgccaatagcaccc

SEQ ID NO: 7776286 - DNA, 22 bp, Homo sapiens
acactacaacagcagaggtgag

SEQ ID NO: 7776287 - DNA, 22 bp, Homo sapiens
acacggcactttaggaaggggc

SEQ ID NO: 7776288 - DNA, 22 bp, Homo sapiens
acacggcactttaggaaggggc

SEQ ID NO: 7776289 - DNA, 22 bp, Homo sapiens
acactaaatgagtctacagtac

SEQ ID NO: 7776290 - DNA, 22 bp, Homo sapiens
acactaatcttttatttggttt

SEQ ID NO: 7776291 - DNA, 22 bp, Homo sapiens
acacatttctcccagtctccat

SEQ ID NO: 7776292 - DNA, 22 bp, Homo sapiens
acacatttctctttttgtaagt

SEQ ID NO: 7776293 - DNA, 22 bp, Homo sapiens
acacatttctctttttgtaagt

SEQ ID NO: 7776294 - DNA, 22 bp, Homo sapiens
aagatacatcattcaggagtga

SEQ ID NO: 7776295 - DNA, 22 bp, Homo sapiens
aagatacattttcttcagagaa

SEQ ID NO: 7776296 - DNA, 22 bp, Homo sapiens
aagatatagataaaactatgca

SEQ ID NO: 7776297 - DNA, 22 bp, Homo sapiens
aagatatactattaagtaccat

SEQ ID NO: 7776298 - DNA, 19 bp, Homo sapiens
acagaaatgtaagtgagac

SEQ ID NO: 7776299 - DNA, 19 bp, Homo sapiens
acagaaatgtaagtgagac

SEQ ID NO: 7776300 - DNA, 19 bp, Homo sapiens
aagatttggtcattgataa

SEQ ID NO: 7776301 - DNA, 22 bp, Homo sapiens
acagaagcagcgcggctcttct

SEQ ID NO: 7776302 - DNA, 22 bp, Homo sapiens
acagaagcagccgtcacagata

SEQ ID NO: 7776303 - DNA, 22 bp, Homo sapiens
aagcacattatagctatctagg

SEQ ID NO: 7776304 - DNA, 20 bp, Homo sapiens
aagcacatttctacaataat

SEQ ID NO: 7776305 - DNA, 22 bp, Homo sapiens
acagaggaagcatatagcacaa

SEQ ID NO: 7776306 - DNA, 22 bp, Homo sapiens
acagagcttcccagcctgagca

SEQ ID NO: 7776307 - DNA, 22 bp, Homo sapiens
aagcaaaaggttacacttctgg

SEQ ID NO: 7776308 - DNA, 18 bp, Homo sapiens
acagaggcagacatgtat

SEQ ID NO: 7776309 - DNA, 22 bp, Homo sapiens
aagcacagttcttagagttaca

SEQ ID NO: 7776310 - DNA, 17 bp, Homo sapiens
acagaggcaggagtgga

SEQ ID NO: 7776311 - DNA, 22 bp, Homo sapiens
acagaggaaggctgagctgccc

SEQ ID NO: 7776312 - DNA, 22 bp, Homo sapiens
acagaggacaactaggcgctca

SEQ ID NO: 7776313 - DNA, 22 bp, Homo sapiens
aattacttaagagaaactttga

SEQ ID NO: 7776314 - DNA, 22 bp, Homo sapiens
aattacttaagagaaactttga

SEQ ID NO: 7776315 - DNA, 22 bp, Homo sapiens
aatgttattacacttgtgaaat

SEQ ID NO: 7776316 - DNA, 22 bp, Homo sapiens
aatgtgttttcactgaagattc

SEQ ID NO: 7776317 - DNA, 22 bp, Homo sapiens
aatgttaattcacagccaaata

SEQ ID NO: 7776318 - DNA, 22 bp, Homo sapiens
aatgttacataacccattgtcc

SEQ ID NO: 7776319 - DNA, 22 bp, Homo sapiens
aatgttacaggacaaagatgga

SEQ ID NO: 7776320 - DNA, 22 bp, Homo sapiens
aatgttacgatcaacaacacat

SEQ ID NO: 7776321 - DNA, 22 bp, Homo sapiens
aactctggttcagtgatttcag

SEQ ID NO: 7776322 - DNA, 20 bp, Homo sapiens
aactcctagcctcaagtgat

SEQ ID NO: 7776323 - DNA, 22 bp, Homo sapiens
aactctgtgtaggaaccaggtc

SEQ ID NO: 7776324 - DNA, 22 bp, Homo sapiens
aactgaaacggtgatcttttaa

SEQ ID NO: 7776325 - DNA, 22 bp, Homo sapiens
aatgtattctgggaaaatgtta

SEQ ID NO: 7776326 - DNA, 20 bp, Homo sapiens
aatgtattgttttgtttcag

SEQ ID NO: 7776327 - DNA, 22 bp, Homo sapiens
aatgtattttgggagtttcttt

SEQ ID NO: 7776328 - DNA, 22 bp, Homo sapiens
aatgtcaaaggctatacattca

SEQ ID NO: 7776329 - DNA, 22 bp, Homo sapiens
aatgtcaacacaagagaaatgc

SEQ ID NO: 7776330 - DNA, 22 bp, Homo sapiens
aatgtcaacacaagagaaatgc

SEQ ID NO: 7776331 - DNA, 22 bp, Homo sapiens
aatgtctttaaagtgcaataga

SEQ ID NO: 7776332 - DNA, 22 bp, Homo sapiens
aatgtcaagggaagcaggaaat

SEQ ID NO: 7776333 - DNA, 22 bp, Homo sapiens
aatgtcaatctcagagaacaca

SEQ ID NO: 7776334 - DNA, 22 bp, Homo sapiens
aattagaagctgttagcaaaat

SEQ ID NO: 7776335 - DNA, 22 bp, Homo sapiens
aattagaagctgttagcaaaat

SEQ ID NO: 7776336 - DNA, 20 bp, Homo sapiens
aattagatgtttaatcaata

SEQ ID NO: 7776337 - DNA, 20 bp, Homo sapiens
aattagatgtttaatcaata

SEQ ID NO: 7776338 - DNA, 22 bp, Homo sapiens
aattcaatctaagaaatgatca

SEQ ID NO: 7776339 - DNA, 22 bp, Homo sapiens
aattcaacagtcagttatctca

SEQ ID NO: 7776340 - DNA, 22 bp, Homo sapiens
aattcacaaaagttagatccat

SEQ ID NO: 7776341 - DNA, 22 bp, Homo sapiens
aattcacaaaaccagattgctt

SEQ ID NO: 7776342 - DNA, 22 bp, Homo sapiens
aattcacaaaaccagattgctt

SEQ ID NO: 7776343 - DNA, 22 bp, Homo sapiens
aagacaatcctggacagtcagc

SEQ ID NO: 7776344 - DNA, 22 bp, Homo sapiens
aagacaagccttgtttttctgc

SEQ ID NO: 7776345 - DNA, 22 bp, Homo sapiens
aagacaagcatcaaatcaggca

SEQ ID NO: 7776346 - DNA, 17 bp, Homo sapiens
aagacaagacaaatgca

SEQ ID NO: 7776347 - DNA, 17 bp, Homo sapiens
aagacaagacaaatgca

SEQ ID NO: 7776348 - DNA, 22 bp, Homo sapiens
aagaatttaaactaaccatatg

SEQ ID NO: 7776349 - DNA, 22 bp, Homo sapiens
acaacaaaatcactagtcttcc

SEQ ID NO: 7776350 - DNA, 22 bp, Homo sapiens
aagacaattttgagtatgcaca

SEQ ID NO: 7776351 - DNA, 22 bp, Homo sapiens
aagacaatgtttctgatagata

SEQ ID NO: 7776352 - DNA, 22 bp, Homo sapiens
aagacaatgcattactaagaag

SEQ ID NO: 7776353 - DNA, 22 bp, Homo sapiens
aagacaatgcattactaagaag

SEQ ID NO: 7776354 - DNA, 22 bp, Homo sapiens
aagacaatcctggacagtcagc

SEQ ID NO: 7776355 - DNA, 22 bp, Homo sapiens
acaagaaaggtaggattcaggt

SEQ ID NO: 7776356 - DNA, 22 bp, Homo sapiens
acaagaaaggtaggattcaggt

SEQ ID NO: 7776357 - DNA, 22 bp, Homo sapiens
acaagaaaggtaggattcaggt

SEQ ID NO: 7776358 - DNA, 22 bp, Homo sapiens
acaactttgtagcaattccacg

SEQ ID NO: 7776359 - DNA, 22 bp, Homo sapiens
aagacattcacaaatgttcact

SEQ ID NO: 7776360 - DNA, 22 bp, Homo sapiens
acaagaataaggataagagatt

SEQ ID NO: 7776361 - DNA, 22 bp, Homo sapiens
aagacattgctgcttttaattg

SEQ ID NO: 7776362 - DNA, 22 bp, Homo sapiens
aacaaatgtgttttgtaattaa

SEQ ID NO: 7776363 - DNA, 22 bp, Homo sapiens
aacaaattagttgcaagactgg

SEQ ID NO: 7776364 - DNA, 22 bp, Homo sapiens
aacaaatttagctctgagtgct

SEQ ID NO: 7776365 - DNA, 22 bp, Homo sapiens
aacaacaacggagaaagggttg

SEQ ID NO: 7776366 - DNA, 22 bp, Homo sapiens
aacaaccaaaaagatgaatgta

SEQ ID NO: 7776367 - DNA, 22 bp, Homo sapiens
aaagcacattacaagctcagtc

SEQ ID NO: 7776368 - DNA, 22 bp, Homo sapiens
aaagcaagtctctacaaagtac

SEQ ID NO: 7776369 - DNA, 22 bp, Homo sapiens
aaagcaatgggtctaaggtaaa

SEQ ID NO: 7776370 - DNA, 21 bp, Homo sapiens
aacacatccagagtatttgac

SEQ ID NO: 7776371 - DNA, 22 bp, Homo sapiens
aacacatatttatatatgcaca

SEQ ID NO: 7776372 - DNA, 22 bp, Homo sapiens
aacacatatttatatatgcaca

SEQ ID NO: 7776373 - DNA, 22 bp, Homo sapiens
aacacatgccttaagaataagt

SEQ ID NO: 7776374 - DNA, 22 bp, Homo sapiens
aacagctttgcttctggagaca

SEQ ID NO: 7776375 - DNA, 22 bp, Homo sapiens
aacaattatcatatacattgca

SEQ ID NO: 7776376 - DNA, 22 bp, Homo sapiens
aacacaaagaagctgcaggatc

SEQ ID NO: 7776377 - DNA, 22 bp, Homo sapiens
aacaagaacacctacagttcta

SEQ ID NO: 7776378 - DNA, 22 bp, Homo sapiens
aacaatgttcttttagcttgaa

SEQ ID NO: 7776379 - DNA, 22 bp, Homo sapiens
aacaattagactgacggtatta

SEQ ID NO: 7776380 - DNA, 22 bp, Homo sapiens
aacattcaagttctggtttatg

SEQ ID NO: 7776381 - DNA, 22 bp, Homo sapiens
aacatgcaatgtctgaaaatcc

SEQ ID NO: 7776382 - DNA, 22 bp, Homo sapiens
aacattaattacagtcaaacat

SEQ ID NO: 7776383 - DNA, 22 bp, Homo sapiens
aacattctcattgggatatgtg

SEQ ID NO: 7776384 - DNA, 22 bp, Homo sapiens
aacattctatgtgcattcagaa

SEQ ID NO: 7776385 - DNA, 22 bp, Homo sapiens
aacattctactgtactgcattg

SEQ ID NO: 7776386 - DNA, 22 bp, Homo sapiens
aacatttccggccttttgttct

SEQ ID NO: 7776387 - DNA, 22 bp, Homo sapiens
aacatttctgagaatatcagtt

SEQ ID NO: 7776388 - DNA, 22 bp, Homo sapiens
aacatttcataacttgactttt

SEQ ID NO: 7776389 - DNA, 22 bp, Homo sapiens
aacatttcattggaagctatgt

SEQ ID NO: 7776390 - DNA, 22 bp, Homo sapiens
aacagtgagaaggtggacagga

SEQ ID NO: 7776391 - DNA, 22 bp, Homo sapiens
aacagtctgggagttccttata

SEQ ID NO: 7776392 - DNA, 22 bp, Homo sapiens
aacagtcttggaagtcttgtta

SEQ ID NO: 7776393 - DNA, 22 bp, Homo sapiens
aacagtaatgtggtgttgggtt

SEQ ID NO: 7776394 - DNA, 22 bp, Homo sapiens
aacagtaatggcattgccatga

SEQ ID NO: 7776395 - DNA, 22 bp, Homo sapiens
aacagtagtatttaaactgaac

SEQ ID NO: 7776396 - DNA, 22 bp, Homo sapiens
aacagtaatttgcggtttttgc

SEQ ID NO: 7776397 - DNA, 20 bp, Homo sapiens
aactcagagatgaaaaagac

SEQ ID NO: 7776398 - DNA, 22 bp, Homo sapiens
aactcagatatgatagcaggag

SEQ ID NO: 7776399 - DNA, 22 bp, Homo sapiens
aactgcaaaaatggtagtctta

SEQ ID NO: 7776400 - DNA, 23 bp, Homo sapiens
aactgagataatgtatgtaaagc

SEQ ID NO: 7776401 - DNA, 22 bp, Homo sapiens
aactcaaagatgcatgacgctt

SEQ ID NO: 7776402 - DNA, 22 bp, Homo sapiens
aactatgttaataagtttcatt

SEQ ID NO: 7776403 - DNA, 22 bp, Homo sapiens
aactatgttaataagtttcatt

SEQ ID NO: 7776404 - DNA, 22 bp, Homo sapiens
aactattctgtggactcttata

SEQ ID NO: 7776405 - DNA, 22 bp, Homo sapiens
aactatactctgtaaatgtgct

SEQ ID NO: 7776406 - DNA, 22 bp, Homo sapiens
aacatttgcatgctttattaga

SEQ ID NO: 7776407 - DNA, 22 bp, Homo sapiens
aacatttcttctgaaactgagt

SEQ ID NO: 7776408 - DNA, 21 bp, Homo sapiens
aacatttggctggcttttgtg

SEQ ID NO: 7776409 - DNA, 22 bp, Homo sapiens
aacatttgtactaaagaagttc

SEQ ID NO: 7776410 - DNA, 23 bp, Homo sapiens
aacatttgtaaggtgattttgtt

SEQ ID NO: 7776411 - DNA, 22 bp, Homo sapiens
aacatttgtgtttgctaaaaat

SEQ ID NO: 7776412 - DNA, 22 bp, Homo sapiens
aagagcccttgttcataattat

SEQ ID NO: 7776413 - DNA, 22 bp, Homo sapiens
aagaatgttcttgtagtcatga

SEQ ID NO: 7776414 - DNA, 22 bp, Homo sapiens
aagacagagactctgcaacagg

SEQ ID NO: 7776415 - DNA, 22 bp, Homo sapiens
aagaagttaggtgtaacaatat

SEQ ID NO: 7776416 - DNA, 22 bp, Homo sapiens
aagcagaaaaactgagctccaa

SEQ ID NO: 7776417 - DNA, 22 bp, Homo sapiens
aagcagaactgggaagtagtgg

SEQ ID NO: 7776418 - DNA, 22 bp, Homo sapiens
aagcacttgcttagatgtggtt

SEQ ID NO: 7776419 - DNA, 22 bp, Homo sapiens
aagccacaatctgcatcagcat

SEQ ID NO: 7776420 - DNA, 22 bp, Homo sapiens
aagccacagatcgttctgtcac

SEQ ID NO: 7776421 - DNA, 22 bp, Homo sapiens
aagcaaagagtttagtgggtga

SEQ ID NO: 7776422 - DNA, 22 bp, Homo sapiens
aagcaaattggatgtctgtgag

SEQ ID NO: 7776423 - DNA, 22 bp, Homo sapiens
aagcaaatatttctagagactg

SEQ ID NO: 7776424 - DNA, 18 bp, Homo sapiens
aagaggaggagcaggttg

SEQ ID NO: 7776425 - DNA, 18 bp, Homo sapiens
aagaggaggagcaggttg

SEQ ID NO: 7776426 - DNA, 22 bp, Homo sapiens
aaatatcatttataacttttaa

SEQ ID NO: 7776427 - DNA, 22 bp, Homo sapiens
aaatatcatttataacttttaa

SEQ ID NO: 7776428 - DNA, 22 bp, Homo sapiens
aaatatcatttataacttttaa

SEQ ID NO: 7776429 - DNA, 22 bp, Homo sapiens
aaatatcttaggagtatatgag

SEQ ID NO: 7776430 - DNA, 22 bp, Homo sapiens
aagcacagctggaacagcagga

SEQ ID NO: 7776431 - DNA, 22 bp, Homo sapiens
aaagtgcagtccatgaaattaa

SEQ ID NO: 7776432 - DNA, 23 bp, Homo sapiens
aaagtgcagttgaggaatcatag

SEQ ID NO: 7776433 - DNA, 23 bp, Homo sapiens
aaagtgcagttgaggaatcatag

SEQ ID NO: 7776434 - DNA, 22 bp, Homo sapiens
aaagtcatttagccttatctcc

SEQ ID NO: 7776435 - DNA, 22 bp, Homo sapiens
aaagtgcattgtttgtgttcct

SEQ ID NO: 7776436 - DNA, 22 bp, Homo sapiens
aaagtgcatagagtagtgccta

SEQ ID NO: 7776437 - DNA, 22 bp, Homo sapiens
aaagtgcattcgaaagtccatc

SEQ ID NO: 7776438 - DNA, 22 bp, Homo sapiens
aaagtgcatcaaatgacttccc

SEQ ID NO: 7776439 - DNA, 22 bp, Homo sapiens
aaacatagataatagatagatg

SEQ ID NO: 7776440 - DNA, 22 bp, Homo sapiens
aaacatagataatagatagatg

SEQ ID NO: 7776441 - DNA, 22 bp, Homo sapiens
aaacatctactgtaggctggag

SEQ ID NO: 7776442 - DNA, 22 bp, Homo sapiens
aaacatctactgtaggctggag

SEQ ID NO: 7776443 - DNA, 22 bp, Homo sapiens
aaacagttttctcatttagtgt

SEQ ID NO: 7776444 - DNA, 22 bp, Homo sapiens
aaacagttttctcatttagtgt

SEQ ID NO: 7776445 - DNA, 22 bp, Homo sapiens
aaagcaatgcccgttcattatc

SEQ ID NO: 7776446 - DNA, 22 bp, Homo sapiens
aaagcaatgcccgttcattatc

SEQ ID NO: 7776447 - DNA, 22 bp, Homo sapiens
aaaggcccacagtcagtctacc

SEQ ID NO: 7776448 - DNA, 22 bp, Homo sapiens
aaaggccaggttggctggtatt

SEQ ID NO: 7776449 - DNA, 22 bp, Homo sapiens
aaaggccaccaacatgaagcat

SEQ ID NO: 7776450 - DNA, 22 bp, Homo sapiens
aaaggaggaatggagagatgct

SEQ ID NO: 7776451 - DNA, 22 bp, Homo sapiens
aaagcaatggatgagaatctgt

SEQ ID NO: 7776452 - DNA, 22 bp, Homo sapiens
aaagcaatggatgagaatctgt

SEQ ID NO: 7776453 - DNA, 22 bp, Homo sapiens
aaaggcatgtggtcaaggctca

SEQ ID NO: 7776454 - DNA, 22 bp, Homo sapiens
aaaggcatgtgggctggttgta

SEQ ID NO: 7776455 - DNA, 22 bp, Homo sapiens
aaaggccaataaagacaagctg

SEQ ID NO: 7776456 - DNA, 22 bp, Homo sapiens
aaaggccaataaagacaagctg

SEQ ID NO: 7776457 - DNA, 22 bp, Homo sapiens
aaatagaattaactagctactg

SEQ ID NO: 7776458 - DNA, 22 bp, Homo sapiens
aaatagaattaactagctactg

SEQ ID NO: 7776459 - DNA, 22 bp, Homo sapiens
aaatagaattggaagcagagtt

SEQ ID NO: 7776460 - DNA, 22 bp, Homo sapiens
aaatagaattggaagcagagtt

SEQ ID NO: 7776461 - DNA, 22 bp, Homo sapiens
aaatactgttgaatgaagtaag

SEQ ID NO: 7776462 - DNA, 22 bp, Homo sapiens
aaatactgtccaccatggagca

SEQ ID NO: 7776463 - DNA, 22 bp, Homo sapiens
aaactactatgggaatgtactt

SEQ ID NO: 7776464 - DNA, 22 bp, Homo sapiens
aaactacactttgggaccagca

SEQ ID NO: 7776465 - DNA, 22 bp, Homo sapiens
aaactactggattagtaactta

SEQ ID NO: 7776466 - DNA, 22 bp, Homo sapiens
aaactactgatttgtgaattga

SEQ ID NO: 7776467 - DNA, 22 bp, Homo sapiens
aaactaaggtgctgtggactga

SEQ ID NO: 7776468 - DNA, 19 bp, Homo sapiens
aaactaaggggaaatgttt

SEQ ID NO: 7776469 - DNA, 23 bp, Homo sapiens
aaactacaacgccaggcactgag

SEQ ID NO: 7776470 - DNA, 22 bp, Homo sapiens
aaatgcagctgggcatgagagg

SEQ ID NO: 7776471 - DNA, 20 bp, Homo sapiens
aaatgccagtgattctgctt

SEQ ID NO: 7776472 - DNA, 23 bp, Homo sapiens
aaatggccaaaaccaggtggtta

SEQ ID NO: 7776473 - DNA, 22 bp, Homo sapiens
aaatgctgagtgtttagagatc

SEQ ID NO: 7776474 - DNA, 22 bp, Homo sapiens
aaatatgttttccagttgtcat

SEQ ID NO: 7776475 - DNA, 22 bp, Homo sapiens
aaatcatgtgcagagatcagga

SEQ ID NO: 7776476 - DNA, 22 bp, Homo sapiens
aaatcatggtggaagaaacaga

SEQ ID NO: 7776477 - DNA, 22 bp, Homo sapiens
aaatcatgttggcacaataaaa

SEQ ID NO: 7776478 - DNA, 22 bp, Homo sapiens
aaatcatggtggaagaaacaga

SEQ ID NO: 7776479 - DNA, 21 bp, Homo sapiens
aaatccaaacactagtccaca

SEQ ID NO: 7776480 - DNA, 22 bp, Homo sapiens
aaagaagacagacatttctttc

SEQ ID NO: 7776481 - DNA, 22 bp, Homo sapiens
aaagaagagctggaaggagtct

SEQ ID NO: 7776482 - DNA, 22 bp, Homo sapiens
aaagaagatggagacctgacta

SEQ ID NO: 7776483 - DNA, 22 bp, Homo sapiens
aaagaacttatcctagaatttg

SEQ ID NO: 7776484 - DNA, 22 bp, Homo sapiens
aaagaactacctgtatgatatt

SEQ ID NO: 7776485 - DNA, 22 bp, Homo sapiens
aaactttaagacagtcctcaag

SEQ ID NO: 7776486 - DNA, 22 bp, Homo sapiens
aaacttgtgagctaaataaatg

SEQ ID NO: 7776487 - DNA, 20 bp, Homo sapiens
aaacttgatggcatagaata

SEQ ID NO: 7776488 - DNA, 23 bp, Homo sapiens
aaacttgctatggctgaaatcat

SEQ ID NO: 7776489 - DNA, 22 bp, Homo sapiens
aaacttcttgctgcattttctg

SEQ ID NO: 7776490 - DNA, 22 bp, Homo sapiens
aaacttgacagtgagacagttt

SEQ ID NO: 7776491 - DNA, 22 bp, Homo sapiens
aaacttgacagtagacagatta

SEQ ID NO: 7776492 - DNA, 19 bp, Homo sapiens
aaacacagatttcttacca

SEQ ID NO: 7776493 - DNA, 22 bp, Homo sapiens
aaacacagatttctttgtccca

SEQ ID NO: 7776494 - DNA, 20 bp, Homo sapiens
aaacacagcctctctttaca

SEQ ID NO: 7776495 - DNA, 22 bp, Homo sapiens
aaacatgaatagatattaaaca

SEQ ID NO: 7776496 - DNA, 22 bp, Homo sapiens
aaacatctttctattgcaagtt

SEQ ID NO: 7776497 - DNA, 22 bp, Homo sapiens
aaacatcttgctctgattggta

SEQ ID NO: 7776498 - DNA, 22 bp, Homo sapiens
aaacatgaatagatattaaaca

SEQ ID NO: 7776499 - DNA, 22 bp, Homo sapiens
aaaccacttatatcgtgatttg

SEQ ID NO: 7776500 - DNA, 22 bp, Homo sapiens
aaaccactcctgattcacttca

SEQ ID NO: 7776501 - DNA, 22 bp, Homo sapiens
aaaccagtgatagactagacac

SEQ ID NO: 7776502 - DNA, 22 bp, Homo sapiens
aaaccattaggttttatctact

SEQ ID NO: 7776503 - DNA, 22 bp, Homo sapiens
aaacatgagttaaaagtaactg

SEQ ID NO: 7776504 - DNA, 22 bp, Homo sapiens
aaaaatgaattcttcagtggca

SEQ ID NO: 7776505 - DNA, 22 bp, Homo sapiens
aaaaagactagtcgagtgcagt

SEQ ID NO: 7776506 - DNA, 22 bp, Homo sapiens
aaaaagacagaggatgaggcag

SEQ ID NO: 7776507 - DNA, 22 bp, Homo sapiens
aaaaagagaaatgctctagtcc

SEQ ID NO: 7776508 - DNA, 22 bp, Homo sapiens
aaaaagacttccaactcaggag

SEQ ID NO: 7776509 - DNA, 19 bp, Homo sapiens
aaaaacttagtccagaaag

SEQ ID NO: 7776510 - DNA, 19 bp, Homo sapiens
aaaaacttagtccagaaag

SEQ ID NO: 7776511 - DNA, 20 bp, Homo sapiens
aaaaagacaaaacgagttgg

SEQ ID NO: 7776512 - DNA, 22 bp, Homo sapiens
aaaaatgcttggacttaataaa

SEQ ID NO: 7776513 - DNA, 22 bp, Homo sapiens
aaaaatgtcattatggaactga

SEQ ID NO: 7776514 - DNA, 22 bp, Homo sapiens
aaaagtattttggatctcagat

SEQ ID NO: 7776515 - DNA, 22 bp, Homo sapiens
aaaagtattttgagcactttat

SEQ ID NO: 7776516 - DNA, 22 bp, Homo sapiens
aaaagtattttggatctcagat

SEQ ID NO: 7776517 - DNA, 22 bp, Homo sapiens
aaaagtctacaagcttcaacaa

SEQ ID NO: 7776518 - DNA, 19 bp, Homo sapiens
aaaagtctattcaattaca

SEQ ID NO: 7776519 - DNA, 22 bp, Homo sapiens
aaaagtctctctgagtaaaagt

SEQ ID NO: 7776520 - DNA, 22 bp, Homo sapiens
aaaagtctgctctcatttcaga

SEQ ID NO: 7776521 - DNA, 22 bp, Homo sapiens
aaaagtctgctttctattatca

SEQ ID NO: 7776522 - DNA, 22 bp, Homo sapiens
aaacaaacataggtttgaaagt

SEQ ID NO: 7776523 - DNA, 22 bp, Homo sapiens
aaaattcattcctcagactgcc

SEQ ID NO: 7776524 - DNA, 22 bp, Homo sapiens
aaacaaatttcaagctgtgaca

SEQ ID NO: 7776525 - DNA, 22 bp, Homo sapiens
aaacacaatgtttctttgttct

SEQ ID NO: 7776526 - DNA, 22 bp, Homo sapiens
aaacacacagaaatgaatgagg

SEQ ID NO: 7776527 - DNA, 22 bp, Homo sapiens
aaacaacctaaagttactgatc

SEQ ID NO: 7776528 - DNA, 22 bp, Homo sapiens
aaacaactcggcaactgctttt

SEQ ID NO: 7776529 - DNA, 22 bp, Homo sapiens
aaacaactcggcaactgctttt

SEQ ID NO: 7776530 - DNA, 22 bp, Homo sapiens
aaacaagagcttacatggctgc

SEQ ID NO: 7776531 - DNA, 22 bp, Homo sapiens
aaacaactcggcaactgctttt

SEQ ID NO: 7776532 - DNA, 22 bp, Homo sapiens
aaaatagattctaggatgtctt

SEQ ID NO: 7776533 - DNA, 22 bp, Homo sapiens
aaaataggtacggattagaatg

SEQ ID NO: 7776534 - DNA, 22 bp, Homo sapiens
aaaatagctatggaatgtcact

SEQ ID NO: 7776535 - DNA, 22 bp, Homo sapiens
aaaatagcagggatgtgggaaa

SEQ ID NO: 7776536 - DNA, 22 bp, Homo sapiens
aaaatagcatgaaaggcctttg

SEQ ID NO: 7776537 - DNA, 22 bp, Homo sapiens
aaaatagcatattgctttcttt

SEQ ID NO: 7776538 - DNA, 22 bp, Homo sapiens
aattcacatgttgaagtcctaa

SEQ ID NO: 7776539 - DNA, 22 bp, Homo sapiens
aattcacatccgaccaggtcaa

SEQ ID NO: 7776540 - DNA, 22 bp, Homo sapiens
aattcacatatacattattcct

SEQ ID NO: 7776541 - DNA, 22 bp, Homo sapiens
aattcacatgcatgtctgtgca

SEQ ID NO: 7776542 - DNA, 22 bp, Homo sapiens
aattcacatatacattattcct

SEQ ID NO: 7776543 - DNA, 22 bp, Homo sapiens
aattcacagttctgcaccttac

SEQ ID NO: 7776544 - DNA, 22 bp, Homo sapiens
aattcacagttctgcaccttac

SEQ ID NO: 7776545 - DNA, 22 bp, Homo sapiens
aattcacagcatttgcccatct

SEQ ID NO: 7776546 - DNA, 22 bp, Homo sapiens
aattcacaggaggtatttgtcc

SEQ ID NO: 7776547 - DNA, 22 bp, Homo sapiens
aattcacaggaggtatttgtcc

SEQ ID NO: 7776548 - DNA, 22 bp, Homo sapiens
aattcacaggatcacaggagag

SEQ ID NO: 7776549 - DNA, 22 bp, Homo sapiens
aattcatactctatattgcttt

SEQ ID NO: 7776550 - DNA, 22 bp, Homo sapiens
aattcatactctatattgcttt

SEQ ID NO: 7776551 - DNA, 22 bp, Homo sapiens
agagcaggggcaatgtgttgca

SEQ ID NO: 7776552 - DNA, 22 bp, Homo sapiens
agagcaggcataaagctttgaa

SEQ ID NO: 7776553 - DNA, 22 bp, Homo sapiens
agaggcagtatacaatccgagc

SEQ ID NO: 7776554 - DNA, 23 bp, Homo sapiens
agaggccaacttcttgcccctcc

SEQ ID NO: 7776555 - DNA, 23 bp, Homo sapiens
agaggccaacttcttgcccctcc

SEQ ID NO: 7776556 - DNA, 22 bp, Homo sapiens
agaggccaagccagactgtgca

SEQ ID NO: 7776557 - DNA, 22 bp, Homo sapiens
agaggccaagccagactgtgca

SEQ ID NO: 7776558 - DNA, 22 bp, Homo sapiens
aatttatttcctgccagtacac

SEQ ID NO: 7776559 - DNA, 22 bp, Homo sapiens
aatttatttcctgccagtacac

SEQ ID NO: 7776560 - DNA, 22 bp, Homo sapiens
aatttattcccgtctctgggct

SEQ ID NO: 7776561 - DNA, 22 bp, Homo sapiens
agaggccaatagtaggtggcat

SEQ ID NO: 7776562 - DNA, 22 bp, Homo sapiens
agaggccaatagtaggtggcat

SEQ ID NO: 7776563 - DNA, 22 bp, Homo sapiens
agaggccaatagtaggtggcat

SEQ ID NO: 7776564 - DNA, 22 bp, Homo sapiens
aatttatctttagtaagcttct

SEQ ID NO: 7776565 - DNA, 22 bp, Homo sapiens
aatttattatatcctaggggaa

SEQ ID NO: 7776566 - DNA, 22 bp, Homo sapiens
aatttcaatgcactcatggttg

SEQ ID NO: 7776567 - DNA, 22 bp, Homo sapiens
agagggcataaaatagagcacg

SEQ ID NO: 7776568 - DNA, 20 bp, Homo sapiens
agaggctttcttgtagtcag

SEQ ID NO: 7776569 - DNA, 22 bp, Homo sapiens
agagggcatgcttggtggcctg

SEQ ID NO: 7776570 - DNA, 22 bp, Homo sapiens
agagggctgcctcagtcagcta

SEQ ID NO: 7776571 - DNA, 21 bp, Homo sapiens
aattttgaaggaagattaagg

SEQ ID NO: 7776572 - DNA, 22 bp, Homo sapiens
aattttgttcttggaaatcagg

SEQ ID NO: 7776573 - DNA, 22 bp, Homo sapiens
agagtacactgtacacacaatt

SEQ ID NO: 7776574 - DNA, 19 bp, Homo sapiens
agagtctgtgctcttccta

SEQ ID NO: 7776575 - DNA, 22 bp, Homo sapiens
acaaaaagctccattactgtcc

SEQ ID NO: 7776576 - DNA, 22 bp, Homo sapiens
acaaaaagctccattactgtcc

SEQ ID NO: 7776577 - DNA, 22 bp, Homo sapiens
agaggtggagctcttggcatca

SEQ ID NO: 7776578 - DNA, 22 bp, Homo sapiens
agaggtggccatgggcgctgga

SEQ ID NO: 7776579 - DNA, 22 bp, Homo sapiens
acaaaaaccgtggattcagcat

SEQ ID NO: 7776580 - DNA, 22 bp, Homo sapiens
acaaaaaccgtggattcagcat

SEQ ID NO: 7776581 - DNA, 22 bp, Homo sapiens
acaaaaaccgtggattcagcat

SEQ ID NO: 7776582 - DNA, 22 bp, Homo sapiens
acaaaaaccgtggattcagcat

SEQ ID NO: 7776583 - DNA, 22 bp, Homo sapiens
agatatgtttgtatatatttgt

SEQ ID NO: 7776584 - DNA, 22 bp, Homo sapiens
agatatgttactgcatcatggg

SEQ ID NO: 7776585 - DNA, 22 bp, Homo sapiens
agatatagttgttgagaagaac

SEQ ID NO: 7776586 - DNA, 21 bp, Homo sapiens
agattacaggtgtgatccacc

SEQ ID NO: 7776587 - DNA, 22 bp, Homo sapiens
agattaggtatggtttaagtag

SEQ ID NO: 7776588 - DNA, 20 bp, Homo sapiens
agattaggggctttcttctt

SEQ ID NO: 7776589 - DNA, 19 bp, Homo sapiens
agattattgcacattcatg

SEQ ID NO: 7776590 - DNA, 22 bp, Homo sapiens
agattatttccagactaatgaa

SEQ ID NO: 7776591 - DNA, 22 bp, Homo sapiens
agattatttaagacaggaacca

SEQ ID NO: 7776592 - DNA, 22 bp, Homo sapiens
agatctggttggagtcctgaca

SEQ ID NO: 7776593 - DNA, 22 bp, Homo sapiens
agatctggccctcagcttgatt

SEQ ID NO: 7776594 - DNA, 22 bp, Homo sapiens
agatctggaactgaggtttatt

SEQ ID NO: 7776595 - DNA, 22 bp, Homo sapiens
agactgaataggaaagagggaa

SEQ ID NO: 7776596 - DNA, 22 bp, Homo sapiens
agagaaactgatgtcctttgaa

SEQ ID NO: 7776597 - DNA, 22 bp, Homo sapiens
agactctggaggggctggtcct

SEQ ID NO: 7776598 - DNA, 20 bp, Homo sapiens
agagagcacaggcaggaaag

SEQ ID NO: 7776599 - DNA, 22 bp, Homo sapiens
agagatattatttaccaagtta

SEQ ID NO: 7776600 - DNA, 22 bp, Homo sapiens
agagatcaaagcttgccaagta

SEQ ID NO: 7776601 - DNA, 22 bp, Homo sapiens
aattcacacctccggtttttct

SEQ ID NO: 7776602 - DNA, 22 bp, Homo sapiens
aattcacagaaccatggtgctc

SEQ ID NO: 7776603 - DNA, 22 bp, Homo sapiens
agagagaggcagcagtgctcac

SEQ ID NO: 7776604 - DNA, 22 bp, Homo sapiens
agagagagggaaactgctaaac

SEQ ID NO: 7776605 - DNA, 22 bp, Homo sapiens
agaagttttgggaaatactgat

SEQ ID NO: 7776606 - DNA, 22 bp, Homo sapiens
agaataaaatagtctgaagatg

SEQ ID NO: 7776607 - DNA, 22 bp, Homo sapiens
agaataaatgctacctatcaca

SEQ ID NO: 7776608 - DNA, 22 bp, Homo sapiens
agaataatcactgaagttcaaa

SEQ ID NO: 7776609 - DNA, 19 bp, Homo sapiens
agaatcaggtcaggtgaca

SEQ ID NO: 7776610 - DNA, 22 bp, Homo sapiens
agaatcagtgagcagttgtgat

SEQ ID NO: 7776611 - DNA, 22 bp, Homo sapiens
aatggaatacctaggtggccca

SEQ ID NO: 7776612 - DNA, 19 bp, Homo sapiens
aatggacaggcaatagtct

SEQ ID NO: 7776613 - DNA, 22 bp, Homo sapiens
aatgctttgtctgctccagact

SEQ ID NO: 7776614 - DNA, 22 bp, Homo sapiens
aatgctttgactatatctataa

SEQ ID NO: 7776615 - DNA, 22 bp, Homo sapiens
aatgtacatctcagtgtagtac

SEQ ID NO: 7776616 - DNA, 22 bp, Homo sapiens
aatgtacagctgtctttcctcc

SEQ ID NO: 7776617 - DNA, 22 bp, Homo sapiens
aatgtacagctgctgctgaagg

SEQ ID NO: 7776618 - DNA, 22 bp, Homo sapiens
aatgtataaagtgttaataact

SEQ ID NO: 7776619 - DNA, 22 bp, Homo sapiens
aatgtataaagtgttaataact

SEQ ID NO: 7776620 - DNA, 22 bp, Homo sapiens
aatgtataaagtgttaataact

SEQ ID NO: 7776621 - DNA, 22 bp, Homo sapiens
agaatctaagtacacagacaga

SEQ ID NO: 7776622 - DNA, 22 bp, Homo sapiens
agaattgttctgtagcttggct

SEQ ID NO: 7776623 - DNA, 22 bp, Homo sapiens
agaatttcaaaaggaagccagc

SEQ ID NO: 7776624 - DNA, 23 bp, Homo sapiens
agaatttcaaagtccagcacatt

SEQ ID NO: 7776625 - DNA, 22 bp, Homo sapiens
agcccaggtctggcccagcctg

SEQ ID NO: 7776626 - DNA, 22 bp, Homo sapiens
agcccaggtctggcccagcctg

SEQ ID NO: 7776627 - DNA, 22 bp, Homo sapiens
agcccaggtctggcccagcctg

SEQ ID NO: 7776628 - DNA, 22 bp, Homo sapiens
agcccaggtctcaaagtacagg

SEQ ID NO: 7776629 - DNA, 22 bp, Homo sapiens
agcccaggtggagtgtgtgggg

SEQ ID NO: 7776630 - DNA, 22 bp, Homo sapiens
acagacatcatcaacatcttcc

SEQ ID NO: 7776631 - DNA, 22 bp, Homo sapiens
agcccagctttgaaccatatca

SEQ ID NO: 7776632 - DNA, 22 bp, Homo sapiens
agcccagggctaataggaacca

SEQ ID NO: 7776633 - DNA, 22 bp, Homo sapiens
agcccagggctaataggaacca

SEQ ID NO: 7776634 - DNA, 22 bp, Homo sapiens
agcccaggtccagttcactgca

SEQ ID NO: 7776635 - DNA, 22 bp, Homo sapiens
acagaactgggggcacagatag

SEQ ID NO: 7776636 - DNA, 21 bp, Homo sapiens
acagaactgtatagtgataaa

SEQ ID NO: 7776637 - DNA, 22 bp, Homo sapiens
acagaactgggggcacagatag

SEQ ID NO: 7776638 - DNA, 22 bp, Homo sapiens
acagaactgcagacagtgccaa

SEQ ID NO: 7776639 - DNA, 22 bp, Homo sapiens
acagaactgcaggaggaaaagc

SEQ ID NO: 7776640 - DNA, 22 bp, Homo sapiens
acagaactgggaaatgcacata

SEQ ID NO: 7776641 - DNA, 22 bp, Homo sapiens
agccaggctactccttgctgac

SEQ ID NO: 7776642 - DNA, 22 bp, Homo sapiens
agccaggcgggtctttgctcct

SEQ ID NO: 7776643 - DNA, 22 bp, Homo sapiens
agcatctggtcatgagtgagaa

SEQ ID NO: 7776644 - DNA, 22 bp, Homo sapiens
agcatctgcatattgggagacc

SEQ ID NO: 7776645 - DNA, 22 bp, Homo sapiens
agcattccacactgaagtctgc

SEQ ID NO: 7776646 - DNA, 22 bp, Homo sapiens
agcattccacactgaagtctgc

SEQ ID NO: 7776647 - DNA, 22 bp, Homo sapiens
agcctgtggatccctgcactgg

SEQ ID NO: 7776648 - DNA, 22 bp, Homo sapiens
agcctggcttaatcctcctttt

SEQ ID NO: 7776649 - DNA, 22 bp, Homo sapiens
agcctggcttaatcctcctttt

SEQ ID NO: 7776650 - DNA, 22 bp, Homo sapiens
agcctggctgtaacctcatggt

SEQ ID NO: 7776651 - DNA, 22 bp, Homo sapiens
agcctggctgtaacctcatggt

SEQ ID NO: 7776652 - DNA, 22 bp, Homo sapiens
agcctggctgggaagagcctct

SEQ ID NO: 7776653 - DNA, 22 bp, Homo sapiens
agcctggctgggaagagcctct

SEQ ID NO: 7776654 - DNA, 22 bp, Homo sapiens
agcctggctaaattctcccatg

SEQ ID NO: 7776655 - DNA, 22 bp, Homo sapiens
agctcaggctctgcagggacta

SEQ ID NO: 7776656 - DNA, 22 bp, Homo sapiens
agctcagggctccaggaccgct

SEQ ID NO: 7776657 - DNA, 22 bp, Homo sapiens
agctcaggccggagctacaggc

SEQ ID NO: 7776658 - DNA, 22 bp, Homo sapiens
agctcaagctacacacagagtc

SEQ ID NO: 7776659 - DNA, 22 bp, Homo sapiens
agccttagatttgggcaagaac

SEQ ID NO: 7776660 - DNA, 22 bp, Homo sapiens
agccctgggttagggtgggagc

SEQ ID NO: 7776661 - DNA, 21 bp, Homo sapiens
agcctggcccagggggaggct

SEQ ID NO: 7776662 - DNA, 21 bp, Homo sapiens
agcctggcccagggggaggct

SEQ ID NO: 7776663 - DNA, 22 bp, Homo sapiens
agcctggccctgctgaactctg

SEQ ID NO: 7776664 - DNA, 22 bp, Homo sapiens
agcctggcctgggcaggcacat

SEQ ID NO: 7776665 - DNA, 22 bp, Homo sapiens
agcctggcggtcgtcggtcagg

SEQ ID NO: 7776666 - DNA, 22 bp, Homo sapiens
agcctggccaggcctgcccagg

SEQ ID NO: 7776667 - DNA, 22 bp, Homo sapiens
acacacttcagatgtaatttgt

SEQ ID NO: 7776668 - DNA, 20 bp, Homo sapiens
acacactttgatcttgagcc

SEQ ID NO: 7776669 - DNA, 22 bp, Homo sapiens
acacactgtaaggactatcact

SEQ ID NO: 7776670 - DNA, 22 bp, Homo sapiens
agcagccaggaatctgcagagc

SEQ ID NO: 7776671 - DNA, 22 bp, Homo sapiens
agcagaaatgatggtatgggac

SEQ ID NO: 7776672 - DNA, 19 bp, Homo sapiens
agcagcagcaccagggatt

SEQ ID NO: 7776673 - DNA, 22 bp, Homo sapiens
agcagaaacagccagtctggac

SEQ ID NO: 7776674 - DNA, 22 bp, Homo sapiens
agcagaaagcttattttgactg

SEQ ID NO: 7776675 - DNA, 22 bp, Homo sapiens
agcagaaatagaagtcaatgat

SEQ ID NO: 7776676 - DNA, 22 bp, Homo sapiens
agcagaaaactttcatgctctg

SEQ ID NO: 7776677 - DNA, 22 bp, Homo sapiens
agcactttgtgcatttctgaag

SEQ ID NO: 7776678 - DNA, 22 bp, Homo sapiens
agcactttgggagataaagctg

SEQ ID NO: 7776679 - DNA, 22 bp, Homo sapiens
agcactttaagcaacagatcaa

SEQ ID NO: 7776680 - DNA, 22 bp, Homo sapiens
agcactttagaatttagagttg

SEQ ID NO: 7776681 - DNA, 22 bp, Homo sapiens
agcactttattcaggaactcca

SEQ ID NO: 7776682 - DNA, 22 bp, Homo sapiens
agcactttcctggcaaatgtgg

SEQ ID NO: 7776683 - DNA, 22 bp, Homo sapiens
acacacatgcctttcctaagta

SEQ ID NO: 7776684 - DNA, 22 bp, Homo sapiens
agatttcccactccatgtattg

SEQ ID NO: 7776685 - DNA, 22 bp, Homo sapiens
agatttcctcttttgtaaagtg

SEQ ID NO: 7776686 - DNA, 22 bp, Homo sapiens
agatttcctatggtaattatag

SEQ ID NO: 7776687 - DNA, 22 bp, Homo sapiens
agatttctgtcaccttctatgc

SEQ ID NO: 7776688 - DNA, 23 bp, Homo sapiens
agatttggaaagctgagtggcgt

SEQ ID NO: 7776689 - DNA, 22 bp, Homo sapiens
agcaggtgacagggctgtggtg

SEQ ID NO: 7776690 - DNA, 22 bp, Homo sapiens
agcaggcatagagtagcactca

SEQ ID NO: 7776691 - DNA, 22 bp, Homo sapiens
agcaggcagtgtagagccttca

SEQ ID NO: 7776692 - DNA, 19 bp, Homo sapiens
agcaggcaggtggcccagg

SEQ ID NO: 7776693 - DNA, 19 bp, Homo sapiens
agcaggcaggtggcccagg

SEQ ID NO: 7776694 - DNA, 23 bp, Homo sapiens
agcaggcatctgtggcacaaggc

SEQ ID NO: 7776695 - DNA, 23 bp, Homo sapiens
agcaggcatctgtggcacaaggc

SEQ ID NO: 7776696 - DNA, 22 bp, Homo sapiens
agcagggcctctggcactggtc

SEQ ID NO: 7776697 - DNA, 22 bp, Homo sapiens
agcagggcctctggcactggtc

SEQ ID NO: 7776698 - DNA, 22 bp, Homo sapiens
agcagggctgtgctccttccga

SEQ ID NO: 7776699 - DNA, 22 bp, Homo sapiens
agcagggcttctgtgcctgtgc

SEQ ID NO: 7776700 - DNA, 22 bp, Homo sapiens
agcagggctgtgtaggtaatga

SEQ ID NO: 7776701 - DNA, 22 bp, Homo sapiens
agcagggcttgccgcttgtcct

SEQ ID NO: 7776702 - DNA, 22 bp, Homo sapiens
agcagggctttgcagacttggg

SEQ ID NO: 7776703 - DNA, 22 bp, Homo sapiens
agcagcccaaacagactaagac

SEQ ID NO: 7776704 - DNA, 22 bp, Homo sapiens
agcagcccaaacagactaagac

SEQ ID NO: 7776705 - DNA, 22 bp, Homo sapiens
agcagccatccttagagaaaga

SEQ ID NO: 7776706 - DNA, 22 bp, Homo sapiens
agcagctctggcactgtagcat

SEQ ID NO: 7776707 - DNA, 22 bp, Homo sapiens
agcagctgagccccagctgtga

SEQ ID NO: 7776708 - DNA, 22 bp, Homo sapiens
agcaggagctgtgggaagatgg

SEQ ID NO: 7776709 - DNA, 22 bp, Homo sapiens
agcaggagctgtgggaagatgg

SEQ ID NO: 7776710 - DNA, 22 bp, Homo sapiens
agcaggaggagagcctggcggt

SEQ ID NO: 7776711 - DNA, 22 bp, Homo sapiens
agcaggcaggctgccagtgaat

SEQ ID NO: 7776712 - DNA, 22 bp, Homo sapiens
agcaggagggttttgtagagtc

SEQ ID NO: 7776713 - DNA, 22 bp, Homo sapiens
agcaggagggttttgtagagtc

SEQ ID NO: 7776714 - DNA, 22 bp, Homo sapiens
agcaggagtgtcccctggctgt

SEQ ID NO: 7776715 - DNA, 21 bp, Homo sapiens
agcaggaggcagtcacagctc

SEQ ID NO: 7776716 - DNA, 21 bp, Homo sapiens
agcaggaggcagtcacagctc

SEQ ID NO: 7776717 - DNA, 22 bp, Homo sapiens
agcaggagggttttgtagagtc

SEQ ID NO: 7776718 - DNA, 22 bp, Homo sapiens
actcatgatatgcctataagat

SEQ ID NO: 7776719 - DNA, 22 bp, Homo sapiens
actcagagatatggtggttgat

SEQ ID NO: 7776720 - DNA, 22 bp, Homo sapiens
aagtgcataagtatgattattt

SEQ ID NO: 7776721 - DNA, 22 bp, Homo sapiens
aagtggcagttcaggaagcaga

SEQ ID NO: 7776722 - DNA, 22 bp, Homo sapiens
aagtggcagaatagtggcagga

SEQ ID NO: 7776723 - DNA, 22 bp, Homo sapiens
aagtttgttttagtctaatgat

SEQ ID NO: 7776724 - DNA, 22 bp, Homo sapiens
aagttttaacaagtacttacta

SEQ ID NO: 7776725 - DNA, 22 bp, Homo sapiens
aagtttgtggttatacttgatt

SEQ ID NO: 7776726 - DNA, 22 bp, Homo sapiens
aagtttgtggtcatttattata

SEQ ID NO: 7776727 - DNA, 22 bp, Homo sapiens
aagtttgttcagggcttacatt

SEQ ID NO: 7776728 - DNA, 22 bp, Homo sapiens
aagtttgttcattcattcatcc

SEQ ID NO: 7776729 - DNA, 22 bp, Homo sapiens
aagtttgtctcatttgatcttc

SEQ ID NO: 7776730 - DNA, 22 bp, Homo sapiens
aagtttgtgaggttaatccctt

SEQ ID NO: 7776731 - DNA, 22 bp, Homo sapiens
aagtttgtcgaaattatcagca

SEQ ID NO: 7776732 - DNA, 22 bp, Homo sapiens
aagtttgtagctggatgtctgt

SEQ ID NO: 7776733 - DNA, 22 bp, Homo sapiens
aagtttgtcgaaattatcagca

SEQ ID NO: 7776734 - DNA, 21 bp, Homo sapiens
aagttttatgttgccatttgt

SEQ ID NO: 7776735 - DNA, 22 bp, Homo sapiens
aagttttattggctatagcact

SEQ ID NO: 7776736 - DNA, 22 bp, Homo sapiens
actgagaagctcgcagtgatgc

SEQ ID NO: 7776737 - DNA, 22 bp, Homo sapiens
aataaagccttattgattttac

SEQ ID NO: 7776738 - DNA, 22 bp, Homo sapiens
aataaaggcaccataaggcaaa

SEQ ID NO: 7776739 - DNA, 22 bp, Homo sapiens
aataaagtgtattctttgtcat

SEQ ID NO: 7776740 - DNA, 22 bp, Homo sapiens
aataaagtagcgtttaaggtgc

SEQ ID NO: 7776741 - DNA, 22 bp, Homo sapiens
aataaagaatggatgagatcgt

SEQ ID NO: 7776742 - DNA, 22 bp, Homo sapiens
aataaatgaacaaagcaggttg

SEQ ID NO: 7776743 - DNA, 22 bp, Homo sapiens
aataaatcaatcctattggtag

SEQ ID NO: 7776744 - DNA, 22 bp, Homo sapiens
aataaatgttaagattgtctca

SEQ ID NO: 7776745 - DNA, 22 bp, Homo sapiens
aataacagaaacttgagcatca

SEQ ID NO: 7776746 - DNA, 22 bp, Homo sapiens
aataacagagtcttcaagatag

SEQ ID NO: 7776747 - DNA, 22 bp, Homo sapiens
accttgttgtaggtacaaaaga

SEQ ID NO: 7776748 - DNA, 22 bp, Homo sapiens
accttgttgtaggtacaaaaga

SEQ ID NO: 7776749 - DNA, 22 bp, Homo sapiens
accttgtcttttatagaacaag

SEQ ID NO: 7776750 - DNA, 22 bp, Homo sapiens
aagtgacataccttacatatgt

SEQ ID NO: 7776751 - DNA, 22 bp, Homo sapiens
aagtgatgctacgactttgaca

SEQ ID NO: 7776752 - DNA, 22 bp, Homo sapiens
aagtgattcattgatgatgagg

SEQ ID NO: 7776753 - DNA, 22 bp, Homo sapiens
aagtgattctagtcatgattct

SEQ ID NO: 7776754 - DNA, 22 bp, Homo sapiens
aagtgatttagtcttataaagg

SEQ ID NO: 7776755 - DNA, 22 bp, Homo sapiens
aagtgattttcctacttgctaa

SEQ ID NO: 7776756 - DNA, 21 bp, Homo sapiens
aagtaaatcagagaaataacc

SEQ ID NO: 7776757 - DNA, 22 bp, Homo sapiens
aagtaaatgttggagctcaaat

SEQ ID NO: 7776758 - DNA, 22 bp, Homo sapiens
aagtaaatatctgtagtcttta

SEQ ID NO: 7776759 - DNA, 18 bp, Homo sapiens
aagtaacagaagagcaca

SEQ ID NO: 7776760 - DNA, 18 bp, Homo sapiens
acctggctgtgtgagctg

SEQ ID NO: 7776761 - DNA, 18 bp, Homo sapiens
acctgcctgttcttctct

SEQ ID NO: 7776762 - DNA, 18 bp, Homo sapiens
acctgcctgttcttctct

SEQ ID NO: 7776763 - DNA, 22 bp, Homo sapiens
acctgggatggggccaggttta

SEQ ID NO: 7776764 - DNA, 20 bp, Homo sapiens
acctggcttgggggaggagt

SEQ ID NO: 7776765 - DNA, 19 bp, Homo sapiens
accttctgggaaacattcc

SEQ ID NO: 7776766 - DNA, 23 bp, Homo sapiens
accttggacttcccagcttccag

SEQ ID NO: 7776767 - DNA, 22 bp, Homo sapiens
agaaaataatttcttggctggt

SEQ ID NO: 7776768 - DNA, 22 bp, Homo sapiens
aatattcatttgcagaagaagt

SEQ ID NO: 7776769 - DNA, 22 bp, Homo sapiens
aatattcatttgcagaagaagt

SEQ ID NO: 7776770 - DNA, 22 bp, Homo sapiens
aatattcatttgcagaagaagt

SEQ ID NO: 7776771 - DNA, 22 bp, Homo sapiens
agaaaatattcattgagaggct

SEQ ID NO: 7776772 - DNA, 22 bp, Homo sapiens
agaaaataatttcttggctggt

SEQ ID NO: 7776773 - DNA, 21 bp, Homo sapiens
agaaaatggcgttttagattt

SEQ ID NO: 7776774 - DNA, 22 bp, Homo sapiens
agaaaatattcattgagaggct

SEQ ID NO: 7776775 - DNA, 22 bp, Homo sapiens
agaaaatattcattgagaggct

SEQ ID NO: 7776776 - DNA, 21 bp, Homo sapiens
agaaaatggcgttttagattt

SEQ ID NO: 7776777 - DNA, 22 bp, Homo sapiens
agaaaatgtgaacttgtgaatt

SEQ ID NO: 7776778 - DNA, 20 bp, Homo sapiens
agaaaatgttttcagctgga

SEQ ID NO: 7776779 - DNA, 22 bp, Homo sapiens
agaaaattactccagagacaag

SEQ ID NO: 7776780 - DNA, 22 bp, Homo sapiens
aatattcaagttattctttctt

SEQ ID NO: 7776781 - DNA, 22 bp, Homo sapiens
aatattatcaaaagctttttca

SEQ ID NO: 7776782 - DNA, 22 bp, Homo sapiens
aatattaatagaaggggttcta

SEQ ID NO: 7776783 - DNA, 22 bp, Homo sapiens
aatatgttccacttaaagctgg

SEQ ID NO: 7776784 - DNA, 22 bp, Homo sapiens
aatatgttcaaaatagatcact

SEQ ID NO: 7776785 - DNA, 22 bp, Homo sapiens
aatatgttccacttaaagctgg

SEQ ID NO: 7776786 - DNA, 22 bp, Homo sapiens
aatatgcagcttatcttctagg

SEQ ID NO: 7776787 - DNA, 22 bp, Homo sapiens
aatatgcaaagcgtgttatctg

SEQ ID NO: 7776788 - DNA, 22 bp, Homo sapiens
agaaactatcctgagtagcaaa

SEQ ID NO: 7776789 - DNA, 22 bp, Homo sapiens
agaaactatcctgagtagcaaa

SEQ ID NO: 7776790 - DNA, 22 bp, Homo sapiens
agaaactacttggaggaaagat

SEQ ID NO: 7776791 - DNA, 22 bp, Homo sapiens
agaaactaagtcataactcttt

SEQ ID NO: 7776792 - DNA, 22 bp, Homo sapiens
agaaactaagtcataactcttt

SEQ ID NO: 7776793 - DNA, 22 bp, Homo sapiens
agaaacctcacagcaattctga

SEQ ID NO: 7776794 - DNA, 22 bp, Homo sapiens
agaaacctgggggttgtacata

SEQ ID NO: 7776795 - DNA, 22 bp, Homo sapiens
agaaactaaagccaagggctct

SEQ ID NO: 7776796 - DNA, 22 bp, Homo sapiens
agaaactaacctggtagggttc

SEQ ID NO: 7776797 - DNA, 22 bp, Homo sapiens
agaaactattatggtaaacaaa

SEQ ID NO: 7776798 - DNA, 22 bp, Homo sapiens
agaaactattatggtaaacaaa

SEQ ID NO: 7776799 - DNA, 22 bp, Homo sapiens
agaaactattatggtaaacaaa

SEQ ID NO: 7776800 - DNA, 22 bp, Homo sapiens
agaaactctaggtcaattgagg

SEQ ID NO: 7776801 - DNA, 22 bp, Homo sapiens
agaaactcatcctggagatgac

SEQ ID NO: 7776802 - DNA, 22 bp, Homo sapiens
aatctatatgcttttcacatac

SEQ ID NO: 7776803 - DNA, 22 bp, Homo sapiens
aatcttaaagaatattctacca

SEQ ID NO: 7776804 - DNA, 22 bp, Homo sapiens
aatcttaaagaatattctacca

SEQ ID NO: 7776805 - DNA, 22 bp, Homo sapiens
aatcttcactcattcagagttg

SEQ ID NO: 7776806 - DNA, 22 bp, Homo sapiens
aatcttaagctgaattctctcc

SEQ ID NO: 7776807 - DNA, 22 bp, Homo sapiens
aatctttaaggactcagtctct

SEQ ID NO: 7776808 - DNA, 22 bp, Homo sapiens
aatcttggttgcagtatatccg

SEQ ID NO: 7776809 - DNA, 22 bp, Homo sapiens
aatgaaaattggaccctagaac

SEQ ID NO: 7776810 - DNA, 22 bp, Homo sapiens
aatactttcctatataaggtgc

SEQ ID NO: 7776811 - DNA, 22 bp, Homo sapiens
aatacttttgaactgaaaggca

SEQ ID NO: 7776812 - DNA, 22 bp, Homo sapiens
aatagaaaggaggggctcttgt

SEQ ID NO: 7776813 - DNA, 22 bp, Homo sapiens
aatacttgaatttcatgtcagg

SEQ ID NO: 7776814 - DNA, 17 bp, Homo sapiens
aatacttccaactagtg

SEQ ID NO: 7776815 - DNA, 22 bp, Homo sapiens
actgtgctgctctccgcagccc

SEQ ID NO: 7776816 - DNA, 22 bp, Homo sapiens
aataacagtgccatgaaattga

SEQ ID NO: 7776817 - DNA, 22 bp, Homo sapiens
aataacagggttgatttgcaat

SEQ ID NO: 7776818 - DNA, 22 bp, Homo sapiens
aataacctttatttcaaagtgt

SEQ ID NO: 7776819 - DNA, 22 bp, Homo sapiens
actgtggataagtcagagatgt

SEQ ID NO: 7776820 - DNA, 22 bp, Homo sapiens
acttcccaacacttttgagatg

SEQ ID NO: 7776821 - DNA, 23 bp, Homo sapiens
acttccagttataggaactcttc

SEQ ID NO: 7776822 - DNA, 22 bp, Homo sapiens
acttcccacaccctgttttctc

SEQ ID NO: 7776823 - DNA, 22 bp, Homo sapiens
acttcccactgcagtgactgag

SEQ ID NO: 7776824 - DNA, 22 bp, Homo sapiens
acttcctagatacgagattgaa

SEQ ID NO: 7776825 - DNA, 22 bp, Homo sapiens
acttcccaggtggtgtggagtt

SEQ ID NO: 7776826 - DNA, 22 bp, Homo sapiens
acttcccatttctctgctttag

SEQ ID NO: 7776827 - DNA, 22 bp, Homo sapiens
aatatgagtttgcctttcctgc

SEQ ID NO: 7776828 - DNA, 22 bp, Homo sapiens
aatatgacatagaattgagatg

SEQ ID NO: 7776829 - DNA, 22 bp, Homo sapiens
acttagctgtgtgatttccatt

SEQ ID NO: 7776830 - DNA, 22 bp, Homo sapiens
acttataggccaagtagactgt

SEQ ID NO: 7776831 - DNA, 16 bp, Homo sapiens
acttccaggggagccc

SEQ ID NO: 7776832 - DNA, 22 bp, Homo sapiens
acttccagggtagaggggaaga

SEQ ID NO: 7776833 - DNA, 22 bp, Homo sapiens
acttattctgagattatgatca

SEQ ID NO: 7776834 - DNA, 22 bp, Homo sapiens
acttatttattcattcagctca

SEQ ID NO: 7776835 - DNA, 22 bp, Homo sapiens
acttatgtagtacctcttatgt

SEQ ID NO: 7776836 - DNA, 22 bp, Homo sapiens
acatacattgcctcattggtaa

SEQ ID NO: 7776837 - DNA, 22 bp, Homo sapiens
acataccatctcctggaaagct

SEQ ID NO: 7776838 - DNA, 22 bp, Homo sapiens
acataacatagttgacattttt

SEQ ID NO: 7776839 - DNA, 22 bp, Homo sapiens
acataacactcttctctagtga

SEQ ID NO: 7776840 - DNA, 22 bp, Homo sapiens
acataacactcttctctagtga

SEQ ID NO: 7776841 - DNA, 22 bp, Homo sapiens
acataagtgcacaataaatatt

SEQ ID NO: 7776842 - DNA, 22 bp, Homo sapiens
acatacttatgctaaaaatata

SEQ ID NO: 7776843 - DNA, 22 bp, Homo sapiens
acatacttatgtgtatatgtgt

SEQ ID NO: 7776844 - DNA, 22 bp, Homo sapiens
acatacttgaagcaagtgatca

SEQ ID NO: 7776845 - DNA, 22 bp, Homo sapiens
acatactttttaaaagattgct

SEQ ID NO: 7776846 - DNA, 23 bp, Homo sapiens
acatagaacagaatatatttgtg

SEQ ID NO: 7776847 - DNA, 21 bp, Homo sapiens
acatgggacctgcgaaaggaa

SEQ ID NO: 7776848 - DNA, 22 bp, Homo sapiens
acattacttaccttgggttcta

SEQ ID NO: 7776849 - DNA, 22 bp, Homo sapiens
acattctgaaaaacagtgtttt

SEQ ID NO: 7776850 - DNA, 22 bp, Homo sapiens
acattcaacatggctggtctag

SEQ ID NO: 7776851 - DNA, 22 bp, Homo sapiens
acattacctggcatttgatctt

SEQ ID NO: 7776852 - DNA, 21 bp, Homo sapiens
acattacagggtgatgtgtct

SEQ ID NO: 7776853 - DNA, 22 bp, Homo sapiens
aaggccagggatgccagctcgg

SEQ ID NO: 7776854 - DNA, 22 bp, Homo sapiens
aaggccaggcagggagctgtga

SEQ ID NO: 7776855 - DNA, 22 bp, Homo sapiens
aaggccagcttgtagggctggt

SEQ ID NO: 7776856 - DNA, 22 bp, Homo sapiens
aaggccagcttgtagggctggt

SEQ ID NO: 7776857 - DNA, 22 bp, Homo sapiens
acatgtaaaagataaattaaca

SEQ ID NO: 7776858 - DNA, 22 bp, Homo sapiens
acatgtaaaaattaaggtaaga

SEQ ID NO: 7776859 - DNA, 22 bp, Homo sapiens
aaggccagctggagggatgagg

SEQ ID NO: 7776860 - DNA, 22 bp, Homo sapiens
accacccccttgggtgtggaag

SEQ ID NO: 7776861 - DNA, 22 bp, Homo sapiens
accaccccagaatttttcaagg

SEQ ID NO: 7776862 - DNA, 22 bp, Homo sapiens
accacagtttcattcatgcagg

SEQ ID NO: 7776863 - DNA, 22 bp, Homo sapiens
accacagtatgaaatctgaaat

SEQ ID NO: 7776864 - DNA, 22 bp, Homo sapiens
accacaggggaggaatgatgcc

SEQ ID NO: 7776865 - DNA, 22 bp, Homo sapiens
acattctgtttccccaaagaga

SEQ ID NO: 7776866 - DNA, 22 bp, Homo sapiens
acattctgtgagtcatgtttta

SEQ ID NO: 7776867 - DNA, 22 bp, Homo sapiens
acattctgtcaacagtgagcag

SEQ ID NO: 7776868 - DNA, 22 bp, Homo sapiens
acattttgcccttatttgctga

SEQ ID NO: 7776869 - DNA, 22 bp, Homo sapiens
acattcttataagagtgaggca

SEQ ID NO: 7776870 - DNA, 22 bp, Homo sapiens
acattcttaacagttaaaaact

SEQ ID NO: 7776871 - DNA, 22 bp, Homo sapiens
accacaggacccatgagtcagt

SEQ ID NO: 7776872 - DNA, 20 bp, Homo sapiens
acattttggcatactctcaa

SEQ ID NO: 7776873 - DNA, 20 bp, Homo sapiens
acattttggcatactctcaa

SEQ ID NO: 7776874 - DNA, 22 bp, Homo sapiens
accacaggaggatggctgctgg

SEQ ID NO: 7776875 - DNA, 22 bp, Homo sapiens
accagcagagttgaggaggaca

SEQ ID NO: 7776876 - DNA, 22 bp, Homo sapiens
accagcacggattagaatgctt

SEQ ID NO: 7776877 - DNA, 22 bp, Homo sapiens
aagggcagcttaaattggtagc

SEQ ID NO: 7776878 - DNA, 22 bp, Homo sapiens
aagggcagcttaaattggtagc

SEQ ID NO: 7776879 - DNA, 22 bp, Homo sapiens
aagggcagcctgactcacggtc

SEQ ID NO: 7776880 - DNA, 22 bp, Homo sapiens
accactgcccatggtgaaaact

SEQ ID NO: 7776881 - DNA, 22 bp, Homo sapiens
aagggcagctattatcgtcatc

SEQ ID NO: 7776882 - DNA, 22 bp, Homo sapiens
aagggcagctgacagatgctta

SEQ ID NO: 7776883 - DNA, 22 bp, Homo sapiens
accagctgtgtgacctgaggca

SEQ ID NO: 7776884 - DNA, 22 bp, Homo sapiens
accagctgttaggcttggtgct

SEQ ID NO: 7776885 - DNA, 22 bp, Homo sapiens
accagctgtgtcctggctgcag

SEQ ID NO: 7776886 - DNA, 22 bp, Homo sapiens
accagctggtcacctgggcact

SEQ ID NO: 7776887 - DNA, 22 bp, Homo sapiens
accaggcaaaaccacaggagca

SEQ ID NO: 7776888 - DNA, 22 bp, Homo sapiens
accaggcaactgtgaatgggct

SEQ ID NO: 7776889 - DNA, 22 bp, Homo sapiens
accaggcagtatggtgctgcaa

SEQ ID NO: 7776890 - DNA, 22 bp, Homo sapiens
accaggcactcttgtggcagtg

SEQ ID NO: 7776891 - DNA, 22 bp, Homo sapiens
accaggcagagctgggccttaa

SEQ ID NO: 7776892 - DNA, 22 bp, Homo sapiens
aagtaaaagcaggtgtgctggg

SEQ ID NO: 7776893 - DNA, 22 bp, Homo sapiens
aagtaaaagctttaccatgcgc

SEQ ID NO: 7776894 - DNA, 22 bp, Homo sapiens
aagtaaaattcaatcttcactg

SEQ ID NO: 7776895 - DNA, 22 bp, Homo sapiens
accaggcatgatgtggagcaca

SEQ ID NO: 7776896 - DNA, 22 bp, Homo sapiens
aaggtttccagtgatattgtgg

SEQ ID NO: 7776897 - DNA, 22 bp, Homo sapiens
acaggtgacctgctcatatgaa

SEQ ID NO: 7776898 - DNA, 22 bp, Homo sapiens
acaggtaggttaaaatgtgtca

SEQ ID NO: 7776899 - DNA, 22 bp, Homo sapiens
acaggtagatacatacttctaa

SEQ ID NO: 7776900 - DNA, 22 bp, Homo sapiens
acaggtagcatttttcctcttt

SEQ ID NO: 7776901 - DNA, 22 bp, Homo sapiens
acaggcttttttagaatgacat

SEQ ID NO: 7776902 - DNA, 21 bp, Homo sapiens
acaggctttagaaaatgactc

SEQ ID NO: 7776903 - DNA, 22 bp, Homo sapiens
acaggcttctcacagaaaaggg

SEQ ID NO: 7776904 - DNA, 22 bp, Homo sapiens
acaggcttacaggctgcaagta

SEQ ID NO: 7776905 - DNA, 22 bp, Homo sapiens
acaggctgatagaccataaata

SEQ ID NO: 7776906 - DNA, 22 bp, Homo sapiens
acaggctgccacttgcatccaa

SEQ ID NO: 7776907 - DNA, 22 bp, Homo sapiens
acaggctgaggatgattgcatc

SEQ ID NO: 7776908 - DNA, 22 bp, Homo sapiens
acaggctgagcgtccatcttca

SEQ ID NO: 7776909 - DNA, 22 bp, Homo sapiens
acaggctgacttcctgccatgt

SEQ ID NO: 7776910 - DNA, 22 bp, Homo sapiens
acaggctgacttcctgccatgt

SEQ ID NO: 7776911 - DNA, 22 bp, Homo sapiens
acaggctgaaagttaagttctg

SEQ ID NO: 7776912 - DNA, 22 bp, Homo sapiens
acaggctctggggcaggatggc

SEQ ID NO: 7776913 - DNA, 22 bp, Homo sapiens
acagtgtcatgtcgtgttcccc

SEQ ID NO: 7776914 - DNA, 22 bp, Homo sapiens
acagtgtcatcagtttctcaac

SEQ ID NO: 7776915 - DNA, 22 bp, Homo sapiens
acagtgtccccagctctgtgag

SEQ ID NO: 7776916 - DNA, 22 bp, Homo sapiens
acagtgtccttgtggtccctgt

SEQ ID NO: 7776917 - DNA, 22 bp, Homo sapiens
acagtgtactaaatagtaagag

SEQ ID NO: 7776918 - DNA, 22 bp, Homo sapiens
acagtgtactaggtacatgttc

SEQ ID NO: 7776919 - DNA, 22 bp, Homo sapiens
acagtgtactcctttaccggag

SEQ ID NO: 7776920 - DNA, 22 bp, Homo sapiens
acagtgtagcatggtagcaatg

SEQ ID NO: 7776921 - DNA, 22 bp, Homo sapiens
acagtgtagaatcctgtactta

SEQ ID NO: 7776922 - DNA, 22 bp, Homo sapiens
acagtgtataaaatcttaaaga

SEQ ID NO: 7776923 - DNA, 22 bp, Homo sapiens
acagtgtatattgtttatctgg

SEQ ID NO: 7776924 - DNA, 22 bp, Homo sapiens
acagtgtatgatatttcacagt

SEQ ID NO: 7776925 - DNA, 22 bp, Homo sapiens
acagtgtaatatgggagtcagt

SEQ ID NO: 7776926 - DNA, 22 bp, Homo sapiens
acagtgtaatatgggagtcagt

SEQ ID NO: 7776927 - DNA, 20 bp, Homo sapiens
acagtgtaatattcacattc

SEQ ID NO: 7776928 - DNA, 22 bp, Homo sapiens
acagtggtaggataactgtttt

SEQ ID NO: 7776929 - DNA, 22 bp, Homo sapiens
acagtgctgtcaaatatgtttt

SEQ ID NO: 7776930 - DNA, 22 bp, Homo sapiens
acagtctttgcaggagaaagga

SEQ ID NO: 7776931 - DNA, 22 bp, Homo sapiens
acagtctttctacattctgtgc

SEQ ID NO: 7776932 - DNA, 22 bp, Homo sapiens
acagtgcgggctgcggtgggtc

SEQ ID NO: 7776933 - DNA, 22 bp, Homo sapiens
acaggtgtgagaacatgccttg

SEQ ID NO: 7776934 - DNA, 22 bp, Homo sapiens
acaggtgattcaggctctggga

SEQ ID NO: 7776935 - DNA, 22 bp, Homo sapiens
acagatgagactccaggacctt

SEQ ID NO: 7776936 - DNA, 22 bp, Homo sapiens
acaggaaattggcatatcagtt

SEQ ID NO: 7776937 - DNA, 22 bp, Homo sapiens
acagctttatctcagggatcag

SEQ ID NO: 7776938 - DNA, 22 bp, Homo sapiens
acagctttttactaatagattg

SEQ ID NO: 7776939 - DNA, 20 bp, Homo sapiens
acaggagatctgaggaaagg

SEQ ID NO: 7776940 - DNA, 22 bp, Homo sapiens
acaggagccaaacacatgccag

SEQ ID NO: 7776941 - DNA, 22 bp, Homo sapiens
acaggagcaacagactaagaca

SEQ ID NO: 7776942 - DNA, 22 bp, Homo sapiens
acaggagctctagggacagcac

SEQ ID NO: 7776943 - DNA, 22 bp, Homo sapiens
acaggcagagaactcagccaga

SEQ ID NO: 7776944 - DNA, 22 bp, Homo sapiens
acaggcagagaactcagccaga

SEQ ID NO: 7776945 - DNA, 22 bp, Homo sapiens
acaggcactttgacatgccatc

SEQ ID NO: 7776946 - DNA, 22 bp, Homo sapiens
acaggcacctgccaccacatct

SEQ ID NO: 7776947 - DNA, 22 bp, Homo sapiens
acaggcactgtcaagtcatgaa

SEQ ID NO: 7776948 - DNA, 22 bp, Homo sapiens
acaggcagagagtggcggactc

SEQ ID NO: 7776949 - DNA, 22 bp, Homo sapiens
acaggcagagagtggcggactc

SEQ ID NO: 7776950 - DNA, 22 bp, Homo sapiens
acaggcagagtcaggttgggtt

SEQ ID NO: 7776951 - DNA, 22 bp, Homo sapiens
aagccctgcagtctctgccaca

SEQ ID NO: 7776952 - DNA, 22 bp, Homo sapiens
tcacagctattctcatgtattt

SEQ ID NO: 7776953 - DNA, 22 bp, Homo sapiens
tcacagctattctcatgtattt

SEQ ID NO: 7776954 - DNA, 23 bp, Homo sapiens
tcacatatcaagaaagtggtaga

SEQ ID NO: 7776955 - DNA, 23 bp, Homo sapiens
tcacatatgtagaagtggaattc

SEQ ID NO: 7776956 - DNA, 23 bp, Homo sapiens
tcacatatgtagaagtggaattc

SEQ ID NO: 7776957 - DNA, 22 bp, Homo sapiens
tcacagcctggacagttgcctg

SEQ ID NO: 7776958 - DNA, 22 bp, Homo sapiens
tcacagcctggtcactctgccc

SEQ ID NO: 7776959 - DNA, 22 bp, Homo sapiens
tcacatatttaagaaagttaaa

SEQ ID NO: 7776960 - DNA, 22 bp, Homo sapiens
tcacatatttaagaaagttaaa

SEQ ID NO: 7776961 - DNA, 22 bp, Homo sapiens
tcacatatttaagaaagttaaa

SEQ ID NO: 7776962 - DNA, 22 bp, Homo sapiens
tcacatcactagctggtaatga

SEQ ID NO: 7776963 - DNA, 22 bp, Homo sapiens
tcacatcaggtgtctccccaag

SEQ ID NO: 7776964 - DNA, 22 bp, Homo sapiens
tcacatctaattccatttctgc

SEQ ID NO: 7776965 - DNA, 22 bp, Homo sapiens
tcacatctatacccaataattt

SEQ ID NO: 7776966 - DNA, 22 bp, Homo sapiens
tcacatcatggagaattatggg

SEQ ID NO: 7776967 - DNA, 18 bp, Homo sapiens
tcacatcatcccatgctt

SEQ ID NO: 7776968 - DNA, 22 bp, Homo sapiens
tcacatcattaagacttctcct

SEQ ID NO: 7776969 - DNA, 22 bp, Homo sapiens
tcacatctgaaaaaatattgag

SEQ ID NO: 7776970 - DNA, 23 bp, Homo sapiens
tcacatctgccgtagtgtattct

SEQ ID NO: 7776971 - DNA, 23 bp, Homo sapiens
tcacatctgccgtagtgtattct

SEQ ID NO: 7776972 - DNA, 22 bp, Homo sapiens
tcacacagggttctggtctcat

SEQ ID NO: 7776973 - DNA, 18 bp, Homo sapiens
tcacagaatattgagtgg

SEQ ID NO: 7776974 - DNA, 22 bp, Homo sapiens
tcacagaatctctgataagtct

SEQ ID NO: 7776975 - DNA, 23 bp, Homo sapiens
tcacagagcatactgcattttgc

SEQ ID NO: 7776976 - DNA, 22 bp, Homo sapiens
tcacagagctcacagtttagca

SEQ ID NO: 7776977 - DNA, 22 bp, Homo sapiens
tcacagagttaaaagtttcttt

SEQ ID NO: 7776978 - DNA, 22 bp, Homo sapiens
tcacagagcacacaagaattgc

SEQ ID NO: 7776979 - DNA, 22 bp, Homo sapiens
tcacagagaggttaagcagttg

SEQ ID NO: 7776980 - DNA, 22 bp, Homo sapiens
tcacagagaggttaagcagttg

SEQ ID NO: 7776981 - DNA, 22 bp, Homo sapiens
tcacagagagaatattgtgttt

SEQ ID NO: 7776982 - DNA, 22 bp, Homo sapiens
tcacagagaactataatccatc

SEQ ID NO: 7776983 - DNA, 22 bp, Homo sapiens
tcacaatttggatacagctatg

SEQ ID NO: 7776984 - DNA, 22 bp, Homo sapiens
tcacaattgtttttaggatcaa

SEQ ID NO: 7776985 - DNA, 22 bp, Homo sapiens
tcacacagctagtaagggccga

SEQ ID NO: 7776986 - DNA, 22 bp, Homo sapiens
tcaatgtcagctggtaggaaat

SEQ ID NO: 7776987 - DNA, 22 bp, Homo sapiens
tcaatgtaataaaatactctat

SEQ ID NO: 7776988 - DNA, 20 bp, Homo sapiens
tcaatgtaatcatatcatca

SEQ ID NO: 7776989 - DNA, 22 bp, Homo sapiens
tcaattaagaggctaagttact

SEQ ID NO: 7776990 - DNA, 22 bp, Homo sapiens
tcaattacagcaatgactgtac

SEQ ID NO: 7776991 - DNA, 22 bp, Homo sapiens
tcaattatgccattgcaatatt

SEQ ID NO: 7776992 - DNA, 22 bp, Homo sapiens
tcaattatgccattgcaatatt

SEQ ID NO: 7776993 - DNA, 22 bp, Homo sapiens
tcaattctagagccttacattg

SEQ ID NO: 7776994 - DNA, 22 bp, Homo sapiens
tcaattctggtcctcaggaact

SEQ ID NO: 7776995 - DNA, 22 bp, Homo sapiens
tcaattctgcctctaaatattt

SEQ ID NO: 7776996 - DNA, 22 bp, Homo sapiens
tcaattctgcctctaaatattt

SEQ ID NO: 7776997 - DNA, 22 bp, Homo sapiens
tcaattctgcatacatttcact

SEQ ID NO: 7776998 - DNA, 22 bp, Homo sapiens
tcaattctgcatacatttcact

SEQ ID NO: 7776999 - DNA, 22 bp, Homo sapiens
tcaattatttgatatgaaaggg

SEQ ID NO: 7777000 - DNA, 22 bp, Homo sapiens
tcaattattttggctatgctaa

SEQ ID NO: 7777001 - DNA, 22 bp, Homo sapiens
tcaaacatatctgattttccat

SEQ ID NO: 7777002 - DNA, 22 bp, Homo sapiens
tcaaacatgaaagcttgatttt

SEQ ID NO: 7777003 - DNA, 22 bp, Homo sapiens
tcaaacatgaaagcttgatttt

SEQ ID NO: 7777004 - DNA, 22 bp, Homo sapiens
tcaaacatatctgattttccat

SEQ ID NO: 7777005 - DNA, 22 bp, Homo sapiens
tcaaacagcaggtctttcatag

SEQ ID NO: 7777006 - DNA, 20 bp, Homo sapiens
tcaaaataggtgtgggcgga

SEQ ID NO: 7777007 - DNA, 20 bp, Homo sapiens
tcaaaataggtgtgggcgga

SEQ ID NO: 7777008 - DNA, 22 bp, Homo sapiens
tcaaaaatgttttatattggta

SEQ ID NO: 7777009 - DNA, 22 bp, Homo sapiens
tcaaaattctagggagaatggt

SEQ ID NO: 7777010 - DNA, 22 bp, Homo sapiens
tcaaacagaggaacaattgttt

SEQ ID NO: 7777011 - DNA, 18 bp, Homo sapiens
tcaaaatatttctgtgga

SEQ ID NO: 7777012 - DNA, 18 bp, Homo sapiens
tcaaaatatttctgtgga

SEQ ID NO: 7777013 - DNA, 20 bp, Homo sapiens
tcacctaaaccagcagtttc

SEQ ID NO: 7777014 - DNA, 22 bp, Homo sapiens
tcacctaattgaagtcaggagt

SEQ ID NO: 7777015 - DNA, 22 bp, Homo sapiens
tcaccttaacaatctgaccatc

SEQ ID NO: 7777016 - DNA, 22 bp, Homo sapiens
tcaccttagctagaggaagaga

SEQ ID NO: 7777017 - DNA, 22 bp, Homo sapiens
tcaccgaggctggagtgcagtg

SEQ ID NO: 7777018 - DNA, 22 bp, Homo sapiens
tcaccgaggctggagtgcagtg

SEQ ID NO: 7777019 - DNA, 22 bp, Homo sapiens
tcaccgaggctggagtgcagtg

SEQ ID NO: 7777020 - DNA, 22 bp, Homo sapiens
tcaccggcagacgtggcctgat

SEQ ID NO: 7777021 - DNA, 22 bp, Homo sapiens
tcacccctacatttcccttgct

SEQ ID NO: 7777022 - DNA, 22 bp, Homo sapiens
tcaccccttgtgaatgctgctc

SEQ ID NO: 7777023 - DNA, 22 bp, Homo sapiens
tcacccctggcccagtcttgga

SEQ ID NO: 7777024 - DNA, 22 bp, Homo sapiens
tcacccctaccaaggagcactg

SEQ ID NO: 7777025 - DNA, 22 bp, Homo sapiens
tcacccctccattctctcatgt

SEQ ID NO: 7777026 - DNA, 22 bp, Homo sapiens
tcacatgccttttactctgcac

SEQ ID NO: 7777027 - DNA, 18 bp, Homo sapiens
tcacatgacagctgttgc

SEQ ID NO: 7777028 - DNA, 22 bp, Homo sapiens
tcacatgaggttatgacaaagc

SEQ ID NO: 7777029 - DNA, 22 bp, Homo sapiens
tcacatctttaggcttacaggt

SEQ ID NO: 7777030 - DNA, 22 bp, Homo sapiens
tcacatcttgtgatgttttcat

SEQ ID NO: 7777031 - DNA, 22 bp, Homo sapiens
tcacatctgtgtgattgtcatt

SEQ ID NO: 7777032 - DNA, 20 bp, Homo sapiens
tcacatctggcagctgatga

SEQ ID NO: 7777033 - DNA, 22 bp, Homo sapiens
tcacatctgtgtgattgtcatt

SEQ ID NO: 7777034 - DNA, 22 bp, Homo sapiens
tcacatctgttgatacagcatc

SEQ ID NO: 7777035 - DNA, 22 bp, Homo sapiens
tcacatcttggattacaatttt

SEQ ID NO: 7777036 - DNA, 22 bp, Homo sapiens
tcactgggccctgaggtgggac

SEQ ID NO: 7777037 - DNA, 22 bp, Homo sapiens
tcactgggagatgtgggaaggg

SEQ ID NO: 7777038 - DNA, 22 bp, Homo sapiens
tcactggggccatgtgagggac

SEQ ID NO: 7777039 - DNA, 22 bp, Homo sapiens
tcactgctttgagccactgagc

SEQ ID NO: 7777040 - DNA, 23 bp, Homo sapiens
tcactaaagtgtttagtgcagat

SEQ ID NO: 7777041 - DNA, 22 bp, Homo sapiens
tcacgttttactgagtgagata

SEQ ID NO: 7777042 - DNA, 22 bp, Homo sapiens
tcactacaacctccgcctcctg

SEQ ID NO: 7777043 - DNA, 20 bp, Homo sapiens
tcactgtaacatttgggggg

SEQ ID NO: 7777044 - DNA, 22 bp, Homo sapiens
tcactgggtaggacatgctgat

SEQ ID NO: 7777045 - DNA, 22 bp, Homo sapiens
tcactgtgaatgttatcatctt

SEQ ID NO: 7777046 - DNA, 22 bp, Homo sapiens
tcactgtgaatgttatcatctt

SEQ ID NO: 7777047 - DNA, 21 bp, Homo sapiens
tcagaggcactgagagcaatg

SEQ ID NO: 7777048 - DNA, 22 bp, Homo sapiens
tcagaggcatcattcatagtta

SEQ ID NO: 7777049 - DNA, 22 bp, Homo sapiens
tcagaggcctgaaagaatttgg

SEQ ID NO: 7777050 - DNA, 22 bp, Homo sapiens
tcagaggctacagtctgggagt

SEQ ID NO: 7777051 - DNA, 22 bp, Homo sapiens
tcagaggacgcactagggttgt

SEQ ID NO: 7777052 - DNA, 19 bp, Homo sapiens
tcagaggatttggctatga

SEQ ID NO: 7777053 - DNA, 18 bp, Homo sapiens
tcagaggagatacctaaa

SEQ ID NO: 7777054 - DNA, 18 bp, Homo sapiens
tcagagagcagctttatt

SEQ ID NO: 7777055 - DNA, 22 bp, Homo sapiens
tcagaggaatttgcttttcatg

SEQ ID NO: 7777056 - DNA, 22 bp, Homo sapiens
tcagaagcaaacatcactctag

SEQ ID NO: 7777057 - DNA, 22 bp, Homo sapiens
tcagaacttaaagccgattggg

SEQ ID NO: 7777058 - DNA, 21 bp, Homo sapiens
tcagaactggtgcagatgaat

SEQ ID NO: 7777059 - DNA, 19 bp, Homo sapiens
tcagaactcagaatgtgta

SEQ ID NO: 7777060 - DNA, 22 bp, Homo sapiens
tcagaagcaggagtgtgcacaa

SEQ ID NO: 7777061 - DNA, 22 bp, Homo sapiens
tcagaagcatgtggggagcctg

SEQ ID NO: 7777062 - DNA, 22 bp, Homo sapiens
tcagaagcatgtggggagcctg

SEQ ID NO: 7777063 - DNA, 22 bp, Homo sapiens
tcagagaaggtaagtgacctgc

SEQ ID NO: 7777064 - DNA, 23 bp, Homo sapiens
tcagagaagttgtaggctgggga

SEQ ID NO: 7777065 - DNA, 22 bp, Homo sapiens
tcagagaatgtccttcttcatt

SEQ ID NO: 7777066 - DNA, 22 bp, Homo sapiens
tcagagaattctcagatgactc

SEQ ID NO: 7777067 - DNA, 22 bp, Homo sapiens
tcagagaattctcagatgactc

SEQ ID NO: 7777068 - DNA, 21 bp, Homo sapiens
tcagagaatggcctactctca

SEQ ID NO: 7777069 - DNA, 23 bp, Homo sapiens
tcagagaatggtatgcttttcct

SEQ ID NO: 7777070 - DNA, 22 bp, Homo sapiens
tcagagaatgtccttcttcatt

SEQ ID NO: 7777071 - DNA, 22 bp, Homo sapiens
tcagagaatccgtaagtcacaa

SEQ ID NO: 7777072 - DNA, 22 bp, Homo sapiens
tcaggagctcttccctggtgtg

SEQ ID NO: 7777073 - DNA, 22 bp, Homo sapiens
tcaggagctatggactgtcaaa

SEQ ID NO: 7777074 - DNA, 22 bp, Homo sapiens
tcaggagctcaggctgatggaa

SEQ ID NO: 7777075 - DNA, 22 bp, Homo sapiens
tcaggagctgtgaatacaaagg

SEQ ID NO: 7777076 - DNA, 22 bp, Homo sapiens
tcaggagcagctgtaggaaggg

SEQ ID NO: 7777077 - DNA, 22 bp, Homo sapiens
tcaggagcagggggaagctctg

SEQ ID NO: 7777078 - DNA, 22 bp, Homo sapiens
tcaggagcagggtctgttacca

SEQ ID NO: 7777079 - DNA, 20 bp, Homo sapiens
tcaggagcctaggacatgat

SEQ ID NO: 7777080 - DNA, 22 bp, Homo sapiens
tcaggaggatgtcggcaaattt

SEQ ID NO: 7777081 - DNA, 22 bp, Homo sapiens
tcaggagggtgacaggccctgg

SEQ ID NO: 7777082 - DNA, 22 bp, Homo sapiens
tcaggaaatggaattcttgtgt

SEQ ID NO: 7777083 - DNA, 22 bp, Homo sapiens
tcaggaaatggacatctttgct

SEQ ID NO: 7777084 - DNA, 22 bp, Homo sapiens
tcaggaaatggcttcatggttt

SEQ ID NO: 7777085 - DNA, 22 bp, Homo sapiens
tcaggagcaacatctttgaatc

SEQ ID NO: 7777086 - DNA, 22 bp, Homo sapiens
tcaggagcagcatgggtgagag

SEQ ID NO: 7777087 - DNA, 22 bp, Homo sapiens
tcaggagcagcatgggtgagag

SEQ ID NO: 7777088 - DNA, 22 bp, Homo sapiens
tcaggagcagccttggagagcg

SEQ ID NO: 7777089 - DNA, 22 bp, Homo sapiens
tcaggaaaggtttgttgaatgg

SEQ ID NO: 7777090 - DNA, 22 bp, Homo sapiens
tcaggaaatacaagtgacatca

SEQ ID NO: 7777091 - DNA, 22 bp, Homo sapiens
tcaggaaagtgttctcagagga

SEQ ID NO: 7777092 - DNA, 22 bp, Homo sapiens
tcaggaaagtgttctcagagga

SEQ ID NO: 7777093 - DNA, 22 bp, Homo sapiens
tcaggaaagagtgtatccatca

SEQ ID NO: 7777094 - DNA, 22 bp, Homo sapiens
tcaggcaggttggctgcaggtc

SEQ ID NO: 7777095 - DNA, 22 bp, Homo sapiens
tcaggcaggctcagaggaaaac

SEQ ID NO: 7777096 - DNA, 22 bp, Homo sapiens
tcaggcaggctcagaggaaaac

SEQ ID NO: 7777097 - DNA, 21 bp, Homo sapiens
tcaggcaggcgcagagggaag

SEQ ID NO: 7777098 - DNA, 22 bp, Homo sapiens
tcaggcaggctcagaggaaaac

SEQ ID NO: 7777099 - DNA, 21 bp, Homo sapiens
tcaggcaggcgcagagggaag

SEQ ID NO: 7777100 - DNA, 21 bp, Homo sapiens
tcaggcaggcgcagagggaag

SEQ ID NO: 7777101 - DNA, 22 bp, Homo sapiens
tcaggcaggcagagggcaaatg

SEQ ID NO: 7777102 - DNA, 22 bp, Homo sapiens
tcaggcaggaagggaggacttg

SEQ ID NO: 7777103 - DNA, 22 bp, Homo sapiens
tcaggcaggatcccagggaagg

SEQ ID NO: 7777104 - DNA, 22 bp, Homo sapiens
tcaggaggtccgcccgggaggg

SEQ ID NO: 7777105 - DNA, 22 bp, Homo sapiens
tcaggaggtaggacatactggt

SEQ ID NO: 7777106 - DNA, 19 bp, Homo sapiens
tcaggaggtcgacctggca

SEQ ID NO: 7777107 - DNA, 22 bp, Homo sapiens
tcaggcaaggctggtctcatac

SEQ ID NO: 7777108 - DNA, 22 bp, Homo sapiens
tcaggcaccccttgagtagggg

SEQ ID NO: 7777109 - DNA, 22 bp, Homo sapiens
tcaggcaccctctattttcatc

SEQ ID NO: 7777110 - DNA, 22 bp, Homo sapiens
tcaggcagatgcagggatggat

SEQ ID NO: 7777111 - DNA, 22 bp, Homo sapiens
tcaggcactggctgagtgatgg

SEQ ID NO: 7777112 - DNA, 22 bp, Homo sapiens
tcaggcagatgcagggatggat

SEQ ID NO: 7777113 - DNA, 22 bp, Homo sapiens
tcaggcagctccaggaatggta

SEQ ID NO: 7777114 - DNA, 22 bp, Homo sapiens
tcaggcagctccaggaatggta

SEQ ID NO: 7777115 - DNA, 22 bp, Homo sapiens
tcagagtcattgcaagtagaag

SEQ ID NO: 7777116 - DNA, 22 bp, Homo sapiens
tcagagtccatggtacttaatt

SEQ ID NO: 7777117 - DNA, 22 bp, Homo sapiens
tcagagtcattgcaagtagaag

SEQ ID NO: 7777118 - DNA, 22 bp, Homo sapiens
tcagagtgaccttacatggtct

SEQ ID NO: 7777119 - DNA, 22 bp, Homo sapiens
tcagagtcttggcaataggtta

SEQ ID NO: 7777120 - DNA, 22 bp, Homo sapiens
tcagagtcttaactattcagag

SEQ ID NO: 7777121 - DNA, 21 bp, Homo sapiens
tcagaggctgggggaatgccc

SEQ ID NO: 7777122 - DNA, 20 bp, Homo sapiens
tcagaggctgccagctgggg

SEQ ID NO: 7777123 - DNA, 22 bp, Homo sapiens
tcagaggcttccttcctcggag

SEQ ID NO: 7777124 - DNA, 22 bp, Homo sapiens
tcagaggcttctggccagtctg

SEQ ID NO: 7777125 - DNA, 22 bp, Homo sapiens
tcagaggcttgaagcccaagcc

SEQ ID NO: 7777126 - DNA, 20 bp, Homo sapiens
tcagccattccttacctttc

SEQ ID NO: 7777127 - DNA, 22 bp, Homo sapiens
tcagcctcattttctgctctgt

SEQ ID NO: 7777128 - DNA, 22 bp, Homo sapiens
tcagcctccgaaagtgctggga

SEQ ID NO: 7777129 - DNA, 22 bp, Homo sapiens
tcagctgtatcagaaatacaat

SEQ ID NO: 7777130 - DNA, 22 bp, Homo sapiens
tcagcttatatttttagtgtaa

SEQ ID NO: 7777131 - DNA, 22 bp, Homo sapiens
tcagcttggacagcttggttga

SEQ ID NO: 7777132 - DNA, 22 bp, Homo sapiens
tcaggtcccactgctagtaagt

SEQ ID NO: 7777133 - DNA, 22 bp, Homo sapiens
tcagtgcattaataatatcagt

SEQ ID NO: 7777134 - DNA, 22 bp, Homo sapiens
tcagtgcatggacagatttaga

SEQ ID NO: 7777135 - DNA, 22 bp, Homo sapiens
tcagggttctttcagttaagtt

SEQ ID NO: 7777136 - DNA, 22 bp, Homo sapiens
tcagggttgtgaaggaaagggg

SEQ ID NO: 7777137 - DNA, 22 bp, Homo sapiens
tcagggtttcggctcaacagaa

SEQ ID NO: 7777138 - DNA, 22 bp, Homo sapiens
tcagggctgtggttccttttct

SEQ ID NO: 7777139 - DNA, 22 bp, Homo sapiens
tcagggcagcctaaggcacctc

SEQ ID NO: 7777140 - DNA, 22 bp, Homo sapiens
tcagggcagaatccaaagaatt

SEQ ID NO: 7777141 - DNA, 22 bp, Homo sapiens
tcaggggaggttgaatcgtctc

SEQ ID NO: 7777142 - DNA, 22 bp, Homo sapiens
tcaggggcagccggggaagcca

SEQ ID NO: 7777143 - DNA, 22 bp, Homo sapiens
tcaggggacagccagctggagg

SEQ ID NO: 7777144 - DNA, 22 bp, Homo sapiens
tcaggggacttaggagagaagt

SEQ ID NO: 7777145 - DNA, 22 bp, Homo sapiens
tcaggggaaatctctcagcgaa

SEQ ID NO: 7777146 - DNA, 22 bp, Homo sapiens
tcaggggcttgaggtgcatgtc

SEQ ID NO: 7777147 - DNA, 22 bp, Homo sapiens
tcaggctcaggttaggggccaa

SEQ ID NO: 7777148 - DNA, 22 bp, Homo sapiens
tcaggctccctgctgggctctg

SEQ ID NO: 7777149 - DNA, 22 bp, Homo sapiens
tcaggctctcagaccaacagca

SEQ ID NO: 7777150 - DNA, 22 bp, Homo sapiens
tcaggctctacacttgacacac

SEQ ID NO: 7777151 - DNA, 22 bp, Homo sapiens
tcaggctgaaggaggcctatct

SEQ ID NO: 7777152 - DNA, 22 bp, Homo sapiens
tcaggctgaatcatcctagctt

SEQ ID NO: 7777153 - DNA, 22 bp, Homo sapiens
tcaggctgaaaggactccagtt

SEQ ID NO: 7777154 - DNA, 22 bp, Homo sapiens
tcagggcaagtctcagaaggtt

SEQ ID NO: 7777155 - DNA, 22 bp, Homo sapiens
tcagggcaaagggcagagtttg

SEQ ID NO: 7777156 - DNA, 22 bp, Homo sapiens
tcaggctgaggtcatctgcatc

SEQ ID NO: 7777157 - DNA, 22 bp, Homo sapiens
tcaggctgaggtcatctgcatc

SEQ ID NO: 7777158 - DNA, 22 bp, Homo sapiens
tcaggctgaccaggttttgctc

SEQ ID NO: 7777159 - DNA, 22 bp, Homo sapiens
tcaggctgagaaaatctggacc

SEQ ID NO: 7777160 - DNA, 22 bp, Homo sapiens
tcaggctgagaaaatctggacc

SEQ ID NO: 7777161 - DNA, 22 bp, Homo sapiens
tcagggcaaaagggaaaccatt

SEQ ID NO: 7777162 - DNA, 22 bp, Homo sapiens
tcagggagaggtgagagcctgt

SEQ ID NO: 7777163 - DNA, 22 bp, Homo sapiens
tcagtgcttcctggaggaagcc

SEQ ID NO: 7777164 - DNA, 22 bp, Homo sapiens
tcagttttgtatgttgtaagtc

SEQ ID NO: 7777165 - DNA, 22 bp, Homo sapiens
tcataaaaatagactctaaagt

SEQ ID NO: 7777166 - DNA, 22 bp, Homo sapiens
tcataaaaatagactctaaagt

SEQ ID NO: 7777167 - DNA, 22 bp, Homo sapiens
tcataaaacacaccaggtagtt

SEQ ID NO: 7777168 - DNA, 19 bp, Homo sapiens
tcataaaaatggtaaccca

SEQ ID NO: 7777169 - DNA, 22 bp, Homo sapiens
tcagttctaacagtttagaaca

SEQ ID NO: 7777170 - DNA, 22 bp, Homo sapiens
tcagttttaaggtttgagaatt

SEQ ID NO: 7777171 - DNA, 22 bp, Homo sapiens
tcataaagatactaagtgagtt

SEQ ID NO: 7777172 - DNA, 22 bp, Homo sapiens
tcataaacacactagtatgatt

SEQ ID NO: 7777173 - DNA, 21 bp, Homo sapiens
tcataaactagtatcaaagtt

SEQ ID NO: 7777174 - DNA, 20 bp, Homo sapiens
tcataaagaggaaataaata

SEQ ID NO: 7777175 - DNA, 22 bp, Homo sapiens
tcataaaatgctcctgatattg

SEQ ID NO: 7777176 - DNA, 22 bp, Homo sapiens
tcataaaagtactcatgttcat

SEQ ID NO: 7777177 - DNA, 22 bp, Homo sapiens
tcataaaatgctcctgatattg

SEQ ID NO: 7777178 - DNA, 22 bp, Homo sapiens
tcataaaagtactcatgttcat

SEQ ID NO: 7777179 - DNA, 23 bp, Homo sapiens
tcatcaaaggaagtacgtgtcac

SEQ ID NO: 7777180 - DNA, 22 bp, Homo sapiens
tcatcatctgcaagctcatgtc

SEQ ID NO: 7777181 - DNA, 23 bp, Homo sapiens
tcatcaaacagctgctcaagaaa

SEQ ID NO: 7777182 - DNA, 22 bp, Homo sapiens
tcatctaagagtcttacattta

SEQ ID NO: 7777183 - DNA, 22 bp, Homo sapiens
tcatctaagagtcttacattta

SEQ ID NO: 7777184 - DNA, 22 bp, Homo sapiens
tcatccttttgcatgggaaggc

SEQ ID NO: 7777185 - DNA, 22 bp, Homo sapiens
tcccacatgtgaatcctcaggt

SEQ ID NO: 7777186 - DNA, 22 bp, Homo sapiens
tcccactgagcccctgctggtg

SEQ ID NO: 7777187 - DNA, 23 bp, Homo sapiens
tccagtgtgtgcagattaagtgc

SEQ ID NO: 7777188 - DNA, 22 bp, Homo sapiens
tccagtgtggtcaaaggggaat

SEQ ID NO: 7777189 - DNA, 22 bp, Homo sapiens
tcccagagttcaatgggaaggt

SEQ ID NO: 7777190 - DNA, 22 bp, Homo sapiens
tcccagcctttcttttctgctg

SEQ ID NO: 7777191 - DNA, 22 bp, Homo sapiens
tcccagcagtcagagctatgtg

SEQ ID NO: 7777192 - DNA, 22 bp, Homo sapiens
tcccagcagggccgaccagcct

SEQ ID NO: 7777193 - DNA, 22 bp, Homo sapiens
tcccagcagatgagctgaccta

SEQ ID NO: 7777194 - DNA, 22 bp, Homo sapiens
tcccagcagcatagctcagaat

SEQ ID NO: 7777195 - DNA, 22 bp, Homo sapiens
tcccagcaggagtccagttccc

SEQ ID NO: 7777196 - DNA, 22 bp, Homo sapiens
tcccagcacgtctgctgtttct

SEQ ID NO: 7777197 - DNA, 22 bp, Homo sapiens
tcccagcacagggcagatgtga

SEQ ID NO: 7777198 - DNA, 22 bp, Homo sapiens
tcccagcaagaaagggggtggc

SEQ ID NO: 7777199 - DNA, 22 bp, Homo sapiens
tcccagcactgtaattctttgg

SEQ ID NO: 7777200 - DNA, 22 bp, Homo sapiens
tcccagcagagccagcaagccg

SEQ ID NO: 7777201 - DNA, 22 bp, Homo sapiens
tcccagcagatgagctgaccta

SEQ ID NO: 7777202 - DNA, 22 bp, Homo sapiens
tcccagcttagatttgctcatt

SEQ ID NO: 7777203 - DNA, 22 bp, Homo sapiens
tcccaggatgtgcgtgccgccg

SEQ ID NO: 7777204 - DNA, 22 bp, Homo sapiens
tccaggaggaggaaggctgcca

SEQ ID NO: 7777205 - DNA, 22 bp, Homo sapiens
tccaggaggcagggctgtgccc

SEQ ID NO: 7777206 - DNA, 22 bp, Homo sapiens
tccaggccattgactgcatcct

SEQ ID NO: 7777207 - DNA, 22 bp, Homo sapiens
tccagggagatactggctgcca

SEQ ID NO: 7777208 - DNA, 22 bp, Homo sapiens
tccagggagatggcagaggctg

SEQ ID NO: 7777209 - DNA, 22 bp, Homo sapiens
tccagggagatggcagaggctg

SEQ ID NO: 7777210 - DNA, 22 bp, Homo sapiens
tccagggacagtatagaggatc

SEQ ID NO: 7777211 - DNA, 22 bp, Homo sapiens
tccagggacctccctgagagct

SEQ ID NO: 7777212 - DNA, 22 bp, Homo sapiens
tccagggacctccctgagagct

SEQ ID NO: 7777213 - DNA, 22 bp, Homo sapiens
tccagggagagccgctgctcca

SEQ ID NO: 7777214 - DNA, 22 bp, Homo sapiens
tccaggccctgggatgggagca

SEQ ID NO: 7777215 - DNA, 22 bp, Homo sapiens
tccaggccgcaggggcagcccc

SEQ ID NO: 7777216 - DNA, 22 bp, Homo sapiens
tccaggcctaggccaagtgatt

SEQ ID NO: 7777217 - DNA, 18 bp, Homo sapiens
tccagtcccaaggccagc

SEQ ID NO: 7777218 - DNA, 22 bp, Homo sapiens
tccagtccatggcctcagtctt

SEQ ID NO: 7777219 - DNA, 22 bp, Homo sapiens
tccagggagcaagtcaggccgg

SEQ ID NO: 7777220 - DNA, 22 bp, Homo sapiens
tccagggagtcaaatgaactac

SEQ ID NO: 7777221 - DNA, 22 bp, Homo sapiens
tccagggatctttagagtcttt

SEQ ID NO: 7777222 - DNA, 22 bp, Homo sapiens
tccagggatgccagccatgttg

SEQ ID NO: 7777223 - DNA, 22 bp, Homo sapiens
tccagggatgtcctgtagcact

SEQ ID NO: 7777224 - DNA, 22 bp, Homo sapiens
tccagtgatctagggagctgga

SEQ ID NO: 7777225 - DNA, 22 bp, Homo sapiens
tccacagaatgtaagatccaca

SEQ ID NO: 7777226 - DNA, 22 bp, Homo sapiens
tccacaggcaagtctcttggca

SEQ ID NO: 7777227 - DNA, 22 bp, Homo sapiens
tccacaggaaagcacctcccat

SEQ ID NO: 7777228 - DNA, 22 bp, Homo sapiens
tccacaggctgaggcccttctg

SEQ ID NO: 7777229 - DNA, 22 bp, Homo sapiens
tccacagggatgcctgcggctt

SEQ ID NO: 7777230 - DNA, 22 bp, Homo sapiens
tccacagggatgcctgcggctt

SEQ ID NO: 7777231 - DNA, 22 bp, Homo sapiens
tcatgtgtcctagttcatataa

SEQ ID NO: 7777232 - DNA, 18 bp, Homo sapiens
tcatggctttagtccctc

SEQ ID NO: 7777233 - DNA, 22 bp, Homo sapiens
tcatgtttgagactaatttttc

SEQ ID NO: 7777234 - DNA, 22 bp, Homo sapiens
tcatgtttggagtttgctcact

SEQ ID NO: 7777235 - DNA, 22 bp, Homo sapiens
tcatgttttaatgcctttttct

SEQ ID NO: 7777236 - DNA, 21 bp, Homo sapiens
tccaccctctctgctcccagt

SEQ ID NO: 7777237 - DNA, 22 bp, Homo sapiens
tccacgtgagcttcgtgtgcag

SEQ ID NO: 7777238 - DNA, 22 bp, Homo sapiens
tccactgctcattccacaggca

SEQ ID NO: 7777239 - DNA, 22 bp, Homo sapiens
tccactgcagcttctgatggaa

SEQ ID NO: 7777240 - DNA, 22 bp, Homo sapiens
tccacccccagacagctggtga

SEQ ID NO: 7777241 - DNA, 22 bp, Homo sapiens
tccacccccagacagctggtga

SEQ ID NO: 7777242 - DNA, 19 bp, Homo sapiens
tccaccccagccagctctg

SEQ ID NO: 7777243 - DNA, 19 bp, Homo sapiens
tccaccccagccagctctg

SEQ ID NO: 7777244 - DNA, 22 bp, Homo sapiens
tccaccatgtaacaagctctgt

SEQ ID NO: 7777245 - DNA, 23 bp, Homo sapiens
tccaggagcatgctggctggcga

SEQ ID NO: 7777246 - DNA, 21 bp, Homo sapiens
tccaggaatgtctgttcatct

SEQ ID NO: 7777247 - DNA, 21 bp, Homo sapiens
tccaggacttgagaattccag

SEQ ID NO: 7777248 - DNA, 22 bp, Homo sapiens
tccaggagaaaactgacggtgg

SEQ ID NO: 7777249 - DNA, 22 bp, Homo sapiens
tccaggacctcccaggctagag

SEQ ID NO: 7777250 - DNA, 23 bp, Homo sapiens
tccagcctcttgctctcacatgc

SEQ ID NO: 7777251 - DNA, 22 bp, Homo sapiens
tccagccttctcaaggctggct

SEQ ID NO: 7777252 - DNA, 22 bp, Homo sapiens
tccagccttctcaaggctggct

SEQ ID NO: 7777253 - DNA, 22 bp, Homo sapiens
tccagcctggttgcgggcatcc

SEQ ID NO: 7777254 - DNA, 22 bp, Homo sapiens
tccagcctgaactttgtccaga

SEQ ID NO: 7777255 - DNA, 19 bp, Homo sapiens
tccagcctgctgtttctct

SEQ ID NO: 7777256 - DNA, 21 bp, Homo sapiens
tccagcctttccctcacttcc

SEQ ID NO: 7777257 - DNA, 22 bp, Homo sapiens
tccaggaacagaatgttagtgc

SEQ ID NO: 7777258 - DNA, 22 bp, Homo sapiens
tccagccttgccacttttctgt

SEQ ID NO: 7777259 - DNA, 21 bp, Homo sapiens
tccagcctttccctcacttcc

SEQ ID NO: 7777260 - DNA, 22 bp, Homo sapiens
tccagccactcagcagggattg

SEQ ID NO: 7777261 - DNA, 22 bp, Homo sapiens
tccctgccctcagtgcacccgg

SEQ ID NO: 7777262 - DNA, 22 bp, Homo sapiens
tccctgcagacgtcctgcgggt

SEQ ID NO: 7777263 - DNA, 22 bp, Homo sapiens
tccctgcacccttgctgggccc

SEQ ID NO: 7777264 - DNA, 22 bp, Homo sapiens
tccctgcagtagtggctaagat

SEQ ID NO: 7777265 - DNA, 22 bp, Homo sapiens
tccctgcagtaggcagccctcc

SEQ ID NO: 7777266 - DNA, 22 bp, Homo sapiens
tccctgcaggtgtgcaagctga

SEQ ID NO: 7777267 - DNA, 22 bp, Homo sapiens
tcccaggcaaaggcagctcatt

SEQ ID NO: 7777268 - DNA, 22 bp, Homo sapiens
tcccaggcagcttctttcatca

SEQ ID NO: 7777269 - DNA, 19 bp, Homo sapiens
tcccaggcaaaggcttctc

SEQ ID NO: 7777270 - DNA, 22 bp, Homo sapiens
tcccaggatgtttatggctggt

SEQ ID NO: 7777271 - DNA, 19 bp, Homo sapiens
tcccttctatagtaataaa

SEQ ID NO: 7777272 - DNA, 18 bp, Homo sapiens
tcccttctcccttgcctc

SEQ ID NO: 7777273 - DNA, 22 bp, Homo sapiens
tcccttaaccgtaggacagtct

SEQ ID NO: 7777274 - DNA, 22 bp, Homo sapiens
tcccttaagcacctgagtagtc

SEQ ID NO: 7777275 - DNA, 22 bp, Homo sapiens
tccctgtgtccatgccaggagg

SEQ ID NO: 7777276 - DNA, 23 bp, Homo sapiens
tccctgtgtacagcctgcatgag

SEQ ID NO: 7777277 - DNA, 22 bp, Homo sapiens
tccctgtgggatgaggactctg

SEQ ID NO: 7777278 - DNA, 20 bp, Homo sapiens
tccctggggccctacttcct

SEQ ID NO: 7777279 - DNA, 22 bp, Homo sapiens
tccctgggcggacattctccca

SEQ ID NO: 7777280 - DNA, 22 bp, Homo sapiens
tccctgggcttctccagacttg

SEQ ID NO: 7777281 - DNA, 22 bp, Homo sapiens
tccctggggaagggcaagcaag

SEQ ID NO: 7777282 - DNA, 23 bp, Homo sapiens
tcctcagtatataaaggcagatg

SEQ ID NO: 7777283 - DNA, 22 bp, Homo sapiens
tcctcagtattgtggagcagat

SEQ ID NO: 7777284 - DNA, 22 bp, Homo sapiens
tcctcagttataaataggaaac

SEQ ID NO: 7777285 - DNA, 22 bp, Homo sapiens
tccgggagctgaacgtcttgcg

SEQ ID NO: 7777286 - DNA, 22 bp, Homo sapiens
tccggcagcagctctgaaggag

SEQ ID NO: 7777287 - DNA, 22 bp, Homo sapiens
tccggcagcatctggagggatg

SEQ ID NO: 7777288 - DNA, 22 bp, Homo sapiens
tccgaggccaaagctgtgaata

SEQ ID NO: 7777289 - DNA, 22 bp, Homo sapiens
tccgccaggactgagggcccat

SEQ ID NO: 7777290 - DNA, 22 bp, Homo sapiens
tcctcattcttggtgcatcaaa

SEQ ID NO: 7777291 - DNA, 22 bp, Homo sapiens
tcctccaggataaaatgtgttg

SEQ ID NO: 7777292 - DNA, 22 bp, Homo sapiens
tcctcccttgactcctgctttt

SEQ ID NO: 7777293 - DNA, 19 bp, Homo sapiens
tcctccctttggtgtcctg

SEQ ID NO: 7777294 - DNA, 22 bp, Homo sapiens
tcctccctaaatcctagactgt

SEQ ID NO: 7777295 - DNA, 22 bp, Homo sapiens
tcctccctaaatcctagactgt

SEQ ID NO: 7777296 - DNA, 23 bp, Homo sapiens
tcctccctgacttctacagcaca

SEQ ID NO: 7777297 - DNA, 23 bp, Homo sapiens
tcctccctgacttctacagcaca

SEQ ID NO: 7777298 - DNA, 22 bp, Homo sapiens
tcctccctgtaccattcctctg

SEQ ID NO: 7777299 - DNA, 22 bp, Homo sapiens
tcctccctgcactcagtgaagt

SEQ ID NO: 7777300 - DNA, 22 bp, Homo sapiens
tcctccctgggagcttctgagt

SEQ ID NO: 7777301 - DNA, 22 bp, Homo sapiens
tcctcccctgcccatgaggagg

SEQ ID NO: 7777302 - DNA, 22 bp, Homo sapiens
tagcaaaaactgcagttacttt

SEQ ID NO: 7777303 - DNA, 18 bp, Homo sapiens
tagattaaaattgaattc

SEQ ID NO: 7777304 - DNA, 22 bp, Homo sapiens
tagattaacagttttgttgaag

SEQ ID NO: 7777305 - DNA, 22 bp, Homo sapiens
tagattaagatgccagttttga

SEQ ID NO: 7777306 - DNA, 22 bp, Homo sapiens
tagattttacttctgtcattac

SEQ ID NO: 7777307 - DNA, 22 bp, Homo sapiens
tagattttaggagattttactg

SEQ ID NO: 7777308 - DNA, 22 bp, Homo sapiens
tagattttgcatttctaacaag

SEQ ID NO: 7777309 - DNA, 22 bp, Homo sapiens
tagattttgcatttctaacaag

SEQ ID NO: 7777310 - DNA, 22 bp, Homo sapiens
tagatgttccacatatatatgt

SEQ ID NO: 7777311 - DNA, 22 bp, Homo sapiens
tagcacctgcaggatgtgcaca

SEQ ID NO: 7777312 - DNA, 22 bp, Homo sapiens
tagcaccttaactctgctgcgt

SEQ ID NO: 7777313 - DNA, 22 bp, Homo sapiens
tagcagtatggagcgaggccca

SEQ ID NO: 7777314 - DNA, 22 bp, Homo sapiens
tagcagtatattttaaggaagc

SEQ ID NO: 7777315 - DNA, 22 bp, Homo sapiens
tagcatttattccagatttgga

SEQ ID NO: 7777316 - DNA, 22 bp, Homo sapiens
tagcatttatggtcatgtgtcc

SEQ ID NO: 7777317 - DNA, 22 bp, Homo sapiens
tagccacatgcagactttcatg

SEQ ID NO: 7777318 - DNA, 22 bp, Homo sapiens
tagcatttcccaaatgcatttg

SEQ ID NO: 7777319 - DNA, 22 bp, Homo sapiens
tagcatttggcaccagttattt

SEQ ID NO: 7777320 - DNA, 22 bp, Homo sapiens
tagccaggcaattatgggtgat

SEQ ID NO: 7777321 - DNA, 22 bp, Homo sapiens
tagccaggcgaggtcagtgtcg

SEQ ID NO: 7777322 - DNA, 22 bp, Homo sapiens
tagccagtttctttaacagcaa

SEQ ID NO: 7777323 - DNA, 22 bp, Homo sapiens
tagccagtgagacccagaaata

SEQ ID NO: 7777324 - DNA, 22 bp, Homo sapiens
tagccagtgaatgtttccagtg

SEQ ID NO: 7777325 - DNA, 22 bp, Homo sapiens
tagagcagttggcagctgtatt

SEQ ID NO: 7777326 - DNA, 22 bp, Homo sapiens
tagagatgaattctgcagtctt

SEQ ID NO: 7777327 - DNA, 22 bp, Homo sapiens
tagaggcacagtctatgtagag

SEQ ID NO: 7777328 - DNA, 22 bp, Homo sapiens
tagagctgataatgaggccaag

SEQ ID NO: 7777329 - DNA, 22 bp, Homo sapiens
tagaagttaggaaataggaata

SEQ ID NO: 7777330 - DNA, 22 bp, Homo sapiens
tagaataagttgatgatatatg

SEQ ID NO: 7777331 - DNA, 22 bp, Homo sapiens
tagaataagttgatgatatatg

SEQ ID NO: 7777332 - DNA, 22 bp, Homo sapiens
tactttctttcccaagaggtgg

SEQ ID NO: 7777333 - DNA, 22 bp, Homo sapiens
tacttgctgttagtattttaca

SEQ ID NO: 7777334 - DNA, 22 bp, Homo sapiens
tacttgcttggatttcaccaga

SEQ ID NO: 7777335 - DNA, 22 bp, Homo sapiens
tacttgctgggtgtaattttct

SEQ ID NO: 7777336 - DNA, 23 bp, Homo sapiens
tacttggttttgatagaaatcca

SEQ ID NO: 7777337 - DNA, 22 bp, Homo sapiens
tacttgttaaaatattagctat

SEQ ID NO: 7777338 - DNA, 22 bp, Homo sapiens
tactttcatgggttttctttat

SEQ ID NO: 7777339 - DNA, 19 bp, Homo sapiens
tagcccagagcctggctac

SEQ ID NO: 7777340 - DNA, 22 bp, Homo sapiens
tagcccagatgattgaaccatg

SEQ ID NO: 7777341 - DNA, 22 bp, Homo sapiens
taggaaatatttgaacatagga

SEQ ID NO: 7777342 - DNA, 22 bp, Homo sapiens
taggaaatattgatttcagtca

SEQ ID NO: 7777343 - DNA, 22 bp, Homo sapiens
taggaaatgaatgcaggctccc

SEQ ID NO: 7777344 - DNA, 20 bp, Homo sapiens
taggaaatcgaggcagggtg

SEQ ID NO: 7777345 - DNA, 22 bp, Homo sapiens
taggaaatcagagaaagaggtg

SEQ ID NO: 7777346 - DNA, 20 bp, Homo sapiens
taggaaatatgtttttaccc

SEQ ID NO: 7777347 - DNA, 18 bp, Homo sapiens
taggaaatagggctgtga

SEQ ID NO: 7777348 - DNA, 22 bp, Homo sapiens
taggaaatactgtaagtttggg

SEQ ID NO: 7777349 - DNA, 22 bp, Homo sapiens
taggaaataattcactctggct

SEQ ID NO: 7777350 - DNA, 22 bp, Homo sapiens
taggaaataaatacttatggtt

SEQ ID NO: 7777351 - DNA, 22 bp, Homo sapiens
taggaagatgagtatcaacttg

SEQ ID NO: 7777352 - DNA, 22 bp, Homo sapiens
taggaaatggctcagttactgc

SEQ ID NO: 7777353 - DNA, 22 bp, Homo sapiens
taggaaatgctgtcttattgta

SEQ ID NO: 7777354 - DNA, 22 bp, Homo sapiens
taggaaatgctccattgcataa

SEQ ID NO: 7777355 - DNA, 22 bp, Homo sapiens
taggaaatgccagccttcctcc

SEQ ID NO: 7777356 - DNA, 22 bp, Homo sapiens
taggaaatgaggccaacatgtg

SEQ ID NO: 7777357 - DNA, 23 bp, Homo sapiens
taggacagaatgcagaaaaatac

SEQ ID NO: 7777358 - DNA, 22 bp, Homo sapiens
taggacagagatttgttttatg

SEQ ID NO: 7777359 - DNA, 22 bp, Homo sapiens
taggacagagctggttacaatg

SEQ ID NO: 7777360 - DNA, 22 bp, Homo sapiens
taggaaggaggccatcttggcg

SEQ ID NO: 7777361 - DNA, 22 bp, Homo sapiens
taggaaggtgtttttaaggagc

SEQ ID NO: 7777362 - DNA, 22 bp, Homo sapiens
taggcctggtactgtgttaata

SEQ ID NO: 7777363 - DNA, 22 bp, Homo sapiens
taggcctggatctctgggagca

SEQ ID NO: 7777364 - DNA, 22 bp, Homo sapiens
taggcccagttccgcctcccgg

SEQ ID NO: 7777365 - DNA, 22 bp, Homo sapiens
taggacagggacatctttttga

SEQ ID NO: 7777366 - DNA, 20 bp, Homo sapiens
taggacagggcctggcttct

SEQ ID NO: 7777367 - DNA, 22 bp, Homo sapiens
taggacaggatcatgatgctgg

SEQ ID NO: 7777368 - DNA, 22 bp, Homo sapiens
taggacaggctaaaagggataa

SEQ ID NO: 7777369 - DNA, 20 bp, Homo sapiens
taggacaggcagccgagggg

SEQ ID NO: 7777370 - DNA, 22 bp, Homo sapiens
taggacagagttccctgatggc

SEQ ID NO: 7777371 - DNA, 21 bp, Homo sapiens
taggacagcccccctgccctc

SEQ ID NO: 7777372 - DNA, 22 bp, Homo sapiens
tagtctctaggaggggaaaaga

SEQ ID NO: 7777373 - DNA, 22 bp, Homo sapiens
tagtggatgggtaaagtatttt

SEQ ID NO: 7777374 - DNA, 22 bp, Homo sapiens
tagtccaggtttccatctccac

SEQ ID NO: 7777375 - DNA, 22 bp, Homo sapiens
tagtccagtaaaacagctaacg

SEQ ID NO: 7777376 - DNA, 22 bp, Homo sapiens
tagtcctgaccagctggatgtt

SEQ ID NO: 7777377 - DNA, 22 bp, Homo sapiens
tagtcctggattggtggaggca

SEQ ID NO: 7777378 - DNA, 20 bp, Homo sapiens
tagtatttgcataaggatag

SEQ ID NO: 7777379 - DNA, 22 bp, Homo sapiens
tagtattttagaaaaccatgaa

SEQ ID NO: 7777380 - DNA, 22 bp, Homo sapiens
tagtcacaaccttcaagttgtc

SEQ ID NO: 7777381 - DNA, 22 bp, Homo sapiens
tagtattcagcttctcaggcaa

SEQ ID NO: 7777382 - DNA, 22 bp, Homo sapiens
tagtatttataatcatgcttaa

SEQ ID NO: 7777383 - DNA, 22 bp, Homo sapiens
tagtcacatgatcacaggatcg

SEQ ID NO: 7777384 - DNA, 22 bp, Homo sapiens
tagtcacagtacaggataaaga

SEQ ID NO: 7777385 - DNA, 22 bp, Homo sapiens
tagtcacaggaagtttcaatgt

SEQ ID NO: 7777386 - DNA, 22 bp, Homo sapiens
tagtcacacaattgtgtacatt

SEQ ID NO: 7777387 - DNA, 22 bp, Homo sapiens
tagtccacagactctacagcat

SEQ ID NO: 7777388 - DNA, 22 bp, Homo sapiens
tagtccagccttgggtgtagcc

SEQ ID NO: 7777389 - DNA, 22 bp, Homo sapiens
tagtcagatatatgacttacgt

SEQ ID NO: 7777390 - DNA, 22 bp, Homo sapiens
tagtcagagtcttctctgttgt

SEQ ID NO: 7777391 - DNA, 22 bp, Homo sapiens
tagtcagacccaagagagccat

SEQ ID NO: 7777392 - DNA, 22 bp, Homo sapiens
taggctggaggaagcagtgcct

SEQ ID NO: 7777393 - DNA, 22 bp, Homo sapiens
taggctggaggaagcagtgcct

SEQ ID NO: 7777394 - DNA, 22 bp, Homo sapiens
taggctgggaagaaagattctc

SEQ ID NO: 7777395 - DNA, 22 bp, Homo sapiens
taggctggaacttaggcagagg

SEQ ID NO: 7777396 - DNA, 22 bp, Homo sapiens
taggctggaacttaggcagagg

SEQ ID NO: 7777397 - DNA, 22 bp, Homo sapiens
taggttcaggagatattgcaca

SEQ ID NO: 7777398 - DNA, 22 bp, Homo sapiens
taggctgggagcctgaggctag

SEQ ID NO: 7777399 - DNA, 22 bp, Homo sapiens
taggctgggagcctgaggctag

SEQ ID NO: 7777400 - DNA, 22 bp, Homo sapiens
taggctgggaagaaagattctc

SEQ ID NO: 7777401 - DNA, 22 bp, Homo sapiens
tagtaaaaggtcttcctttgtt

SEQ ID NO: 7777402 - DNA, 22 bp, Homo sapiens
tagtaaaaagcaatggtgagta

SEQ ID NO: 7777403 - DNA, 22 bp, Homo sapiens
tagtaaaagtttagttgaaagt

SEQ ID NO: 7777404 - DNA, 22 bp, Homo sapiens
tagtaaaagtttagttgaaagt

SEQ ID NO: 7777405 - DNA, 22 bp, Homo sapiens
tagtaaaagtttagttgaaagt

SEQ ID NO: 7777406 - DNA, 22 bp, Homo sapiens
tagtacagtttactttcagcgc

SEQ ID NO: 7777407 - DNA, 22 bp, Homo sapiens
tagtatagattgaagcagatca

SEQ ID NO: 7777408 - DNA, 22 bp, Homo sapiens
tataccttccacaaaacagctt

SEQ ID NO: 7777409 - DNA, 22 bp, Homo sapiens
tatacctttaccttgaccaaat

SEQ ID NO: 7777410 - DNA, 22 bp, Homo sapiens
tataccttgagcagggcggccc

SEQ ID NO: 7777411 - DNA, 22 bp, Homo sapiens
tatacagatatctaagatgtaa

SEQ ID NO: 7777412 - DNA, 22 bp, Homo sapiens
tataccaaaaaaattcttgtct

SEQ ID NO: 7777413 - DNA, 22 bp, Homo sapiens
tatacatgttttacataagtga

SEQ ID NO: 7777414 - DNA, 22 bp, Homo sapiens
tagttaaagattctgttaagag

SEQ ID NO: 7777415 - DNA, 22 bp, Homo sapiens
tagttaaagattctgttaagag

SEQ ID NO: 7777416 - DNA, 22 bp, Homo sapiens
tagttaaaataatggagatgtt

SEQ ID NO: 7777417 - DNA, 22 bp, Homo sapiens
tagttaatgctaattaacaaat

SEQ ID NO: 7777418 - DNA, 21 bp, Homo sapiens
tatacagaggggaacaggaga

SEQ ID NO: 7777419 - DNA, 22 bp, Homo sapiens
tatacagaaccgcctgaagtct

SEQ ID NO: 7777420 - DNA, 22 bp, Homo sapiens
tatacagaactgcacgtgcacg

SEQ ID NO: 7777421 - DNA, 22 bp, Homo sapiens
tatacagaaccgcctgaagtct

SEQ ID NO: 7777422 - DNA, 22 bp, Homo sapiens
tagtgtcatttcagtggagttt

SEQ ID NO: 7777423 - DNA, 22 bp, Homo sapiens
tagtgtctagtgagtttgatgc

SEQ ID NO: 7777424 - DNA, 22 bp, Homo sapiens
tagtgtcatgaaaagtacacta

SEQ ID NO: 7777425 - DNA, 22 bp, Homo sapiens
tagtgttttctagaatggtttt

SEQ ID NO: 7777426 - DNA, 23 bp, Homo sapiens
tagtgtcaagagggagtgtaatt

SEQ ID NO: 7777427 - DNA, 22 bp, Homo sapiens
tagtgtcaaatagcctgagctt

SEQ ID NO: 7777428 - DNA, 22 bp, Homo sapiens
tagtgtcaaacagggattagaa

SEQ ID NO: 7777429 - DNA, 22 bp, Homo sapiens
tagtgtcagcatctcattgagc

SEQ ID NO: 7777430 - DNA, 22 bp, Homo sapiens
tagtgtcagagaatcttggttt

SEQ ID NO: 7777431 - DNA, 19 bp, Homo sapiens
tagtgtcaaggaggagggt

SEQ ID NO: 7777432 - DNA, 23 bp, Homo sapiens
tagtgtcatcctcagcttctgtt

SEQ ID NO: 7777433 - DNA, 22 bp, Homo sapiens
tagtgtcatcgttgcagctgag

SEQ ID NO: 7777434 - DNA, 22 bp, Homo sapiens
tagtgtcaggagggaaatgcaa

SEQ ID NO: 7777435 - DNA, 22 bp, Homo sapiens
tagtgtcagggagtgataaatg

SEQ ID NO: 7777436 - DNA, 22 bp, Homo sapiens
tatattaacttgtgatcctgga

SEQ ID NO: 7777437 - DNA, 22 bp, Homo sapiens
tatattaaccatagggttctag

SEQ ID NO: 7777438 - DNA, 22 bp, Homo sapiens
tatattaacacccacttgcctc

SEQ ID NO: 7777439 - DNA, 22 bp, Homo sapiens
tatattacctgcctgatctata

SEQ ID NO: 7777440 - DNA, 22 bp, Homo sapiens
tatattataagccctttcagaa

SEQ ID NO: 7777441 - DNA, 22 bp, Homo sapiens
tatattataagccctttcagaa

SEQ ID NO: 7777442 - DNA, 22 bp, Homo sapiens
tatattatcataaaaccattca

SEQ ID NO: 7777443 - DNA, 22 bp, Homo sapiens
tatattatcataaaaccattca

SEQ ID NO: 7777444 - DNA, 22 bp, Homo sapiens
tatatgtgtggattcttgtaga

SEQ ID NO: 7777445 - DNA, 22 bp, Homo sapiens
tatattaaaccctctctgtagg

SEQ ID NO: 7777446 - DNA, 22 bp, Homo sapiens
tatattaaagtgctttgcagtg

SEQ ID NO: 7777447 - DNA, 22 bp, Homo sapiens
tatattaaatgaccagttttaa

SEQ ID NO: 7777448 - DNA, 22 bp, Homo sapiens
tatagcaagcaggacagtctca

SEQ ID NO: 7777449 - DNA, 22 bp, Homo sapiens
tatagcaactccaaagagactt

SEQ ID NO: 7777450 - DNA, 22 bp, Homo sapiens
tatagcaaggacataatatgct

SEQ ID NO: 7777451 - DNA, 22 bp, Homo sapiens
tatagacttggcatgcatgttc

SEQ ID NO: 7777452 - DNA, 22 bp, Homo sapiens
tatagactagcagcagaattta

SEQ ID NO: 7777453 - DNA, 22 bp, Homo sapiens
tatctttagaggaagagaatct

SEQ ID NO: 7777454 - DNA, 22 bp, Homo sapiens
tatcttacagactgaatgttgg

SEQ ID NO: 7777455 - DNA, 22 bp, Homo sapiens
tatcttaaatgcatgatagaca

SEQ ID NO: 7777456 - DNA, 22 bp, Homo sapiens
tatctttgcaaatatctctaag

SEQ ID NO: 7777457 - DNA, 22 bp, Homo sapiens
tatgcacattcacacaaaaatg

SEQ ID NO: 7777458 - DNA, 23 bp, Homo sapiens
tatgccaaaatggaaagtgtata

SEQ ID NO: 7777459 - DNA, 22 bp, Homo sapiens
tatgcattgtgagactgtggga

SEQ ID NO: 7777460 - DNA, 22 bp, Homo sapiens
tatgccaaggatcaatatgtat

SEQ ID NO: 7777461 - DNA, 22 bp, Homo sapiens
tatgcattatacattaatttct

SEQ ID NO: 7777462 - DNA, 22 bp, Homo sapiens
tatctataagtactaacatggt

SEQ ID NO: 7777463 - DNA, 22 bp, Homo sapiens
tatcacactgttttaattactt

SEQ ID NO: 7777464 - DNA, 22 bp, Homo sapiens
tatcacaattcctatagtttgt

SEQ ID NO: 7777465 - DNA, 22 bp, Homo sapiens
tatcaatatctcagtgtgcttc

SEQ ID NO: 7777466 - DNA, 22 bp, Homo sapiens
tatcaactgagattaaatattt

SEQ ID NO: 7777467 - DNA, 22 bp, Homo sapiens
tatcaatacatgttatcagtgt

SEQ ID NO: 7777468 - DNA, 21 bp, Homo sapiens
tatcaagatgttatggttgaa

SEQ ID NO: 7777469 - DNA, 22 bp, Homo sapiens
tatcaatacatgttatcagtgt

SEQ ID NO: 7777470 - DNA, 19 bp, Homo sapiens
tatatttgttgaataaaaa

SEQ ID NO: 7777471 - DNA, 20 bp, Homo sapiens
tatattttctctttggcctt

SEQ ID NO: 7777472 - DNA, 22 bp, Homo sapiens
tatcaaattgaggcagctgggg

SEQ ID NO: 7777473 - DNA, 22 bp, Homo sapiens
tatcaaagttgtcctgtgaagt

SEQ ID NO: 7777474 - DNA, 22 bp, Homo sapiens
tattcacattctcaggcctggt

SEQ ID NO: 7777475 - DNA, 22 bp, Homo sapiens
tattcacattctcaggcctggt

SEQ ID NO: 7777476 - DNA, 22 bp, Homo sapiens
tattcagaaaataaattggatt

SEQ ID NO: 7777477 - DNA, 22 bp, Homo sapiens
tattcagaggtgaagtagggag

SEQ ID NO: 7777478 - DNA, 22 bp, Homo sapiens
tattgatatgcagaactgactt

SEQ ID NO: 7777479 - DNA, 21 bp, Homo sapiens
tattgattcaatttcttgagt

SEQ ID NO: 7777480 - DNA, 22 bp, Homo sapiens
tattcaaagtgcgaggtcaggg

SEQ ID NO: 7777481 - DNA, 22 bp, Homo sapiens
tattcacaggcacgaaatattg

SEQ ID NO: 7777482 - DNA, 22 bp, Homo sapiens
tattcacagctgccgcactcag

SEQ ID NO: 7777483 - DNA, 22 bp, Homo sapiens
tattcacagctgccgcactcag

SEQ ID NO: 7777484 - DNA, 22 bp, Homo sapiens
tattcacaaaatgaggtcctca

SEQ ID NO: 7777485 - DNA, 22 bp, Homo sapiens
tattcacaaaatgaggtcctca

SEQ ID NO: 7777486 - DNA, 22 bp, Homo sapiens
tattcacatgtacatatgctca

SEQ ID NO: 7777487 - DNA, 22 bp, Homo sapiens
tattcacattaataagtcttca

SEQ ID NO: 7777488 - DNA, 22 bp, Homo sapiens
tattcacattaataagtcttca

SEQ ID NO: 7777489 - DNA, 22 bp, Homo sapiens
tattcacatgaaaacaaatttt

SEQ ID NO: 7777490 - DNA, 22 bp, Homo sapiens
tattcacatgtacatatgctca

SEQ ID NO: 7777491 - DNA, 22 bp, Homo sapiens
tattcacatgtacatatgctca

SEQ ID NO: 7777492 - DNA, 22 bp, Homo sapiens
tattcacaggctggagtgatgt

SEQ ID NO: 7777493 - DNA, 22 bp, Homo sapiens
tattcacaggctggagtgatgt

SEQ ID NO: 7777494 - DNA, 22 bp, Homo sapiens
tattcacaggttccggagatta

SEQ ID NO: 7777495 - DNA, 22 bp, Homo sapiens
tattcacaggttctggggatca

SEQ ID NO: 7777496 - DNA, 22 bp, Homo sapiens
tattcacagttgatttacagtt

SEQ ID NO: 7777497 - DNA, 22 bp, Homo sapiens
tattcacatgaaaacaaatttt

SEQ ID NO: 7777498 - DNA, 21 bp, Homo sapiens
tatgttagtgatgtttgtagg

SEQ ID NO: 7777499 - DNA, 22 bp, Homo sapiens
tatgttactcacatgttcttgc

SEQ ID NO: 7777500 - DNA, 22 bp, Homo sapiens
tatgttacaaagtttttctaaa

SEQ ID NO: 7777501 - DNA, 22 bp, Homo sapiens
tatgttaagtgggataatcaaa

SEQ ID NO: 7777502 - DNA, 22 bp, Homo sapiens
tatgttaagtgggataatcaaa

SEQ ID NO: 7777503 - DNA, 22 bp, Homo sapiens
tatgttctaaccttgtctttcc

SEQ ID NO: 7777504 - DNA, 22 bp, Homo sapiens
tatgttcatagaaatcatgacc

SEQ ID NO: 7777505 - DNA, 22 bp, Homo sapiens
tatgtttaaatgtatgtgtatg

SEQ ID NO: 7777506 - DNA, 22 bp, Homo sapiens
tatgttgagtgaaagaagctag

SEQ ID NO: 7777507 - DNA, 22 bp, Homo sapiens
tatgctttaacattaaacaaca

SEQ ID NO: 7777508 - DNA, 22 bp, Homo sapiens
tatgctctgagacctttgtgca

SEQ ID NO: 7777509 - DNA, 22 bp, Homo sapiens
tatgcctggggtgctcaggcca

SEQ ID NO: 7777510 - DNA, 22 bp, Homo sapiens
tatgcctggaacctttctcttt

SEQ ID NO: 7777511 - DNA, 22 bp, Homo sapiens
tatgccagcacttagatgagat

SEQ ID NO: 7777512 - DNA, 22 bp, Homo sapiens
tattttcaccttctctggatat

SEQ ID NO: 7777513 - DNA, 22 bp, Homo sapiens
tattttcaccttctctggatat

SEQ ID NO: 7777514 - DNA, 22 bp, Homo sapiens
tattttcaccttctctggatat

SEQ ID NO: 7777515 - DNA, 22 bp, Homo sapiens
tattttcattctgtgtgactgt

SEQ ID NO: 7777516 - DNA, 22 bp, Homo sapiens
tattttcattctgtgtgactgt

SEQ ID NO: 7777517 - DNA, 22 bp, Homo sapiens
tatttctaagctgtaagtctga

SEQ ID NO: 7777518 - DNA, 22 bp, Homo sapiens
tatttctaagctgtaagtctga

SEQ ID NO: 7777519 - DNA, 22 bp, Homo sapiens
tatttgtagaatggattaaggg

SEQ ID NO: 7777520 - DNA, 22 bp, Homo sapiens
tatttgtatgtgtgtacatata

SEQ ID NO: 7777521 - DNA, 22 bp, Homo sapiens
tatttgtatgtgtgtacatata

SEQ ID NO: 7777522 - DNA, 18 bp, Homo sapiens
tatttcccaatggaaaca

SEQ ID NO: 7777523 - DNA, 22 bp, Homo sapiens
tatttccaggccccactctaga

SEQ ID NO: 7777524 - DNA, 22 bp, Homo sapiens
tatttcagacactgatcttgca

SEQ ID NO: 7777525 - DNA, 22 bp, Homo sapiens
tatttcactattctctgtaact

SEQ ID NO: 7777526 - DNA, 22 bp, Homo sapiens
tatttcactcagtataccatag

SEQ ID NO: 7777527 - DNA, 22 bp, Homo sapiens
tatttcagctctttggattatc

SEQ ID NO: 7777528 - DNA, 22 bp, Homo sapiens
tatttcagcacatgggataggt

SEQ ID NO: 7777529 - DNA, 22 bp, Homo sapiens
tattgcatctcttcatatctgt

SEQ ID NO: 7777530 - DNA, 22 bp, Homo sapiens
tattgattcctgctttctgctc

SEQ ID NO: 7777531 - DNA, 22 bp, Homo sapiens
tattgattctgtcccaagttga

SEQ ID NO: 7777532 - DNA, 22 bp, Homo sapiens
tacccagagggagagcaactat

SEQ ID NO: 7777533 - DNA, 22 bp, Homo sapiens
tacctgagcccagtgcagcata

SEQ ID NO: 7777534 - DNA, 22 bp, Homo sapiens
tacccagcaatccctagaggtt

SEQ ID NO: 7777535 - DNA, 22 bp, Homo sapiens
tactgaaagtggtcaacagtgg

SEQ ID NO: 7777536 - DNA, 22 bp, Homo sapiens
tactgaggctgaattcttagca

SEQ ID NO: 7777537 - DNA, 17 bp, Homo sapiens
tactgaggggtctggag

SEQ ID NO: 7777538 - DNA, 22 bp, Homo sapiens
tactgcgccttcaccaagcggc

SEQ ID NO: 7777539 - DNA, 22 bp, Homo sapiens
tacttgagtatagtcgcttcac

SEQ ID NO: 7777540 - DNA, 22 bp, Homo sapiens
tactgtaatgagattagcttcc

SEQ ID NO: 7777541 - DNA, 22 bp, Homo sapiens
tacttattggttcagaagttta

SEQ ID NO: 7777542 - DNA, 19 bp, Homo sapiens
tacttattagaaatatggg

SEQ ID NO: 7777543 - DNA, 22 bp, Homo sapiens
tacatacatattcatacaggtg

SEQ ID NO: 7777544 - DNA, 22 bp, Homo sapiens
tacatacagtggatgctttagg

SEQ ID NO: 7777545 - DNA, 22 bp, Homo sapiens
tacatacacaaatatactgttt

SEQ ID NO: 7777546 - DNA, 22 bp, Homo sapiens
tacatacagagatgctagttaa

SEQ ID NO: 7777547 - DNA, 22 bp, Homo sapiens
tacatacacaaatatactgttt

SEQ ID NO: 7777548 - DNA, 22 bp, Homo sapiens
tacattatcttgttatctttca

SEQ ID NO: 7777549 - DNA, 22 bp, Homo sapiens
tacagctttagcaaattaccta

SEQ ID NO: 7777550 - DNA, 18 bp, Homo sapiens
tacaggaaggggttctcg

SEQ ID NO: 7777551 - DNA, 22 bp, Homo sapiens
tacatacaagatgtgtttaaaa

SEQ ID NO: 7777552 - DNA, 22 bp, Homo sapiens
tacagtttttcactgaagatgt

SEQ ID NO: 7777553 - DNA, 22 bp, Homo sapiens
taatgcagtaggtattaaagaa

SEQ ID NO: 7777554 - DNA, 22 bp, Homo sapiens
taatgcagtactgatataaaca

SEQ ID NO: 7777555 - DNA, 22 bp, Homo sapiens
taatgagatcatatcttctgag

SEQ ID NO: 7777556 - DNA, 22 bp, Homo sapiens
taatgactgccgtctctcttca

SEQ ID NO: 7777557 - DNA, 22 bp, Homo sapiens
taatgacttgaaggacccatgg

SEQ ID NO: 7777558 - DNA, 22 bp, Homo sapiens
taatgactgtaccaaggcttca

SEQ ID NO: 7777559 - DNA, 22 bp, Homo sapiens
taatgactaagcatcattaaac

SEQ ID NO: 7777560 - DNA, 22 bp, Homo sapiens
taatgactaagcaatcatgaat

SEQ ID NO: 7777561 - DNA, 20 bp, Homo sapiens
taatgcttaacacatcccct

SEQ ID NO: 7777562 - DNA, 22 bp, Homo sapiens
taataaatgaaagtgctggcat

SEQ ID NO: 7777563 - DNA, 22 bp, Homo sapiens
taataaatgaaagtgctggcat

SEQ ID NO: 7777564 - DNA, 22 bp, Homo sapiens
taataaatgaaagtgctggcat

SEQ ID NO: 7777565 - DNA, 22 bp, Homo sapiens
taataacaattgtaggacatga

SEQ ID NO: 7777566 - DNA, 22 bp, Homo sapiens
taataacaattgtaggacatga

SEQ ID NO: 7777567 - DNA, 22 bp, Homo sapiens
taagcactttatatgctttatc

SEQ ID NO: 7777568 - DNA, 22 bp, Homo sapiens
taagcaggggtcaagtgtacaa

SEQ ID NO: 7777569 - DNA, 22 bp, Homo sapiens
taagcaatgagataatcatggg

SEQ ID NO: 7777570 - DNA, 22 bp, Homo sapiens
taagttcattagactacagata

SEQ ID NO: 7777571 - DNA, 22 bp, Homo sapiens
taagttcagttggtcgaagtag

SEQ ID NO: 7777572 - DNA, 22 bp, Homo sapiens
taagttcattagactacagata

SEQ ID NO: 7777573 - DNA, 22 bp, Homo sapiens
taagttcaaatcatcccaactt

SEQ ID NO: 7777574 - DNA, 22 bp, Homo sapiens
taagttcaatgaactcagttct

SEQ ID NO: 7777575 - DNA, 22 bp, Homo sapiens
taagttcaccagttgtaataag

SEQ ID NO: 7777576 - DNA, 22 bp, Homo sapiens
tacacatgcatgtactccagga

SEQ ID NO: 7777577 - DNA, 22 bp, Homo sapiens
tacacattacataatactatct

SEQ ID NO: 7777578 - DNA, 22 bp, Homo sapiens
tacaccattcccaggtggattt

SEQ ID NO: 7777579 - DNA, 22 bp, Homo sapiens
tacaccattcccaggtggattt

SEQ ID NO: 7777580 - DNA, 22 bp, Homo sapiens
tacactaatgtttttgcaaagc

SEQ ID NO: 7777581 - DNA, 22 bp, Homo sapiens
tacacatccttctgaacaacct

SEQ ID NO: 7777582 - DNA, 22 bp, Homo sapiens
tacacatctctgtcagtagtga

SEQ ID NO: 7777583 - DNA, 22 bp, Homo sapiens
tacacataggtctgaataaaaa

SEQ ID NO: 7777584 - DNA, 19 bp, Homo sapiens
tacaattggctttccattg

SEQ ID NO: 7777585 - DNA, 22 bp, Homo sapiens
tacacaaaggcactctgttgtt

SEQ ID NO: 7777586 - DNA, 22 bp, Homo sapiens
tacacaaaggcactctgttgtt

SEQ ID NO: 7777587 - DNA, 22 bp, Homo sapiens
tacaatgttggtaaagtatcat

SEQ ID NO: 7777588 - DNA, 22 bp, Homo sapiens
tacaattactcagctctgctgt

SEQ ID NO: 7777589 - DNA, 22 bp, Homo sapiens
tacaatgtgtgcttcttgtcac

SEQ ID NO: 7777590 - DNA, 17 bp, Homo sapiens
tacaatgtgattcaatc

SEQ ID NO: 7777591 - DNA, 22 bp, Homo sapiens
tacaatgttaaggaaagagaga

SEQ ID NO: 7777592 - DNA, 22 bp, Homo sapiens
tacaatgtaattctgattatgt

SEQ ID NO: 7777593 - DNA, 22 bp, Homo sapiens
tacaatatgtggccttttgtga

SEQ ID NO: 7777594 - DNA, 20 bp, Homo sapiens
tacaatattcccactttgct

SEQ ID NO: 7777595 - DNA, 20 bp, Homo sapiens
tacaatattcccactttgct

SEQ ID NO: 7777596 - DNA, 22 bp, Homo sapiens
taatttttccacgtacactggg

SEQ ID NO: 7777597 - DNA, 23 bp, Homo sapiens
taattttagccttacaggaccct

SEQ ID NO: 7777598 - DNA, 22 bp, Homo sapiens
taattttatgacagtgtatttt

SEQ ID NO: 7777599 - DNA, 22 bp, Homo sapiens
taattttatgacagtgtatttt

SEQ ID NO: 7777600 - DNA, 22 bp, Homo sapiens
taattttaactgtgctgtttgg

SEQ ID NO: 7777601 - DNA, 22 bp, Homo sapiens
taattttaatagtatgtggcat

SEQ ID NO: 7777602 - DNA, 22 bp, Homo sapiens
taattttacttcctgagcacct

SEQ ID NO: 7777603 - DNA, 22 bp, Homo sapiens
gttagagggaaaaatcatttgc

SEQ ID NO: 7777604 - DNA, 22 bp, Homo sapiens
gttagagggctgccttttgttt

SEQ ID NO: 7777605 - DNA, 20 bp, Homo sapiens
gttaggaggttggacatgga

SEQ ID NO: 7777606 - DNA, 22 bp, Homo sapiens
gttactcttccccggggtctgg

SEQ ID NO: 7777607 - DNA, 22 bp, Homo sapiens
gttactcctggttgagcttggt

SEQ ID NO: 7777608 - DNA, 22 bp, Homo sapiens
gttacaaaggtcataaaagtgt

SEQ ID NO: 7777609 - DNA, 22 bp, Homo sapiens
gttagaaacacattcttattga

SEQ ID NO: 7777610 - DNA, 22 bp, Homo sapiens
gttactcttgagaggctgaggt

SEQ ID NO: 7777611 - DNA, 22 bp, Homo sapiens
gttactcttgagaggctgaggt

SEQ ID NO: 7777612 - DNA, 22 bp, Homo sapiens
gttccaaagtctctgagctgag

SEQ ID NO: 7777613 - DNA, 22 bp, Homo sapiens
gttccaattccaaattccaagg

SEQ ID NO: 7777614 - DNA, 22 bp, Homo sapiens
gttcatttttagaatgctagta

SEQ ID NO: 7777615 - DNA, 23 bp, Homo sapiens
gttcattttattgtctgattgct

SEQ ID NO: 7777616 - DNA, 22 bp, Homo sapiens
gttcatttttactttgatctac

SEQ ID NO: 7777617 - DNA, 23 bp, Homo sapiens
gttcattttattgtctgattgct

SEQ ID NO: 7777618 - DNA, 22 bp, Homo sapiens
gttataaatacctaataggatt

SEQ ID NO: 7777619 - DNA, 22 bp, Homo sapiens
gttataaaggtgataatggtca

SEQ ID NO: 7777620 - DNA, 22 bp, Homo sapiens
gttataaatacctaataggatt

SEQ ID NO: 7777621 - DNA, 22 bp, Homo sapiens
gttataaaggtgataatggtca

SEQ ID NO: 7777622 - DNA, 22 bp, Homo sapiens
gttataaaatgcacagttgttt

SEQ ID NO: 7777623 - DNA, 22 bp, Homo sapiens
gtgttaatggtagaatctgagt

SEQ ID NO: 7777624 - DNA, 22 bp, Homo sapiens
gtgttaatgaaaaacaactcat

SEQ ID NO: 7777625 - DNA, 19 bp, Homo sapiens
gtgctttttaagagctcag

SEQ ID NO: 7777626 - DNA, 22 bp, Homo sapiens
gttccagggaagggaaggcaga

SEQ ID NO: 7777627 - DNA, 22 bp, Homo sapiens
gtttataaggcccaatatttct

SEQ ID NO: 7777628 - DNA, 22 bp, Homo sapiens
gtttataaattctgcttttgtt

SEQ ID NO: 7777629 - DNA, 22 bp, Homo sapiens
gtttagtgtttcaagactcttt

SEQ ID NO: 7777630 - DNA, 22 bp, Homo sapiens
gtttactgttaaccaacgaatg

SEQ ID NO: 7777631 - DNA, 22 bp, Homo sapiens
gtttactgttaaccaacgaatg

SEQ ID NO: 7777632 - DNA, 22 bp, Homo sapiens
gtttactgtcttgcacagtgca

SEQ ID NO: 7777633 - DNA, 22 bp, Homo sapiens
gtttactggagaagatgacctg

SEQ ID NO: 7777634 - DNA, 22 bp, Homo sapiens
gtttactgctctaggttgcaca

SEQ ID NO: 7777635 - DNA, 22 bp, Homo sapiens
gtttactgttttctgataagtg

SEQ ID NO: 7777636 - DNA, 22 bp, Homo sapiens
gtttacattgctgtttgtgtct

SEQ ID NO: 7777637 - DNA, 22 bp, Homo sapiens
gtttataaggcccaatatttct

SEQ ID NO: 7777638 - DNA, 22 bp, Homo sapiens
gtttataaggcccaatatttct

SEQ ID NO: 7777639 - DNA, 22 bp, Homo sapiens
gtttctaaatgttctgagtttt

SEQ ID NO: 7777640 - DNA, 22 bp, Homo sapiens
gtttcctttttctgccctcaat

SEQ ID NO: 7777641 - DNA, 22 bp, Homo sapiens
gtttctaagcacatgtgagtgt

SEQ ID NO: 7777642 - DNA, 22 bp, Homo sapiens
gtttctaattggaactttgagg

SEQ ID NO: 7777643 - DNA, 22 bp, Homo sapiens
gtttctacatgcctctttcacc

SEQ ID NO: 7777644 - DNA, 22 bp, Homo sapiens
gtttctcaagcttgaatgcaca

SEQ ID NO: 7777645 - DNA, 22 bp, Homo sapiens
gtttctcacttccagtagccaa

SEQ ID NO: 7777646 - DNA, 23 bp, Homo sapiens
gtttctatgtcttgtgccttcat

SEQ ID NO: 7777647 - DNA, 22 bp, Homo sapiens
gtttctcaaattatttcagctt

SEQ ID NO: 7777648 - DNA, 22 bp, Homo sapiens
gtttctcaacatgctttctaac

SEQ ID NO: 7777649 - DNA, 22 bp, Homo sapiens
gtttctcaacatgctttctaac

SEQ ID NO: 7777650 - DNA, 22 bp, Homo sapiens
gtttctcaacatgctttctaac

SEQ ID NO: 7777651 - DNA, 22 bp, Homo sapiens
gtttctgagcacttttattgca

SEQ ID NO: 7777652 - DNA, 22 bp, Homo sapiens
gtttctgagagccacacacagc

SEQ ID NO: 7777653 - DNA, 22 bp, Homo sapiens
gtttctgaagggattacttggt

SEQ ID NO: 7777654 - DNA, 22 bp, Homo sapiens
gtttctcttaacacataaagta

SEQ ID NO: 7777655 - DNA, 20 bp, Homo sapiens
gtttctgattcagtaggtct

SEQ ID NO: 7777656 - DNA, 22 bp, Homo sapiens
gtttctgattctagaggcaggc

SEQ ID NO: 7777657 - DNA, 22 bp, Homo sapiens
gtttctcagtttggtctgcaga

SEQ ID NO: 7777658 - DNA, 22 bp, Homo sapiens
gtttctcatcagtttctgatat

SEQ ID NO: 7777659 - DNA, 22 bp, Homo sapiens
gtttctcatcagtttctgatat

SEQ ID NO: 7777660 - DNA, 22 bp, Homo sapiens
gttttacacacctatgaaagac

SEQ ID NO: 7777661 - DNA, 22 bp, Homo sapiens
taagaaacttaactgggaacta

SEQ ID NO: 7777662 - DNA, 22 bp, Homo sapiens
taagaaatttagttatagaatg

SEQ ID NO: 7777663 - DNA, 22 bp, Homo sapiens
taagaaactattgtctctgaac

SEQ ID NO: 7777664 - DNA, 22 bp, Homo sapiens
taagaaactgtcacagtactat

SEQ ID NO: 7777665 - DNA, 22 bp, Homo sapiens
taagaaactgtcacagtactat

SEQ ID NO: 7777666 - DNA, 22 bp, Homo sapiens
taagaaacccaggaatttctta

SEQ ID NO: 7777667 - DNA, 22 bp, Homo sapiens
taagaaacccaggaatttctta

SEQ ID NO: 7777668 - DNA, 22 bp, Homo sapiens
taagaaactaatgcaataagag

SEQ ID NO: 7777669 - DNA, 22 bp, Homo sapiens
taagaaactaatgcaataagag

SEQ ID NO: 7777670 - DNA, 22 bp, Homo sapiens
taagaaactatggagaagaact

SEQ ID NO: 7777671 - DNA, 22 bp, Homo sapiens
taactgtcacttctgcacatct

SEQ ID NO: 7777672 - DNA, 22 bp, Homo sapiens
taagataatccattataatgtt

SEQ ID NO: 7777673 - DNA, 22 bp, Homo sapiens
taagataataagtatgtctatg

SEQ ID NO: 7777674 - DNA, 22 bp, Homo sapiens
taagataataagtatgtctatg

SEQ ID NO: 7777675 - DNA, 22 bp, Homo sapiens
taagagttagggctagcaatat

SEQ ID NO: 7777676 - DNA, 22 bp, Homo sapiens
taagataatccattataatgtt

SEQ ID NO: 7777677 - DNA, 22 bp, Homo sapiens
taacacataagctgagaccatg

SEQ ID NO: 7777678 - DNA, 22 bp, Homo sapiens
taacacatagatattttaactt

SEQ ID NO: 7777679 - DNA, 22 bp, Homo sapiens
taacacatatttgcagtaagca

SEQ ID NO: 7777680 - DNA, 22 bp, Homo sapiens
taacacatggttagtacacaat

SEQ ID NO: 7777681 - DNA, 22 bp, Homo sapiens
taacacatatttcaagagtagt

SEQ ID NO: 7777682 - DNA, 22 bp, Homo sapiens
taacacatatttcaagagtagt

SEQ ID NO: 7777683 - DNA, 21 bp, Homo sapiens
taacacattttggtactttgg

SEQ ID NO: 7777684 - DNA, 21 bp, Homo sapiens
taacacattttggtactttgg

SEQ ID NO: 7777685 - DNA, 22 bp, Homo sapiens
taacacattttcctcatacgga

SEQ ID NO: 7777686 - DNA, 22 bp, Homo sapiens
taacaatttgcttcatttgttt

SEQ ID NO: 7777687 - DNA, 21 bp, Homo sapiens
taacaatctctacttctcatt

SEQ ID NO: 7777688 - DNA, 22 bp, Homo sapiens
taacaaactggaaattgacatt

SEQ ID NO: 7777689 - DNA, 22 bp, Homo sapiens
taacaatagtgtttgctagtca

SEQ ID NO: 7777690 - DNA, 22 bp, Homo sapiens
taacaatagtgtttgctagtca

SEQ ID NO: 7777691 - DNA, 22 bp, Homo sapiens
taaatacagtcatttgagccat

SEQ ID NO: 7777692 - DNA, 23 bp, Homo sapiens
gttttcaacacaataaatgtaac

SEQ ID NO: 7777693 - DNA, 22 bp, Homo sapiens
gttttataggtgaaatattact

SEQ ID NO: 7777694 - DNA, 22 bp, Homo sapiens
gttttataggtgaaatattact

SEQ ID NO: 7777695 - DNA, 22 bp, Homo sapiens
gttttataggtgaaatattact

SEQ ID NO: 7777696 - DNA, 20 bp, Homo sapiens
gttttatgccagttctgtgt

SEQ ID NO: 7777697 - DNA, 22 bp, Homo sapiens
gttttatatgtctctgctgaca

SEQ ID NO: 7777698 - DNA, 22 bp, Homo sapiens
gttttatagttcgggacctgtt

SEQ ID NO: 7777699 - DNA, 22 bp, Homo sapiens
gttttataggctgttgctatat

SEQ ID NO: 7777700 - DNA, 22 bp, Homo sapiens
gttttataattgcttcataaga

SEQ ID NO: 7777701 - DNA, 22 bp, Homo sapiens
gttttataattgcttcataaga

SEQ ID NO: 7777702 - DNA, 21 bp, Homo sapiens
taaacataaccttgtatggct

SEQ ID NO: 7777703 - DNA, 22 bp, Homo sapiens
taaacagtgatacgttccagct

SEQ ID NO: 7777704 - DNA, 22 bp, Homo sapiens
taaacatggctgtttcagttat

SEQ ID NO: 7777705 - DNA, 22 bp, Homo sapiens
taaacatgcccagtgacaggga

SEQ ID NO: 7777706 - DNA, 22 bp, Homo sapiens
gttttcagccaggagcacattt

SEQ ID NO: 7777707 - DNA, 21 bp, Homo sapiens
gttttcatgatagagtctgta

SEQ ID NO: 7777708 - DNA, 22 bp, Homo sapiens
gttttcaaggggatttaactga

SEQ ID NO: 7777709 - DNA, 22 bp, Homo sapiens
taaacagagtgctagttcacgg

SEQ ID NO: 7777710 - DNA, 22 bp, Homo sapiens
taaagacaatttcgagctgtag

SEQ ID NO: 7777711 - DNA, 22 bp, Homo sapiens
taaagacaaacccactagggtt

SEQ ID NO: 7777712 - DNA, 22 bp, Homo sapiens
taaagacaaacccactagggtt

SEQ ID NO: 7777713 - DNA, 22 bp, Homo sapiens
taaagacaaatgacattacggc

SEQ ID NO: 7777714 - DNA, 22 bp, Homo sapiens
taaactgcttctctcagtctgt

SEQ ID NO: 7777715 - DNA, 21 bp, Homo sapiens
taaagaagatgaatgtgatca

SEQ ID NO: 7777716 - DNA, 21 bp, Homo sapiens
taaagaagatgaatgtgatca

SEQ ID NO: 7777717 - DNA, 22 bp, Homo sapiens
taaagtttggcagacaataaca

SEQ ID NO: 7777718 - DNA, 22 bp, Homo sapiens
taaagtttatttgaacatctct

SEQ ID NO: 7777719 - DNA, 21 bp, Homo sapiens
taaataataagttgctgagat

SEQ ID NO: 7777720 - DNA, 21 bp, Homo sapiens
taaataataagttgctgagat

SEQ ID NO: 7777721 - DNA, 21 bp, Homo sapiens
taaataataagttgctgagat

SEQ ID NO: 7777722 - DNA, 22 bp, Homo sapiens
taaataagttcttcattgtttg

SEQ ID NO: 7777723 - DNA, 17 bp, Homo sapiens
taaatacacaagggtat

SEQ ID NO: 7777724 - DNA, 22 bp, Homo sapiens
ggaaggaagtgaccaggatatc

SEQ ID NO: 7777725 - DNA, 22 bp, Homo sapiens
ggaagctgttgtgagtgcagca

SEQ ID NO: 7777726 - DNA, 21 bp, Homo sapiens
ggaacattgttaatagtctct

SEQ ID NO: 7777727 - DNA, 22 bp, Homo sapiens
ggaacataccgaaaatacttaa

SEQ ID NO: 7777728 - DNA, 22 bp, Homo sapiens
ggaacatactgtgtagactttg

SEQ ID NO: 7777729 - DNA, 21 bp, Homo sapiens
ggaagcagtggcggcaactcc

SEQ ID NO: 7777730 - DNA, 22 bp, Homo sapiens
gcttcccatagtggaattcggg

SEQ ID NO: 7777731 - DNA, 22 bp, Homo sapiens
gcttcccattatggaaactctt

SEQ ID NO: 7777732 - DNA, 23 bp, Homo sapiens
gcttcccagacaatactgcttcc

SEQ ID NO: 7777733 - DNA, 22 bp, Homo sapiens
gcttcccaggcgcctgaccttt

SEQ ID NO: 7777734 - DNA, 22 bp, Homo sapiens
gcttcccagcagaggaaagact

SEQ ID NO: 7777735 - DNA, 22 bp, Homo sapiens
gcttcccaatgtgctagtttct

SEQ ID NO: 7777736 - DNA, 20 bp, Homo sapiens
gcttcccaattcttgatctg

SEQ ID NO: 7777737 - DNA, 22 bp, Homo sapiens
gcttcccacagctggactgggg

SEQ ID NO: 7777738 - DNA, 19 bp, Homo sapiens
gcttcccaccagccagccc

SEQ ID NO: 7777739 - DNA, 22 bp, Homo sapiens
gcttcctccctgctgctcacta

SEQ ID NO: 7777740 - DNA, 22 bp, Homo sapiens
ggaaatcaaggggacaaattgt

SEQ ID NO: 7777741 - DNA, 22 bp, Homo sapiens
ggaaatattttgtctaatttgt

SEQ ID NO: 7777742 - DNA, 22 bp, Homo sapiens
ggagagaggagcccactgctgt

SEQ ID NO: 7777743 - DNA, 21 bp, Homo sapiens
ggactctacacaggccatctt

SEQ ID NO: 7777744 - DNA, 22 bp, Homo sapiens
ggagagctggtatatgaagaca

SEQ ID NO: 7777745 - DNA, 22 bp, Homo sapiens
ggagaggaaatgccagcacttc

SEQ ID NO: 7777746 - DNA, 22 bp, Homo sapiens
ggagaggcgatgagtcacagcc

SEQ ID NO: 7777747 - DNA, 22 bp, Homo sapiens
ggagaggcgatgagtcacagcc

SEQ ID NO: 7777748 - DNA, 19 bp, Homo sapiens
ggagaggctggagggatgc

SEQ ID NO: 7777749 - DNA, 19 bp, Homo sapiens
ggagaggctggagggatgc

SEQ ID NO: 7777750 - DNA, 19 bp, Homo sapiens
ggagaggctggagggatgc

SEQ ID NO: 7777751 - DNA, 22 bp, Homo sapiens
ggagaggcttccagagtcgtgc

SEQ ID NO: 7777752 - DNA, 22 bp, Homo sapiens
ggagaggcttccagagtcgtgc

SEQ ID NO: 7777753 - DNA, 22 bp, Homo sapiens
ggagaggcttccagagtcgtgc

SEQ ID NO: 7777754 - DNA, 22 bp, Homo sapiens
ggagaggcttccagagtcgtgc

SEQ ID NO: 7777755 - DNA, 22 bp, Homo sapiens
ggacagagggcaggagcccaga

SEQ ID NO: 7777756 - DNA, 18 bp, Homo sapiens
ggacccagggcctcaccc

SEQ ID NO: 7777757 - DNA, 22 bp, Homo sapiens
ggacccagaggggagtctggca

SEQ ID NO: 7777758 - DNA, 22 bp, Homo sapiens
ggacccagctctgagaccctgc

SEQ ID NO: 7777759 - DNA, 22 bp, Homo sapiens
ggacccagctctgagaccctgc

SEQ ID NO: 7777760 - DNA, 22 bp, Homo sapiens
ggacccaggtagggaggaagat

SEQ ID NO: 7777761 - DNA, 18 bp, Homo sapiens
ggacccagggcctcaccc

SEQ ID NO: 7777762 - DNA, 18 bp, Homo sapiens
ggacccagggcctcaccc

SEQ ID NO: 7777763 - DNA, 22 bp, Homo sapiens
ggaccctggagacccactggga

SEQ ID NO: 7777764 - DNA, 22 bp, Homo sapiens
ggaccctgggcttgctcctggg

SEQ ID NO: 7777765 - DNA, 23 bp, Homo sapiens
ggaccctgtggagggtgagagtc

SEQ ID NO: 7777766 - DNA, 22 bp, Homo sapiens
ggacagagccctggtggcctaa

SEQ ID NO: 7777767 - DNA, 22 bp, Homo sapiens
ggacagagccctggtggcctaa

SEQ ID NO: 7777768 - DNA, 22 bp, Homo sapiens
ggacactagatggagaagggaa

SEQ ID NO: 7777769 - DNA, 22 bp, Homo sapiens
ggacactaaatggaagtgtctg

SEQ ID NO: 7777770 - DNA, 22 bp, Homo sapiens
ggacactacaatctgcctgcat

SEQ ID NO: 7777771 - DNA, 22 bp, Homo sapiens
gctggcaggatagaagtctaat

SEQ ID NO: 7777772 - DNA, 22 bp, Homo sapiens
gctggcaggatagaagtctaat

SEQ ID NO: 7777773 - DNA, 22 bp, Homo sapiens
gctggcaggataacttctaagc

SEQ ID NO: 7777774 - DNA, 22 bp, Homo sapiens
gctggcaggagaaacggggtgc

SEQ ID NO: 7777775 - DNA, 22 bp, Homo sapiens
gctggcagagacaagaagacta

SEQ ID NO: 7777776 - DNA, 22 bp, Homo sapiens
gctggcagccaagtgaagaggg

SEQ ID NO: 7777777 - DNA, 22 bp, Homo sapiens
gctggcagctggaagttgggct

SEQ ID NO: 7777778 - DNA, 22 bp, Homo sapiens
gctggcagggacagctgcgtgt

SEQ ID NO: 7777779 - DNA, 22 bp, Homo sapiens
gctggcagggacagctgcgtgt

SEQ ID NO: 7777780 - DNA, 22 bp, Homo sapiens
gctggctcccagaggccccagc

SEQ ID NO: 7777781 - DNA, 22 bp, Homo sapiens
gctggctccaaaagcaggggct

SEQ ID NO: 7777782 - DNA, 22 bp, Homo sapiens
gctggctcaagtgtgcttccca

SEQ ID NO: 7777783 - DNA, 22 bp, Homo sapiens
gctggcagacttcctctggaac

SEQ ID NO: 7777784 - DNA, 22 bp, Homo sapiens
gctggcagacttcctctggaac

SEQ ID NO: 7777785 - DNA, 22 bp, Homo sapiens
gctggcagacttcctctggaac

SEQ ID NO: 7777786 - DNA, 22 bp, Homo sapiens
gctggcagactgggggcagaac

SEQ ID NO: 7777787 - DNA, 22 bp, Homo sapiens
gctggcagactgggggcagaac

SEQ ID NO: 7777788 - DNA, 22 bp, Homo sapiens
gctggcagactgggggcagaac

SEQ ID NO: 7777789 - DNA, 22 bp, Homo sapiens
gctggcagaagagctggttcaa

SEQ ID NO: 7777790 - DNA, 22 bp, Homo sapiens
gctggcagaatttcttcttgct

SEQ ID NO: 7777791 - DNA, 22 bp, Homo sapiens
gctggcagaatttcttcttgct

SEQ ID NO: 7777792 - DNA, 22 bp, Homo sapiens
gctgccatgttgtgaggacact

SEQ ID NO: 7777793 - DNA, 22 bp, Homo sapiens
gctggctgcacaggggctcact

SEQ ID NO: 7777794 - DNA, 22 bp, Homo sapiens
gctggctgcacaggggctcact

SEQ ID NO: 7777795 - DNA, 18 bp, Homo sapiens
gctggctgcacttctgct

SEQ ID NO: 7777796 - DNA, 22 bp, Homo sapiens
gctggctgcctggttatgcctt

SEQ ID NO: 7777797 - DNA, 22 bp, Homo sapiens
gctggctgccttactttgtgga

SEQ ID NO: 7777798 - DNA, 22 bp, Homo sapiens
gctggctgccttactttgtgga

SEQ ID NO: 7777799 - DNA, 22 bp, Homo sapiens
gctggctgcagattttagaggt

SEQ ID NO: 7777800 - DNA, 22 bp, Homo sapiens
gctggctgccaatttcagagct

SEQ ID NO: 7777801 - DNA, 22 bp, Homo sapiens
gctggctctgatgggctccagg

SEQ ID NO: 7777802 - DNA, 22 bp, Homo sapiens
gctggctcgggaagcaggggat

SEQ ID NO: 7777803 - DNA, 22 bp, Homo sapiens
gctggctcctctgtcctcacgg

SEQ ID NO: 7777804 - DNA, 22 bp, Homo sapiens
gctggctcccattggtccttcc

SEQ ID NO: 7777805 - DNA, 22 bp, Homo sapiens
gctgggagaggcagctttcgga

SEQ ID NO: 7777806 - DNA, 22 bp, Homo sapiens
gctgggagaggccctgaagtga

SEQ ID NO: 7777807 - DNA, 22 bp, Homo sapiens
gctgggagcaaagccatgcata

SEQ ID NO: 7777808 - DNA, 22 bp, Homo sapiens
gctgggaggaatttggggaata

SEQ ID NO: 7777809 - DNA, 22 bp, Homo sapiens
gctgggaaccatgggaaggcag

SEQ ID NO: 7777810 - DNA, 22 bp, Homo sapiens
gctgggaagaacaggagagaat

SEQ ID NO: 7777811 - DNA, 22 bp, Homo sapiens
gctgggaagtgcaagatcaagg

SEQ ID NO: 7777812 - DNA, 22 bp, Homo sapiens
gctgggaatgattttggagagg

SEQ ID NO: 7777813 - DNA, 22 bp, Homo sapiens
gctgggacggctcagtaagaag

SEQ ID NO: 7777814 - DNA, 22 bp, Homo sapiens
gctggtagacctcactgcactc

SEQ ID NO: 7777815 - DNA, 22 bp, Homo sapiens
gctgggttttcttccgggccta

SEQ ID NO: 7777816 - DNA, 22 bp, Homo sapiens
gctgggttttcttccgggccta

SEQ ID NO: 7777817 - DNA, 22 bp, Homo sapiens
gctgggtctggatgctcaggtg

SEQ ID NO: 7777818 - DNA, 20 bp, Homo sapiens
gctgggggtgtgctgagtga

SEQ ID NO: 7777819 - DNA, 22 bp, Homo sapiens
gctggggtctgtgaggagggct

SEQ ID NO: 7777820 - DNA, 22 bp, Homo sapiens
gctggggtgtggtggataagct

SEQ ID NO: 7777821 - DNA, 21 bp, Homo sapiens
gctgggtcagcaggtcctctg

SEQ ID NO: 7777822 - DNA, 20 bp, Homo sapiens
gctgggggtgtgctgagtga

SEQ ID NO: 7777823 - DNA, 22 bp, Homo sapiens
gctgggagtcgcgtctgtggcc

SEQ ID NO: 7777824 - DNA, 16 bp, Homo sapiens
gctgggagggagaggt

SEQ ID NO: 7777825 - DNA, 22 bp, Homo sapiens
gcttccaatgcttctatcacat

SEQ ID NO: 7777826 - DNA, 22 bp, Homo sapiens
gcttccaaatctgttcaaaatg

SEQ ID NO: 7777827 - DNA, 22 bp, Homo sapiens
gcttcccaaacttgtggataga

SEQ ID NO: 7777828 - DNA, 22 bp, Homo sapiens
gcttccagtcctcagaggctgg

SEQ ID NO: 7777829 - DNA, 22 bp, Homo sapiens
gctgtgcagccaagtgcctctg

SEQ ID NO: 7777830 - DNA, 22 bp, Homo sapiens
gctgtgcatcttcattctggac

SEQ ID NO: 7777831 - DNA, 22 bp, Homo sapiens
gctgtgagccgctgctgagcat

SEQ ID NO: 7777832 - DNA, 22 bp, Homo sapiens
gctgtgagtggaggaggctgag

SEQ ID NO: 7777833 - DNA, 22 bp, Homo sapiens
gctgtgagtggaggaggctgag

SEQ ID NO: 7777834 - DNA, 22 bp, Homo sapiens
gctgtgagggcttctgaggcat

SEQ ID NO: 7777835 - DNA, 22 bp, Homo sapiens
gctgtgagggcttctgaggcat

SEQ ID NO: 7777836 - DNA, 23 bp, Homo sapiens
gctgtgcacgagccactgcctgt

SEQ ID NO: 7777837 - DNA, 22 bp, Homo sapiens
gctgtgatccttgagagaaggt

SEQ ID NO: 7777838 - DNA, 22 bp, Homo sapiens
gctgtgataaatgcagatgtca

SEQ ID NO: 7777839 - DNA, 22 bp, Homo sapiens
gctgtgagtggagttctgtgct

SEQ ID NO: 7777840 - DNA, 22 bp, Homo sapiens
gctctgctgcttactagatggt

SEQ ID NO: 7777841 - DNA, 17 bp, Homo sapiens
gctctgcctctcccacc

SEQ ID NO: 7777842 - DNA, 18 bp, Homo sapiens
gctctgcccaggctgccc

SEQ ID NO: 7777843 - DNA, 22 bp, Homo sapiens
gctcctgttttcttccagaaat

SEQ ID NO: 7777844 - DNA, 21 bp, Homo sapiens
gctcctggtgctgcgtggcgc

SEQ ID NO: 7777845 - DNA, 22 bp, Homo sapiens
gctcctggtgctgtagagattt

SEQ ID NO: 7777846 - DNA, 18 bp, Homo sapiens
gctcctggttggaaagaa

SEQ ID NO: 7777847 - DNA, 22 bp, Homo sapiens
gctcagggaactttttgcaggc

SEQ ID NO: 7777848 - DNA, 22 bp, Homo sapiens
gctcctggtctggagcttcaag

SEQ ID NO: 7777849 - DNA, 22 bp, Homo sapiens
gctcctggtgcaaagtttcttc

SEQ ID NO: 7777850 - DNA, 21 bp, Homo sapiens
gctcaggctcaggttcaggtt

SEQ ID NO: 7777851 - DNA, 22 bp, Homo sapiens
gctcaggctctcccaggggaat

SEQ ID NO: 7777852 - DNA, 22 bp, Homo sapiens
gctgcaggatgaggctctgctc

SEQ ID NO: 7777853 - DNA, 22 bp, Homo sapiens
gctgccactctgagcttgcttc

SEQ ID NO: 7777854 - DNA, 22 bp, Homo sapiens
gctgcaggtttgtctagtctgg

SEQ ID NO: 7777855 - DNA, 22 bp, Homo sapiens
gctgcagctttaggatccagtg

SEQ ID NO: 7777856 - DNA, 22 bp, Homo sapiens
gctgcaggagctggagctgtgg

SEQ ID NO: 7777857 - DNA, 22 bp, Homo sapiens
gctgcagctgtaggacacaatt

SEQ ID NO: 7777858 - DNA, 22 bp, Homo sapiens
gctgcagctcgccttccggcct

SEQ ID NO: 7777859 - DNA, 23 bp, Homo sapiens
gctgcagctgtggatgttctcag

SEQ ID NO: 7777860 - DNA, 23 bp, Homo sapiens
gctgcagctgtggatgttctcag

SEQ ID NO: 7777861 - DNA, 22 bp, Homo sapiens
gctgccatcccctgctgggctg

SEQ ID NO: 7777862 - DNA, 22 bp, Homo sapiens
gctgccatctcctgaggacagg

SEQ ID NO: 7777863 - DNA, 22 bp, Homo sapiens
gctgccagctcactctcctgag

SEQ ID NO: 7777864 - DNA, 22 bp, Homo sapiens
gctgatgcagggttgagaggag

SEQ ID NO: 7777865 - DNA, 23 bp, Homo sapiens
gctgatggagacttgtggcctcc

SEQ ID NO: 7777866 - DNA, 22 bp, Homo sapiens
gctgatggcttgctggctgaca

SEQ ID NO: 7777867 - DNA, 22 bp, Homo sapiens
gctgcaagtccttccctctctt

SEQ ID NO: 7777868 - DNA, 22 bp, Homo sapiens
gctgcaagtcatggcttttgca

SEQ ID NO: 7777869 - DNA, 22 bp, Homo sapiens
gctgcaagtcacagaaacagtg

SEQ ID NO: 7777870 - DNA, 22 bp, Homo sapiens
gctgcaagcatgtcatcctcac

SEQ ID NO: 7777871 - DNA, 22 bp, Homo sapiens
gctgattttgagaagcacagtc

SEQ ID NO: 7777872 - DNA, 22 bp, Homo sapiens
gctgattttgtcacatagcaag

SEQ ID NO: 7777873 - DNA, 22 bp, Homo sapiens
gctgcaagttagtatacattct

SEQ ID NO: 7777874 - DNA, 22 bp, Homo sapiens
gctgcacatggcagaggccttt

SEQ ID NO: 7777875 - DNA, 22 bp, Homo sapiens
gctgaagggagtgctgagtctg

SEQ ID NO: 7777876 - DNA, 22 bp, Homo sapiens
gctgaagctgcagcaggaggaa

SEQ ID NO: 7777877 - DNA, 22 bp, Homo sapiens
gctgaagctgcagcaggaggaa

SEQ ID NO: 7777878 - DNA, 22 bp, Homo sapiens
gccttctctgtgagctcctagg

SEQ ID NO: 7777879 - DNA, 22 bp, Homo sapiens
gccttctgcgctcgtgtctccg

SEQ ID NO: 7777880 - DNA, 22 bp, Homo sapiens
gccttttttgttgctctgtcac

SEQ ID NO: 7777881 - DNA, 22 bp, Homo sapiens
gcgccccatctacagtactttt

SEQ ID NO: 7777882 - DNA, 22 bp, Homo sapiens
gcgagaaactaagtgccctttg

SEQ ID NO: 7777883 - DNA, 22 bp, Homo sapiens
gcggcggagacagcaggaagcc

SEQ ID NO: 7777884 - DNA, 22 bp, Homo sapiens
gcggcccgagcaggacgggtgg

SEQ ID NO: 7777885 - DNA, 22 bp, Homo sapiens
gcgggccaccttggagagcgct

SEQ ID NO: 7777886 - DNA, 22 bp, Homo sapiens
gcggaaggctgcctggcttgag

SEQ ID NO: 7777887 - DNA, 22 bp, Homo sapiens
gcggcaggaagagcgcagcccc

SEQ ID NO: 7777888 - DNA, 22 bp, Homo sapiens
gcggcaggagtaaaggaggaag

SEQ ID NO: 7777889 - DNA, 22 bp, Homo sapiens
gcggggggaggaacatcttgca

SEQ ID NO: 7777890 - DNA, 22 bp, Homo sapiens
gctatgaacatgagaatgcaaa

SEQ ID NO: 7777891 - DNA, 22 bp, Homo sapiens
gcggggggaggaacatcttgca

SEQ ID NO: 7777892 - DNA, 22 bp, Homo sapiens
gctcaagagagatgcagttctt

SEQ ID NO: 7777893 - DNA, 22 bp, Homo sapiens
gctcaaatttcagactcatgaa

SEQ ID NO: 7777894 - DNA, 22 bp, Homo sapiens
gctcaaatttcagactcatgaa

SEQ ID NO: 7777895 - DNA, 22 bp, Homo sapiens
gctcaatgctcaatgctgcaaa

SEQ ID NO: 7777896 - DNA, 22 bp, Homo sapiens
gctcaagccttctgcccacctc

SEQ ID NO: 7777897 - DNA, 22 bp, Homo sapiens
gctcaagccttctgcccacctc

SEQ ID NO: 7777898 - DNA, 22 bp, Homo sapiens
gctcagctgcacctggagagcc

SEQ ID NO: 7777899 - DNA, 22 bp, Homo sapiens
gctcacatcatagtaagctcat

SEQ ID NO: 7777900 - DNA, 22 bp, Homo sapiens
gctcagctggagagggacgggt

SEQ ID NO: 7777901 - DNA, 22 bp, Homo sapiens
gcctcaggcctatagctgctgt

SEQ ID NO: 7777902 - DNA, 22 bp, Homo sapiens
gcctcaggcctatagctgctgt

SEQ ID NO: 7777903 - DNA, 22 bp, Homo sapiens
gcctcagggataggatgagcat

SEQ ID NO: 7777904 - DNA, 22 bp, Homo sapiens
gcctggctaagcagaaggaccc

SEQ ID NO: 7777905 - DNA, 22 bp, Homo sapiens
gcctggctgaggtggggaggca

SEQ ID NO: 7777906 - DNA, 23 bp, Homo sapiens
gcctggcttccaaggtaggggag

SEQ ID NO: 7777907 - DNA, 22 bp, Homo sapiens
gcctggcttgccagccctggcg

SEQ ID NO: 7777908 - DNA, 22 bp, Homo sapiens
gcctggctgggcaccaggggag

SEQ ID NO: 7777909 - DNA, 22 bp, Homo sapiens
gcctggctggtagagggggctc

SEQ ID NO: 7777910 - DNA, 22 bp, Homo sapiens
gcctggctggtagagggggctc

SEQ ID NO: 7777911 - DNA, 22 bp, Homo sapiens
gcctggctggtcactgcctggc

SEQ ID NO: 7777912 - DNA, 22 bp, Homo sapiens
gcctggggcatgcagctgatac

SEQ ID NO: 7777913 - DNA, 22 bp, Homo sapiens
gcctggggcatgcagctgatac

SEQ ID NO: 7777914 - DNA, 22 bp, Homo sapiens
gcctggtctctggggttgggta

SEQ ID NO: 7777915 - DNA, 22 bp, Homo sapiens
gcctggtgaaaggcagagagcg

SEQ ID NO: 7777916 - DNA, 22 bp, Homo sapiens
gcctggtgataagcagtgacct

SEQ ID NO: 7777917 - DNA, 22 bp, Homo sapiens
gccttcagtagtgtcagctgta

SEQ ID NO: 7777918 - DNA, 22 bp, Homo sapiens
gccttcaggaaatcagtccttg

SEQ ID NO: 7777919 - DNA, 18 bp, Homo sapiens
gccttcagactgcatgct

SEQ ID NO: 7777920 - DNA, 22 bp, Homo sapiens
gccttcagagtaccatgtcctc

SEQ ID NO: 7777921 - DNA, 22 bp, Homo sapiens
gcctggtgctatgagggccagc

SEQ ID NO: 7777922 - DNA, 22 bp, Homo sapiens
gcctggtggacactgggcatca

SEQ ID NO: 7777923 - DNA, 22 bp, Homo sapiens
gagggggcgaacagaagcaagg

SEQ ID NO: 7777924 - DNA, 22 bp, Homo sapiens
gagggggcgaacagaagcaagg

SEQ ID NO: 7777925 - DNA, 22 bp, Homo sapiens
gagggtccctgctcagggccag

SEQ ID NO: 7777926 - DNA, 22 bp, Homo sapiens
gcaaatgcactgcatttagatt

SEQ ID NO: 7777927 - DNA, 22 bp, Homo sapiens
gcaaatgagttgtaacataaaa

SEQ ID NO: 7777928 - DNA, 22 bp, Homo sapiens
gcaaatgctaaagtgtagagac

SEQ ID NO: 7777929 - DNA, 22 bp, Homo sapiens
gcaagatgttaacatagggaga

SEQ ID NO: 7777930 - DNA, 22 bp, Homo sapiens
gcaagatgttaacatagggaga

SEQ ID NO: 7777931 - DNA, 22 bp, Homo sapiens
gcaagcaaattatttataggca

SEQ ID NO: 7777932 - DNA, 22 bp, Homo sapiens
gcaagcaaaatgggagattccc

SEQ ID NO: 7777933 - DNA, 22 bp, Homo sapiens
gcaagcacagatagactcagcc

SEQ ID NO: 7777934 - DNA, 22 bp, Homo sapiens
gcaagcaagcaggtagagctga

SEQ ID NO: 7777935 - DNA, 22 bp, Homo sapiens
gcaagcaagcaggtagagctga

SEQ ID NO: 7777936 - DNA, 22 bp, Homo sapiens
gcacaggcaatagatacagcta

SEQ ID NO: 7777937 - DNA, 22 bp, Homo sapiens
gcacaggaggccgatgctcatg

SEQ ID NO: 7777938 - DNA, 22 bp, Homo sapiens
gcacaggagccaggtccttcac

SEQ ID NO: 7777939 - DNA, 19 bp, Homo sapiens
gcacaggacatctgatgga

SEQ ID NO: 7777940 - DNA, 22 bp, Homo sapiens
gcacaggaaatgactcatgtta

SEQ ID NO: 7777941 - DNA, 19 bp, Homo sapiens
gcacaggacatctgatgga

SEQ ID NO: 7777942 - DNA, 22 bp, Homo sapiens
gcaagctgctcttatgtggagg

SEQ ID NO: 7777943 - DNA, 22 bp, Homo sapiens
gcaagctggctgttagaggatg

SEQ ID NO: 7777944 - DNA, 22 bp, Homo sapiens
gcaagctgatgtgatagtgaaa

SEQ ID NO: 7777945 - DNA, 21 bp, Homo sapiens
gcaagccaccactgctgccac

SEQ ID NO: 7777946 - DNA, 22 bp, Homo sapiens
gcaagcagggttccttagggca

SEQ ID NO: 7777947 - DNA, 22 bp, Homo sapiens
gcaagctgtgccttctcaggat

SEQ ID NO: 7777948 - DNA, 22 bp, Homo sapiens
gcaagctgtgatttatgtgaat

SEQ ID NO: 7777949 - DNA, 22 bp, Homo sapiens
gcaagctgtccttttgcatggc

SEQ ID NO: 7777950 - DNA, 22 bp, Homo sapiens
gcacagccactgagtgagaacc

SEQ ID NO: 7777951 - DNA, 22 bp, Homo sapiens
gcactctgccaggtctcctgat

SEQ ID NO: 7777952 - DNA, 22 bp, Homo sapiens
gcacaggcacagagggccactg

SEQ ID NO: 7777953 - DNA, 22 bp, Homo sapiens
gcactgagcaccagccacagat

SEQ ID NO: 7777954 - DNA, 22 bp, Homo sapiens
gcactgagcaccagccacagat

SEQ ID NO: 7777955 - DNA, 17 bp, Homo sapiens
gcactgagccacagttt

SEQ ID NO: 7777956 - DNA, 18 bp, Homo sapiens
gcactgaggaaaacctct

SEQ ID NO: 7777957 - DNA, 22 bp, Homo sapiens
gcactgctccaggtgtggcttg

SEQ ID NO: 7777958 - DNA, 22 bp, Homo sapiens
gcactgcaggtgggtggagagg

SEQ ID NO: 7777959 - DNA, 22 bp, Homo sapiens
gcactgggaagaatgagcctgt

SEQ ID NO: 7777960 - DNA, 22 bp, Homo sapiens
gcactggaaatacctagatgaa

SEQ ID NO: 7777961 - DNA, 22 bp, Homo sapiens
gcactgcttttacctaggtgag

SEQ ID NO: 7777962 - DNA, 22 bp, Homo sapiens
gcagaggactcaatcaaggtat

SEQ ID NO: 7777963 - DNA, 22 bp, Homo sapiens
gcagaggagatgaagatacttt

SEQ ID NO: 7777964 - DNA, 22 bp, Homo sapiens
gcagaggacagggatttagatt

SEQ ID NO: 7777965 - DNA, 22 bp, Homo sapiens
gcagaggagcaagctggacacc

SEQ ID NO: 7777966 - DNA, 22 bp, Homo sapiens
gcagaggacacaggagggcaag

SEQ ID NO: 7777967 - DNA, 22 bp, Homo sapiens
gcagaggacacaggagggcaag

SEQ ID NO: 7777968 - DNA, 22 bp, Homo sapiens
gcagagctgcagcgaggcctgg

SEQ ID NO: 7777969 - DNA, 22 bp, Homo sapiens
gcagagctgcagcgaggcctgg

SEQ ID NO: 7777970 - DNA, 22 bp, Homo sapiens
gcagagctgagcggctgcccgg

SEQ ID NO: 7777971 - DNA, 22 bp, Homo sapiens
gcactgggaatgagggcagctt

SEQ ID NO: 7777972 - DNA, 22 bp, Homo sapiens
gcactgggaatgctgatgggct

SEQ ID NO: 7777973 - DNA, 22 bp, Homo sapiens
gcactgggagctgcctgccggt

SEQ ID NO: 7777974 - DNA, 22 bp, Homo sapiens
gcactgggaatgtgagcagctg

SEQ ID NO: 7777975 - DNA, 22 bp, Homo sapiens
gcactgggagtctgtgggggtt

SEQ ID NO: 7777976 - DNA, 16 bp, Homo sapiens
gcactgggatgtcttc

SEQ ID NO: 7777977 - DNA, 22 bp, Homo sapiens
gcactgggctccaggaaggagg

SEQ ID NO: 7777978 - DNA, 22 bp, Homo sapiens
gcactgttctaggtgcagagct

SEQ ID NO: 7777979 - DNA, 22 bp, Homo sapiens
gcactgttctaggtgcagagct

SEQ ID NO: 7777980 - DNA, 22 bp, Homo sapiens
gcactgttctcagagcattaga

SEQ ID NO: 7777981 - DNA, 22 bp, Homo sapiens
gcacttgaagaattgaactgga

SEQ ID NO: 7777982 - DNA, 22 bp, Homo sapiens
gcaggctgatagaggattccat

SEQ ID NO: 7777983 - DNA, 22 bp, Homo sapiens
gcaggctgatgactggagttgg

SEQ ID NO: 7777984 - DNA, 22 bp, Homo sapiens
gcaggctgatgactggagttgg

SEQ ID NO: 7777985 - DNA, 22 bp, Homo sapiens
gcaggctgccaccttctgagtt

SEQ ID NO: 7777986 - DNA, 22 bp, Homo sapiens
gcagggccttagcagcggctgc

SEQ ID NO: 7777987 - DNA, 22 bp, Homo sapiens
gcagggccttagcagcggctgc

SEQ ID NO: 7777988 - DNA, 22 bp, Homo sapiens
gcagggctaggtcttctagggc

SEQ ID NO: 7777989 - DNA, 22 bp, Homo sapiens
gcagggctagatatttgcaagt

SEQ ID NO: 7777990 - DNA, 22 bp, Homo sapiens
gcagggctaatggggcaagtag

SEQ ID NO: 7777991 - DNA, 22 bp, Homo sapiens
gcagggcggcccagagcaggcc

SEQ ID NO: 7777992 - DNA, 22 bp, Homo sapiens
gcagggcgcgtttgagcgggct

SEQ ID NO: 7777993 - DNA, 22 bp, Homo sapiens
gcaggctccaaggcctgggaga

SEQ ID NO: 7777994 - DNA, 22 bp, Homo sapiens
gcaggctcgttggaagtcccct

SEQ ID NO: 7777995 - DNA, 22 bp, Homo sapiens
gcaggctgaaactcggggtcta

SEQ ID NO: 7777996 - DNA, 22 bp, Homo sapiens
gcaggctgagagtccaagaagg

SEQ ID NO: 7777997 - DNA, 22 bp, Homo sapiens
gcaggctgaaactcggggtcta

SEQ ID NO: 7777998 - DNA, 22 bp, Homo sapiens
gcaggctgagtattaccctagt

SEQ ID NO: 7777999 - DNA, 22 bp, Homo sapiens
gcaggctgagttgggaaaccaa

SEQ ID NO: 7778000 - DNA, 22 bp, Homo sapiens
gcaggaggttgagccaggactg

SEQ ID NO: 7778001 - DNA, 22 bp, Homo sapiens
gcaggcctctgttgagggcctt

SEQ ID NO: 7778002 - DNA, 22 bp, Homo sapiens
gcaggagctggaaagtgatgtt

SEQ ID NO: 7778003 - DNA, 22 bp, Homo sapiens
gcagctggagaaataccaccct

SEQ ID NO: 7778004 - DNA, 22 bp, Homo sapiens
gcagctgcctattcagggcttg

SEQ ID NO: 7778005 - DNA, 22 bp, Homo sapiens
gcagctggatttcaagagggag

SEQ ID NO: 7778006 - DNA, 22 bp, Homo sapiens
gcagctggatttcaagagggag

SEQ ID NO: 7778007 - DNA, 22 bp, Homo sapiens
gcagctggagccagccagacac

SEQ ID NO: 7778008 - DNA, 22 bp, Homo sapiens
gcagctgcctaaagtgctaaga

SEQ ID NO: 7778009 - DNA, 22 bp, Homo sapiens
gcagctgccgtgagctcacgcc

SEQ ID NO: 7778010 - DNA, 22 bp, Homo sapiens
gcagctgccccgactgtgagtc

SEQ ID NO: 7778011 - DNA, 18 bp, Homo sapiens
gcagctgcagttgtagct

SEQ ID NO: 7778012 - DNA, 22 bp, Homo sapiens
gcagctgcaggcaggcttgctg

SEQ ID NO: 7778013 - DNA, 22 bp, Homo sapiens
gcagctgcagaccctcagtgct

SEQ ID NO: 7778014 - DNA, 22 bp, Homo sapiens
gcagcaggatggccaattgcca

SEQ ID NO: 7778015 - DNA, 22 bp, Homo sapiens
gcagcaggcacggtctcgacat

SEQ ID NO: 7778016 - DNA, 22 bp, Homo sapiens
gcagcaggcacttaccgttgct

SEQ ID NO: 7778017 - DNA, 22 bp, Homo sapiens
gcagcaggtctgtcaatgtcat

SEQ ID NO: 7778018 - DNA, 22 bp, Homo sapiens
gcagcaggtgtgcttttaatga

SEQ ID NO: 7778019 - DNA, 22 bp, Homo sapiens
gcagcaggagagtaatagcggt

SEQ ID NO: 7778020 - DNA, 22 bp, Homo sapiens
gcagcaggactgccgttaaagt

SEQ ID NO: 7778021 - DNA, 22 bp, Homo sapiens
gcagcaggagagtttgtcctgc

SEQ ID NO: 7778022 - DNA, 22 bp, Homo sapiens
gcagcaggaatttaaatttata

SEQ ID NO: 7778023 - DNA, 22 bp, Homo sapiens
gcagcaggaataggataagcaa

SEQ ID NO: 7778024 - DNA, 22 bp, Homo sapiens
gcagcaggaataggataagcaa

SEQ ID NO: 7778025 - DNA, 22 bp, Homo sapiens
gcagcagctctgaatgggcccc

SEQ ID NO: 7778026 - DNA, 22 bp, Homo sapiens
gcagcagctgacagtgggtgcc

SEQ ID NO: 7778027 - DNA, 22 bp, Homo sapiens
gcagcagctctgaatgggcccc

SEQ ID NO: 7778028 - DNA, 22 bp, Homo sapiens
gcagcagctcagttctgggagg

SEQ ID NO: 7778029 - DNA, 22 bp, Homo sapiens
gcagcagctcagccgggcactg

SEQ ID NO: 7778030 - DNA, 22 bp, Homo sapiens
gcagaggaggacccaggaatta

SEQ ID NO: 7778031 - DNA, 22 bp, Homo sapiens
gcagaggaggacccaggaatta

SEQ ID NO: 7778032 - DNA, 22 bp, Homo sapiens
gcagaggaggacccaggaatta

SEQ ID NO: 7778033 - DNA, 22 bp, Homo sapiens
gccagtaaaacaaaggccatgt

SEQ ID NO: 7778034 - DNA, 22 bp, Homo sapiens
gccagtaagtggtagagttgag

SEQ ID NO: 7778035 - DNA, 22 bp, Homo sapiens
gccagtctccctcagtcctctg

SEQ ID NO: 7778036 - DNA, 22 bp, Homo sapiens
gccagtctgataggggagaagt

SEQ ID NO: 7778037 - DNA, 18 bp, Homo sapiens
gccagtgccctggctcac

SEQ ID NO: 7778038 - DNA, 22 bp, Homo sapiens
gccagtgcctcgccgcgctcct

SEQ ID NO: 7778039 - DNA, 21 bp, Homo sapiens
gccagtgctgtctgtgtgatc

SEQ ID NO: 7778040 - DNA, 22 bp, Homo sapiens
gccagtgcttgtggagctggca

SEQ ID NO: 7778041 - DNA, 22 bp, Homo sapiens
gccagtggagcacatggtgaag

SEQ ID NO: 7778042 - DNA, 22 bp, Homo sapiens
gccagtggcttgccaggcagga

SEQ ID NO: 7778043 - DNA, 22 bp, Homo sapiens
gccagtggccctctggagaagg

SEQ ID NO: 7778044 - DNA, 22 bp, Homo sapiens
gccagtggcttgccaggcagga

SEQ ID NO: 7778045 - DNA, 22 bp, Homo sapiens
gcccagagggaagaggtgtcat

SEQ ID NO: 7778046 - DNA, 21 bp, Homo sapiens
gcccagagggagccaagccca

SEQ ID NO: 7778047 - DNA, 23 bp, Homo sapiens
gcccagagaggctcaccaggaat

SEQ ID NO: 7778048 - DNA, 22 bp, Homo sapiens
gcccagagtgagtcctgggccc

SEQ ID NO: 7778049 - DNA, 22 bp, Homo sapiens
gcccagagtggccacttggctc

SEQ ID NO: 7778050 - DNA, 22 bp, Homo sapiens
gcccagagagatgaagtgatgg

SEQ ID NO: 7778051 - DNA, 22 bp, Homo sapiens
gccaggagaatgctagcagagg

SEQ ID NO: 7778052 - DNA, 22 bp, Homo sapiens
gccaggagaatgctagcagagg

SEQ ID NO: 7778053 - DNA, 22 bp, Homo sapiens
gccaggagaatgctagcagagg

SEQ ID NO: 7778054 - DNA, 22 bp, Homo sapiens
gccaggagagctccttcaggtt

SEQ ID NO: 7778055 - DNA, 22 bp, Homo sapiens
gccaggagagctccttcaggtt

SEQ ID NO: 7778056 - DNA, 22 bp, Homo sapiens
gccaggagagctccttcaggtt

SEQ ID NO: 7778057 - DNA, 22 bp, Homo sapiens
gccaggagccctgggcaagttc

SEQ ID NO: 7778058 - DNA, 22 bp, Homo sapiens
gccaggaggctgctgtgtaggc

SEQ ID NO: 7778059 - DNA, 22 bp, Homo sapiens
gccaggagaaaaggcgaatgat

SEQ ID NO: 7778060 - DNA, 22 bp, Homo sapiens
gccaggactgagaatgggagca

SEQ ID NO: 7778061 - DNA, 22 bp, Homo sapiens
gccaggagttcagatgcatgtt

SEQ ID NO: 7778062 - DNA, 23 bp, Homo sapiens
gccaggcacatggtggacacgca

SEQ ID NO: 7778063 - DNA, 22 bp, Homo sapiens
gccaggtccagggtggagcgct

SEQ ID NO: 7778064 - DNA, 22 bp, Homo sapiens
gccaggcacagttctaggtgct

SEQ ID NO: 7778065 - DNA, 22 bp, Homo sapiens
gccaggtctgggtagcagagga

SEQ ID NO: 7778066 - DNA, 22 bp, Homo sapiens
gcccagtggtaaaagcaggcct

SEQ ID NO: 7778067 - DNA, 22 bp, Homo sapiens
gcccatggaaaacctgtcctct

SEQ ID NO: 7778068 - DNA, 23 bp, Homo sapiens
gcccatgctgttgggcccgagca

SEQ ID NO: 7778069 - DNA, 22 bp, Homo sapiens
gcccagggcgatggtcggggcc

SEQ ID NO: 7778070 - DNA, 22 bp, Homo sapiens
gcccaggctggagttcagtggt

SEQ ID NO: 7778071 - DNA, 22 bp, Homo sapiens
gcccaggctggagtgcagtggt

SEQ ID NO: 7778072 - DNA, 21 bp, Homo sapiens
gcccagagttaagcccaccca

SEQ ID NO: 7778073 - DNA, 22 bp, Homo sapiens
gcccagagtggccacttggctc

SEQ ID NO: 7778074 - DNA, 22 bp, Homo sapiens
gcccagcaaggaccaagggccg

SEQ ID NO: 7778075 - DNA, 22 bp, Homo sapiens
gcccaggctggagtgcagtggt

SEQ ID NO: 7778076 - DNA, 22 bp, Homo sapiens
gccctgagcctatgagcctctc

SEQ ID NO: 7778077 - DNA, 22 bp, Homo sapiens
gccctgagcactgctgctgggg

SEQ ID NO: 7778078 - DNA, 22 bp, Homo sapiens
gccctgacactttgcagctgag

SEQ ID NO: 7778079 - DNA, 22 bp, Homo sapiens
gccctgagactgagcatgggtt

SEQ ID NO: 7778080 - DNA, 22 bp, Homo sapiens
gcctcagctcccagcccaggct

SEQ ID NO: 7778081 - DNA, 22 bp, Homo sapiens
gcctcaggactggcatactcat

SEQ ID NO: 7778082 - DNA, 22 bp, Homo sapiens
gcctcagccggcggacgccagg

SEQ ID NO: 7778083 - DNA, 20 bp, Homo sapiens
gcctcagccaacccatgggg

SEQ ID NO: 7778084 - DNA, 22 bp, Homo sapiens
gcctcagagggccctagggaca

SEQ ID NO: 7778085 - DNA, 23 bp, Homo sapiens
gcctcagagaaacagctgcacac

SEQ ID NO: 7778086 - DNA, 22 bp, Homo sapiens
gcctaatacatgatgataggta

SEQ ID NO: 7778087 - DNA, 22 bp, Homo sapiens
gccagccataggccagcactgg

SEQ ID NO: 7778088 - DNA, 22 bp, Homo sapiens
gccagcccagctccaggggaaa

SEQ ID NO: 7778089 - DNA, 22 bp, Homo sapiens
gccagccccttagggctctccc

SEQ ID NO: 7778090 - DNA, 22 bp, Homo sapiens
gccagccccagacatcctatcg

SEQ ID NO: 7778091 - DNA, 22 bp, Homo sapiens
gccagcagtcctgctgtgtgcc

SEQ ID NO: 7778092 - DNA, 22 bp, Homo sapiens
gccagcagtggccaccaccagg

SEQ ID NO: 7778093 - DNA, 22 bp, Homo sapiens
gccagcagtatgtcctggcagt

SEQ ID NO: 7778094 - DNA, 22 bp, Homo sapiens
gccagcaggttgtcaaggagct

SEQ ID NO: 7778095 - DNA, 22 bp, Homo sapiens
gccagcagggcggagccatcta

SEQ ID NO: 7778096 - DNA, 22 bp, Homo sapiens
gccagaggaacgctgcgcgccc

SEQ ID NO: 7778097 - DNA, 22 bp, Homo sapiens
gccagaggcccaaggacagctg

SEQ ID NO: 7778098 - DNA, 22 bp, Homo sapiens
gccagaggcccaaggacagctg

SEQ ID NO: 7778099 - DNA, 22 bp, Homo sapiens
gccagagagagtccctgggcct

SEQ ID NO: 7778100 - DNA, 22 bp, Homo sapiens
gccagagcagaatagagtggcc

SEQ ID NO: 7778101 - DNA, 22 bp, Homo sapiens
gccagagcatgcactgcctgca

SEQ ID NO: 7778102 - DNA, 22 bp, Homo sapiens
gccaaggcctctgcaggatgag

SEQ ID NO: 7778103 - DNA, 22 bp, Homo sapiens
gccaaggcctctgcaggatgag

SEQ ID NO: 7778104 - DNA, 22 bp, Homo sapiens
gccaagcctgtagacacaagct

SEQ ID NO: 7778105 - DNA, 22 bp, Homo sapiens
gccaagctgtttttcagagacg

SEQ ID NO: 7778106 - DNA, 22 bp, Homo sapiens
gccaagctggatgaagaggttg

SEQ ID NO: 7778107 - DNA, 22 bp, Homo sapiens
gccaaggaaggcttcctggaag

SEQ ID NO: 7778108 - DNA, 22 bp, Homo sapiens
gcattttaataagattcatagg

SEQ ID NO: 7778109 - DNA, 22 bp, Homo sapiens
gcattttaatgaggtttatgag

SEQ ID NO: 7778110 - DNA, 22 bp, Homo sapiens
gcagggctccactgtggccaag

SEQ ID NO: 7778111 - DNA, 21 bp, Homo sapiens
gcagtcactcggttggctacc

SEQ ID NO: 7778112 - DNA, 22 bp, Homo sapiens
gcagggctctgctgtagtccta

SEQ ID NO: 7778113 - DNA, 22 bp, Homo sapiens
gcagtcctctcattggcctcct

SEQ ID NO: 7778114 - DNA, 22 bp, Homo sapiens
gcagtcctctcattggcctcct

SEQ ID NO: 7778115 - DNA, 22 bp, Homo sapiens
gcagtcctcctgcctcagcctc

SEQ ID NO: 7778116 - DNA, 22 bp, Homo sapiens
gcagtcctcatcctttagcagt

SEQ ID NO: 7778117 - DNA, 22 bp, Homo sapiens
gcatgatgaaggaggaggagtc

SEQ ID NO: 7778118 - DNA, 22 bp, Homo sapiens
gcatgaggttcttggccagcat

SEQ ID NO: 7778119 - DNA, 19 bp, Homo sapiens
gcatctgcatgatggggtt

SEQ ID NO: 7778120 - DNA, 22 bp, Homo sapiens
gcatcttcacacaaagccagtg

SEQ ID NO: 7778121 - DNA, 21 bp, Homo sapiens
gcatgaaaacagcctgtgctc

SEQ ID NO: 7778122 - DNA, 19 bp, Homo sapiens
gcatttctctttacagcca

SEQ ID NO: 7778123 - DNA, 19 bp, Homo sapiens
gcatttctctttacagcca

SEQ ID NO: 7778124 - DNA, 22 bp, Homo sapiens
gcatttctgtgcatacacatga

SEQ ID NO: 7778125 - DNA, 22 bp, Homo sapiens
gcatgcaaatagtcatgcttcc

SEQ ID NO: 7778126 - DNA, 22 bp, Homo sapiens
gcatgcaactcccagttctgcc

SEQ ID NO: 7778127 - DNA, 23 bp, Homo sapiens
gcatgcaaagaatataggtgttc

SEQ ID NO: 7778128 - DNA, 22 bp, Homo sapiens
gcatgcaaaaaatgtatttgtt

SEQ ID NO: 7778129 - DNA, 22 bp, Homo sapiens
gcatctaaggtggataacttct

SEQ ID NO: 7778130 - DNA, 22 bp, Homo sapiens
gcatcctggctctaggtgtcat

SEQ ID NO: 7778131 - DNA, 22 bp, Homo sapiens
gcatcctggctctaggtgtcat

SEQ ID NO: 7778132 - DNA, 22 bp, Homo sapiens
gcataattaaacaggcaagatt

SEQ ID NO: 7778133 - DNA, 22 bp, Homo sapiens
ggtagggaaggctctgcgggga

SEQ ID NO: 7778134 - DNA, 22 bp, Homo sapiens
ggtcaggaaaagactccccaga

SEQ ID NO: 7778135 - DNA, 22 bp, Homo sapiens
ggtcagccttggatttggtagc

SEQ ID NO: 7778136 - DNA, 22 bp, Homo sapiens
ggtagactgagctccttgagga

SEQ ID NO: 7778137 - DNA, 22 bp, Homo sapiens
ggtaggagtattttgcagcagt

SEQ ID NO: 7778138 - DNA, 22 bp, Homo sapiens
ggtccaggtatgtggtgtgaat

SEQ ID NO: 7778139 - DNA, 22 bp, Homo sapiens
ggtccaggatcaaggcatcacc

SEQ ID NO: 7778140 - DNA, 22 bp, Homo sapiens
ggtcagggggatctgtgaggta

SEQ ID NO: 7778141 - DNA, 22 bp, Homo sapiens
ggtaactgaggccatattctga

SEQ ID NO: 7778142 - DNA, 22 bp, Homo sapiens
gggtccagatggtgagagttaa

SEQ ID NO: 7778143 - DNA, 22 bp, Homo sapiens
ggtaccaccaattcagctgcca

SEQ ID NO: 7778144 - DNA, 22 bp, Homo sapiens
ggtaccaccaattcagctgcca

SEQ ID NO: 7778145 - DNA, 22 bp, Homo sapiens
ggtaccaccaattcagctgcca

SEQ ID NO: 7778146 - DNA, 22 bp, Homo sapiens
gggtcaggcctcaaggtgggct

SEQ ID NO: 7778147 - DNA, 22 bp, Homo sapiens
gggtcaggcctcaaggtgggct

SEQ ID NO: 7778148 - DNA, 23 bp, Homo sapiens
gggtccagagacaggcatgggtg

SEQ ID NO: 7778149 - DNA, 23 bp, Homo sapiens
gggtccagagaagccattagggc

SEQ ID NO: 7778150 - DNA, 23 bp, Homo sapiens
gggtccagagacaggcatgggtg

SEQ ID NO: 7778151 - DNA, 22 bp, Homo sapiens
gggtccagagttgaagaggtta

SEQ ID NO: 7778152 - DNA, 22 bp, Homo sapiens
gggtccagagttgaagaggtta

SEQ ID NO: 7778153 - DNA, 22 bp, Homo sapiens
gggtccagagcctcagcccaga

SEQ ID NO: 7778154 - DNA, 22 bp, Homo sapiens
gggtccagaatgagaatgggct

SEQ ID NO: 7778155 - DNA, 22 bp, Homo sapiens
gggtccagacactccagaggaa

SEQ ID NO: 7778156 - DNA, 22 bp, Homo sapiens
gggtccagacactccagaggaa

SEQ ID NO: 7778157 - DNA, 22 bp, Homo sapiens
ggtgccagagtggcccaggggc

SEQ ID NO: 7778158 - DNA, 22 bp, Homo sapiens
ggtgccagagtggcccaggggc

SEQ ID NO: 7778159 - DNA, 22 bp, Homo sapiens
ggtgccagcctagtgcagtggt

SEQ ID NO: 7778160 - DNA, 22 bp, Homo sapiens
ggtgccaggctgtagtcagggt

SEQ ID NO: 7778161 - DNA, 22 bp, Homo sapiens
ggtgcggagactccatgaggcc

SEQ ID NO: 7778162 - DNA, 22 bp, Homo sapiens
ggtgggaggcaggctgctccca

SEQ ID NO: 7778163 - DNA, 22 bp, Homo sapiens
ggtgggagccaacacccttctg

SEQ ID NO: 7778164 - DNA, 22 bp, Homo sapiens
ggtgggagccaacacccttctg

SEQ ID NO: 7778165 - DNA, 22 bp, Homo sapiens
ggtgggagtgggcacagttacg

SEQ ID NO: 7778166 - DNA, 22 bp, Homo sapiens
ggtgggagtggaacgtggaaga

SEQ ID NO: 7778167 - DNA, 16 bp, Homo sapiens
ggtgggaggtgaggtg

SEQ ID NO: 7778168 - DNA, 22 bp, Homo sapiens
ggtgggcaacatttggcctgag

SEQ ID NO: 7778169 - DNA, 21 bp, Homo sapiens
ggtgggcacaggagagcagag

SEQ ID NO: 7778170 - DNA, 22 bp, Homo sapiens
ggtcccagaattggttagcaca

SEQ ID NO: 7778171 - DNA, 22 bp, Homo sapiens
ggtgaagggccttaggagacag

SEQ ID NO: 7778172 - DNA, 22 bp, Homo sapiens
ggtgaaggtcagagcaggaaaa

SEQ ID NO: 7778173 - DNA, 22 bp, Homo sapiens
ggtgcatgtgagaaagactggg

SEQ ID NO: 7778174 - DNA, 22 bp, Homo sapiens
ggtgcagtggtgtggcaaaggg

SEQ ID NO: 7778175 - DNA, 20 bp, Homo sapiens
ggtgcaggtaacgctgtgct

SEQ ID NO: 7778176 - DNA, 20 bp, Homo sapiens
ggtgcaggtaacgctgtgct

SEQ ID NO: 7778177 - DNA, 22 bp, Homo sapiens
gggggagaagattctgctgctt

SEQ ID NO: 7778178 - DNA, 22 bp, Homo sapiens
gggggaaagtggaggttcgtga

SEQ ID NO: 7778179 - DNA, 22 bp, Homo sapiens
gggggaaagctcaggagcctgt

SEQ ID NO: 7778180 - DNA, 22 bp, Homo sapiens
gggggctaccgtctctggagct

SEQ ID NO: 7778181 - DNA, 18 bp, Homo sapiens
gggtatccagaactggtc

SEQ ID NO: 7778182 - DNA, 22 bp, Homo sapiens
ggggatggtgggaaggcaatct

SEQ ID NO: 7778183 - DNA, 22 bp, Homo sapiens
ggggcacacttttggtagatat

SEQ ID NO: 7778184 - DNA, 22 bp, Homo sapiens
ggggatggtagaccggtgacgt

SEQ ID NO: 7778185 - DNA, 22 bp, Homo sapiens
ggggatggtgggaaggcaatct

SEQ ID NO: 7778186 - DNA, 22 bp, Homo sapiens
ggggatggaatgtagtagtgat

SEQ ID NO: 7778187 - DNA, 22 bp, Homo sapiens
ggggatggaggcgtgtggtcct

SEQ ID NO: 7778188 - DNA, 22 bp, Homo sapiens
gggctgggatggcttgaagatt

SEQ ID NO: 7778189 - DNA, 22 bp, Homo sapiens
gggctggctctgtctagaaagg

SEQ ID NO: 7778190 - DNA, 22 bp, Homo sapiens
gggctggctgattttcctctct

SEQ ID NO: 7778191 - DNA, 22 bp, Homo sapiens
gggctgggcatggtgttccctc

SEQ ID NO: 7778192 - DNA, 22 bp, Homo sapiens
gggctctaggccaagagtcccg

SEQ ID NO: 7778193 - DNA, 22 bp, Homo sapiens
gggctggctcccaggtgttgaa

SEQ ID NO: 7778194 - DNA, 22 bp, Homo sapiens
gggctggctcccaggtgttgaa

SEQ ID NO: 7778195 - DNA, 22 bp, Homo sapiens
gggctggctcccaggtgttgaa

SEQ ID NO: 7778196 - DNA, 20 bp, Homo sapiens
gggctggctcaactggatcc

SEQ ID NO: 7778197 - DNA, 22 bp, Homo sapiens
gggctggctaagacttttctgt

SEQ ID NO: 7778198 - DNA, 20 bp, Homo sapiens
gggctggcgcatggggaaag

SEQ ID NO: 7778199 - DNA, 22 bp, Homo sapiens
gggctggcgggaaaggcaattc

SEQ ID NO: 7778200 - DNA, 22 bp, Homo sapiens
gggctccagcccgggaccaggt

SEQ ID NO: 7778201 - DNA, 22 bp, Homo sapiens
gggcctccgtgtgctggtgctc

SEQ ID NO: 7778202 - DNA, 22 bp, Homo sapiens
gggcctcagctctgctctgcaa

SEQ ID NO: 7778203 - DNA, 22 bp, Homo sapiens
gggcatctggtggagcctcagg

SEQ ID NO: 7778204 - DNA, 22 bp, Homo sapiens
gggcagtgttgtggttctctat

SEQ ID NO: 7778205 - DNA, 22 bp, Homo sapiens
gggcatgagaggcaggcaagtg

SEQ ID NO: 7778206 - DNA, 22 bp, Homo sapiens
gggcctgcaggttctgagaggc

SEQ ID NO: 7778207 - DNA, 22 bp, Homo sapiens
gggcctgccattgctgccccag

SEQ ID NO: 7778208 - DNA, 22 bp, Homo sapiens
gggcctgctccccatcgctgct

SEQ ID NO: 7778209 - DNA, 21 bp, Homo sapiens
gggcctggctgcgcaggacgg

SEQ ID NO: 7778210 - DNA, 21 bp, Homo sapiens
gggcctggctgcgcaggacgg

SEQ ID NO: 7778211 - DNA, 22 bp, Homo sapiens
gtaataggttttcttgctccag

SEQ ID NO: 7778212 - DNA, 17 bp, Homo sapiens
gtaatataataagcctt

SEQ ID NO: 7778213 - DNA, 22 bp, Homo sapiens
gtaatctcagctacttgggagg

SEQ ID NO: 7778214 - DNA, 22 bp, Homo sapiens
gtaacaaaggataacttggttt

SEQ ID NO: 7778215 - DNA, 22 bp, Homo sapiens
gtaaatgtttgctgatgattct

SEQ ID NO: 7778216 - DNA, 22 bp, Homo sapiens
gtaaatgtgctaaaatgtgtcg

SEQ ID NO: 7778217 - DNA, 22 bp, Homo sapiens
ggtgggcaggcgaggcccaggt

SEQ ID NO: 7778218 - DNA, 22 bp, Homo sapiens
gtaggaagctctgaggctagtt

SEQ ID NO: 7778219 - DNA, 22 bp, Homo sapiens
gtagcggttatgtctgcaggga

SEQ ID NO: 7778220 - DNA, 22 bp, Homo sapiens
gtagctctgtttaaagttcttt

SEQ ID NO: 7778221 - DNA, 22 bp, Homo sapiens
gtcaataagtttgtaactggat

SEQ ID NO: 7778222 - DNA, 19 bp, Homo sapiens
gtcaataaaagttaggggt

SEQ ID NO: 7778223 - DNA, 22 bp, Homo sapiens
gtcaataattttatggagagaa

SEQ ID NO: 7778224 - DNA, 22 bp, Homo sapiens
gtcaataattgatagatattgg

SEQ ID NO: 7778225 - DNA, 22 bp, Homo sapiens
gtcaagttaagataaggtcatg

SEQ ID NO: 7778226 - DNA, 22 bp, Homo sapiens
gtcaagtttatccgctcattca

SEQ ID NO: 7778227 - DNA, 22 bp, Homo sapiens
gtcaagtcatgactcaaaggaa

SEQ ID NO: 7778228 - DNA, 22 bp, Homo sapiens
gtcaactttaagatgatctttt

SEQ ID NO: 7778229 - DNA, 22 bp, Homo sapiens
gtcaactttttcatagctctgc

SEQ ID NO: 7778230 - DNA, 22 bp, Homo sapiens
gtcaacttgcaagatgctgggc

SEQ ID NO: 7778231 - DNA, 22 bp, Homo sapiens
gtagaggggtgattctgtgaga

SEQ ID NO: 7778232 - DNA, 22 bp, Homo sapiens
gtagaggctgaaatctgagggc

SEQ ID NO: 7778233 - DNA, 22 bp, Homo sapiens
gtctcctccctttcattcacct

SEQ ID NO: 7778234 - DNA, 22 bp, Homo sapiens
gtcctctgcccaggtcaaggtt

SEQ ID NO: 7778235 - DNA, 22 bp, Homo sapiens
gtctcccatcgtttgtgaggaa

SEQ ID NO: 7778236 - DNA, 22 bp, Homo sapiens
gtcattgcagtggcaaatcaca

SEQ ID NO: 7778237 - DNA, 22 bp, Homo sapiens
gtccctggagctgagcagtgct

SEQ ID NO: 7778238 - DNA, 22 bp, Homo sapiens
gtccctggatctgggacagctg

SEQ ID NO: 7778239 - DNA, 22 bp, Homo sapiens
gtccctggagctgagcagtgct

SEQ ID NO: 7778240 - DNA, 22 bp, Homo sapiens
gtcaggggccatgggccaagga

SEQ ID NO: 7778241 - DNA, 22 bp, Homo sapiens
gtcaggggatgtgctggtggcc

SEQ ID NO: 7778242 - DNA, 22 bp, Homo sapiens
gtcagtgtcttaacagagatta

SEQ ID NO: 7778243 - DNA, 22 bp, Homo sapiens
gtcagtgtagcaggtgcaagcc

SEQ ID NO: 7778244 - DNA, 22 bp, Homo sapiens
gtcagtgtaggttcatcagtgg

SEQ ID NO: 7778245 - DNA, 22 bp, Homo sapiens
gtcattcttaacaactcagtag

SEQ ID NO: 7778246 - DNA, 22 bp, Homo sapiens
gtcattctctggtgtggttgtt

SEQ ID NO: 7778247 - DNA, 22 bp, Homo sapiens
gtcataaaaggaccacctattg

SEQ ID NO: 7778248 - DNA, 22 bp, Homo sapiens
gtcagtgttataagtttagcca

SEQ ID NO: 7778249 - DNA, 22 bp, Homo sapiens
gtcagtgtggttgctggcttgg

SEQ ID NO: 7778250 - DNA, 22 bp, Homo sapiens
gtcagtgtttaacaaccagctc

SEQ ID NO: 7778251 - DNA, 22 bp, Homo sapiens
gtcagtgtgagttgattccata

SEQ ID NO: 7778252 - DNA, 22 bp, Homo sapiens
gtcagtgtgagataatcttgga

SEQ ID NO: 7778253 - DNA, 20 bp, Homo sapiens
gtcagtgtcttcagtagtga

SEQ ID NO: 7778254 - DNA, 22 bp, Homo sapiens
gtgctgggccctgagaccaggg

SEQ ID NO: 7778255 - DNA, 22 bp, Homo sapiens
gtgctgggattacaggtgtgag

SEQ ID NO: 7778256 - DNA, 22 bp, Homo sapiens
gtgctgggattacaggtgtgag

SEQ ID NO: 7778257 - DNA, 22 bp, Homo sapiens
gtgctgggggtttctgtaggtc

SEQ ID NO: 7778258 - DNA, 22 bp, Homo sapiens
gtgctggggagataggaagaga

SEQ ID NO: 7778259 - DNA, 22 bp, Homo sapiens
gtgctggggagataggaagaga

SEQ ID NO: 7778260 - DNA, 22 bp, Homo sapiens
gtgctggggagataggaagaga

SEQ ID NO: 7778261 - DNA, 22 bp, Homo sapiens
gtgctgggggtttctgtaggtc

SEQ ID NO: 7778262 - DNA, 22 bp, Homo sapiens
gtgctgggtgctgcagacaggt

SEQ ID NO: 7778263 - DNA, 22 bp, Homo sapiens
gtgcttgcagtgagatgagatg

SEQ ID NO: 7778264 - DNA, 22 bp, Homo sapiens
gtgcctctgagctctgctacag

SEQ ID NO: 7778265 - DNA, 21 bp, Homo sapiens
gtgccctgttcccacatgccc

SEQ ID NO: 7778266 - DNA, 23 bp, Homo sapiens
gtgccgacgctccagcaccatcc

SEQ ID NO: 7778267 - DNA, 22 bp, Homo sapiens
gtgcccaggtgtccctgagaag

SEQ ID NO: 7778268 - DNA, 22 bp, Homo sapiens
gtgcccaggggccagctgccgg

SEQ ID NO: 7778269 - DNA, 22 bp, Homo sapiens
gtgcaatattgccatgttcttg

SEQ ID NO: 7778270 - DNA, 22 bp, Homo sapiens
gtgcaaatgtaattgtgatttt

SEQ ID NO: 7778271 - DNA, 22 bp, Homo sapiens
gtgcaaatgtaattgtggtttt

SEQ ID NO: 7778272 - DNA, 22 bp, Homo sapiens
gtgcaaattccactggaaagct

SEQ ID NO: 7778273 - DNA, 22 bp, Homo sapiens
gtgattctgcctggaaggtcct

SEQ ID NO: 7778274 - DNA, 22 bp, Homo sapiens
gtgattcaaatgtaactaatta

SEQ ID NO: 7778275 - DNA, 22 bp, Homo sapiens
gtgattcattcgattagtattt

SEQ ID NO: 7778276 - DNA, 22 bp, Homo sapiens
gtgattcatcctggcattcatt

SEQ ID NO: 7778277 - DNA, 22 bp, Homo sapiens
gtcttctgtttactttgaagtt

SEQ ID NO: 7778278 - DNA, 22 bp, Homo sapiens
gtgaggcagggaaagaggataa

SEQ ID NO: 7778279 - DNA, 22 bp, Homo sapiens
gtgaggctactcagctgtccga

SEQ ID NO: 7778280 - DNA, 16 bp, Homo sapiens
gtgagggacatagctt

SEQ ID NO: 7778281 - DNA, 22 bp, Homo sapiens
gtgaggtgggctggccagagac

SEQ ID NO: 7778282 - DNA, 22 bp, Homo sapiens
gtgaggtgggctgggctctatg

SEQ ID NO: 7778283 - DNA, 22 bp, Homo sapiens
gtgatcttgtaattgggcaatg

SEQ ID NO: 7778284 - DNA, 22 bp, Homo sapiens
gtgataaaatagaaacagtggt

SEQ ID NO: 7778285 - DNA, 22 bp, Homo sapiens
gtgagttactctggttctcatt

SEQ ID NO: 7778286 - DNA, 22 bp, Homo sapiens
gtgataaaattcaaatagctct

SEQ ID NO: 7778287 - DNA, 22 bp, Homo sapiens
gtctcctggaaatatgcccata

SEQ ID NO: 7778288 - DNA, 22 bp, Homo sapiens
gtctcctggctgcagctaagac

SEQ ID NO: 7778289 - DNA, 22 bp, Homo sapiens
gtctctatcatagctgaaccct

SEQ ID NO: 7778290 - DNA, 22 bp, Homo sapiens
gtctctctgactggtccacacc

SEQ ID NO: 7778291 - DNA, 23 bp, Homo sapiens
gtctctagagtgtggagcaaaga

SEQ ID NO: 7778292 - DNA, 22 bp, Homo sapiens
gtctctatcatagctgaaccct

SEQ ID NO: 7778293 - DNA, 22 bp, Homo sapiens
gtcttattaggttaaccctgct

SEQ ID NO: 7778294 - DNA, 22 bp, Homo sapiens
gtcttatagtacaatttgaagt

SEQ ID NO: 7778295 - DNA, 22 bp, Homo sapiens
gtcttcattcaacaaatattca

SEQ ID NO: 7778296 - DNA, 22 bp, Homo sapiens
gggagctgagctctgagccacg

SEQ ID NO: 7778297 - DNA, 22 bp, Homo sapiens
gggagctgagctggaagagaat

SEQ ID NO: 7778298 - DNA, 22 bp, Homo sapiens
gggaagtgatggagccaggatt

SEQ ID NO: 7778299 - DNA, 22 bp, Homo sapiens
gggaagtgagctggaatcaagg

SEQ ID NO: 7778300 - DNA, 22 bp, Homo sapiens
ggctttgacatgctgaattaaa

SEQ ID NO: 7778301 - DNA, 22 bp, Homo sapiens
gggaaggctgcctgagggatgg

SEQ ID NO: 7778302 - DNA, 22 bp, Homo sapiens
gggaaggctgcctgagggatgg

SEQ ID NO: 7778303 - DNA, 22 bp, Homo sapiens
gggaagggacttgtttaaggtc

SEQ ID NO: 7778304 - DNA, 22 bp, Homo sapiens
ggctgtgcctctggcagcacat

SEQ ID NO: 7778305 - DNA, 22 bp, Homo sapiens
ggctgtgcctcaaggctactca

SEQ ID NO: 7778306 - DNA, 22 bp, Homo sapiens
gggaggtgatggcaagcagcgg

SEQ ID NO: 7778307 - DNA, 22 bp, Homo sapiens
gggcacaggagaaggatctggc

SEQ ID NO: 7778308 - DNA, 22 bp, Homo sapiens
gggaggtgattaggaccatgta

SEQ ID NO: 7778309 - DNA, 22 bp, Homo sapiens
gggagggaggtgatgcttggct

SEQ ID NO: 7778310 - DNA, 22 bp, Homo sapiens
gggcaggttattggagtaggga

SEQ ID NO: 7778311 - DNA, 22 bp, Homo sapiens
gggcagtgaatattggtgggaa

SEQ ID NO: 7778312 - DNA, 22 bp, Homo sapiens
gggcagtgacaaaggggatgaa

SEQ ID NO: 7778313 - DNA, 22 bp, Homo sapiens
gggcagtgaatattggtgggaa

SEQ ID NO: 7778314 - DNA, 19 bp, Homo sapiens
gggcagtggcactagggag

SEQ ID NO: 7778315 - DNA, 22 bp, Homo sapiens
gggcagtgacaaaggggatgaa

SEQ ID NO: 7778316 - DNA, 22 bp, Homo sapiens
gggcaccagcggccgcactgcc

SEQ ID NO: 7778317 - DNA, 22 bp, Homo sapiens
gggcaccttgggtctcaggcaa

SEQ ID NO: 7778318 - DNA, 20 bp, Homo sapiens
ggctggaagtgtgggtttgg

SEQ ID NO: 7778319 - DNA, 22 bp, Homo sapiens
ggctggacatagacatagccat

SEQ ID NO: 7778320 - DNA, 22 bp, Homo sapiens
ggctgctggggacgtgggagag

SEQ ID NO: 7778321 - DNA, 20 bp, Homo sapiens
ggctgctgtgggcagagagg

SEQ ID NO: 7778322 - DNA, 18 bp, Homo sapiens
ggctgaggttgactagaa

SEQ ID NO: 7778323 - DNA, 22 bp, Homo sapiens
ggctgagggccagggctagtct

SEQ ID NO: 7778324 - DNA, 22 bp, Homo sapiens
ggctgagggtcccagaccctaa

SEQ ID NO: 7778325 - DNA, 22 bp, Homo sapiens
ggctgagggtatagctgtccca

SEQ ID NO: 7778326 - DNA, 22 bp, Homo sapiens
ggctgtgcagggcagagtctca

SEQ ID NO: 7778327 - DNA, 21 bp, Homo sapiens
ggctggtcgcgtgcatgtctc

SEQ ID NO: 7778328 - DNA, 21 bp, Homo sapiens
ggctgggtcatgcagctggcc

SEQ ID NO: 7778329 - DNA, 22 bp, Homo sapiens
ggctgggtcccagctgggagga

SEQ ID NO: 7778330 - DNA, 22 bp, Homo sapiens
ggctgggtcccagctgggagga

SEQ ID NO: 7778331 - DNA, 22 bp, Homo sapiens
ggctggactttctgctgggctc

SEQ ID NO: 7778332 - DNA, 22 bp, Homo sapiens
ggctggaccatgctgccccttc

SEQ ID NO: 7778333 - DNA, 19 bp, Homo sapiens
ggctggagaaaggaatcag

SEQ ID NO: 7778334 - DNA, 22 bp, Homo sapiens
ggctacagtggcactgggcttt

SEQ ID NO: 7778335 - DNA, 22 bp, Homo sapiens
ggctagagtggaactggagcgg

SEQ ID NO: 7778336 - DNA, 23 bp, Homo sapiens
ggctagagtggaggggaactgca

SEQ ID NO: 7778337 - DNA, 22 bp, Homo sapiens
ggctaggcctcaggcctgcctg

SEQ ID NO: 7778338 - DNA, 22 bp, Homo sapiens
ggctacagaggccgtgagcctg

SEQ ID NO: 7778339 - DNA, 22 bp, Homo sapiens
ggcggtggttgagaggacggcg

SEQ ID NO: 7778340 - DNA, 22 bp, Homo sapiens
ggcggtggttgagaggacggcg

SEQ ID NO: 7778341 - DNA, 22 bp, Homo sapiens
ggctccagggagtggagagaag

SEQ ID NO: 7778342 - DNA, 22 bp, Homo sapiens
ggctcccaggagggcctggagg

SEQ ID NO: 7778343 - DNA, 22 bp, Homo sapiens
ggctccagtttgtgccttcagc

SEQ ID NO: 7778344 - DNA, 17 bp, Homo sapiens
ggctccctgactatgga

SEQ ID NO: 7778345 - DNA, 22 bp, Homo sapiens
ggctccctgcaacctccgcctc

SEQ ID NO: 7778346 - DNA, 22 bp, Homo sapiens
ggctccctgcctgtcctcagtc

SEQ ID NO: 7778347 - DNA, 22 bp, Homo sapiens
ggctctgggttctgcaatgcgt

SEQ ID NO: 7778348 - DNA, 17 bp, Homo sapiens
ggctctgggtgtcacat

SEQ ID NO: 7778349 - DNA, 22 bp, Homo sapiens
ggctctgggtctgtggggagcg

SEQ ID NO: 7778350 - DNA, 23 bp, Homo sapiens
ggctctgtgctgggcctgcagga

SEQ ID NO: 7778351 - DNA, 22 bp, Homo sapiens
ggctgaggctcatgccatcttg

SEQ ID NO: 7778352 - DNA, 22 bp, Homo sapiens
ggctccctgggtgctcctgctc

SEQ ID NO: 7778353 - DNA, 23 bp, Homo sapiens
ggcctggcccagggccctgatga

SEQ ID NO: 7778354 - DNA, 22 bp, Homo sapiens
ggcctggcctccagatgtgggc

SEQ ID NO: 7778355 - DNA, 22 bp, Homo sapiens
ggcggtctcagcaccctcttgg

SEQ ID NO: 7778356 - DNA, 22 bp, Homo sapiens
ggcggtggcgtgaaggtggctg

SEQ ID NO: 7778357 - DNA, 19 bp, Homo sapiens
ggcctggctatccctgctg

SEQ ID NO: 7778358 - DNA, 22 bp, Homo sapiens
ggcctgcctcacagtcagcacc

SEQ ID NO: 7778359 - DNA, 22 bp, Homo sapiens
ggcctcagaccggagctggcca

SEQ ID NO: 7778360 - DNA, 22 bp, Homo sapiens
ggcctgctaacctgaaacggag

SEQ ID NO: 7778361 - DNA, 22 bp, Homo sapiens
ggcctgctgcagtgtgacagtt

SEQ ID NO: 7778362 - DNA, 22 bp, Homo sapiens
ggcctgctgggccccacagtcc

SEQ ID NO: 7778363 - DNA, 22 bp, Homo sapiens
ggcctagggagtggccatgcct

SEQ ID NO: 7778364 - DNA, 22 bp, Homo sapiens
ggccctgggccctctagcttgt

SEQ ID NO: 7778365 - DNA, 22 bp, Homo sapiens
ggccctgggacacaacaccgaa

SEQ ID NO: 7778366 - DNA, 22 bp, Homo sapiens
ggccaggagaggagggcactga

SEQ ID NO: 7778367 - DNA, 22 bp, Homo sapiens
ggccaggagcaagccaggctct

SEQ ID NO: 7778368 - DNA, 22 bp, Homo sapiens
ggccctgctcaggctgcgatga

SEQ ID NO: 7778369 - DNA, 18 bp, Homo sapiens
ggcaggagcaagaatagg

SEQ ID NO: 7778370 - DNA, 22 bp, Homo sapiens
ggcaggaggaagagttagcacc

SEQ ID NO: 7778371 - DNA, 22 bp, Homo sapiens
ggcaggggttcattttgtctta

SEQ ID NO: 7778372 - DNA, 22 bp, Homo sapiens
ggcaggggtggccttcctttgg

SEQ ID NO: 7778373 - DNA, 22 bp, Homo sapiens
ggcaggggtgaggccactctga

SEQ ID NO: 7778374 - DNA, 22 bp, Homo sapiens
ggcagggtaaaccgaggtaagt

SEQ ID NO: 7778375 - DNA, 22 bp, Homo sapiens
ggcagggtatgattacctctga

SEQ ID NO: 7778376 - DNA, 22 bp, Homo sapiens
ggcaggggttcattttgtctta

SEQ ID NO: 7778377 - DNA, 22 bp, Homo sapiens
ggcagggtgcctggctcctgtt

SEQ ID NO: 7778378 - DNA, 22 bp, Homo sapiens
ggcagggtctggactgaaagct

SEQ ID NO: 7778379 - DNA, 22 bp, Homo sapiens
ggcagggtccacacctgggaaa

SEQ ID NO: 7778380 - DNA, 17 bp, Homo sapiens
ggcagggtgctgggtat

SEQ ID NO: 7778381 - DNA, 17 bp, Homo sapiens
ggcagggtgctgggtat

SEQ ID NO: 7778382 - DNA, 22 bp, Homo sapiens
ggcagggtggccctccagtgag

SEQ ID NO: 7778383 - DNA, 22 bp, Homo sapiens
ggcagggtggcagaggctcaga

SEQ ID NO: 7778384 - DNA, 22 bp, Homo sapiens
ggcagggtttctccattctgcc

SEQ ID NO: 7778385 - DNA, 22 bp, Homo sapiens
ggcagggtttacaatagcaata

SEQ ID NO: 7778386 - DNA, 22 bp, Homo sapiens
ggcagggtgtggagttgggaca

SEQ ID NO: 7778387 - DNA, 22 bp, Homo sapiens
ggcagggtgtggagttgggaca

SEQ ID NO: 7778388 - DNA, 22 bp, Homo sapiens
ggcagggtttctccattctgcc

SEQ ID NO: 7778389 - DNA, 22 bp, Homo sapiens
ggcaggtagcctagaggaggtt

SEQ ID NO: 7778390 - DNA, 22 bp, Homo sapiens
ggcaggtgacggggatgagtat

SEQ ID NO: 7778391 - DNA, 22 bp, Homo sapiens
ggcatcttgttgctcaaatcta

SEQ ID NO: 7778392 - DNA, 22 bp, Homo sapiens
ggcatcttgttgctcaaatcta

SEQ ID NO: 7778393 - DNA, 20 bp, Homo sapiens
ggcatgagatgtgagggagg

SEQ ID NO: 7778394 - DNA, 21 bp, Homo sapiens
ggcatgagggcagtgagcaga

SEQ ID NO: 7778395 - DNA, 22 bp, Homo sapiens
ggcatgagtaacgtgagtgagg

SEQ ID NO: 7778396 - DNA, 22 bp, Homo sapiens
ggccaggaacttttgggatggg

SEQ ID NO: 7778397 - DNA, 22 bp, Homo sapiens
ggccagcttattagctcagagg

SEQ ID NO: 7778398 - DNA, 22 bp, Homo sapiens
ggagatttatagcacacttcag

SEQ ID NO: 7778399 - DNA, 22 bp, Homo sapiens
ggagatgggggattttacagcg

SEQ ID NO: 7778400 - DNA, 22 bp, Homo sapiens
ggagatggctggcaggtagatg

SEQ ID NO: 7778401 - DNA, 22 bp, Homo sapiens
ggagaggcttggcccagcctgg

SEQ ID NO: 7778402 - DNA, 22 bp, Homo sapiens
ggatgcaggagttgaagaagga

SEQ ID NO: 7778403 - DNA, 22 bp, Homo sapiens
ggatgcaggagttgaagaagga

SEQ ID NO: 7778404 - DNA, 22 bp, Homo sapiens
ggatgcaggggcagcagagcct

SEQ ID NO: 7778405 - DNA, 22 bp, Homo sapiens
ggatgctggggaccaatctctg

SEQ ID NO: 7778406 - DNA, 18 bp, Homo sapiens
ggatgctgtgtgctcctt

SEQ ID NO: 7778407 - DNA, 23 bp, Homo sapiens
ggatggacgtgatgccttagcca

SEQ ID NO: 7778408 - DNA, 22 bp, Homo sapiens
ggatggaggttctcagatgctc

SEQ ID NO: 7778409 - DNA, 22 bp, Homo sapiens
ggatggaggttctcagatgctc

SEQ ID NO: 7778410 - DNA, 22 bp, Homo sapiens
ggatggcagtctgcatgagaaa

SEQ ID NO: 7778411 - DNA, 22 bp, Homo sapiens
ggatgggaacttggtagggcat

SEQ ID NO: 7778412 - DNA, 19 bp, Homo sapiens
ggcagaaggtgtaggggga

SEQ ID NO: 7778413 - DNA, 22 bp, Homo sapiens
ggcagaagataggacagggaat

SEQ ID NO: 7778414 - DNA, 22 bp, Homo sapiens
ggcagaagataggacagggaat

SEQ ID NO: 7778415 - DNA, 22 bp, Homo sapiens
ggcacttttctccccggtcatg

SEQ ID NO: 7778416 - DNA, 22 bp, Homo sapiens
ggcagaagaaaggctaagtctc

SEQ ID NO: 7778417 - DNA, 20 bp, Homo sapiens
ggcagcaggagtttcctctt

SEQ ID NO: 7778418 - DNA, 22 bp, Homo sapiens
ggcactgtgtacacacagagac

SEQ ID NO: 7778419 - DNA, 18 bp, Homo sapiens
ggcactggtgatgcagag

SEQ ID NO: 7778420 - DNA, 22 bp, Homo sapiens
ggcactgtttttgtattcagtt

SEQ ID NO: 7778421 - DNA, 22 bp, Homo sapiens
ggcactttccagtctatagagc

SEQ ID NO: 7778422 - DNA, 19 bp, Homo sapiens
ggcactggggccaggacca

SEQ ID NO: 7778423 - DNA, 18 bp, Homo sapiens
ggcactggtgatgcagag

SEQ ID NO: 7778424 - DNA, 22 bp, Homo sapiens
ggcactgggttgtaggaattaa

SEQ ID NO: 7778425 - DNA, 22 bp, Homo sapiens
ggcactgggcaccggctgaggg

SEQ ID NO: 7778426 - DNA, 22 bp, Homo sapiens
ggcagccagtagggccagcctg

SEQ ID NO: 7778427 - DNA, 22 bp, Homo sapiens
ggcagccatgctccaggtgcag

SEQ ID NO: 7778428 - DNA, 22 bp, Homo sapiens
ggcagcagggctgtctccctac

SEQ ID NO: 7778429 - DNA, 22 bp, Homo sapiens
ggcagctgtttgtcctcctgtt

SEQ ID NO: 7778430 - DNA, 22 bp, Homo sapiens
ggcagctgttggctctctagga

SEQ ID NO: 7778431 - DNA, 22 bp, Homo sapiens
ggcagctgttggctctctagga

SEQ ID NO: 7778432 - DNA, 23 bp, Homo sapiens
ggcagcttatactttcatagaca

SEQ ID NO: 7778433 - DNA, 22 bp, Homo sapiens
ggcagcttcctgagccagcagc

SEQ ID NO: 7778434 - DNA, 22 bp, Homo sapiens
ggcagcttcttaatatggagac

SEQ ID NO: 7778435 - DNA, 22 bp, Homo sapiens
ggcagcttgtccttcaggagag

SEQ ID NO: 7778436 - DNA, 22 bp, Homo sapiens
ggcagctttcaatagggttatg

SEQ ID NO: 7778437 - DNA, 22 bp, Homo sapiens
ggcagctttcacctgtcttcct

SEQ ID NO: 7778438 - DNA, 22 bp, Homo sapiens
ggcagctttctcacccatgacc

SEQ ID NO: 7778439 - DNA, 22 bp, Homo sapiens
cttacaacttgtatgtgattgt

SEQ ID NO: 7778440 - DNA, 22 bp, Homo sapiens
cttacatactgagaaaatatcc

SEQ ID NO: 7778441 - DNA, 22 bp, Homo sapiens
cttacatatgcaagacaaaggg

SEQ ID NO: 7778442 - DNA, 22 bp, Homo sapiens
cttagaaatgcagattctcagg

SEQ ID NO: 7778443 - DNA, 22 bp, Homo sapiens
cttacaaatacacttaggagag

SEQ ID NO: 7778444 - DNA, 22 bp, Homo sapiens
cttaatttcaaactgctagtga

SEQ ID NO: 7778445 - DNA, 22 bp, Homo sapiens
cttacaaaggagaggagatagg

SEQ ID NO: 7778446 - DNA, 22 bp, Homo sapiens
cttacaaaggagaggagatagg

SEQ ID NO: 7778447 - DNA, 22 bp, Homo sapiens
cttaaagatgtcaaggctgttt

SEQ ID NO: 7778448 - DNA, 22 bp, Homo sapiens
cttaaagagtatttaatataat

SEQ ID NO: 7778449 - DNA, 22 bp, Homo sapiens
cttaaagtctatcctttctaga

SEQ ID NO: 7778450 - DNA, 22 bp, Homo sapiens
cttaaatccatcatttctaatc

SEQ ID NO: 7778451 - DNA, 22 bp, Homo sapiens
cttaaattcttaatgccctcat

SEQ ID NO: 7778452 - DNA, 22 bp, Homo sapiens
cttaaattttcatctacaagaa

SEQ ID NO: 7778453 - DNA, 22 bp, Homo sapiens
cttaaattttcatctacaagaa

SEQ ID NO: 7778454 - DNA, 22 bp, Homo sapiens
cttaaattggatgagttaagtt

SEQ ID NO: 7778455 - DNA, 22 bp, Homo sapiens
ctgttttatctcaagagttcaa

SEQ ID NO: 7778456 - DNA, 22 bp, Homo sapiens
ctgttttataaagtccaaaagt

SEQ ID NO: 7778457 - DNA, 22 bp, Homo sapiens
ctgttttaatggagactgatgt

SEQ ID NO: 7778458 - DNA, 22 bp, Homo sapiens
ctgttttccctggagttcagca

SEQ ID NO: 7778459 - DNA, 20 bp, Homo sapiens
ctgtttgctatcatgagctg

SEQ ID NO: 7778460 - DNA, 22 bp, Homo sapiens
cttaaaatctggcagttagcta

SEQ ID NO: 7778461 - DNA, 22 bp, Homo sapiens
ctgtttttcagaaggtaaggga

SEQ ID NO: 7778462 - DNA, 22 bp, Homo sapiens
ctgttttctagggctgaggtga

SEQ ID NO: 7778463 - DNA, 22 bp, Homo sapiens
ctgtttttgtgctgtgtctccc

SEQ ID NO: 7778464 - DNA, 22 bp, Homo sapiens
cttaaaagttgcttccctaact

SEQ ID NO: 7778465 - DNA, 22 bp, Homo sapiens
cttaaagaaattgaggagagga

SEQ ID NO: 7778466 - DNA, 22 bp, Homo sapiens
ctgtgcttgacagtgggaagca

SEQ ID NO: 7778467 - DNA, 22 bp, Homo sapiens
ctgtgcttgcgggtgtggagcc

SEQ ID NO: 7778468 - DNA, 22 bp, Homo sapiens
ctgtgcttgacagtgggaagca

SEQ ID NO: 7778469 - DNA, 22 bp, Homo sapiens
ctgtttaatgaggtgtaacaac

SEQ ID NO: 7778470 - DNA, 19 bp, Homo sapiens
ctgtttctgagcttgcttt

SEQ ID NO: 7778471 - DNA, 21 bp, Homo sapiens
ctgtttcttgtgaagtgacac

SEQ ID NO: 7778472 - DNA, 22 bp, Homo sapiens
ctgtttatccctttggtcagca

SEQ ID NO: 7778473 - DNA, 22 bp, Homo sapiens
ctgtttataaatagaggggagt

SEQ ID NO: 7778474 - DNA, 22 bp, Homo sapiens
ctgtttatacgacaggtggagg

SEQ ID NO: 7778475 - DNA, 22 bp, Homo sapiens
cttccagagttgcgttctcggt

SEQ ID NO: 7778476 - DNA, 22 bp, Homo sapiens
cttccagctgattacaggctat

SEQ ID NO: 7778477 - DNA, 22 bp, Homo sapiens
cttcgatttaattcttaacctt

SEQ ID NO: 7778478 - DNA, 22 bp, Homo sapiens
cttccagctgattggcatccag

SEQ ID NO: 7778479 - DNA, 22 bp, Homo sapiens
cttctcagcattttgtcagtct

SEQ ID NO: 7778480 - DNA, 23 bp, Homo sapiens
cttctcagtagtacacacactat

SEQ ID NO: 7778481 - DNA, 22 bp, Homo sapiens
cttctattcactggtcacagtt

SEQ ID NO: 7778482 - DNA, 22 bp, Homo sapiens
cttctattcactggtcacagtt

SEQ ID NO: 7778483 - DNA, 22 bp, Homo sapiens
cttctattttcatgcctgggtc

SEQ ID NO: 7778484 - DNA, 22 bp, Homo sapiens
cttctaattcttatgtaagctt

SEQ ID NO: 7778485 - DNA, 22 bp, Homo sapiens
cttctaggcttctcagggggca

SEQ ID NO: 7778486 - DNA, 22 bp, Homo sapiens
cttctagggcatcatgacaaat

SEQ ID NO: 7778487 - DNA, 22 bp, Homo sapiens
cttctaggtcttgattgaatgt

SEQ ID NO: 7778488 - DNA, 22 bp, Homo sapiens
cttctagagctggagcaaatgt

SEQ ID NO: 7778489 - DNA, 22 bp, Homo sapiens
cttctagagtaaggaacaaatg

SEQ ID NO: 7778490 - DNA, 22 bp, Homo sapiens
cttcatttcaggctgaagaata

SEQ ID NO: 7778491 - DNA, 22 bp, Homo sapiens
cttcagtgttggttcattacga

SEQ ID NO: 7778492 - DNA, 22 bp, Homo sapiens
cttcatttccatccaactggga

SEQ ID NO: 7778493 - DNA, 22 bp, Homo sapiens
cttatacaccctcttcccaggc

SEQ ID NO: 7778494 - DNA, 22 bp, Homo sapiens
cttttcctattgattctgttac

SEQ ID NO: 7778495 - DNA, 18 bp, Homo sapiens
cttttcccctttggactc

SEQ ID NO: 7778496 - DNA, 22 bp, Homo sapiens
ctttgcaggagtatgtgataat

SEQ ID NO: 7778497 - DNA, 22 bp, Homo sapiens
ctttgattcagagagaattagc

SEQ ID NO: 7778498 - DNA, 22 bp, Homo sapiens
ctttgcagatttgtttagtgct

SEQ ID NO: 7778499 - DNA, 22 bp, Homo sapiens
ctttgcagcaatttctgttaaa

SEQ ID NO: 7778500 - DNA, 22 bp, Homo sapiens
cttttgcacccagagttatttg

SEQ ID NO: 7778501 - DNA, 22 bp, Homo sapiens
gaaaatgttagcttcatagtca

SEQ ID NO: 7778502 - DNA, 22 bp, Homo sapiens
gaaaatgtttcctgttatttgc

SEQ ID NO: 7778503 - DNA, 22 bp, Homo sapiens
gaaaattattgaaaatggctct

SEQ ID NO: 7778504 - DNA, 22 bp, Homo sapiens
gaaaatacttcagtgttctggc

SEQ ID NO: 7778505 - DNA, 22 bp, Homo sapiens
gaaaatacttcagtgttctggc

SEQ ID NO: 7778506 - DNA, 22 bp, Homo sapiens
gaaaatacttcagtgttctggc

SEQ ID NO: 7778507 - DNA, 22 bp, Homo sapiens
cttttgcacccagagttatttg

SEQ ID NO: 7778508 - DNA, 22 bp, Homo sapiens
cttttgcaccttttaagtaatg

SEQ ID NO: 7778509 - DNA, 22 bp, Homo sapiens
cttttgcagccattattgctgc

SEQ ID NO: 7778510 - DNA, 22 bp, Homo sapiens
cttttgcagccattattgctgc

SEQ ID NO: 7778511 - DNA, 22 bp, Homo sapiens
cttttgcagccattattgctgc

SEQ ID NO: 7778512 - DNA, 22 bp, Homo sapiens
gaaacaactactattgatttct

SEQ ID NO: 7778513 - DNA, 22 bp, Homo sapiens
gaaaatttctgccacatgtgtg

SEQ ID NO: 7778514 - DNA, 22 bp, Homo sapiens
gaaacaatcatcatgtgatttg

SEQ ID NO: 7778515 - DNA, 22 bp, Homo sapiens
gaaacaatcatcatgtgatttg

SEQ ID NO: 7778516 - DNA, 22 bp, Homo sapiens
gaaaatttagaactgaacttct

SEQ ID NO: 7778517 - DNA, 22 bp, Homo sapiens
gaaaatttagaactgaacttct

SEQ ID NO: 7778518 - DNA, 22 bp, Homo sapiens
gaaaatttaattctcttctgtg

SEQ ID NO: 7778519 - DNA, 22 bp, Homo sapiens
gaaaattattgaaaatggctct

SEQ ID NO: 7778520 - DNA, 22 bp, Homo sapiens
gaaacactatgccaagacaggg

SEQ ID NO: 7778521 - DNA, 22 bp, Homo sapiens
gaaacaatttttgttgtctaag

SEQ ID NO: 7778522 - DNA, 22 bp, Homo sapiens
ctttgacatccttgttcctcag

SEQ ID NO: 7778523 - DNA, 22 bp, Homo sapiens
ctttgactccatctctctttgt

SEQ ID NO: 7778524 - DNA, 22 bp, Homo sapiens
ctttgatataagtatacatagt

SEQ ID NO: 7778525 - DNA, 22 bp, Homo sapiens
ctttgatctactcactaaacaa

SEQ ID NO: 7778526 - DNA, 22 bp, Homo sapiens
ctttgaaaacttaaataacagc

SEQ ID NO: 7778527 - DNA, 22 bp, Homo sapiens
ctttgaaaaatggtttcctaga

SEQ ID NO: 7778528 - DNA, 22 bp, Homo sapiens
ctttctttgtccaccaacaatg

SEQ ID NO: 7778529 - DNA, 22 bp, Homo sapiens
ctttctttgtccaccaacaatg

SEQ ID NO: 7778530 - DNA, 22 bp, Homo sapiens
ctttctttgcagtgagccagag

SEQ ID NO: 7778531 - DNA, 22 bp, Homo sapiens
ctttctttgcagtgagccagag

SEQ ID NO: 7778532 - DNA, 22 bp, Homo sapiens
ctttaaataatacaaggtccag

SEQ ID NO: 7778533 - DNA, 22 bp, Homo sapiens
ctttacaaactataaagtgcgg

SEQ ID NO: 7778534 - DNA, 22 bp, Homo sapiens
ctttacaaagcaattttgtctc

SEQ ID NO: 7778535 - DNA, 22 bp, Homo sapiens
ctttacaaagcaattttgtctc

SEQ ID NO: 7778536 - DNA, 22 bp, Homo sapiens
ctttacaaatagggagggagtg

SEQ ID NO: 7778537 - DNA, 22 bp, Homo sapiens
ctttacaaattagctctcggga

SEQ ID NO: 7778538 - DNA, 21 bp, Homo sapiens
cttgttttgaaaggactggcc

SEQ ID NO: 7778539 - DNA, 22 bp, Homo sapiens
cttgttttgaaagcagtggcca

SEQ ID NO: 7778540 - DNA, 22 bp, Homo sapiens
cttgttttcttctgcagtctat

SEQ ID NO: 7778541 - DNA, 22 bp, Homo sapiens
cttgttttctaaaacatcattt

SEQ ID NO: 7778542 - DNA, 22 bp, Homo sapiens
cttgtttttaagagatgtttac

SEQ ID NO: 7778543 - DNA, 22 bp, Homo sapiens
cttgtttttaagagatgtttac

SEQ ID NO: 7778544 - DNA, 22 bp, Homo sapiens
cttgttttggaacagagtgaat

SEQ ID NO: 7778545 - DNA, 22 bp, Homo sapiens
cttgttttggctagtatgatgt

SEQ ID NO: 7778546 - DNA, 22 bp, Homo sapiens
cttctgggtgtggagtgaggac

SEQ ID NO: 7778547 - DNA, 22 bp, Homo sapiens
cttctggcgttggaggtctgag

SEQ ID NO: 7778548 - DNA, 22 bp, Homo sapiens
cttctgaagaggttatcataga

SEQ ID NO: 7778549 - DNA, 22 bp, Homo sapiens
cttctgaatggctgtgtatgct

SEQ ID NO: 7778550 - DNA, 22 bp, Homo sapiens
cttctgaagtgtttgatgattg

SEQ ID NO: 7778551 - DNA, 22 bp, Homo sapiens
cttctggagctcaccaacttcc

SEQ ID NO: 7778552 - DNA, 22 bp, Homo sapiens
cttctggaggacactggcccca

SEQ ID NO: 7778553 - DNA, 22 bp, Homo sapiens
ctgggaagaagtgggctacatt

SEQ ID NO: 7778554 - DNA, 22 bp, Homo sapiens
ctgctgtgtggattcaatggct

SEQ ID NO: 7778555 - DNA, 20 bp, Homo sapiens
ctgctgtgttattgtagaac

SEQ ID NO: 7778556 - DNA, 22 bp, Homo sapiens
ctgctgtgttggcattggatag

SEQ ID NO: 7778557 - DNA, 22 bp, Homo sapiens
ctgctgtgtttctgctagaaaa

SEQ ID NO: 7778558 - DNA, 22 bp, Homo sapiens
ctgcttatggagatgagtaaga

SEQ ID NO: 7778559 - DNA, 22 bp, Homo sapiens
ctgggagatctcctgagggcag

SEQ ID NO: 7778560 - DNA, 22 bp, Homo sapiens
ctgggagatctgttgggactgg

SEQ ID NO: 7778561 - DNA, 22 bp, Homo sapiens
ctgggagattgctagagatgca

SEQ ID NO: 7778562 - DNA, 22 bp, Homo sapiens
ctgggacagctgagacaggaga

SEQ ID NO: 7778563 - DNA, 22 bp, Homo sapiens
ctgggacctcctgaggtggagc

SEQ ID NO: 7778564 - DNA, 22 bp, Homo sapiens
ctgggacctcctcactgttcta

SEQ ID NO: 7778565 - DNA, 22 bp, Homo sapiens
ctgggaccctgccctgtggcct

SEQ ID NO: 7778566 - DNA, 22 bp, Homo sapiens
ctgggacccccactgcgtagct

SEQ ID NO: 7778567 - DNA, 22 bp, Homo sapiens
ctgggaccatctgtgtctactt

SEQ ID NO: 7778568 - DNA, 22 bp, Homo sapiens
ctgggaccagtgaagcaactca

SEQ ID NO: 7778569 - DNA, 22 bp, Homo sapiens
ctgggacctgtgtgcctgggcc

SEQ ID NO: 7778570 - DNA, 22 bp, Homo sapiens
ctgggctggagtgcaatggcgc

SEQ ID NO: 7778571 - DNA, 22 bp, Homo sapiens
ctgggcctccagctctgccagc

SEQ ID NO: 7778572 - DNA, 22 bp, Homo sapiens
ctgggcagaattttaggatggc

SEQ ID NO: 7778573 - DNA, 22 bp, Homo sapiens
ctgggcagaattttaggatggc

SEQ ID NO: 7778574 - DNA, 22 bp, Homo sapiens
ctgggcagaattttaggatggc

SEQ ID NO: 7778575 - DNA, 22 bp, Homo sapiens
ctgggcagagctaacacctgag

SEQ ID NO: 7778576 - DNA, 22 bp, Homo sapiens
ctgggcagagtccggaagatgg

SEQ ID NO: 7778577 - DNA, 22 bp, Homo sapiens
ctgggcagctaccaccactgct

SEQ ID NO: 7778578 - DNA, 17 bp, Homo sapiens
ctgggatgtggactctt

SEQ ID NO: 7778579 - DNA, 22 bp, Homo sapiens
ctgggatgtgaggagcgcctct

SEQ ID NO: 7778580 - DNA, 22 bp, Homo sapiens
ctgggagcggctgtcactggtt

SEQ ID NO: 7778581 - DNA, 22 bp, Homo sapiens
ctgggagcggctgtcactggtt

SEQ ID NO: 7778582 - DNA, 22 bp, Homo sapiens
ctgggagcgcagcaggcacaac

SEQ ID NO: 7778583 - DNA, 22 bp, Homo sapiens
ctgggagccctgactagcctgg

SEQ ID NO: 7778584 - DNA, 22 bp, Homo sapiens
ctgggagcctggcagttgctga

SEQ ID NO: 7778585 - DNA, 22 bp, Homo sapiens
ctgggagcaagaggctgcaaat

SEQ ID NO: 7778586 - DNA, 22 bp, Homo sapiens
ctgggagcaagtcaggaaaggt

SEQ ID NO: 7778587 - DNA, 22 bp, Homo sapiens
ctgggagcaccatacttgtttc

SEQ ID NO: 7778588 - DNA, 22 bp, Homo sapiens
ctgggagcccgcgtcctggtgg

SEQ ID NO: 7778589 - DNA, 22 bp, Homo sapiens
ctgtgctggtccagggagctgg

SEQ ID NO: 7778590 - DNA, 22 bp, Homo sapiens
ctgtgctgtcttgggagcctta

SEQ ID NO: 7778591 - DNA, 22 bp, Homo sapiens
ctgtgctgctagacctggattc

SEQ ID NO: 7778592 - DNA, 22 bp, Homo sapiens
ctgtgctggattctgaggctac

SEQ ID NO: 7778593 - DNA, 22 bp, Homo sapiens
ctgtgctgaggatgcagtttct

SEQ ID NO: 7778594 - DNA, 17 bp, Homo sapiens
ctgtctgcgcatgaggt

SEQ ID NO: 7778595 - DNA, 22 bp, Homo sapiens
ctgtcaggggcgggtggagcgg

SEQ ID NO: 7778596 - DNA, 19 bp, Homo sapiens
ctgtcaggggctggatgtt

SEQ ID NO: 7778597 - DNA, 22 bp, Homo sapiens
ctgtctgaatcctaagcttcct

SEQ ID NO: 7778598 - DNA, 22 bp, Homo sapiens
ctgtctgccctggccagagccc

SEQ ID NO: 7778599 - DNA, 22 bp, Homo sapiens
ctgtcaggttggtctcagagct

SEQ ID NO: 7778600 - DNA, 22 bp, Homo sapiens
ctgtatatggcttactttatat

SEQ ID NO: 7778601 - DNA, 22 bp, Homo sapiens
ctgtcaaattcataacacttat

SEQ ID NO: 7778602 - DNA, 22 bp, Homo sapiens
ctgtattttcatgcctacgtac

SEQ ID NO: 7778603 - DNA, 22 bp, Homo sapiens
ctgtattttttaagaatatctc

SEQ ID NO: 7778604 - DNA, 22 bp, Homo sapiens
ctgtattttttaagaatatctc

SEQ ID NO: 7778605 - DNA, 22 bp, Homo sapiens
ctgtaaaatgaacctagtcatc

SEQ ID NO: 7778606 - DNA, 22 bp, Homo sapiens
ctggtgccattctgtggcctag

SEQ ID NO: 7778607 - DNA, 22 bp, Homo sapiens
ctggtgccctgtgtggcaggag

SEQ ID NO: 7778608 - DNA, 22 bp, Homo sapiens
ctggggaacgcagcgagcagcg

SEQ ID NO: 7778609 - DNA, 22 bp, Homo sapiens
ctggggacgtcgggcagtgttc

SEQ ID NO: 7778610 - DNA, 22 bp, Homo sapiens
ctggggaatagagctggagacc

SEQ ID NO: 7778611 - DNA, 22 bp, Homo sapiens
ctggggagaagcgactcggctg

SEQ ID NO: 7778612 - DNA, 22 bp, Homo sapiens
ctggggagaagcgactcggctg

SEQ ID NO: 7778613 - DNA, 22 bp, Homo sapiens
ctggggagacgatcgatgttct

SEQ ID NO: 7778614 - DNA, 22 bp, Homo sapiens
ctggtctgcgggaaggcgtggg

SEQ ID NO: 7778615 - DNA, 22 bp, Homo sapiens
ctggtcactggtctcatccagc

SEQ ID NO: 7778616 - DNA, 23 bp, Homo sapiens
ctggtcagaggctgctggaaggg

SEQ ID NO: 7778617 - DNA, 22 bp, Homo sapiens
ctggtcagctgaagccccacac

SEQ ID NO: 7778618 - DNA, 22 bp, Homo sapiens
ctggtcaggaaggtggggacag

SEQ ID NO: 7778619 - DNA, 20 bp, Homo sapiens
ctggggagcctcgcggtggc

SEQ ID NO: 7778620 - DNA, 20 bp, Homo sapiens
ctggggagcctcgcggtggc

SEQ ID NO: 7778621 - DNA, 22 bp, Homo sapiens
gagagaaaaatgagcttcattg

SEQ ID NO: 7778622 - DNA, 22 bp, Homo sapiens
gagagggcaaggtagatgctac

SEQ ID NO: 7778623 - DNA, 22 bp, Homo sapiens
gagagggcaaggtagatgctac

SEQ ID NO: 7778624 - DNA, 22 bp, Homo sapiens
gagaaacttggagttattctgg

SEQ ID NO: 7778625 - DNA, 22 bp, Homo sapiens
gagaaacttggagttattctgg

SEQ ID NO: 7778626 - DNA, 22 bp, Homo sapiens
gagaaactgaaacatagggcca

SEQ ID NO: 7778627 - DNA, 22 bp, Homo sapiens
gagaaactgaatatttaacggg

SEQ ID NO: 7778628 - DNA, 18 bp, Homo sapiens
gagaaacctgtgaatgct

SEQ ID NO: 7778629 - DNA, 22 bp, Homo sapiens
gagaaacctgtaaggaaggaag

SEQ ID NO: 7778630 - DNA, 22 bp, Homo sapiens
gactgaggtgcccagaggtgac

SEQ ID NO: 7778631 - DNA, 22 bp, Homo sapiens
gactgaggtgacctaggactac

SEQ ID NO: 7778632 - DNA, 22 bp, Homo sapiens
gagaaaccgattctgcatgtca

SEQ ID NO: 7778633 - DNA, 19 bp, Homo sapiens
gagaaaccccgtctttagg

SEQ ID NO: 7778634 - DNA, 23 bp, Homo sapiens
gagaaacctcggtaagcaggagg

SEQ ID NO: 7778635 - DNA, 23 bp, Homo sapiens
gagaaacctcggtaagcaggagg

SEQ ID NO: 7778636 - DNA, 22 bp, Homo sapiens
gagacagatgctgctggagcat

SEQ ID NO: 7778637 - DNA, 22 bp, Homo sapiens
gactgaggcctttattgagaca

SEQ ID NO: 7778638 - DNA, 22 bp, Homo sapiens
gactgaggtattaagatggctt

SEQ ID NO: 7778639 - DNA, 22 bp, Homo sapiens
gactctgggagtttatgtgatt

SEQ ID NO: 7778640 - DNA, 22 bp, Homo sapiens
gaccagctctctgaagaaagag

SEQ ID NO: 7778641 - DNA, 22 bp, Homo sapiens
gactcccctgggccccatccag

SEQ ID NO: 7778642 - DNA, 22 bp, Homo sapiens
gactccaggtgtccaggcctcc

SEQ ID NO: 7778643 - DNA, 22 bp, Homo sapiens
gactccaggtgcaggaggagcc

SEQ ID NO: 7778644 - DNA, 22 bp, Homo sapiens
gaccacagctacaagggcaagg

SEQ ID NO: 7778645 - DNA, 22 bp, Homo sapiens
gacatttagaagttagattcaa

SEQ ID NO: 7778646 - DNA, 22 bp, Homo sapiens
gaccacaggtatgggcttggca

SEQ ID NO: 7778647 - DNA, 22 bp, Homo sapiens
gacagcaatgacggggcagctg

SEQ ID NO: 7778648 - DNA, 22 bp, Homo sapiens
gacagcaagagacagagcatcc

SEQ ID NO: 7778649 - DNA, 22 bp, Homo sapiens
gacagaggagaagatgctgtgg

SEQ ID NO: 7778650 - DNA, 21 bp, Homo sapiens
gacagcaactgtagtcctctt

SEQ ID NO: 7778651 - DNA, 22 bp, Homo sapiens
gacagacatttcctgatccaat

SEQ ID NO: 7778652 - DNA, 22 bp, Homo sapiens
gacagacatgggacttcatact

SEQ ID NO: 7778653 - DNA, 22 bp, Homo sapiens
gacatttaaattgcaggcagcc

SEQ ID NO: 7778654 - DNA, 22 bp, Homo sapiens
gacatttactgaatactgatta

SEQ ID NO: 7778655 - DNA, 22 bp, Homo sapiens
gacattctaaaaaatatggaag

SEQ ID NO: 7778656 - DNA, 22 bp, Homo sapiens
gacagcagatgaagcctgcaga

SEQ ID NO: 7778657 - DNA, 22 bp, Homo sapiens
gacagcagatgaagcctgcaga

SEQ ID NO: 7778658 - DNA, 22 bp, Homo sapiens
gaatgagactatgcgagtgtga

SEQ ID NO: 7778659 - DNA, 22 bp, Homo sapiens
gaatgatatattagcagatttt

SEQ ID NO: 7778660 - DNA, 22 bp, Homo sapiens
gaatgataaatggaagcagcat

SEQ ID NO: 7778661 - DNA, 22 bp, Homo sapiens
gaatgatagagctgccttcgga

SEQ ID NO: 7778662 - DNA, 22 bp, Homo sapiens
gaatgatattatttcgtgctgg

SEQ ID NO: 7778663 - DNA, 22 bp, Homo sapiens
gacagacacaattgatccatga

SEQ ID NO: 7778664 - DNA, 22 bp, Homo sapiens
gacagacaggagctcacaggca

SEQ ID NO: 7778665 - DNA, 22 bp, Homo sapiens
gacagacaggaggcattcaggg

SEQ ID NO: 7778666 - DNA, 22 bp, Homo sapiens
gaatctagggcctagatcacag

SEQ ID NO: 7778667 - DNA, 22 bp, Homo sapiens
gaatatttgtaattactgttga

SEQ ID NO: 7778668 - DNA, 22 bp, Homo sapiens
gaatattttcagtacagatggt

SEQ ID NO: 7778669 - DNA, 22 bp, Homo sapiens
gaaggtgcagtggctggaggct

SEQ ID NO: 7778670 - DNA, 22 bp, Homo sapiens
gaaaggaagaaaggtcatttta

SEQ ID NO: 7778671 - DNA, 22 bp, Homo sapiens
gaaaggaaattgagggacgcat

SEQ ID NO: 7778672 - DNA, 22 bp, Homo sapiens
gaaaggaacttgtgagtgggag

SEQ ID NO: 7778673 - DNA, 22 bp, Homo sapiens
gaaaggaaatattctaagcact

SEQ ID NO: 7778674 - DNA, 22 bp, Homo sapiens
gaagcaaagagctagtgccgct

SEQ ID NO: 7778675 - DNA, 22 bp, Homo sapiens
gaagcaagtggcctgattcaga

SEQ ID NO: 7778676 - DNA, 22 bp, Homo sapiens
gaagcaagtgcaaggaagaggc

SEQ ID NO: 7778677 - DNA, 22 bp, Homo sapiens
gaagccaagtgcaaatgcctta

SEQ ID NO: 7778678 - DNA, 22 bp, Homo sapiens
gaagccaagggctgcttttcct

SEQ ID NO: 7778679 - DNA, 22 bp, Homo sapiens
gaagccaacattccaagtagaa

SEQ ID NO: 7778680 - DNA, 22 bp, Homo sapiens
gaagcagtcagcagcacctttg

SEQ ID NO: 7778681 - DNA, 22 bp, Homo sapiens
gaagcagtatcctgacagcacc

SEQ ID NO: 7778682 - DNA, 22 bp, Homo sapiens
gaagcagtgtgaacccatgtaa

SEQ ID NO: 7778683 - DNA, 22 bp, Homo sapiens
gaaggcaggtttttcaaaactg

SEQ ID NO: 7778684 - DNA, 22 bp, Homo sapiens
gaaggcagggaatgtggtgcta

SEQ ID NO: 7778685 - DNA, 22 bp, Homo sapiens
gaaggcaggcttctgattaggt

SEQ ID NO: 7778686 - DNA, 20 bp, Homo sapiens
gaagccagaggggaaaggag

SEQ ID NO: 7778687 - DNA, 22 bp, Homo sapiens
gaagccacgttaaattggctgt

SEQ ID NO: 7778688 - DNA, 22 bp, Homo sapiens
gaagccacagagattgtggggg

SEQ ID NO: 7778689 - DNA, 22 bp, Homo sapiens
gaaggcccagcttgaatgctgc

SEQ ID NO: 7778690 - DNA, 22 bp, Homo sapiens
gaaggcccagcttgaatgctgc

SEQ ID NO: 7778691 - DNA, 22 bp, Homo sapiens
gaaggcccagtcaaggggctag

SEQ ID NO: 7778692 - DNA, 22 bp, Homo sapiens
gaaggccagttttgagataggt

SEQ ID NO: 7778693 - DNA, 22 bp, Homo sapiens
gaaggcaggtttttcaaaactg

SEQ ID NO: 7778694 - DNA, 22 bp, Homo sapiens
gaaggcagtaaatggctgtttt

SEQ ID NO: 7778695 - DNA, 22 bp, Homo sapiens
gaaggccaagaggctccaagat

SEQ ID NO: 7778696 - DNA, 22 bp, Homo sapiens
gaggagagagggactgtctgca

SEQ ID NO: 7778697 - DNA, 21 bp, Homo sapiens
gaggaaatgctctggtgttca

SEQ ID NO: 7778698 - DNA, 22 bp, Homo sapiens
gaggaaatggttgttcaggtgg

SEQ ID NO: 7778699 - DNA, 20 bp, Homo sapiens
gaggaaccactgggaggaga

SEQ ID NO: 7778700 - DNA, 22 bp, Homo sapiens
gaggaaatcattccagaaaagg

SEQ ID NO: 7778701 - DNA, 22 bp, Homo sapiens
gaggaaatcttaggccccaacc

SEQ ID NO: 7778702 - DNA, 22 bp, Homo sapiens
gaggaaagaaccccagtcaata

SEQ ID NO: 7778703 - DNA, 18 bp, Homo sapiens
gaggaaacaaggcagagg

SEQ ID NO: 7778704 - DNA, 22 bp, Homo sapiens
gagctgcctgttgcatagcaac

SEQ ID NO: 7778705 - DNA, 22 bp, Homo sapiens
gagctgaggctcaggctggcgt

SEQ ID NO: 7778706 - DNA, 22 bp, Homo sapiens
gagctgagggtctaggagggtt

SEQ ID NO: 7778707 - DNA, 22 bp, Homo sapiens
gagctgagcagggagcctcact

SEQ ID NO: 7778708 - DNA, 22 bp, Homo sapiens
gagctgagcctgggtggaccgc

SEQ ID NO: 7778709 - DNA, 22 bp, Homo sapiens
gagctgaggatacatcagtgaa

SEQ ID NO: 7778710 - DNA, 22 bp, Homo sapiens
gagctgagatttgaagcaagtt

SEQ ID NO: 7778711 - DNA, 22 bp, Homo sapiens
gagcatggatagaaggtgggat

SEQ ID NO: 7778712 - DNA, 22 bp, Homo sapiens
gagcataggacacagaggtgtg

SEQ ID NO: 7778713 - DNA, 22 bp, Homo sapiens
gagcaggcttgcagagaagggg

SEQ ID NO: 7778714 - DNA, 22 bp, Homo sapiens
gagcaggcttgcagagaagggg

SEQ ID NO: 7778715 - DNA, 22 bp, Homo sapiens
gagcagtgggaaggaacagggt

SEQ ID NO: 7778716 - DNA, 22 bp, Homo sapiens
gagcagtgagtgaatgttgcct

SEQ ID NO: 7778717 - DNA, 22 bp, Homo sapiens
gagcccagctctacctcagact

SEQ ID NO: 7778718 - DNA, 22 bp, Homo sapiens
gagcccagctgcggccctcagc

SEQ ID NO: 7778719 - DNA, 22 bp, Homo sapiens
gagcccagctctacctcagact

SEQ ID NO: 7778720 - DNA, 22 bp, Homo sapiens
gagcccagcccagagccatatg

SEQ ID NO: 7778721 - DNA, 22 bp, Homo sapiens
gagcccagctgcggccctcagc

SEQ ID NO: 7778722 - DNA, 22 bp, Homo sapiens
gagcccagctgcggccctcagc

SEQ ID NO: 7778723 - DNA, 22 bp, Homo sapiens
gagcccagctgtccttggcaaa

SEQ ID NO: 7778724 - DNA, 22 bp, Homo sapiens
gagcccaggaagtggaggctga

SEQ ID NO: 7778725 - DNA, 22 bp, Homo sapiens
gagcccaggaagtggaggctga

SEQ ID NO: 7778726 - DNA, 22 bp, Homo sapiens
gagcccaggaagtggaggctga

SEQ ID NO: 7778727 - DNA, 22 bp, Homo sapiens
gagcccagggcaggcaaggcag

SEQ ID NO: 7778728 - DNA, 22 bp, Homo sapiens
gagcccagggcaggcaaggcag

SEQ ID NO: 7778729 - DNA, 22 bp, Homo sapiens
gagcccagggtgaaatagcagc

SEQ ID NO: 7778730 - DNA, 22 bp, Homo sapiens
gagcccaggatggtgtatggct

SEQ ID NO: 7778731 - DNA, 22 bp, Homo sapiens
gagcccaggcagaggttgcagt

SEQ ID NO: 7778732 - DNA, 21 bp, Homo sapiens
gagcccaggcatctcattaat

SEQ ID NO: 7778733 - DNA, 21 bp, Homo sapiens
gagcccaggcatctcattaat

SEQ ID NO: 7778734 - DNA, 22 bp, Homo sapiens
gagcccaggttctgcttccagc

SEQ ID NO: 7778735 - DNA, 22 bp, Homo sapiens
gagcccaggttctgcttccagc

SEQ ID NO: 7778736 - DNA, 22 bp, Homo sapiens
gagcccaggttctgcttccagc

SEQ ID NO: 7778737 - DNA, 22 bp, Homo sapiens
gagcccaggttctgcttccagc

SEQ ID NO: 7778738 - DNA, 22 bp, Homo sapiens
gagggctgcaatgagacagaga

SEQ ID NO: 7778739 - DNA, 22 bp, Homo sapiens
gagggagtgctttctgatagtt

SEQ ID NO: 7778740 - DNA, 22 bp, Homo sapiens
gagggaggtgatactgaacgta

SEQ ID NO: 7778741 - DNA, 22 bp, Homo sapiens
gaggctgagggttagagagtca

SEQ ID NO: 7778742 - DNA, 22 bp, Homo sapiens
gaggctgaggttgcagtgagct

SEQ ID NO: 7778743 - DNA, 22 bp, Homo sapiens
gaggctgaggttgcagtgagcc

SEQ ID NO: 7778744 - DNA, 22 bp, Homo sapiens
gaggctgcccaactggagtgga

SEQ ID NO: 7778745 - DNA, 22 bp, Homo sapiens
gaggctgccaatgtgtgcatgt

SEQ ID NO: 7778746 - DNA, 22 bp, Homo sapiens
gagggagggccaggtcccaacc

SEQ ID NO: 7778747 - DNA, 22 bp, Homo sapiens
gagggaggggagctccaccctc

SEQ ID NO: 7778748 - DNA, 22 bp, Homo sapiens
gagggagggaaagtttaacact

SEQ ID NO: 7778749 - DNA, 22 bp, Homo sapiens
gagggagggactagcattctct

SEQ ID NO: 7778750 - DNA, 22 bp, Homo sapiens
gagggaggcatcatgaatccag

SEQ ID NO: 7778751 - DNA, 22 bp, Homo sapiens
gagggagagtgatggaccattg

SEQ ID NO: 7778752 - DNA, 22 bp, Homo sapiens
gagggagccgccacagactggg

SEQ ID NO: 7778753 - DNA, 22 bp, Homo sapiens
gaggcagtgcattgtctagggg

SEQ ID NO: 7778754 - DNA, 22 bp, Homo sapiens
gaggcagtgtcggtggcaggat

SEQ ID NO: 7778755 - DNA, 22 bp, Homo sapiens
gaggctcaacccacaggggttg

SEQ ID NO: 7778756 - DNA, 22 bp, Homo sapiens
gaggctcacctagggagcactg

SEQ ID NO: 7778757 - DNA, 22 bp, Homo sapiens
gaggctcagagaagtcatggta

SEQ ID NO: 7778758 - DNA, 22 bp, Homo sapiens
gaggctcagagggagcatggtc

SEQ ID NO: 7778759 - DNA, 22 bp, Homo sapiens
gaggctcagagaggtccacata

SEQ ID NO: 7778760 - DNA, 22 bp, Homo sapiens
gaggctgaggcaggaggatcac

SEQ ID NO: 7778761 - DNA, 22 bp, Homo sapiens
gaggagaggctggacgcggtga

SEQ ID NO: 7778762 - DNA, 22 bp, Homo sapiens
gaggagaggctggacgcggtga

SEQ ID NO: 7778763 - DNA, 22 bp, Homo sapiens
gaggagaggggctcccaagagc

SEQ ID NO: 7778764 - DNA, 22 bp, Homo sapiens
gaggagaggggctcccaagagc

SEQ ID NO: 7778765 - DNA, 22 bp, Homo sapiens
gaggagagatggtagattgggt

SEQ ID NO: 7778766 - DNA, 22 bp, Homo sapiens
gaggagagatggtagattgggt

SEQ ID NO: 7778767 - DNA, 22 bp, Homo sapiens
gaggagcacatgaggctgaggg

SEQ ID NO: 7778768 - DNA, 22 bp, Homo sapiens
gaggagcacatgaggctgaggg

SEQ ID NO: 7778769 - DNA, 22 bp, Homo sapiens
gaggagcacatgaggctgaggg

SEQ ID NO: 7778770 - DNA, 22 bp, Homo sapiens
gaggagccaaggtatgtgtgtt

SEQ ID NO: 7778771 - DNA, 22 bp, Homo sapiens
gaggagcatgggaaggctctgg

SEQ ID NO: 7778772 - DNA, 22 bp, Homo sapiens
gaggagcatgggaaggctctgg

SEQ ID NO: 7778773 - DNA, 22 bp, Homo sapiens
gaggcagcttggggctgtgggt

SEQ ID NO: 7778774 - DNA, 22 bp, Homo sapiens
gaggcaggaggattgcttgagc

SEQ ID NO: 7778775 - DNA, 22 bp, Homo sapiens
gaggcaggcagattgcttgagg

SEQ ID NO: 7778776 - DNA, 22 bp, Homo sapiens
gaggcaggccctgaatgagtca

SEQ ID NO: 7778777 - DNA, 20 bp, Homo sapiens
ctctgctttaggagagtcag

SEQ ID NO: 7778778 - DNA, 19 bp, Homo sapiens
ctctggagcagacactgga

SEQ ID NO: 7778779 - DNA, 22 bp, Homo sapiens
ctctggagtaagagctatgaaa

SEQ ID NO: 7778780 - DNA, 22 bp, Homo sapiens
ctctggaggtggaggttgcagt

SEQ ID NO: 7778781 - DNA, 22 bp, Homo sapiens
ctctggaggcctaaggaagtgg

SEQ ID NO: 7778782 - DNA, 22 bp, Homo sapiens
ctctggagggaggctgagctgg

SEQ ID NO: 7778783 - DNA, 22 bp, Homo sapiens
tttcttatattctgtcattgtt

SEQ ID NO: 7778784 - DNA, 22 bp, Homo sapiens
tttcttatactatattgtcatc

SEQ ID NO: 7778785 - DNA, 22 bp, Homo sapiens
tttcttatactatattgtcatc

SEQ ID NO: 7778786 - DNA, 22 bp, Homo sapiens
tttcttatactatattgtcatc

SEQ ID NO: 7778787 - DNA, 22 bp, Homo sapiens
tttcttctttcccagtgatggg

SEQ ID NO: 7778788 - DNA, 22 bp, Homo sapiens
tttcttcttgatttaaacaggg

SEQ ID NO: 7778789 - DNA, 22 bp, Homo sapiens
tttcttcttaatactggctgct

SEQ ID NO: 7778790 - DNA, 22 bp, Homo sapiens
tttcttctgtttgtagttacac

SEQ ID NO: 7778791 - DNA, 22 bp, Homo sapiens
tttcttcttgagtaaccagatt

SEQ ID NO: 7778792 - DNA, 20 bp, Homo sapiens
ctctgctgcgcatcccactt

SEQ ID NO: 7778793 - DNA, 22 bp, Homo sapiens
tttcttgagctaggaacctggg

SEQ ID NO: 7778794 - DNA, 22 bp, Homo sapiens
ctctgctgtctcagatgggcca

SEQ ID NO: 7778795 - DNA, 21 bp, Homo sapiens
ctctgctgtctaccagctgtt

SEQ ID NO: 7778796 - DNA, 22 bp, Homo sapiens
tttctgttgtatggcttctgca

SEQ ID NO: 7778797 - DNA, 22 bp, Homo sapiens
tttctgttgtatggcttctgca

SEQ ID NO: 7778798 - DNA, 19 bp, Homo sapiens
tttctgtttgcttctggtt

SEQ ID NO: 7778799 - DNA, 19 bp, Homo sapiens
tttctgcagcccagcagca

SEQ ID NO: 7778800 - DNA, 22 bp, Homo sapiens
tttctgcaggtattgcataagt

SEQ ID NO: 7778801 - DNA, 22 bp, Homo sapiens
ctctgaggtccttcccagctct

SEQ ID NO: 7778802 - DNA, 22 bp, Homo sapiens
ctctgaggtctaggaccatggc

SEQ ID NO: 7778803 - DNA, 22 bp, Homo sapiens
tttctgatttgacttgaagtat

SEQ ID NO: 7778804 - DNA, 22 bp, Homo sapiens
tttctgcaaacttccacgtctc

SEQ ID NO: 7778805 - DNA, 22 bp, Homo sapiens
tttctgcaaaataaatagtgac

SEQ ID NO: 7778806 - DNA, 22 bp, Homo sapiens
tttctgcacatttctaaagttg

SEQ ID NO: 7778807 - DNA, 22 bp, Homo sapiens
tttctgcaagtgtagataccca

SEQ ID NO: 7778808 - DNA, 22 bp, Homo sapiens
ctctgaggtcctacagtgaccc

SEQ ID NO: 7778809 - DNA, 22 bp, Homo sapiens
ctctgaggctccatgcaggctt

SEQ ID NO: 7778810 - DNA, 22 bp, Homo sapiens
ctctgacaggtggcattatctc

SEQ ID NO: 7778811 - DNA, 22 bp, Homo sapiens
ctctgacagccttcattatgca

SEQ ID NO: 7778812 - DNA, 22 bp, Homo sapiens
ctctctggcacttcattgctgt

SEQ ID NO: 7778813 - DNA, 22 bp, Homo sapiens
tttctctctacagtactttcat

SEQ ID NO: 7778814 - DNA, 19 bp, Homo sapiens
tttctctccctcatcccga

SEQ ID NO: 7778815 - DNA, 22 bp, Homo sapiens
tttctctggcattaggtataaa

SEQ ID NO: 7778816 - DNA, 22 bp, Homo sapiens
ctctatttttcttggctagtgt

SEQ ID NO: 7778817 - DNA, 22 bp, Homo sapiens
ctctatttatggcatctttatg

SEQ ID NO: 7778818 - DNA, 22 bp, Homo sapiens
ctctcaaagtaaggtgtataca

SEQ ID NO: 7778819 - DNA, 22 bp, Homo sapiens
ctctcaaatgtaatttgaggtt

SEQ ID NO: 7778820 - DNA, 22 bp, Homo sapiens
ctccctgtgtcttcacttggcc

SEQ ID NO: 7778821 - DNA, 22 bp, Homo sapiens
ctccctggtgtcccctccagga

SEQ ID NO: 7778822 - DNA, 22 bp, Homo sapiens
ctccctggtgtcccctccagga

SEQ ID NO: 7778823 - DNA, 22 bp, Homo sapiens
ctccctggtctttcccatcatt

SEQ ID NO: 7778824 - DNA, 22 bp, Homo sapiens
ctccctggtctttcccatcatt

SEQ ID NO: 7778825 - DNA, 22 bp, Homo sapiens
ctccctggtctttcccatcatt

SEQ ID NO: 7778826 - DNA, 19 bp, Homo sapiens
ctcctcagtcccagaggtc

SEQ ID NO: 7778827 - DNA, 22 bp, Homo sapiens
ctccctgcttgtttcccttcag

SEQ ID NO: 7778828 - DNA, 22 bp, Homo sapiens
ctccctggaggcccagacctgg

SEQ ID NO: 7778829 - DNA, 23 bp, Homo sapiens
ctccctggcccttgggagacctg

SEQ ID NO: 7778830 - DNA, 22 bp, Homo sapiens
ctccctggcacagcgagaggtt

SEQ ID NO: 7778831 - DNA, 22 bp, Homo sapiens
ctccctggcagccgcactcctg

SEQ ID NO: 7778832 - DNA, 22 bp, Homo sapiens
ctccctggcagccgcactcctg

SEQ ID NO: 7778833 - DNA, 22 bp, Homo sapiens
ctccccacatttctccctgtct

SEQ ID NO: 7778834 - DNA, 22 bp, Homo sapiens
ctccccacatttctccctgtct

SEQ ID NO: 7778835 - DNA, 22 bp, Homo sapiens
ctccccacgcctggactaagag

SEQ ID NO: 7778836 - DNA, 22 bp, Homo sapiens
ctcccagggccatcgagtcact

SEQ ID NO: 7778837 - DNA, 22 bp, Homo sapiens
ctcaggcttgggaggaggccca

SEQ ID NO: 7778838 - DNA, 22 bp, Homo sapiens
ttgtttcaaatatttcagaata

SEQ ID NO: 7778839 - DNA, 23 bp, Homo sapiens
ttgtttaccgtaggacttttaac

SEQ ID NO: 7778840 - DNA, 22 bp, Homo sapiens
ttgtttacaagttactcagtct

SEQ ID NO: 7778841 - DNA, 22 bp, Homo sapiens
ttgtttattagcaattatcctg

SEQ ID NO: 7778842 - DNA, 22 bp, Homo sapiens
ctccccaggttcaggaggtggg

SEQ ID NO: 7778843 - DNA, 22 bp, Homo sapiens
ttgtttaatgcctcatacatct

SEQ ID NO: 7778844 - DNA, 22 bp, Homo sapiens
ttgtttaatgcctcatacatct

SEQ ID NO: 7778845 - DNA, 22 bp, Homo sapiens
ctccccagccctggtattctga

SEQ ID NO: 7778846 - DNA, 22 bp, Homo sapiens
tttatattacctggaatagctt

SEQ ID NO: 7778847 - DNA, 22 bp, Homo sapiens
ctcctggttcctgtcttaaata

SEQ ID NO: 7778848 - DNA, 22 bp, Homo sapiens
ctcctgtcagaagcatcctgag

SEQ ID NO: 7778849 - DNA, 22 bp, Homo sapiens
ctcctgtcaataggctcctggc

SEQ ID NO: 7778850 - DNA, 22 bp, Homo sapiens
ctcctgtcaataggctcctggc

SEQ ID NO: 7778851 - DNA, 22 bp, Homo sapiens
ctcctgtggtactcccagggcc

SEQ ID NO: 7778852 - DNA, 22 bp, Homo sapiens
tttcaaagtcaagaaggatact

SEQ ID NO: 7778853 - DNA, 22 bp, Homo sapiens
ctcctgtgcacctccagcggca

SEQ ID NO: 7778854 - DNA, 22 bp, Homo sapiens
ctcctgtcccggggaccgccga

SEQ ID NO: 7778855 - DNA, 22 bp, Homo sapiens
tttcaaatagaatctttccaaa

SEQ ID NO: 7778856 - DNA, 22 bp, Homo sapiens
tttcaaatgcatgtctttcctc

SEQ ID NO: 7778857 - DNA, 22 bp, Homo sapiens
ctcgggtaccatgctaggcact

SEQ ID NO: 7778858 - DNA, 22 bp, Homo sapiens
ctcgttgctgaagccaaagtca

SEQ ID NO: 7778859 - DNA, 22 bp, Homo sapiens
ctctaaatccaaataagtgtcc

SEQ ID NO: 7778860 - DNA, 22 bp, Homo sapiens
tttacaagtttacagaatgatg

SEQ ID NO: 7778861 - DNA, 22 bp, Homo sapiens
tttacacaaaagatagcacacc

SEQ ID NO: 7778862 - DNA, 22 bp, Homo sapiens
tttacacataaatgtgtagaca

SEQ ID NO: 7778863 - DNA, 22 bp, Homo sapiens
tttacacaaaagatagcacacc

SEQ ID NO: 7778864 - DNA, 22 bp, Homo sapiens
tttacacaaaatgttagtagat

SEQ ID NO: 7778865 - DNA, 22 bp, Homo sapiens
tttacacaaaatgttagtagat

SEQ ID NO: 7778866 - DNA, 22 bp, Homo sapiens
tttatatgtttgtacaattaag

SEQ ID NO: 7778867 - DNA, 22 bp, Homo sapiens
tttatatgtgaaggtttgcaga

SEQ ID NO: 7778868 - DNA, 18 bp, Homo sapiens
tttatatggatagagacc

SEQ ID NO: 7778869 - DNA, 22 bp, Homo sapiens
tttatatatggctggtctggat

SEQ ID NO: 7778870 - DNA, 22 bp, Homo sapiens
ctcctggatcttagccagattc

SEQ ID NO: 7778871 - DNA, 22 bp, Homo sapiens
ctcctggaggctccaagggaga

SEQ ID NO: 7778872 - DNA, 22 bp, Homo sapiens
ctcctggacatggagcggagga

SEQ ID NO: 7778873 - DNA, 22 bp, Homo sapiens
ctcctggagcagcaggcgcagg

SEQ ID NO: 7778874 - DNA, 22 bp, Homo sapiens
ctgagaggtaagcagcgcagtg

SEQ ID NO: 7778875 - DNA, 22 bp, Homo sapiens
ctgagaggtaagcagcgcagtg

SEQ ID NO: 7778876 - DNA, 22 bp, Homo sapiens
ctgagaggggaccagggtgttt

SEQ ID NO: 7778877 - DNA, 22 bp, Homo sapiens
ctgagaggtgacagcgtgctgg

SEQ ID NO: 7778878 - DNA, 22 bp, Homo sapiens
ctgagagttaagagatggggct

SEQ ID NO: 7778879 - DNA, 22 bp, Homo sapiens
ctgagctgggagtagagactct

SEQ ID NO: 7778880 - DNA, 22 bp, Homo sapiens
ctgagctgggctctcttgaggg

SEQ ID NO: 7778881 - DNA, 22 bp, Homo sapiens
ctgagggcaccgacagagtgga

SEQ ID NO: 7778882 - DNA, 22 bp, Homo sapiens
ctgagggatgtggattttggtc

SEQ ID NO: 7778883 - DNA, 22 bp, Homo sapiens
ctgaggctgggcatggggtcca

SEQ ID NO: 7778884 - DNA, 22 bp, Homo sapiens
ctgagggaggagaattgcttga

SEQ ID NO: 7778885 - DNA, 22 bp, Homo sapiens
ctgaggaagacagcagctgtgt

SEQ ID NO: 7778886 - DNA, 22 bp, Homo sapiens
ctgaggaaagtattgcctggtg

SEQ ID NO: 7778887 - DNA, 22 bp, Homo sapiens
ctgaggaaagctgcagcggtac

SEQ ID NO: 7778888 - DNA, 22 bp, Homo sapiens
ctgagctgttactctgtcctcg

SEQ ID NO: 7778889 - DNA, 22 bp, Homo sapiens
ctgagctgtgtggtcctgggca

SEQ ID NO: 7778890 - DNA, 22 bp, Homo sapiens
ttttcctctgtatttgaaatgc

SEQ ID NO: 7778891 - DNA, 22 bp, Homo sapiens
ttttctcaggtgcttatctaag

SEQ ID NO: 7778892 - DNA, 22 bp, Homo sapiens
ttttctcaggtgcttatctaag

SEQ ID NO: 7778893 - DNA, 22 bp, Homo sapiens
ttttctccaactcaaaggaaag

SEQ ID NO: 7778894 - DNA, 22 bp, Homo sapiens
tttttctcttctgtaaagtggt

SEQ ID NO: 7778895 - DNA, 22 bp, Homo sapiens
tttttctgagaatatgagagga

SEQ ID NO: 7778896 - DNA, 19 bp, Homo sapiens
tttttacaagtaggtgtga

SEQ ID NO: 7778897 - DNA, 19 bp, Homo sapiens
tttttacaagtaggtgtga

SEQ ID NO: 7778898 - DNA, 22 bp, Homo sapiens
ttttctcctttcaagatagcat

SEQ ID NO: 7778899 - DNA, 22 bp, Homo sapiens
ctgaaaatgttacacaggaaga

SEQ ID NO: 7778900 - DNA, 22 bp, Homo sapiens
ctgaaaagctttgaaccgttaa

SEQ ID NO: 7778901 - DNA, 22 bp, Homo sapiens
tttttcttgtgctggatctaat

SEQ ID NO: 7778902 - DNA, 22 bp, Homo sapiens
tttttctggataactgtatctc

SEQ ID NO: 7778903 - DNA, 22 bp, Homo sapiens
tttttcttaaatgtgggttggc

SEQ ID NO: 7778904 - DNA, 19 bp, Homo sapiens
ctgctccaggagctgggga

SEQ ID NO: 7778905 - DNA, 22 bp, Homo sapiens
ctgctccaggaacagagctgct

SEQ ID NO: 7778906 - DNA, 22 bp, Homo sapiens
ctgctccccagcctgcgccttt

SEQ ID NO: 7778907 - DNA, 19 bp, Homo sapiens
ctgctccctccttctggca

SEQ ID NO: 7778908 - DNA, 22 bp, Homo sapiens
ctgcctgagtacaagtcccaga

SEQ ID NO: 7778909 - DNA, 22 bp, Homo sapiens
ctgcctgactgataatctctga

SEQ ID NO: 7778910 - DNA, 22 bp, Homo sapiens
ctgcctctgttgggcatggtct

SEQ ID NO: 7778911 - DNA, 22 bp, Homo sapiens
ctgcctcttaagtggatggagt

SEQ ID NO: 7778912 - DNA, 22 bp, Homo sapiens
ctgcctcttgacagatcgtggc

SEQ ID NO: 7778913 - DNA, 17 bp, Homo sapiens
ctgctggctggggcttg

SEQ ID NO: 7778914 - DNA, 17 bp, Homo sapiens
ctgctggctggggcttg

SEQ ID NO: 7778915 - DNA, 22 bp, Homo sapiens
ctgctggaggttggagcatgca

SEQ ID NO: 7778916 - DNA, 22 bp, Homo sapiens
ctgctggaggttggagcatgca

SEQ ID NO: 7778917 - DNA, 22 bp, Homo sapiens
ctgctggcaccgatgaaagaca

SEQ ID NO: 7778918 - DNA, 22 bp, Homo sapiens
ctgctggcaagcccagttggag

SEQ ID NO: 7778919 - DNA, 22 bp, Homo sapiens
ctgctggcaagcccagttggag

SEQ ID NO: 7778920 - DNA, 22 bp, Homo sapiens
ctgctggactacaggaagagtt

SEQ ID NO: 7778921 - DNA, 22 bp, Homo sapiens
ctgctggagggagctgatagtg

SEQ ID NO: 7778922 - DNA, 22 bp, Homo sapiens
ctgctggaagtttgctgtggat

SEQ ID NO: 7778923 - DNA, 22 bp, Homo sapiens
ctgctcctgtgggccagtggcc

SEQ ID NO: 7778924 - DNA, 22 bp, Homo sapiens
ctgctcctgtgggccagtggcc

SEQ ID NO: 7778925 - DNA, 22 bp, Homo sapiens
ctgctctccccaggccagtctg

SEQ ID NO: 7778926 - DNA, 22 bp, Homo sapiens
ctgctgagcatttgcagggaca

SEQ ID NO: 7778927 - DNA, 22 bp, Homo sapiens
ctgctgccggcgagcctccctt

SEQ ID NO: 7778928 - DNA, 22 bp, Homo sapiens
ctgctgagcctggtgcgggatg

SEQ ID NO: 7778929 - DNA, 22 bp, Homo sapiens
ctgcctctattcactgaggcag

SEQ ID NO: 7778930 - DNA, 22 bp, Homo sapiens
ctgcctctattcactgaggcag

SEQ ID NO: 7778931 - DNA, 22 bp, Homo sapiens
ctgcctctgttgggcatggtct

SEQ ID NO: 7778932 - DNA, 22 bp, Homo sapiens
ctgcctctgttgggcatggtct

SEQ ID NO: 7778933 - DNA, 22 bp, Homo sapiens
ctgcctctggttttggtccctg

SEQ ID NO: 7778934 - DNA, 22 bp, Homo sapiens
ctgcctctggttttggtccctg

SEQ ID NO: 7778935 - DNA, 22 bp, Homo sapiens
ctgcctctggcctcaggcccag

SEQ ID NO: 7778936 - DNA, 22 bp, Homo sapiens
ctgcctctggcctcaggcccag

SEQ ID NO: 7778937 - DNA, 22 bp, Homo sapiens
ctgccctgagtcatgccagatg

SEQ ID NO: 7778938 - DNA, 22 bp, Homo sapiens
ctgccctgcagctccacggact

SEQ ID NO: 7778939 - DNA, 22 bp, Homo sapiens
ctgagggctggagctgaggcct

SEQ ID NO: 7778940 - DNA, 22 bp, Homo sapiens
ctgagggctggagctgaggcct

SEQ ID NO: 7778941 - DNA, 22 bp, Homo sapiens
ctgagggctggagctgaggcct

SEQ ID NO: 7778942 - DNA, 22 bp, Homo sapiens
ctgagggcctgaggacctagat

SEQ ID NO: 7778943 - DNA, 22 bp, Homo sapiens
ctgagggcctgaggacctagat

SEQ ID NO: 7778944 - DNA, 23 bp, Homo sapiens
ctgaggggaaaagggcttcaggc

SEQ ID NO: 7778945 - DNA, 22 bp, Homo sapiens
ctgcagtgcaagcccagatgga

SEQ ID NO: 7778946 - DNA, 22 bp, Homo sapiens
ctcagccatggggtggatcagc

SEQ ID NO: 7778947 - DNA, 22 bp, Homo sapiens
ctcagccagacatgacccagtc

SEQ ID NO: 7778948 - DNA, 22 bp, Homo sapiens
ctcagccaggagagtgttcaca

SEQ ID NO: 7778949 - DNA, 22 bp, Homo sapiens
ctcaggccaggtttctcccaca

SEQ ID NO: 7778950 - DNA, 22 bp, Homo sapiens
ctcaggagttggaggctacagt

SEQ ID NO: 7778951 - DNA, 22 bp, Homo sapiens
ttgatcaaatcagctactgagg

SEQ ID NO: 7778952 - DNA, 22 bp, Homo sapiens
ttgatttttccagcttctagag

SEQ ID NO: 7778953 - DNA, 22 bp, Homo sapiens
ttgatttttttctactatgcgc

SEQ ID NO: 7778954 - DNA, 22 bp, Homo sapiens
ttgatttttttctactatgcgc

SEQ ID NO: 7778955 - DNA, 22 bp, Homo sapiens
ttgcaaaaaccacaattacttt

SEQ ID NO: 7778956 - DNA, 22 bp, Homo sapiens
ttgcaaaagccgaggcactcca

SEQ ID NO: 7778957 - DNA, 22 bp, Homo sapiens
ttgcaaaaactgcaattacttt

SEQ ID NO: 7778958 - DNA, 22 bp, Homo sapiens
ttgcaaaatcatttctcaggat

SEQ ID NO: 7778959 - DNA, 22 bp, Homo sapiens
ctcagcagtgacaagagagtat

SEQ ID NO: 7778960 - DNA, 20 bp, Homo sapiens
ttgcacagagaaggaggcag

SEQ ID NO: 7778961 - DNA, 22 bp, Homo sapiens
ttgcactccagcccgagcaaca

SEQ ID NO: 7778962 - DNA, 23 bp, Homo sapiens
ttgcactgatcaatttgataagc

SEQ ID NO: 7778963 - DNA, 22 bp, Homo sapiens
ttgcactgtaagcatctgtgtc

SEQ ID NO: 7778964 - DNA, 22 bp, Homo sapiens
ttgcacatgttggttcttgaaa

SEQ ID NO: 7778965 - DNA, 22 bp, Homo sapiens
ttgctgatggtattatgctagt

SEQ ID NO: 7778966 - DNA, 22 bp, Homo sapiens
ttgctgatctgtgaatcagcca

SEQ ID NO: 7778967 - DNA, 22 bp, Homo sapiens
ttgctgctcccaagaggcagct

SEQ ID NO: 7778968 - DNA, 22 bp, Homo sapiens
ttgctgctcccaagaggcagct

SEQ ID NO: 7778969 - DNA, 22 bp, Homo sapiens
ttgctgatttgtttctattcca

SEQ ID NO: 7778970 - DNA, 22 bp, Homo sapiens
ttctgaaatttcaactttacta

SEQ ID NO: 7778971 - DNA, 22 bp, Homo sapiens
ttctgaaatttcaactttacta

SEQ ID NO: 7778972 - DNA, 22 bp, Homo sapiens
ttctgaaagtctttttaagtta

SEQ ID NO: 7778973 - DNA, 22 bp, Homo sapiens
ttctgaaatgagatataaggta

SEQ ID NO: 7778974 - DNA, 22 bp, Homo sapiens
ttctctttttgcatctcaacct

SEQ ID NO: 7778975 - DNA, 22 bp, Homo sapiens
ttctgaaaacacactttgcagc

SEQ ID NO: 7778976 - DNA, 22 bp, Homo sapiens
ctataaatctacccagcattgg

SEQ ID NO: 7778977 - DNA, 22 bp, Homo sapiens
ctataaatctacccagcattgg

SEQ ID NO: 7778978 - DNA, 22 bp, Homo sapiens
ttctgaaaccactgaccaacta

SEQ ID NO: 7778979 - DNA, 22 bp, Homo sapiens
ttctgaaaattgggtcatactt

SEQ ID NO: 7778980 - DNA, 22 bp, Homo sapiens
ttcttaagactgcaaatcaacc

SEQ ID NO: 7778981 - DNA, 20 bp, Homo sapiens
ttcttaaagacctcactttg

SEQ ID NO: 7778982 - DNA, 20 bp, Homo sapiens
ttcttaaagacctcactttg

SEQ ID NO: 7778983 - DNA, 20 bp, Homo sapiens
ttcttaaagacctcactttg

SEQ ID NO: 7778984 - DNA, 22 bp, Homo sapiens
ttcttcagtcccactagccaca

SEQ ID NO: 7778985 - DNA, 22 bp, Homo sapiens
ttcttacaagtattccaggtcc

SEQ ID NO: 7778986 - DNA, 22 bp, Homo sapiens
ttcttcaggaagagcctggact

SEQ ID NO: 7778987 - DNA, 22 bp, Homo sapiens
ttcttcaggatacgtcatccag

SEQ ID NO: 7778988 - DNA, 21 bp, Homo sapiens
ttcttcaggccaatgctcatt

SEQ ID NO: 7778989 - DNA, 21 bp, Homo sapiens
ttcttcaggccaatgctcatt

SEQ ID NO: 7778990 - DNA, 22 bp, Homo sapiens
ttcttacaaacaagatcattga

SEQ ID NO: 7778991 - DNA, 22 bp, Homo sapiens
ttcttacaagtatgacgtagca

SEQ ID NO: 7778992 - DNA, 22 bp, Homo sapiens
ttgaatgaagtccctttttact

SEQ ID NO: 7778993 - DNA, 22 bp, Homo sapiens
ttgaatgaagggatgaccgaag

SEQ ID NO: 7778994 - DNA, 22 bp, Homo sapiens
ttgaatgaaattgctgtgttat

SEQ ID NO: 7778995 - DNA, 22 bp, Homo sapiens
ttgaagtttaatggtagattcc

SEQ ID NO: 7778996 - DNA, 22 bp, Homo sapiens
ctcactggcaagactacaggtg

SEQ ID NO: 7778997 - DNA, 22 bp, Homo sapiens
ctcactgtccaacaggctttac

SEQ ID NO: 7778998 - DNA, 22 bp, Homo sapiens
ctcactgcaagctctgcctcca

SEQ ID NO: 7778999 - DNA, 22 bp, Homo sapiens
ctcactgcaagctctgcctccc

SEQ ID NO: 7779000 - DNA, 22 bp, Homo sapiens
ttgaagttgcacattataattt

SEQ ID NO: 7779001 - DNA, 22 bp, Homo sapiens
ttcttcatgggttcttttagga

SEQ ID NO: 7779002 - DNA, 22 bp, Homo sapiens
ttcttcatgctgttgctgcttg

SEQ ID NO: 7779003 - DNA, 21 bp, Homo sapiens
ttcttcatgatgattaatggc

SEQ ID NO: 7779004 - DNA, 23 bp, Homo sapiens
ttcttcattttcagagttgagca

SEQ ID NO: 7779005 - DNA, 22 bp, Homo sapiens
ttcttcccagccagcacagccc

SEQ ID NO: 7779006 - DNA, 22 bp, Homo sapiens
ttcttcagtgcccctctagtag

SEQ ID NO: 7779007 - DNA, 22 bp, Homo sapiens
ttcttcagtttggtaaatgtaa

SEQ ID NO: 7779008 - DNA, 22 bp, Homo sapiens
ttcttcatctgtaagataagca

SEQ ID NO: 7779009 - DNA, 22 bp, Homo sapiens
ttcagtttccacttacatttaa

SEQ ID NO: 7779010 - DNA, 22 bp, Homo sapiens
ttcagtttgaattctgtagaac

SEQ ID NO: 7779011 - DNA, 22 bp, Homo sapiens
cgcagctgcacggggctgagcc

SEQ ID NO: 7779012 - DNA, 22 bp, Homo sapiens
cggcttccaacaagctttgctg

SEQ ID NO: 7779013 - DNA, 22 bp, Homo sapiens
ttcctctcctcccaccaggtga

SEQ ID NO: 7779014 - DNA, 19 bp, Homo sapiens
cgtgaacatgactgcatgg

SEQ ID NO: 7779015 - DNA, 19 bp, Homo sapiens
ttccacttgggttagaatt

SEQ ID NO: 7779016 - DNA, 22 bp, Homo sapiens
cgtcccgggttcacgccattct

SEQ ID NO: 7779017 - DNA, 22 bp, Homo sapiens
cgtcctgggtctgggaaggcat

SEQ ID NO: 7779018 - DNA, 22 bp, Homo sapiens
cgtctaggccgtgccctgaggt

SEQ ID NO: 7779019 - DNA, 22 bp, Homo sapiens
cgtcccagttccagccgcgctg

SEQ ID NO: 7779020 - DNA, 22 bp, Homo sapiens
cgtcatcacggcaagcatctcc

SEQ ID NO: 7779021 - DNA, 22 bp, Homo sapiens
ttctatttttgtggaactgtag

SEQ ID NO: 7779022 - DNA, 18 bp, Homo sapiens
ctacattcataggaaagg

SEQ ID NO: 7779023 - DNA, 22 bp, Homo sapiens
ctacattctgggaaatcagatg

SEQ ID NO: 7779024 - DNA, 22 bp, Homo sapiens
ttctatttttgtggaactgtag

SEQ ID NO: 7779025 - DNA, 22 bp, Homo sapiens
ttctcattctgactcagtgtag

SEQ ID NO: 7779026 - DNA, 20 bp, Homo sapiens
ttctccaaaggagacactag

SEQ ID NO: 7779027 - DNA, 22 bp, Homo sapiens
ttctcctgcgcaggcccaggga

SEQ ID NO: 7779028 - DNA, 22 bp, Homo sapiens
ttctccttattcatagttgtct

SEQ ID NO: 7779029 - DNA, 21 bp, Homo sapiens
ttctcctgttttgcaccacag

SEQ ID NO: 7779030 - DNA, 22 bp, Homo sapiens
ttctcctttgtaattctcatcc

SEQ ID NO: 7779031 - DNA, 22 bp, Homo sapiens
ttctcctttgtaattctcatcc

SEQ ID NO: 7779032 - DNA, 18 bp, Homo sapiens
ctagggctgtggctctca

SEQ ID NO: 7779033 - DNA, 22 bp, Homo sapiens
ttctccttggtttatgggacat

SEQ ID NO: 7779034 - DNA, 22 bp, Homo sapiens
ttctccttggtttatgggacat

SEQ ID NO: 7779035 - DNA, 22 bp, Homo sapiens
ctagttgtttaatattgattga

SEQ ID NO: 7779036 - DNA, 22 bp, Homo sapiens
ctagttctagatccctgaggaa

SEQ ID NO: 7779037 - DNA, 22 bp, Homo sapiens
ctagtgtacaagtggtggagat

SEQ ID NO: 7779038 - DNA, 22 bp, Homo sapiens
ctacattcaacagcagagtttt

SEQ ID NO: 7779039 - DNA, 22 bp, Homo sapiens
ttctacatcacttaacatgcta

SEQ ID NO: 7779040 - DNA, 22 bp, Homo sapiens
ttctacattcatgtattacctc

SEQ ID NO: 7779041 - DNA, 22 bp, Homo sapiens
ttcctttttacataatcacatt

SEQ ID NO: 7779042 - DNA, 22 bp, Homo sapiens
ttctacatatatttttctcact

SEQ ID NO: 7779043 - DNA, 22 bp, Homo sapiens
ttctacatatatttttctcact

SEQ ID NO: 7779044 - DNA, 22 bp, Homo sapiens
ctaaatgtcagagtagcttgca

SEQ ID NO: 7779045 - DNA, 22 bp, Homo sapiens
ctaaatgtcatggagttgtaga

SEQ ID NO: 7779046 - DNA, 22 bp, Homo sapiens
ctaaatgtgctaatagcatgaa

SEQ ID NO: 7779047 - DNA, 22 bp, Homo sapiens
ctaaatgtgactcaccatctca

SEQ ID NO: 7779048 - DNA, 22 bp, Homo sapiens
ctaaatgttcacatgcaatttt

SEQ ID NO: 7779049 - DNA, 22 bp, Homo sapiens
cgatttccgcttgatctgatct

SEQ ID NO: 7779050 - DNA, 22 bp, Homo sapiens
cctttggccgctttatggagga

SEQ ID NO: 7779051 - DNA, 22 bp, Homo sapiens
cctttggctgcatagggaaggg

SEQ ID NO: 7779052 - DNA, 22 bp, Homo sapiens
cctttggagcaactgagagcta

SEQ ID NO: 7779053 - DNA, 22 bp, Homo sapiens
cctttggcattttgaggatgcg

SEQ ID NO: 7779054 - DNA, 22 bp, Homo sapiens
cctttggccctgagagatgatt

SEQ ID NO: 7779055 - DNA, 22 bp, Homo sapiens
ttatgtaagtggagtcatatag

SEQ ID NO: 7779056 - DNA, 22 bp, Homo sapiens
ttatttttaaaagttcacacag

SEQ ID NO: 7779057 - DNA, 22 bp, Homo sapiens
ttatttttaaaagttcacacag

SEQ ID NO: 7779058 - DNA, 22 bp, Homo sapiens
ttatttcattgatttctaagac

SEQ ID NO: 7779059 - DNA, 22 bp, Homo sapiens
ttatttcattgatttctaagac

SEQ ID NO: 7779060 - DNA, 22 bp, Homo sapiens
cgcaccactgaattccagcctg

SEQ ID NO: 7779061 - DNA, 22 bp, Homo sapiens
ttattattgtgacctgagaatg

SEQ ID NO: 7779062 - DNA, 22 bp, Homo sapiens
ttattattgtggttgcattatc

SEQ ID NO: 7779063 - DNA, 22 bp, Homo sapiens
ttattattgtggttgcattatc

SEQ ID NO: 7779064 - DNA, 22 bp, Homo sapiens
ttattattttgtgtacagcaaa

SEQ ID NO: 7779065 - DNA, 22 bp, Homo sapiens
ttattattttgtgtacagcaaa

SEQ ID NO: 7779066 - DNA, 22 bp, Homo sapiens
ttattcaccagtgtaaaacact

SEQ ID NO: 7779067 - DNA, 22 bp, Homo sapiens
cgcactggagctggaacgagtc

SEQ ID NO: 7779068 - DNA, 21 bp, Homo sapiens
cgcagagcgaacttgcggcgc

SEQ ID NO: 7779069 - DNA, 22 bp, Homo sapiens
cgcagagggcaggcagtgctgg

SEQ ID NO: 7779070 - DNA, 22 bp, Homo sapiens
cgcagagggagccgcgggctgc

SEQ ID NO: 7779071 - DNA, 22 bp, Homo sapiens
cgcagcagccccgtggtaggtg

SEQ ID NO: 7779072 - DNA, 17 bp, Homo sapiens
ttattttttgggctgag

SEQ ID NO: 7779073 - DNA, 22 bp, Homo sapiens
ttatttttaaaagttcacacag

SEQ ID NO: 7779074 - DNA, 17 bp, Homo sapiens
ttattttttgggctgag

SEQ ID NO: 7779075 - DNA, 22 bp, Homo sapiens
ccttcttaaacatcattttggc

SEQ ID NO: 7779076 - DNA, 22 bp, Homo sapiens
ccttctggaagctctaagggag

SEQ ID NO: 7779077 - DNA, 22 bp, Homo sapiens
ccttctgatactgacatcattt

SEQ ID NO: 7779078 - DNA, 22 bp, Homo sapiens
ccttctgagcttcaatttcagt

SEQ ID NO: 7779079 - DNA, 22 bp, Homo sapiens
ttaccaatgtgcttttgctaca

SEQ ID NO: 7779080 - DNA, 21 bp, Homo sapiens
ccttctcttgcttcagcttca

SEQ ID NO: 7779081 - DNA, 22 bp, Homo sapiens
ttacagaagagaaagaattcag

SEQ ID NO: 7779082 - DNA, 22 bp, Homo sapiens
ttatggcttaaatactacaggg

SEQ ID NO: 7779083 - DNA, 22 bp, Homo sapiens
cctttaaatggatgttcaactg

SEQ ID NO: 7779084 - DNA, 22 bp, Homo sapiens
ccttgggtctaggccagggagt

SEQ ID NO: 7779085 - DNA, 22 bp, Homo sapiens
ccttgggttccaagtcactgaa

SEQ ID NO: 7779086 - DNA, 22 bp, Homo sapiens
ccttgtcttgcacagatgcagc

SEQ ID NO: 7779087 - DNA, 22 bp, Homo sapiens
ccttgtttctctcccagataag

SEQ ID NO: 7779088 - DNA, 22 bp, Homo sapiens
ccttggcttccttccctctaga

SEQ ID NO: 7779089 - DNA, 22 bp, Homo sapiens
ccttggcttgcacacggccacc

SEQ ID NO: 7779090 - DNA, 22 bp, Homo sapiens
ccttggcttgtgggctgcagcc

SEQ ID NO: 7779091 - DNA, 22 bp, Homo sapiens
ttacgaatgttagattgcatct

SEQ ID NO: 7779092 - DNA, 21 bp, Homo sapiens
ttactaaacaaaacatgcagg

SEQ ID NO: 7779093 - DNA, 21 bp, Homo sapiens
ttactaaacaaaacatgcagg

SEQ ID NO: 7779094 - DNA, 22 bp, Homo sapiens
ccttggctgtgctgccctttgc

SEQ ID NO: 7779095 - DNA, 22 bp, Homo sapiens
ccttggctgtgttgcctgccct

SEQ ID NO: 7779096 - DNA, 22 bp, Homo sapiens
ccttggctgtgttgcctgccct

SEQ ID NO: 7779097 - DNA, 19 bp, Homo sapiens
ccttgcctgtccctgcagc

SEQ ID NO: 7779098 - DNA, 22 bp, Homo sapiens
ccttggctggaattactctggg

SEQ ID NO: 7779099 - DNA, 22 bp, Homo sapiens
ttaatgacctagagcagtaatt

SEQ ID NO: 7779100 - DNA, 22 bp, Homo sapiens
ttaatgacatcataggtgaagt

SEQ ID NO: 7779101 - DNA, 22 bp, Homo sapiens
ttaatgacaggataggctctga

SEQ ID NO: 7779102 - DNA, 22 bp, Homo sapiens
ttaatgacttatatttaaagca

SEQ ID NO: 7779103 - DNA, 22 bp, Homo sapiens
ttaatgacctggaagaagtgat

SEQ ID NO: 7779104 - DNA, 22 bp, Homo sapiens
cctgtgctttaggcctcaaact

SEQ ID NO: 7779105 - DNA, 22 bp, Homo sapiens
ttaatgccaacaaagtgatttt

SEQ ID NO: 7779106 - DNA, 22 bp, Homo sapiens
cctgtgcttcagctggaggagg

SEQ ID NO: 7779107 - DNA, 22 bp, Homo sapiens
cctgtgcttggccagagaggtt

SEQ ID NO: 7779108 - DNA, 22 bp, Homo sapiens
ttacaagtgtcaggtactggca

SEQ ID NO: 7779109 - DNA, 22 bp, Homo sapiens
ttacaagtatttaagatgctgt

SEQ ID NO: 7779110 - DNA, 22 bp, Homo sapiens
ttacaagtttctggcttcatcc

SEQ ID NO: 7779111 - DNA, 22 bp, Homo sapiens
ttacaagtttctggcttcatcc

SEQ ID NO: 7779112 - DNA, 23 bp, Homo sapiens
ttacaagttctgaaatttccttc

SEQ ID NO: 7779113 - DNA, 22 bp, Homo sapiens
ttacaatagttccttcttttgt

SEQ ID NO: 7779114 - DNA, 22 bp, Homo sapiens
ttaaggaaacatttttccatag

SEQ ID NO: 7779115 - DNA, 22 bp, Homo sapiens
ttaagctctcattattattatt

SEQ ID NO: 7779116 - DNA, 22 bp, Homo sapiens
ttaatatgttgaaatttattag

SEQ ID NO: 7779117 - DNA, 22 bp, Homo sapiens
ttaatatacaattttacgggct

SEQ ID NO: 7779118 - DNA, 22 bp, Homo sapiens
ttaatagatatgcctctagagt

SEQ ID NO: 7779119 - DNA, 22 bp, Homo sapiens
cctgtaggcgagggatggacag

SEQ ID NO: 7779120 - DNA, 22 bp, Homo sapiens
ttaaaatagccagtgcccctct

SEQ ID NO: 7779121 - DNA, 22 bp, Homo sapiens
ttaaaagagcagcccagcatat

SEQ ID NO: 7779122 - DNA, 22 bp, Homo sapiens
ttaaaagagcagcccagcatat

SEQ ID NO: 7779123 - DNA, 22 bp, Homo sapiens
tgttttctattacctgagattg

SEQ ID NO: 7779124 - DNA, 19 bp, Homo sapiens
tgttggaggtgctgaatta

SEQ ID NO: 7779125 - DNA, 22 bp, Homo sapiens
tgttggagcccgagtcagggag

SEQ ID NO: 7779126 - DNA, 22 bp, Homo sapiens
tgttgcccaggttctctcctgc

SEQ ID NO: 7779127 - DNA, 22 bp, Homo sapiens
tgttgcccaggttctctcctgc

SEQ ID NO: 7779128 - DNA, 22 bp, Homo sapiens
tggttcattgagaagactgaag

SEQ ID NO: 7779129 - DNA, 22 bp, Homo sapiens
tggttccagttttcaatagagc

SEQ ID NO: 7779130 - DNA, 22 bp, Homo sapiens
tggttcaggcagggtgttgctg

SEQ ID NO: 7779131 - DNA, 23 bp, Homo sapiens
tggttcaagtgagaagtaatgtt

SEQ ID NO: 7779132 - DNA, 22 bp, Homo sapiens
tggttagactcaccttatagtt

SEQ ID NO: 7779133 - DNA, 22 bp, Homo sapiens
tggttagaggcttcttgcttgg

SEQ ID NO: 7779134 - DNA, 22 bp, Homo sapiens
tggttagatgaggctggtttca

SEQ ID NO: 7779135 - DNA, 22 bp, Homo sapiens
cctggggagccgcctgagcccc

SEQ ID NO: 7779136 - DNA, 22 bp, Homo sapiens
cctggggagccgcctgagcccc

SEQ ID NO: 7779137 - DNA, 22 bp, Homo sapiens
cctggggagagaaagcccagcc

SEQ ID NO: 7779138 - DNA, 23 bp, Homo sapiens
cctggggcacttgagtcctcatc

SEQ ID NO: 7779139 - DNA, 22 bp, Homo sapiens
cctggggctcaagatggcgccg

SEQ ID NO: 7779140 - DNA, 22 bp, Homo sapiens
tgtttctagagaaaatatttac

SEQ ID NO: 7779141 - DNA, 22 bp, Homo sapiens
tgtttctagagaaaatatttac

SEQ ID NO: 7779142 - DNA, 22 bp, Homo sapiens
tgtttctatctggatcaataga

SEQ ID NO: 7779143 - DNA, 22 bp, Homo sapiens
tgtttctaggtcaataattttt

SEQ ID NO: 7779144 - DNA, 22 bp, Homo sapiens
tgtttctaggtcaataattttt

SEQ ID NO: 7779145 - DNA, 22 bp, Homo sapiens
tgtttcttacgtttttagaggc

SEQ ID NO: 7779146 - DNA, 20 bp, Homo sapiens
tgtttctgacggtaggagag

SEQ ID NO: 7779147 - DNA, 22 bp, Homo sapiens
tgtttctatctggatcaataga

SEQ ID NO: 7779148 - DNA, 22 bp, Homo sapiens
tgtttctatctggatcaataga

SEQ ID NO: 7779149 - DNA, 22 bp, Homo sapiens
tgtttctgtctgttttctacat

SEQ ID NO: 7779150 - DNA, 22 bp, Homo sapiens
tgtttctgtatgatcaatattg

SEQ ID NO: 7779151 - DNA, 19 bp, Homo sapiens
tgtttcttcctccatctga

SEQ ID NO: 7779152 - DNA, 22 bp, Homo sapiens
tgttttcatttgatgtaacaaa

SEQ ID NO: 7779153 - DNA, 22 bp, Homo sapiens
tgttttcctcctggtttctgcc

SEQ ID NO: 7779154 - DNA, 17 bp, Homo sapiens
tgttttcattcattgct

SEQ ID NO: 7779155 - DNA, 22 bp, Homo sapiens
ccctggctgctaccaggtagct

SEQ ID NO: 7779156 - DNA, 22 bp, Homo sapiens
tggcagaattttaaagacagat

SEQ ID NO: 7779157 - DNA, 22 bp, Homo sapiens
tggcagaagttcactagtagct

SEQ ID NO: 7779158 - DNA, 22 bp, Homo sapiens
tggcagaatttctagcagattc

SEQ ID NO: 7779159 - DNA, 22 bp, Homo sapiens
tggcagaatttctagcagattc

SEQ ID NO: 7779160 - DNA, 22 bp, Homo sapiens
ccctggagtgtgacgaggcatt

SEQ ID NO: 7779161 - DNA, 22 bp, Homo sapiens
tggcacttgatatttgatttgc

SEQ ID NO: 7779162 - DNA, 22 bp, Homo sapiens
ccctggagtgtgacgaggcatt

SEQ ID NO: 7779163 - DNA, 22 bp, Homo sapiens
tggcagaagtacacaagcatgc

SEQ ID NO: 7779164 - DNA, 22 bp, Homo sapiens
tggcagaagtacacaagcatgc

SEQ ID NO: 7779165 - DNA, 22 bp, Homo sapiens
tggcagaagtacacaagcatgc

SEQ ID NO: 7779166 - DNA, 22 bp, Homo sapiens
tggcagaaagaaccatgtgcaa

SEQ ID NO: 7779167 - DNA, 22 bp, Homo sapiens
tggcagaagttcactagtagct

SEQ ID NO: 7779168 - DNA, 22 bp, Homo sapiens
ccctggaggtcagaggcctggg

SEQ ID NO: 7779169 - DNA, 22 bp, Homo sapiens
ccctggagggcagacagatgcc

SEQ ID NO: 7779170 - DNA, 22 bp, Homo sapiens
ccctggaggtggaggttgcagg

SEQ ID NO: 7779171 - DNA, 22 bp, Homo sapiens
ccctggagtccggagctcacct

SEQ ID NO: 7779172 - DNA, 22 bp, Homo sapiens
ccctggagtgccggaatcaaga

SEQ ID NO: 7779173 - DNA, 22 bp, Homo sapiens
ccctggagtccggagctcacct

SEQ ID NO: 7779174 - DNA, 22 bp, Homo sapiens
tggcagggagccaccggtcatg

SEQ ID NO: 7779175 - DNA, 19 bp, Homo sapiens
tggcagggagagtttgaag

SEQ ID NO: 7779176 - DNA, 22 bp, Homo sapiens
tggcagggaatacagatgttta

SEQ ID NO: 7779177 - DNA, 22 bp, Homo sapiens
ccctttaaggtctgattttcag

SEQ ID NO: 7779178 - DNA, 22 bp, Homo sapiens
cccttgggccccagctcagggc

SEQ ID NO: 7779179 - DNA, 22 bp, Homo sapiens
cccttggggtggaggttgcagt

SEQ ID NO: 7779180 - DNA, 22 bp, Homo sapiens
ccctggctgcttgtagtctggc

SEQ ID NO: 7779181 - DNA, 22 bp, Homo sapiens
ccctgggaggcttccaggcaga

SEQ ID NO: 7779182 - DNA, 22 bp, Homo sapiens
tggaggcagtttaagtctgaga

SEQ ID NO: 7779183 - DNA, 22 bp, Homo sapiens
ccctggagggatttctcaatca

SEQ ID NO: 7779184 - DNA, 22 bp, Homo sapiens
ccctggaggaagaaacaatggc

SEQ ID NO: 7779185 - DNA, 22 bp, Homo sapiens
tggaggaatcagggcttaggct

SEQ ID NO: 7779186 - DNA, 18 bp, Homo sapiens
tggaggaatcacaatggc

SEQ ID NO: 7779187 - DNA, 21 bp, Homo sapiens
tggaggaataaagcacagaag

SEQ ID NO: 7779188 - DNA, 22 bp, Homo sapiens
tggaggaagtggctggccagaa

SEQ ID NO: 7779189 - DNA, 22 bp, Homo sapiens
tggaggaagttgctggaagtca

SEQ ID NO: 7779190 - DNA, 23 bp, Homo sapiens
tggaggaaacacatcagaagacc

SEQ ID NO: 7779191 - DNA, 22 bp, Homo sapiens
tggagatgtaaagcaaggctta

SEQ ID NO: 7779192 - DNA, 22 bp, Homo sapiens
tggagatgcacgagcaggtgga

SEQ ID NO: 7779193 - DNA, 22 bp, Homo sapiens
tggagatgcctggagattaggg

SEQ ID NO: 7779194 - DNA, 22 bp, Homo sapiens
ccctccctgtgtgcctcatttg

SEQ ID NO: 7779195 - DNA, 22 bp, Homo sapiens
ccctccctgaagaagttactct

SEQ ID NO: 7779196 - DNA, 22 bp, Homo sapiens
ccctccctgaagaagttactct

SEQ ID NO: 7779197 - DNA, 22 bp, Homo sapiens
ccctccctttgcagcagtgcat

SEQ ID NO: 7779198 - DNA, 23 bp, Homo sapiens
tggaaacattctgaatgtccatc

SEQ ID NO: 7779199 - DNA, 22 bp, Homo sapiens
ccctccctttgcagcagtgcat

SEQ ID NO: 7779200 - DNA, 22 bp, Homo sapiens
ccctcctcaactctggcttcca

SEQ ID NO: 7779201 - DNA, 22 bp, Homo sapiens
tggaaacctactgatacaggag

SEQ ID NO: 7779202 - DNA, 22 bp, Homo sapiens
tgctctggacgctgagtggttt

SEQ ID NO: 7779203 - DNA, 22 bp, Homo sapiens
tgctgcctggtttcttcttgct

SEQ ID NO: 7779204 - DNA, 22 bp, Homo sapiens
tgctgccttctaggcgtgccct

SEQ ID NO: 7779205 - DNA, 22 bp, Homo sapiens
tgctgccttgacctcctgggct

SEQ ID NO: 7779206 - DNA, 19 bp, Homo sapiens
cccagtctaggtcctagga

SEQ ID NO: 7779207 - DNA, 19 bp, Homo sapiens
cccagtccttgtcctgggc

SEQ ID NO: 7779208 - DNA, 22 bp, Homo sapiens
tgctcaggtgccttggctgctg

SEQ ID NO: 7779209 - DNA, 22 bp, Homo sapiens
tgctctgaaggggaagggatgg

SEQ ID NO: 7779210 - DNA, 22 bp, Homo sapiens
tgctctgcaagcaggagcaaga

SEQ ID NO: 7779211 - DNA, 22 bp, Homo sapiens
tgctctgcacatccctcacaaa

SEQ ID NO: 7779212 - DNA, 22 bp, Homo sapiens
tgccttcttctccctggctcag

SEQ ID NO: 7779213 - DNA, 22 bp, Homo sapiens
tgccttctcccttggaccctga

SEQ ID NO: 7779214 - DNA, 22 bp, Homo sapiens
tgccttctcttccctgggagct

SEQ ID NO: 7779215 - DNA, 22 bp, Homo sapiens
tgcaggtgctccgggggtgccc

SEQ ID NO: 7779216 - DNA, 22 bp, Homo sapiens
tgctagggatatagtggcgagt

SEQ ID NO: 7779217 - DNA, 22 bp, Homo sapiens
tgctagggaagaacgagggaat

SEQ ID NO: 7779218 - DNA, 22 bp, Homo sapiens
tgctaggggtcagcaccatatc

SEQ ID NO: 7779219 - DNA, 22 bp, Homo sapiens
tgctagggatgtagcagtgaag

SEQ ID NO: 7779220 - DNA, 22 bp, Homo sapiens
tgctaggggcactaaaagctga

SEQ ID NO: 7779221 - DNA, 22 bp, Homo sapiens
tgctagcactgtgcagtctacg

SEQ ID NO: 7779222 - DNA, 22 bp, Homo sapiens
tgcttcctgaggccgtcttctc

SEQ ID NO: 7779223 - DNA, 22 bp, Homo sapiens
tgcttcctgaggccgtcttctc

SEQ ID NO: 7779224 - DNA, 22 bp, Homo sapiens
tgcttccctgctctgcacacct

SEQ ID NO: 7779225 - DNA, 22 bp, Homo sapiens
tgcttccttcccgttcttctcc

SEQ ID NO: 7779226 - DNA, 22 bp, Homo sapiens
tgcttccttcccgttcttctcc

SEQ ID NO: 7779227 - DNA, 22 bp, Homo sapiens
tgcttccttgatcattcccaaa

SEQ ID NO: 7779228 - DNA, 22 bp, Homo sapiens
ccccaggacacatggaccaagt

SEQ ID NO: 7779229 - DNA, 22 bp, Homo sapiens
ccccaggagatttgggagcaca

SEQ ID NO: 7779230 - DNA, 22 bp, Homo sapiens
tgcttgtcaggataagctctgg

SEQ ID NO: 7779231 - DNA, 22 bp, Homo sapiens
ccctccccagggtcatattgaa

SEQ ID NO: 7779232 - DNA, 22 bp, Homo sapiens
ccctccccacaaagcttcacac

SEQ ID NO: 7779233 - DNA, 22 bp, Homo sapiens
ccctccctatgtagatgatgtt

SEQ ID NO: 7779234 - DNA, 18 bp, Homo sapiens
tgctggggtagaatccac

SEQ ID NO: 7779235 - DNA, 22 bp, Homo sapiens
tgctgggggttcagatgagtaa

SEQ ID NO: 7779236 - DNA, 22 bp, Homo sapiens
tgctgggggttcagatgagtaa

SEQ ID NO: 7779237 - DNA, 22 bp, Homo sapiens
ccccagctcagtgcagggacat

SEQ ID NO: 7779238 - DNA, 22 bp, Homo sapiens
tgctgggggtgtctcaccaggc

SEQ ID NO: 7779239 - DNA, 22 bp, Homo sapiens
tgctgggggtagctctgcgtag

SEQ ID NO: 7779240 - DNA, 22 bp, Homo sapiens
tgctgggggtagctctgcgtag

SEQ ID NO: 7779241 - DNA, 22 bp, Homo sapiens
tgctggggctctgaccactcca

SEQ ID NO: 7779242 - DNA, 22 bp, Homo sapiens
tgctgggggctttctggatacc

SEQ ID NO: 7779243 - DNA, 22 bp, Homo sapiens
tgctgggggctttctggatacc

SEQ ID NO: 7779244 - DNA, 22 bp, Homo sapiens
tgctgctcaatgagatgccatc

SEQ ID NO: 7779245 - DNA, 22 bp, Homo sapiens
tgctgctcaagctgcagcaaaa

SEQ ID NO: 7779246 - DNA, 22 bp, Homo sapiens
cctgcctcccagaggtcctcta

SEQ ID NO: 7779247 - DNA, 22 bp, Homo sapiens
cctgcctcccagaggtcctcta

SEQ ID NO: 7779248 - DNA, 22 bp, Homo sapiens
cctgcctcccagaggtcctcta

SEQ ID NO: 7779249 - DNA, 23 bp, Homo sapiens
cctgcctccccatcagttataca

SEQ ID NO: 7779250 - DNA, 22 bp, Homo sapiens
tggttagacacatgcatgtcat

SEQ ID NO: 7779251 - DNA, 22 bp, Homo sapiens
tggtgggacatctgaggagagg

SEQ ID NO: 7779252 - DNA, 22 bp, Homo sapiens
tggtgggagtccgctgtgctgc

SEQ ID NO: 7779253 - DNA, 22 bp, Homo sapiens
cctgcctgattccaggatggct

SEQ ID NO: 7779254 - DNA, 22 bp, Homo sapiens
cctgcctgcaccttctctgggg

SEQ ID NO: 7779255 - DNA, 22 bp, Homo sapiens
cctgcccttctttccccagcat

SEQ ID NO: 7779256 - DNA, 22 bp, Homo sapiens
cctgcccttctttccccagcat

SEQ ID NO: 7779257 - DNA, 22 bp, Homo sapiens
cctgcccttctttccccagcat

SEQ ID NO: 7779258 - DNA, 22 bp, Homo sapiens
cctgcctatgagacgttttgcc

SEQ ID NO: 7779259 - DNA, 22 bp, Homo sapiens
cctgcctcaggactctgcatat

SEQ ID NO: 7779260 - DNA, 22 bp, Homo sapiens
cctgcctcaggactctgcatat

SEQ ID NO: 7779261 - DNA, 22 bp, Homo sapiens
cctgcctcatcaacttgtcgtg

SEQ ID NO: 7779262 - DNA, 22 bp, Homo sapiens
cctgcctcatcaacttgtcgtg

SEQ ID NO: 7779263 - DNA, 22 bp, Homo sapiens
cctgcccagcttcacctcaggc

SEQ ID NO: 7779264 - DNA, 22 bp, Homo sapiens
cctgccctgtcactggctaggg

SEQ ID NO: 7779265 - DNA, 22 bp, Homo sapiens
cctgcagggtgctgccacagat

SEQ ID NO: 7779266 - DNA, 22 bp, Homo sapiens
cctgccactgtaggtgacagtt

SEQ ID NO: 7779267 - DNA, 18 bp, Homo sapiens
tgggtggctagggagttt

SEQ ID NO: 7779268 - DNA, 18 bp, Homo sapiens
tgggtggctagggagttt

SEQ ID NO: 7779269 - DNA, 22 bp, Homo sapiens
tgggtggaataaatcagttctg

SEQ ID NO: 7779270 - DNA, 22 bp, Homo sapiens
tgggtggagctccacaacctgt

SEQ ID NO: 7779271 - DNA, 22 bp, Homo sapiens
tggtaagtaagtgaaacatcca

SEQ ID NO: 7779272 - DNA, 22 bp, Homo sapiens
cctgcagacacttgtccagcaa

SEQ ID NO: 7779273 - DNA, 23 bp, Homo sapiens
tggggagagttaccctggaagcg

SEQ ID NO: 7779274 - DNA, 22 bp, Homo sapiens
cctgcagctttgcctcctgaac

SEQ ID NO: 7779275 - DNA, 22 bp, Homo sapiens
cctgcagctgtaggagaaggcg

SEQ ID NO: 7779276 - DNA, 22 bp, Homo sapiens
cctgagtggccaggcagctgtg

SEQ ID NO: 7779277 - DNA, 22 bp, Homo sapiens
cctgagtgcttccagagtcatg

SEQ ID NO: 7779278 - DNA, 17 bp, Homo sapiens
cctgagtgggagaggaa

SEQ ID NO: 7779279 - DNA, 22 bp, Homo sapiens
cctgagtctttcccattgcgct

SEQ ID NO: 7779280 - DNA, 22 bp, Homo sapiens
cctgagtgacctgaggtctagt

SEQ ID NO: 7779281 - DNA, 22 bp, Homo sapiens
cctgatggagccctgctgcatg

SEQ ID NO: 7779282 - DNA, 22 bp, Homo sapiens
tggggagaagcaatagactcta

SEQ ID NO: 7779283 - DNA, 22 bp, Homo sapiens
tgggcctggagtttgtccagag

SEQ ID NO: 7779284 - DNA, 22 bp, Homo sapiens
tgggcctggacaaggccactag

SEQ ID NO: 7779285 - DNA, 21 bp, Homo sapiens
tgggcctcaagtgggtggcag

SEQ ID NO: 7779286 - DNA, 22 bp, Homo sapiens
tgggcaggcaagtgaatacctt

SEQ ID NO: 7779287 - DNA, 22 bp, Homo sapiens
tgggcaggataatatctcatgt

SEQ ID NO: 7779288 - DNA, 22 bp, Homo sapiens
tgggctccgttgcctggggcag

SEQ ID NO: 7779289 - DNA, 22 bp, Homo sapiens
tgggctccagcacctgtgctct

SEQ ID NO: 7779290 - DNA, 22 bp, Homo sapiens
tgggcctggccctgtggaggag

SEQ ID NO: 7779291 - DNA, 22 bp, Homo sapiens
tgggctcatggcccagcactgg

SEQ ID NO: 7779292 - DNA, 22 bp, Homo sapiens
tgggcctgggagggcagacgct

SEQ ID NO: 7779293 - DNA, 22 bp, Homo sapiens
tggcagtgggaatggacaaaca

SEQ ID NO: 7779294 - DNA, 22 bp, Homo sapiens
cctccagggcagacggggagca

SEQ ID NO: 7779295 - DNA, 22 bp, Homo sapiens
cctcctggcttttcccattgaa

SEQ ID NO: 7779296 - DNA, 22 bp, Homo sapiens
cctcctgggacaggctggcaca

SEQ ID NO: 7779297 - DNA, 22 bp, Homo sapiens
cctcctggccctgggcctggaa

SEQ ID NO: 7779298 - DNA, 22 bp, Homo sapiens
cctcctggcctgtgcagagccc

SEQ ID NO: 7779299 - DNA, 22 bp, Homo sapiens
cctcctgggctcctgtctgcac

SEQ ID NO: 7779300 - DNA, 22 bp, Homo sapiens
cctcctgggccttgctctgtga

SEQ ID NO: 7779301 - DNA, 22 bp, Homo sapiens
cctcctgggactcattagcacc

SEQ ID NO: 7779302 - DNA, 22 bp, Homo sapiens
cctcctgggagagcacggaggg

SEQ ID NO: 7779303 - DNA, 23 bp, Homo sapiens
cctcctgggcacaggcctgatgg

SEQ ID NO: 7779304 - DNA, 22 bp, Homo sapiens
cctcccacatcctagctctgct

SEQ ID NO: 7779305 - DNA, 22 bp, Homo sapiens
cctcccacatcctagctctgct

SEQ ID NO: 7779306 - DNA, 17 bp, Homo sapiens
cctcccacaccgccctg

SEQ ID NO: 7779307 - DNA, 17 bp, Homo sapiens
cctcccacaccgccctg

SEQ ID NO: 7779308 - DNA, 22 bp, Homo sapiens
cctcccacttcttgctgaggtc

SEQ ID NO: 7779309 - DNA, 22 bp, Homo sapiens
cctcccacttcttgctgaggtc

SEQ ID NO: 7779310 - DNA, 19 bp, Homo sapiens
cctcccacggattccttcc

SEQ ID NO: 7779311 - DNA, 23 bp, Homo sapiens
cctcccacctatttcactttctt

SEQ ID NO: 7779312 - DNA, 22 bp, Homo sapiens
cctcccaccgtatctcagtggc

SEQ ID NO: 7779313 - DNA, 22 bp, Homo sapiens
cctcccaccgtatctcagtggc

SEQ ID NO: 7779314 - DNA, 22 bp, Homo sapiens
cctcccaccatttagagagagc

SEQ ID NO: 7779315 - DNA, 22 bp, Homo sapiens
cctcccacattgaggacatgct

SEQ ID NO: 7779316 - DNA, 22 bp, Homo sapiens
cctcccacattgaggacatgct

SEQ ID NO: 7779317 - DNA, 19 bp, Homo sapiens
tggcttggctgcagatgct

SEQ ID NO: 7779318 - DNA, 22 bp, Homo sapiens
tggcttggactaaatggaccgt

SEQ ID NO: 7779319 - DNA, 22 bp, Homo sapiens
tggcttgcttcttctgctgtcg

SEQ ID NO: 7779320 - DNA, 22 bp, Homo sapiens
tggcttggtaaggaccagcagg

SEQ ID NO: 7779321 - DNA, 22 bp, Homo sapiens
tggcttcccctaccttccaatt

SEQ ID NO: 7779322 - DNA, 22 bp, Homo sapiens
tggcttccccggagtgacatgt

SEQ ID NO: 7779323 - DNA, 22 bp, Homo sapiens
cctcctggtccagcatctcttt

SEQ ID NO: 7779324 - DNA, 22 bp, Homo sapiens
tggcttcccatagcttgctagt

SEQ ID NO: 7779325 - DNA, 22 bp, Homo sapiens
cctcctgggttcaagcgattct

SEQ ID NO: 7779326 - DNA, 22 bp, Homo sapiens
cctcctggggtgaaggatggga

SEQ ID NO: 7779327 - DNA, 20 bp, Homo sapiens
cctcctggtcaggtgtgcag

SEQ ID NO: 7779328 - DNA, 22 bp, Homo sapiens
cctcctggtaattagcgaaagg

SEQ ID NO: 7779329 - DNA, 22 bp, Homo sapiens
cctctcccgggtgccgctgggc

SEQ ID NO: 7779330 - DNA, 22 bp, Homo sapiens
tgggaaggcgtggaagtagaag

SEQ ID NO: 7779331 - DNA, 19 bp, Homo sapiens
cctctcccatgcttacctc

SEQ ID NO: 7779332 - DNA, 22 bp, Homo sapiens
cctctccagttttaacgtgacc

SEQ ID NO: 7779333 - DNA, 22 bp, Homo sapiens
cctctcccagggagagcctgag

SEQ ID NO: 7779334 - DNA, 22 bp, Homo sapiens
tgggcagaatgtgggatccaga

SEQ ID NO: 7779335 - DNA, 22 bp, Homo sapiens
tgggcagacgctgttggaaggc

SEQ ID NO: 7779336 - DNA, 22 bp, Homo sapiens
tgggagagaattctggtgactg

SEQ ID NO: 7779337 - DNA, 22 bp, Homo sapiens
tgggacagattataagtctgca

SEQ ID NO: 7779338 - DNA, 19 bp, Homo sapiens
ccatataaccagcaagtgt

SEQ ID NO: 7779339 - DNA, 19 bp, Homo sapiens
ccatataaccagcaagtgt

SEQ ID NO: 7779340 - DNA, 18 bp, Homo sapiens
tgaggctgagggtagagg

SEQ ID NO: 7779341 - DNA, 22 bp, Homo sapiens
tgaggctgagatatcagggagg

SEQ ID NO: 7779342 - DNA, 22 bp, Homo sapiens
tgaggctgagatatcagggagg

SEQ ID NO: 7779343 - DNA, 19 bp, Homo sapiens
ccatataaccagcaagtgt

SEQ ID NO: 7779344 - DNA, 22 bp, Homo sapiens
ccatcagattagcaaaatccag

SEQ ID NO: 7779345 - DNA, 18 bp, Homo sapiens
ccatcaccctaactagtg

SEQ ID NO: 7779346 - DNA, 22 bp, Homo sapiens
ccatcagtggcaaataaacacc

SEQ ID NO: 7779347 - DNA, 22 bp, Homo sapiens
ccatccagaagggtttgaaaga

SEQ ID NO: 7779348 - DNA, 22 bp, Homo sapiens
ccatcagttttatctgacaaaa

SEQ ID NO: 7779349 - DNA, 22 bp, Homo sapiens
tgaggccagggattccatcatt

SEQ ID NO: 7779350 - DNA, 22 bp, Homo sapiens
tgaggccaggcaaaggcgatct

SEQ ID NO: 7779351 - DNA, 22 bp, Homo sapiens
tgaggccatggaactagcttgg

SEQ ID NO: 7779352 - DNA, 17 bp, Homo sapiens
tgaggccatggcaccat

SEQ ID NO: 7779353 - DNA, 22 bp, Homo sapiens
tgaggcccagccgccctgagag

SEQ ID NO: 7779354 - DNA, 22 bp, Homo sapiens
tgaggctgaaactggcgataga

SEQ ID NO: 7779355 - DNA, 22 bp, Homo sapiens
tgaggctgaaactggcgataga

SEQ ID NO: 7779356 - DNA, 22 bp, Homo sapiens
tgaggctgacaaaagatgaggt

SEQ ID NO: 7779357 - DNA, 22 bp, Homo sapiens
tgaggctgacaaaagatgaggt

SEQ ID NO: 7779358 - DNA, 22 bp, Homo sapiens
tgataaacagctgatgaagacc

SEQ ID NO: 7779359 - DNA, 22 bp, Homo sapiens
tgataaatccatgtaaatggta

SEQ ID NO: 7779360 - DNA, 22 bp, Homo sapiens
tgataaacattttaggaactaa

SEQ ID NO: 7779361 - DNA, 22 bp, Homo sapiens
tgataaactggagaggtggagg

SEQ ID NO: 7779362 - DNA, 22 bp, Homo sapiens
tgataaacttagaaagaatgtt

SEQ ID NO: 7779363 - DNA, 22 bp, Homo sapiens
tgagttgaaagactgacttctg

SEQ ID NO: 7779364 - DNA, 19 bp, Homo sapiens
tgagttctgtggttctcaa

SEQ ID NO: 7779365 - DNA, 22 bp, Homo sapiens
tgagttgccctgccctgtgctt

SEQ ID NO: 7779366 - DNA, 22 bp, Homo sapiens
tgagtttaatgatatttatatg

SEQ ID NO: 7779367 - DNA, 22 bp, Homo sapiens
tgagtttaatgatatttatatg

SEQ ID NO: 7779368 - DNA, 19 bp, Homo sapiens
tgagtttaatgcaaaactg

SEQ ID NO: 7779369 - DNA, 22 bp, Homo sapiens
tgagtttagtgtgagacttatc

SEQ ID NO: 7779370 - DNA, 22 bp, Homo sapiens
tgagtttaattggagcctgaat

SEQ ID NO: 7779371 - DNA, 22 bp, Homo sapiens
ccatccctgggccatgtcccct

SEQ ID NO: 7779372 - DNA, 22 bp, Homo sapiens
ccatcccttctctggccagcag

SEQ ID NO: 7779373 - DNA, 22 bp, Homo sapiens
ccatccagaccagtccatgggt

SEQ ID NO: 7779374 - DNA, 22 bp, Homo sapiens
tgagccatgggactccaaggga

SEQ ID NO: 7779375 - DNA, 22 bp, Homo sapiens
tgagccagttcttcagatccat

SEQ ID NO: 7779376 - DNA, 22 bp, Homo sapiens
tgagcccaggagtatgaggctg

SEQ ID NO: 7779377 - DNA, 22 bp, Homo sapiens
tgagcccagaagcccactcggc

SEQ ID NO: 7779378 - DNA, 22 bp, Homo sapiens
tgagcccagaagcccactcggc

SEQ ID NO: 7779379 - DNA, 22 bp, Homo sapiens
tgagcccaggaggcagaggttg

SEQ ID NO: 7779380 - DNA, 23 bp, Homo sapiens
tgagcccaggaggtcaaggctgc

SEQ ID NO: 7779381 - DNA, 22 bp, Homo sapiens
ccagtcagtcagttgctggcat

SEQ ID NO: 7779382 - DNA, 22 bp, Homo sapiens
ccagtcagtcagttgctggcat

SEQ ID NO: 7779383 - DNA, 22 bp, Homo sapiens
ccagtcagggcaggagcctggt

SEQ ID NO: 7779384 - DNA, 22 bp, Homo sapiens
tgcactttgcaggcatggaaac

SEQ ID NO: 7779385 - DNA, 22 bp, Homo sapiens
tgcactttatttcctctcacac

SEQ ID NO: 7779386 - DNA, 22 bp, Homo sapiens
tgcactttaaaaaatggtgatg

SEQ ID NO: 7779387 - DNA, 22 bp, Homo sapiens
tgcactggtggtgagtgaggga

SEQ ID NO: 7779388 - DNA, 22 bp, Homo sapiens
tgcactccaggctgggtgacag

SEQ ID NO: 7779389 - DNA, 22 bp, Homo sapiens
tgcactggggtcccagcgcacg

SEQ ID NO: 7779390 - DNA, 22 bp, Homo sapiens
tgcactgggaaagaaggaggga

SEQ ID NO: 7779391 - DNA, 22 bp, Homo sapiens
cccagagctgagggggcacgtt

SEQ ID NO: 7779392 - DNA, 22 bp, Homo sapiens
cccagagctccggtcctgccca

SEQ ID NO: 7779393 - DNA, 22 bp, Homo sapiens
cccagagcctcattctgttggg

SEQ ID NO: 7779394 - DNA, 22 bp, Homo sapiens
tgcacagatgctaggaggtgaa

SEQ ID NO: 7779395 - DNA, 18 bp, Homo sapiens
tgcactagatgctggcag

SEQ ID NO: 7779396 - DNA, 22 bp, Homo sapiens
tgcacagatgggcttgttcata

SEQ ID NO: 7779397 - DNA, 22 bp, Homo sapiens
tgcactccaggctgggtgacag

SEQ ID NO: 7779398 - DNA, 19 bp, Homo sapiens
cccaaggccctgggcaggc

SEQ ID NO: 7779399 - DNA, 23 bp, Homo sapiens
cccaagcctgtgccctctgactc

SEQ ID NO: 7779400 - DNA, 22 bp, Homo sapiens
tgataaatccatgtaaatggta

SEQ ID NO: 7779401 - DNA, 22 bp, Homo sapiens
tgcaataaagtgctataaatcc

SEQ ID NO: 7779402 - DNA, 22 bp, Homo sapiens
tgcaataaagtgctataaatcc

SEQ ID NO: 7779403 - DNA, 22 bp, Homo sapiens
tgcaataacccagtatctgtga

SEQ ID NO: 7779404 - DNA, 22 bp, Homo sapiens
tgcaataatgtatgtcactccc

SEQ ID NO: 7779405 - DNA, 23 bp, Homo sapiens
tgcaatatgtcagtgcaaagtgg

SEQ ID NO: 7779406 - DNA, 22 bp, Homo sapiens
tgcaatatttggcactgagatg

SEQ ID NO: 7779407 - DNA, 22 bp, Homo sapiens
tgcaataacccatgagatagaa

SEQ ID NO: 7779408 - DNA, 22 bp, Homo sapiens
tgcaataactactttaatgttg

SEQ ID NO: 7779409 - DNA, 22 bp, Homo sapiens
tgcaataaggagtaatagtaaa

SEQ ID NO: 7779410 - DNA, 22 bp, Homo sapiens
tgcaataagttgtgttatcact

SEQ ID NO: 7779411 - DNA, 22 bp, Homo sapiens
tgcaataagtattgcttacatg

SEQ ID NO: 7779412 - DNA, 22 bp, Homo sapiens
cccagcaggcatgttgggagga

SEQ ID NO: 7779413 - DNA, 22 bp, Homo sapiens
cccagcaggaggaggttgcagt

SEQ ID NO: 7779414 - DNA, 22 bp, Homo sapiens
cccagcagggtctctgtgtcta

SEQ ID NO: 7779415 - DNA, 22 bp, Homo sapiens
cccagcagggtctctgtgtcta

SEQ ID NO: 7779416 - DNA, 22 bp, Homo sapiens
tgcagggatcctagctgaagag

SEQ ID NO: 7779417 - DNA, 22 bp, Homo sapiens
tgcaggcaggggatgagcagcc

SEQ ID NO: 7779418 - DNA, 22 bp, Homo sapiens
cccagcagccttgtcccttctc

SEQ ID NO: 7779419 - DNA, 22 bp, Homo sapiens
tgcagctgcctccttcccttgt

SEQ ID NO: 7779420 - DNA, 22 bp, Homo sapiens
tgcagctgcctagggctggctt

SEQ ID NO: 7779421 - DNA, 22 bp, Homo sapiens
tgcagctgcctagggctggctt

SEQ ID NO: 7779422 - DNA, 22 bp, Homo sapiens
tgcagctgcaggagggtgggag

SEQ ID NO: 7779423 - DNA, 22 bp, Homo sapiens
tgcaggaatagctacagagctg

SEQ ID NO: 7779424 - DNA, 22 bp, Homo sapiens
tgcagctgctcattctctcagt

SEQ ID NO: 7779425 - DNA, 22 bp, Homo sapiens
tgcagctgattaaagggcagac

SEQ ID NO: 7779426 - DNA, 22 bp, Homo sapiens
tgcagctgattaaagggcagac

SEQ ID NO: 7779427 - DNA, 20 bp, Homo sapiens
tgcagctgcaggagggtggg

SEQ ID NO: 7779428 - DNA, 20 bp, Homo sapiens
tgcagctgcaggagggtggg

SEQ ID NO: 7779429 - DNA, 20 bp, Homo sapiens
tgcagctgcaggagggtggg

SEQ ID NO: 7779430 - DNA, 20 bp, Homo sapiens
tgcagctgcaggagggtggg

SEQ ID NO: 7779431 - DNA, 22 bp, Homo sapiens
tctgggctctgtcagcacctct

SEQ ID NO: 7779432 - DNA, 21 bp, Homo sapiens
tctggggaagacatctaggat

SEQ ID NO: 7779433 - DNA, 22 bp, Homo sapiens
tctgggcttttgcactggccat

SEQ ID NO: 7779434 - DNA, 22 bp, Homo sapiens
tctggggaccatggcatctaaa

SEQ ID NO: 7779435 - DNA, 22 bp, Homo sapiens
tctggggacggggcccagcaat

SEQ ID NO: 7779436 - DNA, 22 bp, Homo sapiens
tctggggatgaggacctagatg

SEQ ID NO: 7779437 - DNA, 22 bp, Homo sapiens
ccaggagcaaagatcactggga

SEQ ID NO: 7779438 - DNA, 22 bp, Homo sapiens
ccaggagcaacttgaaggcaag

SEQ ID NO: 7779439 - DNA, 22 bp, Homo sapiens
tctgggccctaaaccagctcta

SEQ ID NO: 7779440 - DNA, 22 bp, Homo sapiens
ccaggagcagagtaggtgttca

SEQ ID NO: 7779441 - DNA, 22 bp, Homo sapiens
ccaggagcagatatggacataa

SEQ ID NO: 7779442 - DNA, 22 bp, Homo sapiens
ccaggagcaccaggcctgtgcc

SEQ ID NO: 7779443 - DNA, 22 bp, Homo sapiens
ccaggagcagccggcccacctg

SEQ ID NO: 7779444 - DNA, 22 bp, Homo sapiens
ccaggagcaggagctgcagctg

SEQ ID NO: 7779445 - DNA, 22 bp, Homo sapiens
ccaggagcaggagctgcagctg

SEQ ID NO: 7779446 - DNA, 19 bp, Homo sapiens
ccaggagcagtggtgagct

SEQ ID NO: 7779447 - DNA, 22 bp, Homo sapiens
ccaggagcattaagagaacata

SEQ ID NO: 7779448 - DNA, 22 bp, Homo sapiens
ccaggagccactcaggcccaca

SEQ ID NO: 7779449 - DNA, 22 bp, Homo sapiens
ccaggagcagggctggctgcac

SEQ ID NO: 7779450 - DNA, 22 bp, Homo sapiens
ccaggagcagggctggctgcac

SEQ ID NO: 7779451 - DNA, 22 bp, Homo sapiens
ccaggagcaggagctggacaga

SEQ ID NO: 7779452 - DNA, 22 bp, Homo sapiens
ccaggagcagggctggctgcac

SEQ ID NO: 7779453 - DNA, 19 bp, Homo sapiens
ccaggcctcctgggaggtc

SEQ ID NO: 7779454 - DNA, 22 bp, Homo sapiens
ccaggcctcctgtgagtggacc

SEQ ID NO: 7779455 - DNA, 22 bp, Homo sapiens
ccaggcccccgagcagaagaca

SEQ ID NO: 7779456 - DNA, 22 bp, Homo sapiens
ccaggcaggcgatggtgcagtg

SEQ ID NO: 7779457 - DNA, 22 bp, Homo sapiens
ccaggcaggcgatggtgcagtg

SEQ ID NO: 7779458 - DNA, 22 bp, Homo sapiens
ccaggcaggcgatggtgcagtg

SEQ ID NO: 7779459 - DNA, 22 bp, Homo sapiens
ccaggcaggcagcgttctcagg

SEQ ID NO: 7779460 - DNA, 22 bp, Homo sapiens
ccaggcaggcgatggtgcagtg

SEQ ID NO: 7779461 - DNA, 22 bp, Homo sapiens
ccaggcagccaagtgtgtgtgt

SEQ ID NO: 7779462 - DNA, 22 bp, Homo sapiens
ccaggcagcctgctccattctg

SEQ ID NO: 7779463 - DNA, 22 bp, Homo sapiens
ccaggcagcctgctccattctg

SEQ ID NO: 7779464 - DNA, 22 bp, Homo sapiens
tcttagaaactgtatcgattag

SEQ ID NO: 7779465 - DNA, 22 bp, Homo sapiens
tcttagaaatgaagttctttct

SEQ ID NO: 7779466 - DNA, 17 bp, Homo sapiens
tcttctcttccagtctt

SEQ ID NO: 7779467 - DNA, 22 bp, Homo sapiens
ccaggcagagggaatagcaagt

SEQ ID NO: 7779468 - DNA, 22 bp, Homo sapiens
ccaggcagagggatccccatcc

SEQ ID NO: 7779469 - DNA, 22 bp, Homo sapiens
ccaggcagagggatccccatcc

SEQ ID NO: 7779470 - DNA, 22 bp, Homo sapiens
ccaggcagagtgctccagaaag

SEQ ID NO: 7779471 - DNA, 22 bp, Homo sapiens
ccaggcagagtgctccagaaag

SEQ ID NO: 7779472 - DNA, 22 bp, Homo sapiens
ccaggcagatgggccggcttca

SEQ ID NO: 7779473 - DNA, 22 bp, Homo sapiens
ccaggcagagtgctccagaaag

SEQ ID NO: 7779474 - DNA, 20 bp, Homo sapiens
tcttacaatcgttacatcca

SEQ ID NO: 7779475 - DNA, 20 bp, Homo sapiens
tcttacaatcgttacatcca

SEQ ID NO: 7779476 - DNA, 22 bp, Homo sapiens
ccaggcagcaaattttctgaat

SEQ ID NO: 7779477 - DNA, 22 bp, Homo sapiens
tcttaatgctagccaatagaga

SEQ ID NO: 7779478 - DNA, 22 bp, Homo sapiens
tcttacaagaaataagccaatg

SEQ ID NO: 7779479 - DNA, 22 bp, Homo sapiens
tcttacaagaaggaaaagggag

SEQ ID NO: 7779480 - DNA, 22 bp, Homo sapiens
tcttaattctgtgtcttcacta

SEQ ID NO: 7779481 - DNA, 22 bp, Homo sapiens
ccaggcaattctgaaagcattt

SEQ ID NO: 7779482 - DNA, 21 bp, Homo sapiens
ccaggcagagctgtgagttct

SEQ ID NO: 7779483 - DNA, 22 bp, Homo sapiens
ccaggcagaatgaaacccctgt

SEQ ID NO: 7779484 - DNA, 22 bp, Homo sapiens
ccaggcacttgtttgccaggca

SEQ ID NO: 7779485 - DNA, 21 bp, Homo sapiens
ccaggctgggagggcagttcc

SEQ ID NO: 7779486 - DNA, 22 bp, Homo sapiens
ccaggctgtaagagtgatgttg

SEQ ID NO: 7779487 - DNA, 22 bp, Homo sapiens
ccaggctgtgcttttcataaat

SEQ ID NO: 7779488 - DNA, 22 bp, Homo sapiens
ccaggctgtggtttagatagag

SEQ ID NO: 7779489 - DNA, 22 bp, Homo sapiens
ccaggctgtggtttagatagag

SEQ ID NO: 7779490 - DNA, 22 bp, Homo sapiens
ccaggctgttttcaaacttggg

SEQ ID NO: 7779491 - DNA, 21 bp, Homo sapiens
tgaaatgagaatgctgagcac

SEQ ID NO: 7779492 - DNA, 22 bp, Homo sapiens
tgaaatgacaaaggtttttctt

SEQ ID NO: 7779493 - DNA, 22 bp, Homo sapiens
tgaaatgaagggcttgttctgg

SEQ ID NO: 7779494 - DNA, 22 bp, Homo sapiens
tgaaatgaagggcttgttctgg

SEQ ID NO: 7779495 - DNA, 17 bp, Homo sapiens
tgaaacaccaagactgt

SEQ ID NO: 7779496 - DNA, 22 bp, Homo sapiens
tgaaacaattagaatgtaatga

SEQ ID NO: 7779497 - DNA, 22 bp, Homo sapiens
tcttttgtggatgaagaaatgg

SEQ ID NO: 7779498 - DNA, 23 bp, Homo sapiens
ccaggcctctcagagggtgtgcc

SEQ ID NO: 7779499 - DNA, 22 bp, Homo sapiens
tcttgatttactctaatagctt

SEQ ID NO: 7779500 - DNA, 22 bp, Homo sapiens
ccaggcctgcatctgctgcgca

SEQ ID NO: 7779501 - DNA, 22 bp, Homo sapiens
tcttgatttattctacccagaa

SEQ ID NO: 7779502 - DNA, 22 bp, Homo sapiens
tcttgattttgtgaataagttg

SEQ ID NO: 7779503 - DNA, 22 bp, Homo sapiens
tcttttgtagctaacacattca

SEQ ID NO: 7779504 - DNA, 22 bp, Homo sapiens
tctttggtttctgtctctgtaa

SEQ ID NO: 7779505 - DNA, 22 bp, Homo sapiens
tctttggtttctgtctctgtaa

SEQ ID NO: 7779506 - DNA, 22 bp, Homo sapiens
ccagggaagattagaagccact

SEQ ID NO: 7779507 - DNA, 17 bp, Homo sapiens
ccagggaggggccgcgc

SEQ ID NO: 7779508 - DNA, 22 bp, Homo sapiens
tgaaatgatcagtttggttact

SEQ ID NO: 7779509 - DNA, 22 bp, Homo sapiens
tgaaatgagcatttattcttta

SEQ ID NO: 7779510 - DNA, 22 bp, Homo sapiens
ccagggagggtcctgtggcttc

SEQ ID NO: 7779511 - DNA, 23 bp, Homo sapiens
ccagggagtgctactatcaagcc

SEQ ID NO: 7779512 - DNA, 22 bp, Homo sapiens
ccagggcaaatgagatcatagc

SEQ ID NO: 7779513 - DNA, 22 bp, Homo sapiens
ccagggcaattatttggagggt

SEQ ID NO: 7779514 - DNA, 22 bp, Homo sapiens
ccagggcaacgctgtctcagag

SEQ ID NO: 7779515 - DNA, 22 bp, Homo sapiens
ccagggcacgttgggacagtac

SEQ ID NO: 7779516 - DNA, 22 bp, Homo sapiens
ccagggcacgttgggacagtac

SEQ ID NO: 7779517 - DNA, 22 bp, Homo sapiens
ccagggcaggagaaagactcac

SEQ ID NO: 7779518 - DNA, 22 bp, Homo sapiens
ccagggcacgttgggacagtac

SEQ ID NO: 7779519 - DNA, 22 bp, Homo sapiens
ccagggctctatgagggtggag

SEQ ID NO: 7779520 - DNA, 22 bp, Homo sapiens
ccagggctgagctgtgaccatg

SEQ ID NO: 7779521 - DNA, 22 bp, Homo sapiens
ccagggcctacagcttaagtcc

SEQ ID NO: 7779522 - DNA, 22 bp, Homo sapiens
ccagggctccattgctcatcct

SEQ ID NO: 7779523 - DNA, 22 bp, Homo sapiens
ccagggctctatgagggtggag

SEQ ID NO: 7779524 - DNA, 22 bp, Homo sapiens
ccagggctccccagaagtaccc

SEQ ID NO: 7779525 - DNA, 22 bp, Homo sapiens
ccagggcagtgggagaaggtgc

SEQ ID NO: 7779526 - DNA, 22 bp, Homo sapiens
ccagggcatgggaagaactgaa

SEQ ID NO: 7779527 - DNA, 22 bp, Homo sapiens
tccaagatctacagcagtttag

SEQ ID NO: 7779528 - DNA, 22 bp, Homo sapiens
tccaagagtaagaggactcttt

SEQ ID NO: 7779529 - DNA, 22 bp, Homo sapiens
tccaagaagcttacaatctaat

SEQ ID NO: 7779530 - DNA, 22 bp, Homo sapiens
tccaagagaatactggagagta

SEQ ID NO: 7779531 - DNA, 22 bp, Homo sapiens
tccaagcatgtggtcaggagcc

SEQ ID NO: 7779532 - DNA, 18 bp, Homo sapiens
tccagagagggagaagtg

SEQ ID NO: 7779533 - DNA, 18 bp, Homo sapiens
tccagagagggagaagtg

SEQ ID NO: 7779534 - DNA, 17 bp, Homo sapiens
tccagagaggcttccct

SEQ ID NO: 7779535 - DNA, 22 bp, Homo sapiens
tccagaggtgaacacccaggca

SEQ ID NO: 7779536 - DNA, 22 bp, Homo sapiens
tcatcagtcagaacttaagctt

SEQ ID NO: 7779537 - DNA, 22 bp, Homo sapiens
catgctaagtcataaaagagta

SEQ ID NO: 7779538 - DNA, 22 bp, Homo sapiens
catgctccagctccagacaggt

SEQ ID NO: 7779539 - DNA, 22 bp, Homo sapiens
catgctatttatacataagtct

SEQ ID NO: 7779540 - DNA, 22 bp, Homo sapiens
catgctgggccttgggtgcact

SEQ ID NO: 7779541 - DNA, 22 bp, Homo sapiens
catgctggtcagccagtggatg

SEQ ID NO: 7779542 - DNA, 22 bp, Homo sapiens
catgctgtactctgtgtcagaa

SEQ ID NO: 7779543 - DNA, 22 bp, Homo sapiens
catgctgttgaatatgacattg

SEQ ID NO: 7779544 - DNA, 22 bp, Homo sapiens
tccagcagaaccagagacctgg

SEQ ID NO: 7779545 - DNA, 22 bp, Homo sapiens
tccagcagaaccagagacctgg

SEQ ID NO: 7779546 - DNA, 22 bp, Homo sapiens
tccagcacctggaggcgtcccc

SEQ ID NO: 7779547 - DNA, 22 bp, Homo sapiens
tccagcagaaaagaggtaggga

SEQ ID NO: 7779548 - DNA, 22 bp, Homo sapiens
tccagcactcgcccagggcttg

SEQ ID NO: 7779549 - DNA, 22 bp, Homo sapiens
tccagcacccaatgtggctaag

SEQ ID NO: 7779550 - DNA, 21 bp, Homo sapiens
tccagcacagatgacctcccc

SEQ ID NO: 7779551 - DNA, 22 bp, Homo sapiens
catgtaaagaatttcacacaag

SEQ ID NO: 7779552 - DNA, 22 bp, Homo sapiens
catgtaaaacactcagaacagt

SEQ ID NO: 7779553 - DNA, 19 bp, Homo sapiens
catggtgaaaccccgtctc

SEQ ID NO: 7779554 - DNA, 22 bp, Homo sapiens
tccagggcaggtgctgggctct

SEQ ID NO: 7779555 - DNA, 22 bp, Homo sapiens
cattaatattgttcttctttag

SEQ ID NO: 7779556 - DNA, 22 bp, Homo sapiens
cattaatattgttcttctttag

SEQ ID NO: 7779557 - DNA, 22 bp, Homo sapiens
cattaataaacatttcagaaga

SEQ ID NO: 7779558 - DNA, 22 bp, Homo sapiens
cattaattgtatttttcaaagt

SEQ ID NO: 7779559 - DNA, 22 bp, Homo sapiens
cattacaacaatctgccatggc

SEQ ID NO: 7779560 - DNA, 23 bp, Homo sapiens
tccagggcagtggctgggtctgc

SEQ ID NO: 7779561 - DNA, 22 bp, Homo sapiens
catgtgcattggggccagggag

SEQ ID NO: 7779562 - DNA, 22 bp, Homo sapiens
catgtgggaagaggccagctgg

SEQ ID NO: 7779563 - DNA, 22 bp, Homo sapiens
cattaataaacatttcagaaga

SEQ ID NO: 7779564 - DNA, 22 bp, Homo sapiens
catgttttctaggctttcacaa

SEQ ID NO: 7779565 - DNA, 22 bp, Homo sapiens
catgttttgtgtacagaatatt

SEQ ID NO: 7779566 - DNA, 22 bp, Homo sapiens
tcacttagatggggatcatcac

SEQ ID NO: 7779567 - DNA, 22 bp, Homo sapiens
cagtgtacttggaatgtaacag

SEQ ID NO: 7779568 - DNA, 22 bp, Homo sapiens
cagtgtaagctctagactagaa

SEQ ID NO: 7779569 - DNA, 22 bp, Homo sapiens
cagtgtcaccaggcgagtctcc

SEQ ID NO: 7779570 - DNA, 22 bp, Homo sapiens
cagtgtcaggatcagtatattt

SEQ ID NO: 7779571 - DNA, 22 bp, Homo sapiens
tcaggaggcctgagtagctcta

SEQ ID NO: 7779572 - DNA, 22 bp, Homo sapiens
tcaggaggccggcaggatttga

SEQ ID NO: 7779573 - DNA, 22 bp, Homo sapiens
tcaggaggccaccaggacctgt

SEQ ID NO: 7779574 - DNA, 22 bp, Homo sapiens
tcaggaggctcaagacctggca

SEQ ID NO: 7779575 - DNA, 22 bp, Homo sapiens
tcaggaggcgtctcgctggggc

SEQ ID NO: 7779576 - DNA, 22 bp, Homo sapiens
tcaggcagaaaaatcactaatt

SEQ ID NO: 7779577 - DNA, 22 bp, Homo sapiens
tcaggagggagtgtggatagag

SEQ ID NO: 7779578 - DNA, 22 bp, Homo sapiens
tcaggcagaattatcaaaagat

SEQ ID NO: 7779579 - DNA, 22 bp, Homo sapiens
tcaggcagaattatcaaaagat

SEQ ID NO: 7779580 - DNA, 22 bp, Homo sapiens
tcaggctgcccgttcagggctc

SEQ ID NO: 7779581 - DNA, 22 bp, Homo sapiens
tcaggctgcccgttcagggctc

SEQ ID NO: 7779582 - DNA, 18 bp, Homo sapiens
tcaggctgccctgtgtct

SEQ ID NO: 7779583 - DNA, 22 bp, Homo sapiens
tcaggctgcatctgtaagggtg

SEQ ID NO: 7779584 - DNA, 22 bp, Homo sapiens
tcaggctgcctatcagactgtg

SEQ ID NO: 7779585 - DNA, 22 bp, Homo sapiens
tcaggctgcctatcagactgtg

SEQ ID NO: 7779586 - DNA, 22 bp, Homo sapiens
catcacattagtctcaagagaa

SEQ ID NO: 7779587 - DNA, 21 bp, Homo sapiens
catcaactcttgtgctcacac

SEQ ID NO: 7779588 - DNA, 22 bp, Homo sapiens
tcaggctgcagtggcaaaagac

SEQ ID NO: 7779589 - DNA, 22 bp, Homo sapiens
tcaggctgatttcttttgaggg

SEQ ID NO: 7779590 - DNA, 22 bp, Homo sapiens
tcaggctgcagctgtcagcagc

SEQ ID NO: 7779591 - DNA, 22 bp, Homo sapiens
tcaggcagaccaccgtgggcag

SEQ ID NO: 7779592 - DNA, 22 bp, Homo sapiens
tcaggcagaccaccgtgggcag

SEQ ID NO: 7779593 - DNA, 22 bp, Homo sapiens
tcaggcagagctgtggagctct

SEQ ID NO: 7779594 - DNA, 22 bp, Homo sapiens
tcaggcagagggagaagccaag

SEQ ID NO: 7779595 - DNA, 22 bp, Homo sapiens
catcaaataggaatatttggca

SEQ ID NO: 7779596 - DNA, 22 bp, Homo sapiens
catcaaatactacatgggttgg

SEQ ID NO: 7779597 - DNA, 22 bp, Homo sapiens
catcaaatgccatatatggttg

SEQ ID NO: 7779598 - DNA, 22 bp, Homo sapiens
catcaaatgccatatatggttg

SEQ ID NO: 7779599 - DNA, 22 bp, Homo sapiens
catcaaagcttttttctgtgtt

SEQ ID NO: 7779600 - DNA, 21 bp, Homo sapiens
catattaaatcggtgccttta

SEQ ID NO: 7779601 - DNA, 22 bp, Homo sapiens
tcatcaaagtcaaagaatgact

SEQ ID NO: 7779602 - DNA, 22 bp, Homo sapiens
tcatacaattcaatctctgatt

SEQ ID NO: 7779603 - DNA, 22 bp, Homo sapiens
tcatacaattcaatctctgatt

SEQ ID NO: 7779604 - DNA, 22 bp, Homo sapiens
tcatacaaggagggtgttcaaa

SEQ ID NO: 7779605 - DNA, 22 bp, Homo sapiens
tcatacaaggagggtgttcaaa

SEQ ID NO: 7779606 - DNA, 22 bp, Homo sapiens
tcatacaactaagagtttcaga

SEQ ID NO: 7779607 - DNA, 22 bp, Homo sapiens
tcatacaactaagagtttcaga

SEQ ID NO: 7779608 - DNA, 22 bp, Homo sapiens
tcataattgtatacatttatgg

SEQ ID NO: 7779609 - DNA, 22 bp, Homo sapiens
tcataagtggtttatatgcttg

SEQ ID NO: 7779610 - DNA, 22 bp, Homo sapiens
catcgtatggccgaatgtacat

SEQ ID NO: 7779611 - DNA, 22 bp, Homo sapiens
catctacactgattaggtgaac

SEQ ID NO: 7779612 - DNA, 22 bp, Homo sapiens
tcataagctagctgcaccatat

SEQ ID NO: 7779613 - DNA, 22 bp, Homo sapiens
tcagtgtgtagtaaattgtagg

SEQ ID NO: 7779614 - DNA, 22 bp, Homo sapiens
tcagtgtcttgggcttgaatgc

SEQ ID NO: 7779615 - DNA, 22 bp, Homo sapiens
catcatcacctgctatacgatc

SEQ ID NO: 7779616 - DNA, 22 bp, Homo sapiens
tcagtgtcttctctttcctacc

SEQ ID NO: 7779617 - DNA, 22 bp, Homo sapiens
tcagtgtcttgacctgggtgtg

SEQ ID NO: 7779618 - DNA, 22 bp, Homo sapiens
tcagtgctgtgtaaatgtatta

SEQ ID NO: 7779619 - DNA, 22 bp, Homo sapiens
tcagtgctgtaaacaaaaggaa

SEQ ID NO: 7779620 - DNA, 22 bp, Homo sapiens
catcagtgttcactattccttc

SEQ ID NO: 7779621 - DNA, 22 bp, Homo sapiens
catcagtgttgatccaccagca

SEQ ID NO: 7779622 - DNA, 22 bp, Homo sapiens
catcagtgtggcagttcactgt

SEQ ID NO: 7779623 - DNA, 22 bp, Homo sapiens
catcaggaaaaaactggagcca

SEQ ID NO: 7779624 - DNA, 22 bp, Homo sapiens
catcaggaaaggacgtctagcc

SEQ ID NO: 7779625 - DNA, 20 bp, Homo sapiens
catcaggaccctcagttttt

SEQ ID NO: 7779626 - DNA, 22 bp, Homo sapiens
catcaggacagcttcttttcac

SEQ ID NO: 7779627 - DNA, 22 bp, Homo sapiens
catcaggaaaggacgtctagcc

SEQ ID NO: 7779628 - DNA, 22 bp, Homo sapiens
catcaggaataaatgaggctgt

SEQ ID NO: 7779629 - DNA, 22 bp, Homo sapiens
catcaggaataaatgaggctgt

SEQ ID NO: 7779630 - DNA, 22 bp, Homo sapiens
catcaggaattatcctaattat

SEQ ID NO: 7779631 - DNA, 22 bp, Homo sapiens
catcaggatctctctggaatgc

SEQ ID NO: 7779632 - DNA, 22 bp, Homo sapiens
catcaggatctctctggaatgc

SEQ ID NO: 7779633 - DNA, 22 bp, Homo sapiens
catcaggataagttccaggtgg

SEQ ID NO: 7779634 - DNA, 22 bp, Homo sapiens
catcaggagaccaggtcctgct

SEQ ID NO: 7779635 - DNA, 22 bp, Homo sapiens
catcaggaggagatgaagaaaa

SEQ ID NO: 7779636 - DNA, 22 bp, Homo sapiens
catcagagtggtggcctggtgt

SEQ ID NO: 7779637 - DNA, 22 bp, Homo sapiens
catcagcactatgattaaagta

SEQ ID NO: 7779638 - DNA, 22 bp, Homo sapiens
catcagctcttcattcttgatt

SEQ ID NO: 7779639 - DNA, 22 bp, Homo sapiens
ccacccctgggtgcagggagcg

SEQ ID NO: 7779640 - DNA, 22 bp, Homo sapiens
ccacccatgtgactacctcatg

SEQ ID NO: 7779641 - DNA, 19 bp, Homo sapiens
ccacccctttgctgggccc

SEQ ID NO: 7779642 - DNA, 22 bp, Homo sapiens
ccacccctgggtgcagggagcg

SEQ ID NO: 7779643 - DNA, 22 bp, Homo sapiens
ccacccctgtagagggacagac

SEQ ID NO: 7779644 - DNA, 22 bp, Homo sapiens
ccacccctgtagagggacagac

SEQ ID NO: 7779645 - DNA, 19 bp, Homo sapiens
ccacccctttgctgggccc

SEQ ID NO: 7779646 - DNA, 22 bp, Homo sapiens
ccaccctgccttgggccagtga

SEQ ID NO: 7779647 - DNA, 20 bp, Homo sapiens
ccaccctgctaagaatacac

SEQ ID NO: 7779648 - DNA, 20 bp, Homo sapiens
ccaccctgctaagaatacac

SEQ ID NO: 7779649 - DNA, 22 bp, Homo sapiens
tctagaacttctctaaaatgaa

SEQ ID NO: 7779650 - DNA, 22 bp, Homo sapiens
tctcaggaatagagtggcagca

SEQ ID NO: 7779651 - DNA, 22 bp, Homo sapiens
tctcaggaatagagtggcagca

SEQ ID NO: 7779652 - DNA, 22 bp, Homo sapiens
tctataaattatgcagtctcag

SEQ ID NO: 7779653 - DNA, 22 bp, Homo sapiens
tctagaatctaaactatagttt

SEQ ID NO: 7779654 - DNA, 22 bp, Homo sapiens
tctataaatgcagatatgtgtg

SEQ ID NO: 7779655 - DNA, 22 bp, Homo sapiens
tctcagtggatctcagaatttt

SEQ ID NO: 7779656 - DNA, 22 bp, Homo sapiens
tctcaggagccacagcgggagt

SEQ ID NO: 7779657 - DNA, 22 bp, Homo sapiens
tctcaggactcctctggccata

SEQ ID NO: 7779658 - DNA, 22 bp, Homo sapiens
ccagagaggccttggcaagaca

SEQ ID NO: 7779659 - DNA, 22 bp, Homo sapiens
tctcagtgtttaaaaagatttc

SEQ ID NO: 7779660 - DNA, 22 bp, Homo sapiens
tctcagtgggaagggcacagtt

SEQ ID NO: 7779661 - DNA, 22 bp, Homo sapiens
tctctgtaaggaagaattagat

SEQ ID NO: 7779662 - DNA, 22 bp, Homo sapiens
ccagatgttcccctggaggcct

SEQ ID NO: 7779663 - DNA, 22 bp, Homo sapiens
ccagaggtcctgctcactggtg

SEQ ID NO: 7779664 - DNA, 22 bp, Homo sapiens
ccagaggtgagggggattcttg

SEQ ID NO: 7779665 - DNA, 22 bp, Homo sapiens
ccagaggtgaacaggaggctgt

SEQ ID NO: 7779666 - DNA, 22 bp, Homo sapiens
ccagaggtctcctgcacgggat

SEQ ID NO: 7779667 - DNA, 22 bp, Homo sapiens
ccagaggctgggttcacctcag

SEQ ID NO: 7779668 - DNA, 22 bp, Homo sapiens
ccagaggatcagtactggctgg

SEQ ID NO: 7779669 - DNA, 22 bp, Homo sapiens
ccagagcagggcagcagggctc

SEQ ID NO: 7779670 - DNA, 22 bp, Homo sapiens
ccagagcccgggacctggactt

SEQ ID NO: 7779671 - DNA, 22 bp, Homo sapiens
ccagagccggctccctcagctt

SEQ ID NO: 7779672 - DNA, 22 bp, Homo sapiens
ccagagccggctccctcagctt

SEQ ID NO: 7779673 - DNA, 22 bp, Homo sapiens
catttattggcatgtagtaggt

SEQ ID NO: 7779674 - DNA, 22 bp, Homo sapiens
catttcactattcactaaaagg

SEQ ID NO: 7779675 - DNA, 22 bp, Homo sapiens
catttcaccttagagaattatt

SEQ ID NO: 7779676 - DNA, 22 bp, Homo sapiens
tccatatacaacttaatcttta

SEQ ID NO: 7779677 - DNA, 22 bp, Homo sapiens
tccatataatgggattccttat

SEQ ID NO: 7779678 - DNA, 22 bp, Homo sapiens
tccataaaccagaaaatcaaga

SEQ ID NO: 7779679 - DNA, 22 bp, Homo sapiens
catttccacttctgaaaactgg

SEQ ID NO: 7779680 - DNA, 22 bp, Homo sapiens
catttctaccaaatgtgactgg

SEQ ID NO: 7779681 - DNA, 22 bp, Homo sapiens
catttcactattcactaaaagg

SEQ ID NO: 7779682 - DNA, 22 bp, Homo sapiens
catttcatagttgtcacaataa

SEQ ID NO: 7779683 - DNA, 21 bp, Homo sapiens
catttcatgattatagaaatg

SEQ ID NO: 7779684 - DNA, 20 bp, Homo sapiens
catttcattgtgtcttcact

SEQ ID NO: 7779685 - DNA, 22 bp, Homo sapiens
catttcattcctttgaaagtgg

SEQ ID NO: 7779686 - DNA, 22 bp, Homo sapiens
cattttatcctctgggaagcta

SEQ ID NO: 7779687 - DNA, 22 bp, Homo sapiens
cattttcagcacccatctgaaa

SEQ ID NO: 7779688 - DNA, 22 bp, Homo sapiens
cattttatgtttatggagtgct

SEQ ID NO: 7779689 - DNA, 21 bp, Homo sapiens
catttctattgatgagaaaag

SEQ ID NO: 7779690 - DNA, 19 bp, Homo sapiens
cattttcccatcatccttt

SEQ ID NO: 7779691 - DNA, 21 bp, Homo sapiens
tcctgccttagtccagagcag

SEQ ID NO: 7779692 - DNA, 22 bp, Homo sapiens
tcctgccttagagcaaggaaaa

SEQ ID NO: 7779693 - DNA, 21 bp, Homo sapiens
tcctgccttagtccagagcag

SEQ ID NO: 7779694 - DNA, 22 bp, Homo sapiens
tcctgccttgcctgggacatca

SEQ ID NO: 7779695 - DNA, 22 bp, Homo sapiens
tcctgccttgcctgggacatca

SEQ ID NO: 7779696 - DNA, 22 bp, Homo sapiens
tcctgccttcatactgctgtat

SEQ ID NO: 7779697 - DNA, 22 bp, Homo sapiens
tcctgccttcatactgctgtat

SEQ ID NO: 7779698 - DNA, 21 bp, Homo sapiens
ccaagactcccatctagtggt

SEQ ID NO: 7779699 - DNA, 22 bp, Homo sapiens
ccaaattaaatcatacagacag

SEQ ID NO: 7779700 - DNA, 22 bp, Homo sapiens
ccacagggaacatgacagcctt

SEQ ID NO: 7779701 - DNA, 22 bp, Homo sapiens
ccacaggctgctgcaggtcccg

SEQ ID NO: 7779702 - DNA, 22 bp, Homo sapiens
ccacaggcggagtggcgggcag

SEQ ID NO: 7779703 - DNA, 22 bp, Homo sapiens
tcctggagcttccttcatggta

SEQ ID NO: 7779704 - DNA, 22 bp, Homo sapiens
tcctggagctggtgtctttccc

SEQ ID NO: 7779705 - DNA, 20 bp, Homo sapiens
tcctggccttctcgggcagt

SEQ ID NO: 7779706 - DNA, 22 bp, Homo sapiens
tcctggctccactgagcaggcc

SEQ ID NO: 7779707 - DNA, 22 bp, Homo sapiens
tcctggccttagcgaggcggtc

SEQ ID NO: 7779708 - DNA, 22 bp, Homo sapiens
ccacagggcctttcctgctggc

SEQ ID NO: 7779709 - DNA, 21 bp, Homo sapiens
ccacaggggctcccctgtcag

SEQ ID NO: 7779710 - DNA, 22 bp, Homo sapiens
tacacaggggagcatggttgac

SEQ ID NO: 7779711 - DNA, 22 bp, Homo sapiens
tacacagggtatggcttgagga

SEQ ID NO: 7779712 - DNA, 22 bp, Homo sapiens
tacacagggagagattggaaac

SEQ ID NO: 7779713 - DNA, 22 bp, Homo sapiens
tacaatagggcttttgtttatg

SEQ ID NO: 7779714 - DNA, 22 bp, Homo sapiens
tacactgtgaggtttccaaggg

SEQ ID NO: 7779715 - DNA, 22 bp, Homo sapiens
tacagagaactcatagaaagaa

SEQ ID NO: 7779716 - DNA, 22 bp, Homo sapiens
tacacttgttcaaacagcaaaa

SEQ ID NO: 7779717 - DNA, 22 bp, Homo sapiens
caggcctggagtgcaatggcac

SEQ ID NO: 7779718 - DNA, 22 bp, Homo sapiens
caggcctgtctgcacatgaggc

SEQ ID NO: 7779719 - DNA, 22 bp, Homo sapiens
tacagagaggtgacccttgggc

SEQ ID NO: 7779720 - DNA, 22 bp, Homo sapiens
caggctccctgggcagtggcag

SEQ ID NO: 7779721 - DNA, 22 bp, Homo sapiens
caggctcccgctccactgggca

SEQ ID NO: 7779722 - DNA, 22 bp, Homo sapiens
caggctccctaagtcagcagcc

SEQ ID NO: 7779723 - DNA, 22 bp, Homo sapiens
caggctccctaagtcagcagcc

SEQ ID NO: 7779724 - DNA, 22 bp, Homo sapiens
caggctctaggttagtaggaga

SEQ ID NO: 7779725 - DNA, 22 bp, Homo sapiens
caggctccttcccagggatggt

SEQ ID NO: 7779726 - DNA, 22 bp, Homo sapiens
caggctccttatcttacaactt

SEQ ID NO: 7779727 - DNA, 17 bp, Homo sapiens
caggctccttccagatt

SEQ ID NO: 7779728 - DNA, 20 bp, Homo sapiens
caggctccgcaggactaggg

SEQ ID NO: 7779729 - DNA, 22 bp, Homo sapiens
caggctcccgaaatcacccatg

SEQ ID NO: 7779730 - DNA, 22 bp, Homo sapiens
tagacatttggcatggttttca

SEQ ID NO: 7779731 - DNA, 22 bp, Homo sapiens
tagacatttgtcaagaatgact

SEQ ID NO: 7779732 - DNA, 22 bp, Homo sapiens
tagacaggagtcaggctagaat

SEQ ID NO: 7779733 - DNA, 22 bp, Homo sapiens
cagggagaggcatcatagggaa

SEQ ID NO: 7779734 - DNA, 22 bp, Homo sapiens
cagggagaggcctctgttgccc

SEQ ID NO: 7779735 - DNA, 22 bp, Homo sapiens
tagaaatgtgataatagcttaa

SEQ ID NO: 7779736 - DNA, 22 bp, Homo sapiens
tagaaatgttagatgtattgag

SEQ ID NO: 7779737 - DNA, 22 bp, Homo sapiens
cagggacagccttggggtggcg

SEQ ID NO: 7779738 - DNA, 22 bp, Homo sapiens
cagggagaagtctggtcagtcc

SEQ ID NO: 7779739 - DNA, 22 bp, Homo sapiens
tacctcatgctgtacagcacgt

SEQ ID NO: 7779740 - DNA, 22 bp, Homo sapiens
tacctcattacatctgcaatga

SEQ ID NO: 7779741 - DNA, 22 bp, Homo sapiens
caggctgagggttaggccttag

SEQ ID NO: 7779742 - DNA, 22 bp, Homo sapiens
caggctgcagaggcctttcatg

SEQ ID NO: 7779743 - DNA, 22 bp, Homo sapiens
caggctgcagcagcagtggccc

SEQ ID NO: 7779744 - DNA, 22 bp, Homo sapiens
cagggcagttttacttctctct

SEQ ID NO: 7779745 - DNA, 22 bp, Homo sapiens
cagggcataagatgaggctgta

SEQ ID NO: 7779746 - DNA, 22 bp, Homo sapiens
cagggcagttttacttctctct

SEQ ID NO: 7779747 - DNA, 22 bp, Homo sapiens
cagggcagtttgtgcctatgag

SEQ ID NO: 7779748 - DNA, 22 bp, Homo sapiens
cagggcagtgaagaacacacgt

SEQ ID NO: 7779749 - DNA, 22 bp, Homo sapiens
cagggcagtgaagaacacacgt

SEQ ID NO: 7779750 - DNA, 22 bp, Homo sapiens
cagggcagtaccgccctctggc

SEQ ID NO: 7779751 - DNA, 22 bp, Homo sapiens
cagggcagtaccgccctctggc

SEQ ID NO: 7779752 - DNA, 22 bp, Homo sapiens
tagcattagagatagaaatagt

SEQ ID NO: 7779753 - DNA, 22 bp, Homo sapiens
tagcattaaaggtaagacatta

SEQ ID NO: 7779754 - DNA, 20 bp, Homo sapiens
tagcatgggtgagggtagag

SEQ ID NO: 7779755 - DNA, 22 bp, Homo sapiens
tagcataggaaagtactgggaa

SEQ ID NO: 7779756 - DNA, 22 bp, Homo sapiens
tagcataacaggtaagagtgag

SEQ ID NO: 7779757 - DNA, 22 bp, Homo sapiens
cagggatggcctggcgggccac

SEQ ID NO: 7779758 - DNA, 22 bp, Homo sapiens
cagggatgagcagatggagcaa

SEQ ID NO: 7779759 - DNA, 22 bp, Homo sapiens
tagcagcacagaaagcctggag

SEQ ID NO: 7779760 - DNA, 21 bp, Homo sapiens
tagcaattatagatgtctaaa

SEQ ID NO: 7779761 - DNA, 22 bp, Homo sapiens
cagggatgagaaagctctctaa

SEQ ID NO: 7779762 - DNA, 22 bp, Homo sapiens
cagggatgagaaagctctctaa

SEQ ID NO: 7779763 - DNA, 22 bp, Homo sapiens
cagggagctttgtcttctcatt

SEQ ID NO: 7779764 - DNA, 22 bp, Homo sapiens
cagggagcctgaatgttccagg

SEQ ID NO: 7779765 - DNA, 22 bp, Homo sapiens
cagggagcggagtcccatgcct

SEQ ID NO: 7779766 - DNA, 22 bp, Homo sapiens
cagtgcagttggtggcaggggt

SEQ ID NO: 7779767 - DNA, 22 bp, Homo sapiens
cagtgcagtttcccagatgctg

SEQ ID NO: 7779768 - DNA, 22 bp, Homo sapiens
cagtgcagaggccagggaggat

SEQ ID NO: 7779769 - DNA, 22 bp, Homo sapiens
cagtgcagaggtgcaagcatgt

SEQ ID NO: 7779770 - DNA, 22 bp, Homo sapiens
cagtggagaggcatgcttggca

SEQ ID NO: 7779771 - DNA, 19 bp, Homo sapiens
cagtggagattggaggagg

SEQ ID NO: 7779772 - DNA, 22 bp, Homo sapiens
tcacactaagacaaaataattt

SEQ ID NO: 7779773 - DNA, 22 bp, Homo sapiens
cagtggagtgggactggtctga

SEQ ID NO: 7779774 - DNA, 22 bp, Homo sapiens
cagtggaggccttgggaccttt

SEQ ID NO: 7779775 - DNA, 22 bp, Homo sapiens
cagtggcaagaacagtaataat

SEQ ID NO: 7779776 - DNA, 22 bp, Homo sapiens
cagtggcaaggacagtaataat

SEQ ID NO: 7779777 - DNA, 22 bp, Homo sapiens
cagtggcaagaacagtaataat

SEQ ID NO: 7779778 - DNA, 22 bp, Homo sapiens
cagtggcaaggacagtaataat

SEQ ID NO: 7779779 - DNA, 22 bp, Homo sapiens
cagtggcacttgtcatttctga

SEQ ID NO: 7779780 - DNA, 22 bp, Homo sapiens
cagtggcagagaacagagacct

SEQ ID NO: 7779781 - DNA, 17 bp, Homo sapiens
cagtggcagatcttctc

SEQ ID NO: 7779782 - DNA, 22 bp, Homo sapiens
cagtggcacccacgggctgggc

SEQ ID NO: 7779783 - DNA, 21 bp, Homo sapiens
cagtggcacgatttcggctca

SEQ ID NO: 7779784 - DNA, 22 bp, Homo sapiens
tcactgcaagctccacctcccg

SEQ ID NO: 7779785 - DNA, 22 bp, Homo sapiens
tcactgcaacctccacctcctg

SEQ ID NO: 7779786 - DNA, 22 bp, Homo sapiens
tcacattcatggtgctaataaa

SEQ ID NO: 7779787 - DNA, 18 bp, Homo sapiens
tcacattataatgtaaca

SEQ ID NO: 7779788 - DNA, 22 bp, Homo sapiens
tcacatgtcagtcttaaacaga

SEQ ID NO: 7779789 - DNA, 22 bp, Homo sapiens
tcacatgtcagtcttaaacaga

SEQ ID NO: 7779790 - DNA, 22 bp, Homo sapiens
tcacatgtcaaaaactacataa

SEQ ID NO: 7779791 - DNA, 22 bp, Homo sapiens
tcacatgtcaagaagataattt

SEQ ID NO: 7779792 - DNA, 22 bp, Homo sapiens
cagtcccatctcccaggtggct

SEQ ID NO: 7779793 - DNA, 22 bp, Homo sapiens
cagtcccatctcccaggtggct

SEQ ID NO: 7779794 - DNA, 22 bp, Homo sapiens
cagtcccatgagcccagaacat

SEQ ID NO: 7779795 - DNA, 15 bp, Homo sapiens
cagtcccagggaccc

SEQ ID NO: 7779796 - DNA, 22 bp, Homo sapiens
cagtcccagctgctcagaaggc

SEQ ID NO: 7779797 - DNA, 22 bp, Homo sapiens
cagtcccagggttggttcagct

SEQ ID NO: 7779798 - DNA, 22 bp, Homo sapiens
cagtcccagggttggttcagct

SEQ ID NO: 7779799 - DNA, 22 bp, Homo sapiens
cagtcccagtttgagactctgg

SEQ ID NO: 7779800 - DNA, 22 bp, Homo sapiens
cagtctggaggtcagctggctt

SEQ ID NO: 7779801 - DNA, 22 bp, Homo sapiens
cagtcttaggagaaactacaga

SEQ ID NO: 7779802 - DNA, 22 bp, Homo sapiens
cagtcttagccttccctcaccc

SEQ ID NO: 7779803 - DNA, 22 bp, Homo sapiens
cagtgaaatagtggacatcaaa

SEQ ID NO: 7779804 - DNA, 22 bp, Homo sapiens
cagtgaaatcacaactttagtt

SEQ ID NO: 7779805 - DNA, 22 bp, Homo sapiens
cagtctttgacaagccctttca

SEQ ID NO: 7779806 - DNA, 22 bp, Homo sapiens
cagtctttgatgcatcctagcc

SEQ ID NO: 7779807 - DNA, 22 bp, Homo sapiens
cagtctttgttcccattactga

SEQ ID NO: 7779808 - DNA, 22 bp, Homo sapiens
cagtcttttgtatattagcaga

SEQ ID NO: 7779809 - DNA, 22 bp, Homo sapiens
tcaaattagtggaataataatg

SEQ ID NO: 7779810 - DNA, 22 bp, Homo sapiens
tcaaattagtggaataataatg

SEQ ID NO: 7779811 - DNA, 22 bp, Homo sapiens
tcaaattgtcatcttgataatg

SEQ ID NO: 7779812 - DNA, 22 bp, Homo sapiens
tcaacaaatacttaaagcagag

SEQ ID NO: 7779813 - DNA, 22 bp, Homo sapiens
tcaaattttaacatgcattaga

SEQ ID NO: 7779814 - DNA, 22 bp, Homo sapiens
tcaaaagaaacaccatgttcct

SEQ ID NO: 7779815 - DNA, 20 bp, Homo sapiens
tcaaagcactgcctgtcatc

SEQ ID NO: 7779816 - DNA, 22 bp, Homo sapiens
tcaaaggagtttaagttactgg

SEQ ID NO: 7779817 - DNA, 20 bp, Homo sapiens
tcaaaggcaaaggtgggtgt

SEQ ID NO: 7779818 - DNA, 22 bp, Homo sapiens
cagtacttttctggctttctac

SEQ ID NO: 7779819 - DNA, 22 bp, Homo sapiens
cagtagaagcttgtttttcaga

SEQ ID NO: 7779820 - DNA, 22 bp, Homo sapiens
cagtagaattattataaaacat

SEQ ID NO: 7779821 - DNA, 22 bp, Homo sapiens
cagtaattccaagtgcttatac

SEQ ID NO: 7779822 - DNA, 22 bp, Homo sapiens
cagtaaaagatggaaatagaat

SEQ ID NO: 7779823 - DNA, 22 bp, Homo sapiens
caggtggggcagctgtgggagc

SEQ ID NO: 7779824 - DNA, 22 bp, Homo sapiens
caggtggggagagtgtggagca

SEQ ID NO: 7779825 - DNA, 22 bp, Homo sapiens
tatgcaaatgactggtatgttt

SEQ ID NO: 7779826 - DNA, 22 bp, Homo sapiens
tatgcaaatcattagatttcct

SEQ ID NO: 7779827 - DNA, 22 bp, Homo sapiens
tatgcaaatcattagatttcct

SEQ ID NO: 7779828 - DNA, 22 bp, Homo sapiens
tatgcaacagcattattacaat

SEQ ID NO: 7779829 - DNA, 22 bp, Homo sapiens
tatgcaacatctggtagaaatc

SEQ ID NO: 7779830 - DNA, 22 bp, Homo sapiens
tatgcaacagcattattacaat

SEQ ID NO: 7779831 - DNA, 22 bp, Homo sapiens
tatgcacaacatgcaggtttgt

SEQ ID NO: 7779832 - DNA, 22 bp, Homo sapiens
tatgcaaagccacccagggacg

SEQ ID NO: 7779833 - DNA, 22 bp, Homo sapiens
tatgcaaactaagttgtttcct

SEQ ID NO: 7779834 - DNA, 22 bp, Homo sapiens
tatgcaaactaagttgtttcct

SEQ ID NO: 7779835 - DNA, 22 bp, Homo sapiens
tatgcaaacagttcaggtgaca

SEQ ID NO: 7779836 - DNA, 22 bp, Homo sapiens
tatattgtaggtgctatttgaa

SEQ ID NO: 7779837 - DNA, 22 bp, Homo sapiens
tatattgtagctgatgacaaat

SEQ ID NO: 7779838 - DNA, 18 bp, Homo sapiens
tatattctgtgccctggt

SEQ ID NO: 7779839 - DNA, 22 bp, Homo sapiens
tagtttctagtcaatcttcttt

SEQ ID NO: 7779840 - DNA, 22 bp, Homo sapiens
tagttttacttgcgatgataat

SEQ ID NO: 7779841 - DNA, 22 bp, Homo sapiens
tagttttacttgcgatgataat

SEQ ID NO: 7779842 - DNA, 22 bp, Homo sapiens
tagttttacttgcgatgataat

SEQ ID NO: 7779843 - DNA, 22 bp, Homo sapiens
tagtttgtagaaatctagaaat

SEQ ID NO: 7779844 - DNA, 22 bp, Homo sapiens
tagttttacatcagccattgtt

SEQ ID NO: 7779845 - DNA, 22 bp, Homo sapiens
tagtttgtcaaccactgtcaca

SEQ ID NO: 7779846 - DNA, 22 bp, Homo sapiens
tagtttctgaggattgaaagat

SEQ ID NO: 7779847 - DNA, 22 bp, Homo sapiens
tagtttctcagggaggaaagaa

SEQ ID NO: 7779848 - DNA, 22 bp, Homo sapiens
tagtttctgaggattgaaagat

SEQ ID NO: 7779849 - DNA, 22 bp, Homo sapiens
tagtttcttcacctgtaaaatg

SEQ ID NO: 7779850 - DNA, 22 bp, Homo sapiens
tagtttcttgattagccacttt

SEQ ID NO: 7779851 - DNA, 22 bp, Homo sapiens
tagtttcttcacctgtaaaatg

SEQ ID NO: 7779852 - DNA, 22 bp, Homo sapiens
tatataatttgtaaaagcacct

SEQ ID NO: 7779853 - DNA, 21 bp, Homo sapiens
tatacatgtgcacacacatgc

SEQ ID NO: 7779854 - DNA, 22 bp, Homo sapiens
tagttttagcagcaatgggatg

SEQ ID NO: 7779855 - DNA, 22 bp, Homo sapiens
tatatagaaaagcagatgttgg

SEQ ID NO: 7779856 - DNA, 22 bp, Homo sapiens
tagtacagtggcattcaaactt

SEQ ID NO: 7779857 - DNA, 22 bp, Homo sapiens
tagtacagttccatcaaagcag

SEQ ID NO: 7779858 - DNA, 22 bp, Homo sapiens
tagtaataagttgtgctttgat

SEQ ID NO: 7779859 - DNA, 22 bp, Homo sapiens
tagtaaatctcagaaaaagatc

SEQ ID NO: 7779860 - DNA, 22 bp, Homo sapiens
taggtatacagagatttctggg

SEQ ID NO: 7779861 - DNA, 17 bp, Homo sapiens
tagtaaatgagtagagc

SEQ ID NO: 7779862 - DNA, 22 bp, Homo sapiens
tagtaaattaaaatattgactt

SEQ ID NO: 7779863 - DNA, 22 bp, Homo sapiens
tagtaaattaaaatattgactt

SEQ ID NO: 7779864 - DNA, 20 bp, Homo sapiens
cagggccacgctccaaggca

SEQ ID NO: 7779865 - DNA, 22 bp, Homo sapiens
tttcataaacagtagaagacta

SEQ ID NO: 7779866 - DNA, 22 bp, Homo sapiens
tttcacatttgttttaagaagt

SEQ ID NO: 7779867 - DNA, 22 bp, Homo sapiens
tttcacatttgttttaagaagt

SEQ ID NO: 7779868 - DNA, 22 bp, Homo sapiens
tttcacatttaggcgtgaattg

SEQ ID NO: 7779869 - DNA, 22 bp, Homo sapiens
tttcagtgtatcttccaaaagc

SEQ ID NO: 7779870 - DNA, 22 bp, Homo sapiens
tttcacattggcttctatttct

SEQ ID NO: 7779871 - DNA, 22 bp, Homo sapiens
tttcacattggcttctatttct

SEQ ID NO: 7779872 - DNA, 23 bp, Homo sapiens
tttcacatttactgttagatggc

SEQ ID NO: 7779873 - DNA, 23 bp, Homo sapiens
tttcacatttactgttagatggc

SEQ ID NO: 7779874 - DNA, 22 bp, Homo sapiens
tttcacattctctggttatcga

SEQ ID NO: 7779875 - DNA, 22 bp, Homo sapiens
tttcacattctctggttatcga

SEQ ID NO: 7779876 - DNA, 22 bp, Homo sapiens
tttcacattcttctgaatctac

SEQ ID NO: 7779877 - DNA, 22 bp, Homo sapiens
tttcacattcttctgaatctac

SEQ ID NO: 7779878 - DNA, 22 bp, Homo sapiens
tttcacattcagatatagactt

SEQ ID NO: 7779879 - DNA, 22 bp, Homo sapiens
tttcacattcagatatagactt

SEQ ID NO: 7779880 - DNA, 22 bp, Homo sapiens
tttcacattagatatgtcattt

SEQ ID NO: 7779881 - DNA, 23 bp, Homo sapiens
tttcacattaatgtttagcagga

SEQ ID NO: 7779882 - DNA, 23 bp, Homo sapiens
tttcacattaatgtttagcagga

SEQ ID NO: 7779883 - DNA, 22 bp, Homo sapiens
tttcacattagatatgtcattt

SEQ ID NO: 7779884 - DNA, 22 bp, Homo sapiens
tttcacatggactttttgttct

SEQ ID NO: 7779885 - DNA, 22 bp, Homo sapiens
tttcacatggactttttgttct

SEQ ID NO: 7779886 - DNA, 22 bp, Homo sapiens
tttcacatggaagctctcgaga

SEQ ID NO: 7779887 - DNA, 22 bp, Homo sapiens
tttcacatgcagcagggaagtg

SEQ ID NO: 7779888 - DNA, 20 bp, Homo sapiens
tttcacatctgtccctttaa

SEQ ID NO: 7779889 - DNA, 20 bp, Homo sapiens
tttcacatctgtccctttaa

SEQ ID NO: 7779890 - DNA, 22 bp, Homo sapiens
tttcacatcctgaagccccact

SEQ ID NO: 7779891 - DNA, 22 bp, Homo sapiens
tttcacatcccgcgcgccctta

SEQ ID NO: 7779892 - DNA, 22 bp, Homo sapiens
tttcacatcatgggatggaagc

SEQ ID NO: 7779893 - DNA, 22 bp, Homo sapiens
tttcacatgtatataggcatta

SEQ ID NO: 7779894 - DNA, 22 bp, Homo sapiens
tttcacatgtatataggcatta

SEQ ID NO: 7779895 - DNA, 22 bp, Homo sapiens
tttcacatggtactgcctgttt

SEQ ID NO: 7779896 - DNA, 22 bp, Homo sapiens
tttcacatggtactgcctgttt

SEQ ID NO: 7779897 - DNA, 22 bp, Homo sapiens
tttcacatgtgctgttgtcaat

SEQ ID NO: 7779898 - DNA, 22 bp, Homo sapiens
tttcacatgtggaatgccaggt

SEQ ID NO: 7779899 - DNA, 22 bp, Homo sapiens
tttcacatgtggaatgccaggt

SEQ ID NO: 7779900 - DNA, 22 bp, Homo sapiens
tttcacatcagaggtagattag

SEQ ID NO: 7779901 - DNA, 22 bp, Homo sapiens
tttcacatatggttgttgattg

SEQ ID NO: 7779902 - DNA, 22 bp, Homo sapiens
tttcacatatggttgttgattg

SEQ ID NO: 7779903 - DNA, 22 bp, Homo sapiens
tttcacatcagaggtagattag

SEQ ID NO: 7779904 - DNA, 22 bp, Homo sapiens
tttatttataagccacttgctg

SEQ ID NO: 7779905 - DNA, 21 bp, Homo sapiens
tttatttatataggacacatg

SEQ ID NO: 7779906 - DNA, 22 bp, Homo sapiens
tttatttatccttctggattgc

SEQ ID NO: 7779907 - DNA, 23 bp, Homo sapiens
tttatttatttaggctgagggat

SEQ ID NO: 7779908 - DNA, 20 bp, Homo sapiens
tttcaagtcagcaattctca

SEQ ID NO: 7779909 - DNA, 22 bp, Homo sapiens
tttcaagtaagatacatttcag

SEQ ID NO: 7779910 - DNA, 22 bp, Homo sapiens
tttcaagtcagtagctaatcat

SEQ ID NO: 7779911 - DNA, 22 bp, Homo sapiens
tttcaagtgtcctgattaatgg

SEQ ID NO: 7779912 - DNA, 22 bp, Homo sapiens
tttcaagtggggacatttgaga

SEQ ID NO: 7779913 - DNA, 22 bp, Homo sapiens
tttcaagtggcgagataaggaa

SEQ ID NO: 7779914 - DNA, 22 bp, Homo sapiens
tttcaagttctgttcctaaact

SEQ ID NO: 7779915 - DNA, 22 bp, Homo sapiens
tttcaatgacacaaaagagaaa

SEQ ID NO: 7779916 - DNA, 22 bp, Homo sapiens
tttcaatgacacaaaagagaaa

SEQ ID NO: 7779917 - DNA, 22 bp, Homo sapiens
tttcaagttgtttatatccaga

SEQ ID NO: 7779918 - DNA, 22 bp, Homo sapiens
tttcaagttgttgcattaaatg

SEQ ID NO: 7779919 - DNA, 20 bp, Homo sapiens
tttcaagttgtaaggtatca

SEQ ID NO: 7779920 - DNA, 22 bp, Homo sapiens
tttcacaacgttgtggtgagag

SEQ ID NO: 7779921 - DNA, 22 bp, Homo sapiens
tttcacaacgttgtggtgagag

SEQ ID NO: 7779922 - DNA, 22 bp, Homo sapiens
tttcacaagtttcaggattctg

SEQ ID NO: 7779923 - DNA, 22 bp, Homo sapiens
tttcacaactgcttatttgaga

SEQ ID NO: 7779924 - DNA, 22 bp, Homo sapiens
tttcacaactgcttatttgaga

SEQ ID NO: 7779925 - DNA, 22 bp, Homo sapiens
tttcccaaagcctggggtgagt

SEQ ID NO: 7779926 - DNA, 22 bp, Homo sapiens
tttcccaacagtctctctcaaa

SEQ ID NO: 7779927 - DNA, 22 bp, Homo sapiens
tttcccaagaccatagatggaa

SEQ ID NO: 7779928 - DNA, 22 bp, Homo sapiens
tttcccaagaaaaataattgga

SEQ ID NO: 7779929 - DNA, 22 bp, Homo sapiens
tttcccaattgagaggttctgt

SEQ ID NO: 7779930 - DNA, 22 bp, Homo sapiens
tttcccaatgagtccttgagca

SEQ ID NO: 7779931 - DNA, 22 bp, Homo sapiens
tttcccaagtgtaaacatggca

SEQ ID NO: 7779932 - DNA, 22 bp, Homo sapiens
tttcccaagtgaagtgaagcca

SEQ ID NO: 7779933 - DNA, 23 bp, Homo sapiens
tttcccaccctctctcattgctg

SEQ ID NO: 7779934 - DNA, 22 bp, Homo sapiens
tttcctttgggagcatgaattt

SEQ ID NO: 7779935 - DNA, 22 bp, Homo sapiens
tttctaaggtgaggtagaaaat

SEQ ID NO: 7779936 - DNA, 22 bp, Homo sapiens
tttctaaggtgaggtagaaaat

SEQ ID NO: 7779937 - DNA, 22 bp, Homo sapiens
tttctaaggctaggtcttaagg

SEQ ID NO: 7779938 - DNA, 22 bp, Homo sapiens
tttctaaggctaggtcttaagg

SEQ ID NO: 7779939 - DNA, 19 bp, Homo sapiens
tttctaagctaaatgcttc

SEQ ID NO: 7779940 - DNA, 22 bp, Homo sapiens
tttctaagatgtggtttcaagg

SEQ ID NO: 7779941 - DNA, 19 bp, Homo sapiens
tttctaagctaaatgcttc

SEQ ID NO: 7779942 - DNA, 22 bp, Homo sapiens
tttctaagaatattgctcttaa

SEQ ID NO: 7779943 - DNA, 22 bp, Homo sapiens
tttctaagaaagtaatggttat

SEQ ID NO: 7779944 - DNA, 22 bp, Homo sapiens
tttctaaagggtagatttggcc

SEQ ID NO: 7779945 - DNA, 22 bp, Homo sapiens
tttcggaataaatacgaacatc

SEQ ID NO: 7779946 - DNA, 22 bp, Homo sapiens
tttcctttgtgcaggccttggg

SEQ ID NO: 7779947 - DNA, 22 bp, Homo sapiens
tttcctttgtgcaggccttggg

SEQ ID NO: 7779948 - DNA, 22 bp, Homo sapiens
tttccttttataaggcttgagg

SEQ ID NO: 7779949 - DNA, 22 bp, Homo sapiens
tttctaaaatagattttatggt

SEQ ID NO: 7779950 - DNA, 22 bp, Homo sapiens
tttctaaactggattcagcctg

SEQ ID NO: 7779951 - DNA, 22 bp, Homo sapiens
tttccaggagaaagagagcctt

SEQ ID NO: 7779952 - DNA, 22 bp, Homo sapiens
tttccaaataaggtcacattct

SEQ ID NO: 7779953 - DNA, 22 bp, Homo sapiens
tttccaaataaggtcacattct

SEQ ID NO: 7779954 - DNA, 22 bp, Homo sapiens
tttccaaataaggtcacattct

SEQ ID NO: 7779955 - DNA, 22 bp, Homo sapiens
tttcatcttccttggcataggt

SEQ ID NO: 7779956 - DNA, 22 bp, Homo sapiens
tttccaaataaggtcacactca

SEQ ID NO: 7779957 - DNA, 22 bp, Homo sapiens
tttcatctgtgctgccaagact

SEQ ID NO: 7779958 - DNA, 22 bp, Homo sapiens
tttcatcttatttgtctacatc

SEQ ID NO: 7779959 - DNA, 22 bp, Homo sapiens
tttccagggctctgtagaagaa

SEQ ID NO: 7779960 - DNA, 22 bp, Homo sapiens
tttcatattgtccagtcagcgc

SEQ ID NO: 7779961 - DNA, 22 bp, Homo sapiens
tttcatattattccttgagtct

SEQ ID NO: 7779962 - DNA, 22 bp, Homo sapiens
tttcatagccttctaatgagtt

SEQ ID NO: 7779963 - DNA, 22 bp, Homo sapiens
tttcatagtcaagtgtgtatga

SEQ ID NO: 7779964 - DNA, 22 bp, Homo sapiens
tttcataatactgtacatgaaa

SEQ ID NO: 7779965 - DNA, 22 bp, Homo sapiens
tttcataatatccagagatttt

SEQ ID NO: 7779966 - DNA, 22 bp, Homo sapiens
tttattgccctgtagtacagga

SEQ ID NO: 7779967 - DNA, 22 bp, Homo sapiens
tttatctttggatcttcagaaa

SEQ ID NO: 7779968 - DNA, 22 bp, Homo sapiens
tttatgaactacagatataact

SEQ ID NO: 7779969 - DNA, 22 bp, Homo sapiens
tttaggaacttaggtttatgga

SEQ ID NO: 7779970 - DNA, 22 bp, Homo sapiens
tttagcttcagttctagcttct

SEQ ID NO: 7779971 - DNA, 19 bp, Homo sapiens
tttagcttacgtttcattg

SEQ ID NO: 7779972 - DNA, 22 bp, Homo sapiens
tttatctttaggactttgcaga

SEQ ID NO: 7779973 - DNA, 22 bp, Homo sapiens
tttatctgtatatctcaagtgt

SEQ ID NO: 7779974 - DNA, 22 bp, Homo sapiens
ttgttgttataggtggtacaag

SEQ ID NO: 7779975 - DNA, 22 bp, Homo sapiens
ttgttgtcattgtagaggattt

SEQ ID NO: 7779976 - DNA, 22 bp, Homo sapiens
ttgttgtcattgtagaggattt

SEQ ID NO: 7779977 - DNA, 22 bp, Homo sapiens
ttgttgggcatgcagtggctgt

SEQ ID NO: 7779978 - DNA, 22 bp, Homo sapiens
ttgttgcagagatgaatgacat

SEQ ID NO: 7779979 - DNA, 22 bp, Homo sapiens
tttaagaagttatgttataaat

SEQ ID NO: 7779980 - DNA, 22 bp, Homo sapiens
tttaaccagtttacaaagaatt

SEQ ID NO: 7779981 - DNA, 23 bp, Homo sapiens
tttaacatttgaacatgtggcca

SEQ ID NO: 7779982 - DNA, 22 bp, Homo sapiens
ttgtttaaaatgtagcaagaaa

SEQ ID NO: 7779983 - DNA, 22 bp, Homo sapiens
tttacaagtttacagaatgatg

SEQ ID NO: 7779984 - DNA, 22 bp, Homo sapiens
tttacactcctggaaatgatat

SEQ ID NO: 7779985 - DNA, 22 bp, Homo sapiens
tttacacattattttcagtgtg

SEQ ID NO: 7779986 - DNA, 22 bp, Homo sapiens
tttacacattattttcagtgtg

SEQ ID NO: 7779987 - DNA, 22 bp, Homo sapiens
tttacactgcttgaacaatctc

SEQ ID NO: 7779988 - DNA, 22 bp, Homo sapiens
tttacaagtcagggactgttct

SEQ ID NO: 7779989 - DNA, 22 bp, Homo sapiens
tttacagagagagaactggact

SEQ ID NO: 7779990 - DNA, 22 bp, Homo sapiens
tttacagacaacttaatagggg

SEQ ID NO: 7779991 - DNA, 22 bp, Homo sapiens
tttacagaagagaaggatgctt

SEQ ID NO: 7779992 - DNA, 22 bp, Homo sapiens
tttacacttgaggaaactgagg

SEQ ID NO: 7779993 - DNA, 22 bp, Homo sapiens
tttacagatgtggaaagtgagc

SEQ ID NO: 7779994 - DNA, 22 bp, Homo sapiens
tttacagatgaggatactgagg

SEQ ID NO: 7779995 - DNA, 22 bp, Homo sapiens
tttacagatgaggatactgagg

SEQ ID NO: 7779996 - DNA, 22 bp, Homo sapiens
tttacagatgaggaaactgaga

SEQ ID NO: 7779997 - DNA, 22 bp, Homo sapiens
ttggaacatgccggggtccagg

SEQ ID NO: 7779998 - DNA, 22 bp, Homo sapiens
ttgctttatgtgtatgacttga

SEQ ID NO: 7779999 - DNA, 22 bp, Homo sapiens
ttgctttagaatctgcttctgg

SEQ ID NO: 7780000 - DNA, 23 bp, Homo sapiens
ttgcttctgtgcaattcagtact

SEQ ID NO: 7780001 - DNA, 23 bp, Homo sapiens
ttgcttctgtgcaattcagtact

SEQ ID NO: 7780002 - DNA, 23 bp, Homo sapiens
ttgcttctgtgcaattcagtact

SEQ ID NO: 7780003 - DNA, 23 bp, Homo sapiens
ttgcttctgtgcaattcagtact

SEQ ID NO: 7780004 - DNA, 22 bp, Homo sapiens
ttgcttctggaactttctgttc

SEQ ID NO: 7780005 - DNA, 22 bp, Homo sapiens
ttgcttctggaactttctgttc

SEQ ID NO: 7780006 - DNA, 22 bp, Homo sapiens
ttgcttctaagtataaatatga

SEQ ID NO: 7780007 - DNA, 22 bp, Homo sapiens
ttgcttcctggatgtgactttg

SEQ ID NO: 7780008 - DNA, 18 bp, Homo sapiens
ttgcttcttttctctagg

SEQ ID NO: 7780009 - DNA, 18 bp, Homo sapiens
ttgcttcttttctctagg

SEQ ID NO: 7780010 - DNA, 22 bp, Homo sapiens
ttgcttcttagatattcctctc

SEQ ID NO: 7780011 - DNA, 22 bp, Homo sapiens
ttgcttcttagatattcctctc

SEQ ID NO: 7780012 - DNA, 22 bp, Homo sapiens
ttgcttcttagatattcctctc

SEQ ID NO: 7780013 - DNA, 22 bp, Homo sapiens
ttggagggacagatggctaggc

SEQ ID NO: 7780014 - DNA, 19 bp, Homo sapiens
ttggatgctaccaggtacc

SEQ ID NO: 7780015 - DNA, 18 bp, Homo sapiens
ttggaggatgtccatgaa

SEQ ID NO: 7780016 - DNA, 22 bp, Homo sapiens
ttggaggcaatgggaaggaggc

SEQ ID NO: 7780017 - DNA, 22 bp, Homo sapiens
ttggcaatatttactgaagttg

SEQ ID NO: 7780018 - DNA, 22 bp, Homo sapiens
ttggcaatcaattctgacgtct

SEQ ID NO: 7780019 - DNA, 22 bp, Homo sapiens
ttggcacacagtaagccctaag

SEQ ID NO: 7780020 - DNA, 22 bp, Homo sapiens
ttgcatttggttctgcctggta

SEQ ID NO: 7780021 - DNA, 22 bp, Homo sapiens
ttgcatttggttctgcctggta

SEQ ID NO: 7780022 - DNA, 22 bp, Homo sapiens
ttgcattttggttgtaaatatg

SEQ ID NO: 7780023 - DNA, 22 bp, Homo sapiens
ttgccagggtcaggatgagatc

SEQ ID NO: 7780024 - DNA, 22 bp, Homo sapiens
ttgccaggagctcatctgaggg

SEQ ID NO: 7780025 - DNA, 22 bp, Homo sapiens
ttgcatttgacaaattatttaa

SEQ ID NO: 7780026 - DNA, 22 bp, Homo sapiens
ttgctaatagaagatttgggaa

SEQ ID NO: 7780027 - DNA, 22 bp, Homo sapiens
ttgctaaaaatggaattatagg

SEQ ID NO: 7780028 - DNA, 22 bp, Homo sapiens
ttgctaaaaatggaattatagg

SEQ ID NO: 7780029 - DNA, 22 bp, Homo sapiens
ttgctaatgccctagaagtatt

SEQ ID NO: 7780030 - DNA, 22 bp, Homo sapiens
ttgctaatcatatttcatcact

SEQ ID NO: 7780031 - DNA, 22 bp, Homo sapiens
ttgcttcatatttgtggcttgc

SEQ ID NO: 7780032 - DNA, 22 bp, Homo sapiens
ttgcctgctacggtcttcactg

SEQ ID NO: 7780033 - DNA, 22 bp, Homo sapiens
ttgcccagagtcacccagctca

SEQ ID NO: 7780034 - DNA, 22 bp, Homo sapiens
ttgcctgtgaacgctgagtcct

SEQ ID NO: 7780035 - DNA, 22 bp, Homo sapiens
ttgcctggagggacatggagac

SEQ ID NO: 7780036 - DNA, 22 bp, Homo sapiens
ttgccttgttattctctcagaa

SEQ ID NO: 7780037 - DNA, 22 bp, Homo sapiens
ttgggaaattactctgctagga

SEQ ID NO: 7780038 - DNA, 22 bp, Homo sapiens
ttgggaaagaatgagaaggtga

SEQ ID NO: 7780039 - DNA, 22 bp, Homo sapiens
ttgggaaagaatgagaaggtga

SEQ ID NO: 7780040 - DNA, 22 bp, Homo sapiens
ttgggaaagccacaaattggag

SEQ ID NO: 7780041 - DNA, 23 bp, Homo sapiens
ttgggaaatagttaagacatgag

SEQ ID NO: 7780042 - DNA, 22 bp, Homo sapiens
ttgggaaacagtatagctaaca

SEQ ID NO: 7780043 - DNA, 18 bp, Homo sapiens
ttggctttgagaactggt

SEQ ID NO: 7780044 - DNA, 22 bp, Homo sapiens
ttggcttcattgatctcacttt

SEQ ID NO: 7780045 - DNA, 22 bp, Homo sapiens
ttggcttgatgactggcagtgt

SEQ ID NO: 7780046 - DNA, 22 bp, Homo sapiens
ttggcttctgttttggctctgt

SEQ ID NO: 7780047 - DNA, 22 bp, Homo sapiens
ttgggctgatctgtggaagaag

SEQ ID NO: 7780048 - DNA, 22 bp, Homo sapiens
ttggcctcatggacagctcatc

SEQ ID NO: 7780049 - DNA, 22 bp, Homo sapiens
ttggcccagggtcagcggcgct

SEQ ID NO: 7780050 - DNA, 22 bp, Homo sapiens
ttggcccagactcggggactga

SEQ ID NO: 7780051 - DNA, 22 bp, Homo sapiens
ttggcccagcatgcgggtctgt

SEQ ID NO: 7780052 - DNA, 22 bp, Homo sapiens
ttggctggtttcaagaaggcat

SEQ ID NO: 7780053 - DNA, 22 bp, Homo sapiens
ttgttcataaagacagttcaga

SEQ ID NO: 7780054 - DNA, 22 bp, Homo sapiens
ttgttcatcaggtgacacatac

SEQ ID NO: 7780055 - DNA, 23 bp, Homo sapiens
ttgtggagtggttgttttctagg

SEQ ID NO: 7780056 - DNA, 22 bp, Homo sapiens
ttgttcatggttgtaagtttga

SEQ ID NO: 7780057 - DNA, 22 bp, Homo sapiens
ttgttctatggtgaggcagcca

SEQ ID NO: 7780058 - DNA, 22 bp, Homo sapiens
ttgtgctaagtgctatgaaggc

SEQ ID NO: 7780059 - DNA, 22 bp, Homo sapiens
ttgtatagcccagagagtgaga

SEQ ID NO: 7780060 - DNA, 22 bp, Homo sapiens
ttgtatacaggtcttgtccatt

SEQ ID NO: 7780061 - DNA, 22 bp, Homo sapiens
ttgtatacattatcctgtttca

SEQ ID NO: 7780062 - DNA, 22 bp, Homo sapiens
ttgtatatattcttaaagatgt

SEQ ID NO: 7780063 - DNA, 22 bp, Homo sapiens
ttgtatcagtgcctataaaatg

SEQ ID NO: 7780064 - DNA, 22 bp, Homo sapiens
ttgtatcagtgcctataaaatg

SEQ ID NO: 7780065 - DNA, 22 bp, Homo sapiens
ttgtattaattgaaatgaatgc

SEQ ID NO: 7780066 - DNA, 22 bp, Homo sapiens
ttgtattaaaatgtgtttctgt

SEQ ID NO: 7780067 - DNA, 22 bp, Homo sapiens
ttgtattcttccttagcagtac

SEQ ID NO: 7780068 - DNA, 22 bp, Homo sapiens
ttgtatttcctataacctttct

SEQ ID NO: 7780069 - DNA, 22 bp, Homo sapiens
ttgggggcatattgagtagtgg

SEQ ID NO: 7780070 - DNA, 19 bp, Homo sapiens
ttggggtgaatgccagaca

SEQ ID NO: 7780071 - DNA, 18 bp, Homo sapiens
ttggggtgaggccaggaa

SEQ ID NO: 7780072 - DNA, 22 bp, Homo sapiens
ttatttaatgtgatctgaagag

SEQ ID NO: 7780073 - DNA, 22 bp, Homo sapiens
ttatttaattttctcactcaga

SEQ ID NO: 7780074 - DNA, 22 bp, Homo sapiens
ttatttaggagaaggaaccctg

SEQ ID NO: 7780075 - DNA, 22 bp, Homo sapiens
ttatttaggaggaaactgaggt

SEQ ID NO: 7780076 - DNA, 22 bp, Homo sapiens
ttatttagtctagatgaatttt

SEQ ID NO: 7780077 - DNA, 22 bp, Homo sapiens
ttatttagtctagatgaatttt

SEQ ID NO: 7780078 - DNA, 22 bp, Homo sapiens
ttatttatggcactgttggtgg

SEQ ID NO: 7780079 - DNA, 22 bp, Homo sapiens
ttatttaatgtgatctgaagag

SEQ ID NO: 7780080 - DNA, 22 bp, Homo sapiens
ttatttaaaagtggtaagattc

SEQ ID NO: 7780081 - DNA, 22 bp, Homo sapiens
ttattgtttgggtataatttga

SEQ ID NO: 7780082 - DNA, 22 bp, Homo sapiens
ttattgtttgggtataatttga

SEQ ID NO: 7780083 - DNA, 22 bp, Homo sapiens
ttattttctcctcagaaagtgg

SEQ ID NO: 7780084 - DNA, 21 bp, Homo sapiens
ttcaaaatggtgtgtttgtct

SEQ ID NO: 7780085 - DNA, 22 bp, Homo sapiens
ttcaaaatgcacaaagggctag

SEQ ID NO: 7780086 - DNA, 22 bp, Homo sapiens
ttcaaaatgcacaaagggctag

SEQ ID NO: 7780087 - DNA, 22 bp, Homo sapiens
ttcaaaatccgggaggcgcccc

SEQ ID NO: 7780088 - DNA, 22 bp, Homo sapiens
ttcaagaggcttaattctggat

SEQ ID NO: 7780089 - DNA, 17 bp, Homo sapiens
ttcaagatattgaaatg

SEQ ID NO: 7780090 - DNA, 22 bp, Homo sapiens
ttcaaaattgttctaagctctg

SEQ ID NO: 7780091 - DNA, 22 bp, Homo sapiens
ttcaaacaactcatttatgcaa

SEQ ID NO: 7780092 - DNA, 22 bp, Homo sapiens
ttcaaggcagagtgtagttaaa

SEQ ID NO: 7780093 - DNA, 22 bp, Homo sapiens
ttcaagatgtcttcacaatagt

SEQ ID NO: 7780094 - DNA, 22 bp, Homo sapiens
ttcaagatggctgcaaatactt

SEQ ID NO: 7780095 - DNA, 22 bp, Homo sapiens
ttcaagatgcacagtggcattc

SEQ ID NO: 7780096 - DNA, 22 bp, Homo sapiens
ttcaagatcgagtttaaagtga

SEQ ID NO: 7780097 - DNA, 22 bp, Homo sapiens
ttcaagatcttccaaaggatac

SEQ ID NO: 7780098 - DNA, 22 bp, Homo sapiens
ttatgctaacctcatcttctcc

SEQ ID NO: 7780099 - DNA, 22 bp, Homo sapiens
ttatgctagttgaaataacaca

SEQ ID NO: 7780100 - DNA, 22 bp, Homo sapiens
ttatggaaaatacaattataag

SEQ ID NO: 7780101 - DNA, 22 bp, Homo sapiens
ttagttgatcattcaacatggg

SEQ ID NO: 7780102 - DNA, 22 bp, Homo sapiens
ttagttgatagccaaaatttat

SEQ ID NO: 7780103 - DNA, 23 bp, Homo sapiens
ttatgcaagcttcctggtctcag

SEQ ID NO: 7780104 - DNA, 22 bp, Homo sapiens
tcctcctgtttctcaggcctgg

SEQ ID NO: 7780105 - DNA, 21 bp, Homo sapiens
tcctcctgtagagggtcctgg

SEQ ID NO: 7780106 - DNA, 21 bp, Homo sapiens
tcctcctggccaggcggcccc

SEQ ID NO: 7780107 - DNA, 22 bp, Homo sapiens
tcctctgccccagatgaaattt

SEQ ID NO: 7780108 - DNA, 22 bp, Homo sapiens
ttagtggagagttattatcagc

SEQ ID NO: 7780109 - DNA, 22 bp, Homo sapiens
ttagtgtctttcaaaaggttta

SEQ ID NO: 7780110 - DNA, 22 bp, Homo sapiens
ttagtgtctggctatatttaaa

SEQ ID NO: 7780111 - DNA, 22 bp, Homo sapiens
tcctctggctctttccctagga

SEQ ID NO: 7780112 - DNA, 21 bp, Homo sapiens
tcctctgctctcataccacaa

SEQ ID NO: 7780113 - DNA, 22 bp, Homo sapiens
tcctctgctgttctggttcttt

SEQ ID NO: 7780114 - DNA, 22 bp, Homo sapiens
tcctctgctccatctttactgt

SEQ ID NO: 7780115 - DNA, 22 bp, Homo sapiens
ttcatagacccatgtgaggaag

SEQ ID NO: 7780116 - DNA, 22 bp, Homo sapiens
ttcatagaagcagaaagtaaac

SEQ ID NO: 7780117 - DNA, 22 bp, Homo sapiens
ttcatagaaagtgcttagattg

SEQ ID NO: 7780118 - DNA, 22 bp, Homo sapiens
ttcatactcactccaataactg

SEQ ID NO: 7780119 - DNA, 22 bp, Homo sapiens
ttcatactgtgtttccaagttt

SEQ ID NO: 7780120 - DNA, 22 bp, Homo sapiens
ttcatacaatgggatattatga

SEQ ID NO: 7780121 - DNA, 22 bp, Homo sapiens
ttcatacatttttactaacagc

SEQ ID NO: 7780122 - DNA, 22 bp, Homo sapiens
ttcatacatgtgtactgttcca

SEQ ID NO: 7780123 - DNA, 22 bp, Homo sapiens
ttcatacatgagactagatgca

SEQ ID NO: 7780124 - DNA, 22 bp, Homo sapiens
ttcagaatgtgaccttatttgg

SEQ ID NO: 7780125 - DNA, 19 bp, Homo sapiens
ttcagaattgggaggtgat

SEQ ID NO: 7780126 - DNA, 22 bp, Homo sapiens
ttcagaatgtgaccttatttgg

SEQ ID NO: 7780127 - DNA, 22 bp, Homo sapiens
ttcagaatgacttatgtaaggc

SEQ ID NO: 7780128 - DNA, 22 bp, Homo sapiens
ttcagaatctatgtgccagctc

SEQ ID NO: 7780129 - DNA, 22 bp, Homo sapiens
ttcagaatgagaatggatgggt

SEQ ID NO: 7780130 - DNA, 22 bp, Homo sapiens
ttcagaatgctatttctgaaat

SEQ ID NO: 7780131 - DNA, 22 bp, Homo sapiens
ttcagaatgtactgatagaaca

SEQ ID NO: 7780132 - DNA, 22 bp, Homo sapiens
ttcagaatgctatttctgaaat

SEQ ID NO: 7780133 - DNA, 22 bp, Homo sapiens
ttcatatttgaaacagaagtta

SEQ ID NO: 7780134 - DNA, 22 bp, Homo sapiens
ttcatcaatgtgtttaataatg

SEQ ID NO: 7780135 - DNA, 22 bp, Homo sapiens
ttcatattatgatttgaaatgc

SEQ ID NO: 7780136 - DNA, 22 bp, Homo sapiens
ttcatattcaaatactctgctt

SEQ ID NO: 7780137 - DNA, 22 bp, Homo sapiens
ttcatattatgatttgaaatgc

SEQ ID NO: 7780138 - DNA, 22 bp, Homo sapiens
ttcatattatgatttgaaatgc

SEQ ID NO: 7780139 - DNA, 22 bp, Homo sapiens
ttcatatatatgcactacgtac

SEQ ID NO: 7780140 - DNA, 22 bp, Homo sapiens
ttcatatgtgaactcagtgatg

SEQ ID NO: 7780141 - DNA, 22 bp, Homo sapiens
ttcatatgcagattaacaaata

SEQ ID NO: 7780142 - DNA, 23 bp, Homo sapiens
ttcatatgttgctgaaaacagca

SEQ ID NO: 7780143 - DNA, 22 bp, Homo sapiens
ttcatataaatggaatcagaat

SEQ ID NO: 7780144 - DNA, 22 bp, Homo sapiens
ttcatataaatggaatcagaat

SEQ ID NO: 7780145 - DNA, 22 bp, Homo sapiens
ttcatataaatggaatcagaat

SEQ ID NO: 7780146 - DNA, 22 bp, Homo sapiens
ttcatagtgcttaatttgataa

SEQ ID NO: 7780147 - DNA, 22 bp, Homo sapiens
ttcatagtgacatgcattctgg

SEQ ID NO: 7780148 - DNA, 22 bp, Homo sapiens
ttcaatatctctaagaatgagg

SEQ ID NO: 7780149 - DNA, 21 bp, Homo sapiens
ttcaagtctctaggacttctc

SEQ ID NO: 7780150 - DNA, 22 bp, Homo sapiens
ttcaagtcatgttaactgcttc

SEQ ID NO: 7780151 - DNA, 22 bp, Homo sapiens
ttcaagtcagagcaagccaagt

SEQ ID NO: 7780152 - DNA, 22 bp, Homo sapiens
ttcaagtagctaaattagctgc

SEQ ID NO: 7780153 - DNA, 22 bp, Homo sapiens
ttcaatatgatattagctgtgg

SEQ ID NO: 7780154 - DNA, 22 bp, Homo sapiens
ttcagaagtagctaagcagtca

SEQ ID NO: 7780155 - DNA, 22 bp, Homo sapiens
ttcagaagtagctaagcagtca

SEQ ID NO: 7780156 - DNA, 22 bp, Homo sapiens
ttcactgtgatggtgcagaggc

SEQ ID NO: 7780157 - DNA, 22 bp, Homo sapiens
ttcactgtgaactcatattcag

SEQ ID NO: 7780158 - DNA, 22 bp, Homo sapiens
ttcactgtcctgcaactctaga

SEQ ID NO: 7780159 - DNA, 21 bp, Homo sapiens
ttcatcagccagaaatcaagc

SEQ ID NO: 7780160 - DNA, 22 bp, Homo sapiens
ttccaacaatgtgttattgttc

SEQ ID NO: 7780161 - DNA, 22 bp, Homo sapiens
ttccaataaaatgttatttgca

SEQ ID NO: 7780162 - DNA, 22 bp, Homo sapiens
ttccaagtgggggaagctgagt

SEQ ID NO: 7780163 - DNA, 23 bp, Homo sapiens
ttccaagtgctttacttaatcct

SEQ ID NO: 7780164 - DNA, 22 bp, Homo sapiens
ttccaagtgcccatatttcatc

SEQ ID NO: 7780165 - DNA, 22 bp, Homo sapiens
ttccatatgtatatagctgtta

SEQ ID NO: 7780166 - DNA, 22 bp, Homo sapiens
ttccatacgactgaggtctcgg

SEQ ID NO: 7780167 - DNA, 21 bp, Homo sapiens
ttcccagcacctagcacaggt

SEQ ID NO: 7780168 - DNA, 22 bp, Homo sapiens
ttcccctctcagatctggccta

SEQ ID NO: 7780169 - DNA, 22 bp, Homo sapiens
ttccatttattcttgtccagat

SEQ ID NO: 7780170 - DNA, 22 bp, Homo sapiens
ttccctctgcgcattgaatttc

SEQ ID NO: 7780171 - DNA, 22 bp, Homo sapiens
ttccctcccccagcctggcagg

SEQ ID NO: 7780172 - DNA, 22 bp, Homo sapiens
ttccctctttcactgtgatttt

SEQ ID NO: 7780173 - DNA, 22 bp, Homo sapiens
ttcgtatttatattctcaatac

SEQ ID NO: 7780174 - DNA, 22 bp, Homo sapiens
ttcgttttctaggaccaacaga

SEQ ID NO: 7780175 - DNA, 22 bp, Homo sapiens
ttcgttgctttaagccactacg

SEQ ID NO: 7780176 - DNA, 22 bp, Homo sapiens
ttcgttttctaggaccaacaga

SEQ ID NO: 7780177 - DNA, 22 bp, Homo sapiens
ttctaaaaccaattctgcttct

SEQ ID NO: 7780178 - DNA, 22 bp, Homo sapiens
ttctaaacttcaattctaaatt

SEQ ID NO: 7780179 - DNA, 22 bp, Homo sapiens
ttctaaactgaagtattttaaa

SEQ ID NO: 7780180 - DNA, 20 bp, Homo sapiens
ttctaaactgttaggcttgc

SEQ ID NO: 7780181 - DNA, 22 bp, Homo sapiens
ttctaaacactacgggatttgg

SEQ ID NO: 7780182 - DNA, 22 bp, Homo sapiens
ttctaaacggcttcacaggaat

SEQ ID NO: 7780183 - DNA, 22 bp, Homo sapiens
ttctaaaataagtttatctggt

SEQ ID NO: 7780184 - DNA, 22 bp, Homo sapiens
ttctaaaataagtttatctggt

SEQ ID NO: 7780185 - DNA, 22 bp, Homo sapiens
ttctaaaataagtttatctggt

SEQ ID NO: 7780186 - DNA, 22 bp, Homo sapiens
ttctaaagcctgtcctatcaga

SEQ ID NO: 7780187 - DNA, 22 bp, Homo sapiens
ttctaaagtgcaatctgacaga

SEQ ID NO: 7780188 - DNA, 22 bp, Homo sapiens
ttctcacaggatttcttttagt

SEQ ID NO: 7780189 - DNA, 22 bp, Homo sapiens
ttctcagaaaagcaagctttct

SEQ ID NO: 7780190 - DNA, 22 bp, Homo sapiens
ttctcaactctcaagagaagct

SEQ ID NO: 7780191 - DNA, 21 bp, Homo sapiens
ttctccaggcaaccatttcag

SEQ ID NO: 7780192 - DNA, 22 bp, Homo sapiens
ttctcttcatctcagtaaatgt

SEQ ID NO: 7780193 - DNA, 23 bp, Homo sapiens
ttctctttagatttacattactc

SEQ ID NO: 7780194 - DNA, 22 bp, Homo sapiens
ttctcttgtgccaagttgttgc

SEQ ID NO: 7780195 - DNA, 23 bp, Homo sapiens
ttctctttagatttacattactc

SEQ ID NO: 7780196 - DNA, 22 bp, Homo sapiens
ttctcttgactaccagttagga

SEQ ID NO: 7780197 - DNA, 22 bp, Homo sapiens
ttctcttctgttcagtgcccaa

SEQ ID NO: 7780198 - DNA, 22 bp, Homo sapiens
ttctccagtttctcccttcagt

SEQ ID NO: 7780199 - DNA, 22 bp, Homo sapiens
ttctccatttaacttccttatg

SEQ ID NO: 7780200 - DNA, 22 bp, Homo sapiens
ttctccctgccaaagctgcctc

SEQ ID NO: 7780201 - DNA, 21 bp, Homo sapiens
ttctccccagcgaatcctcgg

SEQ ID NO: 7780202 - DNA, 17 bp, Homo sapiens
ttctcctctgtgtcctt

SEQ ID NO: 7780203 - DNA, 22 bp, Homo sapiens
ttctgattcatgatccagttct

SEQ ID NO: 7780204 - DNA, 22 bp, Homo sapiens
ttctgagctgcaacactaacat

SEQ ID NO: 7780205 - DNA, 22 bp, Homo sapiens
ttctctttatgtatttagtggg

SEQ ID NO: 7780206 - DNA, 22 bp, Homo sapiens
ttctgccacgagcagtttcttc

SEQ ID NO: 7780207 - DNA, 22 bp, Homo sapiens
ttctgcacattttagcaaagta

SEQ ID NO: 7780208 - DNA, 22 bp, Homo sapiens
ttctgcactaaatatcaaatat

SEQ ID NO: 7780209 - DNA, 20 bp, Homo sapiens
ttctggaggctacaagtctg

SEQ ID NO: 7780210 - DNA, 22 bp, Homo sapiens
ttcttctgattgccttctgcaa

SEQ ID NO: 7780211 - DNA, 22 bp, Homo sapiens
ttctttctcaacatgaatgttt

SEQ ID NO: 7780212 - DNA, 22 bp, Homo sapiens
ttctttctcagtgggcagatac

SEQ ID NO: 7780213 - DNA, 22 bp, Homo sapiens
ttcttcttgaaactttaggttg

SEQ ID NO: 7780214 - DNA, 22 bp, Homo sapiens
ttcttcttctggctgcacctgg

SEQ ID NO: 7780215 - DNA, 22 bp, Homo sapiens
ttcttcttctggctgcacctgg

SEQ ID NO: 7780216 - DNA, 22 bp, Homo sapiens
ttctttgcccttaatgaaataa

SEQ ID NO: 7780217 - DNA, 22 bp, Homo sapiens
ttctttgcccatgtttcctaag

SEQ ID NO: 7780218 - DNA, 22 bp, Homo sapiens
ttctttggaataagtcaagctg

SEQ ID NO: 7780219 - DNA, 22 bp, Homo sapiens
ttctttggaataagtcaagctg

SEQ ID NO: 7780220 - DNA, 22 bp, Homo sapiens
ttctttggcatttcctgtatgt

SEQ ID NO: 7780221 - DNA, 22 bp, Homo sapiens
ttctttggcatttcctgtatgt

SEQ ID NO: 7780222 - DNA, 23 bp, Homo sapiens
ttctttggaattgggctgcaagg

SEQ ID NO: 7780223 - DNA, 23 bp, Homo sapiens
ttctttggaattgggctgcaagg

SEQ ID NO: 7780224 - DNA, 23 bp, Homo sapiens
ttctttggaattgggctgcaagg

SEQ ID NO: 7780225 - DNA, 22 bp, Homo sapiens
ttctttggggaatattctggtt

SEQ ID NO: 7780226 - DNA, 22 bp, Homo sapiens
ttctttgggctcagagagggag

SEQ ID NO: 7780227 - DNA, 22 bp, Homo sapiens
ttctttgggctcagagagggag

SEQ ID NO: 7780228 - DNA, 22 bp, Homo sapiens
ttctttggtgggagattgaggt

SEQ ID NO: 7780229 - DNA, 22 bp, Homo sapiens
ttctttggtgggagattgaggt

SEQ ID NO: 7780230 - DNA, 22 bp, Homo sapiens
ttctttggggtctccagcatag

SEQ ID NO: 7780231 - DNA, 22 bp, Homo sapiens
ttctttggggtctccagcatag

SEQ ID NO: 7780232 - DNA, 22 bp, Homo sapiens
ttctttggggtctccagcatag

SEQ ID NO: 7780233 - DNA, 22 bp, Homo sapiens
ttctttggggaatattctggtt

SEQ ID NO: 7780234 - DNA, 22 bp, Homo sapiens
ttctttggggaatattctggtt

SEQ ID NO: 7780235 - DNA, 22 bp, Homo sapiens
ttctttggctgccagtctggag

SEQ ID NO: 7780236 - DNA, 22 bp, Homo sapiens
ttctttggctgccagtctggag

SEQ ID NO: 7780237 - DNA, 22 bp, Homo sapiens
ttctttggctgccagtctggag

SEQ ID NO: 7780238 - DNA, 22 bp, Homo sapiens
ttctttggcttacgtctggcct

SEQ ID NO: 7780239 - DNA, 22 bp, Homo sapiens
ttctttggcttacgtctggcct

SEQ ID NO: 7780240 - DNA, 22 bp, Homo sapiens
ttctttggcttacgtctggcct

SEQ ID NO: 7780241 - DNA, 22 bp, Homo sapiens
ttctttgggattgtagctgtct

SEQ ID NO: 7780242 - DNA, 22 bp, Homo sapiens
ttctttgggattgtagctgtct

SEQ ID NO: 7780243 - DNA, 22 bp, Homo sapiens
ttctttgggattgtagctgtct

SEQ ID NO: 7780244 - DNA, 22 bp, Homo sapiens
ttctttgggcaattgctggccc

SEQ ID NO: 7780245 - DNA, 22 bp, Homo sapiens
ttctttgggcaattgctggccc

SEQ ID NO: 7780246 - DNA, 22 bp, Homo sapiens
ttctttgggcaattgctggccc

SEQ ID NO: 7780247 - DNA, 22 bp, Homo sapiens
ttctgggacatctggacagttt

SEQ ID NO: 7780248 - DNA, 22 bp, Homo sapiens
ttctggctttgaccaagttcaa

SEQ ID NO: 7780249 - DNA, 22 bp, Homo sapiens
ttctggatcagcatcatgagat

SEQ ID NO: 7780250 - DNA, 22 bp, Homo sapiens
ttctggataggggtatggagct

SEQ ID NO: 7780251 - DNA, 23 bp, Homo sapiens
ttcttcagccttatagccctggg

SEQ ID NO: 7780252 - DNA, 22 bp, Homo sapiens
ttcttcagatcctacaagtctg

SEQ ID NO: 7780253 - DNA, 22 bp, Homo sapiens
ttcttcagagagtagaagcaag

SEQ ID NO: 7780254 - DNA, 22 bp, Homo sapiens
ttcttcagagagtagaagcaag

SEQ ID NO: 7780255 - DNA, 22 bp, Homo sapiens
ttgaccactgaatggttctgaa

SEQ ID NO: 7780256 - DNA, 22 bp, Homo sapiens
ttgaaaaaattggtagaggatg

SEQ ID NO: 7780257 - DNA, 22 bp, Homo sapiens
ttgaaaaaattggtagaggatg

SEQ ID NO: 7780258 - DNA, 22 bp, Homo sapiens
ttgaaaatatcacaggagcagc

SEQ ID NO: 7780259 - DNA, 22 bp, Homo sapiens
ttgaaaatatcacaggagcagc

SEQ ID NO: 7780260 - DNA, 19 bp, Homo sapiens
ttgagaacaccaagtactg

SEQ ID NO: 7780261 - DNA, 22 bp, Homo sapiens
ttgagaaataagcatgtctaga

SEQ ID NO: 7780262 - DNA, 22 bp, Homo sapiens
ttgagaacaggagtgttctttt

SEQ ID NO: 7780263 - DNA, 23 bp, Homo sapiens
ttgagaacaggtgtgagaatggc

SEQ ID NO: 7780264 - DNA, 22 bp, Homo sapiens
ttgagaactactttattattct

SEQ ID NO: 7780265 - DNA, 22 bp, Homo sapiens
ttgagaaccactgagttagata

SEQ ID NO: 7780266 - DNA, 22 bp, Homo sapiens
ttgagaactagcatggtctatc

SEQ ID NO: 7780267 - DNA, 22 bp, Homo sapiens
ttgagaactctgtatgtccagc

SEQ ID NO: 7780268 - DNA, 22 bp, Homo sapiens
ttgagaaggtggtcatttgcaa

SEQ ID NO: 7780269 - DNA, 22 bp, Homo sapiens
ttgagagaggaaacatagtctc

SEQ ID NO: 7780270 - DNA, 22 bp, Homo sapiens
ttgagggtctggatctgctgct

SEQ ID NO: 7780271 - DNA, 22 bp, Homo sapiens
ttgagggtctggatctgctgct

SEQ ID NO: 7780272 - DNA, 22 bp, Homo sapiens
ttgagagtgccaagcatcctcc

SEQ ID NO: 7780273 - DNA, 22 bp, Homo sapiens
ttgagaggctgttgacattctg

SEQ ID NO: 7780274 - DNA, 22 bp, Homo sapiens
ttgagggaacatgagaatcatc

SEQ ID NO: 7780275 - DNA, 22 bp, Homo sapiens
tttgtctgccttgctggactgt

SEQ ID NO: 7780276 - DNA, 22 bp, Homo sapiens
tttgtcttcatccttcgagctg

SEQ ID NO: 7780277 - DNA, 22 bp, Homo sapiens
tttgtggaactctcttcttgca

SEQ ID NO: 7780278 - DNA, 22 bp, Homo sapiens
tttgtgctaatgctagattact

SEQ ID NO: 7780279 - DNA, 22 bp, Homo sapiens
tttgtgcacttctgtagctgcc

SEQ ID NO: 7780280 - DNA, 22 bp, Homo sapiens
tttgtgtaccttgtacatttgt

SEQ ID NO: 7780281 - DNA, 22 bp, Homo sapiens
ttttacacttcggttgtgtgca

SEQ ID NO: 7780282 - DNA, 22 bp, Homo sapiens
ttttacaagctgagtcgttaaa

SEQ ID NO: 7780283 - DNA, 22 bp, Homo sapiens
ttttaccactgggtgacatgga

SEQ ID NO: 7780284 - DNA, 22 bp, Homo sapiens
ttttacttaattcttggtcatg

SEQ ID NO: 7780285 - DNA, 22 bp, Homo sapiens
ttttactttggatacagtactt

SEQ ID NO: 7780286 - DNA, 22 bp, Homo sapiens
ttttcacacaaggtgataagtt

SEQ ID NO: 7780287 - DNA, 22 bp, Homo sapiens
ttttcaagagagtgttctatgt

SEQ ID NO: 7780288 - DNA, 22 bp, Homo sapiens
ttttcaaagactggaggctgat

SEQ ID NO: 7780289 - DNA, 22 bp, Homo sapiens
ttttattgtcaatgaagacaga

SEQ ID NO: 7780290 - DNA, 22 bp, Homo sapiens
ttttttatagcaatgaacccac

SEQ ID NO: 7780291 - DNA, 22 bp, Homo sapiens
ttttttatatcaactgaagtct

SEQ ID NO: 7780292 - DNA, 22 bp, Homo sapiens
ttttttatatcaactgaagtct

SEQ ID NO: 7780293 - DNA, 22 bp, Homo sapiens
ttttttcagcctgtctgtgcca

SEQ ID NO: 7780294 - DNA, 22 bp, Homo sapiens
ttttttccaacttaagacttca

SEQ ID NO: 7780295 - DNA, 22 bp, Homo sapiens
ttttttatctatggtagtacca

SEQ ID NO: 7780296 - DNA, 22 bp, Homo sapiens
ttttttatctatggtagtacca

SEQ ID NO: 7780297 - DNA, 22 bp, Homo sapiens
tttttgtctagcgtctctagtt

SEQ ID NO: 7780298 - DNA, 22 bp, Homo sapiens
tttttgttcccagagaatttgt

SEQ ID NO: 7780299 - DNA, 22 bp, Homo sapiens
tttttgtagtcattagaagagg

SEQ ID NO: 7780300 - DNA, 17 bp, Homo sapiens
ttttgttcatcttcaaa

SEQ ID NO: 7780301 - DNA, 22 bp, Homo sapiens
tttttgtatagaaatgaactaa

SEQ ID NO: 7780302 - DNA, 22 bp, Homo sapiens
tttttgtatagaaatgaactaa

SEQ ID NO: 7780303 - DNA, 22 bp, Homo sapiens
ttttgtcagtgagaacagagtt

SEQ ID NO: 7780304 - DNA, 22 bp, Homo sapiens
ttttgtatagtcaaagacaaga

SEQ ID NO: 7780305 - DNA, 22 bp, Homo sapiens
ttttggttctgggatacagaga

SEQ ID NO: 7780306 - DNA, 22 bp, Homo sapiens
ttttggctcttggtaggtcaga

SEQ ID NO: 7780307 - DNA, 22 bp, Homo sapiens
ttttgggtgaatttgccagtta

SEQ ID NO: 7780308 - DNA, 19 bp, Homo sapiens
ttttcccaccctttagaat

SEQ ID NO: 7780309 - DNA, 22 bp, Homo sapiens
ttttccagatggatactagaat

SEQ ID NO: 7780310 - DNA, 22 bp, Homo sapiens
ttttcccatctacaaagcaggg

SEQ ID NO: 7780311 - DNA, 22 bp, Homo sapiens
ttttcctactgataaacagtta

SEQ ID NO: 7780312 - DNA, 22 bp, Homo sapiens
ttttcctctgcaataaaagcag

SEQ ID NO: 7780313 - DNA, 22 bp, Homo sapiens
ttttcctctgagctttgaataa

SEQ ID NO: 7780314 - DNA, 22 bp, Homo sapiens
ttttccttcacctcttgagcct

SEQ ID NO: 7780315 - DNA, 20 bp, Homo sapiens
tttgagaccagtctgcccaa

SEQ ID NO: 7780316 - DNA, 20 bp, Homo sapiens
tttgagaccagtctgcccaa

SEQ ID NO: 7780317 - DNA, 22 bp, Homo sapiens
tttgcattatctcacttatata

SEQ ID NO: 7780318 - DNA, 22 bp, Homo sapiens
tttgcattatctcacttatata

SEQ ID NO: 7780319 - DNA, 22 bp, Homo sapiens
tttgcattatatttatagaaga

SEQ ID NO: 7780320 - DNA, 22 bp, Homo sapiens
tttgcatgggaggtagtaatca

SEQ ID NO: 7780321 - DNA, 22 bp, Homo sapiens
tttgcatcctgtgtgtgaaagt

SEQ ID NO: 7780322 - DNA, 22 bp, Homo sapiens
tttgcatgggaggtagtaatca

SEQ ID NO: 7780323 - DNA, 22 bp, Homo sapiens
tttgctgtcagccgctattttc

SEQ ID NO: 7780324 - DNA, 22 bp, Homo sapiens
tttgcattctagaaaaatttct

SEQ ID NO: 7780325 - DNA, 22 bp, Homo sapiens
tttgcatttataagttggtgga

SEQ ID NO: 7780326 - DNA, 22 bp, Homo sapiens
tttgcatttgtttagaacctga

SEQ ID NO: 7780327 - DNA, 21 bp, Homo sapiens
tttgcattttacatgtgggga

SEQ ID NO: 7780328 - DNA, 22 bp, Homo sapiens
tttggctttagtgccttctgat

SEQ ID NO: 7780329 - DNA, 22 bp, Homo sapiens
tttggcttgcactggcaccaac

SEQ ID NO: 7780330 - DNA, 22 bp, Homo sapiens
tttggcttgcactggcaccaac

SEQ ID NO: 7780331 - DNA, 21 bp, Homo sapiens
tttggcttctctgctgcagcc

SEQ ID NO: 7780332 - DNA, 20 bp, Homo sapiens
tttggcttcaagtgcattgc

SEQ ID NO: 7780333 - DNA, 22 bp, Homo sapiens
tttggcttaacttacatgatat

SEQ ID NO: 7780334 - DNA, 22 bp, Homo sapiens
tttggcggactgagaacgcggg

SEQ ID NO: 7780335 - DNA, 22 bp, Homo sapiens
tttggcggggcaattctgaagc

SEQ ID NO: 7780336 - DNA, 22 bp, Homo sapiens
tttgggcatatagctgttccct

SEQ ID NO: 7780337 - DNA, 22 bp, Homo sapiens
tttgtcatcagttattaatatg

SEQ ID NO: 7780338 - DNA, 22 bp, Homo sapiens
tttggtaaatgcaggttcttct

SEQ ID NO: 7780339 - DNA, 22 bp, Homo sapiens
tttgtcattctgtgtatttaaa

SEQ ID NO: 7780340 - DNA, 22 bp, Homo sapiens
tttgtcatttccctgattaaag

SEQ ID NO: 7780341 - DNA, 23 bp, Homo sapiens
tttgaacatttctagattacata

SEQ ID NO: 7780342 - DNA, 22 bp, Homo sapiens
tttgaacatgctgcatgataat

SEQ ID NO: 7780343 - DNA, 22 bp, Homo sapiens
tttgaacaggagtatctatagt

SEQ ID NO: 7780344 - DNA, 22 bp, Homo sapiens
tttgaacaggagtatctatagt

SEQ ID NO: 7780345 - DNA, 22 bp, Homo sapiens
tttgaaattggctcattggttt

SEQ ID NO: 7780346 - DNA, 22 bp, Homo sapiens
tttgacatgtgcttataacttt

SEQ ID NO: 7780347 - DNA, 22 bp, Homo sapiens
tttgacattaaggaacatatat

SEQ ID NO: 7780348 - DNA, 22 bp, Homo sapiens
tttgacattaaggaacatatat

SEQ ID NO: 7780349 - DNA, 22 bp, Homo sapiens
tttgagaaggtgacaaattcta

SEQ ID NO: 7780350 - DNA, 22 bp, Homo sapiens
tttgacattgaaagcagaatcg

SEQ ID NO: 7780351 - DNA, 22 bp, Homo sapiens
tttgacattgaaagcagaatcg

SEQ ID NO: 7780352 - DNA, 22 bp, Homo sapiens
tttgacatctaagaattcttac

SEQ ID NO: 7780353 - DNA, 22 bp, Homo sapiens
tttctagtaatcaatataaagt

SEQ ID NO: 7780354 - DNA, 22 bp, Homo sapiens
tttctagacatttctatgtaca

SEQ ID NO: 7780355 - DNA, 22 bp, Homo sapiens
tttctagagttcatcatggtaa

SEQ ID NO: 7780356 - DNA, 22 bp, Homo sapiens
tttctattctggatctgtggca

SEQ ID NO: 7780357 - DNA, 22 bp, Homo sapiens
tttctattctggatctgtggca

SEQ ID NO: 7780358 - DNA, 22 bp, Homo sapiens
tttctatctgagaagatatcta

SEQ ID NO: 7780359 - DNA, 22 bp, Homo sapiens
tttctattggcgtcactgttgt

SEQ ID NO: 7780360 - DNA, 22 bp, Homo sapiens
tttctattggcgtcactgttgt

SEQ ID NO: 7780361 - DNA, 22 bp, Homo sapiens
tttctattgatctaataaacat

SEQ ID NO: 7780362 - DNA, 22 bp, Homo sapiens
tttctattgatctaataaacat

SEQ ID NO: 7780363 - DNA, 22 bp, Homo sapiens
tttctattggcgtcactgttgt

SEQ ID NO: 7780364 - DNA, 22 bp, Homo sapiens
tttgaaattaagatattgtcca

SEQ ID NO: 7780365 - DNA, 22 bp, Homo sapiens
tttgaaatatgtgatgagagag

SEQ ID NO: 7780366 - DNA, 22 bp, Homo sapiens
tttgaaatatgaggcattatga

SEQ ID NO: 7780367 - DNA, 22 bp, Homo sapiens
ttttttcctctgtgatggcaaa

SEQ ID NO: 7780368 - DNA, 22 bp, Homo sapiens
ttttttccaggaagccactgga

SEQ ID NO: 7780369 - DNA, 22 bp, Homo sapiens
ttttttccagcttctagaggcc

SEQ ID NO: 7780370 - DNA, 22 bp, Homo sapiens
ttttttcctgagccttgtggtc

SEQ ID NO: 7780371 - DNA, 22 bp, Homo sapiens
ttttttccttcatgacttaaga

SEQ ID NO: 7780372 - DNA, 21 bp, Homo sapiens
ttttttcttgcgtgaggcctg

SEQ ID NO: 7780373 - DNA, 18 bp, Homo sapiens
cttgttcttctcttggcg

SEQ ID NO: 7780374 - DNA, 22 bp, Homo sapiens
cttgtttaaataagatagcagt

SEQ ID NO: 7780375 - DNA, 22 bp, Homo sapiens
cttgtttaataataccttagca

SEQ ID NO: 7780376 - DNA, 22 bp, Homo sapiens
atgaaataaatacccacacata

SEQ ID NO: 7780377 - DNA, 22 bp, Homo sapiens
atgaaatatcttgaagaaattc

SEQ ID NO: 7780378 - DNA, 22 bp, Homo sapiens
atgaaatatcttgaagaaattc

SEQ ID NO: 7780379 - DNA, 22 bp, Homo sapiens
atgaaacagtgtgtatagcaaa

SEQ ID NO: 7780380 - DNA, 22 bp, Homo sapiens
atgaaacatgagaaatggagag

SEQ ID NO: 7780381 - DNA, 22 bp, Homo sapiens
cttgtggccaatgtttgttata

SEQ ID NO: 7780382 - DNA, 22 bp, Homo sapiens
cttgtggcccatggcttcctgc

SEQ ID NO: 7780383 - DNA, 17 bp, Homo sapiens
cttgtggccagttttta

SEQ ID NO: 7780384 - DNA, 22 bp, Homo sapiens
cttgtgtggtctggtcttgcta

SEQ ID NO: 7780385 - DNA, 22 bp, Homo sapiens
atgaaaagcataaacgctgaag

SEQ ID NO: 7780386 - DNA, 22 bp, Homo sapiens
atgaaaagggagtgatatttgt

SEQ ID NO: 7780387 - DNA, 22 bp, Homo sapiens
atgaaaactttagcctcattag

SEQ ID NO: 7780388 - DNA, 22 bp, Homo sapiens
atctttgggcaatgatgaggga

SEQ ID NO: 7780389 - DNA, 22 bp, Homo sapiens
atctttgggcaatgatgaggga

SEQ ID NO: 7780390 - DNA, 22 bp, Homo sapiens
atctttgggcaatgatgaggga

SEQ ID NO: 7780391 - DNA, 22 bp, Homo sapiens
atgaaatggtggttttccattt

SEQ ID NO: 7780392 - DNA, 22 bp, Homo sapiens
atgaaatgctgagaggtgcttc

SEQ ID NO: 7780393 - DNA, 22 bp, Homo sapiens
atgaaatgctgagaggtgcttc

SEQ ID NO: 7780394 - DNA, 22 bp, Homo sapiens
atgaaatgctattttggctaga

SEQ ID NO: 7780395 - DNA, 22 bp, Homo sapiens
atgaaatgattgaaatctttac

SEQ ID NO: 7780396 - DNA, 22 bp, Homo sapiens
atgaaatgtatgagtctgggtt

SEQ ID NO: 7780397 - DNA, 22 bp, Homo sapiens
atgaaatgtaagtagagagttt

SEQ ID NO: 7780398 - DNA, 22 bp, Homo sapiens
atgaaatgtattcagatatgta

SEQ ID NO: 7780399 - DNA, 22 bp, Homo sapiens
atgaaatgtgaatgcttttcat

SEQ ID NO: 7780400 - DNA, 22 bp, Homo sapiens
atgaaatgtctggatctttttc

SEQ ID NO: 7780401 - DNA, 22 bp, Homo sapiens
atgaaatgtgaatgcttttcat

SEQ ID NO: 7780402 - DNA, 22 bp, Homo sapiens
atgaaatgagtcaatgcgacta

SEQ ID NO: 7780403 - DNA, 22 bp, Homo sapiens
atgaaatgaagttggcctggct

SEQ ID NO: 7780404 - DNA, 23 bp, Homo sapiens
atgaaatgatactttattcactg

SEQ ID NO: 7780405 - DNA, 22 bp, Homo sapiens
atgaaatatttcagagcagagt

SEQ ID NO: 7780406 - DNA, 22 bp, Homo sapiens
atgaaatatcttgaagaaattc

SEQ ID NO: 7780407 - DNA, 22 bp, Homo sapiens
atgaaatatcttgaagaaattc

SEQ ID NO: 7780408 - DNA, 22 bp, Homo sapiens
atgaaatatcttgaagaaattc

SEQ ID NO: 7780409 - DNA, 22 bp, Homo sapiens
atgaaatatcttgaagaaattc

SEQ ID NO: 7780410 - DNA, 22 bp, Homo sapiens
cttttcaaacgctgatgtcagt

SEQ ID NO: 7780411 - DNA, 19 bp, Homo sapiens
cttttcaagccatcagttt

SEQ ID NO: 7780412 - DNA, 22 bp, Homo sapiens
cttttcatgagtctgttatggg

SEQ ID NO: 7780413 - DNA, 19 bp, Homo sapiens
cttttcatcaacagccaat

SEQ ID NO: 7780414 - DNA, 23 bp, Homo sapiens
cttttcattgccttagcgcagag

SEQ ID NO: 7780415 - DNA, 22 bp, Homo sapiens
cttgctggggtaagtctgtgct

SEQ ID NO: 7780416 - DNA, 22 bp, Homo sapiens
cttggcagggtggaggatgcag

SEQ ID NO: 7780417 - DNA, 22 bp, Homo sapiens
cttggcagcttttggaggagcc

SEQ ID NO: 7780418 - DNA, 21 bp, Homo sapiens
cttggcctctagctagagctg

SEQ ID NO: 7780419 - DNA, 22 bp, Homo sapiens
cttggcccagttgccaaggaaa

SEQ ID NO: 7780420 - DNA, 22 bp, Homo sapiens
cttggcccggagccccatgaag

SEQ ID NO: 7780421 - DNA, 22 bp, Homo sapiens
cttggcccagttgccaaggaaa

SEQ ID NO: 7780422 - DNA, 22 bp, Homo sapiens
cttggcatgcagcaggcactca

SEQ ID NO: 7780423 - DNA, 19 bp, Homo sapiens
cttggcatctgtgaagtga

SEQ ID NO: 7780424 - DNA, 22 bp, Homo sapiens
cttggcctcttctcagggtggg

SEQ ID NO: 7780425 - DNA, 22 bp, Homo sapiens
cttggcctgacatgtggcaggg

SEQ ID NO: 7780426 - DNA, 22 bp, Homo sapiens
cttggcctgcccagccagaagg

SEQ ID NO: 7780427 - DNA, 22 bp, Homo sapiens
cttggcctgcaggcagcagcgc

SEQ ID NO: 7780428 - DNA, 22 bp, Homo sapiens
cttggctccaatcccagctctg

SEQ ID NO: 7780429 - DNA, 22 bp, Homo sapiens
cttggcctgggccgcagccact

SEQ ID NO: 7780430 - DNA, 22 bp, Homo sapiens
cttggctgaactccaggatgca

SEQ ID NO: 7780431 - DNA, 22 bp, Homo sapiens
cttgtaaaatatccagttaagg

SEQ ID NO: 7780432 - DNA, 22 bp, Homo sapiens
atcttctcatgtgtaatgaggt

SEQ ID NO: 7780433 - DNA, 22 bp, Homo sapiens
cttgtaatagataggatcaaat

SEQ ID NO: 7780434 - DNA, 22 bp, Homo sapiens
atcttctgggcagtgaaaattg

SEQ ID NO: 7780435 - DNA, 22 bp, Homo sapiens
cttgcctttgtcttcaaaggct

SEQ ID NO: 7780436 - DNA, 22 bp, Homo sapiens
cttgcctttgtcttcaaaggct

SEQ ID NO: 7780437 - DNA, 23 bp, Homo sapiens
cttgcctggcctctctgcccaga

SEQ ID NO: 7780438 - DNA, 22 bp, Homo sapiens
cttgcctgctggagcagggctc

SEQ ID NO: 7780439 - DNA, 19 bp, Homo sapiens
cttgcctgttcctacagct

SEQ ID NO: 7780440 - DNA, 22 bp, Homo sapiens
atctatgtgcctttgtatagaa

SEQ ID NO: 7780441 - DNA, 22 bp, Homo sapiens
atctatgtgcctttgtatagaa

SEQ ID NO: 7780442 - DNA, 22 bp, Homo sapiens
atctaggatttgaatgcacagt

SEQ ID NO: 7780443 - DNA, 22 bp, Homo sapiens
atctagaagtcatggctttctt

SEQ ID NO: 7780444 - DNA, 22 bp, Homo sapiens
atctagaacttaaagtcagtca

SEQ ID NO: 7780445 - DNA, 22 bp, Homo sapiens
atctagaacaattattgtcaca

SEQ ID NO: 7780446 - DNA, 22 bp, Homo sapiens
atctagaaagccaggggcctgc

SEQ ID NO: 7780447 - DNA, 23 bp, Homo sapiens
atctagaaacctgatgactctgt

SEQ ID NO: 7780448 - DNA, 22 bp, Homo sapiens
atctagaaagtgttgaagatca

SEQ ID NO: 7780449 - DNA, 22 bp, Homo sapiens
atctacagctgtctgcacagta

SEQ ID NO: 7780450 - DNA, 19 bp, Homo sapiens
atctacaattattctcagt

SEQ ID NO: 7780451 - DNA, 22 bp, Homo sapiens
atctacaggattttacagagtt

SEQ ID NO: 7780452 - DNA, 22 bp, Homo sapiens
atctacagtgcacaggacagcc

SEQ ID NO: 7780453 - DNA, 22 bp, Homo sapiens
atctacaggctgaggtgggagg

SEQ ID NO: 7780454 - DNA, 22 bp, Homo sapiens
atctagaaaaggtgactaaaat

SEQ ID NO: 7780455 - DNA, 22 bp, Homo sapiens
atgaagcagcgttgtagagtga

SEQ ID NO: 7780456 - DNA, 22 bp, Homo sapiens
gaaagcaatttgtgtaatctgt

SEQ ID NO: 7780457 - DNA, 22 bp, Homo sapiens
gaaagcacagttctgaccatgt

SEQ ID NO: 7780458 - DNA, 22 bp, Homo sapiens
atgagttgaagctacaagaggc

SEQ ID NO: 7780459 - DNA, 22 bp, Homo sapiens
atgagttttgggggatgttaga

SEQ ID NO: 7780460 - DNA, 20 bp, Homo sapiens
atgagtttaaacattcagag

SEQ ID NO: 7780461 - DNA, 22 bp, Homo sapiens
atgcaaaaactgcacttacgct

SEQ ID NO: 7780462 - DNA, 22 bp, Homo sapiens
atgattcagcccaatttttcta

SEQ ID NO: 7780463 - DNA, 22 bp, Homo sapiens
gaaagcagtaaatgggtcccat

SEQ ID NO: 7780464 - DNA, 22 bp, Homo sapiens
atgaggtggtcttcagtaggtc

SEQ ID NO: 7780465 - DNA, 22 bp, Homo sapiens
atgaggtttgagcctcttgacc

SEQ ID NO: 7780466 - DNA, 20 bp, Homo sapiens
atgcaaactcacaaaatacc

SEQ ID NO: 7780467 - DNA, 22 bp, Homo sapiens
atgcaaacatgaagagaaagag

SEQ ID NO: 7780468 - DNA, 22 bp, Homo sapiens
atgcaaaataaggcagaaacat

SEQ ID NO: 7780469 - DNA, 22 bp, Homo sapiens
atgcaaataaagcaactataca

SEQ ID NO: 7780470 - DNA, 22 bp, Homo sapiens
atgcaaataaacagtctagttg

SEQ ID NO: 7780471 - DNA, 22 bp, Homo sapiens
atgcaaataaagcaactataca

SEQ ID NO: 7780472 - DNA, 22 bp, Homo sapiens
atgcaaatcttaagtatgtgtg

SEQ ID NO: 7780473 - DNA, 22 bp, Homo sapiens
atgcaaatgaacatgttgctag

SEQ ID NO: 7780474 - DNA, 20 bp, Homo sapiens
atgcaaatcccaaaatcagg

SEQ ID NO: 7780475 - DNA, 22 bp, Homo sapiens
atgcaaataagtgcaggcgtgg

SEQ ID NO: 7780476 - DNA, 19 bp, Homo sapiens
atgcaaatagatttggaat

SEQ ID NO: 7780477 - DNA, 22 bp, Homo sapiens
atgcaaatattaatggtatgac

SEQ ID NO: 7780478 - DNA, 22 bp, Homo sapiens
atgcagaaagagaatgtaatgt

SEQ ID NO: 7780479 - DNA, 22 bp, Homo sapiens
atgcagaaagcggcaaacaggt

SEQ ID NO: 7780480 - DNA, 22 bp, Homo sapiens
atgcagaagactgaaaagctga

SEQ ID NO: 7780481 - DNA, 22 bp, Homo sapiens
atgcagaagcagaacttacaca

SEQ ID NO: 7780482 - DNA, 22 bp, Homo sapiens
atgcagaatcttgagaaaaatt

SEQ ID NO: 7780483 - DNA, 22 bp, Homo sapiens
atgcagaattgctaagtatctg

SEQ ID NO: 7780484 - DNA, 22 bp, Homo sapiens
atgcagatgttcctactgtgtt

SEQ ID NO: 7780485 - DNA, 22 bp, Homo sapiens
atgcagatggtggatggagaaa

SEQ ID NO: 7780486 - DNA, 22 bp, Homo sapiens
atgcagatctgtgaaaggaata

SEQ ID NO: 7780487 - DNA, 22 bp, Homo sapiens
atgcatgcattgtttatcatgg

SEQ ID NO: 7780488 - DNA, 22 bp, Homo sapiens
atgcatatgccgtagaataagt

SEQ ID NO: 7780489 - DNA, 22 bp, Homo sapiens
atgcagcttccatattttgctg

SEQ ID NO: 7780490 - DNA, 22 bp, Homo sapiens
atgcagctgtgggcaagaaatg

SEQ ID NO: 7780491 - DNA, 22 bp, Homo sapiens
atgcagcttcaggattatgatg

SEQ ID NO: 7780492 - DNA, 22 bp, Homo sapiens
atgcagctgctgacagctttca

SEQ ID NO: 7780493 - DNA, 22 bp, Homo sapiens
atgcagctgtcagggagaacat

SEQ ID NO: 7780494 - DNA, 20 bp, Homo sapiens
atgcagctggagttggggtg

SEQ ID NO: 7780495 - DNA, 22 bp, Homo sapiens
atgcagctagattttccagtgt

SEQ ID NO: 7780496 - DNA, 19 bp, Homo sapiens
atgcagctcctgcctcctt

SEQ ID NO: 7780497 - DNA, 22 bp, Homo sapiens
atgcagctcatttgtttaaaag

SEQ ID NO: 7780498 - DNA, 22 bp, Homo sapiens
atgcagctatttgagcatgtca

SEQ ID NO: 7780499 - DNA, 22 bp, Homo sapiens
atgcagctgacattttcatgtt

SEQ ID NO: 7780500 - DNA, 22 bp, Homo sapiens
atgcagctgagggtagtggagc

SEQ ID NO: 7780501 - DNA, 22 bp, Homo sapiens
atgcagctgctcttcctctatt

SEQ ID NO: 7780502 - DNA, 22 bp, Homo sapiens
atgcagctgctcttcctctatt

SEQ ID NO: 7780503 - DNA, 22 bp, Homo sapiens
atgcattctagcctggacaaca

SEQ ID NO: 7780504 - DNA, 22 bp, Homo sapiens
atgcattctggaaagtagcaat

SEQ ID NO: 7780505 - DNA, 22 bp, Homo sapiens
atgcattcatgaagattgcaca

SEQ ID NO: 7780506 - DNA, 22 bp, Homo sapiens
atggcagctggcttgggcacct

SEQ ID NO: 7780507 - DNA, 22 bp, Homo sapiens
atggcagggaccaagctgtcat

SEQ ID NO: 7780508 - DNA, 22 bp, Homo sapiens
atggcaggatacccagtccggc

SEQ ID NO: 7780509 - DNA, 22 bp, Homo sapiens
gagaggaactcccagtgcctgg

SEQ ID NO: 7780510 - DNA, 22 bp, Homo sapiens
gagccaggaagaaggccttact

SEQ ID NO: 7780511 - DNA, 22 bp, Homo sapiens
gagccagctatgtagcaagagg

SEQ ID NO: 7780512 - DNA, 22 bp, Homo sapiens
atggctggaagagtcgaagagt

SEQ ID NO: 7780513 - DNA, 22 bp, Homo sapiens
gagccaggcccgtacttgctgt

SEQ ID NO: 7780514 - DNA, 22 bp, Homo sapiens
gagccaggcccgtacttgctgt

SEQ ID NO: 7780515 - DNA, 22 bp, Homo sapiens
atggcccaaactgcaattactt

SEQ ID NO: 7780516 - DNA, 22 bp, Homo sapiens
atggcccaagtgccctgacctg

SEQ ID NO: 7780517 - DNA, 22 bp, Homo sapiens
atggcccaaaacctcctccctc

SEQ ID NO: 7780518 - DNA, 22 bp, Homo sapiens
atggcccactctggtcccggca

SEQ ID NO: 7780519 - DNA, 22 bp, Homo sapiens
atggcccagaagtttggaaagg

SEQ ID NO: 7780520 - DNA, 22 bp, Homo sapiens
atggcccagactcagactggtg

SEQ ID NO: 7780521 - DNA, 22 bp, Homo sapiens
atggcccaggcaggctggtact

SEQ ID NO: 7780522 - DNA, 22 bp, Homo sapiens
atggcccaggccaggatccagc

SEQ ID NO: 7780523 - DNA, 22 bp, Homo sapiens
atggcccaggcctcctgtggct

SEQ ID NO: 7780524 - DNA, 22 bp, Homo sapiens
atggccagtgttgagatcaggc

SEQ ID NO: 7780525 - DNA, 22 bp, Homo sapiens
gagccagccttcttctgaggtc

SEQ ID NO: 7780526 - DNA, 22 bp, Homo sapiens
gacagcaacactcaattctgca

SEQ ID NO: 7780527 - DNA, 22 bp, Homo sapiens
gacagcaacacatgcttagtgc

SEQ ID NO: 7780528 - DNA, 22 bp, Homo sapiens
gacagcaacctcatgagaaact

SEQ ID NO: 7780529 - DNA, 22 bp, Homo sapiens
gacagcaaagcagagccaaggc

SEQ ID NO: 7780530 - DNA, 22 bp, Homo sapiens
gacagaggtgtccttgagtcca

SEQ ID NO: 7780531 - DNA, 23 bp, Homo sapiens
gacagagtgagaccttgtcttac

SEQ ID NO: 7780532 - DNA, 22 bp, Homo sapiens
atggaaatggagtgtgcttgct

SEQ ID NO: 7780533 - DNA, 22 bp, Homo sapiens
atggaaatgttccatatattga

SEQ ID NO: 7780534 - DNA, 22 bp, Homo sapiens
atgccactgcgctctagcctgg

SEQ ID NO: 7780535 - DNA, 20 bp, Homo sapiens
atggaggaagggcaagagaa

SEQ ID NO: 7780536 - DNA, 22 bp, Homo sapiens
gagaaatagattcatggtagat

SEQ ID NO: 7780537 - DNA, 22 bp, Homo sapiens
gagaaagggataatttgaagag

SEQ ID NO: 7780538 - DNA, 22 bp, Homo sapiens
atggaagagtccccatggatga

SEQ ID NO: 7780539 - DNA, 22 bp, Homo sapiens
atggaagcagacaggtaattcc

SEQ ID NO: 7780540 - DNA, 22 bp, Homo sapiens
gaggctgcggggaggagcctgc

SEQ ID NO: 7780541 - DNA, 22 bp, Homo sapiens
gaggctgcggggaggagcctgc

SEQ ID NO: 7780542 - DNA, 20 bp, Homo sapiens
gaggctgcggactgctggac

SEQ ID NO: 7780543 - DNA, 22 bp, Homo sapiens
atgtcttttatggagatgtcat

SEQ ID NO: 7780544 - DNA, 22 bp, Homo sapiens
atgtctttggctttgacatggc

SEQ ID NO: 7780545 - DNA, 22 bp, Homo sapiens
atgtctttgccatagttcatat

SEQ ID NO: 7780546 - DNA, 22 bp, Homo sapiens
atgtctttcttgtgtcccaaga

SEQ ID NO: 7780547 - DNA, 22 bp, Homo sapiens
atgtctttctagttaagagcta

SEQ ID NO: 7780548 - DNA, 22 bp, Homo sapiens
atgtctttcttatggtctgttg

SEQ ID NO: 7780549 - DNA, 22 bp, Homo sapiens
atgtctgctttccttttaatca

SEQ ID NO: 7780550 - DNA, 22 bp, Homo sapiens
gaggcctggctgggaggaggtg

SEQ ID NO: 7780551 - DNA, 22 bp, Homo sapiens
gaggcctggctgggaggaggtg

SEQ ID NO: 7780552 - DNA, 22 bp, Homo sapiens
gaggcctgggagaactgttttt

SEQ ID NO: 7780553 - DNA, 22 bp, Homo sapiens
gaggggagaggcttatggatca

SEQ ID NO: 7780554 - DNA, 22 bp, Homo sapiens
gaggctgctgttagccctgggc

SEQ ID NO: 7780555 - DNA, 22 bp, Homo sapiens
gaggagctgggaccctgtcatc

SEQ ID NO: 7780556 - DNA, 22 bp, Homo sapiens
gaggagctggcagcgtctccgc

SEQ ID NO: 7780557 - DNA, 22 bp, Homo sapiens
gaggagctggctgtcgggaggc

SEQ ID NO: 7780558 - DNA, 22 bp, Homo sapiens
gaggccaggagtgctgtaagtt

SEQ ID NO: 7780559 - DNA, 22 bp, Homo sapiens
gaggccagggatgcaatgagag

SEQ ID NO: 7780560 - DNA, 22 bp, Homo sapiens
gaggccagggatgcaatgagag

SEQ ID NO: 7780561 - DNA, 22 bp, Homo sapiens
gaggccaggggtcagcaattgg

SEQ ID NO: 7780562 - DNA, 22 bp, Homo sapiens
gaggagctgaggctgaggcctc

SEQ ID NO: 7780563 - DNA, 22 bp, Homo sapiens
gaggagctctgctccatccttc

SEQ ID NO: 7780564 - DNA, 17 bp, Homo sapiens
gaggagctccagtaggt

SEQ ID NO: 7780565 - DNA, 20 bp, Homo sapiens
atgtactccccacaagcaac

SEQ ID NO: 7780566 - DNA, 22 bp, Homo sapiens
atgtacattcttctcaccgaag

SEQ ID NO: 7780567 - DNA, 22 bp, Homo sapiens
atgtacaattctccttggtagg

SEQ ID NO: 7780568 - DNA, 22 bp, Homo sapiens
gagctgggcctgcgagtgctgc

SEQ ID NO: 7780569 - DNA, 17 bp, Homo sapiens
atggtctcactgagcaa

SEQ ID NO: 7780570 - DNA, 22 bp, Homo sapiens
atggtattgcaacaactgtcat

SEQ ID NO: 7780571 - DNA, 22 bp, Homo sapiens
atttaatttacatttgacagag

SEQ ID NO: 7780572 - DNA, 22 bp, Homo sapiens
atttaatgtcgagctattgtag

SEQ ID NO: 7780573 - DNA, 22 bp, Homo sapiens
atttaatgtcgagctattgtag

SEQ ID NO: 7780574 - DNA, 21 bp, Homo sapiens
atttacaaaacagtcccttcc

SEQ ID NO: 7780575 - DNA, 22 bp, Homo sapiens
atttaattttctcaacagtgct

SEQ ID NO: 7780576 - DNA, 22 bp, Homo sapiens
attgcttcaactgttcaatggg

SEQ ID NO: 7780577 - DNA, 18 bp, Homo sapiens
attgcttttgtaccaacc

SEQ ID NO: 7780578 - DNA, 22 bp, Homo sapiens
attgcttttcagacaatgaggc

SEQ ID NO: 7780579 - DNA, 19 bp, Homo sapiens
gccaggagggctctggctg

SEQ ID NO: 7780580 - DNA, 22 bp, Homo sapiens
gccaggaggcttaactggacag

SEQ ID NO: 7780581 - DNA, 22 bp, Homo sapiens
atttacagaaacttaatcatag

SEQ ID NO: 7780582 - DNA, 22 bp, Homo sapiens
atttacacttggtttactagag

SEQ ID NO: 7780583 - DNA, 22 bp, Homo sapiens
atttacacttggtttactagag

SEQ ID NO: 7780584 - DNA, 22 bp, Homo sapiens
atttacacttggtttactagag

SEQ ID NO: 7780585 - DNA, 22 bp, Homo sapiens
atttacacattcataagatttc

SEQ ID NO: 7780586 - DNA, 22 bp, Homo sapiens
atttacacattcataagatttc

SEQ ID NO: 7780587 - DNA, 22 bp, Homo sapiens
atttacactggttctcagagct

SEQ ID NO: 7780588 - DNA, 22 bp, Homo sapiens
gccaggaggggagagtgtgtca

SEQ ID NO: 7780589 - DNA, 20 bp, Homo sapiens
gccaggagggtgtgatgagc

SEQ ID NO: 7780590 - DNA, 22 bp, Homo sapiens
gccaggaggtcagcccctcaac

SEQ ID NO: 7780591 - DNA, 22 bp, Homo sapiens
gccaggaggtcagcccctcaac

SEQ ID NO: 7780592 - DNA, 22 bp, Homo sapiens
atttagaaattccaaaagtatt

SEQ ID NO: 7780593 - DNA, 22 bp, Homo sapiens
atttactggaaaaactatgagc

SEQ ID NO: 7780594 - DNA, 22 bp, Homo sapiens
atttagaaattccaaaagtatt

SEQ ID NO: 7780595 - DNA, 22 bp, Homo sapiens
atttactgagcagctaccatgt

SEQ ID NO: 7780596 - DNA, 22 bp, Homo sapiens
atttactgcttgacacattggt

SEQ ID NO: 7780597 - DNA, 22 bp, Homo sapiens
atttccttgcaagtttctgtaa

SEQ ID NO: 7780598 - DNA, 22 bp, Homo sapiens
atttccttcggacagtttgggt

SEQ ID NO: 7780599 - DNA, 22 bp, Homo sapiens
atttcatgtgaagaagagataa

SEQ ID NO: 7780600 - DNA, 22 bp, Homo sapiens
atttctactgtgagaaacatga

SEQ ID NO: 7780601 - DNA, 22 bp, Homo sapiens
atttcatatgtatcacctagcc

SEQ ID NO: 7780602 - DNA, 22 bp, Homo sapiens
atttcatgagttattatagtgg

SEQ ID NO: 7780603 - DNA, 21 bp, Homo sapiens
atttcatggtgcttttaagaa

SEQ ID NO: 7780604 - DNA, 22 bp, Homo sapiens
atttcagcccagtatgagcccc

SEQ ID NO: 7780605 - DNA, 22 bp, Homo sapiens
atttcagtagaaaatcttgatt

SEQ ID NO: 7780606 - DNA, 22 bp, Homo sapiens
atttcagtattatacaactgct

SEQ ID NO: 7780607 - DNA, 22 bp, Homo sapiens
atttcagtgagaaagcaatcaa

SEQ ID NO: 7780608 - DNA, 22 bp, Homo sapiens
gccaggcatttgttaggtgctg

SEQ ID NO: 7780609 - DNA, 22 bp, Homo sapiens
atttattgagacttaacaaccc

SEQ ID NO: 7780610 - DNA, 22 bp, Homo sapiens
atttattgagacttaacaaccc

SEQ ID NO: 7780611 - DNA, 22 bp, Homo sapiens
gccaggcctgcaagtgctggtg

SEQ ID NO: 7780612 - DNA, 22 bp, Homo sapiens
gccaggccctgggcacttcgtg

SEQ ID NO: 7780613 - DNA, 22 bp, Homo sapiens
gccaggccactcccgggtcctg

SEQ ID NO: 7780614 - DNA, 22 bp, Homo sapiens
atttcagattcagaaatgtagg

SEQ ID NO: 7780615 - DNA, 21 bp, Homo sapiens
atttcagagcacacaagtaaa

SEQ ID NO: 7780616 - DNA, 18 bp, Homo sapiens
gcctgcctagagcttgcc

SEQ ID NO: 7780617 - DNA, 18 bp, Homo sapiens
gcctgcctagagcttgcc

SEQ ID NO: 7780618 - DNA, 22 bp, Homo sapiens
gcctctctgggctgccgaggct

SEQ ID NO: 7780619 - DNA, 22 bp, Homo sapiens
gcctgctctggaatccatgtaa

SEQ ID NO: 7780620 - DNA, 22 bp, Homo sapiens
gcctgctgaagccagagtgtgt

SEQ ID NO: 7780621 - DNA, 22 bp, Homo sapiens
gcctgctgagggaagttgggca

SEQ ID NO: 7780622 - DNA, 22 bp, Homo sapiens
gcctgctgagggaagttgggca

SEQ ID NO: 7780623 - DNA, 22 bp, Homo sapiens
gcctgctggaggagcctcaggg

SEQ ID NO: 7780624 - DNA, 22 bp, Homo sapiens
gcctgctggacattggccggcc

SEQ ID NO: 7780625 - DNA, 21 bp, Homo sapiens
gcctgctgcctgtggccggtc

SEQ ID NO: 7780626 - DNA, 22 bp, Homo sapiens
gcctgctgccaccctggctccg

SEQ ID NO: 7780627 - DNA, 22 bp, Homo sapiens
gcctgctgcatccaggctattg

SEQ ID NO: 7780628 - DNA, 22 bp, Homo sapiens
gcctgctggatcaagcttatgc

SEQ ID NO: 7780629 - DNA, 22 bp, Homo sapiens
gcctgctggatgtggccaggcc

SEQ ID NO: 7780630 - DNA, 22 bp, Homo sapiens
gcctggagctcatgtgggcatt

SEQ ID NO: 7780631 - DNA, 22 bp, Homo sapiens
gcctggctgaggtggggaggca

SEQ ID NO: 7780632 - DNA, 22 bp, Homo sapiens
gcctggctgaggcctctgctaa

SEQ ID NO: 7780633 - DNA, 22 bp, Homo sapiens
atttctcactgagcagataaaa

SEQ ID NO: 7780634 - DNA, 22 bp, Homo sapiens
atttctcacaaagttgcttatc

SEQ ID NO: 7780635 - DNA, 22 bp, Homo sapiens
atttctcaaccaggtcaaaaag

SEQ ID NO: 7780636 - DNA, 22 bp, Homo sapiens
gcctccacttttgctggcttct

SEQ ID NO: 7780637 - DNA, 22 bp, Homo sapiens
atttctcagtaggtgcacagtg

SEQ ID NO: 7780638 - DNA, 21 bp, Homo sapiens
gcctcaccatgtcaagccagg

SEQ ID NO: 7780639 - DNA, 22 bp, Homo sapiens
atttctcagtgaaatgacaggc

SEQ ID NO: 7780640 - DNA, 21 bp, Homo sapiens
gcctctccaaatcctgccttc

SEQ ID NO: 7780641 - DNA, 22 bp, Homo sapiens
gcctctcctggagaaggcaggg

SEQ ID NO: 7780642 - DNA, 22 bp, Homo sapiens
gcctccccaaagtgctgacagc

SEQ ID NO: 7780643 - DNA, 22 bp, Homo sapiens
gcctccccaaagtgctgacagc

SEQ ID NO: 7780644 - DNA, 22 bp, Homo sapiens
gcctccccaagcagcagggatt

SEQ ID NO: 7780645 - DNA, 22 bp, Homo sapiens
gcctccccaagcagcagggatt

SEQ ID NO: 7780646 - DNA, 22 bp, Homo sapiens
gcctccccaggggtgtcatgag

SEQ ID NO: 7780647 - DNA, 22 bp, Homo sapiens
gcctccagctggggcatttcag

SEQ ID NO: 7780648 - DNA, 22 bp, Homo sapiens
caaactattgttcacaagacaa

SEQ ID NO: 7780649 - DNA, 22 bp, Homo sapiens
caaactatttacaatggaatca

SEQ ID NO: 7780650 - DNA, 22 bp, Homo sapiens
gcgagggcacgcggttgaaggc

SEQ ID NO: 7780651 - DNA, 22 bp, Homo sapiens
gcgagtgccgagagggcagggc

SEQ ID NO: 7780652 - DNA, 22 bp, Homo sapiens
gcgagggcacgcggttgaaggc

SEQ ID NO: 7780653 - DNA, 22 bp, Homo sapiens
gcgcagctcagtgagggaactt

SEQ ID NO: 7780654 - DNA, 22 bp, Homo sapiens
gctcaggaaatagtttagtgtt

SEQ ID NO: 7780655 - DNA, 22 bp, Homo sapiens
gctcaggaaggctcaaccagga

SEQ ID NO: 7780656 - DNA, 22 bp, Homo sapiens
gctcaggaaacagcagggcttg

SEQ ID NO: 7780657 - DNA, 22 bp, Homo sapiens
caaacttttgaggagttcagga

SEQ ID NO: 7780658 - DNA, 22 bp, Homo sapiens
gctcagcttgggagcgcccggt

SEQ ID NO: 7780659 - DNA, 22 bp, Homo sapiens
caaactttcagttataacatga

SEQ ID NO: 7780660 - DNA, 22 bp, Homo sapiens
caaaaccaagaacattcatttc

SEQ ID NO: 7780661 - DNA, 22 bp, Homo sapiens
caaaactatcaggctcaaagct

SEQ ID NO: 7780662 - DNA, 22 bp, Homo sapiens
caaaacattctctgcagcaggg

SEQ ID NO: 7780663 - DNA, 22 bp, Homo sapiens
caaaaccaagaacattcatttc

SEQ ID NO: 7780664 - DNA, 22 bp, Homo sapiens
caaaaaacacagatgtctgtgt

SEQ ID NO: 7780665 - DNA, 22 bp, Homo sapiens
attttttagaacctggcctgat

SEQ ID NO: 7780666 - DNA, 22 bp, Homo sapiens
gcctgtgcctcagcctgcagcc

SEQ ID NO: 7780667 - DNA, 22 bp, Homo sapiens
caaaacattcagagagctcact

SEQ ID NO: 7780668 - DNA, 22 bp, Homo sapiens
gcctgtgacccagggcccagga

SEQ ID NO: 7780669 - DNA, 22 bp, Homo sapiens
gcctgggagtgcacagtgaggt

SEQ ID NO: 7780670 - DNA, 18 bp, Homo sapiens
attaatcataaaatgctg

SEQ ID NO: 7780671 - DNA, 22 bp, Homo sapiens
attaatcatttctgcattatct

SEQ ID NO: 7780672 - DNA, 22 bp, Homo sapiens
attaatcatttctgcattatct

SEQ ID NO: 7780673 - DNA, 22 bp, Homo sapiens
attaatgtgtagccaacttaat

SEQ ID NO: 7780674 - DNA, 22 bp, Homo sapiens
attaatattggttcattagctg

SEQ ID NO: 7780675 - DNA, 22 bp, Homo sapiens
attaatatacactgttagcatg

SEQ ID NO: 7780676 - DNA, 22 bp, Homo sapiens
gatgatgacagtgattagactg

SEQ ID NO: 7780677 - DNA, 22 bp, Homo sapiens
attacaagatgcatccatattt

SEQ ID NO: 7780678 - DNA, 22 bp, Homo sapiens
attaatttttctgacagccaca

SEQ ID NO: 7780679 - DNA, 22 bp, Homo sapiens
attacaaaagaagggagaaggt

SEQ ID NO: 7780680 - DNA, 22 bp, Homo sapiens
attacaaaagaagggagaaggt

SEQ ID NO: 7780681 - DNA, 22 bp, Homo sapiens
gcaaggctgagcacatttgcat

SEQ ID NO: 7780682 - DNA, 22 bp, Homo sapiens
gcaaggctgctgccacccatct

SEQ ID NO: 7780683 - DNA, 22 bp, Homo sapiens
gcaaggctgtgcactttgcatt

SEQ ID NO: 7780684 - DNA, 22 bp, Homo sapiens
attacaataatacatgctcatt

SEQ ID NO: 7780685 - DNA, 22 bp, Homo sapiens
attagaatgacagaaatgaggc

SEQ ID NO: 7780686 - DNA, 22 bp, Homo sapiens
attagaatgaagtataggattt

SEQ ID NO: 7780687 - DNA, 22 bp, Homo sapiens
attagaattatgcttgctaatg

SEQ ID NO: 7780688 - DNA, 22 bp, Homo sapiens
attagacatcatatgattcagc

SEQ ID NO: 7780689 - DNA, 22 bp, Homo sapiens
gcaaggctttgtgaattttaaa

SEQ ID NO: 7780690 - DNA, 21 bp, Homo sapiens
gcaaggcttttgtgtttccca

SEQ ID NO: 7780691 - DNA, 19 bp, Homo sapiens
gcaaggttcactcccagag

SEQ ID NO: 7780692 - DNA, 20 bp, Homo sapiens
attattcatacatgtgtgac

SEQ ID NO: 7780693 - DNA, 22 bp, Homo sapiens
attattcatggtcttccacaat

SEQ ID NO: 7780694 - DNA, 22 bp, Homo sapiens
attattcattggtaggcaagct

SEQ ID NO: 7780695 - DNA, 22 bp, Homo sapiens
attattcttatgtcatcatggc

SEQ ID NO: 7780696 - DNA, 22 bp, Homo sapiens
attattaaagctacatcaagga

SEQ ID NO: 7780697 - DNA, 22 bp, Homo sapiens
attattaaagctacatcaagga

SEQ ID NO: 7780698 - DNA, 22 bp, Homo sapiens
attattaaagctacatcaagga

SEQ ID NO: 7780699 - DNA, 22 bp, Homo sapiens
attattcaatcatattaaaagt

SEQ ID NO: 7780700 - DNA, 22 bp, Homo sapiens
attattcaatcatattaaaagt

SEQ ID NO: 7780701 - DNA, 22 bp, Homo sapiens
attattcaatcatattaaaagt

SEQ ID NO: 7780702 - DNA, 22 bp, Homo sapiens
attattcagtcttgtaaggagt

SEQ ID NO: 7780703 - DNA, 22 bp, Homo sapiens
attattcagtcttgtaaggagt

SEQ ID NO: 7780704 - DNA, 22 bp, Homo sapiens
atgttttattaccaacttgtac

SEQ ID NO: 7780705 - DNA, 22 bp, Homo sapiens
atgttttattaccaacttgtac

SEQ ID NO: 7780706 - DNA, 22 bp, Homo sapiens
atgttttattaccaacttgtac

SEQ ID NO: 7780707 - DNA, 22 bp, Homo sapiens
atgttttccccaaatgatcttc

SEQ ID NO: 7780708 - DNA, 22 bp, Homo sapiens
atgttttcaaagtaaacttgta

SEQ ID NO: 7780709 - DNA, 22 bp, Homo sapiens
atgttttctccatgttatgctt

SEQ ID NO: 7780710 - DNA, 22 bp, Homo sapiens
atgttttctagagtttaaaatc

SEQ ID NO: 7780711 - DNA, 19 bp, Homo sapiens
atgttttatgctgatggga

SEQ ID NO: 7780712 - DNA, 22 bp, Homo sapiens
atgttttatgcttcagatgagg

SEQ ID NO: 7780713 - DNA, 22 bp, Homo sapiens
atgttttatgttccactcaagg

SEQ ID NO: 7780714 - DNA, 22 bp, Homo sapiens
atgttttatgcttcagatgagg

SEQ ID NO: 7780715 - DNA, 20 bp, Homo sapiens
atgttttataaaagaacggg

SEQ ID NO: 7780716 - DNA, 22 bp, Homo sapiens
atgtttctgaagtttacagata

SEQ ID NO: 7780717 - DNA, 22 bp, Homo sapiens
atgtgttagtttgtgattatac

SEQ ID NO: 7780718 - DNA, 22 bp, Homo sapiens
atgtgttttggtaatttctgct

SEQ ID NO: 7780719 - DNA, 22 bp, Homo sapiens
atgttaaaaaccagtacagttg

SEQ ID NO: 7780720 - DNA, 22 bp, Homo sapiens
atgtgtttgtcctgcagaaata

SEQ ID NO: 7780721 - DNA, 18 bp, Homo sapiens
gatgaggctgtctgagaa

SEQ ID NO: 7780722 - DNA, 22 bp, Homo sapiens
gatgagttctttctattctatt

SEQ ID NO: 7780723 - DNA, 22 bp, Homo sapiens
attaaatgttccttaaattata

SEQ ID NO: 7780724 - DNA, 22 bp, Homo sapiens
gatgaggcaagccagaggactg

SEQ ID NO: 7780725 - DNA, 22 bp, Homo sapiens
attaaattagcaaactgtgaaa

SEQ ID NO: 7780726 - DNA, 22 bp, Homo sapiens
attaaattaagtggctaattta

SEQ ID NO: 7780727 - DNA, 22 bp, Homo sapiens
attaaattaagtggctaattta

SEQ ID NO: 7780728 - DNA, 22 bp, Homo sapiens
atgtttttgagatacaaacaga

SEQ ID NO: 7780729 - DNA, 22 bp, Homo sapiens
atgtttttaaatagacttacag

SEQ ID NO: 7780730 - DNA, 22 bp, Homo sapiens
attatttatcctcttggtctat

SEQ ID NO: 7780731 - DNA, 22 bp, Homo sapiens
attatttagaaatcgattgaaa

SEQ ID NO: 7780732 - DNA, 22 bp, Homo sapiens
attatttcagtcagacactggc

SEQ ID NO: 7780733 - DNA, 22 bp, Homo sapiens
attattgtactttcaataaggt

SEQ ID NO: 7780734 - DNA, 20 bp, Homo sapiens
gcagagctgttctgtgggga

SEQ ID NO: 7780735 - DNA, 22 bp, Homo sapiens
gcagagctgttaatggagctga

SEQ ID NO: 7780736 - DNA, 22 bp, Homo sapiens
gcagagctgttaatggagctga

SEQ ID NO: 7780737 - DNA, 23 bp, Homo sapiens
gcagagctgccctattgccttgg

SEQ ID NO: 7780738 - DNA, 21 bp, Homo sapiens
gcagagctggaaccaggaccc

SEQ ID NO: 7780739 - DNA, 21 bp, Homo sapiens
gcagagctggaaccaggaccc

SEQ ID NO: 7780740 - DNA, 22 bp, Homo sapiens
attccactttatgtctgtatga

SEQ ID NO: 7780741 - DNA, 16 bp, Homo sapiens
gcagaggaaaggggag

SEQ ID NO: 7780742 - DNA, 16 bp, Homo sapiens
gcagaggaaaggggag

SEQ ID NO: 7780743 - DNA, 20 bp, Homo sapiens
attcctcagccccagcctca

SEQ ID NO: 7780744 - DNA, 20 bp, Homo sapiens
attcctcagccccagcctca

SEQ ID NO: 7780745 - DNA, 22 bp, Homo sapiens
attcctggtggcagaaacatga

SEQ ID NO: 7780746 - DNA, 22 bp, Homo sapiens
gcagcaggcatggccgccctgg

SEQ ID NO: 7780747 - DNA, 22 bp, Homo sapiens
gcagcaggcttttcataccttg

SEQ ID NO: 7780748 - DNA, 22 bp, Homo sapiens
attctacatttggagtgatgtc

SEQ ID NO: 7780749 - DNA, 22 bp, Homo sapiens
gcagcaggtccgcatcatcatc

SEQ ID NO: 7780750 - DNA, 22 bp, Homo sapiens
gcagcagggtgccagctttgca

SEQ ID NO: 7780751 - DNA, 22 bp, Homo sapiens
gcagcagggagcaggggtgtca

SEQ ID NO: 7780752 - DNA, 22 bp, Homo sapiens
attgaaaaatgactattgctta

SEQ ID NO: 7780753 - DNA, 20 bp, Homo sapiens
attgaaatttttctgagatt

SEQ ID NO: 7780754 - DNA, 22 bp, Homo sapiens
attgaatgcttgctaacacttt

SEQ ID NO: 7780755 - DNA, 22 bp, Homo sapiens
attgacaaatctgaacatacgg

SEQ ID NO: 7780756 - DNA, 22 bp, Homo sapiens
attgcacttcagcctgggtgac

SEQ ID NO: 7780757 - DNA, 23 bp, Homo sapiens
attgaccagctgtctcattttca

SEQ ID NO: 7780758 - DNA, 22 bp, Homo sapiens
attgacatgtaggctacaagga

SEQ ID NO: 7780759 - DNA, 22 bp, Homo sapiens
attcttcacacctgttcctgtt

SEQ ID NO: 7780760 - DNA, 22 bp, Homo sapiens
attcttatttaaatagagtctg

SEQ ID NO: 7780761 - DNA, 22 bp, Homo sapiens
attcttcactgtttcagaatga

SEQ ID NO: 7780762 - DNA, 22 bp, Homo sapiens
attcttattatagtaaaacagt

SEQ ID NO: 7780763 - DNA, 22 bp, Homo sapiens
attcttattatagtaaaacagt

SEQ ID NO: 7780764 - DNA, 22 bp, Homo sapiens
attcttattaaatagccagaag

SEQ ID NO: 7780765 - DNA, 22 bp, Homo sapiens
attcttacaaagcagagtctgt

SEQ ID NO: 7780766 - DNA, 22 bp, Homo sapiens
attcttactccatagaatgaat

SEQ ID NO: 7780767 - DNA, 22 bp, Homo sapiens
attcttacaaatgaaactgcaa

SEQ ID NO: 7780768 - DNA, 22 bp, Homo sapiens
attcttaattgccatgctgtat

SEQ ID NO: 7780769 - DNA, 22 bp, Homo sapiens
attctattttttaagaagtagt

SEQ ID NO: 7780770 - DNA, 22 bp, Homo sapiens
attctattaatatttctaggaa

SEQ ID NO: 7780771 - DNA, 22 bp, Homo sapiens
gctgcagtgagccaagatcgtg

SEQ ID NO: 7780772 - DNA, 22 bp, Homo sapiens
gctgcagcctttgggaaggaca

SEQ ID NO: 7780773 - DNA, 22 bp, Homo sapiens
gctgcagccttcttgccattaa

SEQ ID NO: 7780774 - DNA, 22 bp, Homo sapiens
gctgcagccctgcggatcactt

SEQ ID NO: 7780775 - DNA, 17 bp, Homo sapiens
gctgcagcggtaggcag

SEQ ID NO: 7780776 - DNA, 21 bp, Homo sapiens
gctgccaccgcgtgctccagg

SEQ ID NO: 7780777 - DNA, 22 bp, Homo sapiens
caacatattttccaagagtgaa

SEQ ID NO: 7780778 - DNA, 22 bp, Homo sapiens
caacatatgattttgtatataa

SEQ ID NO: 7780779 - DNA, 22 bp, Homo sapiens
caacatataatatttgagttct

SEQ ID NO: 7780780 - DNA, 22 bp, Homo sapiens
caaagtacagtgcttcctggga

SEQ ID NO: 7780781 - DNA, 19 bp, Homo sapiens
caaagtacctggcacagtg

SEQ ID NO: 7780782 - DNA, 22 bp, Homo sapiens
caaagtatattggattgaatgg

SEQ ID NO: 7780783 - DNA, 22 bp, Homo sapiens
caaagtatatttcatagtctca

SEQ ID NO: 7780784 - DNA, 22 bp, Homo sapiens
caaagtatatttcatagtctca

SEQ ID NO: 7780785 - DNA, 22 bp, Homo sapiens
caaagtatgaaccagtttctct

SEQ ID NO: 7780786 - DNA, 18 bp, Homo sapiens
gctcctggaccaggtcac

SEQ ID NO: 7780787 - DNA, 18 bp, Homo sapiens
gctcctggagtctgactc

SEQ ID NO: 7780788 - DNA, 22 bp, Homo sapiens
gctcctggagagattgagaaag

SEQ ID NO: 7780789 - DNA, 19 bp, Homo sapiens
gctcctggatgacctgtgg

SEQ ID NO: 7780790 - DNA, 22 bp, Homo sapiens
gctgcagcagaagttctcagag

SEQ ID NO: 7780791 - DNA, 22 bp, Homo sapiens
gctgcagcagaagttctcagag

SEQ ID NO: 7780792 - DNA, 22 bp, Homo sapiens
gctgcagcaagccctccagggg

SEQ ID NO: 7780793 - DNA, 19 bp, Homo sapiens
gctgcagcagagaaactgg

SEQ ID NO: 7780794 - DNA, 22 bp, Homo sapiens
gctgcagcagctgcagggttgt

SEQ ID NO: 7780795 - DNA, 22 bp, Homo sapiens
gctgcagccaaattcattgtca

SEQ ID NO: 7780796 - DNA, 22 bp, Homo sapiens
gctgcagcccggcgcgcctgag

SEQ ID NO: 7780797 - DNA, 22 bp, Homo sapiens
gctgcagccaaattcattgtca

SEQ ID NO: 7780798 - DNA, 22 bp, Homo sapiens
gctgcctgccttgcctggagga

SEQ ID NO: 7780799 - DNA, 22 bp, Homo sapiens
caactacaggaaaagtcattca

SEQ ID NO: 7780800 - DNA, 22 bp, Homo sapiens
gctgctggagagcgagactgtt

SEQ ID NO: 7780801 - DNA, 22 bp, Homo sapiens
gctgctggagagcgagactgtt

SEQ ID NO: 7780802 - DNA, 22 bp, Homo sapiens
gctgctggagagcgagactgtt

SEQ ID NO: 7780803 - DNA, 22 bp, Homo sapiens
gctgccttttaaagcctcgctt

SEQ ID NO: 7780804 - DNA, 22 bp, Homo sapiens
gctgccttttgctcctcccacc

SEQ ID NO: 7780805 - DNA, 22 bp, Homo sapiens
gctgctggatgcgcttgatggt

SEQ ID NO: 7780806 - DNA, 22 bp, Homo sapiens
gctgctggatgcgcttgatggt

SEQ ID NO: 7780807 - DNA, 22 bp, Homo sapiens
gctgctggcactggagtgagcc

SEQ ID NO: 7780808 - DNA, 22 bp, Homo sapiens
gctgctggcactggagtgagcc

SEQ ID NO: 7780809 - DNA, 22 bp, Homo sapiens
gctgctggcatctagggggtgg

SEQ ID NO: 7780810 - DNA, 22 bp, Homo sapiens
caagacaatgggtaagtgtaac

SEQ ID NO: 7780811 - DNA, 22 bp, Homo sapiens
caagacaagatctaagcatgct

SEQ ID NO: 7780812 - DNA, 22 bp, Homo sapiens
caagagctcaccggagagcatt

SEQ ID NO: 7780813 - DNA, 22 bp, Homo sapiens
caagagctgcaaatagcgtgac

SEQ ID NO: 7780814 - DNA, 22 bp, Homo sapiens
caagctgcttattctctgctct

SEQ ID NO: 7780815 - DNA, 22 bp, Homo sapiens
caaggaatcccatttctaactc

SEQ ID NO: 7780816 - DNA, 22 bp, Homo sapiens
caagatgtggtgggctgagttt

SEQ ID NO: 7780817 - DNA, 22 bp, Homo sapiens
caagattactatccactgctgg

SEQ ID NO: 7780818 - DNA, 22 bp, Homo sapiens
caagctgccaccagaagagcat

SEQ ID NO: 7780819 - DNA, 22 bp, Homo sapiens
caagatgcccctggtagggatc

SEQ ID NO: 7780820 - DNA, 22 bp, Homo sapiens
caagatggagaagcagcaaggg

SEQ ID NO: 7780821 - DNA, 22 bp, Homo sapiens
caaggagaaaacggcttctgaa

SEQ ID NO: 7780822 - DNA, 22 bp, Homo sapiens
caaggacagcgtcaggtgcaac

SEQ ID NO: 7780823 - DNA, 22 bp, Homo sapiens
caaggacactgatgttcatcct

SEQ ID NO: 7780824 - DNA, 22 bp, Homo sapiens
caagatgatccctgaaggcagc

SEQ ID NO: 7780825 - DNA, 22 bp, Homo sapiens
caagatgaaactacagggagga

SEQ ID NO: 7780826 - DNA, 22 bp, Homo sapiens
caagaggctaaactgggctatt

SEQ ID NO: 7780827 - DNA, 22 bp, Homo sapiens
caagaggcaaattgtctagaag

SEQ ID NO: 7780828 - DNA, 22 bp, Homo sapiens
caagataatttattctgagttt

SEQ ID NO: 7780829 - DNA, 22 bp, Homo sapiens
caagagctttagaaatgctcat

SEQ ID NO: 7780830 - DNA, 22 bp, Homo sapiens
cacaataaatgtttgctgatga

SEQ ID NO: 7780831 - DNA, 22 bp, Homo sapiens
ggaaaatactgattcatgccat

SEQ ID NO: 7780832 - DNA, 17 bp, Homo sapiens
ggaaaagaagagtagga

SEQ ID NO: 7780833 - DNA, 22 bp, Homo sapiens
ggaaaactgaggctctcagcag

SEQ ID NO: 7780834 - DNA, 22 bp, Homo sapiens
cacaaaatatcaagcactttta

SEQ ID NO: 7780835 - DNA, 22 bp, Homo sapiens
cacaaaatatcaagcactttta

SEQ ID NO: 7780836 - DNA, 22 bp, Homo sapiens
cacacattggttttactccttt

SEQ ID NO: 7780837 - DNA, 22 bp, Homo sapiens
cacacattcaccatgactgaaa

SEQ ID NO: 7780838 - DNA, 22 bp, Homo sapiens
cacaccaaagtatttggtattt

SEQ ID NO: 7780839 - DNA, 22 bp, Homo sapiens
cacaccagatggcagcgtggga

SEQ ID NO: 7780840 - DNA, 23 bp, Homo sapiens
cacaccaggagccgtctgggcca

SEQ ID NO: 7780841 - DNA, 19 bp, Homo sapiens
cacacccatgcttgccaag

SEQ ID NO: 7780842 - DNA, 22 bp, Homo sapiens
cacacgtgtgagagctgtggca

SEQ ID NO: 7780843 - DNA, 22 bp, Homo sapiens
cacaccttaggcctgagcgctt

SEQ ID NO: 7780844 - DNA, 22 bp, Homo sapiens
cacacctgtaataccagctact

SEQ ID NO: 7780845 - DNA, 22 bp, Homo sapiens
cacaattattatctctttctac

SEQ ID NO: 7780846 - DNA, 22 bp, Homo sapiens
cacaattatagaagaaagcata

SEQ ID NO: 7780847 - DNA, 22 bp, Homo sapiens
cacaattagcagctctttattt

SEQ ID NO: 7780848 - DNA, 19 bp, Homo sapiens
cacaattatgagacactta

SEQ ID NO: 7780849 - DNA, 22 bp, Homo sapiens
cacacattaatatcaaaggctc

SEQ ID NO: 7780850 - DNA, 22 bp, Homo sapiens
cacacagtgggaaaacctgaag

SEQ ID NO: 7780851 - DNA, 22 bp, Homo sapiens
caaggcagaattcagactcagg

SEQ ID NO: 7780852 - DNA, 22 bp, Homo sapiens
caaggcagcccgctgaaccaca

SEQ ID NO: 7780853 - DNA, 22 bp, Homo sapiens
caaggcagcgttcctttctgga

SEQ ID NO: 7780854 - DNA, 20 bp, Homo sapiens
caaggcagaccagagtgagt

SEQ ID NO: 7780855 - DNA, 20 bp, Homo sapiens
caaggcagaccagagtgagt

SEQ ID NO: 7780856 - DNA, 20 bp, Homo sapiens
caaggcagaccagagtgagt

SEQ ID NO: 7780857 - DNA, 22 bp, Homo sapiens
gctgtctccatagctgtgtgtc

SEQ ID NO: 7780858 - DNA, 22 bp, Homo sapiens
caaggcagctattgtctccata

SEQ ID NO: 7780859 - DNA, 22 bp, Homo sapiens
caaggcagctgtagggatttgg

SEQ ID NO: 7780860 - DNA, 22 bp, Homo sapiens
caaggcagctattgtctccata

SEQ ID NO: 7780861 - DNA, 20 bp, Homo sapiens
gctgtggcaaagctttgtgt

SEQ ID NO: 7780862 - DNA, 22 bp, Homo sapiens
gctgtggcccttggcatctgcg

SEQ ID NO: 7780863 - DNA, 22 bp, Homo sapiens
gctgtgcttgcatgagtgtctg

SEQ ID NO: 7780864 - DNA, 22 bp, Homo sapiens
gctgtgctgcgggaggattccg

SEQ ID NO: 7780865 - DNA, 19 bp, Homo sapiens
gctgtctgatgctgaggtc

SEQ ID NO: 7780866 - DNA, 22 bp, Homo sapiens
gctgtctgagaacatggtggaa

SEQ ID NO: 7780867 - DNA, 19 bp, Homo sapiens
gcttgggagagggagctaa

SEQ ID NO: 7780868 - DNA, 22 bp, Homo sapiens
gcttggctggagaaagttacct

SEQ ID NO: 7780869 - DNA, 22 bp, Homo sapiens
gcttctgaggaaggctcagcct

SEQ ID NO: 7780870 - DNA, 22 bp, Homo sapiens
gcttggcatttgctgggagctg

SEQ ID NO: 7780871 - DNA, 22 bp, Homo sapiens
gcttggctcctggctcacaggt

SEQ ID NO: 7780872 - DNA, 22 bp, Homo sapiens
gcttggctctaagacacctatt

SEQ ID NO: 7780873 - DNA, 22 bp, Homo sapiens
gcttggctggaaataggttgag

SEQ ID NO: 7780874 - DNA, 22 bp, Homo sapiens
gcttggctcctggctcacaggt

SEQ ID NO: 7780875 - DNA, 22 bp, Homo sapiens
gcttctccagaccttcatcccc

SEQ ID NO: 7780876 - DNA, 22 bp, Homo sapiens
gcttctcctcccgctcccaggc

SEQ ID NO: 7780877 - DNA, 22 bp, Homo sapiens
ggcagtgtcaaaataggcagaa

SEQ ID NO: 7780878 - DNA, 22 bp, Homo sapiens
ggcagtgtccagcttcctggag

SEQ ID NO: 7780879 - DNA, 22 bp, Homo sapiens
ggcagtgttctggttgtcagga

SEQ ID NO: 7780880 - DNA, 22 bp, Homo sapiens
ggcagtgtttatgggtaacaca

SEQ ID NO: 7780881 - DNA, 22 bp, Homo sapiens
ggcagtgtccttgcagctctac

SEQ ID NO: 7780882 - DNA, 22 bp, Homo sapiens
ggcagtgtgcatctgtgtggcc

SEQ ID NO: 7780883 - DNA, 22 bp, Homo sapiens
ggcagtgtggcataacatgtag

SEQ ID NO: 7780884 - DNA, 22 bp, Homo sapiens
ggcagtgtccttgcagctctac

SEQ ID NO: 7780885 - DNA, 22 bp, Homo sapiens
ggcagtgtggcctgagtaagtc

SEQ ID NO: 7780886 - DNA, 22 bp, Homo sapiens
ggcagtgttatttttcagaaat

SEQ ID NO: 7780887 - DNA, 22 bp, Homo sapiens
ggcagtgttccagaccttcacc

SEQ ID NO: 7780888 - DNA, 22 bp, Homo sapiens
ggcagctgagatcatgctgttg

SEQ ID NO: 7780889 - DNA, 22 bp, Homo sapiens
ggcagctgattagcatcaagga

SEQ ID NO: 7780890 - DNA, 22 bp, Homo sapiens
caccaggctggagtgcagtggc

SEQ ID NO: 7780891 - DNA, 22 bp, Homo sapiens
caccaggctggagtgcagtggc

SEQ ID NO: 7780892 - DNA, 22 bp, Homo sapiens
ggcagctgagatcatgctgttg

SEQ ID NO: 7780893 - DNA, 22 bp, Homo sapiens
caccccaagttctgtccactgc

SEQ ID NO: 7780894 - DNA, 22 bp, Homo sapiens
caccccaagttctgtccactgc

SEQ ID NO: 7780895 - DNA, 22 bp, Homo sapiens
cacccaggttggagtgcagtgg

SEQ ID NO: 7780896 - DNA, 22 bp, Homo sapiens
cacccaggttggagtgcagtgg

SEQ ID NO: 7780897 - DNA, 22 bp, Homo sapiens
cacccagtaagcatgaggccct

SEQ ID NO: 7780898 - DNA, 22 bp, Homo sapiens
cacccaggctagagtgcagtgg

SEQ ID NO: 7780899 - DNA, 22 bp, Homo sapiens
cacccctgggctgggcacacag

SEQ ID NO: 7780900 - DNA, 22 bp, Homo sapiens
cacccctgtggagcatggtggc

SEQ ID NO: 7780901 - DNA, 22 bp, Homo sapiens
cacccccagcagggaaaggagg

SEQ ID NO: 7780902 - DNA, 22 bp, Homo sapiens
cacccctacctgagtcaggagt

SEQ ID NO: 7780903 - DNA, 22 bp, Homo sapiens
cacccctgtggagcatggtggc

SEQ ID NO: 7780904 - DNA, 22 bp, Homo sapiens
caccccttgtctttggggtcgt

SEQ ID NO: 7780905 - DNA, 20 bp, Homo sapiens
caccctcccagcacctatgc

SEQ ID NO: 7780906 - DNA, 22 bp, Homo sapiens
caccctcccgtcagcccctggg

SEQ ID NO: 7780907 - DNA, 18 bp, Homo sapiens
caccctccgcggctgccc

SEQ ID NO: 7780908 - DNA, 18 bp, Homo sapiens
caccctccgcggctgccc

SEQ ID NO: 7780909 - DNA, 22 bp, Homo sapiens
caccctggctggaggtgcagtg

SEQ ID NO: 7780910 - DNA, 22 bp, Homo sapiens
ggcctctcattctccctggtcc

SEQ ID NO: 7780911 - DNA, 22 bp, Homo sapiens
ggcctctctagcatccagcctg

SEQ ID NO: 7780912 - DNA, 22 bp, Homo sapiens
cactgcagcctcgctctcctga

SEQ ID NO: 7780913 - DNA, 22 bp, Homo sapiens
cactgcagtaactctaggactg

SEQ ID NO: 7780914 - DNA, 22 bp, Homo sapiens
cactgagagatgtgtcacagca

SEQ ID NO: 7780915 - DNA, 22 bp, Homo sapiens
cactggcaaagcctgttcctta

SEQ ID NO: 7780916 - DNA, 22 bp, Homo sapiens
cactggcagatttgggatctgg

SEQ ID NO: 7780917 - DNA, 22 bp, Homo sapiens
cactggcaaatggagagaatgt

SEQ ID NO: 7780918 - DNA, 22 bp, Homo sapiens
cactggcatctaagggtggtag

SEQ ID NO: 7780919 - DNA, 22 bp, Homo sapiens
cactggcattagtcacgaggca

SEQ ID NO: 7780920 - DNA, 22 bp, Homo sapiens
cactggcatgtgaggcggtggc

SEQ ID NO: 7780921 - DNA, 22 bp, Homo sapiens
cactggcatctagtgggttgag

SEQ ID NO: 7780922 - DNA, 22 bp, Homo sapiens
cactggaagttcattctcagaa

SEQ ID NO: 7780923 - DNA, 22 bp, Homo sapiens
ggctcaatgcaacttctgcctc

SEQ ID NO: 7780924 - DNA, 22 bp, Homo sapiens
cactgcttttcagacagttatt

SEQ ID NO: 7780925 - DNA, 22 bp, Homo sapiens
ggctagggagacagagggcatg

SEQ ID NO: 7780926 - DNA, 22 bp, Homo sapiens
ggctagggagacagagggcatg

SEQ ID NO: 7780927 - DNA, 22 bp, Homo sapiens
ggctagggagacagagggcatg

SEQ ID NO: 7780928 - DNA, 22 bp, Homo sapiens
ggctagggactcctcctcaggg

SEQ ID NO: 7780929 - DNA, 22 bp, Homo sapiens
cactgcagtcttcatcaaccaa

SEQ ID NO: 7780930 - DNA, 22 bp, Homo sapiens
ggctagggatctagaccaggac

SEQ ID NO: 7780931 - DNA, 22 bp, Homo sapiens
ggctagggatctagaccaggac

SEQ ID NO: 7780932 - DNA, 22 bp, Homo sapiens
ggctaggggaataatctgtggt

SEQ ID NO: 7780933 - DNA, 22 bp, Homo sapiens
ggctaggggaataatctgtggt

SEQ ID NO: 7780934 - DNA, 22 bp, Homo sapiens
ggctcaagcagtctgcctgcct

SEQ ID NO: 7780935 - DNA, 22 bp, Homo sapiens
cacagctggtgcactagctctg

SEQ ID NO: 7780936 - DNA, 22 bp, Homo sapiens
cacagctggtgcactagctctg

SEQ ID NO: 7780937 - DNA, 22 bp, Homo sapiens
cacactgtcaggtaaataacac

SEQ ID NO: 7780938 - DNA, 22 bp, Homo sapiens
cacagcttccattagaatgaga

SEQ ID NO: 7780939 - DNA, 22 bp, Homo sapiens
cacagcttccattagaatgaga

SEQ ID NO: 7780940 - DNA, 22 bp, Homo sapiens
cacagcttatgccactgattgg

SEQ ID NO: 7780941 - DNA, 22 bp, Homo sapiens
ggaggcggacacaggtagtgtt

SEQ ID NO: 7780942 - DNA, 22 bp, Homo sapiens
ggaggcgcggctcggctgtgcc

SEQ ID NO: 7780943 - DNA, 22 bp, Homo sapiens
cacagcttctgagtgaggattt

SEQ ID NO: 7780944 - DNA, 20 bp, Homo sapiens
cacagcttgccttttatgac

SEQ ID NO: 7780945 - DNA, 22 bp, Homo sapiens
cacagcttgggctctgacaata

SEQ ID NO: 7780946 - DNA, 22 bp, Homo sapiens
ggagggaggttagattcaagct

SEQ ID NO: 7780947 - DNA, 22 bp, Homo sapiens
ggagggagggctagaccaaaga

SEQ ID NO: 7780948 - DNA, 22 bp, Homo sapiens
ggagggagcagagaacccaacc

SEQ ID NO: 7780949 - DNA, 22 bp, Homo sapiens
ggatgggagcagaggacgacca

SEQ ID NO: 7780950 - DNA, 23 bp, Homo sapiens
ggatgggcaagcctagtgcctac

SEQ ID NO: 7780951 - DNA, 22 bp, Homo sapiens
ggatgggctgaaaggtagcccc

SEQ ID NO: 7780952 - DNA, 22 bp, Homo sapiens
ggatgggcccgggacggcgctg

SEQ ID NO: 7780953 - DNA, 22 bp, Homo sapiens
ggatgggcccgggacggcgctg

SEQ ID NO: 7780954 - DNA, 22 bp, Homo sapiens
ggatgtcgaggatggggtagca

SEQ ID NO: 7780955 - DNA, 22 bp, Homo sapiens
ggatgttctggggttctcttgt

SEQ ID NO: 7780956 - DNA, 22 bp, Homo sapiens
cacagggcagagacctgggtgc

SEQ ID NO: 7780957 - DNA, 22 bp, Homo sapiens
ggcacagggaggccctggtgtg

SEQ ID NO: 7780958 - DNA, 22 bp, Homo sapiens
ggcacagggagccgcagttgca

SEQ ID NO: 7780959 - DNA, 22 bp, Homo sapiens
cacagggcagagacctgggtgc

SEQ ID NO: 7780960 - DNA, 20 bp, Homo sapiens
ggcactggaagcacacagga

SEQ ID NO: 7780961 - DNA, 22 bp, Homo sapiens
ggcactggagactgttatgaga

SEQ ID NO: 7780962 - DNA, 22 bp, Homo sapiens
ggcactggaagtcccattgtct

SEQ ID NO: 7780963 - DNA, 22 bp, Homo sapiens
ggcactggaaggatcatgtgag

SEQ ID NO: 7780964 - DNA, 16 bp, Homo sapiens
ggcactggcaggtcct

SEQ ID NO: 7780965 - DNA, 22 bp, Homo sapiens
ggcactggcaaagcaaagtctg

SEQ ID NO: 7780966 - DNA, 22 bp, Homo sapiens
ggcactgggcaccggctgaggg

SEQ ID NO: 7780967 - DNA, 22 bp, Homo sapiens
ggcactgggagaggtgagacgg

SEQ ID NO: 7780968 - DNA, 22 bp, Homo sapiens
ggcactgggaatgcagtgatga

SEQ ID NO: 7780969 - DNA, 22 bp, Homo sapiens
cacagtggcaaaggggcttggg

SEQ ID NO: 7780970 - DNA, 22 bp, Homo sapiens
cacagtggaagtccaggatccc

SEQ ID NO: 7780971 - DNA, 22 bp, Homo sapiens
cacagtgctttatgagagatct

SEQ ID NO: 7780972 - DNA, 22 bp, Homo sapiens
cacagtgctgtttgtaaagaga

SEQ ID NO: 7780973 - DNA, 22 bp, Homo sapiens
cacagtgctcaaacacaagtgc

SEQ ID NO: 7780974 - DNA, 22 bp, Homo sapiens
cacagtgctcgggttttatgtc

SEQ ID NO: 7780975 - DNA, 22 bp, Homo sapiens
ggcagagctagtggcttctctt

SEQ ID NO: 7780976 - DNA, 19 bp, Homo sapiens
ggcagagctcctgctttct

SEQ ID NO: 7780977 - DNA, 22 bp, Homo sapiens
ggcagatggaatgagctgtcta

SEQ ID NO: 7780978 - DNA, 22 bp, Homo sapiens
ggcagccaccctgggaggcaga

SEQ ID NO: 7780979 - DNA, 22 bp, Homo sapiens
ggcagcatatattcagtgggca

SEQ ID NO: 7780980 - DNA, 22 bp, Homo sapiens
gggacacagagaaactggagaa

SEQ ID NO: 7780981 - DNA, 22 bp, Homo sapiens
gggaagctgcgtggtctagggc

SEQ ID NO: 7780982 - DNA, 22 bp, Homo sapiens
gggaagctgaagctagagaaaa

SEQ ID NO: 7780983 - DNA, 23 bp, Homo sapiens
gggaagctccatggaggtgctgg

SEQ ID NO: 7780984 - DNA, 22 bp, Homo sapiens
gggaaaggatcagtgggaggct

SEQ ID NO: 7780985 - DNA, 23 bp, Homo sapiens
gggaaaggatatgatcctagggg

SEQ ID NO: 7780986 - DNA, 22 bp, Homo sapiens
gggacagacccatgggccaggt

SEQ ID NO: 7780987 - DNA, 22 bp, Homo sapiens
gggacactggacccagtgtcca

SEQ ID NO: 7780988 - DNA, 21 bp, Homo sapiens
cagaagtaagggtaacttctc

SEQ ID NO: 7780989 - DNA, 22 bp, Homo sapiens
cagaagtaatgatgtcattcct

SEQ ID NO: 7780990 - DNA, 22 bp, Homo sapiens
cagaagtcaccctcagaataac

SEQ ID NO: 7780991 - DNA, 22 bp, Homo sapiens
cagaagtctttctgtttcacct

SEQ ID NO: 7780992 - DNA, 22 bp, Homo sapiens
gggaaactgtccagttctcccc

SEQ ID NO: 7780993 - DNA, 22 bp, Homo sapiens
gggaaagagaggtggacgcagg

SEQ ID NO: 7780994 - DNA, 22 bp, Homo sapiens
cagaagggcagcactgggaagg

SEQ ID NO: 7780995 - DNA, 22 bp, Homo sapiens
gggagcaggagcctgcctgcca

SEQ ID NO: 7780996 - DNA, 22 bp, Homo sapiens
cagaagtgatgttgagctagtc

SEQ ID NO: 7780997 - DNA, 22 bp, Homo sapiens
cagacagaaggctccttgaggt

SEQ ID NO: 7780998 - DNA, 22 bp, Homo sapiens
gggcaaggcagaagagttggag

SEQ ID NO: 7780999 - DNA, 22 bp, Homo sapiens
gggcacaccttgtctgagcaca

SEQ ID NO: 7781000 - DNA, 22 bp, Homo sapiens
gggcaatgggcttttctgtaag

SEQ ID NO: 7781001 - DNA, 22 bp, Homo sapiens
gggcaatggatgtgatgactcc

SEQ ID NO: 7781002 - DNA, 22 bp, Homo sapiens
cagacagggacctcgctccaga

SEQ ID NO: 7781003 - DNA, 22 bp, Homo sapiens
gggaggtcagggtgcctgctgg

SEQ ID NO: 7781004 - DNA, 20 bp, Homo sapiens
gggaggccccagagtccagg

SEQ ID NO: 7781005 - DNA, 20 bp, Homo sapiens
gggaggccagcctcagagaa

SEQ ID NO: 7781006 - DNA, 22 bp, Homo sapiens
gggcgagggcgaaagcgagagc

SEQ ID NO: 7781007 - DNA, 21 bp, Homo sapiens
gggcgaggcctgatgtggctc

SEQ ID NO: 7781008 - DNA, 22 bp, Homo sapiens
gggcacagagggtcttgaagaa

SEQ ID NO: 7781009 - DNA, 22 bp, Homo sapiens
gggcacttaatgggcacagaga

SEQ ID NO: 7781010 - DNA, 22 bp, Homo sapiens
gggcacttctaagcatggggct

SEQ ID NO: 7781011 - DNA, 22 bp, Homo sapiens
gggcagagaaatggacagttgg

SEQ ID NO: 7781012 - DNA, 22 bp, Homo sapiens
ggggaaaggccatggcaagaac

SEQ ID NO: 7781013 - DNA, 18 bp, Homo sapiens
ggggaaaagccaggtgtc

SEQ ID NO: 7781014 - DNA, 22 bp, Homo sapiens
cagagctgctcatggtggccag

SEQ ID NO: 7781015 - DNA, 19 bp, Homo sapiens
cagagctgctggcctcgtc

SEQ ID NO: 7781016 - DNA, 22 bp, Homo sapiens
gggctgtgtactatgaggaggg

SEQ ID NO: 7781017 - DNA, 22 bp, Homo sapiens
cagagctgagaatgttgatgct

SEQ ID NO: 7781018 - DNA, 22 bp, Homo sapiens
cagagctgagtcttcaaggttg

SEQ ID NO: 7781019 - DNA, 22 bp, Homo sapiens
cagagctgcacattctatgatg

SEQ ID NO: 7781020 - DNA, 22 bp, Homo sapiens
cagagctgcagattgaaggcat

SEQ ID NO: 7781021 - DNA, 22 bp, Homo sapiens
cagaggcaggataagaactgcg

SEQ ID NO: 7781022 - DNA, 20 bp, Homo sapiens
cagaggcattttcagactct

SEQ ID NO: 7781023 - DNA, 22 bp, Homo sapiens
cagaggccacctgtggccactg

SEQ ID NO: 7781024 - DNA, 22 bp, Homo sapiens
cagaggccacctgtggccactg

SEQ ID NO: 7781025 - DNA, 19 bp, Homo sapiens
cagaggccagaagcacagg

SEQ ID NO: 7781026 - DNA, 22 bp, Homo sapiens
cagaggccaggctgcctgactg

SEQ ID NO: 7781027 - DNA, 22 bp, Homo sapiens
cagaggccaggctgcctgactg

SEQ ID NO: 7781028 - DNA, 22 bp, Homo sapiens
cagaggccaggctgcctgactg

SEQ ID NO: 7781029 - DNA, 22 bp, Homo sapiens
cagaggccagggggctcacaaa

SEQ ID NO: 7781030 - DNA, 22 bp, Homo sapiens
cagaggccagggggctcacaaa

SEQ ID NO: 7781031 - DNA, 22 bp, Homo sapiens
cagaggccagtggacaagggcc

SEQ ID NO: 7781032 - DNA, 22 bp, Homo sapiens
cagaggcccagtgagagggctg

SEQ ID NO: 7781033 - DNA, 22 bp, Homo sapiens
cagaggcctatccagtgtccat

SEQ ID NO: 7781034 - DNA, 22 bp, Homo sapiens
cagaggcctcacttccagccag

SEQ ID NO: 7781035 - DNA, 21 bp, Homo sapiens
cagaggcctcatgctctgtgc

SEQ ID NO: 7781036 - DNA, 22 bp, Homo sapiens
cagaggcctggcttggacacct

SEQ ID NO: 7781037 - DNA, 22 bp, Homo sapiens
gggtgccacagagcttccactt

SEQ ID NO: 7781038 - DNA, 22 bp, Homo sapiens
gggtgccacagagcttccactt

SEQ ID NO: 7781039 - DNA, 22 bp, Homo sapiens
gggtgcatggtgtatgactgga

SEQ ID NO: 7781040 - DNA, 21 bp, Homo sapiens
cagaggtggcctgacctctga

SEQ ID NO: 7781041 - DNA, 22 bp, Homo sapiens
cagaggtgtacagagggaggcc

SEQ ID NO: 7781042 - DNA, 22 bp, Homo sapiens
cagaggttacctagagcaagaa

SEQ ID NO: 7781043 - DNA, 22 bp, Homo sapiens
cagaggtgttggtgaatggaga

SEQ ID NO: 7781044 - DNA, 23 bp, Homo sapiens
cagaggtgtcagtgcccagtgtc

SEQ ID NO: 7781045 - DNA, 22 bp, Homo sapiens
cagaggctgggacctcaggcat

SEQ ID NO: 7781046 - DNA, 22 bp, Homo sapiens
cagcccagagccagttcccgct

SEQ ID NO: 7781047 - DNA, 22 bp, Homo sapiens
cagccacagctgggtgcctgac

SEQ ID NO: 7781048 - DNA, 22 bp, Homo sapiens
gtattttactgctcaaagctct

SEQ ID NO: 7781049 - DNA, 22 bp, Homo sapiens
gtattttactgctcaaagctct

SEQ ID NO: 7781050 - DNA, 22 bp, Homo sapiens
gtattttaagtgactactaggt

SEQ ID NO: 7781051 - DNA, 22 bp, Homo sapiens
gtattttaagtgactactaggt

SEQ ID NO: 7781052 - DNA, 22 bp, Homo sapiens
gtatttgtcttgttggtctcca

SEQ ID NO: 7781053 - DNA, 22 bp, Homo sapiens
cagcattgatcccaggctgtgg

SEQ ID NO: 7781054 - DNA, 22 bp, Homo sapiens
ggttcccggatctccgagtccc

SEQ ID NO: 7781055 - DNA, 22 bp, Homo sapiens
ggttctaggattaggaggccca

SEQ ID NO: 7781056 - DNA, 22 bp, Homo sapiens
ggttctaggtctggggataatg

SEQ ID NO: 7781057 - DNA, 22 bp, Homo sapiens
cagcaagggttatatcaaagat

SEQ ID NO: 7781058 - DNA, 22 bp, Homo sapiens
cagcaagtcatccaggatgatg

SEQ ID NO: 7781059 - DNA, 22 bp, Homo sapiens
gtaaaattctagcatctgaaag

SEQ ID NO: 7781060 - DNA, 22 bp, Homo sapiens
gtaaaattgcaattacttttgc

SEQ ID NO: 7781061 - DNA, 22 bp, Homo sapiens
gtaaacaacacaaatcatttga

SEQ ID NO: 7781062 - DNA, 22 bp, Homo sapiens
gtaaacaggaatgtggtcatgg

SEQ ID NO: 7781063 - DNA, 22 bp, Homo sapiens
cagcagagctgtgtgggaaggg

SEQ ID NO: 7781064 - DNA, 22 bp, Homo sapiens
ggttgcatttctcagtggaata

SEQ ID NO: 7781065 - DNA, 22 bp, Homo sapiens
cagcaaggccattggatgcagt

SEQ ID NO: 7781066 - DNA, 22 bp, Homo sapiens
cagcaagggataaacaaggacg

SEQ ID NO: 7781067 - DNA, 22 bp, Homo sapiens
cagcaaggccattggatgcagt

SEQ ID NO: 7781068 - DNA, 22 bp, Homo sapiens
ggtgggtgaaatctaggtgtgt

SEQ ID NO: 7781069 - DNA, 22 bp, Homo sapiens
ggtgggtgaaatctaggtgtgt

SEQ ID NO: 7781070 - DNA, 22 bp, Homo sapiens
ggtgggtaaaactgctggcact

SEQ ID NO: 7781071 - DNA, 20 bp, Homo sapiens
gggtgggagagtctgagggt

SEQ ID NO: 7781072 - DNA, 22 bp, Homo sapiens
ggtgggagagctctgtctccag

SEQ ID NO: 7781073 - DNA, 22 bp, Homo sapiens
cagagtcaatgtccaagaagct

SEQ ID NO: 7781074 - DNA, 22 bp, Homo sapiens
cagcaggcggcccgcgggcccg

SEQ ID NO: 7781075 - DNA, 22 bp, Homo sapiens
cagcaggcccaggtgctggtga

SEQ ID NO: 7781076 - DNA, 22 bp, Homo sapiens
gtatttctttccattatagtca

SEQ ID NO: 7781077 - DNA, 22 bp, Homo sapiens
cagcaggcaggtgggccaagtc

SEQ ID NO: 7781078 - DNA, 22 bp, Homo sapiens
cagcaggcaggtgggccaagtc

SEQ ID NO: 7781079 - DNA, 22 bp, Homo sapiens
cagcaggccatgctgcttttca

SEQ ID NO: 7781080 - DNA, 22 bp, Homo sapiens
cagcaggatatggtggagagag

SEQ ID NO: 7781081 - DNA, 22 bp, Homo sapiens
cagcaggatttgaaaggaagag

SEQ ID NO: 7781082 - DNA, 22 bp, Homo sapiens
cagcaggacatggaggagtaaa

SEQ ID NO: 7781083 - DNA, 22 bp, Homo sapiens
cagcaggaccattgaggcatca

SEQ ID NO: 7781084 - DNA, 22 bp, Homo sapiens
cagcagctacctgctcttgtgg

SEQ ID NO: 7781085 - DNA, 22 bp, Homo sapiens
cagcagcctgccttgggagctt

SEQ ID NO: 7781086 - DNA, 22 bp, Homo sapiens
cagcagcctggcccctcctcgg

SEQ ID NO: 7781087 - DNA, 22 bp, Homo sapiens
cagcagcctgccttgggagctt

SEQ ID NO: 7781088 - DNA, 22 bp, Homo sapiens
cagcagcctcttgtgcctgtgg

SEQ ID NO: 7781089 - DNA, 22 bp, Homo sapiens
gtatgaaggcgagagcccacta

SEQ ID NO: 7781090 - DNA, 22 bp, Homo sapiens
cagcagagtatggcactcaact

SEQ ID NO: 7781091 - DNA, 22 bp, Homo sapiens
cagcagagtaattctcacctct

SEQ ID NO: 7781092 - DNA, 22 bp, Homo sapiens
cagcagcaaatctagaagagga

SEQ ID NO: 7781093 - DNA, 22 bp, Homo sapiens
cagcagcaacaatagcggtcac

SEQ ID NO: 7781094 - DNA, 22 bp, Homo sapiens
cagcagcaaggtgagggtggag

SEQ ID NO: 7781095 - DNA, 22 bp, Homo sapiens
cagcagcaaggtgagggtggag

SEQ ID NO: 7781096 - DNA, 22 bp, Homo sapiens
cagcagcaacaacggaagcctt

SEQ ID NO: 7781097 - DNA, 22 bp, Homo sapiens
cagcagcactctgcgggtcccc

SEQ ID NO: 7781098 - DNA, 22 bp, Homo sapiens
cagcagcaaggtgagggtggag

SEQ ID NO: 7781099 - DNA, 22 bp, Homo sapiens
cagcagcagattcagcgtctgg

SEQ ID NO: 7781100 - DNA, 22 bp, Homo sapiens
cagcagcagagatactggtttc

SEQ ID NO: 7781101 - DNA, 20 bp, Homo sapiens
gtatccccgcgtggggaagg

SEQ ID NO: 7781102 - DNA, 22 bp, Homo sapiens
gtatattttgatcaccctctat

SEQ ID NO: 7781103 - DNA, 21 bp, Homo sapiens
gtatcacatttgcatgcttat

SEQ ID NO: 7781104 - DNA, 22 bp, Homo sapiens
gtatcacttttgagagtgagaa

SEQ ID NO: 7781105 - DNA, 19 bp, Homo sapiens
gtatatttatatggctgta

SEQ ID NO: 7781106 - DNA, 19 bp, Homo sapiens
gtatatttatatggctgta

SEQ ID NO: 7781107 - DNA, 22 bp, Homo sapiens
gtatatgtgtgggcctgcatat

SEQ ID NO: 7781108 - DNA, 22 bp, Homo sapiens
ctcagaattaataaccacaagg

SEQ ID NO: 7781109 - DNA, 22 bp, Homo sapiens
ctcagaagttcagcctagagta

SEQ ID NO: 7781110 - DNA, 22 bp, Homo sapiens
ctcagaagaacaaaggctctac

SEQ ID NO: 7781111 - DNA, 22 bp, Homo sapiens
ctcaccatggatcttccatttc

SEQ ID NO: 7781112 - DNA, 22 bp, Homo sapiens
agtcccagatctacaggaggga

SEQ ID NO: 7781113 - DNA, 22 bp, Homo sapiens
agtcccagagaggtcggggcca

SEQ ID NO: 7781114 - DNA, 22 bp, Homo sapiens
ctcagactggggctccctgagt

SEQ ID NO: 7781115 - DNA, 22 bp, Homo sapiens
ctcagactttcagggtaggcca

SEQ ID NO: 7781116 - DNA, 22 bp, Homo sapiens
ctcagactggtgggtaaaacct

SEQ ID NO: 7781117 - DNA, 22 bp, Homo sapiens
ctcagactggagccccaaggac

SEQ ID NO: 7781118 - DNA, 22 bp, Homo sapiens
ctcagacttgctttttatggaa

SEQ ID NO: 7781119 - DNA, 22 bp, Homo sapiens
ctcagactagcctgtaccgaca

SEQ ID NO: 7781120 - DNA, 22 bp, Homo sapiens
ctcagaggtcaagagcagagct

SEQ ID NO: 7781121 - DNA, 22 bp, Homo sapiens
ctcagagggtctcctccagaat

SEQ ID NO: 7781122 - DNA, 22 bp, Homo sapiens
ctcagataatctttgagtcttc

SEQ ID NO: 7781123 - DNA, 23 bp, Homo sapiens
ctcaaccctagtaagggagtagg

SEQ ID NO: 7781124 - DNA, 22 bp, Homo sapiens
ctcaaatatgtggtcagaaagc

SEQ ID NO: 7781125 - DNA, 22 bp, Homo sapiens
ctcaaatatgtggtcagaaagc

SEQ ID NO: 7781126 - DNA, 22 bp, Homo sapiens
ctatttatgtgctattttgtat

SEQ ID NO: 7781127 - DNA, 22 bp, Homo sapiens
ctatttatgtccaagtgtttta

SEQ ID NO: 7781128 - DNA, 22 bp, Homo sapiens
ctcaaactgtgcttgtaaattc

SEQ ID NO: 7781129 - DNA, 22 bp, Homo sapiens
ctcaaatagaactgatctataa

SEQ ID NO: 7781130 - DNA, 22 bp, Homo sapiens
ctcaaatacctctccatgtgac

SEQ ID NO: 7781131 - DNA, 22 bp, Homo sapiens
ctcaaatacctctccatgtgac

SEQ ID NO: 7781132 - DNA, 22 bp, Homo sapiens
ctcaaatagaactgatctataa

SEQ ID NO: 7781133 - DNA, 22 bp, Homo sapiens
ctcaaatagaactgatctataa

SEQ ID NO: 7781134 - DNA, 22 bp, Homo sapiens
ctcaaatataagctaaatgtgg

SEQ ID NO: 7781135 - DNA, 22 bp, Homo sapiens
ctcaaatagaactgatctataa

SEQ ID NO: 7781136 - DNA, 22 bp, Homo sapiens
ctcaaatatgtggtcagaaagc

SEQ ID NO: 7781137 - DNA, 22 bp, Homo sapiens
cggggtgggaatagacctgtct

SEQ ID NO: 7781138 - DNA, 22 bp, Homo sapiens
cggggttcatccatgctgtggc

SEQ ID NO: 7781139 - DNA, 22 bp, Homo sapiens
cgggttcacgccattctcctgc

SEQ ID NO: 7781140 - DNA, 22 bp, Homo sapiens
cgggtcacctatcaattttgtg

SEQ ID NO: 7781141 - DNA, 22 bp, Homo sapiens
cgggtggttttcatcaagatgg

SEQ ID NO: 7781142 - DNA, 22 bp, Homo sapiens
cgggttcacgccattctcctgc

SEQ ID NO: 7781143 - DNA, 22 bp, Homo sapiens
cgggggcacccacaaatgagga

SEQ ID NO: 7781144 - DNA, 22 bp, Homo sapiens
agtgacaaggtggtaatgaagc

SEQ ID NO: 7781145 - DNA, 22 bp, Homo sapiens
agtgacaaggtagttagttgga

SEQ ID NO: 7781146 - DNA, 22 bp, Homo sapiens
agtgacaacaagttgactagaa

SEQ ID NO: 7781147 - DNA, 22 bp, Homo sapiens
agtgacaacaagttgactagaa

SEQ ID NO: 7781148 - DNA, 22 bp, Homo sapiens
ctcagtgttaaatataaggtat

SEQ ID NO: 7781149 - DNA, 22 bp, Homo sapiens
ctcagtgttaaagactttccag

SEQ ID NO: 7781150 - DNA, 22 bp, Homo sapiens
agtgaaattgctgtaagaggaa

SEQ ID NO: 7781151 - DNA, 20 bp, Homo sapiens
ctcagtgtattctgggtgct

SEQ ID NO: 7781152 - DNA, 22 bp, Homo sapiens
ctcagtgtctggggccccaggg

SEQ ID NO: 7781153 - DNA, 22 bp, Homo sapiens
ctcagtgtcacgttttgcctta

SEQ ID NO: 7781154 - DNA, 22 bp, Homo sapiens
ctcagtgtcttattgtacacat

SEQ ID NO: 7781155 - DNA, 22 bp, Homo sapiens
ctcagtgtcttatttgagttct

SEQ ID NO: 7781156 - DNA, 22 bp, Homo sapiens
ctcagtgtgaatgctcagtaaa

SEQ ID NO: 7781157 - DNA, 20 bp, Homo sapiens
ctcagtgtggcctgagtgtt

SEQ ID NO: 7781158 - DNA, 22 bp, Homo sapiens
ctcagtgtgagtgagaagtgca

SEQ ID NO: 7781159 - DNA, 23 bp, Homo sapiens
ctcagtgtgtgacccatggcctc

SEQ ID NO: 7781160 - DNA, 22 bp, Homo sapiens
ctccagagagaaaggaggccgc

SEQ ID NO: 7781161 - DNA, 22 bp, Homo sapiens
agtctccgctctcggagtcggc

SEQ ID NO: 7781162 - DNA, 22 bp, Homo sapiens
ctcagggacttggatcctggcc

SEQ ID NO: 7781163 - DNA, 22 bp, Homo sapiens
ctcagggacgttagaggacagg

SEQ ID NO: 7781164 - DNA, 22 bp, Homo sapiens
ctcagggaggccctgggaccct

SEQ ID NO: 7781165 - DNA, 22 bp, Homo sapiens
ctcagggaggagcttctgggcc

SEQ ID NO: 7781166 - DNA, 22 bp, Homo sapiens
ctcagctctttatactagctgt

SEQ ID NO: 7781167 - DNA, 20 bp, Homo sapiens
ctcagctcttcagggcaagt

SEQ ID NO: 7781168 - DNA, 22 bp, Homo sapiens
agtctcagcaagcatggctagt

SEQ ID NO: 7781169 - DNA, 22 bp, Homo sapiens
agtgctggattacaggcgtgag

SEQ ID NO: 7781170 - DNA, 22 bp, Homo sapiens
agtgctggattacaggcgtgag

SEQ ID NO: 7781171 - DNA, 22 bp, Homo sapiens
agtgctggagggaggcaggttc

SEQ ID NO: 7781172 - DNA, 22 bp, Homo sapiens
agtgctggaaagggacggagga

SEQ ID NO: 7781173 - DNA, 22 bp, Homo sapiens
agtgctggaaagggacggagga

SEQ ID NO: 7781174 - DNA, 22 bp, Homo sapiens
ctccagagagtccagctctggg

SEQ ID NO: 7781175 - DNA, 22 bp, Homo sapiens
agtgctatcgagttctaatgct

SEQ ID NO: 7781176 - DNA, 22 bp, Homo sapiens
ctcctggttcagagagctgaga

SEQ ID NO: 7781177 - DNA, 22 bp, Homo sapiens
ctcctggtgctggggctgccgc

SEQ ID NO: 7781178 - DNA, 22 bp, Homo sapiens
ctcctggtgctggggctgccgc

SEQ ID NO: 7781179 - DNA, 22 bp, Homo sapiens
ctcctgagtagtagcattgtca

SEQ ID NO: 7781180 - DNA, 22 bp, Homo sapiens
ctcctgaggggacaggactcat

SEQ ID NO: 7781181 - DNA, 18 bp, Homo sapiens
ctccttggagaagaggcc

SEQ ID NO: 7781182 - DNA, 23 bp, Homo sapiens
ctccttggtatgccatgcccagc

SEQ ID NO: 7781183 - DNA, 22 bp, Homo sapiens
agtgctgggattgcaggcatga

SEQ ID NO: 7781184 - DNA, 22 bp, Homo sapiens
agtgctgggattacaggcataa

SEQ ID NO: 7781185 - DNA, 22 bp, Homo sapiens
agtgctggcccatagctgctgg

SEQ ID NO: 7781186 - DNA, 22 bp, Homo sapiens
ctctccttgaggcttggacttc

SEQ ID NO: 7781187 - DNA, 22 bp, Homo sapiens
ctctctagaggcccaccttgag

SEQ ID NO: 7781188 - DNA, 22 bp, Homo sapiens
ctctctcagtgtaatacaggat

SEQ ID NO: 7781189 - DNA, 22 bp, Homo sapiens
ctctccccacaccctctgcatg

SEQ ID NO: 7781190 - DNA, 22 bp, Homo sapiens
ctctccccacaccctctgcatg

SEQ ID NO: 7781191 - DNA, 20 bp, Homo sapiens
ctctcccagcacagcttcct

SEQ ID NO: 7781192 - DNA, 20 bp, Homo sapiens
ctctcccagcacagcttcct

SEQ ID NO: 7781193 - DNA, 22 bp, Homo sapiens
ctctcccagtcaggctcaggat

SEQ ID NO: 7781194 - DNA, 22 bp, Homo sapiens
ctctcccagtcaggctcaggat

SEQ ID NO: 7781195 - DNA, 22 bp, Homo sapiens
ctctcccagtcaggctcaggat

SEQ ID NO: 7781196 - DNA, 18 bp, Homo sapiens
agtggtctgttatatcat

SEQ ID NO: 7781197 - DNA, 22 bp, Homo sapiens
agtggttcttgatctgtagagt

SEQ ID NO: 7781198 - DNA, 22 bp, Homo sapiens
agtggttcagttttggtctggc

SEQ ID NO: 7781199 - DNA, 22 bp, Homo sapiens
agtggtgtcgtgggagtggaag

SEQ ID NO: 7781200 - DNA, 22 bp, Homo sapiens
agtggtgatgacagcagtttct

SEQ ID NO: 7781201 - DNA, 22 bp, Homo sapiens
agtggtgatgtctctattattg

SEQ ID NO: 7781202 - DNA, 22 bp, Homo sapiens
agtggtgataaccgctatcata

SEQ ID NO: 7781203 - DNA, 22 bp, Homo sapiens
agtggtgaggggcatgtgtgat

SEQ ID NO: 7781204 - DNA, 22 bp, Homo sapiens
agtggtgagacctggtgctttc

SEQ ID NO: 7781205 - DNA, 22 bp, Homo sapiens
agtggtgctgcgcgcggagctc

SEQ ID NO: 7781206 - DNA, 19 bp, Homo sapiens
ctcttgggtggcagaggcc

SEQ ID NO: 7781207 - DNA, 22 bp, Homo sapiens
ctcttggtaagacattagaggt

SEQ ID NO: 7781208 - DNA, 22 bp, Homo sapiens
ctcttgtattggagttagtggg

SEQ ID NO: 7781209 - DNA, 16 bp, Homo sapiens
ctctttggcttccaag

SEQ ID NO: 7781210 - DNA, 22 bp, Homo sapiens
ctctttggctttgactcccatt

SEQ ID NO: 7781211 - DNA, 22 bp, Homo sapiens
ctctttggctttgactcccatt

SEQ ID NO: 7781212 - DNA, 16 bp, Homo sapiens
ctctttggcttccaag

SEQ ID NO: 7781213 - DNA, 22 bp, Homo sapiens
ctctttggcgttggcagagcca

SEQ ID NO: 7781214 - DNA, 22 bp, Homo sapiens
ctctttggcgttggcagagcca

SEQ ID NO: 7781215 - DNA, 22 bp, Homo sapiens
ctcttggccagacacagaggca

SEQ ID NO: 7781216 - DNA, 22 bp, Homo sapiens
ctcttgcatgagatccaggagt

SEQ ID NO: 7781217 - DNA, 22 bp, Homo sapiens
ctcttgcatctgttgtattggt

SEQ ID NO: 7781218 - DNA, 22 bp, Homo sapiens
agtgggagagaagcaagtagta

SEQ ID NO: 7781219 - DNA, 22 bp, Homo sapiens
agtgggagaatgaataagggcc

SEQ ID NO: 7781220 - DNA, 22 bp, Homo sapiens
ctctgtcaggctgcagatgctc

SEQ ID NO: 7781221 - DNA, 22 bp, Homo sapiens
agtggcttatctgggacagcta

SEQ ID NO: 7781222 - DNA, 22 bp, Homo sapiens
agtggctgttccaggtgaggac

SEQ ID NO: 7781223 - DNA, 22 bp, Homo sapiens
ctctgctgcaggaaggcgtgca

SEQ ID NO: 7781224 - DNA, 19 bp, Homo sapiens
ctctggagaacaatagtgc

SEQ ID NO: 7781225 - DNA, 22 bp, Homo sapiens
ctctggagaacgctatggatct

SEQ ID NO: 7781226 - DNA, 22 bp, Homo sapiens
ccttgctcaagctagtgacggg

SEQ ID NO: 7781227 - DNA, 22 bp, Homo sapiens
ccttggctgaggagggagctga

SEQ ID NO: 7781228 - DNA, 22 bp, Homo sapiens
ccttggctaggcagcggctgtc

SEQ ID NO: 7781229 - DNA, 22 bp, Homo sapiens
ccttggccctagcctcaggcaa

SEQ ID NO: 7781230 - DNA, 22 bp, Homo sapiens
ccttggcaaaccagggcagctg

SEQ ID NO: 7781231 - DNA, 22 bp, Homo sapiens
ccttggcaagacagtggagggt

SEQ ID NO: 7781232 - DNA, 22 bp, Homo sapiens
aggtgggaacccagcagggccc

SEQ ID NO: 7781233 - DNA, 21 bp, Homo sapiens
aggtgggagaccatgtaggtc

SEQ ID NO: 7781234 - DNA, 22 bp, Homo sapiens
aggtggctggtccaggctgcag

SEQ ID NO: 7781235 - DNA, 22 bp, Homo sapiens
aggtggctgaagagtgggtgag

SEQ ID NO: 7781236 - DNA, 21 bp, Homo sapiens
aggtggctgcatcctcagaag

SEQ ID NO: 7781237 - DNA, 22 bp, Homo sapiens
aggtgctgaactggtgaggtct

SEQ ID NO: 7781238 - DNA, 22 bp, Homo sapiens
aggtgctgaactggtgaggtct

SEQ ID NO: 7781239 - DNA, 22 bp, Homo sapiens
aggtgctggagtctgggcagga

SEQ ID NO: 7781240 - DNA, 22 bp, Homo sapiens
aggtgctggagtctgggcagga

SEQ ID NO: 7781241 - DNA, 22 bp, Homo sapiens
aggtgctggcgccccaggagac

SEQ ID NO: 7781242 - DNA, 22 bp, Homo sapiens
aggtgctgttggcagcgggcag

SEQ ID NO: 7781243 - DNA, 22 bp, Homo sapiens
aggtgctgtttgtcagcagttt

SEQ ID NO: 7781244 - DNA, 22 bp, Homo sapiens
aggtgcaggagctgtgcaggga

SEQ ID NO: 7781245 - DNA, 22 bp, Homo sapiens
aggtgccagctctcaggcagga

SEQ ID NO: 7781246 - DNA, 22 bp, Homo sapiens
aggtgccagctctcaggcagga

SEQ ID NO: 7781247 - DNA, 17 bp, Homo sapiens
aggtgccagtgatatac

SEQ ID NO: 7781248 - DNA, 22 bp, Homo sapiens
aggtgccttccgcggagctcgc

SEQ ID NO: 7781249 - DNA, 22 bp, Homo sapiens
cctgggagaactgctgggttgg

SEQ ID NO: 7781250 - DNA, 22 bp, Homo sapiens
cctgggagaactgctgggttgg

SEQ ID NO: 7781251 - DNA, 19 bp, Homo sapiens
cctgggacttaggctgggt

SEQ ID NO: 7781252 - DNA, 22 bp, Homo sapiens
cctgggacctcgcgggaagcgg

SEQ ID NO: 7781253 - DNA, 22 bp, Homo sapiens
aggtgggggctgtgtccttgac

SEQ ID NO: 7781254 - DNA, 22 bp, Homo sapiens
aggtgggggctgtgtccttgac

SEQ ID NO: 7781255 - DNA, 22 bp, Homo sapiens
cgagcatgatgacggctgtggc

SEQ ID NO: 7781256 - DNA, 22 bp, Homo sapiens
cgaggaagaagtttgagtcaag

SEQ ID NO: 7781257 - DNA, 22 bp, Homo sapiens
cgaggaggaaacgcggagaact

SEQ ID NO: 7781258 - DNA, 22 bp, Homo sapiens
cggagctgcgccgggacacggg

SEQ ID NO: 7781259 - DNA, 22 bp, Homo sapiens
cggccaagccggggccccgaag

SEQ ID NO: 7781260 - DNA, 22 bp, Homo sapiens
cggctcactgcagctccgcctc

SEQ ID NO: 7781261 - DNA, 22 bp, Homo sapiens
cggccgcagcagtgtcggccca

SEQ ID NO: 7781262 - DNA, 22 bp, Homo sapiens
agtatattggtgttattcctca

SEQ ID NO: 7781263 - DNA, 22 bp, Homo sapiens
agtagtcacttctattaatggc

SEQ ID NO: 7781264 - DNA, 22 bp, Homo sapiens
agtagtcagcagataatatagg

SEQ ID NO: 7781265 - DNA, 22 bp, Homo sapiens
agtagtcacttctattaatggc

SEQ ID NO: 7781266 - DNA, 22 bp, Homo sapiens
agtatatatgaggaaccacaaa

SEQ ID NO: 7781267 - DNA, 22 bp, Homo sapiens
cctggcagcccagagcgccgct

SEQ ID NO: 7781268 - DNA, 22 bp, Homo sapiens
cctggcagcccagagcgccgct

SEQ ID NO: 7781269 - DNA, 22 bp, Homo sapiens
cctggcagcgccgaagctggcc

SEQ ID NO: 7781270 - DNA, 22 bp, Homo sapiens
cctggcagcgtgccgagctgcg

SEQ ID NO: 7781271 - DNA, 22 bp, Homo sapiens
cctggaagagctgaatcaggca

SEQ ID NO: 7781272 - DNA, 22 bp, Homo sapiens
cctggaaggacaatagatagtg

SEQ ID NO: 7781273 - DNA, 19 bp, Homo sapiens
cctgctgaagtgatgcagc

SEQ ID NO: 7781274 - DNA, 22 bp, Homo sapiens
cctgctgagaccctgaggtggg

SEQ ID NO: 7781275 - DNA, 22 bp, Homo sapiens
cctgcctggcttccagaagaga

SEQ ID NO: 7781276 - DNA, 22 bp, Homo sapiens
cctgctctggtttagtcagtct

SEQ ID NO: 7781277 - DNA, 22 bp, Homo sapiens
cctgctctgccaagtcctcttt

SEQ ID NO: 7781278 - DNA, 22 bp, Homo sapiens
cctggcagctcctccccggcgg

SEQ ID NO: 7781279 - DNA, 22 bp, Homo sapiens
cctggcagctccgtggccttcc

SEQ ID NO: 7781280 - DNA, 22 bp, Homo sapiens
cctggcagctccgtggccttcc

SEQ ID NO: 7781281 - DNA, 22 bp, Homo sapiens
cctggcagctgtttggcttggc

SEQ ID NO: 7781282 - DNA, 21 bp, Homo sapiens
cctggccaatctgatagggtt

SEQ ID NO: 7781283 - DNA, 22 bp, Homo sapiens
cctggccacccagccttggcca

SEQ ID NO: 7781284 - DNA, 19 bp, Homo sapiens
cctggccagacttctgccc

SEQ ID NO: 7781285 - DNA, 22 bp, Homo sapiens
cctggccacagggctctgcatt

SEQ ID NO: 7781286 - DNA, 20 bp, Homo sapiens
cctggccaatgagataggaa

SEQ ID NO: 7781287 - DNA, 22 bp, Homo sapiens
cctggctggtggcagcgacaag

SEQ ID NO: 7781288 - DNA, 22 bp, Homo sapiens
cctggctggttgtctgattcta

SEQ ID NO: 7781289 - DNA, 22 bp, Homo sapiens
cctgggaagtcagccaaggacg

SEQ ID NO: 7781290 - DNA, 20 bp, Homo sapiens
cctggctggtggaggaaagg

SEQ ID NO: 7781291 - DNA, 22 bp, Homo sapiens
cctggctgggcctgatttctca

SEQ ID NO: 7781292 - DNA, 17 bp, Homo sapiens
cctggctgggaatctga

SEQ ID NO: 7781293 - DNA, 23 bp, Homo sapiens
cctggctggattctctgcattca

SEQ ID NO: 7781294 - DNA, 23 bp, Homo sapiens
cctggctggattctctgcattca

SEQ ID NO: 7781295 - DNA, 19 bp, Homo sapiens
cctggctgctgtgggatgc

SEQ ID NO: 7781296 - DNA, 19 bp, Homo sapiens
cctggctgctgtgggatgc

SEQ ID NO: 7781297 - DNA, 22 bp, Homo sapiens
cctggccagaggcgtgcctgtg

SEQ ID NO: 7781298 - DNA, 22 bp, Homo sapiens
cctggctgctttcactatggag

SEQ ID NO: 7781299 - DNA, 19 bp, Homo sapiens
cctctgccagcccgcctct

SEQ ID NO: 7781300 - DNA, 19 bp, Homo sapiens
cctctgccagcccgcctct

SEQ ID NO: 7781301 - DNA, 22 bp, Homo sapiens
cctgccaggacattgcttgaag

SEQ ID NO: 7781302 - DNA, 22 bp, Homo sapiens
cctgccaggacattgcttgaag

SEQ ID NO: 7781303 - DNA, 22 bp, Homo sapiens
cctgcccccgtcagaggtgatg

SEQ ID NO: 7781304 - DNA, 22 bp, Homo sapiens
cctgccctatgaccagcttcac

SEQ ID NO: 7781305 - DNA, 22 bp, Homo sapiens
cctctctccttcctttgccaaa

SEQ ID NO: 7781306 - DNA, 22 bp, Homo sapiens
cctctgcaaagaatttgtctcc

SEQ ID NO: 7781307 - DNA, 22 bp, Homo sapiens
cctctgcatctggctgctgcag

SEQ ID NO: 7781308 - DNA, 22 bp, Homo sapiens
cctctgccacctcccacgaggc

SEQ ID NO: 7781309 - DNA, 22 bp, Homo sapiens
cctctgccacctcccacgaggc

SEQ ID NO: 7781310 - DNA, 22 bp, Homo sapiens
cctctgcatgtgcagtaccgag

SEQ ID NO: 7781311 - DNA, 22 bp, Homo sapiens
cctctgcagcagagagccagag

SEQ ID NO: 7781312 - DNA, 22 bp, Homo sapiens
cctctgcacttcaccttagctc

SEQ ID NO: 7781313 - DNA, 22 bp, Homo sapiens
cctctgcaccatagccttcagc

SEQ ID NO: 7781314 - DNA, 22 bp, Homo sapiens
agggtctctgggagtagggcac

SEQ ID NO: 7781315 - DNA, 22 bp, Homo sapiens
agggtctctggagagctgagga

SEQ ID NO: 7781316 - DNA, 22 bp, Homo sapiens
agggtgaatctcacaactctta

SEQ ID NO: 7781317 - DNA, 22 bp, Homo sapiens
agggtctgtatttctggcaagc

SEQ ID NO: 7781318 - DNA, 22 bp, Homo sapiens
agggtctatctctctgcctttg

SEQ ID NO: 7781319 - DNA, 20 bp, Homo sapiens
agggtcagagagcgtgagtg

SEQ ID NO: 7781320 - DNA, 22 bp, Homo sapiens
ctgagggtcaacttgattgtat

SEQ ID NO: 7781321 - DNA, 22 bp, Homo sapiens
ctgaggctttgtgtgcatgcct

SEQ ID NO: 7781322 - DNA, 22 bp, Homo sapiens
ctgaggcttgtcctctcagctt

SEQ ID NO: 7781323 - DNA, 22 bp, Homo sapiens
agttgtcacctctattcaaatc

SEQ ID NO: 7781324 - DNA, 22 bp, Homo sapiens
ctgaggcttggaggggtctggt

SEQ ID NO: 7781325 - DNA, 22 bp, Homo sapiens
ctgaggcttgtcctctcagctt

SEQ ID NO: 7781326 - DNA, 22 bp, Homo sapiens
ctgaggcttgtcctctcagctt

SEQ ID NO: 7781327 - DNA, 22 bp, Homo sapiens
ctgaggcttctctagttcagct

SEQ ID NO: 7781328 - DNA, 22 bp, Homo sapiens
ctgaggctgggctgagggtata

SEQ ID NO: 7781329 - DNA, 22 bp, Homo sapiens
ctgaggctgggcttgccttctt

SEQ ID NO: 7781330 - DNA, 22 bp, Homo sapiens
agttggagtgaacatgagattg

SEQ ID NO: 7781331 - DNA, 22 bp, Homo sapiens
agttggagtgaacatgagattg

SEQ ID NO: 7781332 - DNA, 22 bp, Homo sapiens
ctctttggtcgcatcatccatt

SEQ ID NO: 7781333 - DNA, 22 bp, Homo sapiens
ctctttggggtgccccactggt

SEQ ID NO: 7781334 - DNA, 22 bp, Homo sapiens
ctctttggggctggaagcctag

SEQ ID NO: 7781335 - DNA, 22 bp, Homo sapiens
ctctttggggtgccccactggt

SEQ ID NO: 7781336 - DNA, 22 bp, Homo sapiens
ctctttgggatgggctctgctg

SEQ ID NO: 7781337 - DNA, 16 bp, Homo sapiens
ctctttgggcttccag

SEQ ID NO: 7781338 - DNA, 22 bp, Homo sapiens
ctctttggggctggaagcctag

SEQ ID NO: 7781339 - DNA, 16 bp, Homo sapiens
ctctttgggcttccag

SEQ ID NO: 7781340 - DNA, 22 bp, Homo sapiens
ctctttgggatgggctctgctg

SEQ ID NO: 7781341 - DNA, 21 bp, Homo sapiens
ctctttgggatctttggaaag

SEQ ID NO: 7781342 - DNA, 21 bp, Homo sapiens
ctctttgggatctttggaaag

SEQ ID NO: 7781343 - DNA, 21 bp, Homo sapiens
ctctttgggatctttggaaag

SEQ ID NO: 7781344 - DNA, 22 bp, Homo sapiens
ctctttggtcgcatcatccatt

SEQ ID NO: 7781345 - DNA, 22 bp, Homo sapiens
ctctttggtgcaccttgcagtc

SEQ ID NO: 7781346 - DNA, 22 bp, Homo sapiens
ctctttggtgcaccttgcagtc

SEQ ID NO: 7781347 - DNA, 22 bp, Homo sapiens
agttctttctagacacgtagac

SEQ ID NO: 7781348 - DNA, 22 bp, Homo sapiens
agttgtaagaggcacaaggaag

SEQ ID NO: 7781349 - DNA, 22 bp, Homo sapiens
agttgtaataacaataccaaaa

SEQ ID NO: 7781350 - DNA, 22 bp, Homo sapiens
agttgtaagagacagatataaa

SEQ ID NO: 7781351 - DNA, 22 bp, Homo sapiens
agttggtgggtgtgagctggac

SEQ ID NO: 7781352 - DNA, 22 bp, Homo sapiens
agttggtgagcgtgtggtaatc

SEQ ID NO: 7781353 - DNA, 22 bp, Homo sapiens
agttgtcagtcaaagacatttg

SEQ ID NO: 7781354 - DNA, 22 bp, Homo sapiens
agttgtcagtcaaagacatttg

SEQ ID NO: 7781355 - DNA, 22 bp, Homo sapiens
agtttaactttggaaaactata

SEQ ID NO: 7781356 - DNA, 22 bp, Homo sapiens
agtttaattggaggcgtggctc

SEQ ID NO: 7781357 - DNA, 22 bp, Homo sapiens
agtttaatcctccagcccaact

SEQ ID NO: 7781358 - DNA, 22 bp, Homo sapiens
agtttaatatccttcaactttc

SEQ ID NO: 7781359 - DNA, 22 bp, Homo sapiens
ctgcagctatattttcccacag

SEQ ID NO: 7781360 - DNA, 22 bp, Homo sapiens
ctgcagctatattttcccacag

SEQ ID NO: 7781361 - DNA, 22 bp, Homo sapiens
ctgcagctcctctctgtgcccc

SEQ ID NO: 7781362 - DNA, 22 bp, Homo sapiens
ctgcagctcccctgagatcaag

SEQ ID NO: 7781363 - DNA, 22 bp, Homo sapiens
ctgcagctccttctggcatgtg

SEQ ID NO: 7781364 - DNA, 22 bp, Homo sapiens
ctgcagctctagcttttgacct

SEQ ID NO: 7781365 - DNA, 22 bp, Homo sapiens
ctgcagctcctgagctcagaga

SEQ ID NO: 7781366 - DNA, 22 bp, Homo sapiens
ctgcagctcctgagctcagaga

SEQ ID NO: 7781367 - DNA, 22 bp, Homo sapiens
ctgcagctaaggaatgtggttg

SEQ ID NO: 7781368 - DNA, 22 bp, Homo sapiens
agtttgcagattatattagtgt

SEQ ID NO: 7781369 - DNA, 22 bp, Homo sapiens
ctgcagctggctcatgggatat

SEQ ID NO: 7781370 - DNA, 22 bp, Homo sapiens
ctgcagctggagcatcttctca

SEQ ID NO: 7781371 - DNA, 17 bp, Homo sapiens
ctgcagctggagggcca

SEQ ID NO: 7781372 - DNA, 22 bp, Homo sapiens
ctgcagctgcgggaccggagcg

SEQ ID NO: 7781373 - DNA, 22 bp, Homo sapiens
ctgcagctgctcatgttacttg

SEQ ID NO: 7781374 - DNA, 22 bp, Homo sapiens
ctgcagctgccagtgatttcag

SEQ ID NO: 7781375 - DNA, 19 bp, Homo sapiens
ctgcagctgcaccatccca

SEQ ID NO: 7781376 - DNA, 22 bp, Homo sapiens
ctgcagctgcagttctgagaga

SEQ ID NO: 7781377 - DNA, 22 bp, Homo sapiens
ctgcagctgcagttctgagaga

SEQ ID NO: 7781378 - DNA, 22 bp, Homo sapiens
ctgccaggcactgggctctgca

SEQ ID NO: 7781379 - DNA, 22 bp, Homo sapiens
ctgccaggcacgtgcagcatca

SEQ ID NO: 7781380 - DNA, 22 bp, Homo sapiens
ctgccaggattctgtgaacccc

SEQ ID NO: 7781381 - DNA, 21 bp, Homo sapiens
ctgccaggatagcatgcaggc

SEQ ID NO: 7781382 - DNA, 22 bp, Homo sapiens
ctgccaggactgacgtcttcag

SEQ ID NO: 7781383 - DNA, 22 bp, Homo sapiens
ctgccaaaaggtgcacctgctg

SEQ ID NO: 7781384 - DNA, 22 bp, Homo sapiens
ctgccaaaaggtgcacctgctg

SEQ ID NO: 7781385 - DNA, 22 bp, Homo sapiens
ctgccaggcagcagagggagaa

SEQ ID NO: 7781386 - DNA, 22 bp, Homo sapiens
ctgccaggcagggagatggctg

SEQ ID NO: 7781387 - DNA, 22 bp, Homo sapiens
ataaaagtaggaccaacttaca

SEQ ID NO: 7781388 - DNA, 17 bp, Homo sapiens
ataaaggcaagtattat

SEQ ID NO: 7781389 - DNA, 19 bp, Homo sapiens
ataaataaaaagtgggaga

SEQ ID NO: 7781390 - DNA, 22 bp, Homo sapiens
ataaatagtgtgtcataaagtc

SEQ ID NO: 7781391 - DNA, 22 bp, Homo sapiens
ataaatagtgtgtcataaagtc

SEQ ID NO: 7781392 - DNA, 22 bp, Homo sapiens
ataaatagtgtgtcataaagtc

SEQ ID NO: 7781393 - DNA, 22 bp, Homo sapiens
ataaatatcactgttgtccctc

SEQ ID NO: 7781394 - DNA, 20 bp, Homo sapiens
ataaaataactgccacaaga

SEQ ID NO: 7781395 - DNA, 22 bp, Homo sapiens
ataaaagttcaagagagtacag

SEQ ID NO: 7781396 - DNA, 22 bp, Homo sapiens
ataaaagtttccaatcatgcct

SEQ ID NO: 7781397 - DNA, 20 bp, Homo sapiens
ctgctctgctttgcaggtgg

SEQ ID NO: 7781398 - DNA, 22 bp, Homo sapiens
ctgctctgctgatcagtgtctc

SEQ ID NO: 7781399 - DNA, 22 bp, Homo sapiens
ctgctctggggaagccagatgt

SEQ ID NO: 7781400 - DNA, 22 bp, Homo sapiens
ataatacatggttaacctcttt

SEQ ID NO: 7781401 - DNA, 22 bp, Homo sapiens
ataatacatggttaacctcttt

SEQ ID NO: 7781402 - DNA, 22 bp, Homo sapiens
ataaatctattggacatgtgtg

SEQ ID NO: 7781403 - DNA, 22 bp, Homo sapiens
ctgcccacttggccaccttcta

SEQ ID NO: 7781404 - DNA, 22 bp, Homo sapiens
ctgcccagaatcactcactcga

SEQ ID NO: 7781405 - DNA, 22 bp, Homo sapiens
ctgcccagaatcactcactcga

SEQ ID NO: 7781406 - DNA, 22 bp, Homo sapiens
ataatcaaagtcctatgacatc

SEQ ID NO: 7781407 - DNA, 22 bp, Homo sapiens
ctgctgtgtgaccatggacagg

SEQ ID NO: 7781408 - DNA, 22 bp, Homo sapiens
ataatcagaattcatgaaagat

SEQ ID NO: 7781409 - DNA, 22 bp, Homo sapiens
ataatatttgcattactgtgat

SEQ ID NO: 7781410 - DNA, 22 bp, Homo sapiens
ctgctgtgtgcttacttgggtt

SEQ ID NO: 7781411 - DNA, 22 bp, Homo sapiens
ctgcttggagtcctccagcacc

SEQ ID NO: 7781412 - DNA, 20 bp, Homo sapiens
atacaagatgagtaatttct

SEQ ID NO: 7781413 - DNA, 22 bp, Homo sapiens
atacaaggtcatgaaggtttac

SEQ ID NO: 7781414 - DNA, 22 bp, Homo sapiens
atacaaggtggagtcaggaaaa

SEQ ID NO: 7781415 - DNA, 22 bp, Homo sapiens
atacaagtgagaaaactgaaga

SEQ ID NO: 7781416 - DNA, 22 bp, Homo sapiens
ctggagggaggaggctgctatt

SEQ ID NO: 7781417 - DNA, 22 bp, Homo sapiens
ctggagggagattcaaaggagg

SEQ ID NO: 7781418 - DNA, 22 bp, Homo sapiens
ctggagggagattcaaaggagg

SEQ ID NO: 7781419 - DNA, 22 bp, Homo sapiens
ctggaggaaaacaactgcagac

SEQ ID NO: 7781420 - DNA, 22 bp, Homo sapiens
ctggagggagttaggacccgga

SEQ ID NO: 7781421 - DNA, 22 bp, Homo sapiens
ctggagggaggaggctgctatt

SEQ ID NO: 7781422 - DNA, 22 bp, Homo sapiens
ctggagggatgtagggtgtatt

SEQ ID NO: 7781423 - DNA, 22 bp, Homo sapiens
ctggagggatgtagggtgtatt

SEQ ID NO: 7781424 - DNA, 22 bp, Homo sapiens
atacagaattcactacagtttc

SEQ ID NO: 7781425 - DNA, 22 bp, Homo sapiens
ctggagccccagacagggagag

SEQ ID NO: 7781426 - DNA, 22 bp, Homo sapiens
ctggagccccagacagggagag

SEQ ID NO: 7781427 - DNA, 22 bp, Homo sapiens
atacagaagttttccacttatt

SEQ ID NO: 7781428 - DNA, 22 bp, Homo sapiens
ctggagcccaggcctggtgtct

SEQ ID NO: 7781429 - DNA, 22 bp, Homo sapiens
atacaagttaatgagaatgaca

SEQ ID NO: 7781430 - DNA, 22 bp, Homo sapiens
atacaagttaatgagaatgaca

SEQ ID NO: 7781431 - DNA, 22 bp, Homo sapiens
ctggagcattttctgcttctgc

SEQ ID NO: 7781432 - DNA, 22 bp, Homo sapiens
ctggagccactgggtcttgtat

SEQ ID NO: 7781433 - DNA, 22 bp, Homo sapiens
ctggagggctgcagcgaggctg

SEQ ID NO: 7781434 - DNA, 22 bp, Homo sapiens
ctggagggctgcagcgaggctg

SEQ ID NO: 7781435 - DNA, 21 bp, Homo sapiens
ctggagtctgggggtggcagt

SEQ ID NO: 7781436 - DNA, 21 bp, Homo sapiens
ctggagtctgggggtggcagt

SEQ ID NO: 7781437 - DNA, 22 bp, Homo sapiens
ctggagtcttcagcttgctgcc

SEQ ID NO: 7781438 - DNA, 22 bp, Homo sapiens
ctggagtgaagtctggcagctt

SEQ ID NO: 7781439 - DNA, 22 bp, Homo sapiens
ctggagtgaggtctgggagcct

SEQ ID NO: 7781440 - DNA, 22 bp, Homo sapiens
ctggagtgcaatgaacaaggtc

SEQ ID NO: 7781441 - DNA, 22 bp, Homo sapiens
atactcaatttgttggaaagca

SEQ ID NO: 7781442 - DNA, 22 bp, Homo sapiens
atactttagagctagattgcct

SEQ ID NO: 7781443 - DNA, 22 bp, Homo sapiens
atactttagagctagattgcct

SEQ ID NO: 7781444 - DNA, 22 bp, Homo sapiens
atacttctttaagagtaagtct

SEQ ID NO: 7781445 - DNA, 22 bp, Homo sapiens
atacttctttagcatattgaac

SEQ ID NO: 7781446 - DNA, 22 bp, Homo sapiens
atacttctagaaatactatgca

SEQ ID NO: 7781447 - DNA, 22 bp, Homo sapiens
atactttagagctagattgcct

SEQ ID NO: 7781448 - DNA, 19 bp, Homo sapiens
ctggcagcctgtctgtgtc

SEQ ID NO: 7781449 - DNA, 22 bp, Homo sapiens
ctggcagcggtttgcagcctgg

SEQ ID NO: 7781450 - DNA, 22 bp, Homo sapiens
ctggcagctctactcagagcct

SEQ ID NO: 7781451 - DNA, 22 bp, Homo sapiens
ctggcagcgtgagcagcatcca

SEQ ID NO: 7781452 - DNA, 22 bp, Homo sapiens
ctggcagctctactcagagcct

SEQ ID NO: 7781453 - DNA, 22 bp, Homo sapiens
atatgcttacactacaagatga

SEQ ID NO: 7781454 - DNA, 22 bp, Homo sapiens
ctgggcagtggtggcatctttg

SEQ ID NO: 7781455 - DNA, 22 bp, Homo sapiens
atatgattgtccttagcaaatt

SEQ ID NO: 7781456 - DNA, 22 bp, Homo sapiens
ctgggcaggatacttcatggga

SEQ ID NO: 7781457 - DNA, 22 bp, Homo sapiens
atatgacagcggattcacatat

SEQ ID NO: 7781458 - DNA, 22 bp, Homo sapiens
atatgacagaatgtgtgtgtat

SEQ ID NO: 7781459 - DNA, 22 bp, Homo sapiens
atatgattccactattgtatgg

SEQ ID NO: 7781460 - DNA, 22 bp, Homo sapiens
atatatattgcccaggctggtt

SEQ ID NO: 7781461 - DNA, 22 bp, Homo sapiens
atatatattgcccaggctggtt

SEQ ID NO: 7781462 - DNA, 22 bp, Homo sapiens
atatatatgctgatggctgcca

SEQ ID NO: 7781463 - DNA, 22 bp, Homo sapiens
atatgtgtgccatttcagcagt

SEQ ID NO: 7781464 - DNA, 20 bp, Homo sapiens
atatgtgtacgtgtatacat

SEQ ID NO: 7781465 - DNA, 22 bp, Homo sapiens
atatgggggggcgtgcagagga

SEQ ID NO: 7781466 - DNA, 22 bp, Homo sapiens
atatgggggggcgtgcagagga

SEQ ID NO: 7781467 - DNA, 22 bp, Homo sapiens
atatgtatgtacgcacatattc

SEQ ID NO: 7781468 - DNA, 22 bp, Homo sapiens
atatgtttcagtattcaagtca

SEQ ID NO: 7781469 - DNA, 22 bp, Homo sapiens
atatgttttgtgcttcattggt

SEQ ID NO: 7781470 - DNA, 22 bp, Homo sapiens
atatttctctcagacatggaag

SEQ ID NO: 7781471 - DNA, 22 bp, Homo sapiens
atatttcttgagcacctggtat

SEQ ID NO: 7781472 - DNA, 22 bp, Homo sapiens
atatttgcaggaaactagtttt

SEQ ID NO: 7781473 - DNA, 22 bp, Homo sapiens
ctgggacacccaaggaaagagc

SEQ ID NO: 7781474 - DNA, 22 bp, Homo sapiens
atataacatacatacagaaaag

SEQ ID NO: 7781475 - DNA, 22 bp, Homo sapiens
atataacatacatacagaaaag

SEQ ID NO: 7781476 - DNA, 22 bp, Homo sapiens
atataagtgtgtggctgttagt

SEQ ID NO: 7781477 - DNA, 20 bp, Homo sapiens
atataataaattttggttac

SEQ ID NO: 7781478 - DNA, 20 bp, Homo sapiens
atataataaattttggttac

SEQ ID NO: 7781479 - DNA, 22 bp, Homo sapiens
atataacatacatacagaaaag

SEQ ID NO: 7781480 - DNA, 22 bp, Homo sapiens
atataactcttgttcttatagt

SEQ ID NO: 7781481 - DNA, 22 bp, Homo sapiens
atataatacaacctgctaagtg

SEQ ID NO: 7781482 - DNA, 22 bp, Homo sapiens
atatacttttcactaatggcta

SEQ ID NO: 7781483 - DNA, 22 bp, Homo sapiens
atataatacaacctgctaagtg

SEQ ID NO: 7781484 - DNA, 22 bp, Homo sapiens
atatataagctgatgagccaca

SEQ ID NO: 7781485 - DNA, 22 bp, Homo sapiens
ctgggaagcttcgagcaggaaa

SEQ ID NO: 7781486 - DNA, 22 bp, Homo sapiens
ctgggaagtagaatcagatgag

SEQ ID NO: 7781487 - DNA, 22 bp, Homo sapiens
ctggcagctgcccgagatgccc

SEQ ID NO: 7781488 - DNA, 22 bp, Homo sapiens
ctggcagcttagcactctggtt

SEQ ID NO: 7781489 - DNA, 22 bp, Homo sapiens
ctgggcacagaccccctgggcc

SEQ ID NO: 7781490 - DNA, 22 bp, Homo sapiens
ctgggcacaagtggccctggat

SEQ ID NO: 7781491 - DNA, 22 bp, Homo sapiens
ctgggagtactgggggatgtca

SEQ ID NO: 7781492 - DNA, 22 bp, Homo sapiens
atatatatcgagttcatgtctc

SEQ ID NO: 7781493 - DNA, 22 bp, Homo sapiens
ctgggagaggaacctcgagggt

SEQ ID NO: 7781494 - DNA, 22 bp, Homo sapiens
ctgggagagcctttcctgagtc

SEQ ID NO: 7781495 - DNA, 22 bp, Homo sapiens
ctgggagagaagcgaagctggg

SEQ ID NO: 7781496 - DNA, 22 bp, Homo sapiens
ctgggagacaagagagggctga

SEQ ID NO: 7781497 - DNA, 22 bp, Homo sapiens
atatatatcgagttcatgtctc

SEQ ID NO: 7781498 - DNA, 22 bp, Homo sapiens
atatatagagctagatgttaaa

SEQ ID NO: 7781499 - DNA, 22 bp, Homo sapiens
atatatacaactagattaaaag

SEQ ID NO: 7781500 - DNA, 22 bp, Homo sapiens
atctacaatgtctggctgcact

SEQ ID NO: 7781501 - DNA, 22 bp, Homo sapiens
atctacaacgggtggagtaggg

SEQ ID NO: 7781502 - DNA, 22 bp, Homo sapiens
atctacaacccctcaaactgtg

SEQ ID NO: 7781503 - DNA, 22 bp, Homo sapiens
atctacaaaaactgtctcagga

SEQ ID NO: 7781504 - DNA, 22 bp, Homo sapiens
atcctcagtgtttctgacatct

SEQ ID NO: 7781505 - DNA, 22 bp, Homo sapiens
atccctggacggcgcctcccca

SEQ ID NO: 7781506 - DNA, 22 bp, Homo sapiens
atcctaaagaaatatttattaa

SEQ ID NO: 7781507 - DNA, 22 bp, Homo sapiens
atcctaaaattgttcaatttct

SEQ ID NO: 7781508 - DNA, 22 bp, Homo sapiens
atccccctcttggatggcggca

SEQ ID NO: 7781509 - DNA, 22 bp, Homo sapiens
atccccctgtatctggaagaat

SEQ ID NO: 7781510 - DNA, 22 bp, Homo sapiens
atccccttcacaccctctgcat

SEQ ID NO: 7781511 - DNA, 22 bp, Homo sapiens
atccctctctgcatgactgtgt

SEQ ID NO: 7781512 - DNA, 17 bp, Homo sapiens
atccccagcatctagaa

SEQ ID NO: 7781513 - DNA, 22 bp, Homo sapiens
atcattctagtccttatggtct

SEQ ID NO: 7781514 - DNA, 22 bp, Homo sapiens
atcattctagctgttgtgttga

SEQ ID NO: 7781515 - DNA, 22 bp, Homo sapiens
ctgtggagtggggagtactggt

SEQ ID NO: 7781516 - DNA, 22 bp, Homo sapiens
ctgtggagtgcttggctcagtg

SEQ ID NO: 7781517 - DNA, 22 bp, Homo sapiens
ctgtggagtgcttggctcagtg

SEQ ID NO: 7781518 - DNA, 22 bp, Homo sapiens
atccaattctaatattgtgttt

SEQ ID NO: 7781519 - DNA, 22 bp, Homo sapiens
atccaattacgttttttgtcat

SEQ ID NO: 7781520 - DNA, 22 bp, Homo sapiens
atcattttatggctgagaggac

SEQ ID NO: 7781521 - DNA, 22 bp, Homo sapiens
atcattttgtgacaatgcctgt

SEQ ID NO: 7781522 - DNA, 18 bp, Homo sapiens
atccaaaaagatggaagt

SEQ ID NO: 7781523 - DNA, 22 bp, Homo sapiens
atccaaaatttactgtagcatt

SEQ ID NO: 7781524 - DNA, 22 bp, Homo sapiens
ctgtcctccagacgacagtccc

SEQ ID NO: 7781525 - DNA, 22 bp, Homo sapiens
ctgtcctcaccttggcaggggg

SEQ ID NO: 7781526 - DNA, 22 bp, Homo sapiens
atcacatatatgcaccaagaca

SEQ ID NO: 7781527 - DNA, 22 bp, Homo sapiens
atcacatatttaagaaacatgt

SEQ ID NO: 7781528 - DNA, 22 bp, Homo sapiens
atcacagtttacaaacctgctg

SEQ ID NO: 7781529 - DNA, 22 bp, Homo sapiens
atcacagttttgtgccttgtgg

SEQ ID NO: 7781530 - DNA, 22 bp, Homo sapiens
atcacatctcaccactgcaacc

SEQ ID NO: 7781531 - DNA, 22 bp, Homo sapiens
atcacatctcaccactgcaacc

SEQ ID NO: 7781532 - DNA, 22 bp, Homo sapiens
atcacatcacaggttgagctag

SEQ ID NO: 7781533 - DNA, 22 bp, Homo sapiens
atcacaggtggtaggaaaagaa

SEQ ID NO: 7781534 - DNA, 22 bp, Homo sapiens
atcacagtgccttcgtaaattt

SEQ ID NO: 7781535 - DNA, 22 bp, Homo sapiens
atcacagtgtagaccttttaaa

SEQ ID NO: 7781536 - DNA, 22 bp, Homo sapiens
atcacagtggctacctctggat

SEQ ID NO: 7781537 - DNA, 22 bp, Homo sapiens
atcacagttactcaaataatga

SEQ ID NO: 7781538 - DNA, 22 bp, Homo sapiens
atcacagttactcaaataatga

SEQ ID NO: 7781539 - DNA, 20 bp, Homo sapiens
ctgggtcacttggctgctct

SEQ ID NO: 7781540 - DNA, 22 bp, Homo sapiens
ctgggtcaaggaatgctggtgg

SEQ ID NO: 7781541 - DNA, 22 bp, Homo sapiens
ctgggtcccctcagtgacactg

SEQ ID NO: 7781542 - DNA, 22 bp, Homo sapiens
ctgtcccttcccaagcccagcc

SEQ ID NO: 7781543 - DNA, 22 bp, Homo sapiens
ctgtctttagtacaaaaaatgt

SEQ ID NO: 7781544 - DNA, 22 bp, Homo sapiens
ctgtctttggtcctgtctgtta

SEQ ID NO: 7781545 - DNA, 19 bp, Homo sapiens
atcacatgtcaagagcagg

SEQ ID NO: 7781546 - DNA, 18 bp, Homo sapiens
ctgtcttttttctctcca

SEQ ID NO: 7781547 - DNA, 18 bp, Homo sapiens
ctgtcttttttctctcca

SEQ ID NO: 7781548 - DNA, 22 bp, Homo sapiens
ctgtcttttcttctcattgatg

SEQ ID NO: 7781549 - DNA, 22 bp, Homo sapiens
ctgtcttttcttctcattgatg

SEQ ID NO: 7781550 - DNA, 22 bp, Homo sapiens
ctgtcttttcatactttccctc

SEQ ID NO: 7781551 - DNA, 22 bp, Homo sapiens
ctgtcttttactatcatttact

SEQ ID NO: 7781552 - DNA, 22 bp, Homo sapiens
ctgtcttttactatcatttact

SEQ ID NO: 7781553 - DNA, 22 bp, Homo sapiens
atcatgaatcttgtgttctatg

SEQ ID NO: 7781554 - DNA, 22 bp, Homo sapiens
atcatggaaaggttcagcaagc

SEQ ID NO: 7781555 - DNA, 22 bp, Homo sapiens
atcatgctgacacagtttatct

SEQ ID NO: 7781556 - DNA, 22 bp, Homo sapiens
cattccaagtatatacatgata

SEQ ID NO: 7781557 - DNA, 22 bp, Homo sapiens
cattcaaacattaatttattca

SEQ ID NO: 7781558 - DNA, 22 bp, Homo sapiens
aggcagcagaaaacaaatggtt

SEQ ID NO: 7781559 - DNA, 22 bp, Homo sapiens
catggccctcttctggagcaat

SEQ ID NO: 7781560 - DNA, 22 bp, Homo sapiens
catggccccaaatcccatgcat

SEQ ID NO: 7781561 - DNA, 22 bp, Homo sapiens
catggccagggcagatggcagg

SEQ ID NO: 7781562 - DNA, 22 bp, Homo sapiens
catggcggtcaggatgtaggtg

SEQ ID NO: 7781563 - DNA, 22 bp, Homo sapiens
aggcagcagaggttgaggaaag

SEQ ID NO: 7781564 - DNA, 22 bp, Homo sapiens
aggcagcagaggttgaggaaag

SEQ ID NO: 7781565 - DNA, 22 bp, Homo sapiens
aggcagcagccacaaggcctga

SEQ ID NO: 7781566 - DNA, 18 bp, Homo sapiens
aggcagcagcatcttctc

SEQ ID NO: 7781567 - DNA, 21 bp, Homo sapiens
catttacatgacagattggtt

SEQ ID NO: 7781568 - DNA, 22 bp, Homo sapiens
catttacataacagtaacgctg

SEQ ID NO: 7781569 - DNA, 22 bp, Homo sapiens
catttacagtgagagtttttac

SEQ ID NO: 7781570 - DNA, 22 bp, Homo sapiens
catttacagcagactgatgaaa

SEQ ID NO: 7781571 - DNA, 22 bp, Homo sapiens
catttacagcagactgatgaaa

SEQ ID NO: 7781572 - DNA, 22 bp, Homo sapiens
catttacagtgagagtttttac

SEQ ID NO: 7781573 - DNA, 22 bp, Homo sapiens
aggcagccagttcaggtttctt

SEQ ID NO: 7781574 - DNA, 22 bp, Homo sapiens
aggcagcatttgaatccaggtc

SEQ ID NO: 7781575 - DNA, 22 bp, Homo sapiens
aggcagcatttctgcttatcca

SEQ ID NO: 7781576 - DNA, 19 bp, Homo sapiens
aggcagcattctggggctt

SEQ ID NO: 7781577 - DNA, 19 bp, Homo sapiens
aggcagcattctggggctt

SEQ ID NO: 7781578 - DNA, 19 bp, Homo sapiens
aggcagcattctggggctt

SEQ ID NO: 7781579 - DNA, 21 bp, Homo sapiens
catttacatgacagattggtt

SEQ ID NO: 7781580 - DNA, 22 bp, Homo sapiens
catttacatttaaggttaatat

SEQ ID NO: 7781581 - DNA, 22 bp, Homo sapiens
aggcacaggaatgtcatccagt

SEQ ID NO: 7781582 - DNA, 22 bp, Homo sapiens
aggcacagcctcccttcacatg

SEQ ID NO: 7781583 - DNA, 22 bp, Homo sapiens
catgcctgtaatcccagctctt

SEQ ID NO: 7781584 - DNA, 17 bp, Homo sapiens
catctttaaaatcctga

SEQ ID NO: 7781585 - DNA, 22 bp, Homo sapiens
catgaaatatgctacctgtctt

SEQ ID NO: 7781586 - DNA, 22 bp, Homo sapiens
catgaaatgttagaattagaca

SEQ ID NO: 7781587 - DNA, 22 bp, Homo sapiens
catgaaatgttagaattagaca

SEQ ID NO: 7781588 - DNA, 22 bp, Homo sapiens
catgaaattcagcaggtgagta

SEQ ID NO: 7781589 - DNA, 22 bp, Homo sapiens
catgaaatggccaaccttcggc

SEQ ID NO: 7781590 - DNA, 22 bp, Homo sapiens
catgaaatgatatttgggtggg

SEQ ID NO: 7781591 - DNA, 22 bp, Homo sapiens
catgaaatcacaagctgaggac

SEQ ID NO: 7781592 - DNA, 22 bp, Homo sapiens
aggaggtggcctgagcgtgccc

SEQ ID NO: 7781593 - DNA, 22 bp, Homo sapiens
aggaggtggcctgagcgtgccc

SEQ ID NO: 7781594 - DNA, 22 bp, Homo sapiens
aggaggtggctgaacttgaggg

SEQ ID NO: 7781595 - DNA, 22 bp, Homo sapiens
aggaggtgctagagaagatgtt

SEQ ID NO: 7781596 - DNA, 22 bp, Homo sapiens
catgagtgagtatctcaagata

SEQ ID NO: 7781597 - DNA, 22 bp, Homo sapiens
aggaggtgttgatagaaggttt

SEQ ID NO: 7781598 - DNA, 22 bp, Homo sapiens
aggaggtgttgatagaaggttt

SEQ ID NO: 7781599 - DNA, 22 bp, Homo sapiens
catgcacactgcaacaaggact

SEQ ID NO: 7781600 - DNA, 22 bp, Homo sapiens
catgcacagagcttggtcattg

SEQ ID NO: 7781601 - DNA, 20 bp, Homo sapiens
aggaaggaagtttgcatgga

SEQ ID NO: 7781602 - DNA, 22 bp, Homo sapiens
aggaagctgcctgggatgggaa

SEQ ID NO: 7781603 - DNA, 22 bp, Homo sapiens
aggaagcttagtgaaaggacca

SEQ ID NO: 7781604 - DNA, 22 bp, Homo sapiens
aggaagcttggggcagggctac

SEQ ID NO: 7781605 - DNA, 22 bp, Homo sapiens
cagtcctgctggccttccctgg

SEQ ID NO: 7781606 - DNA, 22 bp, Homo sapiens
cagtcctgggagacttacccag

SEQ ID NO: 7781607 - DNA, 20 bp, Homo sapiens
cagtcctgccccttggggac

SEQ ID NO: 7781608 - DNA, 22 bp, Homo sapiens
cagtcctgggcacagccctggg

SEQ ID NO: 7781609 - DNA, 22 bp, Homo sapiens
cagtcctgggcacagccctggg

SEQ ID NO: 7781610 - DNA, 18 bp, Homo sapiens
cagtcccaaaccttagga

SEQ ID NO: 7781611 - DNA, 22 bp, Homo sapiens
cagtcctgaggaagagctgctg

SEQ ID NO: 7781612 - DNA, 22 bp, Homo sapiens
cagtcctgagctcctgggctga

SEQ ID NO: 7781613 - DNA, 20 bp, Homo sapiens
cagtcctgcaggcgggagaa

SEQ ID NO: 7781614 - DNA, 21 bp, Homo sapiens
cagtcctgcaaataattcttt

SEQ ID NO: 7781615 - DNA, 22 bp, Homo sapiens
aggagaattaggaactcaagat

SEQ ID NO: 7781616 - DNA, 22 bp, Homo sapiens
cagtctctttatccaccaagcc

SEQ ID NO: 7781617 - DNA, 22 bp, Homo sapiens
cagtctctgggaaagaggacag

SEQ ID NO: 7781618 - DNA, 22 bp, Homo sapiens
cagtctctgccacttctaagct

SEQ ID NO: 7781619 - DNA, 22 bp, Homo sapiens
cagtctctgccacttctaagct

SEQ ID NO: 7781620 - DNA, 22 bp, Homo sapiens
cagtctctcttgtagtgcagct

SEQ ID NO: 7781621 - DNA, 22 bp, Homo sapiens
cagtctctctgaagtattaaga

SEQ ID NO: 7781622 - DNA, 22 bp, Homo sapiens
cagtctctctgaagtattaaga

SEQ ID NO: 7781623 - DNA, 22 bp, Homo sapiens
cagtctctctccttgcaggcgt

SEQ ID NO: 7781624 - DNA, 23 bp, Homo sapiens
aggagaagagatttccacatgca

SEQ ID NO: 7781625 - DNA, 22 bp, Homo sapiens
aggagaagccaagttgtgagca

SEQ ID NO: 7781626 - DNA, 21 bp, Homo sapiens
aggagaaacacaggtcagccc

SEQ ID NO: 7781627 - DNA, 18 bp, Homo sapiens
aggagaaagggaccaggg

SEQ ID NO: 7781628 - DNA, 22 bp, Homo sapiens
aggagaaagactggacagccaa

SEQ ID NO: 7781629 - DNA, 21 bp, Homo sapiens
aggacaggaactggctgaata

SEQ ID NO: 7781630 - DNA, 22 bp, Homo sapiens
aggacagcccttgagagcacat

SEQ ID NO: 7781631 - DNA, 22 bp, Homo sapiens
aggagaggctctaactctgtgt

SEQ ID NO: 7781632 - DNA, 22 bp, Homo sapiens
aggagaggcatcaagaaaatcg

SEQ ID NO: 7781633 - DNA, 22 bp, Homo sapiens
aggagagagaacacttgggtcc

SEQ ID NO: 7781634 - DNA, 22 bp, Homo sapiens
aggagagaatgttccaggcttg

SEQ ID NO: 7781635 - DNA, 22 bp, Homo sapiens
aggagagaatgttccaggcttg

SEQ ID NO: 7781636 - DNA, 22 bp, Homo sapiens
aggagagaatgttccaggcttg

SEQ ID NO: 7781637 - DNA, 22 bp, Homo sapiens
aggagcctggctggcccacagg

SEQ ID NO: 7781638 - DNA, 22 bp, Homo sapiens
aggagataagaggctggtgtgg

SEQ ID NO: 7781639 - DNA, 18 bp, Homo sapiens
aggagcctttgcactgga

SEQ ID NO: 7781640 - DNA, 19 bp, Homo sapiens
aggagccttgagcagtgag

SEQ ID NO: 7781641 - DNA, 17 bp, Homo sapiens
aggaggatcagagagta

SEQ ID NO: 7781642 - DNA, 22 bp, Homo sapiens
aggaggaggtaagaaaagcata

SEQ ID NO: 7781643 - DNA, 22 bp, Homo sapiens
aggaggaggtgggacacagtga

SEQ ID NO: 7781644 - DNA, 22 bp, Homo sapiens
aggaggaggtaagaaaagcata

SEQ ID NO: 7781645 - DNA, 22 bp, Homo sapiens
aggaggaggtgggacacagtga

SEQ ID NO: 7781646 - DNA, 22 bp, Homo sapiens
aggaggaatacaatccagcagc

SEQ ID NO: 7781647 - DNA, 22 bp, Homo sapiens
aggaggagcagctttttgtctc

SEQ ID NO: 7781648 - DNA, 21 bp, Homo sapiens
aggaggagagcttggcctacc

SEQ ID NO: 7781649 - DNA, 22 bp, Homo sapiens
aggagctctgggcagggcctcc

SEQ ID NO: 7781650 - DNA, 22 bp, Homo sapiens
aggaaagcaatggctgagaaca

SEQ ID NO: 7781651 - DNA, 22 bp, Homo sapiens
aggaaagctcccagtagggctc

SEQ ID NO: 7781652 - DNA, 22 bp, Homo sapiens
cagggccagagagggctggctg

SEQ ID NO: 7781653 - DNA, 22 bp, Homo sapiens
cagggccagagagggctggctg

SEQ ID NO: 7781654 - DNA, 17 bp, Homo sapiens
aggaaacattttctttc

SEQ ID NO: 7781655 - DNA, 22 bp, Homo sapiens
agcttgttagaaatgtagactc

SEQ ID NO: 7781656 - DNA, 21 bp, Homo sapiens
agcttgtgtgtatcacagtgt

SEQ ID NO: 7781657 - DNA, 22 bp, Homo sapiens
agcttgttttgttgaatactta

SEQ ID NO: 7781658 - DNA, 17 bp, Homo sapiens
agcttgtttttgaaagc

SEQ ID NO: 7781659 - DNA, 22 bp, Homo sapiens
agcttgttataaatgcagaatg

SEQ ID NO: 7781660 - DNA, 22 bp, Homo sapiens
agcttgttggggaaggagaaag

SEQ ID NO: 7781661 - DNA, 22 bp, Homo sapiens
agctttaaatcaatccagtgag

SEQ ID NO: 7781662 - DNA, 22 bp, Homo sapiens
agctttacctgccttggggcac

SEQ ID NO: 7781663 - DNA, 22 bp, Homo sapiens
aggaagctcggagagggcaaat

SEQ ID NO: 7781664 - DNA, 18 bp, Homo sapiens
aggaagcaggaggaaggc

SEQ ID NO: 7781665 - DNA, 22 bp, Homo sapiens
aggaacctgagtctgatcattt

SEQ ID NO: 7781666 - DNA, 22 bp, Homo sapiens
aggaacccggtctgtcactgtg

SEQ ID NO: 7781667 - DNA, 22 bp, Homo sapiens
aggaacatctatcacataaacg

SEQ ID NO: 7781668 - DNA, 23 bp, Homo sapiens
aggaactgaggcctagggaggta

SEQ ID NO: 7781669 - DNA, 22 bp, Homo sapiens
aggaaataggaccagacaaagc

SEQ ID NO: 7781670 - DNA, 22 bp, Homo sapiens
aggaaataggaccagacaaagc

SEQ ID NO: 7781671 - DNA, 22 bp, Homo sapiens
aggaacaattgataaactcaca

SEQ ID NO: 7781672 - DNA, 22 bp, Homo sapiens
aggaacaattgataaactcaca

SEQ ID NO: 7781673 - DNA, 22 bp, Homo sapiens
aggaacaactgattcagtcaac

SEQ ID NO: 7781674 - DNA, 22 bp, Homo sapiens
aggaaattttgaatcagtgtct

SEQ ID NO: 7781675 - DNA, 22 bp, Homo sapiens
aggaacaactgattcagtcaac

SEQ ID NO: 7781676 - DNA, 22 bp, Homo sapiens
aggaaattgagaatcagaataa

SEQ ID NO: 7781677 - DNA, 22 bp, Homo sapiens
caggcctgggctgggtatcagg

SEQ ID NO: 7781678 - DNA, 22 bp, Homo sapiens
caggcctgggcttcggggctga

SEQ ID NO: 7781679 - DNA, 22 bp, Homo sapiens
caggcctggctgcagctcgcct

SEQ ID NO: 7781680 - DNA, 22 bp, Homo sapiens
caggcctgggcttcggggctga

SEQ ID NO: 7781681 - DNA, 22 bp, Homo sapiens
caggcctgggttcaaatccctt

SEQ ID NO: 7781682 - DNA, 22 bp, Homo sapiens
caggcctggttgagccctgaga

SEQ ID NO: 7781683 - DNA, 22 bp, Homo sapiens
agctgtgtcatcctggaaaatg

SEQ ID NO: 7781684 - DNA, 22 bp, Homo sapiens
agctgtgtcctgaagacactgc

SEQ ID NO: 7781685 - DNA, 22 bp, Homo sapiens
agctgtgtgacctagggcaagc

SEQ ID NO: 7781686 - DNA, 22 bp, Homo sapiens
agctgtgtgactctaagcaagt

SEQ ID NO: 7781687 - DNA, 22 bp, Homo sapiens
caggcctcaccagcggagctgc

SEQ ID NO: 7781688 - DNA, 22 bp, Homo sapiens
caggcctcaggggctcaggctg

SEQ ID NO: 7781689 - DNA, 22 bp, Homo sapiens
caggcctccactccacgcagac

SEQ ID NO: 7781690 - DNA, 22 bp, Homo sapiens
agctgggaagactggaagacag

SEQ ID NO: 7781691 - DNA, 22 bp, Homo sapiens
agctggcttttgtgaaggtttt

SEQ ID NO: 7781692 - DNA, 22 bp, Homo sapiens
agctgggaagagttttctgcag

SEQ ID NO: 7781693 - DNA, 23 bp, Homo sapiens
agctgggaattttctgaagcttt

SEQ ID NO: 7781694 - DNA, 22 bp, Homo sapiens
agcttgagttttggatgaagtg

SEQ ID NO: 7781695 - DNA, 22 bp, Homo sapiens
agcttgtaacagacataaaaat

SEQ ID NO: 7781696 - DNA, 22 bp, Homo sapiens
agcttaatggaacttgctcaaa

SEQ ID NO: 7781697 - DNA, 22 bp, Homo sapiens
agctgttgaaaatggtgtccta

SEQ ID NO: 7781698 - DNA, 22 bp, Homo sapiens
agctgtgttaggatgttaataa

SEQ ID NO: 7781699 - DNA, 22 bp, Homo sapiens
agctgtgtgtgaatttggccta

SEQ ID NO: 7781700 - DNA, 22 bp, Homo sapiens
agctgtgtggtttgggcaaatt

SEQ ID NO: 7781701 - DNA, 22 bp, Homo sapiens
caggacagacagaatgcctaac

SEQ ID NO: 7781702 - DNA, 22 bp, Homo sapiens
caggacagaaataaggaatata

SEQ ID NO: 7781703 - DNA, 22 bp, Homo sapiens
caggacacttgttcttctctgc

SEQ ID NO: 7781704 - DNA, 22 bp, Homo sapiens
caggacagacagaatgcctaac

SEQ ID NO: 7781705 - DNA, 22 bp, Homo sapiens
caggacagaccaagatcgtgct

SEQ ID NO: 7781706 - DNA, 19 bp, Homo sapiens
caggacagacttcaaagcc

SEQ ID NO: 7781707 - DNA, 22 bp, Homo sapiens
agctggcagttgcgataatgca

SEQ ID NO: 7781708 - DNA, 22 bp, Homo sapiens
agctggcatactttgctaggaa

SEQ ID NO: 7781709 - DNA, 22 bp, Homo sapiens
agctggaggataactcacttct

SEQ ID NO: 7781710 - DNA, 23 bp, Homo sapiens
agctggaggctgtctactcccaa

SEQ ID NO: 7781711 - DNA, 22 bp, Homo sapiens
agctgctgagagtctgccgggc

SEQ ID NO: 7781712 - DNA, 22 bp, Homo sapiens
agctgctgagccaggctgatgt

SEQ ID NO: 7781713 - DNA, 22 bp, Homo sapiens
caggaaaaatgccaggagtcag

SEQ ID NO: 7781714 - DNA, 22 bp, Homo sapiens
caggaaaaggagactttagcac

SEQ ID NO: 7781715 - DNA, 22 bp, Homo sapiens
caggaaaaggagactttagcac

SEQ ID NO: 7781716 - DNA, 22 bp, Homo sapiens
agctgctccttggctgtggttc

SEQ ID NO: 7781717 - DNA, 22 bp, Homo sapiens
agctggctttatggttggctaa

SEQ ID NO: 7781718 - DNA, 22 bp, Homo sapiens
agctggcttgcatgctaaggag

SEQ ID NO: 7781719 - DNA, 22 bp, Homo sapiens
agctggctttgagctgggaggt

SEQ ID NO: 7781720 - DNA, 22 bp, Homo sapiens
agctggctttgagctgggaggt

SEQ ID NO: 7781721 - DNA, 22 bp, Homo sapiens
agctggctttgagctgggaggt

SEQ ID NO: 7781722 - DNA, 22 bp, Homo sapiens
agctggcttcacaggcagtgtg

SEQ ID NO: 7781723 - DNA, 22 bp, Homo sapiens
agctggcttctctgcagacatt

SEQ ID NO: 7781724 - DNA, 19 bp, Homo sapiens
agctggctcttctttgtct

SEQ ID NO: 7781725 - DNA, 22 bp, Homo sapiens
agctggctggccccttcctgcc

SEQ ID NO: 7781726 - DNA, 22 bp, Homo sapiens
agctggctggccccttcctgcc

SEQ ID NO: 7781727 - DNA, 22 bp, Homo sapiens
agctggccagcacctccaggtc

SEQ ID NO: 7781728 - DNA, 22 bp, Homo sapiens
agctggcattgcagggagctgc

SEQ ID NO: 7781729 - DNA, 22 bp, Homo sapiens
agctggcattacaggagcatgc

SEQ ID NO: 7781730 - DNA, 22 bp, Homo sapiens
caggaggttgtaagagcaggcc

SEQ ID NO: 7781731 - DNA, 22 bp, Homo sapiens
cagctctgaagaaaggtgtcta

SEQ ID NO: 7781732 - DNA, 22 bp, Homo sapiens
cagctctcacaccctcctccca

SEQ ID NO: 7781733 - DNA, 21 bp, Homo sapiens
cagcttcttctgtgacctggt

SEQ ID NO: 7781734 - DNA, 22 bp, Homo sapiens
cagcttctttgggattctttat

SEQ ID NO: 7781735 - DNA, 22 bp, Homo sapiens
cagcttcttagtctttccttgt

SEQ ID NO: 7781736 - DNA, 22 bp, Homo sapiens
cagcttctgctcatggaggggt

SEQ ID NO: 7781737 - DNA, 22 bp, Homo sapiens
cagcttctggcgtggagcctga

SEQ ID NO: 7781738 - DNA, 22 bp, Homo sapiens
cagcttctggcgtggagcctga

SEQ ID NO: 7781739 - DNA, 22 bp, Homo sapiens
cagcttctgtttctagcccctg

SEQ ID NO: 7781740 - DNA, 22 bp, Homo sapiens
agctgcagccctcctgcatggc

SEQ ID NO: 7781741 - DNA, 22 bp, Homo sapiens
agctgcaggcctctcctgggga

SEQ ID NO: 7781742 - DNA, 22 bp, Homo sapiens
agctgaggcatggacaggctgc

SEQ ID NO: 7781743 - DNA, 23 bp, Homo sapiens
cagcttctttgggattctttata

SEQ ID NO: 7781744 - DNA, 22 bp, Homo sapiens
agctgaggccacgagtgaaggg

SEQ ID NO: 7781745 - DNA, 22 bp, Homo sapiens
agctgcagtcaagctgggccac

SEQ ID NO: 7781746 - DNA, 22 bp, Homo sapiens
agctgcagtaaagctctccagg

SEQ ID NO: 7781747 - DNA, 22 bp, Homo sapiens
cagctttgattctttctgccat

SEQ ID NO: 7781748 - DNA, 22 bp, Homo sapiens
cagctttgattctttctgccat

SEQ ID NO: 7781749 - DNA, 22 bp, Homo sapiens
cagctttgccctttgcccaatc

SEQ ID NO: 7781750 - DNA, 22 bp, Homo sapiens
cagctttgccaagtaaggtctt

SEQ ID NO: 7781751 - DNA, 22 bp, Homo sapiens
cagctttgcaggctggtcagtg

SEQ ID NO: 7781752 - DNA, 22 bp, Homo sapiens
cagctttggcccagtcgggagg

SEQ ID NO: 7781753 - DNA, 22 bp, Homo sapiens
cagctttggagtgtgagtgctg

SEQ ID NO: 7781754 - DNA, 22 bp, Homo sapiens
cagctttgtcatttgatttggg

SEQ ID NO: 7781755 - DNA, 22 bp, Homo sapiens
cagctttgtcctgcaaacctga

SEQ ID NO: 7781756 - DNA, 16 bp, Homo sapiens
cagctttgtctcctcg

SEQ ID NO: 7781757 - DNA, 22 bp, Homo sapiens
caggaaaaatgccaggagtcag

SEQ ID NO: 7781758 - DNA, 22 bp, Homo sapiens
cagctttgtggccttgacctcg

SEQ ID NO: 7781759 - DNA, 22 bp, Homo sapiens
cagctttgtgcaatgcagtctc

SEQ ID NO: 7781760 - DNA, 22 bp, Homo sapiens
cagctttgtgacttcggacaag

SEQ ID NO: 7781761 - DNA, 22 bp, Homo sapiens
cagctttgtctgattcctcttt

SEQ ID NO: 7781762 - DNA, 21 bp, Homo sapiens
cagctttgtctgtcttcgggg

SEQ ID NO: 7781763 - DNA, 22 bp, Homo sapiens
cccagcctgatctcggccagct

SEQ ID NO: 7781764 - DNA, 22 bp, Homo sapiens
cccagcctgatctcggccagct

SEQ ID NO: 7781765 - DNA, 22 bp, Homo sapiens
cccagcctctgtttgctcctct

SEQ ID NO: 7781766 - DNA, 22 bp, Homo sapiens
cccagcctctgggctcacccaa

SEQ ID NO: 7781767 - DNA, 22 bp, Homo sapiens
cccagcctctgggttctgccgg

SEQ ID NO: 7781768 - DNA, 22 bp, Homo sapiens
cccagcctctggattctgccct

SEQ ID NO: 7781769 - DNA, 18 bp, Homo sapiens
cccagcctctcctttcta

SEQ ID NO: 7781770 - DNA, 18 bp, Homo sapiens
cccagcctctcctttcta

SEQ ID NO: 7781771 - DNA, 22 bp, Homo sapiens
aggctgtgtttcccctggagct

SEQ ID NO: 7781772 - DNA, 22 bp, Homo sapiens
aggctgtgtttcccctggagct

SEQ ID NO: 7781773 - DNA, 22 bp, Homo sapiens
aggctgtgtttcccctggagct

SEQ ID NO: 7781774 - DNA, 22 bp, Homo sapiens
aggctgttctaggagagtggga

SEQ ID NO: 7781775 - DNA, 22 bp, Homo sapiens
cccagcagtgacccagtgatac

SEQ ID NO: 7781776 - DNA, 22 bp, Homo sapiens
cccagcagtggttctcaaactt

SEQ ID NO: 7781777 - DNA, 22 bp, Homo sapiens
cccagcagtaaccagtggaaat

SEQ ID NO: 7781778 - DNA, 22 bp, Homo sapiens
cccagcagtacccaagcccttg

SEQ ID NO: 7781779 - DNA, 22 bp, Homo sapiens
ccatgcaagaagtccaaccatc

SEQ ID NO: 7781780 - DNA, 22 bp, Homo sapiens
ccatgcaaggagaactctcact

SEQ ID NO: 7781781 - DNA, 22 bp, Homo sapiens
ccatgcaagggtctggtcctgc

SEQ ID NO: 7781782 - DNA, 22 bp, Homo sapiens
ccatgcaatttctgtaaaacca

SEQ ID NO: 7781783 - DNA, 22 bp, Homo sapiens
ccatgcaatatatatcctcaag

SEQ ID NO: 7781784 - DNA, 22 bp, Homo sapiens
cccagcagttgttggtgcacat

SEQ ID NO: 7781785 - DNA, 22 bp, Homo sapiens
cccagcatcccagtgggcagca

SEQ ID NO: 7781786 - DNA, 22 bp, Homo sapiens
cccagcatcctcagggagcggg

SEQ ID NO: 7781787 - DNA, 22 bp, Homo sapiens
cccagcctcagctttacttcca

SEQ ID NO: 7781788 - DNA, 22 bp, Homo sapiens
cccagcctcagctttacttcca

SEQ ID NO: 7781789 - DNA, 22 bp, Homo sapiens
ccataatcgtgtgttaaataat

SEQ ID NO: 7781790 - DNA, 22 bp, Homo sapiens
ccataatctggctttgagagag

SEQ ID NO: 7781791 - DNA, 21 bp, Homo sapiens
ccataatcttaggatcaaaat

SEQ ID NO: 7781792 - DNA, 22 bp, Homo sapiens
ccatctccactgtccctgtcaa

SEQ ID NO: 7781793 - DNA, 22 bp, Homo sapiens
ccatgcaaagaatgtgggcata

SEQ ID NO: 7781794 - DNA, 22 bp, Homo sapiens
ccatgcaacagaatccagattt

SEQ ID NO: 7781795 - DNA, 22 bp, Homo sapiens
ccatctgtatctgacaaattct

SEQ ID NO: 7781796 - DNA, 22 bp, Homo sapiens
aggcttcaaggacctgagggaa

SEQ ID NO: 7781797 - DNA, 22 bp, Homo sapiens
agggaaggaaaagctgtcgctt

SEQ ID NO: 7781798 - DNA, 22 bp, Homo sapiens
agggaaggaggccatgtgtccc

SEQ ID NO: 7781799 - DNA, 19 bp, Homo sapiens
agggaaggattctgtcatt

SEQ ID NO: 7781800 - DNA, 22 bp, Homo sapiens
agggaaggcttttgacatttcc

SEQ ID NO: 7781801 - DNA, 22 bp, Homo sapiens
agggagagtagatatcaggtgt

SEQ ID NO: 7781802 - DNA, 22 bp, Homo sapiens
agggagaggttgaaacctcagt

SEQ ID NO: 7781803 - DNA, 22 bp, Homo sapiens
agggagaggttgaaacctcagt

SEQ ID NO: 7781804 - DNA, 22 bp, Homo sapiens
agggaagggcagggtctatgca

SEQ ID NO: 7781805 - DNA, 22 bp, Homo sapiens
agggaagggcagggtctatgca

SEQ ID NO: 7781806 - DNA, 18 bp, Homo sapiens
agggagcatctggttgcc

SEQ ID NO: 7781807 - DNA, 22 bp, Homo sapiens
agggagcagggctcctttgggt

SEQ ID NO: 7781808 - DNA, 22 bp, Homo sapiens
agggagagtttgatgtttcctc

SEQ ID NO: 7781809 - DNA, 22 bp, Homo sapiens
agggagcatgggtgaagcaggc

SEQ ID NO: 7781810 - DNA, 22 bp, Homo sapiens
ccccagggtcagtgtgtggagg

SEQ ID NO: 7781811 - DNA, 22 bp, Homo sapiens
ccccagggtcagtgtgtggagg

SEQ ID NO: 7781812 - DNA, 19 bp, Homo sapiens
ccccagggtaggctagggg

SEQ ID NO: 7781813 - DNA, 22 bp, Homo sapiens
ccccagggactggtttcatgga

SEQ ID NO: 7781814 - DNA, 22 bp, Homo sapiens
ccccagggaagctttgcttact

SEQ ID NO: 7781815 - DNA, 22 bp, Homo sapiens
ccccatgaagtagggtctctga

SEQ ID NO: 7781816 - DNA, 22 bp, Homo sapiens
ccccatgaagtagggtctctga

SEQ ID NO: 7781817 - DNA, 22 bp, Homo sapiens
ccccatgaagtagggtctctga

SEQ ID NO: 7781818 - DNA, 21 bp, Homo sapiens
ccccatggagtacagttgggc

SEQ ID NO: 7781819 - DNA, 22 bp, Homo sapiens
ccccatggcaactgctgggggt

SEQ ID NO: 7781820 - DNA, 22 bp, Homo sapiens
cctctcggcagcccatcttgtc

SEQ ID NO: 7781821 - DNA, 22 bp, Homo sapiens
cctcgctgtgtgaccttgggtg

SEQ ID NO: 7781822 - DNA, 22 bp, Homo sapiens
cctctctccaattttcacctca

SEQ ID NO: 7781823 - DNA, 22 bp, Homo sapiens
cctcgcggcactcgggccggat

SEQ ID NO: 7781824 - DNA, 22 bp, Homo sapiens
cctcgctgtgtgaccttgggtg

SEQ ID NO: 7781825 - DNA, 22 bp, Homo sapiens
cctcccatccctgcaagagagc

SEQ ID NO: 7781826 - DNA, 23 bp, Homo sapiens
cctccccaccagactctaacata

SEQ ID NO: 7781827 - DNA, 22 bp, Homo sapiens
cctccccacagcccaggagact

SEQ ID NO: 7781828 - DNA, 22 bp, Homo sapiens
cctccaggataagtcagggcct

SEQ ID NO: 7781829 - DNA, 22 bp, Homo sapiens
cctccaggctggttatcagctg

SEQ ID NO: 7781830 - DNA, 22 bp, Homo sapiens
cctcagacccctgctgagcttc

SEQ ID NO: 7781831 - DNA, 22 bp, Homo sapiens
cctcagacgcaggcctatgggc

SEQ ID NO: 7781832 - DNA, 22 bp, Homo sapiens
cctcaagttggaaataaaatgt

SEQ ID NO: 7781833 - DNA, 20 bp, Homo sapiens
cctcaagcagactgacagct

SEQ ID NO: 7781834 - DNA, 21 bp, Homo sapiens
cctcaagtgcctcctgctgct

SEQ ID NO: 7781835 - DNA, 22 bp, Homo sapiens
cctcaaattgctcagcgtctag

SEQ ID NO: 7781836 - DNA, 23 bp, Homo sapiens
cctcaaatgtagcctttttccca

SEQ ID NO: 7781837 - DNA, 22 bp, Homo sapiens
cctcaaatctttagagttattt

SEQ ID NO: 7781838 - DNA, 22 bp, Homo sapiens
cctcaaattgtcaaataagaat

SEQ ID NO: 7781839 - DNA, 22 bp, Homo sapiens
cctcaaattggcattaattaag

SEQ ID NO: 7781840 - DNA, 22 bp, Homo sapiens
cctcaagaacaatccaccatta

SEQ ID NO: 7781841 - DNA, 17 bp, Homo sapiens
ccctgggtgagttctca

SEQ ID NO: 7781842 - DNA, 22 bp, Homo sapiens
ccctgtttatttttggagagaa

SEQ ID NO: 7781843 - DNA, 22 bp, Homo sapiens
cctagaatgtacttaatagatg

SEQ ID NO: 7781844 - DNA, 20 bp, Homo sapiens
cctcaaataagtgccagcat

SEQ ID NO: 7781845 - DNA, 22 bp, Homo sapiens
cctcaaatagcccccagtctag

SEQ ID NO: 7781846 - DNA, 22 bp, Homo sapiens
ccctgggctcagagcaggtagc

SEQ ID NO: 7781847 - DNA, 22 bp, Homo sapiens
agggccagggaaacgatcagca

SEQ ID NO: 7781848 - DNA, 22 bp, Homo sapiens
agggccagggaagctgtatttt

SEQ ID NO: 7781849 - DNA, 22 bp, Homo sapiens
agggccagccgacttccagcct

SEQ ID NO: 7781850 - DNA, 22 bp, Homo sapiens
agggccagctgcagaattagca

SEQ ID NO: 7781851 - DNA, 22 bp, Homo sapiens
agggccagctgatgagaatgag

SEQ ID NO: 7781852 - DNA, 22 bp, Homo sapiens
agggccagctgatgagaatgag

SEQ ID NO: 7781853 - DNA, 22 bp, Homo sapiens
agggccaggatcacagccaaga

SEQ ID NO: 7781854 - DNA, 22 bp, Homo sapiens
agggccaggatcacagccaaga

SEQ ID NO: 7781855 - DNA, 19 bp, Homo sapiens
agggccaggattctggaac

SEQ ID NO: 7781856 - DNA, 22 bp, Homo sapiens
agggcagcagctcctcctagct

SEQ ID NO: 7781857 - DNA, 22 bp, Homo sapiens
agggcagcagctcctcctagct

SEQ ID NO: 7781858 - DNA, 22 bp, Homo sapiens
agggcagcagctgtccctgaga

SEQ ID NO: 7781859 - DNA, 22 bp, Homo sapiens
agggcagcattgcctttctcca

SEQ ID NO: 7781860 - DNA, 22 bp, Homo sapiens
agggcagcccttctgggagggc

SEQ ID NO: 7781861 - DNA, 22 bp, Homo sapiens
agggccagccgacttccagcct

SEQ ID NO: 7781862 - DNA, 22 bp, Homo sapiens
agggcagctgtgagccactgtg

SEQ ID NO: 7781863 - DNA, 22 bp, Homo sapiens
agggcagctggaaggtggcttc

SEQ ID NO: 7781864 - DNA, 22 bp, Homo sapiens
agggcagctctcacctctggcc

SEQ ID NO: 7781865 - DNA, 22 bp, Homo sapiens
agggcagctgtgagccactgtg

SEQ ID NO: 7781866 - DNA, 22 bp, Homo sapiens
agggcagcctgagtgctggccc

SEQ ID NO: 7781867 - DNA, 22 bp, Homo sapiens
agggcagcctctcagcctaggt

SEQ ID NO: 7781868 - DNA, 22 bp, Homo sapiens
agggcagcctctcagcctaggt

SEQ ID NO: 7781869 - DNA, 22 bp, Homo sapiens
agggcagctctcacctctggcc

SEQ ID NO: 7781870 - DNA, 22 bp, Homo sapiens
agggcagctaaggtgctgactg

SEQ ID NO: 7781871 - DNA, 22 bp, Homo sapiens
agggcagcggtgcttgtgttat

SEQ ID NO: 7781872 - DNA, 22 bp, Homo sapiens
aggcagtggagctggaataggc

SEQ ID NO: 7781873 - DNA, 22 bp, Homo sapiens
aggcagtggatgtcaggaatgg

SEQ ID NO: 7781874 - DNA, 22 bp, Homo sapiens
aggcagtggatgtcaggaatgg

SEQ ID NO: 7781875 - DNA, 22 bp, Homo sapiens
aggcagtggctgagaccagggg

SEQ ID NO: 7781876 - DNA, 22 bp, Homo sapiens
aggcagtgctcaagacagcagc

SEQ ID NO: 7781877 - DNA, 22 bp, Homo sapiens
aggcagtggaaggagaaagcaa

SEQ ID NO: 7781878 - DNA, 22 bp, Homo sapiens
aggcagtgctgtgccctgaacc

SEQ ID NO: 7781879 - DNA, 22 bp, Homo sapiens
aggcagtggaaggagaaagcaa

SEQ ID NO: 7781880 - DNA, 22 bp, Homo sapiens
aggcagtggagaaggtttgtga

SEQ ID NO: 7781881 - DNA, 22 bp, Homo sapiens
aggcagtggagctggaataggc

SEQ ID NO: 7781882 - DNA, 22 bp, Homo sapiens
aggcagtgagaaatagcaagat

SEQ ID NO: 7781883 - DNA, 22 bp, Homo sapiens
aggcagtgatgagtcatgaata

SEQ ID NO: 7781884 - DNA, 22 bp, Homo sapiens
aggcagtgcagagtcctcttct

SEQ ID NO: 7781885 - DNA, 22 bp, Homo sapiens
aggcagtgagtgtgacttcaca

SEQ ID NO: 7781886 - DNA, 22 bp, Homo sapiens
aggcagtgagcagggtgtcatg

SEQ ID NO: 7781887 - DNA, 22 bp, Homo sapiens
aggcagtgcctggaccccagct

SEQ ID NO: 7781888 - DNA, 22 bp, Homo sapiens
aggcagtgcatgcaaaggtcgg

SEQ ID NO: 7781889 - DNA, 22 bp, Homo sapiens
aggcagtgcagagtcctcttct

SEQ ID NO: 7781890 - DNA, 23 bp, Homo sapiens
aggcaggtttgggctcttcttgt

SEQ ID NO: 7781891 - DNA, 22 bp, Homo sapiens
aggcagcctatggggagctcag

SEQ ID NO: 7781892 - DNA, 22 bp, Homo sapiens
aggcagccctgtgctggatgct

SEQ ID NO: 7781893 - DNA, 22 bp, Homo sapiens
aggcagccctgtgctggatgct

SEQ ID NO: 7781894 - DNA, 22 bp, Homo sapiens
aggcagcccacaggacacagga

SEQ ID NO: 7781895 - DNA, 22 bp, Homo sapiens
aggcagccatctgcaggaagga

SEQ ID NO: 7781896 - DNA, 22 bp, Homo sapiens
aggcatgatgtgcagtggcaaa

SEQ ID NO: 7781897 - DNA, 22 bp, Homo sapiens
aggcatgatgtgcagtggcaaa

SEQ ID NO: 7781898 - DNA, 21 bp, Homo sapiens
aggcatgagccctgcatggac

SEQ ID NO: 7781899 - DNA, 21 bp, Homo sapiens
aggcatgagccctgcatggac

SEQ ID NO: 7781900 - DNA, 22 bp, Homo sapiens
aggcatgactttggctgaagaa

SEQ ID NO: 7781901 - DNA, 22 bp, Homo sapiens
aggcatctgagtttgcaagctt

SEQ ID NO: 7781902 - DNA, 23 bp, Homo sapiens
aggcagtgggggccactttgctt

SEQ ID NO: 7781903 - DNA, 22 bp, Homo sapiens
aggcagtggctgagaccagggg

SEQ ID NO: 7781904 - DNA, 23 bp, Homo sapiens
aggcagtgggggccactttgctt

SEQ ID NO: 7781905 - DNA, 22 bp, Homo sapiens
aggcagtggcttttgttgtgtt

SEQ ID NO: 7781906 - DNA, 22 bp, Homo sapiens
aggcagttggtcattgctcttt

SEQ ID NO: 7781907 - DNA, 22 bp, Homo sapiens
aggcatgtgctgtttgtctcca

SEQ ID NO: 7781908 - DNA, 22 bp, Homo sapiens
aggcatggcatggggcagatgt

SEQ ID NO: 7781909 - DNA, 22 bp, Homo sapiens
aggcatggcatggggcagatgt

SEQ ID NO: 7781910 - DNA, 22 bp, Homo sapiens
ccactggcttttcctaggtctc

SEQ ID NO: 7781911 - DNA, 19 bp, Homo sapiens
ccactggggctccacatta

SEQ ID NO: 7781912 - DNA, 22 bp, Homo sapiens
ccactggcaaccccgcctcata

SEQ ID NO: 7781913 - DNA, 22 bp, Homo sapiens
ccactggcagttggctagcctt

SEQ ID NO: 7781914 - DNA, 22 bp, Homo sapiens
ccactggcagttggctagcctt

SEQ ID NO: 7781915 - DNA, 22 bp, Homo sapiens
ccactggctgtcagcaggactc

SEQ ID NO: 7781916 - DNA, 22 bp, Homo sapiens
ccactggcatccagctgccatc

SEQ ID NO: 7781917 - DNA, 22 bp, Homo sapiens
aggccccaaagcagtgcaagta

SEQ ID NO: 7781918 - DNA, 22 bp, Homo sapiens
aggcccatgttcacttgctcag

SEQ ID NO: 7781919 - DNA, 20 bp, Homo sapiens
aggccccaggaaactctcag

SEQ ID NO: 7781920 - DNA, 22 bp, Homo sapiens
aggcccagtgtggcttcctgga

SEQ ID NO: 7781921 - DNA, 22 bp, Homo sapiens
aggcccagttatcctacttgtt

SEQ ID NO: 7781922 - DNA, 22 bp, Homo sapiens
aggcccagttatcctacttgtt

SEQ ID NO: 7781923 - DNA, 22 bp, Homo sapiens
aggcccagtgtggcttcctgga

SEQ ID NO: 7781924 - DNA, 22 bp, Homo sapiens
aggcccatgtgagtcttgtcct

SEQ ID NO: 7781925 - DNA, 22 bp, Homo sapiens
aggcccagttatcctacttgtt

SEQ ID NO: 7781926 - DNA, 22 bp, Homo sapiens
aggcccatagtagctctgggca

SEQ ID NO: 7781927 - DNA, 22 bp, Homo sapiens
aggccctgaagtcggcccctca

SEQ ID NO: 7781928 - DNA, 22 bp, Homo sapiens
aggccggcgcttcccaggaggc

SEQ ID NO: 7781929 - DNA, 22 bp, Homo sapiens
aggccctgaagtcggcccctca

SEQ ID NO: 7781930 - DNA, 22 bp, Homo sapiens
aggcccagctgggccaggaaca

SEQ ID NO: 7781931 - DNA, 22 bp, Homo sapiens
aggcccagtagtgctgccttta

SEQ ID NO: 7781932 - DNA, 22 bp, Homo sapiens
aggcccagtcctctgccgtctg

SEQ ID NO: 7781933 - DNA, 22 bp, Homo sapiens
aggcccagtagtgctgccttta

SEQ ID NO: 7781934 - DNA, 22 bp, Homo sapiens
aggcccagtgccattagttttg

SEQ ID NO: 7781935 - DNA, 20 bp, Homo sapiens
aggcccagtgaatatattgc

SEQ ID NO: 7781936 - DNA, 20 bp, Homo sapiens
aggccaggaaatgtagttct

SEQ ID NO: 7781937 - DNA, 20 bp, Homo sapiens
aggccaggaaatgtagttct

SEQ ID NO: 7781938 - DNA, 20 bp, Homo sapiens
aggccaggaaatgtagttct

SEQ ID NO: 7781939 - DNA, 22 bp, Homo sapiens
aggccaggaccattagcccaga

SEQ ID NO: 7781940 - DNA, 22 bp, Homo sapiens
aggccagctcaccctggctcct

SEQ ID NO: 7781941 - DNA, 22 bp, Homo sapiens
aggccagctgttactagagcca

SEQ ID NO: 7781942 - DNA, 22 bp, Homo sapiens
aggccaaatgtgtataaaacat

SEQ ID NO: 7781943 - DNA, 22 bp, Homo sapiens
aggccaagtagctagcattgaa

SEQ ID NO: 7781944 - DNA, 22 bp, Homo sapiens
aggccaagtagctagcattgaa

SEQ ID NO: 7781945 - DNA, 22 bp, Homo sapiens
aggccaagtgctgggacaggtg

SEQ ID NO: 7781946 - DNA, 22 bp, Homo sapiens
aggccaagtgaacaatgctagt

SEQ ID NO: 7781947 - DNA, 22 bp, Homo sapiens
aggccaagtgctgggacaggtg

SEQ ID NO: 7781948 - DNA, 17 bp, Homo sapiens
aggcctccctccaggcc

SEQ ID NO: 7781949 - DNA, 22 bp, Homo sapiens
aggcctcagtttgtcatctgta

SEQ ID NO: 7781950 - DNA, 22 bp, Homo sapiens
aggcctcatgtcaaagcagcaa

SEQ ID NO: 7781951 - DNA, 22 bp, Homo sapiens
aggcctcagctcagtgtgacag

SEQ ID NO: 7781952 - DNA, 22 bp, Homo sapiens
aggcctcagctcagtgtgacag

SEQ ID NO: 7781953 - DNA, 22 bp, Homo sapiens
aggcctcagttcttgccaggtg

SEQ ID NO: 7781954 - DNA, 22 bp, Homo sapiens
aggccgtgtgagcatgtgtgag

SEQ ID NO: 7781955 - DNA, 22 bp, Homo sapiens
ccaggcacttcatcattagggt

SEQ ID NO: 7781956 - DNA, 23 bp, Homo sapiens
ccaggcagtagctattgaagtga

SEQ ID NO: 7781957 - DNA, 22 bp, Homo sapiens
aggcctcctggctccaggcctt

SEQ ID NO: 7781958 - DNA, 22 bp, Homo sapiens
ccaggcacttcatcattagggt

SEQ ID NO: 7781959 - DNA, 22 bp, Homo sapiens
ccaggcagtggaagctaaaatt

SEQ ID NO: 7781960 - DNA, 22 bp, Homo sapiens
ccaggcagtcagggttgtgtgt

SEQ ID NO: 7781961 - DNA, 21 bp, Homo sapiens
ccaggcatgactgcagagagc

SEQ ID NO: 7781962 - DNA, 22 bp, Homo sapiens
ccaggcctagcccctgagggta

SEQ ID NO: 7781963 - DNA, 22 bp, Homo sapiens
ccaggcccgttcccttctccag

SEQ ID NO: 7781964 - DNA, 22 bp, Homo sapiens
ccaggccctgctcctcacacca

SEQ ID NO: 7781965 - DNA, 22 bp, Homo sapiens
aggctccattcatgtgaaggca

SEQ ID NO: 7781966 - DNA, 22 bp, Homo sapiens
aggctccataccatctccggag

SEQ ID NO: 7781967 - DNA, 22 bp, Homo sapiens
ccaggctctgcgctggacatgg

SEQ ID NO: 7781968 - DNA, 22 bp, Homo sapiens
ccaggctctgccaggcccttga

SEQ ID NO: 7781969 - DNA, 22 bp, Homo sapiens
ccaggctctgacatagatggga

SEQ ID NO: 7781970 - DNA, 22 bp, Homo sapiens
ccaggctctgagaggaatgtga

SEQ ID NO: 7781971 - DNA, 23 bp, Homo sapiens
aggctgagctctcccagcttcag

SEQ ID NO: 7781972 - DNA, 23 bp, Homo sapiens
ccagtgattgcctggaaggaggt

SEQ ID NO: 7781973 - DNA, 22 bp, Homo sapiens
aggctgaggcgggaggatcact

SEQ ID NO: 7781974 - DNA, 22 bp, Homo sapiens
aggctgaggcgggaggatcact

SEQ ID NO: 7781975 - DNA, 22 bp, Homo sapiens
ccagttctaaacataaagctaa

SEQ ID NO: 7781976 - DNA, 22 bp, Homo sapiens
ccagttctgagatgaatatcca

SEQ ID NO: 7781977 - DNA, 23 bp, Homo sapiens
ccagttctcctttgaacagtgac

SEQ ID NO: 7781978 - DNA, 22 bp, Homo sapiens
ccagttctttctgtgtgcaaca

SEQ ID NO: 7781979 - DNA, 22 bp, Homo sapiens
ccagtttaagacttatctcaat

SEQ ID NO: 7781980 - DNA, 22 bp, Homo sapiens
ccagtttaggacacatgcccac

SEQ ID NO: 7781981 - DNA, 22 bp, Homo sapiens
ccagtttaggtactaggctcta

SEQ ID NO: 7781982 - DNA, 23 bp, Homo sapiens
ccagtttatctttagtgtagatc

SEQ ID NO: 7781983 - DNA, 22 bp, Homo sapiens
ccagtttataagaaagaaaacc

SEQ ID NO: 7781984 - DNA, 22 bp, Homo sapiens
aggctctgatcaggtggctgtg

SEQ ID NO: 7781985 - DNA, 22 bp, Homo sapiens
aggctctgatcaggtggctgtg

SEQ ID NO: 7781986 - DNA, 22 bp, Homo sapiens
aggctctgcagtgctggaggac

SEQ ID NO: 7781987 - DNA, 22 bp, Homo sapiens
aggctctgcagtgctggaggac

SEQ ID NO: 7781988 - DNA, 22 bp, Homo sapiens
aggctctgcagtgctggaggac

SEQ ID NO: 7781989 - DNA, 22 bp, Homo sapiens
aggctctgttattctagagggc

SEQ ID NO: 7781990 - DNA, 20 bp, Homo sapiens
aggctctgcatttctgagtg

SEQ ID NO: 7781991 - DNA, 22 bp, Homo sapiens
aggctgagccacggggctggct

SEQ ID NO: 7781992 - DNA, 22 bp, Homo sapiens
agcccagcctgattctacaccc

SEQ ID NO: 7781993 - DNA, 22 bp, Homo sapiens
agcccaggaagttgaggcttgc

SEQ ID NO: 7781994 - DNA, 22 bp, Homo sapiens
agcccaggagcctttggagggt

SEQ ID NO: 7781995 - DNA, 22 bp, Homo sapiens
agcccaggagcctttggagggt

SEQ ID NO: 7781996 - DNA, 22 bp, Homo sapiens
agcccaggaggtggaggttgca

SEQ ID NO: 7781997 - DNA, 22 bp, Homo sapiens
agcccaggaggtggaggttgca

SEQ ID NO: 7781998 - DNA, 22 bp, Homo sapiens
agcccaggagtttgaggctgtg

SEQ ID NO: 7781999 - DNA, 22 bp, Homo sapiens
agcccaggagtttgaggctgtg

SEQ ID NO: 7782000 - DNA, 23 bp, Homo sapiens
cagagctggctcagagctgcctg

SEQ ID NO: 7782001 - DNA, 19 bp, Homo sapiens
agcccccagacagcaggcc

SEQ ID NO: 7782002 - DNA, 22 bp, Homo sapiens
agcccggcttccccggttgcta

SEQ ID NO: 7782003 - DNA, 22 bp, Homo sapiens
agcccggcttccccggttgcta

SEQ ID NO: 7782004 - DNA, 22 bp, Homo sapiens
agccaggggattcatcagggac

SEQ ID NO: 7782005 - DNA, 20 bp, Homo sapiens
agccagggttctggatgcac

SEQ ID NO: 7782006 - DNA, 20 bp, Homo sapiens
agccagggttctggatgcac

SEQ ID NO: 7782007 - DNA, 22 bp, Homo sapiens
agccaggtcagctcaccctgct

SEQ ID NO: 7782008 - DNA, 17 bp, Homo sapiens
agccaggtacaagtcca

SEQ ID NO: 7782009 - DNA, 22 bp, Homo sapiens
cagagagggcggccctggcttc

SEQ ID NO: 7782010 - DNA, 22 bp, Homo sapiens
cagagattattataactaatta

SEQ ID NO: 7782011 - DNA, 22 bp, Homo sapiens
cagagatgtgatccagctgtct

SEQ ID NO: 7782012 - DNA, 22 bp, Homo sapiens
cagagatgggtcgcagagatgg

SEQ ID NO: 7782013 - DNA, 22 bp, Homo sapiens
cagagatggggccagctgctcc

SEQ ID NO: 7782014 - DNA, 22 bp, Homo sapiens
cagagagtggcagttactgaag

SEQ ID NO: 7782015 - DNA, 22 bp, Homo sapiens
cactctgtgattgcagcattcc

SEQ ID NO: 7782016 - DNA, 22 bp, Homo sapiens
agccacacctgtcctgccagct

SEQ ID NO: 7782017 - DNA, 22 bp, Homo sapiens
agccaaggacacggagcctcct

SEQ ID NO: 7782018 - DNA, 22 bp, Homo sapiens
agccacagagagggagctgcaa

SEQ ID NO: 7782019 - DNA, 22 bp, Homo sapiens
agccacagagcaggagaccttt

SEQ ID NO: 7782020 - DNA, 19 bp, Homo sapiens
agccacagaacttgcagga

SEQ ID NO: 7782021 - DNA, 22 bp, Homo sapiens
cagaactggcctttcatcagtc

SEQ ID NO: 7782022 - DNA, 22 bp, Homo sapiens
agccacagcgaacctctcttcc

SEQ ID NO: 7782023 - DNA, 22 bp, Homo sapiens
agccacagcatgtgtgtatgta

SEQ ID NO: 7782024 - DNA, 23 bp, Homo sapiens
agccacagccagagctatctcca

SEQ ID NO: 7782025 - DNA, 23 bp, Homo sapiens
agccacagccagagctatctcca

SEQ ID NO: 7782026 - DNA, 22 bp, Homo sapiens
agccacagcacattgtaagaaa

SEQ ID NO: 7782027 - DNA, 22 bp, Homo sapiens
agccacagcaacaagtgcaatt

SEQ ID NO: 7782028 - DNA, 22 bp, Homo sapiens
agccacagcaacaagtgcaatt

SEQ ID NO: 7782029 - DNA, 22 bp, Homo sapiens
agccaggcagactctctttctt

SEQ ID NO: 7782030 - DNA, 22 bp, Homo sapiens
cagacagacagccgtggccacc

SEQ ID NO: 7782031 - DNA, 22 bp, Homo sapiens
agccagctgcctttcacatctg

SEQ ID NO: 7782032 - DNA, 22 bp, Homo sapiens
agccagctctgagttgaagtac

SEQ ID NO: 7782033 - DNA, 22 bp, Homo sapiens
agccagctccctcccctgcagg

SEQ ID NO: 7782034 - DNA, 17 bp, Homo sapiens
cagaaggaagcatggca

SEQ ID NO: 7782035 - DNA, 22 bp, Homo sapiens
agccaggatggtctcgatcggc

SEQ ID NO: 7782036 - DNA, 22 bp, Homo sapiens
cagaagaaatcattatctggac

SEQ ID NO: 7782037 - DNA, 22 bp, Homo sapiens
cagaagacagctgtttcactcg

SEQ ID NO: 7782038 - DNA, 22 bp, Homo sapiens
cagaagaatggtgtctgagctc

SEQ ID NO: 7782039 - DNA, 23 bp, Homo sapiens
cagaagacagtctcaagacaagg

SEQ ID NO: 7782040 - DNA, 22 bp, Homo sapiens
cagaagcctgcctcagatgcac

SEQ ID NO: 7782041 - DNA, 22 bp, Homo sapiens
cagaagctgcagtgatctggga

SEQ ID NO: 7782042 - DNA, 22 bp, Homo sapiens
cagaagcattgactccttgctc

SEQ ID NO: 7782043 - DNA, 22 bp, Homo sapiens
cagaagcctaaatagtgcacca

SEQ ID NO: 7782044 - DNA, 22 bp, Homo sapiens
cagaagcattgactccttgctc

SEQ ID NO: 7782045 - DNA, 22 bp, Homo sapiens
cagccctggctagggcgagggc

SEQ ID NO: 7782046 - DNA, 22 bp, Homo sapiens
cagccctgggagttggggccga

SEQ ID NO: 7782047 - DNA, 22 bp, Homo sapiens
cagccctgggatcttagtgcct

SEQ ID NO: 7782048 - DNA, 22 bp, Homo sapiens
agctcctgtgtgaagcctccct

SEQ ID NO: 7782049 - DNA, 22 bp, Homo sapiens
cagccagctgaatgtaccatga

SEQ ID NO: 7782050 - DNA, 22 bp, Homo sapiens
cagccagctgaatgtaccatga

SEQ ID NO: 7782051 - DNA, 22 bp, Homo sapiens
cagccagcctctcaaccatgca

SEQ ID NO: 7782052 - DNA, 22 bp, Homo sapiens
cagcaggacgtccaagtgctat

SEQ ID NO: 7782053 - DNA, 22 bp, Homo sapiens
cagcaggagcagtcagactcct

SEQ ID NO: 7782054 - DNA, 23 bp, Homo sapiens
agccttggaggttgaggctgcag

SEQ ID NO: 7782055 - DNA, 22 bp, Homo sapiens
agctcagaactgcagacatgtg

SEQ ID NO: 7782056 - DNA, 22 bp, Homo sapiens
agctcagaactgcagacatgtg

SEQ ID NO: 7782057 - DNA, 22 bp, Homo sapiens
agctcagaactgcagacatgtg

SEQ ID NO: 7782058 - DNA, 22 bp, Homo sapiens
agctcaccacaacctccgcctc

SEQ ID NO: 7782059 - DNA, 22 bp, Homo sapiens
agctcagaaatgccagtaggta

SEQ ID NO: 7782060 - DNA, 22 bp, Homo sapiens
cagcaggaggtgagtagcaggt

SEQ ID NO: 7782061 - DNA, 22 bp, Homo sapiens
agccctccatctgtgctcaggc

SEQ ID NO: 7782062 - DNA, 22 bp, Homo sapiens
cagaggcctttctacagtgata

SEQ ID NO: 7782063 - DNA, 22 bp, Homo sapiens
cagaggctaagatgagtgggtg

SEQ ID NO: 7782064 - DNA, 21 bp, Homo sapiens
agcctcaggttgttggttctt

SEQ ID NO: 7782065 - DNA, 22 bp, Homo sapiens
agcctcagcacgcagctctgtg

SEQ ID NO: 7782066 - DNA, 22 bp, Homo sapiens
cagcacaggcccctctctccca

SEQ ID NO: 7782067 - DNA, 22 bp, Homo sapiens
cagcagcagcttagtggtcccc

SEQ ID NO: 7782068 - DNA, 22 bp, Homo sapiens
cagcagcagccccaggaaggtt

SEQ ID NO: 7782069 - DNA, 22 bp, Homo sapiens
cagcagcagtggctgcagaaca

SEQ ID NO: 7782070 - DNA, 22 bp, Homo sapiens
cagcagcatgaattcgagccac

SEQ ID NO: 7782071 - DNA, 22 bp, Homo sapiens
cagcagcatcaggtctgtggtt

SEQ ID NO: 7782072 - DNA, 22 bp, Homo sapiens
cagcagaggcacgtctgtgaat

SEQ ID NO: 7782073 - DNA, 22 bp, Homo sapiens
agcctcagtgtcaccatctacc

SEQ ID NO: 7782074 - DNA, 22 bp, Homo sapiens
agcctccaaatgtcaggtcccg

SEQ ID NO: 7782075 - DNA, 22 bp, Homo sapiens
agcctccatctcccatctgtga

SEQ ID NO: 7782076 - DNA, 22 bp, Homo sapiens
cacatcatgttaattcattaca

SEQ ID NO: 7782077 - DNA, 22 bp, Homo sapiens
cacatcatagagactcaatcca

SEQ ID NO: 7782078 - DNA, 22 bp, Homo sapiens
cacatcaagcatccatgagttt

SEQ ID NO: 7782079 - DNA, 22 bp, Homo sapiens
cacatccgaggagggtgagatg

SEQ ID NO: 7782080 - DNA, 22 bp, Homo sapiens
cacatcttcttaactccaaagt

SEQ ID NO: 7782081 - DNA, 22 bp, Homo sapiens
cacatctgacttccagtgcagg

SEQ ID NO: 7782082 - DNA, 22 bp, Homo sapiens
agcagggcctctggcactggtc

SEQ ID NO: 7782083 - DNA, 22 bp, Homo sapiens
agcagggcagtgcttcagctct

SEQ ID NO: 7782084 - DNA, 22 bp, Homo sapiens
cacagtcacatatctatgtgtg

SEQ ID NO: 7782085 - DNA, 22 bp, Homo sapiens
cacagtatttgtttttctgagt

SEQ ID NO: 7782086 - DNA, 22 bp, Homo sapiens
agcagggctcctgaaagccgcg

SEQ ID NO: 7782087 - DNA, 22 bp, Homo sapiens
agcagggctcctgaaagccgcg

SEQ ID NO: 7782088 - DNA, 22 bp, Homo sapiens
agcagggctctgccatgggccc

SEQ ID NO: 7782089 - DNA, 22 bp, Homo sapiens
agcagggctccatttcactgcc

SEQ ID NO: 7782090 - DNA, 16 bp, Homo sapiens
agcagggcgggaagga

SEQ ID NO: 7782091 - DNA, 22 bp, Homo sapiens
cactctgcagctgaagggctgg

SEQ ID NO: 7782092 - DNA, 22 bp, Homo sapiens
caccagggctctgagctctgaa

SEQ ID NO: 7782093 - DNA, 22 bp, Homo sapiens
caccagggcagcagcctagtct

SEQ ID NO: 7782094 - DNA, 21 bp, Homo sapiens
agcaggtgctgttggaggaaa

SEQ ID NO: 7782095 - DNA, 22 bp, Homo sapiens
caccagggacaatgctaggggt

SEQ ID NO: 7782096 - DNA, 22 bp, Homo sapiens
cacagggctaaatgaagggttg

SEQ ID NO: 7782097 - DNA, 22 bp, Homo sapiens
cacagggctaaatgaagggttg

SEQ ID NO: 7782098 - DNA, 22 bp, Homo sapiens
cacagggcttctcatggggtgc

SEQ ID NO: 7782099 - DNA, 22 bp, Homo sapiens
cacagggcagtgctgcccactc

SEQ ID NO: 7782100 - DNA, 22 bp, Homo sapiens
cacagggcctggggcagctgct

SEQ ID NO: 7782101 - DNA, 22 bp, Homo sapiens
cacaggctgcccgcagctggga

SEQ ID NO: 7782102 - DNA, 22 bp, Homo sapiens
agcaggagaacactgtggctct

SEQ ID NO: 7782103 - DNA, 22 bp, Homo sapiens
agcaggagaacactgtggctct

SEQ ID NO: 7782104 - DNA, 22 bp, Homo sapiens
cacaggagggagcgggcagcca

SEQ ID NO: 7782105 - DNA, 22 bp, Homo sapiens
cacaggaggaggccagagcgta

SEQ ID NO: 7782106 - DNA, 22 bp, Homo sapiens
cacaggaggaggtgcccgggcc

SEQ ID NO: 7782107 - DNA, 22 bp, Homo sapiens
agcaggagagcagtgcgtggtc

SEQ ID NO: 7782108 - DNA, 22 bp, Homo sapiens
agcagctgggctcagagctggg

SEQ ID NO: 7782109 - DNA, 22 bp, Homo sapiens
agcagctgtcccttaacatcag

SEQ ID NO: 7782110 - DNA, 22 bp, Homo sapiens
cacaggagccctgaggcctccc

SEQ ID NO: 7782111 - DNA, 22 bp, Homo sapiens
cacaggaggaggccagagcgta

SEQ ID NO: 7782112 - DNA, 22 bp, Homo sapiens
cacaggagctgtggggcagtgt

SEQ ID NO: 7782113 - DNA, 22 bp, Homo sapiens
agcagcttctttcactcctgga

SEQ ID NO: 7782114 - DNA, 22 bp, Homo sapiens
agcagcttcctgtttgcaggca

SEQ ID NO: 7782115 - DNA, 22 bp, Homo sapiens
agcagcttcctgctcttcgcct

SEQ ID NO: 7782116 - DNA, 22 bp, Homo sapiens
agcagcttagggaattctccct

SEQ ID NO: 7782117 - DNA, 22 bp, Homo sapiens
agcagcttatcttggagaggca

SEQ ID NO: 7782118 - DNA, 19 bp, Homo sapiens
agcagcttaattttgtagc

SEQ ID NO: 7782119 - DNA, 17 bp, Homo sapiens
agcagaagtcagaggga

SEQ ID NO: 7782120 - DNA, 22 bp, Homo sapiens
caaatgttttttagtataagta

SEQ ID NO: 7782121 - DNA, 22 bp, Homo sapiens
caaatgtttttattctacaaca

SEQ ID NO: 7782122 - DNA, 22 bp, Homo sapiens
caaatgttaagacaggatcaag

SEQ ID NO: 7782123 - DNA, 22 bp, Homo sapiens
caaatgtttcttatctattgtt

SEQ ID NO: 7782124 - DNA, 22 bp, Homo sapiens
caaatgttaaatgtgttaagac

SEQ ID NO: 7782125 - DNA, 22 bp, Homo sapiens
caaatgcaaaatataaccctgt

SEQ ID NO: 7782126 - DNA, 23 bp, Homo sapiens
agcacagactagaaaggtctttc

SEQ ID NO: 7782127 - DNA, 23 bp, Homo sapiens
agcacagactagaaaggtctttc

SEQ ID NO: 7782128 - DNA, 19 bp, Homo sapiens
agcacagacaagaccagca

SEQ ID NO: 7782129 - DNA, 22 bp, Homo sapiens
agcacagactggtcccaggtct

SEQ ID NO: 7782130 - DNA, 21 bp, Homo sapiens
agcaatttttcctcctctgca

SEQ ID NO: 7782131 - DNA, 22 bp, Homo sapiens
attttctatgttgtaattgtta

SEQ ID NO: 7782132 - DNA, 22 bp, Homo sapiens
attttctatgttgtaattgtta

SEQ ID NO: 7782133 - DNA, 22 bp, Homo sapiens
attttctattctgctggtttag

SEQ ID NO: 7782134 - DNA, 22 bp, Homo sapiens
attttctatgttgtaattgtta

SEQ ID NO: 7782135 - DNA, 22 bp, Homo sapiens
attttctcacaatgcagaagga

SEQ ID NO: 7782136 - DNA, 22 bp, Homo sapiens
attttctctttgtatatgctag

SEQ ID NO: 7782137 - DNA, 21 bp, Homo sapiens
attttctctggatgatggtca

SEQ ID NO: 7782138 - DNA, 22 bp, Homo sapiens
attttctctttgtatatgctag

SEQ ID NO: 7782139 - DNA, 22 bp, Homo sapiens
agcacagatttgtcaacataga

SEQ ID NO: 7782140 - DNA, 22 bp, Homo sapiens
agcacagattctgaagagtcct

SEQ ID NO: 7782141 - DNA, 22 bp, Homo sapiens
agcacagattctgaagagtcct

SEQ ID NO: 7782142 - DNA, 22 bp, Homo sapiens
agcacagataacatggagtgga

SEQ ID NO: 7782143 - DNA, 22 bp, Homo sapiens
agcacagatgcatgatcaccag

SEQ ID NO: 7782144 - DNA, 22 bp, Homo sapiens
agcacagagttgcagagagcgt

SEQ ID NO: 7782145 - DNA, 22 bp, Homo sapiens
agcacagaggtggaagtgtata

SEQ ID NO: 7782146 - DNA, 22 bp, Homo sapiens
caatgaaattgagatccagaga

SEQ ID NO: 7782147 - DNA, 22 bp, Homo sapiens
agcagcaggtgacctcgatgcc

SEQ ID NO: 7782148 - DNA, 22 bp, Homo sapiens
agcagcagggtgtaattgggca

SEQ ID NO: 7782149 - DNA, 22 bp, Homo sapiens
caaggcaggtctgaggaggttg

SEQ ID NO: 7782150 - DNA, 22 bp, Homo sapiens
caaggcaggccagtttcaaggc

SEQ ID NO: 7782151 - DNA, 22 bp, Homo sapiens
caaggcagttccccagagggct

SEQ ID NO: 7782152 - DNA, 22 bp, Homo sapiens
caaggcagttccccagagggct

SEQ ID NO: 7782153 - DNA, 22 bp, Homo sapiens
caaggcagtgggctaggaacct

SEQ ID NO: 7782154 - DNA, 22 bp, Homo sapiens
caaggcagtccctactccctgc

SEQ ID NO: 7782155 - DNA, 22 bp, Homo sapiens
agcagcacacgggagaaagaca

SEQ ID NO: 7782156 - DNA, 22 bp, Homo sapiens
agcagagtgtgaaggcagggct

SEQ ID NO: 7782157 - DNA, 22 bp, Homo sapiens
agcagcacgagtccacaaatcc

SEQ ID NO: 7782158 - DNA, 22 bp, Homo sapiens
agcagcacctgtcctcgctgct

SEQ ID NO: 7782159 - DNA, 22 bp, Homo sapiens
agcagcacccagagccatgtct

SEQ ID NO: 7782160 - DNA, 22 bp, Homo sapiens
caaggcaggcagttcacttgag

SEQ ID NO: 7782161 - DNA, 22 bp, Homo sapiens
caaggcaggaagcctgtcttat

SEQ ID NO: 7782162 - DNA, 22 bp, Homo sapiens
caactatatagaaattgattgt

SEQ ID NO: 7782163 - DNA, 18 bp, Homo sapiens
agcagaattctagggttc

SEQ ID NO: 7782164 - DNA, 22 bp, Homo sapiens
agcagaagtgccttagcaatca

SEQ ID NO: 7782165 - DNA, 22 bp, Homo sapiens
caactgcttggaggaatactgc

SEQ ID NO: 7782166 - DNA, 22 bp, Homo sapiens
agacacagtgagtttctttccc

SEQ ID NO: 7782167 - DNA, 22 bp, Homo sapiens
agacacaggattctgcatttct

SEQ ID NO: 7782168 - DNA, 22 bp, Homo sapiens
agacacaggtgtaatttctgct

SEQ ID NO: 7782169 - DNA, 22 bp, Homo sapiens
agacagtgataccttgggatgt

SEQ ID NO: 7782170 - DNA, 22 bp, Homo sapiens
atgcaggcagacactgtgggca

SEQ ID NO: 7782171 - DNA, 22 bp, Homo sapiens
agaatgattttggacaatatgg

SEQ ID NO: 7782172 - DNA, 22 bp, Homo sapiens
agacaatacatttattcccttt

SEQ ID NO: 7782173 - DNA, 22 bp, Homo sapiens
agaattctgacaatagaattgg

SEQ ID NO: 7782174 - DNA, 21 bp, Homo sapiens
agaattcttaagtattctaat

SEQ ID NO: 7782175 - DNA, 22 bp, Homo sapiens
agaattacataaatacatgaat

SEQ ID NO: 7782176 - DNA, 18 bp, Homo sapiens
agaattaccaaagtgctt

SEQ ID NO: 7782177 - DNA, 22 bp, Homo sapiens
agaattacagcttttagaatag

SEQ ID NO: 7782178 - DNA, 21 bp, Homo sapiens
agaattaaattggatttgtgt

SEQ ID NO: 7782179 - DNA, 22 bp, Homo sapiens
agacaatttcaaagtaatatta

SEQ ID NO: 7782180 - DNA, 22 bp, Homo sapiens
agacaatatataattttagttg

SEQ ID NO: 7782181 - DNA, 19 bp, Homo sapiens
agacacacttacgtggaat

SEQ ID NO: 7782182 - DNA, 22 bp, Homo sapiens
agaatcactggaattgtttttt

SEQ ID NO: 7782183 - DNA, 22 bp, Homo sapiens
atctttggtgcttggtgctccc

SEQ ID NO: 7782184 - DNA, 22 bp, Homo sapiens
atctttggtgcttggtgctccc

SEQ ID NO: 7782185 - DNA, 22 bp, Homo sapiens
atctttggtgcatgatactttg

SEQ ID NO: 7782186 - DNA, 22 bp, Homo sapiens
atctttggtgcatgatactttg

SEQ ID NO: 7782187 - DNA, 22 bp, Homo sapiens
atctttggtcttgagtgcatct

SEQ ID NO: 7782188 - DNA, 22 bp, Homo sapiens
atctttggtcttgagtgcatct

SEQ ID NO: 7782189 - DNA, 22 bp, Homo sapiens
atctttggtactattcttatca

SEQ ID NO: 7782190 - DNA, 19 bp, Homo sapiens
atctttgggtcctgaaggg

SEQ ID NO: 7782191 - DNA, 22 bp, Homo sapiens
atctttggtactattcttatca

SEQ ID NO: 7782192 - DNA, 22 bp, Homo sapiens
atctttgggtacaaacttgcct

SEQ ID NO: 7782193 - DNA, 22 bp, Homo sapiens
atctttggggcatccaggaaaa

SEQ ID NO: 7782194 - DNA, 19 bp, Homo sapiens
atctttgggtcctgaaggg

SEQ ID NO: 7782195 - DNA, 22 bp, Homo sapiens
atctttggggcatccaggaaaa

SEQ ID NO: 7782196 - DNA, 22 bp, Homo sapiens
atctttgggtacaaacttgcct

SEQ ID NO: 7782197 - DNA, 19 bp, Homo sapiens
atctttgggtcctgaaggg

SEQ ID NO: 7782198 - DNA, 22 bp, Homo sapiens
agaatacttgggaatgggttaa

SEQ ID NO: 7782199 - DNA, 22 bp, Homo sapiens
agaatacagtatgcaaaaagat

SEQ ID NO: 7782200 - DNA, 21 bp, Homo sapiens
agaataatggtatcatttgct

SEQ ID NO: 7782201 - DNA, 22 bp, Homo sapiens
agaagtttgttatgtaaacaaa

SEQ ID NO: 7782202 - DNA, 22 bp, Homo sapiens
agaaggctgagactgggatgaa

SEQ ID NO: 7782203 - DNA, 22 bp, Homo sapiens
agaaggctgaagaagatccgtt

SEQ ID NO: 7782204 - DNA, 19 bp, Homo sapiens
agaaggctcctgttggaga

SEQ ID NO: 7782205 - DNA, 22 bp, Homo sapiens
agaaggctcatttgactgcatt

SEQ ID NO: 7782206 - DNA, 22 bp, Homo sapiens
agaaggctggccatggtgccct

SEQ ID NO: 7782207 - DNA, 22 bp, Homo sapiens
agaaggctgagactgggatgaa

SEQ ID NO: 7782208 - DNA, 22 bp, Homo sapiens
agaaggctggccatggtgccct

SEQ ID NO: 7782209 - DNA, 22 bp, Homo sapiens
agaaggccaatagggtgcactg

SEQ ID NO: 7782210 - DNA, 22 bp, Homo sapiens
agaaggccagatggacggggct

SEQ ID NO: 7782211 - DNA, 22 bp, Homo sapiens
agaaggccaagaagaagcctat

SEQ ID NO: 7782212 - DNA, 22 bp, Homo sapiens
agaaggctcactaagagtgact

SEQ ID NO: 7782213 - DNA, 22 bp, Homo sapiens
agaaggctaaagaaacagattg

SEQ ID NO: 7782214 - DNA, 22 bp, Homo sapiens
agaaggcctaacttgggggcaa

SEQ ID NO: 7782215 - DNA, 22 bp, Homo sapiens
agaagcacacctgacctctagc

SEQ ID NO: 7782216 - DNA, 22 bp, Homo sapiens
agaagcaaggtctgtcagtata

SEQ ID NO: 7782217 - DNA, 22 bp, Homo sapiens
agaagaatacttgatgttcatg

SEQ ID NO: 7782218 - DNA, 22 bp, Homo sapiens
agaagaatacttgatgttcatg

SEQ ID NO: 7782219 - DNA, 22 bp, Homo sapiens
agaagagaactgccaaacactt

SEQ ID NO: 7782220 - DNA, 22 bp, Homo sapiens
agaagaatttctctcatgattt

SEQ ID NO: 7782221 - DNA, 20 bp, Homo sapiens
agaagaggatacaaccaggc

SEQ ID NO: 7782222 - DNA, 20 bp, Homo sapiens
agaagaggatacaaccaggc

SEQ ID NO: 7782223 - DNA, 22 bp, Homo sapiens
atggagttctgccagcgctgct

SEQ ID NO: 7782224 - DNA, 22 bp, Homo sapiens
atggagtgtcaccttcctggtt

SEQ ID NO: 7782225 - DNA, 22 bp, Homo sapiens
atggagtggtacttacttggct

SEQ ID NO: 7782226 - DNA, 22 bp, Homo sapiens
atggagtgcctgtggcagtggg

SEQ ID NO: 7782227 - DNA, 22 bp, Homo sapiens
atggagtctacaaagtgttgga

SEQ ID NO: 7782228 - DNA, 21 bp, Homo sapiens
atggctggtggctcagcctcc

SEQ ID NO: 7782229 - DNA, 22 bp, Homo sapiens
atggcagcatagtggcaagtta

SEQ ID NO: 7782230 - DNA, 19 bp, Homo sapiens
atggaaaattgtactcaat

SEQ ID NO: 7782231 - DNA, 22 bp, Homo sapiens
atgggaggcaaagatcgcagaa

SEQ ID NO: 7782232 - DNA, 23 bp, Homo sapiens
atgtaaacttcagagtcattgcc

SEQ ID NO: 7782233 - DNA, 22 bp, Homo sapiens
atgtctgttttcatatcagata

SEQ ID NO: 7782234 - DNA, 22 bp, Homo sapiens
atgtctgttcattattaactgc

SEQ ID NO: 7782235 - DNA, 19 bp, Homo sapiens
atgtctgttgaatttcata

SEQ ID NO: 7782236 - DNA, 22 bp, Homo sapiens
atgtctgtggcaattgttgatg

SEQ ID NO: 7782237 - DNA, 22 bp, Homo sapiens
atgtctgtctttgtactccaca

SEQ ID NO: 7782238 - DNA, 22 bp, Homo sapiens
atgtctgtggcattatatgttt

SEQ ID NO: 7782239 - DNA, 20 bp, Homo sapiens
atgtccagtgactggaccat

SEQ ID NO: 7782240 - DNA, 22 bp, Homo sapiens
atgtctgtacgagttacaatgg

SEQ ID NO: 7782241 - DNA, 22 bp, Homo sapiens
atgtccaatttcagagtctcat

SEQ ID NO: 7782242 - DNA, 23 bp, Homo sapiens
atttaatgctgagttgaatgtta

SEQ ID NO: 7782243 - DNA, 22 bp, Homo sapiens
agagtggcccgttggcctgaac

SEQ ID NO: 7782244 - DNA, 22 bp, Homo sapiens
atttaatgggtagacattgtta

SEQ ID NO: 7782245 - DNA, 23 bp, Homo sapiens
agagtggcctactcacactcatt

SEQ ID NO: 7782246 - DNA, 22 bp, Homo sapiens
atttaagattgcgtattcatgt

SEQ ID NO: 7782247 - DNA, 22 bp, Homo sapiens
atttaagactgacttcaccagt

SEQ ID NO: 7782248 - DNA, 22 bp, Homo sapiens
atttaagaggctgctagagtat

SEQ ID NO: 7782249 - DNA, 22 bp, Homo sapiens
attcttcatttactgttacttg

SEQ ID NO: 7782250 - DNA, 22 bp, Homo sapiens
attcttcatgttgaagctgtca

SEQ ID NO: 7782251 - DNA, 23 bp, Homo sapiens
attcttcattatcttctagaaaa

SEQ ID NO: 7782252 - DNA, 22 bp, Homo sapiens
atttattctccagatggcgaga

SEQ ID NO: 7782253 - DNA, 22 bp, Homo sapiens
atttattattgtggttacttct

SEQ ID NO: 7782254 - DNA, 22 bp, Homo sapiens
atttattatgggatttggctca

SEQ ID NO: 7782255 - DNA, 22 bp, Homo sapiens
atttagtagagaaattaagaaa

SEQ ID NO: 7782256 - DNA, 17 bp, Homo sapiens
atttagcaagtagacag

SEQ ID NO: 7782257 - DNA, 22 bp, Homo sapiens
atttagcaagagtacaaaataa

SEQ ID NO: 7782258 - DNA, 22 bp, Homo sapiens
agagtggcttctttgacatgct

SEQ ID NO: 7782259 - DNA, 22 bp, Homo sapiens
agagtggcttgctcagctagca

SEQ ID NO: 7782260 - DNA, 22 bp, Homo sapiens
agagtggggaaggtgttgagaa

SEQ ID NO: 7782261 - DNA, 23 bp, Homo sapiens
agatgaaagcttcccatcacagt

SEQ ID NO: 7782262 - DNA, 23 bp, Homo sapiens
agatgaaagcttcccatcacagt

SEQ ID NO: 7782263 - DNA, 22 bp, Homo sapiens
agatgaagactcaggagcaggt

SEQ ID NO: 7782264 - DNA, 22 bp, Homo sapiens
agatgaaaagataagcagcaat

SEQ ID NO: 7782265 - DNA, 22 bp, Homo sapiens
agatgaaaagataagcagcaat

SEQ ID NO: 7782266 - DNA, 18 bp, Homo sapiens
agatgaaagcaaatgaca

SEQ ID NO: 7782267 - DNA, 18 bp, Homo sapiens
agatgaaagcaaatgaca

SEQ ID NO: 7782268 - DNA, 18 bp, Homo sapiens
agatgaaagcaaatgaca

SEQ ID NO: 7782269 - DNA, 22 bp, Homo sapiens
agatgaaagatttttatagaga

SEQ ID NO: 7782270 - DNA, 22 bp, Homo sapiens
agatgaaaatacgtgactttaa

SEQ ID NO: 7782271 - DNA, 22 bp, Homo sapiens
agatgaaaatacgtgactttaa

SEQ ID NO: 7782272 - DNA, 21 bp, Homo sapiens
atttccaagggtacctaagat

SEQ ID NO: 7782273 - DNA, 21 bp, Homo sapiens
atttccaagggtacctaagat

SEQ ID NO: 7782274 - DNA, 22 bp, Homo sapiens
agatggtggactatctgacttg

SEQ ID NO: 7782275 - DNA, 22 bp, Homo sapiens
agatgggcgcgctgctctgatg

SEQ ID NO: 7782276 - DNA, 22 bp, Homo sapiens
agcaaaataaggtaatttattg

SEQ ID NO: 7782277 - DNA, 22 bp, Homo sapiens
agcaaacagtgtgctaagaaat

SEQ ID NO: 7782278 - DNA, 22 bp, Homo sapiens
agcaaacagtgtgctaagaaat

SEQ ID NO: 7782279 - DNA, 22 bp, Homo sapiens
atttgctttaaggtataaaagg

SEQ ID NO: 7782280 - DNA, 22 bp, Homo sapiens
atttgctttcaggtataaaagg

SEQ ID NO: 7782281 - DNA, 22 bp, Homo sapiens
agagggtgggcacgtgatggat

SEQ ID NO: 7782282 - DNA, 22 bp, Homo sapiens
agagggagtgaaatggaataga

SEQ ID NO: 7782283 - DNA, 22 bp, Homo sapiens
agagggagcccagtcatagctg

SEQ ID NO: 7782284 - DNA, 23 bp, Homo sapiens
agagggagatgtttttctcaaga

SEQ ID NO: 7782285 - DNA, 22 bp, Homo sapiens
agagggagctttatttttctgt

SEQ ID NO: 7782286 - DNA, 21 bp, Homo sapiens
agagggagagtggcccttcca

SEQ ID NO: 7782287 - DNA, 22 bp, Homo sapiens
attctggacaaggcaagctcct

SEQ ID NO: 7782288 - DNA, 22 bp, Homo sapiens
attcacagttcattagctgtaa

SEQ ID NO: 7782289 - DNA, 22 bp, Homo sapiens
attcacagttactgctgaacca

SEQ ID NO: 7782290 - DNA, 22 bp, Homo sapiens
attcagcagttcctgcttcagt

SEQ ID NO: 7782291 - DNA, 22 bp, Homo sapiens
attcagcataatcagtagcttg

SEQ ID NO: 7782292 - DNA, 22 bp, Homo sapiens
attcagcagttcctgcttcagt

SEQ ID NO: 7782293 - DNA, 22 bp, Homo sapiens
attcagcattcatttccaactt

SEQ ID NO: 7782294 - DNA, 22 bp, Homo sapiens
attcacactgtatacacaggat

SEQ ID NO: 7782295 - DNA, 22 bp, Homo sapiens
attcacacacatttagagcaga

SEQ ID NO: 7782296 - DNA, 22 bp, Homo sapiens
attcacacacatttagagcaga

SEQ ID NO: 7782297 - DNA, 22 bp, Homo sapiens
attatacattttgtgtagagat

SEQ ID NO: 7782298 - DNA, 22 bp, Homo sapiens
attatacattttgtgtagagat

SEQ ID NO: 7782299 - DNA, 22 bp, Homo sapiens
attataaatattttctaggggt

SEQ ID NO: 7782300 - DNA, 22 bp, Homo sapiens
attataaacctttgagggtggg

SEQ ID NO: 7782301 - DNA, 22 bp, Homo sapiens
attataaagaacatgtgtgtgg

SEQ ID NO: 7782302 - DNA, 22 bp, Homo sapiens
attataaagaacatgtgtgtgg

SEQ ID NO: 7782303 - DNA, 22 bp, Homo sapiens
attaaagaaacccagcatgtga

SEQ ID NO: 7782304 - DNA, 22 bp, Homo sapiens
atgttttaccctttgcacaaac

SEQ ID NO: 7782305 - DNA, 22 bp, Homo sapiens
attaaacaatgtaaagttcttg

SEQ ID NO: 7782306 - DNA, 22 bp, Homo sapiens
atgtttgttgaacatctactgc

SEQ ID NO: 7782307 - DNA, 22 bp, Homo sapiens
atgtttgtgtttcccattcagg

SEQ ID NO: 7782308 - DNA, 22 bp, Homo sapiens
atgttttaaatatgtgtgtaaa

SEQ ID NO: 7782309 - DNA, 22 bp, Homo sapiens
atgtttgtgttacactctgcag

SEQ ID NO: 7782310 - DNA, 22 bp, Homo sapiens
attataaacctttgagggtggg

SEQ ID NO: 7782311 - DNA, 22 bp, Homo sapiens
attaaatactgcaggctaagca

SEQ ID NO: 7782312 - DNA, 22 bp, Homo sapiens
attacagtaacagctacaatgc

SEQ ID NO: 7782313 - DNA, 22 bp, Homo sapiens
atgtgtcttggagttttaatgt

SEQ ID NO: 7782314 - DNA, 22 bp, Homo sapiens
atgttaaatggtttattattaa

SEQ ID NO: 7782315 - DNA, 17 bp, Homo sapiens
atgttaatttcacattt

SEQ ID NO: 7782316 - DNA, 22 bp, Homo sapiens
atgtttctgagtgtatatacat

SEQ ID NO: 7782317 - DNA, 22 bp, Homo sapiens
atgtttctgtcctacgagataa

SEQ ID NO: 7782318 - DNA, 22 bp, Homo sapiens
atgtttgcattcttattatcgt

SEQ ID NO: 7782319 - DNA, 22 bp, Homo sapiens
aggcaggggagctggaagggta

SEQ ID NO: 7782320 - DNA, 22 bp, Homo sapiens
aggcagggctgggattagactc

SEQ ID NO: 7782321 - DNA, 22 bp, Homo sapiens
aggcagggctcatttcttaggc

SEQ ID NO: 7782322 - DNA, 23 bp, Homo sapiens
aggcaggcagttcagctgttgtt

SEQ ID NO: 7782323 - DNA, 23 bp, Homo sapiens
aggcaggcagttcagctgttgtt

SEQ ID NO: 7782324 - DNA, 22 bp, Homo sapiens
aggcagggaccagttgttttct

SEQ ID NO: 7782325 - DNA, 22 bp, Homo sapiens
aggcagggaccagttgttttct

SEQ ID NO: 7782326 - DNA, 22 bp, Homo sapiens
aggcaggcagctgtcaccactc

SEQ ID NO: 7782327 - DNA, 22 bp, Homo sapiens
acatgagatttgggtggtgata

SEQ ID NO: 7782328 - DNA, 22 bp, Homo sapiens
acatgagaggctgtggagtaca

SEQ ID NO: 7782329 - DNA, 23 bp, Homo sapiens
acatgatacacaattagcaaacc

SEQ ID NO: 7782330 - DNA, 22 bp, Homo sapiens
acatgcaatattgagactttct

SEQ ID NO: 7782331 - DNA, 19 bp, Homo sapiens
acatgcaaggcacctgcag

SEQ ID NO: 7782332 - DNA, 22 bp, Homo sapiens
acatgcaagcccctgaacacat

SEQ ID NO: 7782333 - DNA, 22 bp, Homo sapiens
acatgcaagcagccgtgcagat

SEQ ID NO: 7782334 - DNA, 23 bp, Homo sapiens
acatgcaaaaatcacagtctcct

SEQ ID NO: 7782335 - DNA, 22 bp, Homo sapiens
acatgcaaaaatatatttatga

SEQ ID NO: 7782336 - DNA, 22 bp, Homo sapiens
acatgcaactaaagggtgccac

SEQ ID NO: 7782337 - DNA, 22 bp, Homo sapiens
acatgcaactaaagggtgccac

SEQ ID NO: 7782338 - DNA, 22 bp, Homo sapiens
acatgcaacaaagtacctgcaa

SEQ ID NO: 7782339 - DNA, 22 bp, Homo sapiens
acatgcaaagggatgcaattat

SEQ ID NO: 7782340 - DNA, 22 bp, Homo sapiens
acatgcaaatgtgcatgcatgt

SEQ ID NO: 7782341 - DNA, 22 bp, Homo sapiens
acatgcaaagccacaggacccg

SEQ ID NO: 7782342 - DNA, 22 bp, Homo sapiens
acatgcaaagccacaggacccg

SEQ ID NO: 7782343 - DNA, 22 bp, Homo sapiens
acatggcattcactcccacagg

SEQ ID NO: 7782344 - DNA, 22 bp, Homo sapiens
acatggcaggaatcatgtgttt

SEQ ID NO: 7782345 - DNA, 22 bp, Homo sapiens
acatggcagctgatgattggaa

SEQ ID NO: 7782346 - DNA, 22 bp, Homo sapiens
acatggcacccagatctcaaaa

SEQ ID NO: 7782347 - DNA, 22 bp, Homo sapiens
acatggaatgtgtactaagtta

SEQ ID NO: 7782348 - DNA, 22 bp, Homo sapiens
acatggaaagtactccacaatt

SEQ ID NO: 7782349 - DNA, 22 bp, Homo sapiens
acatgcataaactacttcttat

SEQ ID NO: 7782350 - DNA, 22 bp, Homo sapiens
aggccctgttatgagccactgt

SEQ ID NO: 7782351 - DNA, 22 bp, Homo sapiens
aggccctgtccatggtgctgaa

SEQ ID NO: 7782352 - DNA, 22 bp, Homo sapiens
aggccctggtcaggtctggctg

SEQ ID NO: 7782353 - DNA, 22 bp, Homo sapiens
aggccctgtaaggtgtggagat

SEQ ID NO: 7782354 - DNA, 22 bp, Homo sapiens
aggcgcctgcgggatccttgcc

SEQ ID NO: 7782355 - DNA, 22 bp, Homo sapiens
aggctagctgattgccttagaa

SEQ ID NO: 7782356 - DNA, 22 bp, Homo sapiens
aggcgagaggcttgggctagta

SEQ ID NO: 7782357 - DNA, 22 bp, Homo sapiens
aggcctgcctggatcacacaga

SEQ ID NO: 7782358 - DNA, 22 bp, Homo sapiens
aggcctgcctggatcacacaga

SEQ ID NO: 7782359 - DNA, 22 bp, Homo sapiens
aggcctgtttccttgggttgct

SEQ ID NO: 7782360 - DNA, 22 bp, Homo sapiens
aggccttaccatagctgtagca

SEQ ID NO: 7782361 - DNA, 22 bp, Homo sapiens
aggctagggtaacagatgtggc

SEQ ID NO: 7782362 - DNA, 22 bp, Homo sapiens
aggctaggggcagtgccagcat

SEQ ID NO: 7782363 - DNA, 22 bp, Homo sapiens
aggctaggggcagtgccagcat

SEQ ID NO: 7782364 - DNA, 22 bp, Homo sapiens
aggctatttccactcttctcat

SEQ ID NO: 7782365 - DNA, 22 bp, Homo sapiens
acattgtatacagacttagtca

SEQ ID NO: 7782366 - DNA, 22 bp, Homo sapiens
aggctagggccatggctggtga

SEQ ID NO: 7782367 - DNA, 22 bp, Homo sapiens
aggctaggctgatgcctcttcc

SEQ ID NO: 7782368 - DNA, 22 bp, Homo sapiens
aggctaggggaacactagaatc

SEQ ID NO: 7782369 - DNA, 22 bp, Homo sapiens
aggctaggcatgtgctaccaca

SEQ ID NO: 7782370 - DNA, 22 bp, Homo sapiens
aggctaggccttgccctggaac

SEQ ID NO: 7782371 - DNA, 22 bp, Homo sapiens
aggctaggaatcaagcctttct

SEQ ID NO: 7782372 - DNA, 22 bp, Homo sapiens
aggctaggcatgtgctaccaca

SEQ ID NO: 7782373 - DNA, 22 bp, Homo sapiens
aggctaggaacagcccggccct

SEQ ID NO: 7782374 - DNA, 19 bp, Homo sapiens
acatttaaattcagatctc

SEQ ID NO: 7782375 - DNA, 22 bp, Homo sapiens
acatttaaccaaactgtttaat

SEQ ID NO: 7782376 - DNA, 22 bp, Homo sapiens
acatttaaccaaactgtttaat

SEQ ID NO: 7782377 - DNA, 22 bp, Homo sapiens
aggctgagtgctcccctagatg

SEQ ID NO: 7782378 - DNA, 22 bp, Homo sapiens
aggctgagtttctcattctcgc

SEQ ID NO: 7782379 - DNA, 22 bp, Homo sapiens
aggctgagggctcctgagggca

SEQ ID NO: 7782380 - DNA, 22 bp, Homo sapiens
aggctgaggctttccttggaga

SEQ ID NO: 7782381 - DNA, 22 bp, Homo sapiens
acatttatataactcactagga

SEQ ID NO: 7782382 - DNA, 22 bp, Homo sapiens
acatttatataactcactagga

SEQ ID NO: 7782383 - DNA, 22 bp, Homo sapiens
acatttacttatcaaaagtcag

SEQ ID NO: 7782384 - DNA, 22 bp, Homo sapiens
acatttaatgatcctactgtga

SEQ ID NO: 7782385 - DNA, 22 bp, Homo sapiens
accattctgtctctttacaaat

SEQ ID NO: 7782386 - DNA, 22 bp, Homo sapiens
accattgccccctagtgtctgt

SEQ ID NO: 7782387 - DNA, 22 bp, Homo sapiens
accatttaaggaaaatgtatca

SEQ ID NO: 7782388 - DNA, 22 bp, Homo sapiens
agggagctcagttggaagcggt

SEQ ID NO: 7782389 - DNA, 22 bp, Homo sapiens
agggagctctaagtagagggac

SEQ ID NO: 7782390 - DNA, 22 bp, Homo sapiens
acccaggctagaagtgaattat

SEQ ID NO: 7782391 - DNA, 22 bp, Homo sapiens
acccaggcgggagtgcagtgtc

SEQ ID NO: 7782392 - DNA, 22 bp, Homo sapiens
acccaggcgggagtgcagtgtc

SEQ ID NO: 7782393 - DNA, 22 bp, Homo sapiens
acccaggcctgagagacaggag

SEQ ID NO: 7782394 - DNA, 18 bp, Homo sapiens
acccaggctcatggtcct

SEQ ID NO: 7782395 - DNA, 22 bp, Homo sapiens
acccaggctagggtgcagtggc

SEQ ID NO: 7782396 - DNA, 22 bp, Homo sapiens
acccaggctagggtgcagtggc

SEQ ID NO: 7782397 - DNA, 22 bp, Homo sapiens
acccaggctagagtgcagtggt

SEQ ID NO: 7782398 - DNA, 22 bp, Homo sapiens
acccaggctagagtgcagtggt

SEQ ID NO: 7782399 - DNA, 22 bp, Homo sapiens
acccaggctggagtgcagtagc

SEQ ID NO: 7782400 - DNA, 22 bp, Homo sapiens
acccaggctgcttctcagtggc

SEQ ID NO: 7782401 - DNA, 17 bp, Homo sapiens
acccaggctctatcttg

SEQ ID NO: 7782402 - DNA, 22 bp, Homo sapiens
acccaggctggagtgcagtagc

SEQ ID NO: 7782403 - DNA, 22 bp, Homo sapiens
acccggagtcggaggttgcagt

SEQ ID NO: 7782404 - DNA, 22 bp, Homo sapiens
acccgcttccggagctgcagtg

SEQ ID NO: 7782405 - DNA, 22 bp, Homo sapiens
acccgtggttttatactacttc

SEQ ID NO: 7782406 - DNA, 17 bp, Homo sapiens
accctcaatctcctgca

SEQ ID NO: 7782407 - DNA, 22 bp, Homo sapiens
accctcaacaaattcactctat

SEQ ID NO: 7782408 - DNA, 22 bp, Homo sapiens
agggcctggtgacctgggtcct

SEQ ID NO: 7782409 - DNA, 22 bp, Homo sapiens
agggcctggttctgtgtaggga

SEQ ID NO: 7782410 - DNA, 22 bp, Homo sapiens
acccgatgttggtgctctagta

SEQ ID NO: 7782411 - DNA, 22 bp, Homo sapiens
accccttttatagaagaacaga

SEQ ID NO: 7782412 - DNA, 22 bp, Homo sapiens
accccaggaagtggaggtcatg

SEQ ID NO: 7782413 - DNA, 22 bp, Homo sapiens
aggctggcaaggcagatgtgtg

SEQ ID NO: 7782414 - DNA, 20 bp, Homo sapiens
aggctggcactcctggccag

SEQ ID NO: 7782415 - DNA, 22 bp, Homo sapiens
aggctggatgtgcctcaccgag

SEQ ID NO: 7782416 - DNA, 22 bp, Homo sapiens
aggctggatctctgttgccttc

SEQ ID NO: 7782417 - DNA, 22 bp, Homo sapiens
aggctggagtgtgcagtggcgc

SEQ ID NO: 7782418 - DNA, 22 bp, Homo sapiens
aggctggagtgtgcagtggcgc

SEQ ID NO: 7782419 - DNA, 22 bp, Homo sapiens
aggctggcagccacctcagcag

SEQ ID NO: 7782420 - DNA, 22 bp, Homo sapiens
aggctggcatacatttgttctt

SEQ ID NO: 7782421 - DNA, 22 bp, Homo sapiens
agggaagagcttgcaagaaacc

SEQ ID NO: 7782422 - DNA, 22 bp, Homo sapiens
acatttgtcttctttcagatta

SEQ ID NO: 7782423 - DNA, 22 bp, Homo sapiens
acatttttcacatttgtagggt

SEQ ID NO: 7782424 - DNA, 22 bp, Homo sapiens
acatttttgggttgatgtctga

SEQ ID NO: 7782425 - DNA, 22 bp, Homo sapiens
accaaaaattgtggggctgaat

SEQ ID NO: 7782426 - DNA, 22 bp, Homo sapiens
accaaaacctgctactaaagga

SEQ ID NO: 7782427 - DNA, 21 bp, Homo sapiens
accaaaacctatactttctgt

SEQ ID NO: 7782428 - DNA, 22 bp, Homo sapiens
agggaattcactggaacgccct

SEQ ID NO: 7782429 - DNA, 22 bp, Homo sapiens
agggaagcttgttactgagaag

SEQ ID NO: 7782430 - DNA, 22 bp, Homo sapiens
agggaagctgctgggtccacct

SEQ ID NO: 7782431 - DNA, 22 bp, Homo sapiens
agggaagccccgaggaggcacc

SEQ ID NO: 7782432 - DNA, 22 bp, Homo sapiens
agggaagccaagccttagagaa

SEQ ID NO: 7782433 - DNA, 22 bp, Homo sapiens
agggaagccctggctgagaccc

SEQ ID NO: 7782434 - DNA, 22 bp, Homo sapiens
agggaagcaatattagatatca

SEQ ID NO: 7782435 - DNA, 22 bp, Homo sapiens
agggaagcaatgattattattc

SEQ ID NO: 7782436 - DNA, 22 bp, Homo sapiens
agggaagcagcagccgcctgtc

SEQ ID NO: 7782437 - DNA, 22 bp, Homo sapiens
agggaagcaggaatagctctga

SEQ ID NO: 7782438 - DNA, 23 bp, Homo sapiens
agggagctaaaaggctggagcag

SEQ ID NO: 7782439 - DNA, 20 bp, Homo sapiens
accaggccccgggccctgca

SEQ ID NO: 7782440 - DNA, 22 bp, Homo sapiens
accaggagttgggggtgggacc

SEQ ID NO: 7782441 - DNA, 22 bp, Homo sapiens
acagggcacctgaggtaggaag

SEQ ID NO: 7782442 - DNA, 22 bp, Homo sapiens
acagggtggggatggtgagctt

SEQ ID NO: 7782443 - DNA, 18 bp, Homo sapiens
acagggagggcgctgggg

SEQ ID NO: 7782444 - DNA, 18 bp, Homo sapiens
acagggagggcgctgggg

SEQ ID NO: 7782445 - DNA, 22 bp, Homo sapiens
acagggagtctgaggggatagt

SEQ ID NO: 7782446 - DNA, 22 bp, Homo sapiens
acagggagtgcaattcatattg

SEQ ID NO: 7782447 - DNA, 22 bp, Homo sapiens
acagggcaacctctgggagact

SEQ ID NO: 7782448 - DNA, 22 bp, Homo sapiens
aggagctggagtccaggcaagt

SEQ ID NO: 7782449 - DNA, 22 bp, Homo sapiens
aggagcttcagagagaacctgg

SEQ ID NO: 7782450 - DNA, 22 bp, Homo sapiens
aggagcttcagagagaacctgg

SEQ ID NO: 7782451 - DNA, 21 bp, Homo sapiens
aggagctgtgttagctggtcg

SEQ ID NO: 7782452 - DNA, 21 bp, Homo sapiens
aggagctgtgttagctggtcg

SEQ ID NO: 7782453 - DNA, 22 bp, Homo sapiens
acaggtggtaaaatggactgtc

SEQ ID NO: 7782454 - DNA, 17 bp, Homo sapiens
acagtaactatgttatg

SEQ ID NO: 7782455 - DNA, 21 bp, Homo sapiens
acagtaaattccctgcaaaga

SEQ ID NO: 7782456 - DNA, 21 bp, Homo sapiens
acagtaaattccctgcaaaga

SEQ ID NO: 7782457 - DNA, 22 bp, Homo sapiens
aggaggaactcagaaagaaggt

SEQ ID NO: 7782458 - DNA, 22 bp, Homo sapiens
aggaggaaagaaggcccccagc

SEQ ID NO: 7782459 - DNA, 22 bp, Homo sapiens
aggaggaaaaaggccacagcaa

SEQ ID NO: 7782460 - DNA, 22 bp, Homo sapiens
acagtacaaaacccaccagagg

SEQ ID NO: 7782461 - DNA, 22 bp, Homo sapiens
acagtacaagcaatgcattttt

SEQ ID NO: 7782462 - DNA, 22 bp, Homo sapiens
acagtacaccactgtgtacagt

SEQ ID NO: 7782463 - DNA, 22 bp, Homo sapiens
acagtacaagcatgatacataa

SEQ ID NO: 7782464 - DNA, 22 bp, Homo sapiens
acagtacaagcatgatacataa

SEQ ID NO: 7782465 - DNA, 22 bp, Homo sapiens
aggagtctgttgaaatgtctat

SEQ ID NO: 7782466 - DNA, 22 bp, Homo sapiens
aggagtgcaaatagtccagaga

SEQ ID NO: 7782467 - DNA, 22 bp, Homo sapiens
acagtgttttagaaaagcttga

SEQ ID NO: 7782468 - DNA, 22 bp, Homo sapiens
acagtgattggcactgattcag

SEQ ID NO: 7782469 - DNA, 22 bp, Homo sapiens
acagtgattctgcaaaccatat

SEQ ID NO: 7782470 - DNA, 22 bp, Homo sapiens
acagtgattattagttggtggt

SEQ ID NO: 7782471 - DNA, 22 bp, Homo sapiens
acagtgattggtttgggggtga

SEQ ID NO: 7782472 - DNA, 22 bp, Homo sapiens
acagtgattggggtatctgcag

SEQ ID NO: 7782473 - DNA, 18 bp, Homo sapiens
acagtgattgttctatgc

SEQ ID NO: 7782474 - DNA, 22 bp, Homo sapiens
acagtgattttttcgagcagaa

SEQ ID NO: 7782475 - DNA, 22 bp, Homo sapiens
acagtgatttcatccttctggg

SEQ ID NO: 7782476 - DNA, 22 bp, Homo sapiens
acagtgattttaggatagatgg

SEQ ID NO: 7782477 - DNA, 22 bp, Homo sapiens
acagtgatttctgcaagggctc

SEQ ID NO: 7782478 - DNA, 22 bp, Homo sapiens
acagtgatcagttactgtctgt

SEQ ID NO: 7782479 - DNA, 22 bp, Homo sapiens
acagtgatatttttactcaaat

SEQ ID NO: 7782480 - DNA, 22 bp, Homo sapiens
acagtgataaaatttcacatgt

SEQ ID NO: 7782481 - DNA, 22 bp, Homo sapiens
acagtgatgagggaattttgtg

SEQ ID NO: 7782482 - DNA, 22 bp, Homo sapiens
acagtgatgagccggctgaggc

SEQ ID NO: 7782483 - DNA, 22 bp, Homo sapiens
acagtgatcttttagttggaac

SEQ ID NO: 7782484 - DNA, 22 bp, Homo sapiens
acagtgatgccgggcgagaatg

SEQ ID NO: 7782485 - DNA, 22 bp, Homo sapiens
acagtgatgggggtgcaggaag

SEQ ID NO: 7782486 - DNA, 22 bp, Homo sapiens
acagttactcatagaagcactt

SEQ ID NO: 7782487 - DNA, 22 bp, Homo sapiens
acagttaccacttagcagttac

SEQ ID NO: 7782488 - DNA, 22 bp, Homo sapiens
acagttcaagtcttagacaaca

SEQ ID NO: 7782489 - DNA, 22 bp, Homo sapiens
acagttcactttttatatcaaa

SEQ ID NO: 7782490 - DNA, 22 bp, Homo sapiens
acagttcaagacatcagtatga

SEQ ID NO: 7782491 - DNA, 22 bp, Homo sapiens
acagttatctttgaaatagaga

SEQ ID NO: 7782492 - DNA, 23 bp, Homo sapiens
acagttatagctgtgaataacat

SEQ ID NO: 7782493 - DNA, 22 bp, Homo sapiens
aggcaggattgctgacaacaat

SEQ ID NO: 7782494 - DNA, 22 bp, Homo sapiens
aggcaggcaaccacctgggaag

SEQ ID NO: 7782495 - DNA, 22 bp, Homo sapiens
acataaatagattattgggagg

SEQ ID NO: 7782496 - DNA, 21 bp, Homo sapiens
acagttttaaggagcacatgg

SEQ ID NO: 7782497 - DNA, 22 bp, Homo sapiens
acagttttttcaacattggaat

SEQ ID NO: 7782498 - DNA, 22 bp, Homo sapiens
aggcagcatgctctgcttctac

SEQ ID NO: 7782499 - DNA, 22 bp, Homo sapiens
aggcagcatgggcccagagtcc

SEQ ID NO: 7782500 - DNA, 19 bp, Homo sapiens
aggcagcacccagtccttg

SEQ ID NO: 7782501 - DNA, 22 bp, Homo sapiens
aggcagcatgggccccagctcc

SEQ ID NO: 7782502 - DNA, 18 bp, Homo sapiens
acaggctgtgggaatggt

SEQ ID NO: 7782503 - DNA, 22 bp, Homo sapiens
acaggctgtacttctaatcatc

SEQ ID NO: 7782504 - DNA, 22 bp, Homo sapiens
acaggctggtttgtaaaagatg

SEQ ID NO: 7782505 - DNA, 19 bp, Homo sapiens
aggaatggaattaattctg

SEQ ID NO: 7782506 - DNA, 22 bp, Homo sapiens
acaggctggaggaggaccaaga

SEQ ID NO: 7782507 - DNA, 22 bp, Homo sapiens
acaggctgctgggctccgtgct

SEQ ID NO: 7782508 - DNA, 22 bp, Homo sapiens
acaggctgctgggctccgtgct

SEQ ID NO: 7782509 - DNA, 22 bp, Homo sapiens
acaggctgggcgcttcctgcgg

SEQ ID NO: 7782510 - DNA, 22 bp, Homo sapiens
acaggctgggcgcttcctgcgg

SEQ ID NO: 7782511 - DNA, 22 bp, Homo sapiens
acaggctggtggtcctggccat

SEQ ID NO: 7782512 - DNA, 22 bp, Homo sapiens
acaggctgcccgctccccacct

SEQ ID NO: 7782513 - DNA, 22 bp, Homo sapiens
acaggctgcctaccaagtatca

SEQ ID NO: 7782514 - DNA, 22 bp, Homo sapiens
acaggctgctgagccatttgct

SEQ ID NO: 7782515 - DNA, 22 bp, Homo sapiens
acaggctgctgagccatttgct

SEQ ID NO: 7782516 - DNA, 22 bp, Homo sapiens
acaggctgcctaccaagtatca

SEQ ID NO: 7782517 - DNA, 22 bp, Homo sapiens
acaggctctggggcaggatggc

SEQ ID NO: 7782518 - DNA, 22 bp, Homo sapiens
acaggctctggggcaggatggc

SEQ ID NO: 7782519 - DNA, 22 bp, Homo sapiens
acaggctgcccgctccccacct

SEQ ID NO: 7782520 - DNA, 22 bp, Homo sapiens
acagcttagccagtcaagctct

SEQ ID NO: 7782521 - DNA, 22 bp, Homo sapiens
acagcttcacccattatccctg

SEQ ID NO: 7782522 - DNA, 22 bp, Homo sapiens
agctttatgcttcctacaagct

SEQ ID NO: 7782523 - DNA, 22 bp, Homo sapiens
agctttatcagaggagtctcta

SEQ ID NO: 7782524 - DNA, 22 bp, Homo sapiens
acagctcctaacaaaggctctc

SEQ ID NO: 7782525 - DNA, 22 bp, Homo sapiens
acagctcagacatcactgctct

SEQ ID NO: 7782526 - DNA, 22 bp, Homo sapiens
acagctcactcacagggctagt

SEQ ID NO: 7782527 - DNA, 22 bp, Homo sapiens
acagctatagacgatgtataga

SEQ ID NO: 7782528 - DNA, 22 bp, Homo sapiens
agctggggttgcacacattttg

SEQ ID NO: 7782529 - DNA, 22 bp, Homo sapiens
agctggggttgcacacattttg

SEQ ID NO: 7782530 - DNA, 22 bp, Homo sapiens
agctgggggttggataagggta

SEQ ID NO: 7782531 - DNA, 22 bp, Homo sapiens
agctgggggtagtgagaaataa

SEQ ID NO: 7782532 - DNA, 22 bp, Homo sapiens
agctggggctgtggttgtgatt

SEQ ID NO: 7782533 - DNA, 22 bp, Homo sapiens
agctggggctgtggttgtgatt

SEQ ID NO: 7782534 - DNA, 22 bp, Homo sapiens
agctggggctgcagagaacagg

SEQ ID NO: 7782535 - DNA, 19 bp, Homo sapiens
agctggggcggtgtgtgtt

SEQ ID NO: 7782536 - DNA, 22 bp, Homo sapiens
acagcactttacttctcagtga

SEQ ID NO: 7782537 - DNA, 22 bp, Homo sapiens
agctgcaggcccatgctcagtc

SEQ ID NO: 7782538 - DNA, 22 bp, Homo sapiens
agctgccagcaagtttcaaaca

SEQ ID NO: 7782539 - DNA, 22 bp, Homo sapiens
agctgccatcagcctttggatg

SEQ ID NO: 7782540 - DNA, 22 bp, Homo sapiens
agctgccaggcccctgagaacc

SEQ ID NO: 7782541 - DNA, 17 bp, Homo sapiens
agctgccagggagtgtg

SEQ ID NO: 7782542 - DNA, 22 bp, Homo sapiens
acagccttgcttatttgtctct

SEQ ID NO: 7782543 - DNA, 17 bp, Homo sapiens
agctgccttgcttgagc

SEQ ID NO: 7782544 - DNA, 22 bp, Homo sapiens
agctgctatgacaacaccagcc

SEQ ID NO: 7782545 - DNA, 22 bp, Homo sapiens
agctgccttttgagaaagctca

SEQ ID NO: 7782546 - DNA, 22 bp, Homo sapiens
agctgcccccagggctgtgctt

SEQ ID NO: 7782547 - DNA, 19 bp, Homo sapiens
agctgcctgtgcgcgcccg

SEQ ID NO: 7782548 - DNA, 22 bp, Homo sapiens
actggcagaacgtgatgcgggt

SEQ ID NO: 7782549 - DNA, 22 bp, Homo sapiens
actggcagaattgaatagttgt

SEQ ID NO: 7782550 - DNA, 22 bp, Homo sapiens
actggcagaactggtgattgtc

SEQ ID NO: 7782551 - DNA, 22 bp, Homo sapiens
actggcagagaccctgatggcc

SEQ ID NO: 7782552 - DNA, 22 bp, Homo sapiens
actggcagagaccctgatggcc

SEQ ID NO: 7782553 - DNA, 22 bp, Homo sapiens
actggcagaggatagcactaat

SEQ ID NO: 7782554 - DNA, 22 bp, Homo sapiens
actggcagagggaaaaccattc

SEQ ID NO: 7782555 - DNA, 22 bp, Homo sapiens
actggcagaggttggacaccat

SEQ ID NO: 7782556 - DNA, 22 bp, Homo sapiens
actggcagccacaactggcagg

SEQ ID NO: 7782557 - DNA, 22 bp, Homo sapiens
actggcagcagcagcccttggg

SEQ ID NO: 7782558 - DNA, 19 bp, Homo sapiens
actggcaaaaaaggttaat

SEQ ID NO: 7782559 - DNA, 22 bp, Homo sapiens
actggattctcttacacagatg

SEQ ID NO: 7782560 - DNA, 22 bp, Homo sapiens
agtggctgctggagtggagatg

SEQ ID NO: 7782561 - DNA, 23 bp, Homo sapiens
actgctgtctttgaagtgcttga

SEQ ID NO: 7782562 - DNA, 22 bp, Homo sapiens
actgctgattttaggactgtta

SEQ ID NO: 7782563 - DNA, 22 bp, Homo sapiens
actgctctctgcaagtagatgg

SEQ ID NO: 7782564 - DNA, 22 bp, Homo sapiens
actgctctctgcaagtagatgg

SEQ ID NO: 7782565 - DNA, 22 bp, Homo sapiens
actgctcaaggatctggtaggg

SEQ ID NO: 7782566 - DNA, 22 bp, Homo sapiens
actgctattgatgtcacacttt

SEQ ID NO: 7782567 - DNA, 22 bp, Homo sapiens
actgctattttataacagaaga

SEQ ID NO: 7782568 - DNA, 22 bp, Homo sapiens
agtggctgatgtaggcagtggg

SEQ ID NO: 7782569 - DNA, 22 bp, Homo sapiens
actgcttacaaaaggaaagaat

SEQ ID NO: 7782570 - DNA, 20 bp, Homo sapiens
actgcttctttctctgacct

SEQ ID NO: 7782571 - DNA, 22 bp, Homo sapiens
actgctttagacctagagctct

SEQ ID NO: 7782572 - DNA, 22 bp, Homo sapiens
actgcaacacctcctgggttca

SEQ ID NO: 7782573 - DNA, 22 bp, Homo sapiens
actgcaacctccacctcctggg

SEQ ID NO: 7782574 - DNA, 22 bp, Homo sapiens
actgcaatctggatcctagaag

SEQ ID NO: 7782575 - DNA, 22 bp, Homo sapiens
actgcaattatttgttcaccaa

SEQ ID NO: 7782576 - DNA, 22 bp, Homo sapiens
actgcaacctccgcctgccagg

SEQ ID NO: 7782577 - DNA, 23 bp, Homo sapiens
actgcctgtgccgatctctctca

SEQ ID NO: 7782578 - DNA, 21 bp, Homo sapiens
actgcctgtctccatagtcta

SEQ ID NO: 7782579 - DNA, 22 bp, Homo sapiens
actgcacacctccagggcacta

SEQ ID NO: 7782580 - DNA, 22 bp, Homo sapiens
actgattgcattcatagggttt

SEQ ID NO: 7782581 - DNA, 22 bp, Homo sapiens
agtctggctttttgatgagctt

SEQ ID NO: 7782582 - DNA, 17 bp, Homo sapiens
agtctgggacctgcgtg

SEQ ID NO: 7782583 - DNA, 22 bp, Homo sapiens
agtctcttcctcatgcatatgt

SEQ ID NO: 7782584 - DNA, 22 bp, Homo sapiens
agtctcttccttcaaggctggt

SEQ ID NO: 7782585 - DNA, 22 bp, Homo sapiens
agtctcttgcacattgtattaa

SEQ ID NO: 7782586 - DNA, 22 bp, Homo sapiens
agtctgggtggctgagctacag

SEQ ID NO: 7782587 - DNA, 22 bp, Homo sapiens
agtctgggctgtctgcaggagt

SEQ ID NO: 7782588 - DNA, 22 bp, Homo sapiens
agtctgggagggatgccagtgt

SEQ ID NO: 7782589 - DNA, 22 bp, Homo sapiens
actgaaatactgctcttggatt

SEQ ID NO: 7782590 - DNA, 22 bp, Homo sapiens
actgaaaatgaattagaaacag

SEQ ID NO: 7782591 - DNA, 22 bp, Homo sapiens
actcttcatccctttatcagga

SEQ ID NO: 7782592 - DNA, 22 bp, Homo sapiens
actcttcatgctatgctcaact

SEQ ID NO: 7782593 - DNA, 22 bp, Homo sapiens
actgaaatttatattttgggca

SEQ ID NO: 7782594 - DNA, 22 bp, Homo sapiens
actgaaatggggacagtcctta

SEQ ID NO: 7782595 - DNA, 22 bp, Homo sapiens
actgaaatatttagaagtgaag

SEQ ID NO: 7782596 - DNA, 22 bp, Homo sapiens
actgaacatatgcaagaccatt

SEQ ID NO: 7782597 - DNA, 22 bp, Homo sapiens
agtctctgctggttgtgcctat

SEQ ID NO: 7782598 - DNA, 22 bp, Homo sapiens
agtctctgccagcttgtcctct

SEQ ID NO: 7782599 - DNA, 22 bp, Homo sapiens
agtctctgcatgcctgctgtgc

SEQ ID NO: 7782600 - DNA, 22 bp, Homo sapiens
agtctctgggcatggttgtgac

SEQ ID NO: 7782601 - DNA, 22 bp, Homo sapiens
agtctcttaattttttctaagt

SEQ ID NO: 7782602 - DNA, 22 bp, Homo sapiens
agtctctctcctcgtggtaacc

SEQ ID NO: 7782603 - DNA, 22 bp, Homo sapiens
agtctaatgtttgtaaaatcat

SEQ ID NO: 7782604 - DNA, 20 bp, Homo sapiens
agtctctgcaacatagtgca

SEQ ID NO: 7782605 - DNA, 22 bp, Homo sapiens
actcattttataacactgtagt

SEQ ID NO: 7782606 - DNA, 22 bp, Homo sapiens
actcatttgcatgatgtgctat

SEQ ID NO: 7782607 - DNA, 19 bp, Homo sapiens
actccagggatgacagaag

SEQ ID NO: 7782608 - DNA, 22 bp, Homo sapiens
actccaggatgtagaatcagag

SEQ ID NO: 7782609 - DNA, 22 bp, Homo sapiens
acctgccttctcaaggacatga

SEQ ID NO: 7782610 - DNA, 22 bp, Homo sapiens
acctgctgaggagggggaatta

SEQ ID NO: 7782611 - DNA, 22 bp, Homo sapiens
acctgctgtcttgggggaatgc

SEQ ID NO: 7782612 - DNA, 22 bp, Homo sapiens
acctgccttctcaaggacatga

SEQ ID NO: 7782613 - DNA, 22 bp, Homo sapiens
acctccctgcctcttggcgtca

SEQ ID NO: 7782614 - DNA, 22 bp, Homo sapiens
acctgtctataaaagtgaatac

SEQ ID NO: 7782615 - DNA, 22 bp, Homo sapiens
acctgtctgcatgatctaaaac

SEQ ID NO: 7782616 - DNA, 22 bp, Homo sapiens
acctgtcaagtccagcgcaaca

SEQ ID NO: 7782617 - DNA, 21 bp, Homo sapiens
aggtaccaaaagcctgcatga

SEQ ID NO: 7782618 - DNA, 22 bp, Homo sapiens
aggtacagtagacagacagtta

SEQ ID NO: 7782619 - DNA, 22 bp, Homo sapiens
acctcccctgactcgaaaccca

SEQ ID NO: 7782620 - DNA, 22 bp, Homo sapiens
acctcccctcaccaatctggtt

SEQ ID NO: 7782621 - DNA, 22 bp, Homo sapiens
acctccccgggagcagcctcct

SEQ ID NO: 7782622 - DNA, 18 bp, Homo sapiens
acctccccattttctgaa

SEQ ID NO: 7782623 - DNA, 22 bp, Homo sapiens
acctccccattaggtcacccac

SEQ ID NO: 7782624 - DNA, 22 bp, Homo sapiens
acctccccacatggtagtgagt

SEQ ID NO: 7782625 - DNA, 20 bp, Homo sapiens
agggtggggacgttctgact

SEQ ID NO: 7782626 - DNA, 22 bp, Homo sapiens
agggtggtggcgatgaggacat

SEQ ID NO: 7782627 - DNA, 22 bp, Homo sapiens
agggtggtatttaacaactgga

SEQ ID NO: 7782628 - DNA, 22 bp, Homo sapiens
agggtggggtgctacatcttta

SEQ ID NO: 7782629 - DNA, 22 bp, Homo sapiens
agggctggtatgtccatgaaag

SEQ ID NO: 7782630 - DNA, 22 bp, Homo sapiens
agggtgggctagactcttcccc

SEQ ID NO: 7782631 - DNA, 18 bp, Homo sapiens
actcacagcagaagaagg

SEQ ID NO: 7782632 - DNA, 22 bp, Homo sapiens
actcattgaaacttaagatcta

SEQ ID NO: 7782633 - DNA, 22 bp, Homo sapiens
actcatttaaacatttactgaa

SEQ ID NO: 7782634 - DNA, 22 bp, Homo sapiens
actattcatgtttcctaactat

SEQ ID NO: 7782635 - DNA, 19 bp, Homo sapiens
actcaagtctaatgaaatc

SEQ ID NO: 7782636 - DNA, 22 bp, Homo sapiens
actaaatagttttgacagaaca

SEQ ID NO: 7782637 - DNA, 22 bp, Homo sapiens
actaaatacacacatttgttca

SEQ ID NO: 7782638 - DNA, 22 bp, Homo sapiens
actaaatacacacatttgttca

SEQ ID NO: 7782639 - DNA, 22 bp, Homo sapiens
actatcttccttatgcctatca

SEQ ID NO: 7782640 - DNA, 22 bp, Homo sapiens
actatgtacccaaagatctgat

SEQ ID NO: 7782641 - DNA, 22 bp, Homo sapiens
actatcaacatcattgctctag

SEQ ID NO: 7782642 - DNA, 22 bp, Homo sapiens
actatatacacattatcttgtt

SEQ ID NO: 7782643 - DNA, 22 bp, Homo sapiens
actatataagattggcattttt

SEQ ID NO: 7782644 - DNA, 22 bp, Homo sapiens
acgggcagacagagctactcgc

SEQ ID NO: 7782645 - DNA, 22 bp, Homo sapiens
accttcatattctctgatacct

SEQ ID NO: 7782646 - DNA, 21 bp, Homo sapiens
accttcagtgttctcagctgc

SEQ ID NO: 7782647 - DNA, 22 bp, Homo sapiens
accttcaattatttttgttcca

SEQ ID NO: 7782648 - DNA, 19 bp, Homo sapiens
accttcagagtggcacaaa

SEQ ID NO: 7782649 - DNA, 22 bp, Homo sapiens
accttcaagattgtgggtcaat

SEQ ID NO: 7782650 - DNA, 22 bp, Homo sapiens
accttcaagtatgtgggctgaa

SEQ ID NO: 7782651 - DNA, 22 bp, Homo sapiens
acctgtttacctgcacctgttt

SEQ ID NO: 7782652 - DNA, 19 bp, Homo sapiens
accttacagaaacaggcat

SEQ ID NO: 7782653 - DNA, 22 bp, Homo sapiens
accttaaactttacagccaagt

SEQ ID NO: 7782654 - DNA, 22 bp, Homo sapiens
accttaaaactgacacatggag

SEQ ID NO: 7782655 - DNA, 22 bp, Homo sapiens
accttaaaactgacacatggag

SEQ ID NO: 7782656 - DNA, 22 bp, Homo sapiens
accttaaaactgacacatggag

SEQ ID NO: 7782657 - DNA, 22 bp, Homo sapiens
accttaaatgtgacatagtcta

SEQ ID NO: 7782658 - DNA, 22 bp, Homo sapiens
accttaaaggccgaagtaaaga

SEQ ID NO: 7782659 - DNA, 22 bp, Homo sapiens
actaaaaactactgccaatagc

SEQ ID NO: 7782660 - DNA, 22 bp, Homo sapiens
actaaaaactactgccaatagc

SEQ ID NO: 7782661 - DNA, 22 bp, Homo sapiens
actaaaacagtggctagtagac

SEQ ID NO: 7782662 - DNA, 19 bp, Homo sapiens
actaaaaatgatgtttgag

SEQ ID NO: 7782663 - DNA, 19 bp, Homo sapiens
actaaaaatgatgtttgag

SEQ ID NO: 7782664 - DNA, 22 bp, Homo sapiens
actaaacattcttgtctctcaa

SEQ ID NO: 7782665 - DNA, 22 bp, Homo sapiens
actaaacacatgagattcctgc

SEQ ID NO: 7782666 - DNA, 22 bp, Homo sapiens
actaaagctcacagagttgaac

SEQ ID NO: 7782667 - DNA, 22 bp, Homo sapiens
actaaagatgtctaaatatatt

SEQ ID NO: 7782668 - DNA, 22 bp, Homo sapiens
actggcaggctgctggccggcg

SEQ ID NO: 7782669 - DNA, 22 bp, Homo sapiens
actggcaggctgctggccggcg

SEQ ID NO: 7782670 - DNA, 19 bp, Homo sapiens
actggcagctgtagtctgt

SEQ ID NO: 7782671 - DNA, 22 bp, Homo sapiens
actggcagctgtaggatgcatg

SEQ ID NO: 7782672 - DNA, 20 bp, Homo sapiens
actggcagcctgcctgctgt

SEQ ID NO: 7782673 - DNA, 20 bp, Homo sapiens
actggcagcctgcctgctgt

SEQ ID NO: 7782674 - DNA, 22 bp, Homo sapiens
actggcaggtccatcgcccttt

SEQ ID NO: 7782675 - DNA, 22 bp, Homo sapiens
actggcagggggagccccgaga

SEQ ID NO: 7782676 - DNA, 19 bp, Homo sapiens
actggcagggctgcggtgg

SEQ ID NO: 7782677 - DNA, 22 bp, Homo sapiens
actggcagtagagggagcgcat

SEQ ID NO: 7782678 - DNA, 22 bp, Homo sapiens
actggcagtggcagcagaaaga

SEQ ID NO: 7782679 - DNA, 22 bp, Homo sapiens
actggcagtgtcgtttacatga

SEQ ID NO: 7782680 - DNA, 19 bp, Homo sapiens
actggcagtttctgcatgg

SEQ ID NO: 7782681 - DNA, 22 bp, Homo sapiens
actggcagtttgagaatgcatt

SEQ ID NO: 7782682 - DNA, 22 bp, Homo sapiens
agttgctatcgtgaagcacgtg

SEQ ID NO: 7782683 - DNA, 22 bp, Homo sapiens
agtttacacttttgattcttat

SEQ ID NO: 7782684 - DNA, 21 bp, Homo sapiens
agtttacaactgtccagcccc

SEQ ID NO: 7782685 - DNA, 22 bp, Homo sapiens
agtttacactatgaaaagacta

SEQ ID NO: 7782686 - DNA, 22 bp, Homo sapiens
agtttacagttctcatcgcaac

SEQ ID NO: 7782687 - DNA, 22 bp, Homo sapiens
agtttacagatgctacaggagc

SEQ ID NO: 7782688 - DNA, 22 bp, Homo sapiens
agtttacagatgctacaggagc

SEQ ID NO: 7782689 - DNA, 22 bp, Homo sapiens
agtttacatgacgtgtatttca

SEQ ID NO: 7782690 - DNA, 22 bp, Homo sapiens
agtttccaggcaggagctaatt

SEQ ID NO: 7782691 - DNA, 22 bp, Homo sapiens
agtttcatttcttagtaccagt

SEQ ID NO: 7782692 - DNA, 22 bp, Homo sapiens
agtttcattgagatgtttgcta

SEQ ID NO: 7782693 - DNA, 22 bp, Homo sapiens
agtttcatgtagccatatttac

SEQ ID NO: 7782694 - DNA, 22 bp, Homo sapiens
actgtgagagaggttcttggta

SEQ ID NO: 7782695 - DNA, 22 bp, Homo sapiens
actgtgagagtttttctaggag

SEQ ID NO: 7782696 - DNA, 22 bp, Homo sapiens
agtttctaacatatagcattgg

SEQ ID NO: 7782697 - DNA, 22 bp, Homo sapiens
actgtggttacctcttgtctta

SEQ ID NO: 7782698 - DNA, 22 bp, Homo sapiens
actgtgtattcctatatagtaa

SEQ ID NO: 7782699 - DNA, 22 bp, Homo sapiens
actgtgaacggactgaagccca

SEQ ID NO: 7782700 - DNA, 22 bp, Homo sapiens
actgtgaaagctaacatcttag

SEQ ID NO: 7782701 - DNA, 22 bp, Homo sapiens
acttccagaattagaatttaag

SEQ ID NO: 7782702 - DNA, 22 bp, Homo sapiens
acttccagagggtgtggaaata

SEQ ID NO: 7782703 - DNA, 22 bp, Homo sapiens
acttgatttttataataaatgg

SEQ ID NO: 7782704 - DNA, 22 bp, Homo sapiens
acttgatttttataataaatgg

SEQ ID NO: 7782705 - DNA, 22 bp, Homo sapiens
acttgatttttataataaatgg

SEQ ID NO: 7782706 - DNA, 22 bp, Homo sapiens
acttctttcacaatgtttctag

SEQ ID NO: 7782707 - DNA, 22 bp, Homo sapiens
acttcagtgtggtataaaacgt

SEQ ID NO: 7782708 - DNA, 22 bp, Homo sapiens
acttcatttcatttgcacagtg

SEQ ID NO: 7782709 - DNA, 22 bp, Homo sapiens
acttcatgttgtttacaactta

SEQ ID NO: 7782710 - DNA, 22 bp, Homo sapiens
acttcattcattttcacgaatg

SEQ ID NO: 7782711 - DNA, 22 bp, Homo sapiens
acttggctttagtagtaactga

SEQ ID NO: 7782712 - DNA, 22 bp, Homo sapiens
acttggctgggagagttgaaga

SEQ ID NO: 7782713 - DNA, 22 bp, Homo sapiens
acttggctcagataccatgccc

SEQ ID NO: 7782714 - DNA, 21 bp, Homo sapiens
acttggccaggcccccacctg

SEQ ID NO: 7782715 - DNA, 22 bp, Homo sapiens
acttggccttatttccacagaa

SEQ ID NO: 7782716 - DNA, 22 bp, Homo sapiens
acttgcctaaggtcatgcaact

SEQ ID NO: 7782717 - DNA, 22 bp, Homo sapiens
acttcaaacaattaacagagaa

SEQ ID NO: 7782718 - DNA, 22 bp, Homo sapiens
acttcacaggttttcataaaac

SEQ ID NO: 7782719 - DNA, 22 bp, Homo sapiens
acttcacagatatttatttggt

SEQ ID NO: 7782720 - DNA, 23 bp, Homo sapiens
atccagcctgggggtttaaccac

SEQ ID NO: 7782721 - DNA, 22 bp, Homo sapiens
atccagagactggggctgggat

SEQ ID NO: 7782722 - DNA, 22 bp, Homo sapiens
atccagagacccaaggacagaa

SEQ ID NO: 7782723 - DNA, 23 bp, Homo sapiens
atcattctccaatctggagcagg

SEQ ID NO: 7782724 - DNA, 22 bp, Homo sapiens
atcattctattgttgagctgcc

SEQ ID NO: 7782725 - DNA, 19 bp, Homo sapiens
atcagcaaggtaggatgtg

SEQ ID NO: 7782726 - DNA, 22 bp, Homo sapiens
atcatttatgccccaattagat

SEQ ID NO: 7782727 - DNA, 22 bp, Homo sapiens
atcatttaaaacaagtctctat

SEQ ID NO: 7782728 - DNA, 22 bp, Homo sapiens
atcattctgatggtcaatgcta

SEQ ID NO: 7782729 - DNA, 22 bp, Homo sapiens
atcatttaaaacaagtctctat

SEQ ID NO: 7782730 - DNA, 22 bp, Homo sapiens
agaaacatcattgtttggtatt

SEQ ID NO: 7782731 - DNA, 22 bp, Homo sapiens
agaaacatcattggaacacaag

SEQ ID NO: 7782732 - DNA, 22 bp, Homo sapiens
agaaacatcctgctttccattt

SEQ ID NO: 7782733 - DNA, 22 bp, Homo sapiens
agaaacagcattagcatcaatt

SEQ ID NO: 7782734 - DNA, 20 bp, Homo sapiens
agaaacagcacaattctgtt

SEQ ID NO: 7782735 - DNA, 20 bp, Homo sapiens
agaaacagcacaattctgtt

SEQ ID NO: 7782736 - DNA, 22 bp, Homo sapiens
agaaacagaagggaaagctttt

SEQ ID NO: 7782737 - DNA, 22 bp, Homo sapiens
agaaacatttagattatatgtc

SEQ ID NO: 7782738 - DNA, 21 bp, Homo sapiens
agaaacatgatcaaaggaacc

SEQ ID NO: 7782739 - DNA, 22 bp, Homo sapiens
atcacaaaggctgcttcatgat

SEQ ID NO: 7782740 - DNA, 21 bp, Homo sapiens
atcacattggctgttattatt

SEQ ID NO: 7782741 - DNA, 22 bp, Homo sapiens
atcagaggttatgtggagggga

SEQ ID NO: 7782742 - DNA, 22 bp, Homo sapiens
atcactatgggcattatattta

SEQ ID NO: 7782743 - DNA, 22 bp, Homo sapiens
agaaacaacttgtttctcttgc

SEQ ID NO: 7782744 - DNA, 22 bp, Homo sapiens
agaaacaacttgtttctcttgc

SEQ ID NO: 7782745 - DNA, 22 bp, Homo sapiens
agaaaatttattcatgttagtt

SEQ ID NO: 7782746 - DNA, 22 bp, Homo sapiens
agaaaatttattcatgttagtt

SEQ ID NO: 7782747 - DNA, 22 bp, Homo sapiens
agaaaatttaaagagacacaca

SEQ ID NO: 7782748 - DNA, 22 bp, Homo sapiens
agaaaattagattttactgtgt

SEQ ID NO: 7782749 - DNA, 22 bp, Homo sapiens
agaaaataaattgatggtggaa

SEQ ID NO: 7782750 - DNA, 22 bp, Homo sapiens
atatatttgagaatattcatga

SEQ ID NO: 7782751 - DNA, 22 bp, Homo sapiens
atatatttgagaatattcatga

SEQ ID NO: 7782752 - DNA, 22 bp, Homo sapiens
atatatttgagaatattcatga

SEQ ID NO: 7782753 - DNA, 22 bp, Homo sapiens
atatatttactctcctgttgca

SEQ ID NO: 7782754 - DNA, 22 bp, Homo sapiens
atatatttactctcctgttgca

SEQ ID NO: 7782755 - DNA, 22 bp, Homo sapiens
atatatttactctcctgttgca

SEQ ID NO: 7782756 - DNA, 18 bp, Homo sapiens
atatctgtgggatggaga

SEQ ID NO: 7782757 - DNA, 22 bp, Homo sapiens
atatcctttactgtgtcacaga

SEQ ID NO: 7782758 - DNA, 22 bp, Homo sapiens
atatccatagtaaaagtcatta

SEQ ID NO: 7782759 - DNA, 22 bp, Homo sapiens
atatattttgaatagcctctgt

SEQ ID NO: 7782760 - DNA, 22 bp, Homo sapiens
atatatttgagaatattcatga

SEQ ID NO: 7782761 - DNA, 22 bp, Homo sapiens
atatattcttaaagaatctgac

SEQ ID NO: 7782762 - DNA, 22 bp, Homo sapiens
atatataacctggataaggctt

SEQ ID NO: 7782763 - DNA, 22 bp, Homo sapiens
actttgtataagacaataaaga

SEQ ID NO: 7782764 - DNA, 22 bp, Homo sapiens
atataatagtttcataaaggct

SEQ ID NO: 7782765 - DNA, 22 bp, Homo sapiens
atatacaaagggcaacctcgct

SEQ ID NO: 7782766 - DNA, 22 bp, Homo sapiens
aaagcagcaaatacttttgcac

SEQ ID NO: 7782767 - DNA, 22 bp, Homo sapiens
aacataagggagcttcaaaact

SEQ ID NO: 7782768 - DNA, 22 bp, Homo sapiens
aaagcagaggttgcagtgagct

SEQ ID NO: 7782769 - DNA, 22 bp, Homo sapiens
aaagcagattctgatgcagtag

SEQ ID NO: 7782770 - DNA, 22 bp, Homo sapiens
aaagcagaactgagagagctgg

SEQ ID NO: 7782771 - DNA, 22 bp, Homo sapiens
aacatataaactcttaagttca

SEQ ID NO: 7782772 - DNA, 22 bp, Homo sapiens
aacatataaactcttaagttca

SEQ ID NO: 7782773 - DNA, 22 bp, Homo sapiens
aacatagctttactcaaatgac

SEQ ID NO: 7782774 - DNA, 22 bp, Homo sapiens
aaagcccatgtggaagtacagg

SEQ ID NO: 7782775 - DNA, 22 bp, Homo sapiens
aaagcctcccaggttatgagta

SEQ ID NO: 7782776 - DNA, 22 bp, Homo sapiens
aaagcctcccaggttatgagta

SEQ ID NO: 7782777 - DNA, 22 bp, Homo sapiens
aaagccattgcagagcaggatt

SEQ ID NO: 7782778 - DNA, 22 bp, Homo sapiens
aacatacatatttcagtgtcca

SEQ ID NO: 7782779 - DNA, 22 bp, Homo sapiens
aacatacatatttcagtgtcca

SEQ ID NO: 7782780 - DNA, 22 bp, Homo sapiens
aacataatgtggccaaagtcac

SEQ ID NO: 7782781 - DNA, 22 bp, Homo sapiens
aacatacagtgagcagtggact

SEQ ID NO: 7782782 - DNA, 22 bp, Homo sapiens
aacatacagtgagcagtggact

SEQ ID NO: 7782783 - DNA, 22 bp, Homo sapiens
aacatacttatactaaataatg

SEQ ID NO: 7782784 - DNA, 22 bp, Homo sapiens
aaagattaaatcaaattggtca

SEQ ID NO: 7782785 - DNA, 22 bp, Homo sapiens
aaagatgttttataagttatgg

SEQ ID NO: 7782786 - DNA, 22 bp, Homo sapiens
aaagattatggcattgaaatac

SEQ ID NO: 7782787 - DNA, 22 bp, Homo sapiens
aaagattaggcggcaactgggc

SEQ ID NO: 7782788 - DNA, 22 bp, Homo sapiens
aaagatttaagaataatttgtg

SEQ ID NO: 7782789 - DNA, 22 bp, Homo sapiens
aaagattatggcattgaaatac

SEQ ID NO: 7782790 - DNA, 22 bp, Homo sapiens
aaagatttcagaagcctgtgcc

SEQ ID NO: 7782791 - DNA, 22 bp, Homo sapiens
aaagatttgagttctgcttata

SEQ ID NO: 7782792 - DNA, 22 bp, Homo sapiens
aaagcaagtctctacaaagtac

SEQ ID NO: 7782793 - DNA, 23 bp, Homo sapiens
aaagcaaggaattggcaacagag

SEQ ID NO: 7782794 - DNA, 22 bp, Homo sapiens
aacacttaaggagagatcaaat

SEQ ID NO: 7782795 - DNA, 22 bp, Homo sapiens
aacacttatccacatttgaaag

SEQ ID NO: 7782796 - DNA, 22 bp, Homo sapiens
aaagcctcccaggttatgagta

SEQ ID NO: 7782797 - DNA, 22 bp, Homo sapiens
aacatttgtttggcttcaatta

SEQ ID NO: 7782798 - DNA, 22 bp, Homo sapiens
aacccaggtctttggcttccag

SEQ ID NO: 7782799 - DNA, 22 bp, Homo sapiens
aacccagggtggaggttgcagt

SEQ ID NO: 7782800 - DNA, 22 bp, Homo sapiens
aacccaggaggtggaggttgtg

SEQ ID NO: 7782801 - DNA, 22 bp, Homo sapiens
aacccaggagttggaggctgtg

SEQ ID NO: 7782802 - DNA, 22 bp, Homo sapiens
aacccaggctggagtgcagtgg

SEQ ID NO: 7782803 - DNA, 22 bp, Homo sapiens
aacccaggaggcggaggttgtg

SEQ ID NO: 7782804 - DNA, 22 bp, Homo sapiens
aacccaggagccggaggttgtg

SEQ ID NO: 7782805 - DNA, 22 bp, Homo sapiens
aacccaggagatggaggttgtg

SEQ ID NO: 7782806 - DNA, 22 bp, Homo sapiens
aacccaggaggcagaggctgca

SEQ ID NO: 7782807 - DNA, 22 bp, Homo sapiens
aacccaggagacaggttgcagt

SEQ ID NO: 7782808 - DNA, 22 bp, Homo sapiens
aaaggcaggactgcagcatagg

SEQ ID NO: 7782809 - DNA, 18 bp, Homo sapiens
aaaggcagattactggga

SEQ ID NO: 7782810 - DNA, 22 bp, Homo sapiens
aaaggcagagttgttggaggca

SEQ ID NO: 7782811 - DNA, 22 bp, Homo sapiens
aacccgggaggcagaggttgtg

SEQ ID NO: 7782812 - DNA, 22 bp, Homo sapiens
aaccccaggctggaggagtctc

SEQ ID NO: 7782813 - DNA, 22 bp, Homo sapiens
aaccccagtaccccaggatatg

SEQ ID NO: 7782814 - DNA, 22 bp, Homo sapiens
aacccgagggccccaggctcgg

SEQ ID NO: 7782815 - DNA, 21 bp, Homo sapiens
aactgcaaatgatgctggaga

SEQ ID NO: 7782816 - DNA, 21 bp, Homo sapiens
aactgcaaatcttagactgca

SEQ ID NO: 7782817 - DNA, 22 bp, Homo sapiens
aactgcaaagccaatctcagga

SEQ ID NO: 7782818 - DNA, 22 bp, Homo sapiens
aactgcaaaataatcaagttgt

SEQ ID NO: 7782819 - DNA, 22 bp, Homo sapiens
aactgcaaaataatcaagttgt

SEQ ID NO: 7782820 - DNA, 19 bp, Homo sapiens
aaaggcagtgggtggcgtg

SEQ ID NO: 7782821 - DNA, 22 bp, Homo sapiens
aaaggcagtgtgatactgtggt

SEQ ID NO: 7782822 - DNA, 22 bp, Homo sapiens
aaaggcagtgtgatactgtggt

SEQ ID NO: 7782823 - DNA, 23 bp, Homo sapiens
aaaggcaggcctaggacatattg

SEQ ID NO: 7782824 - DNA, 22 bp, Homo sapiens
aaaggcaggctttcacatctca

SEQ ID NO: 7782825 - DNA, 22 bp, Homo sapiens
aaaggcagtgggtatgtggatc

SEQ ID NO: 7782826 - DNA, 22 bp, Homo sapiens
aactgtagcaaagaacagctct

SEQ ID NO: 7782827 - DNA, 22 bp, Homo sapiens
aactgtagtgcttatagactct

SEQ ID NO: 7782828 - DNA, 22 bp, Homo sapiens
aactgtctaaggagaatatgaa

SEQ ID NO: 7782829 - DNA, 22 bp, Homo sapiens
aactgtgaggatgtgcaaattc

SEQ ID NO: 7782830 - DNA, 22 bp, Homo sapiens
aactgtggacttgagactgatg

SEQ ID NO: 7782831 - DNA, 22 bp, Homo sapiens
aactgtggagattcggaaggta

SEQ ID NO: 7782832 - DNA, 22 bp, Homo sapiens
aaaggttttgccctgggtattc

SEQ ID NO: 7782833 - DNA, 22 bp, Homo sapiens
aagaacataacagaagctgtgt

SEQ ID NO: 7782834 - DNA, 22 bp, Homo sapiens
aagaacatgaacacaatgttta

SEQ ID NO: 7782835 - DNA, 22 bp, Homo sapiens
aagaacatgaagtcacaaatgc

SEQ ID NO: 7782836 - DNA, 22 bp, Homo sapiens
aaagtaacaataaggttctatt

SEQ ID NO: 7782837 - DNA, 22 bp, Homo sapiens
aaaggtttttatttatcctgga

SEQ ID NO: 7782838 - DNA, 22 bp, Homo sapiens
aaatactattgaccaggtctct

SEQ ID NO: 7782839 - DNA, 22 bp, Homo sapiens
aagataaactcttgatttctga

SEQ ID NO: 7782840 - DNA, 22 bp, Homo sapiens
aaatactagaattcagagttga

SEQ ID NO: 7782841 - DNA, 23 bp, Homo sapiens
aaatacctgaattagatattatc

SEQ ID NO: 7782842 - DNA, 23 bp, Homo sapiens
aaatacctgaattagatattatc

SEQ ID NO: 7782843 - DNA, 22 bp, Homo sapiens
aaatactagaattcagagttga

SEQ ID NO: 7782844 - DNA, 22 bp, Homo sapiens
aaatacatttacagtcgtggct

SEQ ID NO: 7782845 - DNA, 22 bp, Homo sapiens
aagagggaagtcacctggaggt

SEQ ID NO: 7782846 - DNA, 22 bp, Homo sapiens
aagagggaaattgttggctgct

SEQ ID NO: 7782847 - DNA, 22 bp, Homo sapiens
aagagggctgcaatcttattgc

SEQ ID NO: 7782848 - DNA, 22 bp, Homo sapiens
aagagggctgcaatcttattgc

SEQ ID NO: 7782849 - DNA, 22 bp, Homo sapiens
aaagttttagaactaggaagca

SEQ ID NO: 7782850 - DNA, 22 bp, Homo sapiens
aaagtttgttatatgataagga

SEQ ID NO: 7782851 - DNA, 22 bp, Homo sapiens
aaagtttgcaatttatgttaat

SEQ ID NO: 7782852 - DNA, 22 bp, Homo sapiens
aaagtttatcatagccggggac

SEQ ID NO: 7782853 - DNA, 22 bp, Homo sapiens
aaagtttattttccctggttag

SEQ ID NO: 7782854 - DNA, 22 bp, Homo sapiens
aagactgagtggcttaagaaaa

SEQ ID NO: 7782855 - DNA, 22 bp, Homo sapiens
aaagtttacagtgcacatgggt

SEQ ID NO: 7782856 - DNA, 22 bp, Homo sapiens
aaagtttaggctttgaaaccag

SEQ ID NO: 7782857 - DNA, 22 bp, Homo sapiens
aaagtttagtgtcctctaccac

SEQ ID NO: 7782858 - DNA, 22 bp, Homo sapiens
aagactataccatcttagttac

SEQ ID NO: 7782859 - DNA, 22 bp, Homo sapiens
aagactcaaggaacaacacagt

SEQ ID NO: 7782860 - DNA, 20 bp, Homo sapiens
aaagtgcacagatacagctc

SEQ ID NO: 7782861 - DNA, 15 bp, Homo sapiens
aaagtgcacccaata

SEQ ID NO: 7782862 - DNA, 22 bp, Homo sapiens
aaagtgcacctgcttcttcttg

SEQ ID NO: 7782863 - DNA, 22 bp, Homo sapiens
aaagtgcactagaatccagatt

SEQ ID NO: 7782864 - DNA, 19 bp, Homo sapiens
aaagtgattttttctggca

SEQ ID NO: 7782865 - DNA, 22 bp, Homo sapiens
aaagtgcaaggattacaggcat

SEQ ID NO: 7782866 - DNA, 22 bp, Homo sapiens
aaagtgcaatcagttagaccat

SEQ ID NO: 7782867 - DNA, 22 bp, Homo sapiens
aagacagagggaagcaatgatg

SEQ ID NO: 7782868 - DNA, 22 bp, Homo sapiens
aaagtgcagctgaaaacatcct

SEQ ID NO: 7782869 - DNA, 22 bp, Homo sapiens
aaagtgcagctgaaaacatcct

SEQ ID NO: 7782870 - DNA, 22 bp, Homo sapiens
aaagtgcactctcagtgctgct

SEQ ID NO: 7782871 - DNA, 22 bp, Homo sapiens
aaagtgcagctgaaaacatcct

SEQ ID NO: 7782872 - DNA, 22 bp, Homo sapiens
aaagtgcagaactgttctcact

SEQ ID NO: 7782873 - DNA, 22 bp, Homo sapiens
aaagtgatgaactctgtgacct

SEQ ID NO: 7782874 - DNA, 22 bp, Homo sapiens
aaagtgattatgctgtcaaaga

SEQ ID NO: 7782875 - DNA, 22 bp, Homo sapiens
aagaacatgagttatgatgatt

SEQ ID NO: 7782876 - DNA, 22 bp, Homo sapiens
aagaacatgatggccatgtgca

SEQ ID NO: 7782877 - DNA, 22 bp, Homo sapiens
aagcaggcatcttggaggtcaa

SEQ ID NO: 7782878 - DNA, 22 bp, Homo sapiens
aagcaggcatcttggaggtcaa

SEQ ID NO: 7782879 - DNA, 22 bp, Homo sapiens
aagcaggcatgggaggccatcc

SEQ ID NO: 7782880 - DNA, 22 bp, Homo sapiens
aagcaggcagggtggagagttt

SEQ ID NO: 7782881 - DNA, 22 bp, Homo sapiens
aagcaggcagggtggagagttt

SEQ ID NO: 7782882 - DNA, 22 bp, Homo sapiens
aagcaggcaaggttgtggggca

SEQ ID NO: 7782883 - DNA, 22 bp, Homo sapiens
aagcaggagagcctgggcgagc

SEQ ID NO: 7782884 - DNA, 22 bp, Homo sapiens
aagcaggagagcctgggtgagc

SEQ ID NO: 7782885 - DNA, 22 bp, Homo sapiens
aagcaggagatgcaggaatgta

SEQ ID NO: 7782886 - DNA, 22 bp, Homo sapiens
aagcaggagatgggtgcttttc

SEQ ID NO: 7782887 - DNA, 20 bp, Homo sapiens
aagattcattgtaattaggg

SEQ ID NO: 7782888 - DNA, 20 bp, Homo sapiens
aagattcattgtaattaggg

SEQ ID NO: 7782889 - DNA, 22 bp, Homo sapiens
aagcagcatatgacagcatcca

SEQ ID NO: 7782890 - DNA, 22 bp, Homo sapiens
aagattcacagagtgaatgaaa

SEQ ID NO: 7782891 - DNA, 20 bp, Homo sapiens
aagattcattgtaattaggg

SEQ ID NO: 7782892 - DNA, 22 bp, Homo sapiens
aaatcttcctgaaatttgttca

SEQ ID NO: 7782893 - DNA, 22 bp, Homo sapiens
aaatctctgaacttaataatgc

SEQ ID NO: 7782894 - DNA, 22 bp, Homo sapiens
aaatctgggtcaaggtggagtg

SEQ ID NO: 7782895 - DNA, 22 bp, Homo sapiens
aagcaggcgagggcctggagca

SEQ ID NO: 7782896 - DNA, 22 bp, Homo sapiens
aagcaggcgagggcctggagca

SEQ ID NO: 7782897 - DNA, 22 bp, Homo sapiens
aagcaggcattccagagacaat

SEQ ID NO: 7782898 - DNA, 22 bp, Homo sapiens
aagcaggcattccagagacaat

SEQ ID NO: 7782899 - DNA, 22 bp, Homo sapiens
aagcaggcattccagagacaat

SEQ ID NO: 7782900 - DNA, 22 bp, Homo sapiens
aagcaggccctgggccagggga

SEQ ID NO: 7782901 - DNA, 22 bp, Homo sapiens
aagcaggccctgggccagggga

SEQ ID NO: 7782902 - DNA, 22 bp, Homo sapiens
aaatctcactgtagtcaaagtg

SEQ ID NO: 7782903 - DNA, 22 bp, Homo sapiens
aagccctgttctttctctcacc

SEQ ID NO: 7782904 - DNA, 22 bp, Homo sapiens
aagcccttttcaagatacaaca

SEQ ID NO: 7782905 - DNA, 22 bp, Homo sapiens
aagcccttggcagagttcccca

SEQ ID NO: 7782906 - DNA, 22 bp, Homo sapiens
aaatgcatgtagaataatagag

SEQ ID NO: 7782907 - DNA, 22 bp, Homo sapiens
aagccttcagtccgttgcagag

SEQ ID NO: 7782908 - DNA, 22 bp, Homo sapiens
aagcctgtgtttctgctagtct

SEQ ID NO: 7782909 - DNA, 22 bp, Homo sapiens
aaaattgaggctcatgttaaat

SEQ ID NO: 7782910 - DNA, 22 bp, Homo sapiens
aaaattctgtcattaaattgtg

SEQ ID NO: 7782911 - DNA, 22 bp, Homo sapiens
aaaattctgtcattaaattgtg

SEQ ID NO: 7782912 - DNA, 17 bp, Homo sapiens
aaaattctgtaaagagg

SEQ ID NO: 7782913 - DNA, 17 bp, Homo sapiens
aaaattctgtaaagagg

SEQ ID NO: 7782914 - DNA, 22 bp, Homo sapiens
aaaattgaagtgatcaggaact

SEQ ID NO: 7782915 - DNA, 22 bp, Homo sapiens
aaaattctcttgatcttgacag

SEQ ID NO: 7782916 - DNA, 17 bp, Homo sapiens
aaaattctgtaaagagg

SEQ ID NO: 7782917 - DNA, 22 bp, Homo sapiens
aaaattctcttgatcttgacag

SEQ ID NO: 7782918 - DNA, 22 bp, Homo sapiens
aaaattcattcctcagactgcc

SEQ ID NO: 7782919 - DNA, 22 bp, Homo sapiens
aaaatgtgatctacaaatgcaa

SEQ ID NO: 7782920 - DNA, 22 bp, Homo sapiens
aaacacattagccctgtggaaa

SEQ ID NO: 7782921 - DNA, 22 bp, Homo sapiens
aaacacattttaggaaaatcta

SEQ ID NO: 7782922 - DNA, 22 bp, Homo sapiens
aaacactagcaggaagcactga

SEQ ID NO: 7782923 - DNA, 22 bp, Homo sapiens
aaacaccagtcccagtatacac

SEQ ID NO: 7782924 - DNA, 22 bp, Homo sapiens
aaacaccaagagctagctatta

SEQ ID NO: 7782925 - DNA, 22 bp, Homo sapiens
aaacaccagcactgtttacaaa

SEQ ID NO: 7782926 - DNA, 22 bp, Homo sapiens
aaacacatcattcatgtcgtca

SEQ ID NO: 7782927 - DNA, 22 bp, Homo sapiens
aaacacaagaggcagggtacag

SEQ ID NO: 7782928 - DNA, 22 bp, Homo sapiens
aaaatatgtataactcttctgc

SEQ ID NO: 7782929 - DNA, 22 bp, Homo sapiens
aaaatattttagggccaggaga

SEQ ID NO: 7782930 - DNA, 22 bp, Homo sapiens
aaactgcactttattttgtcaa

SEQ ID NO: 7782931 - DNA, 22 bp, Homo sapiens
aaactgcagagccatggttcaa

SEQ ID NO: 7782932 - DNA, 22 bp, Homo sapiens
aaactgcacatgaggctggtgc

SEQ ID NO: 7782933 - DNA, 22 bp, Homo sapiens
aaactgcacacgatgtgcctga

SEQ ID NO: 7782934 - DNA, 22 bp, Homo sapiens
aaactgcaattatttttgcaat

SEQ ID NO: 7782935 - DNA, 22 bp, Homo sapiens
aaactgcacaagggtgcatagc

SEQ ID NO: 7782936 - DNA, 22 bp, Homo sapiens
aaaatattttagggccaggaga

SEQ ID NO: 7782937 - DNA, 21 bp, Homo sapiens
aaaatgtgagcgtgatgctta

SEQ ID NO: 7782938 - DNA, 22 bp, Homo sapiens
aaactgcaggtcatgacccatt

SEQ ID NO: 7782939 - DNA, 22 bp, Homo sapiens
aaactgcagccttgagttcagg

SEQ ID NO: 7782940 - DNA, 23 bp, Homo sapiens
aaactgcatctctgagcctcagc

SEQ ID NO: 7782941 - DNA, 22 bp, Homo sapiens
aaactgcatgaagctgatttta

SEQ ID NO: 7782942 - DNA, 22 bp, Homo sapiens
aaacagtattatcaatatattt

SEQ ID NO: 7782943 - DNA, 22 bp, Homo sapiens
aaaatagttaacgttcagagta

SEQ ID NO: 7782944 - DNA, 22 bp, Homo sapiens
aaaatatgactgtgctccttaa

SEQ ID NO: 7782945 - DNA, 22 bp, Homo sapiens
aaaatatgaagttgtcagtatg

SEQ ID NO: 7782946 - DNA, 20 bp, Homo sapiens
aaaatatgtataactcttct

SEQ ID NO: 7782947 - DNA, 22 bp, Homo sapiens
aaacagtattatcaatatattt

SEQ ID NO: 7782948 - DNA, 22 bp, Homo sapiens
aaacagtattatcaatatattt

SEQ ID NO: 7782949 - DNA, 22 bp, Homo sapiens
aaaaatacttcacttctgggtg

SEQ ID NO: 7782950 - DNA, 22 bp, Homo sapiens
aaaaggatcagattttgagcag

SEQ ID NO: 7782951 - DNA, 22 bp, Homo sapiens
aaaaatacttcacttctgggtg

SEQ ID NO: 7782952 - DNA, 22 bp, Homo sapiens
aaaaaggctaagcatcttgtgc

SEQ ID NO: 7782953 - DNA, 22 bp, Homo sapiens
aaaaagcttaaatgagcagttc

SEQ ID NO: 7782954 - DNA, 22 bp, Homo sapiens
aaaaccttctagactttatatt

SEQ ID NO: 7782955 - DNA, 22 bp, Homo sapiens
aaaactctgcagttagtttcta

SEQ ID NO: 7782956 - DNA, 22 bp, Homo sapiens
aaaacctgattgaattctattt

SEQ ID NO: 7782957 - DNA, 22 bp, Homo sapiens
aaaaccttcaggtttggagttt

SEQ ID NO: 7782958 - DNA, 22 bp, Homo sapiens
aaaacctgtgaatagttaactc

SEQ ID NO: 7782959 - DNA, 22 bp, Homo sapiens
aaaacataaactgacagcccat

SEQ ID NO: 7782960 - DNA, 22 bp, Homo sapiens
aaaaggcattttgtcaaccata

SEQ ID NO: 7782961 - DNA, 22 bp, Homo sapiens
aaaaggctaattaagttttgga

SEQ ID NO: 7782962 - DNA, 22 bp, Homo sapiens
aaaacagtttttgctaactgct

SEQ ID NO: 7782963 - DNA, 22 bp, Homo sapiens
aaaattatagatctagtgcctg

SEQ ID NO: 7782964 - DNA, 22 bp, Homo sapiens
aaaattaagtgtctgggaagcc

SEQ ID NO: 7782965 - DNA, 22 bp, Homo sapiens
aaaattatggagtatcccaaag

SEQ ID NO: 7782966 - DNA, 22 bp, Homo sapiens
aaaattatggagtatcccaaag

SEQ ID NO: 7782967 - DNA, 22 bp, Homo sapiens
aaaattcatagaactgtacgct

SEQ ID NO: 7782968 - DNA, 22 bp, Homo sapiens
aaaattcatggcttgggaaaag

SEQ ID NO: 7782969 - DNA, 22 bp, Homo sapiens
aaaactttcagggatacagaaa

SEQ ID NO: 7782970 - DNA, 22 bp, Homo sapiens
aaaattcatggcttgggaaaag

SEQ ID NO: 7782971 - DNA, 22 bp, Homo sapiens
aaaaggtagttgccaaataagg

SEQ ID NO: 7782972 - DNA, 22 bp, Homo sapiens
aaaaggtagttgccaaataagg

SEQ ID NO: 7782973 - DNA, 22 bp, Homo sapiens
aaaaggtagattctccttctat

SEQ ID NO: 7782974 - DNA, 22 bp, Homo sapiens
aaacagcagctgtttaatttgc

SEQ ID NO: 7782975 - DNA, 22 bp, Homo sapiens
aaacagcaatggagaagccagg

SEQ ID NO: 7782976 - DNA, 22 bp, Homo sapiens
aaacagataatgctataaatgg

SEQ ID NO: 7782977 - DNA, 22 bp, Homo sapiens
aaacagctgtcattgttttaaa

SEQ ID NO: 7782978 - DNA, 22 bp, Homo sapiens
aaacagctacttctgtataatg

SEQ ID NO: 7782979 - DNA, 22 bp, Homo sapiens
aaagccagcaaggtgagtttca

SEQ ID NO: 7782980 - DNA, 22 bp, Homo sapiens
aaagccagagtgtgttagagac

SEQ ID NO: 7782981 - DNA, 22 bp, Homo sapiens
aaagccagagcaagctgtcaca

SEQ ID NO: 7782982 - DNA, 22 bp, Homo sapiens
aaagccagaattcgtccagcct

SEQ ID NO: 7782983 - DNA, 22 bp, Homo sapiens
aaacagataagggacaatttca

SEQ ID NO: 7782984 - DNA, 22 bp, Homo sapiens
aaacagataatgctataaatgg

SEQ ID NO: 7782985 - DNA, 22 bp, Homo sapiens
aaagccaggaggagggcgctcg

SEQ ID NO: 7782986 - DNA, 22 bp, Homo sapiens
aaagccagctctgagctgcacc

SEQ ID NO: 7782987 - DNA, 22 bp, Homo sapiens
aaagccagctctgagctgcacc

SEQ ID NO: 7782988 - DNA, 22 bp, Homo sapiens
aaagccaggcagccaagccagt

SEQ ID NO: 7782989 - DNA, 22 bp, Homo sapiens
aaagccaggcagccaagccagt

SEQ ID NO: 7782990 - DNA, 22 bp, Homo sapiens
aaagccaggctggcctggggtt

SEQ ID NO: 7782991 - DNA, 22 bp, Homo sapiens
aaagccaggctggcctggggtt

SEQ ID NO: 7782992 - DNA, 22 bp, Homo sapiens
aaacattcaaagcaggatgtgt

SEQ ID NO: 7782993 - DNA, 22 bp, Homo sapiens
aaacattcacatttgctagtaa

SEQ ID NO: 7782994 - DNA, 22 bp, Homo sapiens
aaacatgttttctgaatatttt

SEQ ID NO: 7782995 - DNA, 22 bp, Homo sapiens
aaacattagacaccatatgctc

SEQ ID NO: 7782996 - DNA, 20 bp, Homo sapiens
aaacattcatgtacaagtga

SEQ ID NO: 7782997 - DNA, 20 bp, Homo sapiens
aaacattcatgtacaagtga

SEQ ID NO: 7782998 - DNA, 22 bp, Homo sapiens
aaacattccatttctatgtaag

SEQ ID NO: 7782999 - DNA, 22 bp, Homo sapiens
aaacatgtttagaaagcagctg

SEQ ID NO: 7783000 - DNA, 22 bp, Homo sapiens
aaacatgtaattctgcttaaga

SEQ ID NO: 7783001 - DNA, 22 bp, Homo sapiens
aaacatgtaattctgcttaaga

SEQ ID NO: 7783002 - DNA, 22 bp, Homo sapiens
aaacatgtaagttcagatcacc

SEQ ID NO: 7783003 - DNA, 22 bp, Homo sapiens
aaacatgtaagttcagatcacc

SEQ ID NO: 7783004 - DNA, 23 bp, Homo sapiens
aaacatgcagcacatgaatgcta

SEQ ID NO: 7783005 - DNA, 22 bp, Homo sapiens
aaacatgctggatttagaatat

SEQ ID NO: 7783006 - DNA, 22 bp, Homo sapiens
aaacattgagcacttgctattt

SEQ ID NO: 7783007 - DNA, 22 bp, Homo sapiens
aaacattgtaattttagcatgg

SEQ ID NO: 7783008 - DNA, 22 bp, Homo sapiens
aaacattgatgggaagtttaat

SEQ ID NO: 7783009 - DNA, 22 bp, Homo sapiens
aaactgcaattacttttgcagc

SEQ ID NO: 7783010 - DNA, 22 bp, Homo sapiens
aaactgcaattacttttgcacc

SEQ ID NO: 7783011 - DNA, 22 bp, Homo sapiens
aaactgcaattatgtttgcaga

SEQ ID NO: 7783012 - DNA, 22 bp, Homo sapiens
aaactgtatagggaaaagtaga

SEQ ID NO: 7783013 - DNA, 22 bp, Homo sapiens
aaactgtaagagaataaactac

SEQ ID NO: 7783014 - DNA, 22 bp, Homo sapiens
aaatagtttagctctcatttca

SEQ ID NO: 7783015 - DNA, 22 bp, Homo sapiens
aaatagttgtttggatcaataa

SEQ ID NO: 7783016 - DNA, 22 bp, Homo sapiens
aaactttggtatgtagcaaaac

SEQ ID NO: 7783017 - DNA, 22 bp, Homo sapiens
aaatagttcagcttgtaaaccc

SEQ ID NO: 7783018 - DNA, 22 bp, Homo sapiens
aaactgtcctcccgaggtttcc

SEQ ID NO: 7783019 - DNA, 22 bp, Homo sapiens
aaatagtcctgggaatagtact

SEQ ID NO: 7783020 - DNA, 22 bp, Homo sapiens
aaatagttagccctgcatatat

SEQ ID NO: 7783021 - DNA, 22 bp, Homo sapiens
aaactttttattctaatgtcta

SEQ ID NO: 7783022 - DNA, 16 bp, Homo sapiens
aaagaaacaggtgtcc

SEQ ID NO: 7783023 - DNA, 22 bp, Homo sapiens
aaagaaacctatcagccacatg

SEQ ID NO: 7783024 - DNA, 21 bp, Homo sapiens
aaagaaatctcccattggtag

SEQ ID NO: 7783025 - DNA, 21 bp, Homo sapiens
aaagaaatctcccattggtag

SEQ ID NO: 7783026 - DNA, 22 bp, Homo sapiens
aaagaaatagatggcatttaaa

SEQ ID NO: 7783027 - DNA, 22 bp, Homo sapiens
aaagaaatacctttctcagctt

SEQ ID NO: 7783028 - DNA, 22 bp, Homo sapiens
aaagaaatagatggcatttaaa

SEQ ID NO: 7783029 - DNA, 22 bp, Homo sapiens
aaagagaaaaagatcccggctc

SEQ ID NO: 7783030 - DNA, 22 bp, Homo sapiens
aaagagaaaatgatctgtacat

SEQ ID NO: 7783031 - DNA, 22 bp, Homo sapiens
aaagagaaaatgatctgtacat

SEQ ID NO: 7783032 - DNA, 22 bp, Homo sapiens
aaagagaaacttagaagcctga

SEQ ID NO: 7783033 - DNA, 20 bp, Homo sapiens
aaagagaagcctcaccttgt

SEQ ID NO: 7783034 - DNA, 22 bp, Homo sapiens
aaagagaacttttacccaagaa

SEQ ID NO: 7783035 - DNA, 22 bp, Homo sapiens
aaagagcaagggctttgaggct

SEQ ID NO: 7783036 - DNA, 22 bp, Homo sapiens
aaagagatgtgccaaatagcct

SEQ ID NO: 7783037 - DNA, 22 bp, Homo sapiens
aaagagcaagctgagatttgaa

SEQ ID NO: 7783038 - DNA, 22 bp, Homo sapiens
aaagacatggaactagagatgg

SEQ ID NO: 7783039 - DNA, 22 bp, Homo sapiens
aaagacatgacacattggagag

SEQ ID NO: 7783040 - DNA, 22 bp, Homo sapiens
aaagactttcacctagcaaaga

SEQ ID NO: 7783041 - DNA, 22 bp, Homo sapiens
aacgcccagccttgatcaaatg

SEQ ID NO: 7783042 - DNA, 22 bp, Homo sapiens
aacgaatagggatttttctaac

SEQ ID NO: 7783043 - DNA, 22 bp, Homo sapiens
aacctgctttctcagagaaggg

SEQ ID NO: 7783044 - DNA, 22 bp, Homo sapiens
aacccgtgatcctgactcccct

SEQ ID NO: 7783045 - DNA, 22 bp, Homo sapiens
aaccctggagaaggctttggat

SEQ ID NO: 7783046 - DNA, 22 bp, Homo sapiens
aaccctggggcagctgctaggg

SEQ ID NO: 7783047 - DNA, 22 bp, Homo sapiens
aaccctggggctgctctgcctg

SEQ ID NO: 7783048 - DNA, 22 bp, Homo sapiens
aacctcaaactcttgggcttaa

SEQ ID NO: 7783049 - DNA, 22 bp, Homo sapiens
aacccgggaggcggaggttgtg

SEQ ID NO: 7783050 - DNA, 22 bp, Homo sapiens
aatgacaagacatagtctctga

SEQ ID NO: 7783051 - DNA, 22 bp, Homo sapiens
aatgacaataatcattaacttt

SEQ ID NO: 7783052 - DNA, 22 bp, Homo sapiens
aatgacagccagattcttctct

SEQ ID NO: 7783053 - DNA, 23 bp, Homo sapiens
aatgacaggcaatgtaattgtgt

SEQ ID NO: 7783054 - DNA, 22 bp, Homo sapiens
aactactcaactctgccattgt

SEQ ID NO: 7783055 - DNA, 22 bp, Homo sapiens
aactactaccacagtcaagaca

SEQ ID NO: 7783056 - DNA, 22 bp, Homo sapiens
aatgacagtgttgggccagatg

SEQ ID NO: 7783057 - DNA, 22 bp, Homo sapiens
aactagaaagaacatatttcca

SEQ ID NO: 7783058 - DNA, 22 bp, Homo sapiens
aatgctttcttataaccactgc

SEQ ID NO: 7783059 - DNA, 22 bp, Homo sapiens
aatggctgggtttcattttgta

SEQ ID NO: 7783060 - DNA, 22 bp, Homo sapiens
aacatatttggctgatattccc

SEQ ID NO: 7783061 - DNA, 22 bp, Homo sapiens
aacatctacagtgagatgttag

SEQ ID NO: 7783062 - DNA, 22 bp, Homo sapiens
aacatatcataggatgtcattg

SEQ ID NO: 7783063 - DNA, 22 bp, Homo sapiens
aacataaatttgaagtggcaaa

SEQ ID NO: 7783064 - DNA, 22 bp, Homo sapiens
aacatatctacggatacgatta

SEQ ID NO: 7783065 - DNA, 22 bp, Homo sapiens
aagtgtcctcattcaacatgca

SEQ ID NO: 7783066 - DNA, 22 bp, Homo sapiens
aagtgtcaatatttttgtaggt

SEQ ID NO: 7783067 - DNA, 22 bp, Homo sapiens
aacagcgacgtcctccccaaca

SEQ ID NO: 7783068 - DNA, 22 bp, Homo sapiens
aatagacattatttctctatga

SEQ ID NO: 7783069 - DNA, 22 bp, Homo sapiens
aatagacaattctagccaacat

SEQ ID NO: 7783070 - DNA, 22 bp, Homo sapiens
aatagaggagctttggactccc

SEQ ID NO: 7783071 - DNA, 22 bp, Homo sapiens
aatagagtcagttctacattct

SEQ ID NO: 7783072 - DNA, 22 bp, Homo sapiens
aatagatactacttagatgtag

SEQ ID NO: 7783073 - DNA, 19 bp, Homo sapiens
aatagattaattatcctct

SEQ ID NO: 7783074 - DNA, 22 bp, Homo sapiens
aatagatgggttaaacagcaaa

SEQ ID NO: 7783075 - DNA, 22 bp, Homo sapiens
aatagatactacttagatgtag

SEQ ID NO: 7783076 - DNA, 22 bp, Homo sapiens
aatagcaaacagacatgcacaa

SEQ ID NO: 7783077 - DNA, 22 bp, Homo sapiens
aacatctttgataaacttagtg

SEQ ID NO: 7783078 - DNA, 22 bp, Homo sapiens
aacatctttttgtttgctgaaa

SEQ ID NO: 7783079 - DNA, 22 bp, Homo sapiens
aatagacaagcaccctggtaaa

SEQ ID NO: 7783080 - DNA, 22 bp, Homo sapiens
aacatctagttcctatataata

SEQ ID NO: 7783081 - DNA, 22 bp, Homo sapiens
aacatctagttcctatataata

SEQ ID NO: 7783082 - DNA, 22 bp, Homo sapiens
aacatcttgtactgcacatttt

SEQ ID NO: 7783083 - DNA, 22 bp, Homo sapiens
aaattcacaagagcattgcctg

SEQ ID NO: 7783084 - DNA, 21 bp, Homo sapiens
aaattcacctagtaaaacttc

SEQ ID NO: 7783085 - DNA, 21 bp, Homo sapiens
aaattcacctagtaaaacttc

SEQ ID NO: 7783086 - DNA, 22 bp, Homo sapiens
aaggctggggtgcagacggcct

SEQ ID NO: 7783087 - DNA, 22 bp, Homo sapiens
aaggctgggtaacctgtccact

SEQ ID NO: 7783088 - DNA, 22 bp, Homo sapiens
aaggctgggtttgggatgtgat

SEQ ID NO: 7783089 - DNA, 22 bp, Homo sapiens
aaggctgggtttgggatgtgat

SEQ ID NO: 7783090 - DNA, 22 bp, Homo sapiens
aaggctgggtaacctgtccact

SEQ ID NO: 7783091 - DNA, 19 bp, Homo sapiens
aaggctggtaccataggtt

SEQ ID NO: 7783092 - DNA, 19 bp, Homo sapiens
aaggctggtaccataggtt

SEQ ID NO: 7783093 - DNA, 22 bp, Homo sapiens
aaattcaattaactttcatgct

SEQ ID NO: 7783094 - DNA, 22 bp, Homo sapiens
aaggcagcaagaattccaggtt

SEQ ID NO: 7783095 - DNA, 22 bp, Homo sapiens
aaggcagatataaagactagag

SEQ ID NO: 7783096 - DNA, 22 bp, Homo sapiens
aaggcagccagatcctttgggt

SEQ ID NO: 7783097 - DNA, 22 bp, Homo sapiens
aaggcagccctggctcagcctg

SEQ ID NO: 7783098 - DNA, 22 bp, Homo sapiens
aaggaagactcgcaggtctatg

SEQ ID NO: 7783099 - DNA, 22 bp, Homo sapiens
aaggaagagcaaagaattatgt

SEQ ID NO: 7783100 - DNA, 22 bp, Homo sapiens
aaatgcatttcactaatgtttc

SEQ ID NO: 7783101 - DNA, 22 bp, Homo sapiens
aaggaagagtctagaacaggca

SEQ ID NO: 7783102 - DNA, 22 bp, Homo sapiens
aaatgtcagaaaacatggagtg

SEQ ID NO: 7783103 - DNA, 22 bp, Homo sapiens
aaatgtcaaggtgatagatgca

SEQ ID NO: 7783104 - DNA, 20 bp, Homo sapiens
aacacagataccaaaggttg

SEQ ID NO: 7783105 - DNA, 22 bp, Homo sapiens
aacacagggcagctgctgggaa

SEQ ID NO: 7783106 - DNA, 22 bp, Homo sapiens
aacacaggggcgtggctcttac

SEQ ID NO: 7783107 - DNA, 22 bp, Homo sapiens
aacacaggccagcctgtgcagt

SEQ ID NO: 7783108 - DNA, 22 bp, Homo sapiens
aacacagagtatttgaagcatt

SEQ ID NO: 7783109 - DNA, 22 bp, Homo sapiens
aacacagaagtgccaagagcca

SEQ ID NO: 7783110 - DNA, 20 bp, Homo sapiens
aacacactggtggcatcagg

SEQ ID NO: 7783111 - DNA, 22 bp, Homo sapiens
aaatttctgttgttttgagcca

SEQ ID NO: 7783112 - DNA, 22 bp, Homo sapiens
aaatttgataagccattgttac

SEQ ID NO: 7783113 - DNA, 22 bp, Homo sapiens
aacaatgtgaagtgctgttcag

SEQ ID NO: 7783114 - DNA, 22 bp, Homo sapiens
aaattttaaggctggaacttaa

SEQ ID NO: 7783115 - DNA, 22 bp, Homo sapiens
aaattttaaggctggaacttaa

SEQ ID NO: 7783116 - DNA, 22 bp, Homo sapiens
aaggctggtcagatgtggtgaa

SEQ ID NO: 7783117 - DNA, 22 bp, Homo sapiens
aaggctggtcagatgtggtgaa

SEQ ID NO: 7783118 - DNA, 22 bp, Homo sapiens
aaggctggttccatccctggtg

SEQ ID NO: 7783119 - DNA, 22 bp, Homo sapiens
aaggctggttccatccctggtg

SEQ ID NO: 7783120 - DNA, 22 bp, Homo sapiens
aaggctggtggattatgaggtc

SEQ ID NO: 7783121 - DNA, 22 bp, Homo sapiens
aaggctggtggattatgaggtc

SEQ ID NO: 7783122 - DNA, 22 bp, Homo sapiens
aacagacagaaaaatgtgatct

SEQ ID NO: 7783123 - DNA, 22 bp, Homo sapiens
aacagacagaaaaatgtgatct

SEQ ID NO: 7783124 - DNA, 22 bp, Homo sapiens
aacagacatatttttaatatgc

SEQ ID NO: 7783125 - DNA, 22 bp, Homo sapiens
aacagaaaaggtaggtggcttt

SEQ ID NO: 7783126 - DNA, 22 bp, Homo sapiens
aacagaaatcatttagggctct

SEQ ID NO: 7783127 - DNA, 22 bp, Homo sapiens
aacagaaatcatttagggctct

SEQ ID NO: 7783128 - DNA, 22 bp, Homo sapiens
aacacagttttccaaaatagag

SEQ ID NO: 7783129 - DNA, 22 bp, Homo sapiens
aacacagtttctctatgagagt

SEQ ID NO: 7783130 - DNA, 22 bp, Homo sapiens
aacacagtttctctatgagagt

SEQ ID NO: 7783131 - DNA, 20 bp, Homo sapiens
aacacagggttaccatcaga

SEQ ID NO: 7783132 - DNA, 22 bp, Homo sapiens
aacacaggttgctgggcctcac

SEQ ID NO: 7783133 - DNA, 22 bp, Homo sapiens
aacacaggttcattctgtgagg

SEQ ID NO: 7783134 - DNA, 22 bp, Homo sapiens
aacactttgttgcctatgaacg

SEQ ID NO: 7783135 - DNA, 22 bp, Homo sapiens
aacactttttatatattgtatc

SEQ ID NO: 7783136 - DNA, 22 bp, Homo sapiens
aagcacatttggaaaacatgga

SEQ ID NO: 7783137 - DNA, 22 bp, Homo sapiens
aagcacattttccagcagctct

SEQ ID NO: 7783138 - DNA, 22 bp, Homo sapiens
aagcacaatttaggactgaaat

SEQ ID NO: 7783139 - DNA, 22 bp, Homo sapiens
aagcaattgtcctgtctctaca

SEQ ID NO: 7783140 - DNA, 19 bp, Homo sapiens
aagcaatgttgtgaatcta

SEQ ID NO: 7783141 - DNA, 22 bp, Homo sapiens
aagcaatatactgatatgatta

SEQ ID NO: 7783142 - DNA, 20 bp, Homo sapiens
aagcaatatagtgcaaatgt

SEQ ID NO: 7783143 - DNA, 22 bp, Homo sapiens
aagcagaatttaatagaaaggt

SEQ ID NO: 7783144 - DNA, 22 bp, Homo sapiens
aagcagaatttcccactagttg

SEQ ID NO: 7783145 - DNA, 20 bp, Homo sapiens
aagcagaagctgctctcagc

SEQ ID NO: 7783146 - DNA, 22 bp, Homo sapiens
aagcagaagttgatctaccata

SEQ ID NO: 7783147 - DNA, 22 bp, Homo sapiens
aagcaggaagctcaggtccttg

SEQ ID NO: 7783148 - DNA, 22 bp, Homo sapiens
acagcctggactggctctctgc

SEQ ID NO: 7783149 - DNA, 22 bp, Homo sapiens
aagcagcttaaattagagcctg

SEQ ID NO: 7783150 - DNA, 22 bp, Homo sapiens
acagcagagccagtggctctag

SEQ ID NO: 7783151 - DNA, 22 bp, Homo sapiens
acagcagagacactcaggaggc

SEQ ID NO: 7783152 - DNA, 22 bp, Homo sapiens
acagcagaccccagtgccatgg

SEQ ID NO: 7783153 - DNA, 22 bp, Homo sapiens
aagcagaggccacagagtgggc

SEQ ID NO: 7783154 - DNA, 22 bp, Homo sapiens
aagcagagggtatggccaggtt

SEQ ID NO: 7783155 - DNA, 22 bp, Homo sapiens
aagcagaggccacagagtgggc

SEQ ID NO: 7783156 - DNA, 22 bp, Homo sapiens
acacatatatgtcgaagtcctc

SEQ ID NO: 7783157 - DNA, 17 bp, Homo sapiens
acacatcttggctttgc

SEQ ID NO: 7783158 - DNA, 22 bp, Homo sapiens
aagagcaggctgctgtggagta

SEQ ID NO: 7783159 - DNA, 22 bp, Homo sapiens
acacatttatggatcgcagaaa

SEQ ID NO: 7783160 - DNA, 22 bp, Homo sapiens
acacatttagcaccaggtttat

SEQ ID NO: 7783161 - DNA, 22 bp, Homo sapiens
acacatttattacatgcatgtg

SEQ ID NO: 7783162 - DNA, 22 bp, Homo sapiens
acacatttctaaatttttaccg

SEQ ID NO: 7783163 - DNA, 22 bp, Homo sapiens
acacattctttaaatgtctgtt

SEQ ID NO: 7783164 - DNA, 22 bp, Homo sapiens
acacatttacatgtttacgtat

SEQ ID NO: 7783165 - DNA, 22 bp, Homo sapiens
acacatttaaaaaggaacatat

SEQ ID NO: 7783166 - DNA, 21 bp, Homo sapiens
aagatgatattttatctgtag

SEQ ID NO: 7783167 - DNA, 22 bp, Homo sapiens
aagatgatgttgtgttttcact

SEQ ID NO: 7783168 - DNA, 22 bp, Homo sapiens
aagatgtgaacagaaccacagg

SEQ ID NO: 7783169 - DNA, 22 bp, Homo sapiens
aagatgtgcagttcatggcagg

SEQ ID NO: 7783170 - DNA, 22 bp, Homo sapiens
aagcaagagttggagtgatgtt

SEQ ID NO: 7783171 - DNA, 22 bp, Homo sapiens
aagcaataatcccaaagtgctg

SEQ ID NO: 7783172 - DNA, 22 bp, Homo sapiens
aagcaatagcaacaactttaca

SEQ ID NO: 7783173 - DNA, 22 bp, Homo sapiens
aagcaataaataatttttagta

SEQ ID NO: 7783174 - DNA, 22 bp, Homo sapiens
aagatgtgctgtcttgccactc

SEQ ID NO: 7783175 - DNA, 22 bp, Homo sapiens
aagagcagattcctagtggagc

SEQ ID NO: 7783176 - DNA, 21 bp, Homo sapiens
acacaaacctcctcagcctgg

SEQ ID NO: 7783177 - DNA, 22 bp, Homo sapiens
acacaaaatcaaagtcctaggc

SEQ ID NO: 7783178 - DNA, 22 bp, Homo sapiens
acacaaacagtctatagcacca

SEQ ID NO: 7783179 - DNA, 22 bp, Homo sapiens
acacaaagttggatgacaaaat

SEQ ID NO: 7783180 - DNA, 22 bp, Homo sapiens
acacaaagttggatgacaaaat

SEQ ID NO: 7783181 - DNA, 22 bp, Homo sapiens
aagagaatatcgatagcactct

SEQ ID NO: 7783182 - DNA, 22 bp, Homo sapiens
aagagaattctggttttcctat

SEQ ID NO: 7783183 - DNA, 22 bp, Homo sapiens
acaatgtttctctttagtcatt

SEQ ID NO: 7783184 - DNA, 20 bp, Homo sapiens
aattttatctccatcctttg

SEQ ID NO: 7783185 - DNA, 20 bp, Homo sapiens
aattttatctccatcctttg

SEQ ID NO: 7783186 - DNA, 20 bp, Homo sapiens
aattttatctccatcctttg

SEQ ID NO: 7783187 - DNA, 22 bp, Homo sapiens
aattttatctctaagcaggctt

SEQ ID NO: 7783188 - DNA, 22 bp, Homo sapiens
aagactttctgtaaagctacag

SEQ ID NO: 7783189 - DNA, 22 bp, Homo sapiens
aagagaagaaagtgtctacaca

SEQ ID NO: 7783190 - DNA, 22 bp, Homo sapiens
aatttcagaccatttgcaatta

SEQ ID NO: 7783191 - DNA, 22 bp, Homo sapiens
aattttaagcatatgactggtt

SEQ ID NO: 7783192 - DNA, 22 bp, Homo sapiens
aattttaatcagtggtgctgag

SEQ ID NO: 7783193 - DNA, 22 bp, Homo sapiens
aagaaatgtgaatattgaatag

SEQ ID NO: 7783194 - DNA, 22 bp, Homo sapiens
aagaaattaatgtgccattact

SEQ ID NO: 7783195 - DNA, 22 bp, Homo sapiens
aagaaattaaggaatgcaacga

SEQ ID NO: 7783196 - DNA, 22 bp, Homo sapiens
aagaacaactgctttaaaagca

SEQ ID NO: 7783197 - DNA, 22 bp, Homo sapiens
aatttaaggaggccttcactct

SEQ ID NO: 7783198 - DNA, 22 bp, Homo sapiens
aagaacaactgctttaaaagca

SEQ ID NO: 7783199 - DNA, 22 bp, Homo sapiens
aatttcacctatcacttaagcc

SEQ ID NO: 7783200 - DNA, 22 bp, Homo sapiens
aatttcacctatcacttaagcc

SEQ ID NO: 7783201 - DNA, 22 bp, Homo sapiens
aatttcactggaaaagataatt

SEQ ID NO: 7783202 - DNA, 22 bp, Homo sapiens
aatttcactggaaaagataatt

SEQ ID NO: 7783203 - DNA, 22 bp, Homo sapiens
aattctacattggttcacattt

SEQ ID NO: 7783204 - DNA, 22 bp, Homo sapiens
aattcccatttgcagaaaatca

SEQ ID NO: 7783205 - DNA, 22 bp, Homo sapiens
aattcacaattatgttgggaga

SEQ ID NO: 7783206 - DNA, 22 bp, Homo sapiens
aattcacaatgtgtagtcatgc

SEQ ID NO: 7783207 - DNA, 20 bp, Homo sapiens
aagaaacttgaaagtacaag

SEQ ID NO: 7783208 - DNA, 20 bp, Homo sapiens
aagaaacttgaaagtacaag

SEQ ID NO: 7783209 - DNA, 20 bp, Homo sapiens
aagaaacttgaaagtacaag

SEQ ID NO: 7783210 - DNA, 22 bp, Homo sapiens
aagaaaatcagttctggtcagt

SEQ ID NO: 7783211 - DNA, 22 bp, Homo sapiens
aagaaaccaaccctgccagcac

SEQ ID NO: 7783212 - DNA, 22 bp, Homo sapiens
aagaaacaaccactgctctcct

SEQ ID NO: 7783213 - DNA, 22 bp, Homo sapiens
aagaaactggaatatagagagc

SEQ ID NO: 7783214 - DNA, 22 bp, Homo sapiens
aagaaactgaaagtggcttcat

SEQ ID NO: 7783215 - DNA, 22 bp, Homo sapiens
aagaaacctagtctggagcagc

SEQ ID NO: 7783216 - DNA, 22 bp, Homo sapiens
aagaaacgtttgagctttgact

SEQ ID NO: 7783217 - DNA, 20 bp, Homo sapiens
aagaaaacgtcttcagggga

SEQ ID NO: 7783218 - DNA, 22 bp, Homo sapiens
aagaaaacaatgacttgccagc

SEQ ID NO: 7783219 - DNA, 22 bp, Homo sapiens
aagaaaagatgtttggttttca

SEQ ID NO: 7783220 - DNA, 19 bp, Homo sapiens
aactggataatggccacat

SEQ ID NO: 7783221 - DNA, 22 bp, Homo sapiens
aatatagatttactcaagagaa

SEQ ID NO: 7783222 - DNA, 22 bp, Homo sapiens
aatatagatttactcaagagaa

SEQ ID NO: 7783223 - DNA, 22 bp, Homo sapiens
actgttcatttggatttctctg

SEQ ID NO: 7783224 - DNA, 22 bp, Homo sapiens
actgttcacccagcactagcag

SEQ ID NO: 7783225 - DNA, 22 bp, Homo sapiens
aatatagttctggtattgttaa

SEQ ID NO: 7783226 - DNA, 22 bp, Homo sapiens
aatatagtgttagctcatttga

SEQ ID NO: 7783227 - DNA, 22 bp, Homo sapiens
aatatagttctagaaatatttt

SEQ ID NO: 7783228 - DNA, 22 bp, Homo sapiens
aatatagttctagaaatatttt

SEQ ID NO: 7783229 - DNA, 22 bp, Homo sapiens
aatactatgtagccaaaataat

SEQ ID NO: 7783230 - DNA, 22 bp, Homo sapiens
aatactatgtagccaaaataat

SEQ ID NO: 7783231 - DNA, 22 bp, Homo sapiens
actttcttaggctgtataaatg

SEQ ID NO: 7783232 - DNA, 22 bp, Homo sapiens
actttcttaggctgtataaatg

SEQ ID NO: 7783233 - DNA, 22 bp, Homo sapiens
actttcttaggctgtataaatg

SEQ ID NO: 7783234 - DNA, 22 bp, Homo sapiens
aatcagaaagatcttgatgaga

SEQ ID NO: 7783235 - DNA, 22 bp, Homo sapiens
aatcacatctcattcaacagcc

SEQ ID NO: 7783236 - DNA, 22 bp, Homo sapiens
aatcacatctcattcaacagcc

SEQ ID NO: 7783237 - DNA, 22 bp, Homo sapiens
aatcagaaaggctaaggaagca

SEQ ID NO: 7783238 - DNA, 20 bp, Homo sapiens
aatcagaaagtgtgagctct

SEQ ID NO: 7783239 - DNA, 22 bp, Homo sapiens
aatcagaaattctacatcacaa

SEQ ID NO: 7783240 - DNA, 22 bp, Homo sapiens
actttgaaactaaaattcatta

SEQ ID NO: 7783241 - DNA, 23 bp, Homo sapiens
actttattgaccccaggtcagtt

SEQ ID NO: 7783242 - DNA, 22 bp, Homo sapiens
actgttctgccaagatcaacgt

SEQ ID NO: 7783243 - DNA, 22 bp, Homo sapiens
actgttctgcatgtacctgagg

SEQ ID NO: 7783244 - DNA, 19 bp, Homo sapiens
actgttctaacttgcagct

SEQ ID NO: 7783245 - DNA, 22 bp, Homo sapiens
actgttgaagtgccagcttgat

SEQ ID NO: 7783246 - DNA, 22 bp, Homo sapiens
actttaaaactgatcatcagag

SEQ ID NO: 7783247 - DNA, 22 bp, Homo sapiens
actttaaaactgatcatcagag

SEQ ID NO: 7783248 - DNA, 22 bp, Homo sapiens
actgttcttcatttagcaaaga

SEQ ID NO: 7783249 - DNA, 22 bp, Homo sapiens
agaaattatgcagtagttttat

SEQ ID NO: 7783250 - DNA, 22 bp, Homo sapiens
agaaattcaattctaattagct

SEQ ID NO: 7783251 - DNA, 22 bp, Homo sapiens
agaaattctaagcatcaatagc

SEQ ID NO: 7783252 - DNA, 22 bp, Homo sapiens
agaaattctaagcatcaatagc

SEQ ID NO: 7783253 - DNA, 22 bp, Homo sapiens
agaaattattagtgaatagtct

SEQ ID NO: 7783254 - DNA, 22 bp, Homo sapiens
agaaattattagtgaatagtct

SEQ ID NO: 7783255 - DNA, 22 bp, Homo sapiens
agaacaaatcgatggaagcctg

SEQ ID NO: 7783256 - DNA, 22 bp, Homo sapiens
agaacaatgcgtattttactcc

SEQ ID NO: 7783257 - DNA, 22 bp, Homo sapiens
agaacaattgccccaaagcttg

SEQ ID NO: 7783258 - DNA, 22 bp, Homo sapiens
agaacaattgccccaaagcttg

SEQ ID NO: 7783259 - DNA, 22 bp, Homo sapiens
aatgataagacatgagtagagg

SEQ ID NO: 7783260 - DNA, 22 bp, Homo sapiens
aatgatgtatgtataaggcagg

SEQ ID NO: 7783261 - DNA, 22 bp, Homo sapiens
agaagcagaaggaagcagggcc

SEQ ID NO: 7783262 - DNA, 22 bp, Homo sapiens
aatgatttggcaaaggaatcca

SEQ ID NO: 7783263 - DNA, 22 bp, Homo sapiens
agaaatgacaagactgatcagg

SEQ ID NO: 7783264 - DNA, 22 bp, Homo sapiens
agaaatgaagcaggagttatta

SEQ ID NO: 7783265 - DNA, 22 bp, Homo sapiens
agaaatagaggaaaggtttgac

SEQ ID NO: 7783266 - DNA, 22 bp, Homo sapiens
aatcataattcaaataagctta

SEQ ID NO: 7783267 - DNA, 22 bp, Homo sapiens
aatcataattcaaataagctta

SEQ ID NO: 7783268 - DNA, 22 bp, Homo sapiens
aatcataattcaaataagctta

SEQ ID NO: 7783269 - DNA, 22 bp, Homo sapiens
aatcaggaactcaagtgcattg

SEQ ID NO: 7783270 - DNA, 22 bp, Homo sapiens
aatcaggaaactatcaacacat

SEQ ID NO: 7783271 - DNA, 21 bp, Homo sapiens
aatcaggaagtgtgtgtcctg

SEQ ID NO: 7783272 - DNA, 22 bp, Homo sapiens
aatcaggagctagggggcaatg

SEQ ID NO: 7783273 - DNA, 19 bp, Homo sapiens
aatcaggagcctaattagg

SEQ ID NO: 7783274 - DNA, 22 bp, Homo sapiens
aatcaggagagctgcgaacgtt

SEQ ID NO: 7783275 - DNA, 22 bp, Homo sapiens
aatcaggacccactctacagtt

SEQ ID NO: 7783276 - DNA, 22 bp, Homo sapiens
aatcaggactgtgccaaaccta

SEQ ID NO: 7783277 - DNA, 22 bp, Homo sapiens
aatcaggagtgtgcactttgat

SEQ ID NO: 7783278 - DNA, 22 bp, Homo sapiens
aatcaggaggataagggggtcc

SEQ ID NO: 7783279 - DNA, 22 bp, Homo sapiens
aatcaggagctgaggtttagcc

SEQ ID NO: 7783280 - DNA, 22 bp, Homo sapiens
aatcaggaggaagccttgggca

SEQ ID NO: 7783281 - DNA, 22 bp, Homo sapiens
aatcaggatagaacctcacgtg

SEQ ID NO: 7783282 - DNA, 22 bp, Homo sapiens
aatcaggatatgaacccaggta

SEQ ID NO: 7783283 - DNA, 22 bp, Homo sapiens
aatcaggatgactgtcatttca

SEQ ID NO: 7783284 - DNA, 22 bp, Homo sapiens
aatcagaatcagttgacacagc

SEQ ID NO: 7783285 - DNA, 22 bp, Homo sapiens
aatcagaaccttgggtcataac

SEQ ID NO: 7783286 - DNA, 22 bp, Homo sapiens
aatcagaacttctcagggtggg

SEQ ID NO: 7783287 - DNA, 22 bp, Homo sapiens
aatcagaactcctaccacagag

SEQ ID NO: 7783288 - DNA, 22 bp, Homo sapiens
aatcagaacttctcagggtggg

SEQ ID NO: 7783289 - DNA, 19 bp, Homo sapiens
actgcactccagcctgggt

SEQ ID NO: 7783290 - DNA, 22 bp, Homo sapiens
actgcactccagcctcggggtc

SEQ ID NO: 7783291 - DNA, 22 bp, Homo sapiens
actgcactccagcctgggtaac

SEQ ID NO: 7783292 - DNA, 22 bp, Homo sapiens
actgcactccaacctgggtgac

SEQ ID NO: 7783293 - DNA, 22 bp, Homo sapiens
actgcactccagcccgagcaac

SEQ ID NO: 7783294 - DNA, 22 bp, Homo sapiens
actgcactccaacctgggtgac

SEQ ID NO: 7783295 - DNA, 22 bp, Homo sapiens
actgaggttgaaatagtgatgt

SEQ ID NO: 7783296 - DNA, 22 bp, Homo sapiens
actctgcttattgctgcaggca

SEQ ID NO: 7783297 - DNA, 22 bp, Homo sapiens
actctgctgtttactctctata

SEQ ID NO: 7783298 - DNA, 22 bp, Homo sapiens
actggcccgggagcagaggcct

SEQ ID NO: 7783299 - DNA, 22 bp, Homo sapiens
actggctgaaagtaaagaacac

SEQ ID NO: 7783300 - DNA, 22 bp, Homo sapiens
aataccttccaacatcaagaca

SEQ ID NO: 7783301 - DNA, 22 bp, Homo sapiens
aataccttccacagtgaccttg

SEQ ID NO: 7783302 - DNA, 22 bp, Homo sapiens
aataccttccaacatcaagaca

SEQ ID NO: 7783303 - DNA, 22 bp, Homo sapiens
aataccttttcagtgcacaaaa

SEQ ID NO: 7783304 - DNA, 22 bp, Homo sapiens
aatacctttcctgccattcact

SEQ ID NO: 7783305 - DNA, 22 bp, Homo sapiens
aataccttgctcatagggctga

SEQ ID NO: 7783306 - DNA, 22 bp, Homo sapiens
aataccttgctgtagccacgca

SEQ ID NO: 7783307 - DNA, 22 bp, Homo sapiens
actggctgaggaagttgccact

SEQ ID NO: 7783308 - DNA, 22 bp, Homo sapiens
actggctgagttgcttcagcaa

SEQ ID NO: 7783309 - DNA, 22 bp, Homo sapiens
actggctgaggaagttgccact

SEQ ID NO: 7783310 - DNA, 22 bp, Homo sapiens
actggctgaagtttactttttg

SEQ ID NO: 7783311 - DNA, 22 bp, Homo sapiens
actgcgtggggagctgtgacta

SEQ ID NO: 7783312 - DNA, 22 bp, Homo sapiens
actgctagtgagaaaataacca

SEQ ID NO: 7783313 - DNA, 22 bp, Homo sapiens
actggacaggttcatggtttta

SEQ ID NO: 7783314 - DNA, 23 bp, Homo sapiens
actggacagagtggacgaggctg

SEQ ID NO: 7783315 - DNA, 22 bp, Homo sapiens
actggacagaggaaatatggag

SEQ ID NO: 7783316 - DNA, 22 bp, Homo sapiens
actggagtacagtggcgtgaac

SEQ ID NO: 7783317 - DNA, 22 bp, Homo sapiens
actggagtgtttggaggatgca

SEQ ID NO: 7783318 - DNA, 22 bp, Homo sapiens
actggagtagatctgactgagt

SEQ ID NO: 7783319 - DNA, 22 bp, Homo sapiens
actggagtattgtttaatacca

SEQ ID NO: 7783320 - DNA, 22 bp, Homo sapiens
actggagtgagtatcgatgaac

SEQ ID NO: 7783321 - DNA, 22 bp, Homo sapiens
actccctccaaatctgcacagt

SEQ ID NO: 7783322 - DNA, 20 bp, Homo sapiens
actctaccagggcagcagca

SEQ ID NO: 7783323 - DNA, 22 bp, Homo sapiens
actcagagaaacagcagggtgt

SEQ ID NO: 7783324 - DNA, 23 bp, Homo sapiens
actcagagaccccgggaagtgac

SEQ ID NO: 7783325 - DNA, 22 bp, Homo sapiens
actcagagaatatctagaagga

SEQ ID NO: 7783326 - DNA, 22 bp, Homo sapiens
actctcaaatattaatctttgg

SEQ ID NO: 7783327 - DNA, 22 bp, Homo sapiens
actctccctgagagggaggcat

SEQ ID NO: 7783328 - DNA, 22 bp, Homo sapiens
actatacataaaacatttgggt

SEQ ID NO: 7783329 - DNA, 22 bp, Homo sapiens
actcactgcactttgaaatgtg

SEQ ID NO: 7783330 - DNA, 22 bp, Homo sapiens
actatacattgaatgttaaggt

SEQ ID NO: 7783331 - DNA, 22 bp, Homo sapiens
actataaaaggataaaccagaa

SEQ ID NO: 7783332 - DNA, 22 bp, Homo sapiens
actataacccatggaatataag

SEQ ID NO: 7783333 - DNA, 23 bp, Homo sapiens
actataaagttgttctgatttac

SEQ ID NO: 7783334 - DNA, 22 bp, Homo sapiens
actataacctgttagaatagat

SEQ ID NO: 7783335 - DNA, 22 bp, Homo sapiens
actatacaagattagggatttg

SEQ ID NO: 7783336 - DNA, 22 bp, Homo sapiens
actatacaccaaaatattaagg

SEQ ID NO: 7783337 - DNA, 22 bp, Homo sapiens
aagtcctttccagtcctgtgat

SEQ ID NO: 7783338 - DNA, 20 bp, Homo sapiens
acgtggccaccagtggctta

SEQ ID NO: 7783339 - DNA, 20 bp, Homo sapiens
acgtggccaccagtggctta

SEQ ID NO: 7783340 - DNA, 18 bp, Homo sapiens
acgtgctgtgccttttgc

SEQ ID NO: 7783341 - DNA, 22 bp, Homo sapiens
actacacagggatgtgactacc

SEQ ID NO: 7783342 - DNA, 22 bp, Homo sapiens
acggtgccggtggtgatgagcc

SEQ ID NO: 7783343 - DNA, 22 bp, Homo sapiens
acgtgcaggatctggttggcga

SEQ ID NO: 7783344 - DNA, 22 bp, Homo sapiens
acgtgcaggatctggttggcga

SEQ ID NO: 7783345 - DNA, 22 bp, Homo sapiens
acgtgcaggatctggttggcga

SEQ ID NO: 7783346 - DNA, 22 bp, Homo sapiens
acggtgaccaagcatcaccgag

SEQ ID NO: 7783347 - DNA, 22 bp, Homo sapiens
acggggctagagaaggtttctt

SEQ ID NO: 7783348 - DNA, 22 bp, Homo sapiens
acctttatgtttgattacaatt

SEQ ID NO: 7783349 - DNA, 22 bp, Homo sapiens
accgtgtctgacactttgggcg

SEQ ID NO: 7783350 - DNA, 22 bp, Homo sapiens
accgggtaggtgtcaactctga

SEQ ID NO: 7783351 - DNA, 22 bp, Homo sapiens
aaggcagagggctggatcagag

SEQ ID NO: 7783352 - DNA, 22 bp, Homo sapiens
aaggcagagggctggatcagag

SEQ ID NO: 7783353 - DNA, 22 bp, Homo sapiens
aaggcagagtctatcttggaag

SEQ ID NO: 7783354 - DNA, 22 bp, Homo sapiens
aaggcagaggaaggtctagttt

SEQ ID NO: 7783355 - DNA, 22 bp, Homo sapiens
aaggcagagattagcagaatga

SEQ ID NO: 7783356 - DNA, 22 bp, Homo sapiens
aaggaggaatgtagccagctcc

SEQ ID NO: 7783357 - DNA, 22 bp, Homo sapiens
aaggaggaatgtagccagctcc

SEQ ID NO: 7783358 - DNA, 22 bp, Homo sapiens
aaggaggaatttcagggtgaat

SEQ ID NO: 7783359 - DNA, 22 bp, Homo sapiens
acatatgaggtgttattctatg

SEQ ID NO: 7783360 - DNA, 22 bp, Homo sapiens
acatagaacctggcacatagta

SEQ ID NO: 7783361 - DNA, 22 bp, Homo sapiens
acagtgtctcactgctgaaatc

SEQ ID NO: 7783362 - DNA, 16 bp, Homo sapiens
acagtgtctcaagcac

SEQ ID NO: 7783363 - DNA, 17 bp, Homo sapiens
acagtgtctatgaaatg

SEQ ID NO: 7783364 - DNA, 22 bp, Homo sapiens
acagtctttaatttctttgtgg

SEQ ID NO: 7783365 - DNA, 22 bp, Homo sapiens
acagtctttcagtaataatact

SEQ ID NO: 7783366 - DNA, 22 bp, Homo sapiens
acagtctttcagtaataatact

SEQ ID NO: 7783367 - DNA, 22 bp, Homo sapiens
acagtgtttaaaataatatgct

SEQ ID NO: 7783368 - DNA, 22 bp, Homo sapiens
acagtcttgcacttctatcagc

SEQ ID NO: 7783369 - DNA, 22 bp, Homo sapiens
acagtcttgcacttctatcagc

SEQ ID NO: 7783370 - DNA, 22 bp, Homo sapiens
acagtcttcatgctagaatggc

SEQ ID NO: 7783371 - DNA, 22 bp, Homo sapiens
acagtcttgagcatcagccaga

SEQ ID NO: 7783372 - DNA, 22 bp, Homo sapiens
acagtcttatgcatacactatt

SEQ ID NO: 7783373 - DNA, 22 bp, Homo sapiens
acagtcttatgcatacactatt

SEQ ID NO: 7783374 - DNA, 22 bp, Homo sapiens
acagtcttaatggataggagct

SEQ ID NO: 7783375 - DNA, 19 bp, Homo sapiens
acagtcttacaaatgtcca

SEQ ID NO: 7783376 - DNA, 19 bp, Homo sapiens
acagtcttacaaatgtcca

SEQ ID NO: 7783377 - DNA, 22 bp, Homo sapiens
aaggacaggctaacctgacatt

SEQ ID NO: 7783378 - DNA, 22 bp, Homo sapiens
aagctggagagttaggtgaata

SEQ ID NO: 7783379 - DNA, 22 bp, Homo sapiens
aaggacaggcacagtggtggag

SEQ ID NO: 7783380 - DNA, 22 bp, Homo sapiens
aaggagagtacaggagttggta

SEQ ID NO: 7783381 - DNA, 22 bp, Homo sapiens
aaggagattgttaaagctatat

SEQ ID NO: 7783382 - DNA, 21 bp, Homo sapiens
aaggagcctaggaggctcagg

SEQ ID NO: 7783383 - DNA, 22 bp, Homo sapiens
aagcgccatggttcctgcgcag

SEQ ID NO: 7783384 - DNA, 22 bp, Homo sapiens
aagccttccctttttgagctca

SEQ ID NO: 7783385 - DNA, 22 bp, Homo sapiens
aagcgccatggttcctgcgcag

SEQ ID NO: 7783386 - DNA, 22 bp, Homo sapiens
aagcgccatggttcctgcgcag

SEQ ID NO: 7783387 - DNA, 22 bp, Homo sapiens
aagcgcagacacagagagtgga

SEQ ID NO: 7783388 - DNA, 22 bp, Homo sapiens
aagccaacatgattactataat

SEQ ID NO: 7783389 - DNA, 22 bp, Homo sapiens
aagccaaggagaatggcctcag

SEQ ID NO: 7783390 - DNA, 22 bp, Homo sapiens
aagccaaggttttggtcacagc

SEQ ID NO: 7783391 - DNA, 22 bp, Homo sapiens
aagccaagtgctggccatgggc

SEQ ID NO: 7783392 - DNA, 22 bp, Homo sapiens
aagcatttttcacagcaacagc

SEQ ID NO: 7783393 - DNA, 22 bp, Homo sapiens
acagcctgtttgatctggtgct

SEQ ID NO: 7783394 - DNA, 19 bp, Homo sapiens
acagcctgttggtggggct

SEQ ID NO: 7783395 - DNA, 21 bp, Homo sapiens
acagcctgtcatctcatggtc

SEQ ID NO: 7783396 - DNA, 22 bp, Homo sapiens
aagctgccttccatgtgaggaa

SEQ ID NO: 7783397 - DNA, 22 bp, Homo sapiens
aagctgcctagagttgaatgtc

SEQ ID NO: 7783398 - DNA, 22 bp, Homo sapiens
acagggcagagggcagttggta

SEQ ID NO: 7783399 - DNA, 19 bp, Homo sapiens
acagggcagcaataggata

SEQ ID NO: 7783400 - DNA, 22 bp, Homo sapiens
acagggcagagaggcaggcttg

SEQ ID NO: 7783401 - DNA, 22 bp, Homo sapiens
acagggcagaaatgttgcatct

SEQ ID NO: 7783402 - DNA, 22 bp, Homo sapiens
aagctcattaattagaagctaa

SEQ ID NO: 7783403 - DNA, 22 bp, Homo sapiens
acatttgtttctctagagtagg

SEQ ID NO: 7783404 - DNA, 22 bp, Homo sapiens
acattttacaccaagacttctt

SEQ ID NO: 7783405 - DNA, 22 bp, Homo sapiens
acattttacagttgtctggcta

SEQ ID NO: 7783406 - DNA, 19 bp, Homo sapiens
accaggcttatggtcagtg

SEQ ID NO: 7783407 - DNA, 19 bp, Homo sapiens
accaggcttatggtcagtg

SEQ ID NO: 7783408 - DNA, 22 bp, Homo sapiens
acccagagcccttagcacagac

SEQ ID NO: 7783409 - DNA, 22 bp, Homo sapiens
aagggcttaggattttgctgtg

SEQ ID NO: 7783410 - DNA, 21 bp, Homo sapiens
accaggcttgtgggagggagc

SEQ ID NO: 7783411 - DNA, 22 bp, Homo sapiens
accctgccgtgggctgcttgtg

SEQ ID NO: 7783412 - DNA, 22 bp, Homo sapiens
accccttctcctggctgttcca

SEQ ID NO: 7783413 - DNA, 22 bp, Homo sapiens
acccagagtgtctgtctcagtc

SEQ ID NO: 7783414 - DNA, 22 bp, Homo sapiens
acccagagtcagacagccatgg

SEQ ID NO: 7783415 - DNA, 21 bp, Homo sapiens
aaggcctgcttactgctagtt

SEQ ID NO: 7783416 - DNA, 22 bp, Homo sapiens
aaggcctgctcagctgtctgtg

SEQ ID NO: 7783417 - DNA, 22 bp, Homo sapiens
aaggcctggatttaggttgtga

SEQ ID NO: 7783418 - DNA, 22 bp, Homo sapiens
aaggcccttggaaaatgcagta

SEQ ID NO: 7783419 - DNA, 22 bp, Homo sapiens
aaggcctccgccaatggcagag

SEQ ID NO: 7783420 - DNA, 22 bp, Homo sapiens
aaggcctcttctctctggagat

SEQ ID NO: 7783421 - DNA, 20 bp, Homo sapiens
aaggcagagtgggttggagc

SEQ ID NO: 7783422 - DNA, 20 bp, Homo sapiens
aaggcagagtgggttggagc

SEQ ID NO: 7783423 - DNA, 22 bp, Homo sapiens
aaggccagggatgccagctcgg

SEQ ID NO: 7783424 - DNA, 22 bp, Homo sapiens
aaggcagataagaattcagcaa

SEQ ID NO: 7783425 - DNA, 22 bp, Homo sapiens
aaggccaggggctggcgcctcc

SEQ ID NO: 7783426 - DNA, 22 bp, Homo sapiens
aaggctccaccctcatggatgc

SEQ ID NO: 7783427 - DNA, 22 bp, Homo sapiens
aaggctccagtgaatgctggca

SEQ ID NO: 7783428 - DNA, 22 bp, Homo sapiens
aaggctccctcttctcgagtgt

SEQ ID NO: 7783429 - DNA, 22 bp, Homo sapiens
aaggctctgcaaaacctccaag

SEQ ID NO: 7783430 - DNA, 21 bp, Homo sapiens
aaggctcctcctctaggcctc

SEQ ID NO: 7783431 - DNA, 22 bp, Homo sapiens
aaggctccgtgactggggctga

SEQ ID NO: 7783432 - DNA, 22 bp, Homo sapiens
aaggctcctttgtagttctttt

SEQ ID NO: 7783433 - DNA, 22 bp, Homo sapiens
aaggctctccaaatgatataat

SEQ ID NO: 7783434 - DNA, 22 bp, Homo sapiens
aaggctctccaaatgatataat

SEQ ID NO: 7783435 - DNA, 22 bp, Homo sapiens
aaggctgggaaacatgcaggcc

SEQ ID NO: 7783436 - DNA, 22 bp, Homo sapiens
aaggctgggaaacatgcaggcc

SEQ ID NO: 7783437 - DNA, 22 bp, Homo sapiens
acatttcatgttttccagagca

SEQ ID NO: 7783438 - DNA, 22 bp, Homo sapiens
aaggctggcaatatatttgtta

SEQ ID NO: 7783439 - DNA, 22 bp, Homo sapiens
aaggctggcaatatatttgtta

SEQ ID NO: 7783440 - DNA, 22 bp, Homo sapiens
acatttctcttgatgtctctat

SEQ ID NO: 7783441 - DNA, 22 bp, Homo sapiens
acatttgtgcaacgtatccaca

SEQ ID NO: 7783442 - DNA, 21 bp, Homo sapiens
aaggctggagatgcaggtctg

SEQ ID NO: 7783443 - DNA, 21 bp, Homo sapiens
aaggctggagatgcaggtctg

SEQ ID NO: 7783444 - DNA, 19 bp, Homo sapiens
aaggctggagaaggcctct

SEQ ID NO: 7783445 - DNA, 19 bp, Homo sapiens
aaggctggagaaggcctct

SEQ ID NO: 7783446 - DNA, 22 bp, Homo sapiens
aaggctggagatggttggaatg

SEQ ID NO: 7783447 - DNA, 22 bp, Homo sapiens
aaggctggagatggttggaatg

SEQ ID NO: 7783448 - DNA, 21 bp, Homo sapiens
aaggctggagatgcaggtctg

SEQ ID NO: 7783449 - DNA, 22 bp, Homo sapiens
aaggctggacctggatgaatct

SEQ ID NO: 7783450 - DNA, 22 bp, Homo sapiens
aaggctggacctggatgaatct

SEQ ID NO: 7783451 - DNA, 19 bp, Homo sapiens
aaggctggagaaggcctct

SEQ ID NO: 7783452 - DNA, 22 bp, Homo sapiens
acatttaaatatgccttatatt

SEQ ID NO: 7783453 - DNA, 22 bp, Homo sapiens
acattgtttgagaatacagatg

SEQ ID NO: 7783454 - DNA, 22 bp, Homo sapiens
acatttaaatacctatgtttct

SEQ ID NO: 7783455 - DNA, 22 bp, Homo sapiens
acatttaaatacctatgtttct

SEQ ID NO: 7783456 - DNA, 22 bp, Homo sapiens
acattgttgcctagccatgagt

SEQ ID NO: 7783457 - DNA, 22 bp, Homo sapiens
aatggagaggctgtgagtgaga

SEQ ID NO: 7783458 - DNA, 22 bp, Homo sapiens
agacaatttcaaagtaatatta

SEQ ID NO: 7783459 - DNA, 22 bp, Homo sapiens
agacaattgttctaagtaaaaa

SEQ ID NO: 7783460 - DNA, 22 bp, Homo sapiens
aatggcactttataaatgttaa

SEQ ID NO: 7783461 - DNA, 22 bp, Homo sapiens
aatgggaagtcactactgttac

SEQ ID NO: 7783462 - DNA, 22 bp, Homo sapiens
agacaatatgtatattaagaat

SEQ ID NO: 7783463 - DNA, 22 bp, Homo sapiens
agacaaaccttgttttatgatg

SEQ ID NO: 7783464 - DNA, 22 bp, Homo sapiens
agacaatatgtatattaagaat

SEQ ID NO: 7783465 - DNA, 22 bp, Homo sapiens
agacaatgcaagcagggagtgg

SEQ ID NO: 7783466 - DNA, 20 bp, Homo sapiens
agacaatgagtgacagagtt

SEQ ID NO: 7783467 - DNA, 22 bp, Homo sapiens
agacaatggagagcagagtact

SEQ ID NO: 7783468 - DNA, 22 bp, Homo sapiens
agacaatggctaagtaacctgt

SEQ ID NO: 7783469 - DNA, 22 bp, Homo sapiens
agacaatggagggaaatacttc

SEQ ID NO: 7783470 - DNA, 22 bp, Homo sapiens
agacaatgtcaaggtgatcatc

SEQ ID NO: 7783471 - DNA, 19 bp, Homo sapiens
agacaatggggttggcagt

SEQ ID NO: 7783472 - DNA, 22 bp, Homo sapiens
agacaatgtttggtctacactt

SEQ ID NO: 7783473 - DNA, 22 bp, Homo sapiens
agacaatgtcaaggtgatcatc

SEQ ID NO: 7783474 - DNA, 22 bp, Homo sapiens
agaagcagactctgaggcaagg

SEQ ID NO: 7783475 - DNA, 22 bp, Homo sapiens
agacaaacccagtggctgtttt

SEQ ID NO: 7783476 - DNA, 20 bp, Homo sapiens
agacaaaatgacttcatgca

SEQ ID NO: 7783477 - DNA, 23 bp, Homo sapiens
agaagcagcttctggagtatcgg

SEQ ID NO: 7783478 - DNA, 23 bp, Homo sapiens
aatgggtgcaactatccatgaca

SEQ ID NO: 7783479 - DNA, 22 bp, Homo sapiens
aattaacagagggcttattact

SEQ ID NO: 7783480 - DNA, 22 bp, Homo sapiens
aattaaaagataacccatgagt

SEQ ID NO: 7783481 - DNA, 22 bp, Homo sapiens
aattaaattggtttagagagga

SEQ ID NO: 7783482 - DNA, 22 bp, Homo sapiens
aatgttttaaaagagattgaga

SEQ ID NO: 7783483 - DNA, 22 bp, Homo sapiens
agaccctttgggtctgtgcagg

SEQ ID NO: 7783484 - DNA, 22 bp, Homo sapiens
aatgtgtaaaaggttttcttca

SEQ ID NO: 7783485 - DNA, 22 bp, Homo sapiens
agagccaggctcccatggggca

SEQ ID NO: 7783486 - DNA, 22 bp, Homo sapiens
agagcctggaggttctgctgaa

SEQ ID NO: 7783487 - DNA, 22 bp, Homo sapiens
agagcctgcatcaggcttgggg

SEQ ID NO: 7783488 - DNA, 22 bp, Homo sapiens
acaacacatgtgtatatgtgtg

SEQ ID NO: 7783489 - DNA, 22 bp, Homo sapiens
acaacacagctttcctcaagtt

SEQ ID NO: 7783490 - DNA, 22 bp, Homo sapiens
acaacacagctttcctcaagtt

SEQ ID NO: 7783491 - DNA, 22 bp, Homo sapiens
agataacatttattgaatgtaa

SEQ ID NO: 7783492 - DNA, 22 bp, Homo sapiens
agataaattcctaagatttcag

SEQ ID NO: 7783493 - DNA, 22 bp, Homo sapiens
acaacagagctggactgagagg

SEQ ID NO: 7783494 - DNA, 22 bp, Homo sapiens
acaacaaagacacttgaaatga

SEQ ID NO: 7783495 - DNA, 22 bp, Homo sapiens
acaacaaagacacttgaaatga

SEQ ID NO: 7783496 - DNA, 22 bp, Homo sapiens
acaacacagctttcctcaagtt

SEQ ID NO: 7783497 - DNA, 22 bp, Homo sapiens
acaagagtatctttgactttag

SEQ ID NO: 7783498 - DNA, 22 bp, Homo sapiens
acaagagtctgcatttctaaca

SEQ ID NO: 7783499 - DNA, 22 bp, Homo sapiens
acaagataaggtgtcagtgtgt

SEQ ID NO: 7783500 - DNA, 22 bp, Homo sapiens
acaagatagcttagaagattca

SEQ ID NO: 7783501 - DNA, 22 bp, Homo sapiens
acaagaattatttctagttaac

SEQ ID NO: 7783502 - DNA, 22 bp, Homo sapiens
acaagagacaagaggttcttct

SEQ ID NO: 7783503 - DNA, 22 bp, Homo sapiens
agataataaatgttttaggttt

SEQ ID NO: 7783504 - DNA, 22 bp, Homo sapiens
agataataagtctggtaataat

SEQ ID NO: 7783505 - DNA, 22 bp, Homo sapiens
acaactagcaggtattaatttt

SEQ ID NO: 7783506 - DNA, 22 bp, Homo sapiens
acaagcatgtggtaaaaagacc

SEQ ID NO: 7783507 - DNA, 22 bp, Homo sapiens
acaagcagtaaaggccacagtc

SEQ ID NO: 7783508 - DNA, 22 bp, Homo sapiens
acaagcttccaggtgatgctga

SEQ ID NO: 7783509 - DNA, 22 bp, Homo sapiens
acaagataggttgagtctagcc

SEQ ID NO: 7783510 - DNA, 22 bp, Homo sapiens
acaagcacttcactgtcctctg

SEQ ID NO: 7783511 - DNA, 22 bp, Homo sapiens
acaagcagaaggtggggtctta

SEQ ID NO: 7783512 - DNA, 22 bp, Homo sapiens
acaatgattttttagagtagtt

SEQ ID NO: 7783513 - DNA, 22 bp, Homo sapiens
acaatgatgcagatgagtaaga

SEQ ID NO: 7783514 - DNA, 19 bp, Homo sapiens
acaatgaatgtgttctctt

SEQ ID NO: 7783515 - DNA, 22 bp, Homo sapiens
acaatgaatactaagcaccagg

SEQ ID NO: 7783516 - DNA, 22 bp, Homo sapiens
acaatgaagataatgttgcagt

SEQ ID NO: 7783517 - DNA, 22 bp, Homo sapiens
acaatgaagggagacacttgct

SEQ ID NO: 7783518 - DNA, 22 bp, Homo sapiens
acaatgaaccaaatttaccaat

SEQ ID NO: 7783519 - DNA, 22 bp, Homo sapiens
acaatgaaaaaatttactgtgg

SEQ ID NO: 7783520 - DNA, 22 bp, Homo sapiens
acaatcttattagtagtataga

SEQ ID NO: 7783521 - DNA, 20 bp, Homo sapiens
agaggcttccttgggaggag

SEQ ID NO: 7783522 - DNA, 22 bp, Homo sapiens
acaaagaaggaattggtcttta

SEQ ID NO: 7783523 - DNA, 19 bp, Homo sapiens
acaaagctgtgagcagctt

SEQ ID NO: 7783524 - DNA, 19 bp, Homo sapiens
acaaagctgtgagcagctt

SEQ ID NO: 7783525 - DNA, 18 bp, Homo sapiens
acaaaggatcatgaggga

SEQ ID NO: 7783526 - DNA, 22 bp, Homo sapiens
agaggctgtgcccaccaggcaa

SEQ ID NO: 7783527 - DNA, 22 bp, Homo sapiens
agaggctgtgcccaccaggcaa

SEQ ID NO: 7783528 - DNA, 22 bp, Homo sapiens
agaggctgtgcccaccaggcaa

SEQ ID NO: 7783529 - DNA, 22 bp, Homo sapiens
agaggctgtgcagagggagtgc

SEQ ID NO: 7783530 - DNA, 22 bp, Homo sapiens
agaggctgttacactcccagat

SEQ ID NO: 7783531 - DNA, 22 bp, Homo sapiens
agaggctgtgcccaccaggcaa

SEQ ID NO: 7783532 - DNA, 22 bp, Homo sapiens
agaggctgttacactcccagat

SEQ ID NO: 7783533 - DNA, 23 bp, Homo sapiens
acaaagtaattcctgcttccaaa

SEQ ID NO: 7783534 - DNA, 22 bp, Homo sapiens
acaaagtaggaagattagctga

SEQ ID NO: 7783535 - DNA, 22 bp, Homo sapiens
acaaagtaggcagtgggctgga

SEQ ID NO: 7783536 - DNA, 22 bp, Homo sapiens
acaaagtaggtcatcaaagctc

SEQ ID NO: 7783537 - DNA, 22 bp, Homo sapiens
acaaagtaggcagtgggctgga

SEQ ID NO: 7783538 - DNA, 22 bp, Homo sapiens
acaaagtagtcaaagtagatga

SEQ ID NO: 7783539 - DNA, 20 bp, Homo sapiens
acaaagtattgaggacaagt

SEQ ID NO: 7783540 - DNA, 22 bp, Homo sapiens
acaaagtaagggctaatgagca

SEQ ID NO: 7783541 - DNA, 21 bp, Homo sapiens
agaggccctcggactgggcgt

SEQ ID NO: 7783542 - DNA, 22 bp, Homo sapiens
agaggctctggtgcagcatgca

SEQ ID NO: 7783543 - DNA, 22 bp, Homo sapiens
agaggctctttgagctgggaga

SEQ ID NO: 7783544 - DNA, 22 bp, Homo sapiens
agaggctctgccgcctcaggta

SEQ ID NO: 7783545 - DNA, 22 bp, Homo sapiens
agaggctctaataccagcatgg

SEQ ID NO: 7783546 - DNA, 22 bp, Homo sapiens
agaggctctaatcccctccaca

SEQ ID NO: 7783547 - DNA, 22 bp, Homo sapiens
aattgagatgacagaggaatag

SEQ ID NO: 7783548 - DNA, 22 bp, Homo sapiens
aattgcataaaattcaactctg

SEQ ID NO: 7783549 - DNA, 22 bp, Homo sapiens
aattgcatgttaatgactaagt

SEQ ID NO: 7783550 - DNA, 22 bp, Homo sapiens
acacagataatgctcatatagg

SEQ ID NO: 7783551 - DNA, 22 bp, Homo sapiens
acacagatattgtacttgatcc

SEQ ID NO: 7783552 - DNA, 22 bp, Homo sapiens
agcagctggggcctgtgacgat

SEQ ID NO: 7783553 - DNA, 22 bp, Homo sapiens
agcagctgggtccggcggagca

SEQ ID NO: 7783554 - DNA, 17 bp, Homo sapiens
agcagctgggttgatct

SEQ ID NO: 7783555 - DNA, 22 bp, Homo sapiens
acacagagcttctcaactggga

SEQ ID NO: 7783556 - DNA, 22 bp, Homo sapiens
acacagagtatcttttgcctag

SEQ ID NO: 7783557 - DNA, 22 bp, Homo sapiens
acacagaggtggccactctttt

SEQ ID NO: 7783558 - DNA, 22 bp, Homo sapiens
acacagagggcagaagatacat

SEQ ID NO: 7783559 - DNA, 22 bp, Homo sapiens
acacagagtttgacacatggga

SEQ ID NO: 7783560 - DNA, 22 bp, Homo sapiens
agcagagcctgggctaggggtg

SEQ ID NO: 7783561 - DNA, 22 bp, Homo sapiens
agcagagcccttccatggcctt

SEQ ID NO: 7783562 - DNA, 22 bp, Homo sapiens
agcagagcccttccatggcctt

SEQ ID NO: 7783563 - DNA, 22 bp, Homo sapiens
agcagagcctgggctaggggtg

SEQ ID NO: 7783564 - DNA, 18 bp, Homo sapiens
agcagagcccatgcattc

SEQ ID NO: 7783565 - DNA, 19 bp, Homo sapiens
agcagagccctgaagatcc

SEQ ID NO: 7783566 - DNA, 22 bp, Homo sapiens
agcagatgtgtctctgcactgt

SEQ ID NO: 7783567 - DNA, 22 bp, Homo sapiens
agcagatgttccctggtccctt

SEQ ID NO: 7783568 - DNA, 22 bp, Homo sapiens
agcagagcagaatgtgaaggtg

SEQ ID NO: 7783569 - DNA, 19 bp, Homo sapiens
agcagagcaaagtggctga

SEQ ID NO: 7783570 - DNA, 22 bp, Homo sapiens
agcagagccagaattggaccag

SEQ ID NO: 7783571 - DNA, 22 bp, Homo sapiens
agcagagcatggtgggaagggc

SEQ ID NO: 7783572 - DNA, 22 bp, Homo sapiens
acaatgcaccagcatcttcacc

SEQ ID NO: 7783573 - DNA, 22 bp, Homo sapiens
acaatgcacctattttaaaact

SEQ ID NO: 7783574 - DNA, 22 bp, Homo sapiens
acactagtggaaattgatttgt

SEQ ID NO: 7783575 - DNA, 22 bp, Homo sapiens
acacccaggaataaggactggg

SEQ ID NO: 7783576 - DNA, 22 bp, Homo sapiens
acacattataggcaatcaaaag

SEQ ID NO: 7783577 - DNA, 22 bp, Homo sapiens
acacattatagagagtataata

SEQ ID NO: 7783578 - DNA, 22 bp, Homo sapiens
acacttcagcagtatgcttggg

SEQ ID NO: 7783579 - DNA, 22 bp, Homo sapiens
acacattaacctttgaaattct

SEQ ID NO: 7783580 - DNA, 22 bp, Homo sapiens
agcagctgtactttcatctgtt

SEQ ID NO: 7783581 - DNA, 22 bp, Homo sapiens
acacaggcatagccatacatgt

SEQ ID NO: 7783582 - DNA, 18 bp, Homo sapiens
acacaggctgacagcacc

SEQ ID NO: 7783583 - DNA, 22 bp, Homo sapiens
agcagctggttcccgagggcgt

SEQ ID NO: 7783584 - DNA, 22 bp, Homo sapiens
acacagggatatttcaggtggt

SEQ ID NO: 7783585 - DNA, 17 bp, Homo sapiens
acacagggagagggagc

SEQ ID NO: 7783586 - DNA, 19 bp, Homo sapiens
acacagggatcagagggtt

SEQ ID NO: 7783587 - DNA, 22 bp, Homo sapiens
acacagggcagagagctggctc

SEQ ID NO: 7783588 - DNA, 22 bp, Homo sapiens
acacagggcggaaagcatgaga

SEQ ID NO: 7783589 - DNA, 22 bp, Homo sapiens
acacagggcagagagctggctc

SEQ ID NO: 7783590 - DNA, 22 bp, Homo sapiens
acacatctccagccagcaggag

SEQ ID NO: 7783591 - DNA, 22 bp, Homo sapiens
acacatcttagactgaaatatg

SEQ ID NO: 7783592 - DNA, 22 bp, Homo sapiens
acagattatggatatatgtgga

SEQ ID NO: 7783593 - DNA, 22 bp, Homo sapiens
acagatggtactaaacccatat

SEQ ID NO: 7783594 - DNA, 22 bp, Homo sapiens
acagatggggcacaaagccaca

SEQ ID NO: 7783595 - DNA, 21 bp, Homo sapiens
acagatgggatgagcacactg

SEQ ID NO: 7783596 - DNA, 19 bp, Homo sapiens
acagatggaggaatctggg

SEQ ID NO: 7783597 - DNA, 22 bp, Homo sapiens
agctcctgcaccaggggcccct

SEQ ID NO: 7783598 - DNA, 22 bp, Homo sapiens
agctcctgcccaggaaggctct

SEQ ID NO: 7783599 - DNA, 22 bp, Homo sapiens
agctcctgcgcacggtgcacac

SEQ ID NO: 7783600 - DNA, 22 bp, Homo sapiens
agctcctgcttgacagaagagg

SEQ ID NO: 7783601 - DNA, 22 bp, Homo sapiens
acagcacaatctgagtcccaga

SEQ ID NO: 7783602 - DNA, 22 bp, Homo sapiens
acagagctgggatctgaaccca

SEQ ID NO: 7783603 - DNA, 22 bp, Homo sapiens
agcctctcttatcccttcaaag

SEQ ID NO: 7783604 - DNA, 22 bp, Homo sapiens
agcctctctgttagtcactggg

SEQ ID NO: 7783605 - DNA, 22 bp, Homo sapiens
agcctctcatgttctcccccag

SEQ ID NO: 7783606 - DNA, 22 bp, Homo sapiens
agcctctccagagcctggcaga

SEQ ID NO: 7783607 - DNA, 22 bp, Homo sapiens
agcctctcactgtcaccctccc

SEQ ID NO: 7783608 - DNA, 22 bp, Homo sapiens
acagagcatttgggacagagag

SEQ ID NO: 7783609 - DNA, 22 bp, Homo sapiens
agcctctctttctggtggctaa

SEQ ID NO: 7783610 - DNA, 22 bp, Homo sapiens
agcctctctttattcccagcta

SEQ ID NO: 7783611 - DNA, 22 bp, Homo sapiens
agcctctgatgatcacaggggg

SEQ ID NO: 7783612 - DNA, 22 bp, Homo sapiens
agcctctgatgatcacaggggg

SEQ ID NO: 7783613 - DNA, 22 bp, Homo sapiens
agcctctgatggctcccaagga

SEQ ID NO: 7783614 - DNA, 19 bp, Homo sapiens
agccagggtgagaaggagc

SEQ ID NO: 7783615 - DNA, 19 bp, Homo sapiens
agccagggtccagacatgt

SEQ ID NO: 7783616 - DNA, 22 bp, Homo sapiens
agccagggtaaggtacttagta

SEQ ID NO: 7783617 - DNA, 21 bp, Homo sapiens
agccagggtggacactgtatg

SEQ ID NO: 7783618 - DNA, 22 bp, Homo sapiens
acagagaaagtgggctgaagat

SEQ ID NO: 7783619 - DNA, 21 bp, Homo sapiens
acagagaaagagcagcctcct

SEQ ID NO: 7783620 - DNA, 21 bp, Homo sapiens
acagagaaagagcagcctcct

SEQ ID NO: 7783621 - DNA, 23 bp, Homo sapiens
acagagacaatggtttcatcttg

SEQ ID NO: 7783622 - DNA, 22 bp, Homo sapiens
acagagaaagtgggctgaagat

SEQ ID NO: 7783623 - DNA, 22 bp, Homo sapiens
acagagactaagcttttcatca

SEQ ID NO: 7783624 - DNA, 22 bp, Homo sapiens
acagagagaggcccgaggctgc

SEQ ID NO: 7783625 - DNA, 22 bp, Homo sapiens
acagaaaagtttacttttgctc

SEQ ID NO: 7783626 - DNA, 22 bp, Homo sapiens
acagaaaaatgagggagctgga

SEQ ID NO: 7783627 - DNA, 22 bp, Homo sapiens
acacttttgtttgaagtctcca

SEQ ID NO: 7783628 - DNA, 22 bp, Homo sapiens
acagaaaaatgagggagctgga

SEQ ID NO: 7783629 - DNA, 22 bp, Homo sapiens
acagaaacccagaaaacctctc

SEQ ID NO: 7783630 - DNA, 22 bp, Homo sapiens
acagaaaatgccagaagggtgg

SEQ ID NO: 7783631 - DNA, 22 bp, Homo sapiens
acacttttaagactttaatgaa

SEQ ID NO: 7783632 - DNA, 22 bp, Homo sapiens
acactttatcaatattcaaaaa

SEQ ID NO: 7783633 - DNA, 22 bp, Homo sapiens
agccagggggacgctttctggc

SEQ ID NO: 7783634 - DNA, 22 bp, Homo sapiens
acagaaagataggcacaaggtc

SEQ ID NO: 7783635 - DNA, 22 bp, Homo sapiens
taaatgagatgtacataactca

SEQ ID NO: 7783636 - DNA, 22 bp, Homo sapiens
taaatgagtaatatagctgttt

SEQ ID NO: 7783637 - DNA, 22 bp, Homo sapiens
taaatgagggctgacatgattg

SEQ ID NO: 7783638 - DNA, 22 bp, Homo sapiens
taacactaagaatctaaattta

SEQ ID NO: 7783639 - DNA, 22 bp, Homo sapiens
taaatgaaagggtttaatttat

SEQ ID NO: 7783640 - DNA, 22 bp, Homo sapiens
taaatgaaagggtttaatttat

SEQ ID NO: 7783641 - DNA, 22 bp, Homo sapiens
taaatgaagaaatggagattgt

SEQ ID NO: 7783642 - DNA, 22 bp, Homo sapiens
taaatcactcctaataatcagt

SEQ ID NO: 7783643 - DNA, 22 bp, Homo sapiens
taaatcactgtactttattcct

SEQ ID NO: 7783644 - DNA, 22 bp, Homo sapiens
taacagaatcctgttattgcca

SEQ ID NO: 7783645 - DNA, 22 bp, Homo sapiens
taagaaatttagttatagaatg

SEQ ID NO: 7783646 - DNA, 22 bp, Homo sapiens
taaagcaggtgctcagtgacca

SEQ ID NO: 7783647 - DNA, 22 bp, Homo sapiens
taaaaccataaggctggaagga

SEQ ID NO: 7783648 - DNA, 22 bp, Homo sapiens
taaaaccataaggctggaagga

SEQ ID NO: 7783649 - DNA, 22 bp, Homo sapiens
taaaacagcagggcagagaagt

SEQ ID NO: 7783650 - DNA, 22 bp, Homo sapiens
taaaaccataaggctggaagga

SEQ ID NO: 7783651 - DNA, 22 bp, Homo sapiens
taaaaccaggtcttgggattta

SEQ ID NO: 7783652 - DNA, 22 bp, Homo sapiens
taaaggaactgctgctatggaa

SEQ ID NO: 7783653 - DNA, 22 bp, Homo sapiens
taaaggaacagaggactcattt

SEQ ID NO: 7783654 - DNA, 22 bp, Homo sapiens
taaagcttgtattgcaatattt

SEQ ID NO: 7783655 - DNA, 19 bp, Homo sapiens
taaaggaagaggaagggaa

SEQ ID NO: 7783656 - DNA, 22 bp, Homo sapiens
taaaggaagaattctctgtgat

SEQ ID NO: 7783657 - DNA, 19 bp, Homo sapiens
taaaggaagaagggaggat

SEQ ID NO: 7783658 - DNA, 22 bp, Homo sapiens
taaaggaatcagttttagagat

SEQ ID NO: 7783659 - DNA, 18 bp, Homo sapiens
taaaggaagtgggagagg

SEQ ID NO: 7783660 - DNA, 22 bp, Homo sapiens
taaaggcaaatgtgtgtttgtg

SEQ ID NO: 7783661 - DNA, 22 bp, Homo sapiens
taaaggcacggagttgttatgg

SEQ ID NO: 7783662 - DNA, 22 bp, Homo sapiens
taaaggcctagtaagttgagac

SEQ ID NO: 7783663 - DNA, 22 bp, Homo sapiens
taaaggccatgatggaggatca

SEQ ID NO: 7783664 - DNA, 22 bp, Homo sapiens
taaaggccagggcctgagtgct

SEQ ID NO: 7783665 - DNA, 22 bp, Homo sapiens
taaaggcatgcaggtgaatgta

SEQ ID NO: 7783666 - DNA, 22 bp, Homo sapiens
taaaggcagcctaggaagtgtt

SEQ ID NO: 7783667 - DNA, 22 bp, Homo sapiens
gtttttccttgctgaggacccg

SEQ ID NO: 7783668 - DNA, 19 bp, Homo sapiens
gtttttcccagacgaggca

SEQ ID NO: 7783669 - DNA, 22 bp, Homo sapiens
gtttttcctgctgacttgggtc

SEQ ID NO: 7783670 - DNA, 22 bp, Homo sapiens
gtttaataatgttgaattacta

SEQ ID NO: 7783671 - DNA, 22 bp, Homo sapiens
gttgttttgctgtctgtcttag

SEQ ID NO: 7783672 - DNA, 22 bp, Homo sapiens
gttgtttttgaacggtggtggc

SEQ ID NO: 7783673 - DNA, 19 bp, Homo sapiens
gttgtttttcttattatgg

SEQ ID NO: 7783674 - DNA, 22 bp, Homo sapiens
gttgttttgcaggatccttaca

SEQ ID NO: 7783675 - DNA, 22 bp, Homo sapiens
gttgttttcagcagtttatgac

SEQ ID NO: 7783676 - DNA, 22 bp, Homo sapiens
gttgtttttgttctctatagct

SEQ ID NO: 7783677 - DNA, 22 bp, Homo sapiens
gtttttctttgtgtgaagacaa

SEQ ID NO: 7783678 - DNA, 22 bp, Homo sapiens
gtttttctgtgagcggtaaagg

SEQ ID NO: 7783679 - DNA, 22 bp, Homo sapiens
gtttttctagaaatctcctcct

SEQ ID NO: 7783680 - DNA, 22 bp, Homo sapiens
gttctgaatgtgcctgtactct

SEQ ID NO: 7783681 - DNA, 22 bp, Homo sapiens
gttctattctccagttacatat

SEQ ID NO: 7783682 - DNA, 22 bp, Homo sapiens
gttctatttcagtaagcaggca

SEQ ID NO: 7783683 - DNA, 22 bp, Homo sapiens
gttctatttcagtaagcaggca

SEQ ID NO: 7783684 - DNA, 16 bp, Homo sapiens
gttctattttcgtcct

SEQ ID NO: 7783685 - DNA, 22 bp, Homo sapiens
gttctattccccttatctgtga

SEQ ID NO: 7783686 - DNA, 21 bp, Homo sapiens
gttctattttgcaaacttctg

SEQ ID NO: 7783687 - DNA, 22 bp, Homo sapiens
gttgtttataaaaatatctagc

SEQ ID NO: 7783688 - DNA, 22 bp, Homo sapiens
gttgttttattgtgagtcccat

SEQ ID NO: 7783689 - DNA, 22 bp, Homo sapiens
gttgttttataggctcatgcct

SEQ ID NO: 7783690 - DNA, 22 bp, Homo sapiens
gttgttttcacaaacccatgat

SEQ ID NO: 7783691 - DNA, 22 bp, Homo sapiens
gttgttttataattgattgcaa

SEQ ID NO: 7783692 - DNA, 22 bp, Homo sapiens
gttgttttaaaatactccagaa

SEQ ID NO: 7783693 - DNA, 21 bp, Homo sapiens
gttgtggttggggctgcagct

SEQ ID NO: 7783694 - DNA, 22 bp, Homo sapiens
gttctgagtggcccaagccctg

SEQ ID NO: 7783695 - DNA, 22 bp, Homo sapiens
gttctattcattgctccacgag

SEQ ID NO: 7783696 - DNA, 22 bp, Homo sapiens
gttctattactccctgcttctt

SEQ ID NO: 7783697 - DNA, 22 bp, Homo sapiens
gttctaggttagaaggacagat

SEQ ID NO: 7783698 - DNA, 22 bp, Homo sapiens
gttctaggctaggggagtaaga

SEQ ID NO: 7783699 - DNA, 22 bp, Homo sapiens
gttctagatgactgagcagctg

SEQ ID NO: 7783700 - DNA, 22 bp, Homo sapiens
gttctaggagccaagaatatag

SEQ ID NO: 7783701 - DNA, 22 bp, Homo sapiens
gttctacagttcctattactta

SEQ ID NO: 7783702 - DNA, 22 bp, Homo sapiens
gttcaagaccagcctggccaac

SEQ ID NO: 7783703 - DNA, 18 bp, Homo sapiens
gttcaagccaacatcaag

SEQ ID NO: 7783704 - DNA, 22 bp, Homo sapiens
gttcaagaccagcctggccaac

SEQ ID NO: 7783705 - DNA, 22 bp, Homo sapiens
gttcaagaccagcctggccaac

SEQ ID NO: 7783706 - DNA, 21 bp, Homo sapiens
gttcaaatcctgacactacac

SEQ ID NO: 7783707 - DNA, 22 bp, Homo sapiens
gtgtgcagtagagaaagagcag

SEQ ID NO: 7783708 - DNA, 22 bp, Homo sapiens
gtgtgcagggggccagcgcagc

SEQ ID NO: 7783709 - DNA, 22 bp, Homo sapiens
gtgtgcagaagacacaagacat

SEQ ID NO: 7783710 - DNA, 22 bp, Homo sapiens
gtgtgcagaggcaggaggtgct

SEQ ID NO: 7783711 - DNA, 22 bp, Homo sapiens
gtgtgcagaacagggagtgggt

SEQ ID NO: 7783712 - DNA, 22 bp, Homo sapiens
gtgtgcaactttcattaatatt

SEQ ID NO: 7783713 - DNA, 22 bp, Homo sapiens
gtgtgcagtgagcaaaagatct

SEQ ID NO: 7783714 - DNA, 22 bp, Homo sapiens
gtgtgtacaaatttcatgtaaa

SEQ ID NO: 7783715 - DNA, 22 bp, Homo sapiens
gtgtggggtcttctcttggcct

SEQ ID NO: 7783716 - DNA, 22 bp, Homo sapiens
gtgtctgagtttggaaagtcca

SEQ ID NO: 7783717 - DNA, 22 bp, Homo sapiens
gtgtctcttcctttcaagtggg

SEQ ID NO: 7783718 - DNA, 22 bp, Homo sapiens
gtggtgtggctggcagagttta

SEQ ID NO: 7783719 - DNA, 22 bp, Homo sapiens
gtggtgtggctggcagagttta

SEQ ID NO: 7783720 - DNA, 22 bp, Homo sapiens
gtggtgcaggccagcaggggcg

SEQ ID NO: 7783721 - DNA, 22 bp, Homo sapiens
gtggtgcaggccagcaggggcg

SEQ ID NO: 7783722 - DNA, 22 bp, Homo sapiens
gtggttcacttgaggtcaggag

SEQ ID NO: 7783723 - DNA, 22 bp, Homo sapiens
gtggttcagtgtcatattaacg

SEQ ID NO: 7783724 - DNA, 22 bp, Homo sapiens
gtggtgtttgagctgccaggga

SEQ ID NO: 7783725 - DNA, 22 bp, Homo sapiens
gtggtgtgtgcttagggctagg

SEQ ID NO: 7783726 - DNA, 22 bp, Homo sapiens
gtggtgaagcattgagaagtca

SEQ ID NO: 7783727 - DNA, 22 bp, Homo sapiens
gtggtgaagccccatctctgct

SEQ ID NO: 7783728 - DNA, 22 bp, Homo sapiens
gtggtgagttcaggctggggtg

SEQ ID NO: 7783729 - DNA, 22 bp, Homo sapiens
gtggtctggggtcaggcctgag

SEQ ID NO: 7783730 - DNA, 22 bp, Homo sapiens
gtggtttttagatttctacagt

SEQ ID NO: 7783731 - DNA, 18 bp, Homo sapiens
gtggggtgttgtgaggat

SEQ ID NO: 7783732 - DNA, 22 bp, Homo sapiens
gtggggtgggctgagttaggcc

SEQ ID NO: 7783733 - DNA, 22 bp, Homo sapiens
gtggggtgcagcagtactgtgt

SEQ ID NO: 7783734 - DNA, 22 bp, Homo sapiens
gtgggggctggctcgtcctgtg

SEQ ID NO: 7783735 - DNA, 22 bp, Homo sapiens
gtggggggacgttggtcacttt

SEQ ID NO: 7783736 - DNA, 22 bp, Homo sapiens
gtggggggagctgcaagctgga

SEQ ID NO: 7783737 - DNA, 22 bp, Homo sapiens
gtggggtagatctttctcagga

SEQ ID NO: 7783738 - DNA, 22 bp, Homo sapiens
gtggtcaggggctgaggtgccc

SEQ ID NO: 7783739 - DNA, 22 bp, Homo sapiens
gtggtcaggggctgtggctatg

SEQ ID NO: 7783740 - DNA, 22 bp, Homo sapiens
gtggtcagagatgacagtgggt

SEQ ID NO: 7783741 - DNA, 22 bp, Homo sapiens
gtggtcagaatggagcccagga

SEQ ID NO: 7783742 - DNA, 22 bp, Homo sapiens
gtggtcagaaatctcagtggca

SEQ ID NO: 7783743 - DNA, 22 bp, Homo sapiens
gtgggtggaggcgtcgagggca

SEQ ID NO: 7783744 - DNA, 22 bp, Homo sapiens
gtgggtgatgtactggaggcca

SEQ ID NO: 7783745 - DNA, 22 bp, Homo sapiens
gtgggtgatgtactggaggcca

SEQ ID NO: 7783746 - DNA, 22 bp, Homo sapiens
gtgggggacccaggtgctgtcc

SEQ ID NO: 7783747 - DNA, 22 bp, Homo sapiens
gtgggggacccaggtgctgtcc

SEQ ID NO: 7783748 - DNA, 22 bp, Homo sapiens
gtgggggctggaaatcttgcca

SEQ ID NO: 7783749 - DNA, 22 bp, Homo sapiens
gtggggaggcattcttctccct

SEQ ID NO: 7783750 - DNA, 22 bp, Homo sapiens
gtggggaggcctaagcaagttg

SEQ ID NO: 7783751 - DNA, 22 bp, Homo sapiens
gtggggaggcctaagcaagttg

SEQ ID NO: 7783752 - DNA, 22 bp, Homo sapiens
gtggggagcagccttagcccct

SEQ ID NO: 7783753 - DNA, 22 bp, Homo sapiens
gtggggagcagccttagcccct

SEQ ID NO: 7783754 - DNA, 22 bp, Homo sapiens
gtggggaggcattcttctccct

SEQ ID NO: 7783755 - DNA, 22 bp, Homo sapiens
gtgggctgcccttgaggtcagc

SEQ ID NO: 7783756 - DNA, 22 bp, Homo sapiens
gtgggctgcatgtttactattc

SEQ ID NO: 7783757 - DNA, 22 bp, Homo sapiens
gtgggctgaggggacaccaagg

SEQ ID NO: 7783758 - DNA, 22 bp, Homo sapiens
gtgggcagcctgtccggagacc

SEQ ID NO: 7783759 - DNA, 22 bp, Homo sapiens
gtgggcagcctgtccggagacc

SEQ ID NO: 7783760 - DNA, 22 bp, Homo sapiens
gtgggcagacatgatagaagga

SEQ ID NO: 7783761 - DNA, 22 bp, Homo sapiens
gtgggcagaattgaatctttaa

SEQ ID NO: 7783762 - DNA, 22 bp, Homo sapiens
gtgggcagagcaagggaactca

SEQ ID NO: 7783763 - DNA, 22 bp, Homo sapiens
gtgggcagaggagagaacatta

SEQ ID NO: 7783764 - DNA, 22 bp, Homo sapiens
gtgggcagcaccagggaagtgt

SEQ ID NO: 7783765 - DNA, 22 bp, Homo sapiens
gtgggcagccccttcaaggcca

SEQ ID NO: 7783766 - DNA, 22 bp, Homo sapiens
gtgggcagcaccagggaagtgt

SEQ ID NO: 7783767 - DNA, 18 bp, Homo sapiens
gtcagaggatggggaaat

SEQ ID NO: 7783768 - DNA, 22 bp, Homo sapiens
gtcagaggggcagctgccaggc

SEQ ID NO: 7783769 - DNA, 22 bp, Homo sapiens
gtattacaaataaatgttactg

SEQ ID NO: 7783770 - DNA, 22 bp, Homo sapiens
gtcagctcagcaggtgggagtg

SEQ ID NO: 7783771 - DNA, 22 bp, Homo sapiens
gtcaggaaaaattgataatttt

SEQ ID NO: 7783772 - DNA, 22 bp, Homo sapiens
gtcaggaaaacccgggttgact

SEQ ID NO: 7783773 - DNA, 21 bp, Homo sapiens
gtcaggagccgtcttacattc

SEQ ID NO: 7783774 - DNA, 22 bp, Homo sapiens
gtcaggagatagggcaagcttc

SEQ ID NO: 7783775 - DNA, 22 bp, Homo sapiens
gtcaggagaggccatcagcttt

SEQ ID NO: 7783776 - DNA, 22 bp, Homo sapiens
gtcaggagagacctgttctcct

SEQ ID NO: 7783777 - DNA, 22 bp, Homo sapiens
gtcaggattataatccccatgg

SEQ ID NO: 7783778 - DNA, 18 bp, Homo sapiens
gtcaggcatgaatctggg

SEQ ID NO: 7783779 - DNA, 22 bp, Homo sapiens
gtcctgtgtaagtacttgctca

SEQ ID NO: 7783780 - DNA, 22 bp, Homo sapiens
gtcctgtgtgagtgcaccacct

SEQ ID NO: 7783781 - DNA, 22 bp, Homo sapiens
gtccttaaccacttgtgtttat

SEQ ID NO: 7783782 - DNA, 22 bp, Homo sapiens
gtcccagggaggttcagggctt

SEQ ID NO: 7783783 - DNA, 22 bp, Homo sapiens
gtcccagggcaaggctgtttct

SEQ ID NO: 7783784 - DNA, 22 bp, Homo sapiens
gtcccagggatgcagacatgag

SEQ ID NO: 7783785 - DNA, 22 bp, Homo sapiens
gtcccagggaagaaggcagcac

SEQ ID NO: 7783786 - DNA, 22 bp, Homo sapiens
gtcccagggaggttcagggctt

SEQ ID NO: 7783787 - DNA, 22 bp, Homo sapiens
gtccatacagtggcacacatct

SEQ ID NO: 7783788 - DNA, 22 bp, Homo sapiens
gtctgggcacctggcctgggaa

SEQ ID NO: 7783789 - DNA, 22 bp, Homo sapiens
gtctggggcagcaaggcgcgcg

SEQ ID NO: 7783790 - DNA, 22 bp, Homo sapiens
gtctggggaagtcagggcatca

SEQ ID NO: 7783791 - DNA, 22 bp, Homo sapiens
gtctggcacataagaggagctc

SEQ ID NO: 7783792 - DNA, 22 bp, Homo sapiens
gtctgagggttgtgctggagga

SEQ ID NO: 7783793 - DNA, 22 bp, Homo sapiens
gtctgaggtcattagctctctt

SEQ ID NO: 7783794 - DNA, 22 bp, Homo sapiens
gtctgcacgtgccagggagggg

SEQ ID NO: 7783795 - DNA, 22 bp, Homo sapiens
gtctgcacggggaggatgggct

SEQ ID NO: 7783796 - DNA, 22 bp, Homo sapiens
gtctgaggggtttcccaggaca

SEQ ID NO: 7783797 - DNA, 22 bp, Homo sapiens
gtctgagggacagagtcctggc

SEQ ID NO: 7783798 - DNA, 22 bp, Homo sapiens
gtctgaggcgaggcctgagaac

SEQ ID NO: 7783799 - DNA, 22 bp, Homo sapiens
gtctgagactgggcacatacct

SEQ ID NO: 7783800 - DNA, 22 bp, Homo sapiens
gtctgaagccagtggtagtccg

SEQ ID NO: 7783801 - DNA, 22 bp, Homo sapiens
gtccttggagtcaggcaaggct

SEQ ID NO: 7783802 - DNA, 22 bp, Homo sapiens
gtccttggaggtgtggaatctg

SEQ ID NO: 7783803 - DNA, 22 bp, Homo sapiens
gtccttggcattctgagtcttg

SEQ ID NO: 7783804 - DNA, 22 bp, Homo sapiens
gtcggccacgcaggtgcggtag

SEQ ID NO: 7783805 - DNA, 22 bp, Homo sapiens
gtatatatgtgtgaacatgtat

SEQ ID NO: 7783806 - DNA, 22 bp, Homo sapiens
gtatatatgtgtgaacatgtat

SEQ ID NO: 7783807 - DNA, 22 bp, Homo sapiens
gtatatatcggcactattttaa

SEQ ID NO: 7783808 - DNA, 22 bp, Homo sapiens
gtatatatcggcactattttaa

SEQ ID NO: 7783809 - DNA, 22 bp, Homo sapiens
gtacataagaaattactacaga

SEQ ID NO: 7783810 - DNA, 22 bp, Homo sapiens
gtacatatggcacatgctattt

SEQ ID NO: 7783811 - DNA, 22 bp, Homo sapiens
gtacattctgtggacttggaca

SEQ ID NO: 7783812 - DNA, 22 bp, Homo sapiens
gtacatttactgatgaaaagta

SEQ ID NO: 7783813 - DNA, 22 bp, Homo sapiens
gtacatattataaaatacagct

SEQ ID NO: 7783814 - DNA, 22 bp, Homo sapiens
gtacatattataaaatacagct

SEQ ID NO: 7783815 - DNA, 22 bp, Homo sapiens
gtaaataactggtaattggggt

SEQ ID NO: 7783816 - DNA, 22 bp, Homo sapiens
gtaaataactggtaattggggt

SEQ ID NO: 7783817 - DNA, 22 bp, Homo sapiens
gtaaataactggtaattggggt

SEQ ID NO: 7783818 - DNA, 22 bp, Homo sapiens
gtaaacattttcatctgtgccc

SEQ ID NO: 7783819 - DNA, 22 bp, Homo sapiens
gtaaagaagtttttgaatgcat

SEQ ID NO: 7783820 - DNA, 22 bp, Homo sapiens
gtaaagaaggcaacctggttat

SEQ ID NO: 7783821 - DNA, 22 bp, Homo sapiens
ggtggcaggctggcattggcaa

SEQ ID NO: 7783822 - DNA, 22 bp, Homo sapiens
ggtggcaggctggcattggcaa

SEQ ID NO: 7783823 - DNA, 22 bp, Homo sapiens
ggtggcaggccctgagcatccc

SEQ ID NO: 7783824 - DNA, 22 bp, Homo sapiens
ggtggcagcatggtcccagtgt

SEQ ID NO: 7783825 - DNA, 22 bp, Homo sapiens
ggtggcagcgtctatctgacat

SEQ ID NO: 7783826 - DNA, 22 bp, Homo sapiens
ggtggttgcataggccagcagc

SEQ ID NO: 7783827 - DNA, 22 bp, Homo sapiens
ggtgtcaaattattgagtttca

SEQ ID NO: 7783828 - DNA, 22 bp, Homo sapiens
ggtgtcaaaataccatttcagg

SEQ ID NO: 7783829 - DNA, 22 bp, Homo sapiens
ggtgtcaatgctcccaccttgg

SEQ ID NO: 7783830 - DNA, 23 bp, Homo sapiens
ggtggtggtgagtcacgggctca

SEQ ID NO: 7783831 - DNA, 22 bp, Homo sapiens
ggtggtgtttggaaggaggtgc

SEQ ID NO: 7783832 - DNA, 22 bp, Homo sapiens
ggtggcagaggtgcatcagccc

SEQ ID NO: 7783833 - DNA, 22 bp, Homo sapiens
ggtggcagagaggaggtagttt

SEQ ID NO: 7783834 - DNA, 22 bp, Homo sapiens
ggtgcaggcggtggggcaagta

SEQ ID NO: 7783835 - DNA, 22 bp, Homo sapiens
ggtgcaggcggtggggcaagta

SEQ ID NO: 7783836 - DNA, 22 bp, Homo sapiens
ggtgcaggcggtggggcaagta

SEQ ID NO: 7783837 - DNA, 22 bp, Homo sapiens
ggtgagtgtcaatggttagagt

SEQ ID NO: 7783838 - DNA, 22 bp, Homo sapiens
ggtgcaggaatctgcaattgaa

SEQ ID NO: 7783839 - DNA, 22 bp, Homo sapiens
ggtgcaggaaaattacctggag

SEQ ID NO: 7783840 - DNA, 22 bp, Homo sapiens
ggtgcaggacgaagtgggggtt

SEQ ID NO: 7783841 - DNA, 22 bp, Homo sapiens
gggtgggcctgtctggccatgt

SEQ ID NO: 7783842 - DNA, 22 bp, Homo sapiens
gtgggagaaattagctctagtt

SEQ ID NO: 7783843 - DNA, 22 bp, Homo sapiens
gtgggagaaattagctctagtt

SEQ ID NO: 7783844 - DNA, 22 bp, Homo sapiens
gtgggagccctcagggaggtgc

SEQ ID NO: 7783845 - DNA, 22 bp, Homo sapiens
gtgggagcatggtcccagtgcc

SEQ ID NO: 7783846 - DNA, 22 bp, Homo sapiens
gtgggagctttggcatcaggct

SEQ ID NO: 7783847 - DNA, 22 bp, Homo sapiens
gtgggagctttggcatcaggct

SEQ ID NO: 7783848 - DNA, 22 bp, Homo sapiens
gtgggagctgcggaggcctggg

SEQ ID NO: 7783849 - DNA, 22 bp, Homo sapiens
gtgggagctgcggaggcctggg

SEQ ID NO: 7783850 - DNA, 22 bp, Homo sapiens
gtgggagctgcggaggcctggg

SEQ ID NO: 7783851 - DNA, 22 bp, Homo sapiens
gtggctctaggtgagcatggag

SEQ ID NO: 7783852 - DNA, 22 bp, Homo sapiens
gtggctcttgcatggggtctct

SEQ ID NO: 7783853 - DNA, 22 bp, Homo sapiens
gtggctctccattgacatggaa

SEQ ID NO: 7783854 - DNA, 20 bp, Homo sapiens
gtggcagtggtggcagcagt

SEQ ID NO: 7783855 - DNA, 22 bp, Homo sapiens
gtggcagtgtggagggaggagt

SEQ ID NO: 7783856 - DNA, 22 bp, Homo sapiens
gtggcagggtgctcatcatgca

SEQ ID NO: 7783857 - DNA, 22 bp, Homo sapiens
gtggcatgacagtgaatgggca

SEQ ID NO: 7783858 - DNA, 22 bp, Homo sapiens
gtggcatttggaaagagcacta

SEQ ID NO: 7783859 - DNA, 20 bp, Homo sapiens
gtggcaggcagtgaaggagc

SEQ ID NO: 7783860 - DNA, 20 bp, Homo sapiens
gtggcaggcagtgaaggagc

SEQ ID NO: 7783861 - DNA, 22 bp, Homo sapiens
gtggcaggatcacggctcactg

SEQ ID NO: 7783862 - DNA, 22 bp, Homo sapiens
gtggccagccagggtgctgatg

SEQ ID NO: 7783863 - DNA, 18 bp, Homo sapiens
gtggccagcctggtcttg

SEQ ID NO: 7783864 - DNA, 22 bp, Homo sapiens
gtggcccaggcaccctgatgac

SEQ ID NO: 7783865 - DNA, 22 bp, Homo sapiens
gtggcccaggctggagtgcagt

SEQ ID NO: 7783866 - DNA, 22 bp, Homo sapiens
gtggcccaggcttggcgctggc

SEQ ID NO: 7783867 - DNA, 22 bp, Homo sapiens
gtggcccaggcttggcgctggc

SEQ ID NO: 7783868 - DNA, 22 bp, Homo sapiens
gtggcccatcacgtttcgcctt

SEQ ID NO: 7783869 - DNA, 22 bp, Homo sapiens
gtggcccaggttggagtgcagt

SEQ ID NO: 7783870 - DNA, 22 bp, Homo sapiens
gtggccctctgatagggtcagg

SEQ ID NO: 7783871 - DNA, 22 bp, Homo sapiens
gtggccctcagcagttgccaag

SEQ ID NO: 7783872 - DNA, 22 bp, Homo sapiens
gtggcccacttacgtcatgtgt

SEQ ID NO: 7783873 - DNA, 22 bp, Homo sapiens
gtggcccagccctacagaggac

SEQ ID NO: 7783874 - DNA, 22 bp, Homo sapiens
gtgcctggaactgggtaggctg

SEQ ID NO: 7783875 - DNA, 22 bp, Homo sapiens
gtgaccagtgatgctgaggagt

SEQ ID NO: 7783876 - DNA, 22 bp, Homo sapiens
gtgacagtgacagctagatagt

SEQ ID NO: 7783877 - DNA, 20 bp, Homo sapiens
gtgaagggagtcaggtgtgc

SEQ ID NO: 7783878 - DNA, 22 bp, Homo sapiens
gtgacaggcatggggtcatgca

SEQ ID NO: 7783879 - DNA, 22 bp, Homo sapiens
gtgacaggcccagtgggatgca

SEQ ID NO: 7783880 - DNA, 22 bp, Homo sapiens
gtgacagagtgagaccctgtct

SEQ ID NO: 7783881 - DNA, 22 bp, Homo sapiens
gtggaagggactgcctagagga

SEQ ID NO: 7783882 - DNA, 22 bp, Homo sapiens
gtggaagggactgcctagagga

SEQ ID NO: 7783883 - DNA, 22 bp, Homo sapiens
gtggaaggaagagatggcccca

SEQ ID NO: 7783884 - DNA, 22 bp, Homo sapiens
gtggaagggtcacagcccctac

SEQ ID NO: 7783885 - DNA, 22 bp, Homo sapiens
gtggaagggtcacagcccctac

SEQ ID NO: 7783886 - DNA, 22 bp, Homo sapiens
gtggaaggaagagatggcccca

SEQ ID NO: 7783887 - DNA, 22 bp, Homo sapiens
gtgctttttcaatcagaaggga

SEQ ID NO: 7783888 - DNA, 20 bp, Homo sapiens
gtgcctggagaagaggctgt

SEQ ID NO: 7783889 - DNA, 22 bp, Homo sapiens
gtgcgcaccctcccggcatccc

SEQ ID NO: 7783890 - DNA, 22 bp, Homo sapiens
gtgccttccccggtggtctgtt

SEQ ID NO: 7783891 - DNA, 23 bp, Homo sapiens
gtgcgccaggacaacctgacgga

SEQ ID NO: 7783892 - DNA, 23 bp, Homo sapiens
gtgcgccaggacaacctgacgga

SEQ ID NO: 7783893 - DNA, 22 bp, Homo sapiens
gtggagaggaacccagctctgt

SEQ ID NO: 7783894 - DNA, 22 bp, Homo sapiens
gtggagccctggtagggacccc

SEQ ID NO: 7783895 - DNA, 22 bp, Homo sapiens
gtggagagagataagcctggtc

SEQ ID NO: 7783896 - DNA, 22 bp, Homo sapiens
gtggagagagataagcctggtc

SEQ ID NO: 7783897 - DNA, 22 bp, Homo sapiens
gtggagagagataagcctggtc

SEQ ID NO: 7783898 - DNA, 22 bp, Homo sapiens
gtggagggaatgaatcttctct

SEQ ID NO: 7783899 - DNA, 22 bp, Homo sapiens
gtggagggtgagctcatgtttg

SEQ ID NO: 7783900 - DNA, 18 bp, Homo sapiens
gtggagggttctcagaat

SEQ ID NO: 7783901 - DNA, 22 bp, Homo sapiens
gtggagggtgattgccggctgt

SEQ ID NO: 7783902 - DNA, 22 bp, Homo sapiens
gtggagggtgattgccggctgt

SEQ ID NO: 7783903 - DNA, 22 bp, Homo sapiens
gtggagggtttgcaatgtgcag

SEQ ID NO: 7783904 - DNA, 22 bp, Homo sapiens
gtggagtggcctggccctgaga

SEQ ID NO: 7783905 - DNA, 17 bp, Homo sapiens
gtggaggtgctctggta

SEQ ID NO: 7783906 - DNA, 22 bp, Homo sapiens
gtggatgattgactctgtagac

SEQ ID NO: 7783907 - DNA, 22 bp, Homo sapiens
gtggatctactgtatgggatag

SEQ ID NO: 7783908 - DNA, 20 bp, Homo sapiens
gtggatgatcagtgtagtgg

SEQ ID NO: 7783909 - DNA, 22 bp, Homo sapiens
gtggatgagataactgtagaag

SEQ ID NO: 7783910 - DNA, 22 bp, Homo sapiens
gtggatggattgaggcagtggg

SEQ ID NO: 7783911 - DNA, 22 bp, Homo sapiens
gtggcagagggtgagctggact

SEQ ID NO: 7783912 - DNA, 22 bp, Homo sapiens
gtggcagagggtgagctggact

SEQ ID NO: 7783913 - DNA, 22 bp, Homo sapiens
ggcccagcctcagacatgccct

SEQ ID NO: 7783914 - DNA, 22 bp, Homo sapiens
ggcccagcctcagacatgccct

SEQ ID NO: 7783915 - DNA, 22 bp, Homo sapiens
ggcccagcctggcaacaatgac

SEQ ID NO: 7783916 - DNA, 22 bp, Homo sapiens
ggcccagccttggggtttcttt

SEQ ID NO: 7783917 - DNA, 22 bp, Homo sapiens
ggccccagattctgggctgggt

SEQ ID NO: 7783918 - DNA, 22 bp, Homo sapiens
ggcccagcgaggccacctacag

SEQ ID NO: 7783919 - DNA, 21 bp, Homo sapiens
ggccccgcagacccagcacgt

SEQ ID NO: 7783920 - DNA, 22 bp, Homo sapiens
ggccccagttcactcctggccg

SEQ ID NO: 7783921 - DNA, 22 bp, Homo sapiens
ggccatgtttggcagaaggatt

SEQ ID NO: 7783922 - DNA, 22 bp, Homo sapiens
ggcccacactgacagctgagct

SEQ ID NO: 7783923 - DNA, 22 bp, Homo sapiens
ggcccagccggcgagtctcgcg

SEQ ID NO: 7783924 - DNA, 22 bp, Homo sapiens
ggcccacttgaaatggagctca

SEQ ID NO: 7783925 - DNA, 22 bp, Homo sapiens
ggcccacttgaaatggagctca

SEQ ID NO: 7783926 - DNA, 18 bp, Homo sapiens
ggccagagggagggtccc

SEQ ID NO: 7783927 - DNA, 22 bp, Homo sapiens
ggccagagagcagccaggattc

SEQ ID NO: 7783928 - DNA, 22 bp, Homo sapiens
ggccagaggacctctcatagcc

SEQ ID NO: 7783929 - DNA, 22 bp, Homo sapiens
ggcaggtgctctgtgggcctgg

SEQ ID NO: 7783930 - DNA, 22 bp, Homo sapiens
ggccagaagttggaaaagagcc

SEQ ID NO: 7783931 - DNA, 22 bp, Homo sapiens
ggccagaagttggaaaagagcc

SEQ ID NO: 7783932 - DNA, 22 bp, Homo sapiens
ggccctctggcttccgcatggg

SEQ ID NO: 7783933 - DNA, 22 bp, Homo sapiens
ggccctctgtggctgccatgga

SEQ ID NO: 7783934 - DNA, 22 bp, Homo sapiens
ggccctctgagtagctgcaaac

SEQ ID NO: 7783935 - DNA, 22 bp, Homo sapiens
ggccctctgcctgtgctggcga

SEQ ID NO: 7783936 - DNA, 23 bp, Homo sapiens
ggcctgtgttttgtctgaagtac

SEQ ID NO: 7783937 - DNA, 22 bp, Homo sapiens
ggccctgagctgaagtactgtg

SEQ ID NO: 7783938 - DNA, 22 bp, Homo sapiens
ggcctggctggttcagtaccct

SEQ ID NO: 7783939 - DNA, 22 bp, Homo sapiens
ggccctgcaaggtacccaggcc

SEQ ID NO: 7783940 - DNA, 22 bp, Homo sapiens
ggccttggaaagatacccagct

SEQ ID NO: 7783941 - DNA, 20 bp, Homo sapiens
ggccttggaatagcacagct

SEQ ID NO: 7783942 - DNA, 22 bp, Homo sapiens
ggccttggagtcctccactgga

SEQ ID NO: 7783943 - DNA, 22 bp, Homo sapiens
ggctcaggacacagtggtttag

SEQ ID NO: 7783944 - DNA, 22 bp, Homo sapiens
ggctcaggacctgggattgcca

SEQ ID NO: 7783945 - DNA, 22 bp, Homo sapiens
ggctcagcttggtgcgcagaaa

SEQ ID NO: 7783946 - DNA, 22 bp, Homo sapiens
ggctcagcttatctgggcaggc

SEQ ID NO: 7783947 - DNA, 22 bp, Homo sapiens
ggctcagcttggtgcgcagaaa

SEQ ID NO: 7783948 - DNA, 22 bp, Homo sapiens
ggctcaggccagaccacgactc

SEQ ID NO: 7783949 - DNA, 22 bp, Homo sapiens
ggctcaggatgagccttctcat

SEQ ID NO: 7783950 - DNA, 21 bp, Homo sapiens
ggccttggcgggggccgaatt

SEQ ID NO: 7783951 - DNA, 22 bp, Homo sapiens
ggccttggctcctgcagggagt

SEQ ID NO: 7783952 - DNA, 22 bp, Homo sapiens
ggccttgggaggagggtcagaa

SEQ ID NO: 7783953 - DNA, 22 bp, Homo sapiens
ggccttggatccaagctgcggc

SEQ ID NO: 7783954 - DNA, 22 bp, Homo sapiens
ggccttggatccaagctgcggc

SEQ ID NO: 7783955 - DNA, 22 bp, Homo sapiens
ggccttggcctagccctccagg

SEQ ID NO: 7783956 - DNA, 22 bp, Homo sapiens
ggctcaggtttccttcccagct

SEQ ID NO: 7783957 - DNA, 22 bp, Homo sapiens
ggctcaggtttaaagtgcttta

SEQ ID NO: 7783958 - DNA, 19 bp, Homo sapiens
ggctctcccttgagagagc

SEQ ID NO: 7783959 - DNA, 22 bp, Homo sapiens
ggctgcaagcatgcacagatac

SEQ ID NO: 7783960 - DNA, 22 bp, Homo sapiens
ggctgcagagctggtgccctgg

SEQ ID NO: 7783961 - DNA, 22 bp, Homo sapiens
ggctcctgggcagctgctccct

SEQ ID NO: 7783962 - DNA, 22 bp, Homo sapiens
ggctcctgggatgggactgagc

SEQ ID NO: 7783963 - DNA, 22 bp, Homo sapiens
ggctcctggaggcaccactggt

SEQ ID NO: 7783964 - DNA, 22 bp, Homo sapiens
ggctcctggaaagccctcgctc

SEQ ID NO: 7783965 - DNA, 23 bp, Homo sapiens
ggctcctggattcaaatcctgcc

SEQ ID NO: 7783966 - DNA, 23 bp, Homo sapiens
ggctcctggattcaaatcctgcc

SEQ ID NO: 7783967 - DNA, 22 bp, Homo sapiens
ggctggctacattggaggaagg

SEQ ID NO: 7783968 - DNA, 22 bp, Homo sapiens
ggctgccttgaccctggctccg

SEQ ID NO: 7783969 - DNA, 22 bp, Homo sapiens
ggctgccttccctgagccccgg

SEQ ID NO: 7783970 - DNA, 22 bp, Homo sapiens
ggctgccttccctgagccccgg

SEQ ID NO: 7783971 - DNA, 22 bp, Homo sapiens
ggctgccttccctgagccccgg

SEQ ID NO: 7783972 - DNA, 19 bp, Homo sapiens
ggctgccttctgctcatct

SEQ ID NO: 7783973 - DNA, 22 bp, Homo sapiens
ggctgccttcagactccagctt

SEQ ID NO: 7783974 - DNA, 22 bp, Homo sapiens
ggctgcctgtgcccaggcacac

SEQ ID NO: 7783975 - DNA, 22 bp, Homo sapiens
ggctgccttcatagaccatggg

SEQ ID NO: 7783976 - DNA, 22 bp, Homo sapiens
ggctgcctgtgcccaggcacac

SEQ ID NO: 7783977 - DNA, 22 bp, Homo sapiens
ggctgcctgtgcccaggcacac

SEQ ID NO: 7783978 - DNA, 22 bp, Homo sapiens
gggaaaggatttacagtttgat

SEQ ID NO: 7783979 - DNA, 22 bp, Homo sapiens
gggaaaggatcagtgggaggct

SEQ ID NO: 7783980 - DNA, 22 bp, Homo sapiens
ggcttctccaggtactgagcat

SEQ ID NO: 7783981 - DNA, 22 bp, Homo sapiens
ggctttgggattcagcatgaga

SEQ ID NO: 7783982 - DNA, 22 bp, Homo sapiens
gggaagagaccgtaccctggcc

SEQ ID NO: 7783983 - DNA, 22 bp, Homo sapiens
gggaagagaggaggtggtttcg

SEQ ID NO: 7783984 - DNA, 23 bp, Homo sapiens
gggaccaggcccttcctggtttg

SEQ ID NO: 7783985 - DNA, 22 bp, Homo sapiens
gggaagagatttccacatcatt

SEQ ID NO: 7783986 - DNA, 18 bp, Homo sapiens
gggaagaggatctggccc

SEQ ID NO: 7783987 - DNA, 18 bp, Homo sapiens
gggaagaggatctggccc

SEQ ID NO: 7783988 - DNA, 22 bp, Homo sapiens
gggaacagagtgccagactgac

SEQ ID NO: 7783989 - DNA, 22 bp, Homo sapiens
gggaactgtttaacaggggttt

SEQ ID NO: 7783990 - DNA, 22 bp, Homo sapiens
gggaactgtttaacaggggttt

SEQ ID NO: 7783991 - DNA, 22 bp, Homo sapiens
gggaaccacccctctgccctga

SEQ ID NO: 7783992 - DNA, 22 bp, Homo sapiens
ggcttccctgtttgctgtgcct

SEQ ID NO: 7783993 - DNA, 22 bp, Homo sapiens
ggcttccctgcctcacttattc

SEQ ID NO: 7783994 - DNA, 18 bp, Homo sapiens
ggcttccctactcacttc

SEQ ID NO: 7783995 - DNA, 22 bp, Homo sapiens
ggcttccctaaacctttccact

SEQ ID NO: 7783996 - DNA, 22 bp, Homo sapiens
ggcttcccctccagtgctctgt

SEQ ID NO: 7783997 - DNA, 20 bp, Homo sapiens
ggcttccccgccatcttccg

SEQ ID NO: 7783998 - DNA, 22 bp, Homo sapiens
ggcttcccagtccctgctctca

SEQ ID NO: 7783999 - DNA, 22 bp, Homo sapiens
ggctggctggatgaatggatta

SEQ ID NO: 7784000 - DNA, 22 bp, Homo sapiens
ggctggctgataaagggttgag

SEQ ID NO: 7784001 - DNA, 22 bp, Homo sapiens
ggctggctcttaccgacagcgt

SEQ ID NO: 7784002 - DNA, 22 bp, Homo sapiens
ggctggctgataaagggttgag

SEQ ID NO: 7784003 - DNA, 22 bp, Homo sapiens
ggctggctgataaagggttgag

SEQ ID NO: 7784004 - DNA, 22 bp, Homo sapiens
ggctggctcagggcttgagaga

SEQ ID NO: 7784005 - DNA, 22 bp, Homo sapiens
ggctggctatctgtggttgcct

SEQ ID NO: 7784006 - DNA, 22 bp, Homo sapiens
ggctggctacattggaggaagg

SEQ ID NO: 7784007 - DNA, 22 bp, Homo sapiens
ggctggctatctgtggttgcct

SEQ ID NO: 7784008 - DNA, 22 bp, Homo sapiens
ggctggctccacctaggtagct

SEQ ID NO: 7784009 - DNA, 22 bp, Homo sapiens
ggctggctccacctaggtagct

SEQ ID NO: 7784010 - DNA, 22 bp, Homo sapiens
ggctggctccacctaggtagct

SEQ ID NO: 7784011 - DNA, 22 bp, Homo sapiens
ggctgtggtggcatccctgagc

SEQ ID NO: 7784012 - DNA, 22 bp, Homo sapiens
ggctggcttgccaagctcaggg

SEQ ID NO: 7784013 - DNA, 19 bp, Homo sapiens
ggctgtggtggtgccttgc

SEQ ID NO: 7784014 - DNA, 22 bp, Homo sapiens
ggctgtggtggcatccctgagc

SEQ ID NO: 7784015 - DNA, 22 bp, Homo sapiens
ggctggcttgccaagctcaggg

SEQ ID NO: 7784016 - DNA, 22 bp, Homo sapiens
ggctggcttgccaagctcaggg

SEQ ID NO: 7784017 - DNA, 22 bp, Homo sapiens
ggctggctggctggtagacaag

SEQ ID NO: 7784018 - DNA, 22 bp, Homo sapiens
ggctggctggctggtagacaag

SEQ ID NO: 7784019 - DNA, 22 bp, Homo sapiens
ggctggctgtgccctgtactct

SEQ ID NO: 7784020 - DNA, 22 bp, Homo sapiens
ggctggctgtgccctgtactct

SEQ ID NO: 7784021 - DNA, 22 bp, Homo sapiens
ggctggctggcttagcagagga

SEQ ID NO: 7784022 - DNA, 22 bp, Homo sapiens
ggctggctggcttagcagagga

SEQ ID NO: 7784023 - DNA, 22 bp, Homo sapiens
gggcggggggagctggaatgaa

SEQ ID NO: 7784024 - DNA, 22 bp, Homo sapiens
gggcccagcactggctgggatc

SEQ ID NO: 7784025 - DNA, 22 bp, Homo sapiens
gggcccagcactggctgggatc

SEQ ID NO: 7784026 - DNA, 22 bp, Homo sapiens
gggcccagcactggctgggatc

SEQ ID NO: 7784027 - DNA, 23 bp, Homo sapiens
gggcccagcacaggacctggcag

SEQ ID NO: 7784028 - DNA, 22 bp, Homo sapiens
gggcccagcgtggttccatctg

SEQ ID NO: 7784029 - DNA, 22 bp, Homo sapiens
gggcccagccctctgctcactg

SEQ ID NO: 7784030 - DNA, 22 bp, Homo sapiens
gggcccagcactggctgggatc

SEQ ID NO: 7784031 - DNA, 19 bp, Homo sapiens
gggcccagcatggagggtt

SEQ ID NO: 7784032 - DNA, 19 bp, Homo sapiens
gggcccagcatggagggtt

SEQ ID NO: 7784033 - DNA, 19 bp, Homo sapiens
gggcccagcatggagggtt

SEQ ID NO: 7784034 - DNA, 22 bp, Homo sapiens
gggcagatggggcacaggctga

SEQ ID NO: 7784035 - DNA, 22 bp, Homo sapiens
gggcagatgtctggacacctca

SEQ ID NO: 7784036 - DNA, 22 bp, Homo sapiens
gggcagatcacctgaggtcagg

SEQ ID NO: 7784037 - DNA, 22 bp, Homo sapiens
gggcagcagagccctgccgagt

SEQ ID NO: 7784038 - DNA, 22 bp, Homo sapiens
gggccaggtggaccccagcctc

SEQ ID NO: 7784039 - DNA, 22 bp, Homo sapiens
gggccaggtcggtgaatggtca

SEQ ID NO: 7784040 - DNA, 22 bp, Homo sapiens
gggccacattgaagggtgggta

SEQ ID NO: 7784041 - DNA, 22 bp, Homo sapiens
gggccaggtcggtgaatggtca

SEQ ID NO: 7784042 - DNA, 22 bp, Homo sapiens
gggcagcctgctttctgatcca

SEQ ID NO: 7784043 - DNA, 22 bp, Homo sapiens
gggcagctcagccaccatgcag

SEQ ID NO: 7784044 - DNA, 22 bp, Homo sapiens
gggcagctcggaagtgggaaag

SEQ ID NO: 7784045 - DNA, 22 bp, Homo sapiens
gggcagctcctgtggaatccac

SEQ ID NO: 7784046 - DNA, 22 bp, Homo sapiens
gggaggaggaatgttttgtgta

SEQ ID NO: 7784047 - DNA, 20 bp, Homo sapiens
gggaggccccagagtccagg

SEQ ID NO: 7784048 - DNA, 22 bp, Homo sapiens
gggaggagggtgctggctaaac

SEQ ID NO: 7784049 - DNA, 22 bp, Homo sapiens
gggaggctgccatccttcagga

SEQ ID NO: 7784050 - DNA, 22 bp, Homo sapiens
gggaggcgccgagggtagctaa

SEQ ID NO: 7784051 - DNA, 18 bp, Homo sapiens
gggaggccccagcaggag

SEQ ID NO: 7784052 - DNA, 20 bp, Homo sapiens
gggaggccccagagtccagg

SEQ ID NO: 7784053 - DNA, 22 bp, Homo sapiens
gggaccaggtcagggctctgac

SEQ ID NO: 7784054 - DNA, 22 bp, Homo sapiens
gggaccaggtgggtgcattccg

SEQ ID NO: 7784055 - DNA, 22 bp, Homo sapiens
gggacccaggtaatcctgtgct

SEQ ID NO: 7784056 - DNA, 22 bp, Homo sapiens
gggacgacaggctctgtggtag

SEQ ID NO: 7784057 - DNA, 22 bp, Homo sapiens
gggacgagccccaggctggagg

SEQ ID NO: 7784058 - DNA, 22 bp, Homo sapiens
gggacgagatcttggcagtgtg

SEQ ID NO: 7784059 - DNA, 22 bp, Homo sapiens
gggagaaatgtctggcctgctg

SEQ ID NO: 7784060 - DNA, 22 bp, Homo sapiens
gggatggggagctggaaagggg

SEQ ID NO: 7784061 - DNA, 22 bp, Homo sapiens
gggatggatcttggctgaggct

SEQ ID NO: 7784062 - DNA, 22 bp, Homo sapiens
gggatggactgacggtagcgcg

SEQ ID NO: 7784063 - DNA, 22 bp, Homo sapiens
gggatggcctagactagcttgg

SEQ ID NO: 7784064 - DNA, 22 bp, Homo sapiens
gggatgccagtcctggccctgc

SEQ ID NO: 7784065 - DNA, 22 bp, Homo sapiens
gggatccatccgtgcagcagag

SEQ ID NO: 7784066 - DNA, 22 bp, Homo sapiens
gggaggctggctctggccacag

SEQ ID NO: 7784067 - DNA, 22 bp, Homo sapiens
gggggtgaggacaggagcactg

SEQ ID NO: 7784068 - DNA, 16 bp, Homo sapiens
gggggtgagagagagt

SEQ ID NO: 7784069 - DNA, 22 bp, Homo sapiens
gggggtgagcctgccaggccca

SEQ ID NO: 7784070 - DNA, 22 bp, Homo sapiens
gggggtggttctaagtcctata

SEQ ID NO: 7784071 - DNA, 22 bp, Homo sapiens
gggtccagggccagtggctgag

SEQ ID NO: 7784072 - DNA, 20 bp, Homo sapiens
ggggggcttcagggcctgtg

SEQ ID NO: 7784073 - DNA, 22 bp, Homo sapiens
ggggggtgacaagtagaggttg

SEQ ID NO: 7784074 - DNA, 22 bp, Homo sapiens
ggggggcagctgtcctggccat

SEQ ID NO: 7784075 - DNA, 22 bp, Homo sapiens
gggggtgacgatggcagctggt

SEQ ID NO: 7784076 - DNA, 22 bp, Homo sapiens
gggggctggaatatccatcaac

SEQ ID NO: 7784077 - DNA, 22 bp, Homo sapiens
gggggctgatcatttactgggc

SEQ ID NO: 7784078 - DNA, 22 bp, Homo sapiens
ggggactgaggcactgaaggtg

SEQ ID NO: 7784079 - DNA, 22 bp, Homo sapiens
ggggaccctcaggactgcgtct

SEQ ID NO: 7784080 - DNA, 22 bp, Homo sapiens
ggggaccctcaggactgcgtct

SEQ ID NO: 7784081 - DNA, 22 bp, Homo sapiens
gggggctagagagatgaaatat

SEQ ID NO: 7784082 - DNA, 22 bp, Homo sapiens
gggtgaggagctgccagtcatg

SEQ ID NO: 7784083 - DNA, 22 bp, Homo sapiens
gggtgaggagctgccagtcatg

SEQ ID NO: 7784084 - DNA, 22 bp, Homo sapiens
gggtgggatgccgctgtctcca

SEQ ID NO: 7784085 - DNA, 22 bp, Homo sapiens
gggtgggatggcaggagccgct

SEQ ID NO: 7784086 - DNA, 22 bp, Homo sapiens
gggtgggaacaggatgccagga

SEQ ID NO: 7784087 - DNA, 22 bp, Homo sapiens
gggtgggatggcaggagccgct

SEQ ID NO: 7784088 - DNA, 23 bp, Homo sapiens
gggtgggccaaattaggtagcct

SEQ ID NO: 7784089 - DNA, 17 bp, Homo sapiens
gggtgggcactgctggc

SEQ ID NO: 7784090 - DNA, 22 bp, Homo sapiens
gggtgggccactgagcagcgtg

SEQ ID NO: 7784091 - DNA, 22 bp, Homo sapiens
gggtgggcccagcccagagaag

SEQ ID NO: 7784092 - DNA, 22 bp, Homo sapiens
gggtgggccccaggtatctgta

SEQ ID NO: 7784093 - DNA, 22 bp, Homo sapiens
gggtctggcatgctgagatgga

SEQ ID NO: 7784094 - DNA, 22 bp, Homo sapiens
gggtcttctgatataggtccag

SEQ ID NO: 7784095 - DNA, 22 bp, Homo sapiens
gggtgaagctcctgcaggggcc

SEQ ID NO: 7784096 - DNA, 22 bp, Homo sapiens
gggtctggagatccgggtgaag

SEQ ID NO: 7784097 - DNA, 22 bp, Homo sapiens
gggtctggacggctgcaggaag

SEQ ID NO: 7784098 - DNA, 22 bp, Homo sapiens
gggtctggacggctgcaggaag

SEQ ID NO: 7784099 - DNA, 22 bp, Homo sapiens
gggctgagacgatggggtcttc

SEQ ID NO: 7784100 - DNA, 22 bp, Homo sapiens
gggctaggcttggccagcactg

SEQ ID NO: 7784101 - DNA, 22 bp, Homo sapiens
gggctggagcctggcggtggtt

SEQ ID NO: 7784102 - DNA, 22 bp, Homo sapiens
gggctggatgtttgatgacgaa

SEQ ID NO: 7784103 - DNA, 22 bp, Homo sapiens
gggctggattactgaactgagt

SEQ ID NO: 7784104 - DNA, 22 bp, Homo sapiens
gggctggcaggacctgggctga

SEQ ID NO: 7784105 - DNA, 22 bp, Homo sapiens
gggctggcatcggttgctgaga

SEQ ID NO: 7784106 - DNA, 22 bp, Homo sapiens
gggctggcatcagttgccgaga

SEQ ID NO: 7784107 - DNA, 22 bp, Homo sapiens
gggctggcaggacctgggctga

SEQ ID NO: 7784108 - DNA, 22 bp, Homo sapiens
ggggacagtcgatctagtgatt

SEQ ID NO: 7784109 - DNA, 22 bp, Homo sapiens
ggggacagtcgatctagtgatt

SEQ ID NO: 7784110 - DNA, 23 bp, Homo sapiens
ggggacagttcccactggggtct

SEQ ID NO: 7784111 - DNA, 22 bp, Homo sapiens
ggggacagttaaagaccaagac

SEQ ID NO: 7784112 - DNA, 16 bp, Homo sapiens
ggggaaggcaagaggg

SEQ ID NO: 7784113 - DNA, 22 bp, Homo sapiens
ggggaagggagtccaagtgtta

SEQ ID NO: 7784114 - DNA, 22 bp, Homo sapiens
ggcacagagctttgtcccagtt

SEQ ID NO: 7784115 - DNA, 22 bp, Homo sapiens
ggcacagaggttgcctccagat

SEQ ID NO: 7784116 - DNA, 22 bp, Homo sapiens
ggcacagagttggcagagctgc

SEQ ID NO: 7784117 - DNA, 22 bp, Homo sapiens
ggcacagagttggcagagctgc

SEQ ID NO: 7784118 - DNA, 22 bp, Homo sapiens
ggcagacacaaaaacataaggt

SEQ ID NO: 7784119 - DNA, 22 bp, Homo sapiens
ggcacagcacagtggacccagg

SEQ ID NO: 7784120 - DNA, 22 bp, Homo sapiens
ggcagacctctccagccccaca

SEQ ID NO: 7784121 - DNA, 20 bp, Homo sapiens
ggcagacctgctgagagccc

SEQ ID NO: 7784122 - DNA, 22 bp, Homo sapiens
ggcacacagatggagcactagc

SEQ ID NO: 7784123 - DNA, 22 bp, Homo sapiens
ggcaaggccttgcccagcattc

SEQ ID NO: 7784124 - DNA, 22 bp, Homo sapiens
ggcaagggacggccgtgagaca

SEQ ID NO: 7784125 - DNA, 22 bp, Homo sapiens
ggagttcactgtgcaggctctg

SEQ ID NO: 7784126 - DNA, 22 bp, Homo sapiens
ggagtggtgtcactgagaggaa

SEQ ID NO: 7784127 - DNA, 22 bp, Homo sapiens
ggagtgggaacaatgacatggt

SEQ ID NO: 7784128 - DNA, 19 bp, Homo sapiens
ggagtgggtagttagtggt

SEQ ID NO: 7784129 - DNA, 22 bp, Homo sapiens
ggagtggcctctcctgtgcagg

SEQ ID NO: 7784130 - DNA, 22 bp, Homo sapiens
ggagtggcagctaggctgtcag

SEQ ID NO: 7784131 - DNA, 22 bp, Homo sapiens
ggagtggcactctgaggcgggg

SEQ ID NO: 7784132 - DNA, 22 bp, Homo sapiens
ggagtggcactctgaggcgggg

SEQ ID NO: 7784133 - DNA, 22 bp, Homo sapiens
ggagtgctttgaagccttcatt

SEQ ID NO: 7784134 - DNA, 22 bp, Homo sapiens
ggcaggctagcactgatgtcct

SEQ ID NO: 7784135 - DNA, 22 bp, Homo sapiens
ggcaggctagcactgatgtcct

SEQ ID NO: 7784136 - DNA, 22 bp, Homo sapiens
ggcaggctagcactgatgtcct

SEQ ID NO: 7784137 - DNA, 22 bp, Homo sapiens
ggcaggcagcctccatccacag

SEQ ID NO: 7784138 - DNA, 22 bp, Homo sapiens
ggcaggcattgcaacatgtaca

SEQ ID NO: 7784139 - DNA, 22 bp, Homo sapiens
ggcaggctgcttgggtcatgtc

SEQ ID NO: 7784140 - DNA, 22 bp, Homo sapiens
ggcaggctgcttgggtcatgtc

SEQ ID NO: 7784141 - DNA, 22 bp, Homo sapiens
ggcaggctgcttgggtcatgtc

SEQ ID NO: 7784142 - DNA, 18 bp, Homo sapiens
ggcaggctctctgggtca

SEQ ID NO: 7784143 - DNA, 18 bp, Homo sapiens
ggcaggctctctgggtca

SEQ ID NO: 7784144 - DNA, 22 bp, Homo sapiens
ggcaggctcttggccttatgag

SEQ ID NO: 7784145 - DNA, 22 bp, Homo sapiens
ggcaggctccagagccctctcc

SEQ ID NO: 7784146 - DNA, 22 bp, Homo sapiens
ggcaggctccaagcatcctatg

SEQ ID NO: 7784147 - DNA, 22 bp, Homo sapiens
ggcaggctcagcagccaaggag

SEQ ID NO: 7784148 - DNA, 22 bp, Homo sapiens
ggcaggctcagcagccaaggag

SEQ ID NO: 7784149 - DNA, 22 bp, Homo sapiens
ggcaggctgggtgtcatggagt

SEQ ID NO: 7784150 - DNA, 22 bp, Homo sapiens
ggcaggtgaggcatgtgcctgg

SEQ ID NO: 7784151 - DNA, 22 bp, Homo sapiens
ggcaggctgggagtcatcagag

SEQ ID NO: 7784152 - DNA, 22 bp, Homo sapiens
ggcaggctgggagtcatcagag

SEQ ID NO: 7784153 - DNA, 22 bp, Homo sapiens
ggcaggctggctttgttccagg

SEQ ID NO: 7784154 - DNA, 22 bp, Homo sapiens
ggcaggctggctttgttccagg

SEQ ID NO: 7784155 - DNA, 22 bp, Homo sapiens
ggcaggctggctttgttccagg

SEQ ID NO: 7784156 - DNA, 19 bp, Homo sapiens
ggcaggctggatagagagg

SEQ ID NO: 7784157 - DNA, 22 bp, Homo sapiens
ggcaggctgcttgggtcatgtc

SEQ ID NO: 7784158 - DNA, 22 bp, Homo sapiens
ggcaggtgcgcatgttgcatta

SEQ ID NO: 7784159 - DNA, 17 bp, Homo sapiens
ggcaggtgcggggccgc

SEQ ID NO: 7784160 - DNA, 22 bp, Homo sapiens
ggcaggtgctaagagaggtaaa

SEQ ID NO: 7784161 - DNA, 22 bp, Homo sapiens
ggcagaggaagctggaagtggg

SEQ ID NO: 7784162 - DNA, 22 bp, Homo sapiens
ggcagaggaagctggaagtggg

SEQ ID NO: 7784163 - DNA, 22 bp, Homo sapiens
ggcagaggaagctggaagtggg

SEQ ID NO: 7784164 - DNA, 22 bp, Homo sapiens
ggcagaggaagctggaagtggg

SEQ ID NO: 7784165 - DNA, 22 bp, Homo sapiens
ggcagaggaagctggaagtggg

SEQ ID NO: 7784166 - DNA, 22 bp, Homo sapiens
ggcaggcagatggctgcaccaa

SEQ ID NO: 7784167 - DNA, 22 bp, Homo sapiens
ggcagctgtaagatgagtgaat

SEQ ID NO: 7784168 - DNA, 22 bp, Homo sapiens
ggcagctgggttggccagaaac

SEQ ID NO: 7784169 - DNA, 22 bp, Homo sapiens
ggaggttctgatttgtcacaac

SEQ ID NO: 7784170 - DNA, 22 bp, Homo sapiens
ggagtagctgcattccgagcac

SEQ ID NO: 7784171 - DNA, 22 bp, Homo sapiens
ggaggtggtggcagtgacaatt

SEQ ID NO: 7784172 - DNA, 22 bp, Homo sapiens
ggaggtgggctaaggactctct

SEQ ID NO: 7784173 - DNA, 22 bp, Homo sapiens
ggaggtgggagcctccagtggt

SEQ ID NO: 7784174 - DNA, 22 bp, Homo sapiens
ggaggtgggagcctccagtggt

SEQ ID NO: 7784175 - DNA, 22 bp, Homo sapiens
ggaggtggaggttgcagtgagc

SEQ ID NO: 7784176 - DNA, 22 bp, Homo sapiens
ggaggtggcagagggacattct

SEQ ID NO: 7784177 - DNA, 22 bp, Homo sapiens
ggaggtcccaggcctggcagca

SEQ ID NO: 7784178 - DNA, 22 bp, Homo sapiens
ggagggtggcagcgtcctgggc

SEQ ID NO: 7784179 - DNA, 22 bp, Homo sapiens
ggagggggaattcagccccagc

SEQ ID NO: 7784180 - DNA, 22 bp, Homo sapiens
ggaggggagtctcccaaagccg

SEQ ID NO: 7784181 - DNA, 22 bp, Homo sapiens
ggaggggtggtcgcgaagagca

SEQ ID NO: 7784182 - DNA, 22 bp, Homo sapiens
ggagggtccactgtgaggcaga

SEQ ID NO: 7784183 - DNA, 22 bp, Homo sapiens
ggagggtctaagggagaactga

SEQ ID NO: 7784184 - DNA, 22 bp, Homo sapiens
ggagggtccccagcagcatgaa

SEQ ID NO: 7784185 - DNA, 22 bp, Homo sapiens
ggagggtccatcttgtgaaaag

SEQ ID NO: 7784186 - DNA, 22 bp, Homo sapiens
ggaggggtctctagcgaggaga

SEQ ID NO: 7784187 - DNA, 18 bp, Homo sapiens
ggagggctttggggactg

SEQ ID NO: 7784188 - DNA, 18 bp, Homo sapiens
ggagggctttggggactg

SEQ ID NO: 7784189 - DNA, 22 bp, Homo sapiens
ggagggctgccaggtggagcgg

SEQ ID NO: 7784190 - DNA, 22 bp, Homo sapiens
ggagggctgccaggtggagcgg

SEQ ID NO: 7784191 - DNA, 22 bp, Homo sapiens
ggagggctgccaggtggagcgg

SEQ ID NO: 7784192 - DNA, 22 bp, Homo sapiens
ggagggctgagactggggtctg

SEQ ID NO: 7784193 - DNA, 22 bp, Homo sapiens
ggagggccctgggtgcagctct

SEQ ID NO: 7784194 - DNA, 22 bp, Homo sapiens
ggagggctccctgggagtggat

SEQ ID NO: 7784195 - DNA, 22 bp, Homo sapiens
ggagggctccctgggagtggat

SEQ ID NO: 7784196 - DNA, 22 bp, Homo sapiens
ggagggctccctgggagtggat

SEQ ID NO: 7784197 - DNA, 22 bp, Homo sapiens
ggagggaatgtctagcattctt

SEQ ID NO: 7784198 - DNA, 22 bp, Homo sapiens
ggagggcatcaatcaggcctgg

SEQ ID NO: 7784199 - DNA, 21 bp, Homo sapiens
ggagggcagcccagactggct

SEQ ID NO: 7784200 - DNA, 22 bp, Homo sapiens
ggagggccatcttgggtgtgat

SEQ ID NO: 7784201 - DNA, 22 bp, Homo sapiens
ggagggcccctccagtgggcag

SEQ ID NO: 7784202 - DNA, 22 bp, Homo sapiens
ggaggctgctgcctcacgtggg

SEQ ID NO: 7784203 - DNA, 22 bp, Homo sapiens
ggaggctgctgcctcacgtggg

SEQ ID NO: 7784204 - DNA, 22 bp, Homo sapiens
ggaggctgaggcccctcacagg

SEQ ID NO: 7784205 - DNA, 22 bp, Homo sapiens
ggaggctgctgcctcacgtggg

SEQ ID NO: 7784206 - DNA, 22 bp, Homo sapiens
ggaggctgaggcaggcggatca

SEQ ID NO: 7784207 - DNA, 22 bp, Homo sapiens
ggaggctgaggcaggcggatca

SEQ ID NO: 7784208 - DNA, 22 bp, Homo sapiens
ggaggctgagaggtcgcagtgg

SEQ ID NO: 7784209 - DNA, 22 bp, Homo sapiens
ggaggctgagaggtcgcagtgg

SEQ ID NO: 7784210 - DNA, 22 bp, Homo sapiens
ggaggctgagaagtccaagatc

SEQ ID NO: 7784211 - DNA, 22 bp, Homo sapiens
ggaggctcttgagaggggagta

SEQ ID NO: 7784212 - DNA, 22 bp, Homo sapiens
ggaggctcagtgaggaaatgga

SEQ ID NO: 7784213 - DNA, 22 bp, Homo sapiens
ggaggcctcctgggggaggttc

SEQ ID NO: 7784214 - DNA, 22 bp, Homo sapiens
ggaggcccagaaggaagcccag

SEQ ID NO: 7784215 - DNA, 22 bp, Homo sapiens
ggaggcctagaaaagtggttct

SEQ ID NO: 7784216 - DNA, 22 bp, Homo sapiens
ggaggcctagccagctccagtt

SEQ ID NO: 7784217 - DNA, 22 bp, Homo sapiens
ggaggagcatgagagggtagtg

SEQ ID NO: 7784218 - DNA, 22 bp, Homo sapiens
ggaggaaatccttagtaaggca

SEQ ID NO: 7784219 - DNA, 22 bp, Homo sapiens
ggagctgcacgctctgaagcct

SEQ ID NO: 7784220 - DNA, 22 bp, Homo sapiens
ggaggcagaatagagtgtgggt

SEQ ID NO: 7784221 - DNA, 22 bp, Homo sapiens
ggaggccagcctgaggctgagg

SEQ ID NO: 7784222 - DNA, 22 bp, Homo sapiens
ggaggccagggacccagtcagc

SEQ ID NO: 7784223 - DNA, 22 bp, Homo sapiens
ggaggccagggacccagtcagc

SEQ ID NO: 7784224 - DNA, 22 bp, Homo sapiens
ggaggccaggtgggagtcatct

SEQ ID NO: 7784225 - DNA, 22 bp, Homo sapiens
ggaggccagcctgaggctgagg

SEQ ID NO: 7784226 - DNA, 22 bp, Homo sapiens
ggaggccatctggctggaggct

SEQ ID NO: 7784227 - DNA, 22 bp, Homo sapiens
ggaggccatgaggctctaggtg

SEQ ID NO: 7784228 - DNA, 22 bp, Homo sapiens
ggaggccatcagggagggcatt

SEQ ID NO: 7784229 - DNA, 22 bp, Homo sapiens
ggaggccatcagggagggcatt

SEQ ID NO: 7784230 - DNA, 22 bp, Homo sapiens
ggagaggcttggcccagcctgg

SEQ ID NO: 7784231 - DNA, 21 bp, Homo sapiens
ggagaaggacaatgttgagta

SEQ ID NO: 7784232 - DNA, 22 bp, Homo sapiens
ggagaaggaagaaagctactat

SEQ ID NO: 7784233 - DNA, 22 bp, Homo sapiens
ggagaaggaagaaagctactat

SEQ ID NO: 7784234 - DNA, 22 bp, Homo sapiens
ggagaaggaatattggagtagg

SEQ ID NO: 7784235 - DNA, 22 bp, Homo sapiens
ggagaaggaatattggagtagg

SEQ ID NO: 7784236 - DNA, 22 bp, Homo sapiens
ggaagtggtagagccatgagtg

SEQ ID NO: 7784237 - DNA, 22 bp, Homo sapiens
ggaatactaaaggaagcaattg

SEQ ID NO: 7784238 - DNA, 22 bp, Homo sapiens
ggaataaaaattgtttactgta

SEQ ID NO: 7784239 - DNA, 22 bp, Homo sapiens
ggagagggtgtggaaagttatc

SEQ ID NO: 7784240 - DNA, 22 bp, Homo sapiens
ggagcctggttactagagcctg

SEQ ID NO: 7784241 - DNA, 22 bp, Homo sapiens
ggagatgctttccagtggggat

SEQ ID NO: 7784242 - DNA, 22 bp, Homo sapiens
ggagatgcgactcgcggggctg

SEQ ID NO: 7784243 - DNA, 22 bp, Homo sapiens
ggagcggcagatggagtgggag

SEQ ID NO: 7784244 - DNA, 22 bp, Homo sapiens
ggagctaggcaaagctcacgga

SEQ ID NO: 7784245 - DNA, 22 bp, Homo sapiens
gcttaatgagcagagaatctac

SEQ ID NO: 7784246 - DNA, 22 bp, Homo sapiens
gctgggctgcgtcggggaagcc

SEQ ID NO: 7784247 - DNA, 22 bp, Homo sapiens
gcttacaatcatttcagtttag

SEQ ID NO: 7784248 - DNA, 22 bp, Homo sapiens
gcttagagcagctcacaacatg

SEQ ID NO: 7784249 - DNA, 21 bp, Homo sapiens
gcttatagaaacatcaccaga

SEQ ID NO: 7784250 - DNA, 22 bp, Homo sapiens
gctgggctgagaagttaagcaa

SEQ ID NO: 7784251 - DNA, 22 bp, Homo sapiens
gctgggctgagctagacttggc

SEQ ID NO: 7784252 - DNA, 22 bp, Homo sapiens
gctgggcatgtgaccaacagaa

SEQ ID NO: 7784253 - DNA, 20 bp, Homo sapiens
gcttccttcccagcccccac

SEQ ID NO: 7784254 - DNA, 22 bp, Homo sapiens
gcttctcaattctcaccctcca

SEQ ID NO: 7784255 - DNA, 22 bp, Homo sapiens
gcttctattactactttgagat

SEQ ID NO: 7784256 - DNA, 22 bp, Homo sapiens
gcttctacccacgagatgcaaa

SEQ ID NO: 7784257 - DNA, 22 bp, Homo sapiens
gcttcagaagttgggctctgac

SEQ ID NO: 7784258 - DNA, 22 bp, Homo sapiens
gcttcattactgacagtctgtg

SEQ ID NO: 7784259 - DNA, 22 bp, Homo sapiens
ggaacttatactgccagattct

SEQ ID NO: 7784260 - DNA, 17 bp, Homo sapiens
ggaagaaaaggatcatc

SEQ ID NO: 7784261 - DNA, 22 bp, Homo sapiens
ggaagaaatctggttaagagat

SEQ ID NO: 7784262 - DNA, 22 bp, Homo sapiens
ggaagggcaaaagagatgaact

SEQ ID NO: 7784263 - DNA, 22 bp, Homo sapiens
ggaaggtgctccctggacagag

SEQ ID NO: 7784264 - DNA, 22 bp, Homo sapiens
ggaaggggttaggggtccctga

SEQ ID NO: 7784265 - DNA, 22 bp, Homo sapiens
ggaactcctgctccaagcagct

SEQ ID NO: 7784266 - DNA, 22 bp, Homo sapiens
ggaaagagctaaaagggtgaga

SEQ ID NO: 7784267 - DNA, 23 bp, Homo sapiens
ggaaagagaggagttgtgcatag

SEQ ID NO: 7784268 - DNA, 20 bp, Homo sapiens
ggaaaaatgcatgctcaaga

SEQ ID NO: 7784269 - DNA, 17 bp, Homo sapiens
gcttctggagcttctgt

SEQ ID NO: 7784270 - DNA, 22 bp, Homo sapiens
ggaaacatgcctgctggacagt

SEQ ID NO: 7784271 - DNA, 22 bp, Homo sapiens
ggaaacattccaagagttgaaa

SEQ ID NO: 7784272 - DNA, 20 bp, Homo sapiens
ggaaacatttttatttccat

SEQ ID NO: 7784273 - DNA, 22 bp, Homo sapiens
ggaaactagaagaatactagtc

SEQ ID NO: 7784274 - DNA, 22 bp, Homo sapiens
ggaaaccattcccgactctcct

SEQ ID NO: 7784275 - DNA, 22 bp, Homo sapiens
gctcagagatggggaatgaaaa

SEQ ID NO: 7784276 - DNA, 22 bp, Homo sapiens
gctcagagatgttcagtagctt

SEQ ID NO: 7784277 - DNA, 22 bp, Homo sapiens
gctcagagcccgaggcttgcat

SEQ ID NO: 7784278 - DNA, 22 bp, Homo sapiens
gctcagagcatcccagtgaatg

SEQ ID NO: 7784279 - DNA, 22 bp, Homo sapiens
gctccaggagctcacagctcgc

SEQ ID NO: 7784280 - DNA, 22 bp, Homo sapiens
gctcctggctctctgagggctg

SEQ ID NO: 7784281 - DNA, 22 bp, Homo sapiens
gctcctggctccaggcagccaa

SEQ ID NO: 7784282 - DNA, 22 bp, Homo sapiens
gctcctggcatcctgcttttaa

SEQ ID NO: 7784283 - DNA, 22 bp, Homo sapiens
gctcctggcaggcagtgtgtgt

SEQ ID NO: 7784284 - DNA, 22 bp, Homo sapiens
gctcctggccagcacagggccc

SEQ ID NO: 7784285 - DNA, 22 bp, Homo sapiens
gctccaggagagggaagcagat

SEQ ID NO: 7784286 - DNA, 22 bp, Homo sapiens
gctccagctcgtggctcccagc

SEQ ID NO: 7784287 - DNA, 22 bp, Homo sapiens
gctccagctccggctccgaagc

SEQ ID NO: 7784288 - DNA, 22 bp, Homo sapiens
gctccaaagtacagtgacttac

SEQ ID NO: 7784289 - DNA, 22 bp, Homo sapiens
gctccaaagtccagctgtttcc

SEQ ID NO: 7784290 - DNA, 22 bp, Homo sapiens
gctcttccatttctcttgaact

SEQ ID NO: 7784291 - DNA, 22 bp, Homo sapiens
gctcttctaaagaatgtacagg

SEQ ID NO: 7784292 - DNA, 22 bp, Homo sapiens
gctctgcccaaagctgtggctg

SEQ ID NO: 7784293 - DNA, 22 bp, Homo sapiens
gctctgccagacactgtggcca

SEQ ID NO: 7784294 - DNA, 17 bp, Homo sapiens
gctctgccaggaaagag

SEQ ID NO: 7784295 - DNA, 22 bp, Homo sapiens
gctgagagtgggtgcagtgctt

SEQ ID NO: 7784296 - DNA, 22 bp, Homo sapiens
gctgagagtgggtgcagtgctt

SEQ ID NO: 7784297 - DNA, 22 bp, Homo sapiens
gctgagagtgggtgcagtgctt

SEQ ID NO: 7784298 - DNA, 22 bp, Homo sapiens
gctgaaatgggcactgaaggcc

SEQ ID NO: 7784299 - DNA, 22 bp, Homo sapiens
gctgaaattcagattcctaggc

SEQ ID NO: 7784300 - DNA, 22 bp, Homo sapiens
gctgaaattggaacctgggcct

SEQ ID NO: 7784301 - DNA, 22 bp, Homo sapiens
gctctgagcagggagaaacagg

SEQ ID NO: 7784302 - DNA, 22 bp, Homo sapiens
gctcctgggtgtggctgcccct

SEQ ID NO: 7784303 - DNA, 22 bp, Homo sapiens
gctcctgggctctaccttgcta

SEQ ID NO: 7784304 - DNA, 22 bp, Homo sapiens
gctcctggctctggccaaggga

SEQ ID NO: 7784305 - DNA, 22 bp, Homo sapiens
gctcctggcttcactgacatca

SEQ ID NO: 7784306 - DNA, 19 bp, Homo sapiens
gctcctgggcctcactcat

SEQ ID NO: 7784307 - DNA, 22 bp, Homo sapiens
gctcctgggccctgggctaact

SEQ ID NO: 7784308 - DNA, 16 bp, Homo sapiens
gctcctgggccctcga

SEQ ID NO: 7784309 - DNA, 21 bp, Homo sapiens
gctctgccacttaccagattt

SEQ ID NO: 7784310 - DNA, 22 bp, Homo sapiens
gctctgagtaaatgaaagcatt

SEQ ID NO: 7784311 - DNA, 22 bp, Homo sapiens
gctctgaggctgggagcactct

SEQ ID NO: 7784312 - DNA, 22 bp, Homo sapiens
gctctgagcccccagaagcaga

SEQ ID NO: 7784313 - DNA, 22 bp, Homo sapiens
gctgctctgtgacagcctccgg

SEQ ID NO: 7784314 - DNA, 22 bp, Homo sapiens
gctgctctgtgacagcctccgg

SEQ ID NO: 7784315 - DNA, 22 bp, Homo sapiens
gctgctgccgcggccgctggga

SEQ ID NO: 7784316 - DNA, 22 bp, Homo sapiens
gctgctgcttgaaggctcggag

SEQ ID NO: 7784317 - DNA, 22 bp, Homo sapiens
gctgctgctggtctggggccac

SEQ ID NO: 7784318 - DNA, 22 bp, Homo sapiens
gctgcctgggcaggaggcgctg

SEQ ID NO: 7784319 - DNA, 22 bp, Homo sapiens
gctgcctggtttctcagctgca

SEQ ID NO: 7784320 - DNA, 22 bp, Homo sapiens
gctgctctcagagctcatgctg

SEQ ID NO: 7784321 - DNA, 22 bp, Homo sapiens
gctgcctgtcccaggatgagga

SEQ ID NO: 7784322 - DNA, 22 bp, Homo sapiens
gctgctctccaagcctccttga

SEQ ID NO: 7784323 - DNA, 22 bp, Homo sapiens
gctgcctgatcatacaccaggg

SEQ ID NO: 7784324 - DNA, 22 bp, Homo sapiens
gctgagctagctatctcagtct

SEQ ID NO: 7784325 - DNA, 22 bp, Homo sapiens
gctgagctcccagcagtatctg

SEQ ID NO: 7784326 - DNA, 22 bp, Homo sapiens
gctgagctgaggcagggctggg

SEQ ID NO: 7784327 - DNA, 22 bp, Homo sapiens
gctgaggatatagcaggaacaa

SEQ ID NO: 7784328 - DNA, 22 bp, Homo sapiens
gctgcctgcttcatgtgggaga

SEQ ID NO: 7784329 - DNA, 22 bp, Homo sapiens
gctgcctgcttcatgtgggaga

SEQ ID NO: 7784330 - DNA, 22 bp, Homo sapiens
gctgcctggagctcagcctgcc

SEQ ID NO: 7784331 - DNA, 22 bp, Homo sapiens
gctgcctggagaggcagggatg

SEQ ID NO: 7784332 - DNA, 22 bp, Homo sapiens
gctggcctgacctgaggctggg

SEQ ID NO: 7784333 - DNA, 22 bp, Homo sapiens
gctggcctgacctgaggctggg

SEQ ID NO: 7784334 - DNA, 22 bp, Homo sapiens
gctggcctctggagaagggctt

SEQ ID NO: 7784335 - DNA, 22 bp, Homo sapiens
gctggcctcgcaggcaggatgt

SEQ ID NO: 7784336 - DNA, 22 bp, Homo sapiens
gctggagctgcagcctgggcct

SEQ ID NO: 7784337 - DNA, 22 bp, Homo sapiens
gctggagagtagtaagcagtta

SEQ ID NO: 7784338 - DNA, 22 bp, Homo sapiens
gctggagagtagtaagcagtta

SEQ ID NO: 7784339 - DNA, 22 bp, Homo sapiens
gctggagagtgaggggagcaag

SEQ ID NO: 7784340 - DNA, 22 bp, Homo sapiens
gctggccttgtgtctgaggaag

SEQ ID NO: 7784341 - DNA, 22 bp, Homo sapiens
gctggccttgtgtctgaggaag

SEQ ID NO: 7784342 - DNA, 22 bp, Homo sapiens
gctggcctgcgagggcaggctg

SEQ ID NO: 7784343 - DNA, 22 bp, Homo sapiens
gctggcctgggcagcctgtcgg

SEQ ID NO: 7784344 - DNA, 22 bp, Homo sapiens
gctggcctgggcagaggctatg

SEQ ID NO: 7784345 - DNA, 22 bp, Homo sapiens
gctggcctgggcagaggctatg

SEQ ID NO: 7784346 - DNA, 22 bp, Homo sapiens
gctgggatggagactgcagtga

SEQ ID NO: 7784347 - DNA, 22 bp, Homo sapiens
gctgggatgcgtcttcccaggc

SEQ ID NO: 7784348 - DNA, 22 bp, Homo sapiens
gctgggatgcgtcttcccaggc

SEQ ID NO: 7784349 - DNA, 22 bp, Homo sapiens
gctggcctttgaggaagctgcg

SEQ ID NO: 7784350 - DNA, 22 bp, Homo sapiens
gctgggcaccggagagacccca

SEQ ID NO: 7784351 - DNA, 22 bp, Homo sapiens
gctgggcaaggctgaagctacc

SEQ ID NO: 7784352 - DNA, 22 bp, Homo sapiens
gctgggcaggcctcgtgagggc

SEQ ID NO: 7784353 - DNA, 22 bp, Homo sapiens
gcctgtggccgactgagagcct

SEQ ID NO: 7784354 - DNA, 23 bp, Homo sapiens
gcctgggactcaggaggagctca

SEQ ID NO: 7784355 - DNA, 21 bp, Homo sapiens
gcctgggatagtggcctccgg

SEQ ID NO: 7784356 - DNA, 22 bp, Homo sapiens
gcctggcattacagcactcctg

SEQ ID NO: 7784357 - DNA, 22 bp, Homo sapiens
gcctggccgctccgagctccgc

SEQ ID NO: 7784358 - DNA, 21 bp, Homo sapiens
gcctgcctgcgtgaccctctt

SEQ ID NO: 7784359 - DNA, 23 bp, Homo sapiens
gcctgcctgacctgtgcaaagtc

SEQ ID NO: 7784360 - DNA, 23 bp, Homo sapiens
gcctgcctgacctgtgcaaagtc

SEQ ID NO: 7784361 - DNA, 22 bp, Homo sapiens
gcctgcctgaaggctgtaccag

SEQ ID NO: 7784362 - DNA, 22 bp, Homo sapiens
gcctgcctgaaggctgtaccag

SEQ ID NO: 7784363 - DNA, 20 bp, Homo sapiens
gcctgcctcagctagctgag

SEQ ID NO: 7784364 - DNA, 22 bp, Homo sapiens
gcctgcctcaaaatcccagttc

SEQ ID NO: 7784365 - DNA, 22 bp, Homo sapiens
gcctgcctcaaaatcccagttc

SEQ ID NO: 7784366 - DNA, 18 bp, Homo sapiens
gcctgcctagagcttgcc

SEQ ID NO: 7784367 - DNA, 20 bp, Homo sapiens
gcctgcctcagctagctgag

SEQ ID NO: 7784368 - DNA, 20 bp, Homo sapiens
gcctgcctcagctagctgag

SEQ ID NO: 7784369 - DNA, 19 bp, Homo sapiens
gcctgccagcctgaatctg

SEQ ID NO: 7784370 - DNA, 19 bp, Homo sapiens
gcctgccagatagtaatga

SEQ ID NO: 7784371 - DNA, 22 bp, Homo sapiens
gcctgccagtgtttgaggattg

SEQ ID NO: 7784372 - DNA, 17 bp, Homo sapiens
gcctctgcttgtgtcat

SEQ ID NO: 7784373 - DNA, 21 bp, Homo sapiens
gcctgcctgcgtgaccctctt

SEQ ID NO: 7784374 - DNA, 22 bp, Homo sapiens
gcctgcctgctgtcatctgcct

SEQ ID NO: 7784375 - DNA, 22 bp, Homo sapiens
gcctgcctgctgtcatctgcct

SEQ ID NO: 7784376 - DNA, 22 bp, Homo sapiens
gcctgcctgctgtcatctgcct

SEQ ID NO: 7784377 - DNA, 22 bp, Homo sapiens
gcctgcctgctgtgtgcaagtt

SEQ ID NO: 7784378 - DNA, 22 bp, Homo sapiens
gcctgcctgctgtgtgcaagtt

SEQ ID NO: 7784379 - DNA, 22 bp, Homo sapiens
gcctgcctggagcttgaggtga

SEQ ID NO: 7784380 - DNA, 22 bp, Homo sapiens
gcctgcctggagcttgaggtga

SEQ ID NO: 7784381 - DNA, 19 bp, Homo sapiens
gcctgcctgggtttctgag

SEQ ID NO: 7784382 - DNA, 19 bp, Homo sapiens
gcctgcctgggtttctgag

SEQ ID NO: 7784383 - DNA, 22 bp, Homo sapiens
gcctgccttcggtgcgcagcgg

SEQ ID NO: 7784384 - DNA, 22 bp, Homo sapiens
gcctgccttcggtgcgcagcgg

SEQ ID NO: 7784385 - DNA, 22 bp, Homo sapiens
gcctgcctttgtatgaccctga

SEQ ID NO: 7784386 - DNA, 22 bp, Homo sapiens
gcctgcctttgtatgaccctga

SEQ ID NO: 7784387 - DNA, 22 bp, Homo sapiens
gcctgcctgttggctgaggtgc

SEQ ID NO: 7784388 - DNA, 22 bp, Homo sapiens
gcctgcctgttggctgaggtgc

SEQ ID NO: 7784389 - DNA, 19 bp, Homo sapiens
gcctgcctgggtttctgag

SEQ ID NO: 7784390 - DNA, 22 bp, Homo sapiens
gcctgccttcggtgcgcagcgg

SEQ ID NO: 7784391 - DNA, 22 bp, Homo sapiens
gcctgcctgttggctgaggtgc

SEQ ID NO: 7784392 - DNA, 22 bp, Homo sapiens
gcctgctgttaactgcaggaat

SEQ ID NO: 7784393 - DNA, 22 bp, Homo sapiens
gcctgctgttgagggaagagct

SEQ ID NO: 7784394 - DNA, 22 bp, Homo sapiens
gcctgcctttgtgaggaagcgg

SEQ ID NO: 7784395 - DNA, 22 bp, Homo sapiens
gcctgcctttgtgaggaagcgg

SEQ ID NO: 7784396 - DNA, 22 bp, Homo sapiens
gcctgccttttggaggcacatt

SEQ ID NO: 7784397 - DNA, 22 bp, Homo sapiens
gcctgccttttggaggcacatt

SEQ ID NO: 7784398 - DNA, 22 bp, Homo sapiens
gcctgctcagacctagcaggcc

SEQ ID NO: 7784399 - DNA, 22 bp, Homo sapiens
gcctgccttttggaggcacatt

SEQ ID NO: 7784400 - DNA, 22 bp, Homo sapiens
gcctggaggggccagggtggta

SEQ ID NO: 7784401 - DNA, 22 bp, Homo sapiens
gcctggaggggccagggtggta

SEQ ID NO: 7784402 - DNA, 22 bp, Homo sapiens
gcctggagcctcagcaaggagg

SEQ ID NO: 7784403 - DNA, 22 bp, Homo sapiens
gcccttgacagtggcagaagca

SEQ ID NO: 7784404 - DNA, 22 bp, Homo sapiens
gcccttctgctgttaggtagcc

SEQ ID NO: 7784405 - DNA, 22 bp, Homo sapiens
gccctttcttcttctggactgg

SEQ ID NO: 7784406 - DNA, 22 bp, Homo sapiens
gcccaggctggagtgcagtggc

SEQ ID NO: 7784407 - DNA, 22 bp, Homo sapiens
gcccaggctggagtgcagtggc

SEQ ID NO: 7784408 - DNA, 22 bp, Homo sapiens
gccctcagagttccccacagtg

SEQ ID NO: 7784409 - DNA, 22 bp, Homo sapiens
gccctcagcatcctcagggcca

SEQ ID NO: 7784410 - DNA, 22 bp, Homo sapiens
gccctcagctcctggacacatg

SEQ ID NO: 7784411 - DNA, 21 bp, Homo sapiens
gccctcaggggaggatggcct

SEQ ID NO: 7784412 - DNA, 22 bp, Homo sapiens
gcctcctgttatgccatgtgcc

SEQ ID NO: 7784413 - DNA, 22 bp, Homo sapiens
gcctctgcaactccgccttggt

SEQ ID NO: 7784414 - DNA, 22 bp, Homo sapiens
gcctctgcaattacattgtgcc

SEQ ID NO: 7784415 - DNA, 22 bp, Homo sapiens
gcctctgcaccagtactgtgcc

SEQ ID NO: 7784416 - DNA, 22 bp, Homo sapiens
gcctctgcactgtggcacacca

SEQ ID NO: 7784417 - DNA, 23 bp, Homo sapiens
gcctctgcagcctagttagtgtc

SEQ ID NO: 7784418 - DNA, 22 bp, Homo sapiens
gcctctgcaggtgcggttatcc

SEQ ID NO: 7784419 - DNA, 22 bp, Homo sapiens
gcctctgccaagggggctgcgg

SEQ ID NO: 7784420 - DNA, 22 bp, Homo sapiens
gcctctgcatgctcagcaccca

SEQ ID NO: 7784421 - DNA, 22 bp, Homo sapiens
gcctctgcatcttcgccgcact

SEQ ID NO: 7784422 - DNA, 22 bp, Homo sapiens
gcctctgcatcatcactccagc

SEQ ID NO: 7784423 - DNA, 22 bp, Homo sapiens
gcctctgcggagctgtacatca

SEQ ID NO: 7784424 - DNA, 22 bp, Homo sapiens
gcctctgcggggcccgagcccg

SEQ ID NO: 7784425 - DNA, 22 bp, Homo sapiens
gcctctgctcggactttgcctc

SEQ ID NO: 7784426 - DNA, 22 bp, Homo sapiens
gcctctgcgcctcagccgacct

SEQ ID NO: 7784427 - DNA, 22 bp, Homo sapiens
gcctctgcccatccaccatcag

SEQ ID NO: 7784428 - DNA, 22 bp, Homo sapiens
gcctctgccctcctgggactgc

SEQ ID NO: 7784429 - DNA, 21 bp, Homo sapiens
gcctctgctgtcttattgtga

SEQ ID NO: 7784430 - DNA, 19 bp, Homo sapiens
gcctctgctggggacaggc

SEQ ID NO: 7784431 - DNA, 22 bp, Homo sapiens
gcctctgctgcaagcctggttg

SEQ ID NO: 7784432 - DNA, 22 bp, Homo sapiens
gcctctgctgacaagatggaca

SEQ ID NO: 7784433 - DNA, 22 bp, Homo sapiens
gcctctgctctcaggtagcctc

SEQ ID NO: 7784434 - DNA, 23 bp, Homo sapiens
gcctctgctctgcgttggggact

SEQ ID NO: 7784435 - DNA, 22 bp, Homo sapiens
gccggggctggggagagacatg

SEQ ID NO: 7784436 - DNA, 22 bp, Homo sapiens
gccgttattctgctggccccgg

SEQ ID NO: 7784437 - DNA, 22 bp, Homo sapiens
gcctcctgtcccaggctgagga

SEQ ID NO: 7784438 - DNA, 22 bp, Homo sapiens
gccgggttcaagccattctcct

SEQ ID NO: 7784439 - DNA, 22 bp, Homo sapiens
gccgggttcaagccattctcct

SEQ ID NO: 7784440 - DNA, 22 bp, Homo sapiens
gccgggttcaagccattctcct

SEQ ID NO: 7784441 - DNA, 22 bp, Homo sapiens
gccatgttcttgaatctgggtc

SEQ ID NO: 7784442 - DNA, 21 bp, Homo sapiens
gccatgtttccttactaagag

SEQ ID NO: 7784443 - DNA, 22 bp, Homo sapiens
gccatgtcctgggcatctgcca

SEQ ID NO: 7784444 - DNA, 22 bp, Homo sapiens
gcccaggagttggaggctgcag

SEQ ID NO: 7784445 - DNA, 22 bp, Homo sapiens
gcccaggctggagtgcagtagc

SEQ ID NO: 7784446 - DNA, 22 bp, Homo sapiens
gcccaggctggagtgcagtagc

SEQ ID NO: 7784447 - DNA, 22 bp, Homo sapiens
gcccaggctagcgtagagtgca

SEQ ID NO: 7784448 - DNA, 22 bp, Homo sapiens
gcccaggctagcgtagagtgca

SEQ ID NO: 7784449 - DNA, 22 bp, Homo sapiens
gccagtgggacccgctgtgggc

SEQ ID NO: 7784450 - DNA, 22 bp, Homo sapiens
gccaggctgtttttattactgt

SEQ ID NO: 7784451 - DNA, 22 bp, Homo sapiens
gccagtgggtagttggagctgg

SEQ ID NO: 7784452 - DNA, 22 bp, Homo sapiens
gccatatacccactgtctccat

SEQ ID NO: 7784453 - DNA, 22 bp, Homo sapiens
gccagcagggcccaaatgctgg

SEQ ID NO: 7784454 - DNA, 22 bp, Homo sapiens
gccaggctgactcccccggcct

SEQ ID NO: 7784455 - DNA, 22 bp, Homo sapiens
gccaggctgaggctctggaaga

SEQ ID NO: 7784456 - DNA, 22 bp, Homo sapiens
gccaggctgctggctgctgtcc

SEQ ID NO: 7784457 - DNA, 22 bp, Homo sapiens
gccaggctgctccagggaggcc

SEQ ID NO: 7784458 - DNA, 22 bp, Homo sapiens
gccaggctgccttatctctagc

SEQ ID NO: 7784459 - DNA, 22 bp, Homo sapiens
gccaggctgtggggaacttgaa

SEQ ID NO: 7784460 - DNA, 22 bp, Homo sapiens
gccaggctgctggctgctgtcc

SEQ ID NO: 7784461 - DNA, 22 bp, Homo sapiens
gccaggctggtgtcacaactct

SEQ ID NO: 7784462 - DNA, 22 bp, Homo sapiens
gcacaagggtggtctctggagc

SEQ ID NO: 7784463 - DNA, 22 bp, Homo sapiens
gcacccaggccggcgactgcag

SEQ ID NO: 7784464 - DNA, 22 bp, Homo sapiens
gcacccaggcttgggcagcaac

SEQ ID NO: 7784465 - DNA, 22 bp, Homo sapiens
gcacccagggacttggctggcc

SEQ ID NO: 7784466 - DNA, 22 bp, Homo sapiens
gcacccagggcaggaagtgagg

SEQ ID NO: 7784467 - DNA, 22 bp, Homo sapiens
gcacccagtttgtctcagggtt

SEQ ID NO: 7784468 - DNA, 22 bp, Homo sapiens
gcacccctggacggtagggcca

SEQ ID NO: 7784469 - DNA, 22 bp, Homo sapiens
gcacccctcagcttgtttacta

SEQ ID NO: 7784470 - DNA, 22 bp, Homo sapiens
gcacccctgcgtgccttccctt

SEQ ID NO: 7784471 - DNA, 22 bp, Homo sapiens
gcaccctctgagctccgctccg

SEQ ID NO: 7784472 - DNA, 22 bp, Homo sapiens
gcaccgccttggaccgcccgct

SEQ ID NO: 7784473 - DNA, 22 bp, Homo sapiens
gcaccctgtttatcctgagttc

SEQ ID NO: 7784474 - DNA, 19 bp, Homo sapiens
gcaccctggccactcccac

SEQ ID NO: 7784475 - DNA, 22 bp, Homo sapiens
gcaccctgctctatccttgcta

SEQ ID NO: 7784476 - DNA, 19 bp, Homo sapiens
gcaccctgaggtcatggcc

SEQ ID NO: 7784477 - DNA, 22 bp, Homo sapiens
gcaccctgagtgttcagctcca

SEQ ID NO: 7784478 - DNA, 22 bp, Homo sapiens
gcacctgctggggctgatgaga

SEQ ID NO: 7784479 - DNA, 22 bp, Homo sapiens
gcacctgctgggtgtagaggct

SEQ ID NO: 7784480 - DNA, 22 bp, Homo sapiens
gcacttgtggatttgatataca

SEQ ID NO: 7784481 - DNA, 22 bp, Homo sapiens
gcacttgtgacagttcctggca

SEQ ID NO: 7784482 - DNA, 22 bp, Homo sapiens
gcacctgctggaatcagtctgt

SEQ ID NO: 7784483 - DNA, 22 bp, Homo sapiens
gcacctgctcacacatgtgact

SEQ ID NO: 7784484 - DNA, 22 bp, Homo sapiens
gcagagccagaatggccaggac

SEQ ID NO: 7784485 - DNA, 22 bp, Homo sapiens
gcagagccagaatggccaggac

SEQ ID NO: 7784486 - DNA, 22 bp, Homo sapiens
gcagagccaggagcccaggatc

SEQ ID NO: 7784487 - DNA, 22 bp, Homo sapiens
gcagagccaggctggggcaggt

SEQ ID NO: 7784488 - DNA, 22 bp, Homo sapiens
gcagagcccctcaagccagcct

SEQ ID NO: 7784489 - DNA, 22 bp, Homo sapiens
gcagagccccattgctggcggg

SEQ ID NO: 7784490 - DNA, 22 bp, Homo sapiens
gcagagccaggctggggcaggt

SEQ ID NO: 7784491 - DNA, 22 bp, Homo sapiens
gcagaaggatccgcaggtgcaa

SEQ ID NO: 7784492 - DNA, 22 bp, Homo sapiens
gcagaagctgggcagcgaggtg

SEQ ID NO: 7784493 - DNA, 22 bp, Homo sapiens
gcagaagctgggagaagggatt

SEQ ID NO: 7784494 - DNA, 22 bp, Homo sapiens
gcagaagcccggtcagcgcacg

SEQ ID NO: 7784495 - DNA, 22 bp, Homo sapiens
gcagaagcagggcaggggcaaa

SEQ ID NO: 7784496 - DNA, 22 bp, Homo sapiens
gcagaaacttggagaagccagg

SEQ ID NO: 7784497 - DNA, 22 bp, Homo sapiens
gcagaaaccacagtgtctttta

SEQ ID NO: 7784498 - DNA, 22 bp, Homo sapiens
gattttgaatattaaagaagag

SEQ ID NO: 7784499 - DNA, 22 bp, Homo sapiens
gattttgtcaaattccaaatgt

SEQ ID NO: 7784500 - DNA, 22 bp, Homo sapiens
gcaaacataatatgaagacact

SEQ ID NO: 7784501 - DNA, 22 bp, Homo sapiens
gcaaacatccactgcccttgta

SEQ ID NO: 7784502 - DNA, 22 bp, Homo sapiens
gcaaacaaggacatacatcctg

SEQ ID NO: 7784503 - DNA, 22 bp, Homo sapiens
gcaaaaaatgcttgttgcttag

SEQ ID NO: 7784504 - DNA, 22 bp, Homo sapiens
gcaaaaaatgcttgttgcttag

SEQ ID NO: 7784505 - DNA, 22 bp, Homo sapiens
gcaaacattcaggagtacagga

SEQ ID NO: 7784506 - DNA, 22 bp, Homo sapiens
gcaaacattccacagaaggaag

SEQ ID NO: 7784507 - DNA, 22 bp, Homo sapiens
gcacaacaccaagggaggtatc

SEQ ID NO: 7784508 - DNA, 22 bp, Homo sapiens
gcaatgcaatcagatgattatt

SEQ ID NO: 7784509 - DNA, 22 bp, Homo sapiens
gcaatcaatgatttatatttgt

SEQ ID NO: 7784510 - DNA, 22 bp, Homo sapiens
gcaatgtttttccttccatatt

SEQ ID NO: 7784511 - DNA, 22 bp, Homo sapiens
gattttatctttgtgtgcagta

SEQ ID NO: 7784512 - DNA, 22 bp, Homo sapiens
gattttatctttgtgtgcagta

SEQ ID NO: 7784513 - DNA, 22 bp, Homo sapiens
gattttatcgtcatccttctgg

SEQ ID NO: 7784514 - DNA, 22 bp, Homo sapiens
gattttatcgtcatccttctgg

SEQ ID NO: 7784515 - DNA, 22 bp, Homo sapiens
gattttattagcccaaactttg

SEQ ID NO: 7784516 - DNA, 22 bp, Homo sapiens
gattttatagtcaggaaaaaga

SEQ ID NO: 7784517 - DNA, 22 bp, Homo sapiens
gattttatatggcatactgtgg

SEQ ID NO: 7784518 - DNA, 22 bp, Homo sapiens
gatttgtttcaagttagcatct

SEQ ID NO: 7784519 - DNA, 22 bp, Homo sapiens
gatttgtttcaagttagcatct

SEQ ID NO: 7784520 - DNA, 22 bp, Homo sapiens
gatttctttgcaagctgtgttc

SEQ ID NO: 7784521 - DNA, 22 bp, Homo sapiens
gatttcttggcccactctcaga

SEQ ID NO: 7784522 - DNA, 22 bp, Homo sapiens
gatttcttgataattcaaatcc

SEQ ID NO: 7784523 - DNA, 22 bp, Homo sapiens
gatttcttgagcaagttgctta

SEQ ID NO: 7784524 - DNA, 22 bp, Homo sapiens
gatttcttcattcattagatgg

SEQ ID NO: 7784525 - DNA, 22 bp, Homo sapiens
gatttctgttgagaaacatggg

SEQ ID NO: 7784526 - DNA, 22 bp, Homo sapiens
gatttctgtggcttgtacatat

SEQ ID NO: 7784527 - DNA, 22 bp, Homo sapiens
gattcacagtttaggctgggct

SEQ ID NO: 7784528 - DNA, 23 bp, Homo sapiens
gattcacagggtggtttatgggg

SEQ ID NO: 7784529 - DNA, 22 bp, Homo sapiens
gattcacagaacttagtcaagc

SEQ ID NO: 7784530 - DNA, 22 bp, Homo sapiens
gattcacaactgccctgaaggg

SEQ ID NO: 7784531 - DNA, 22 bp, Homo sapiens
gattcaagacctagctcagcca

SEQ ID NO: 7784532 - DNA, 22 bp, Homo sapiens
gattagtatccttattaagaga

SEQ ID NO: 7784533 - DNA, 22 bp, Homo sapiens
gattagtaagagtttacctatt

SEQ ID NO: 7784534 - DNA, 22 bp, Homo sapiens
gattattttgtgcaataatcgg

SEQ ID NO: 7784535 - DNA, 22 bp, Homo sapiens
gattcaaagttaatgaagatgc

SEQ ID NO: 7784536 - DNA, 22 bp, Homo sapiens
gattcaaaaataagctcctatt

SEQ ID NO: 7784537 - DNA, 22 bp, Homo sapiens
gattcaaaagtttgagctccaa

SEQ ID NO: 7784538 - DNA, 22 bp, Homo sapiens
gattcaaagacagactcatttc

SEQ ID NO: 7784539 - DNA, 22 bp, Homo sapiens
gatgttctggggtgtttgtggc

SEQ ID NO: 7784540 - DNA, 22 bp, Homo sapiens
gatgtgtttccaggatttgttt

SEQ ID NO: 7784541 - DNA, 22 bp, Homo sapiens
gattaatagtacaggttcttag

SEQ ID NO: 7784542 - DNA, 22 bp, Homo sapiens
gattaatagacacaaccaagct

SEQ ID NO: 7784543 - DNA, 22 bp, Homo sapiens
gattaagtggaatgagtatttg

SEQ ID NO: 7784544 - DNA, 22 bp, Homo sapiens
gattaatagacacaaccaagct

SEQ ID NO: 7784545 - DNA, 22 bp, Homo sapiens
gattaagtaactgaacactttg

SEQ ID NO: 7784546 - DNA, 22 bp, Homo sapiens
gattacaaaactcatctatgac

SEQ ID NO: 7784547 - DNA, 20 bp, Homo sapiens
gattacaaaatgaaatgcat

SEQ ID NO: 7784548 - DNA, 22 bp, Homo sapiens
gattacattctccttgtattag

SEQ ID NO: 7784549 - DNA, 22 bp, Homo sapiens
gatttattgtccctgtcctgct

SEQ ID NO: 7784550 - DNA, 22 bp, Homo sapiens
gatttattgtccctgtcctgct

SEQ ID NO: 7784551 - DNA, 22 bp, Homo sapiens
gatttattggtctttcattggt

SEQ ID NO: 7784552 - DNA, 22 bp, Homo sapiens
gatttattggtctttcattggt

SEQ ID NO: 7784553 - DNA, 22 bp, Homo sapiens
gatttatttttaatcagcaggg

SEQ ID NO: 7784554 - DNA, 22 bp, Homo sapiens
gatttatttttaatcagcaggg

SEQ ID NO: 7784555 - DNA, 22 bp, Homo sapiens
gatttatttttaatcagcaggg

SEQ ID NO: 7784556 - DNA, 22 bp, Homo sapiens
gatttacagctatacccaatgg

SEQ ID NO: 7784557 - DNA, 22 bp, Homo sapiens
gatttacaggttaggtcctgta

SEQ ID NO: 7784558 - DNA, 22 bp, Homo sapiens
gatttagtggcccttggtacac

SEQ ID NO: 7784559 - DNA, 22 bp, Homo sapiens
gattgtaaaacagatcattatc

SEQ ID NO: 7784560 - DNA, 22 bp, Homo sapiens
gattgtaattctactttccgct

SEQ ID NO: 7784561 - DNA, 22 bp, Homo sapiens
gattgtaattttcaagaggtaa

SEQ ID NO: 7784562 - DNA, 22 bp, Homo sapiens
gatttacagatctaagggtcac

SEQ ID NO: 7784563 - DNA, 22 bp, Homo sapiens
gatttacaaagctctctagtgt

SEQ ID NO: 7784564 - DNA, 22 bp, Homo sapiens
gatttacaaagctctctagtgt

SEQ ID NO: 7784565 - DNA, 19 bp, Homo sapiens
gatttaaacgtggctctat

SEQ ID NO: 7784566 - DNA, 22 bp, Homo sapiens
gatggaatgtcacttctgtggt

SEQ ID NO: 7784567 - DNA, 22 bp, Homo sapiens
gatggaggagatggcagggtgc

SEQ ID NO: 7784568 - DNA, 18 bp, Homo sapiens
gatgggagcaagagaaga

SEQ ID NO: 7784569 - DNA, 22 bp, Homo sapiens
gatgggcacggcagtctgagag

SEQ ID NO: 7784570 - DNA, 22 bp, Homo sapiens
gatgcctgcatttcaggagagt

SEQ ID NO: 7784571 - DNA, 22 bp, Homo sapiens
gatgcgggcccgctccactgcc

SEQ ID NO: 7784572 - DNA, 22 bp, Homo sapiens
gatgctggcctggccatctggg

SEQ ID NO: 7784573 - DNA, 22 bp, Homo sapiens
gatgtagacacttggaggctta

SEQ ID NO: 7784574 - DNA, 22 bp, Homo sapiens
gatgtacttgccttatctatcc

SEQ ID NO: 7784575 - DNA, 21 bp, Homo sapiens
gatggtagcctcatagaagta

SEQ ID NO: 7784576 - DNA, 17 bp, Homo sapiens
gatggggctgacatcag

SEQ ID NO: 7784577 - DNA, 22 bp, Homo sapiens
gatgtaaactgggacttcctag

SEQ ID NO: 7784578 - DNA, 18 bp, Homo sapiens
gatgtaaaatagtagctt

SEQ ID NO: 7784579 - DNA, 22 bp, Homo sapiens
gcagtgtctttgacctccaccc

SEQ ID NO: 7784580 - DNA, 21 bp, Homo sapiens
gcagtgtcatggtttcaagtt

SEQ ID NO: 7784581 - DNA, 22 bp, Homo sapiens
gcagtgtccagggtggtctgca

SEQ ID NO: 7784582 - DNA, 22 bp, Homo sapiens
gcagtgtcagtgcctgggtggt

SEQ ID NO: 7784583 - DNA, 19 bp, Homo sapiens
gcagtgtcatggtaggagc

SEQ ID NO: 7784584 - DNA, 22 bp, Homo sapiens
gcagtgttaggaataaaaatga

SEQ ID NO: 7784585 - DNA, 22 bp, Homo sapiens
gcagtggggaatgctggggaga

SEQ ID NO: 7784586 - DNA, 22 bp, Homo sapiens
gcagtgggcctgaggaagggtg

SEQ ID NO: 7784587 - DNA, 22 bp, Homo sapiens
gcagtgggcaacaagagctgga

SEQ ID NO: 7784588 - DNA, 22 bp, Homo sapiens
gcagtgggcaacaagagctgga

SEQ ID NO: 7784589 - DNA, 22 bp, Homo sapiens
gcagtggggcgctgggagttgg

SEQ ID NO: 7784590 - DNA, 22 bp, Homo sapiens
gcagtggggaatgctggggaga

SEQ ID NO: 7784591 - DNA, 22 bp, Homo sapiens
gcagtaggagggacaactacct

SEQ ID NO: 7784592 - DNA, 22 bp, Homo sapiens
gcagtgggcaacaagagctgga

SEQ ID NO: 7784593 - DNA, 22 bp, Homo sapiens
gcagtacacacatatgtattcg

SEQ ID NO: 7784594 - DNA, 22 bp, Homo sapiens
gcaggtggcagaggtgggatct

SEQ ID NO: 7784595 - DNA, 22 bp, Homo sapiens
gcaggtgggagccgctgcctga

SEQ ID NO: 7784596 - DNA, 22 bp, Homo sapiens
gcaggtggattatcagaagtgc

SEQ ID NO: 7784597 - DNA, 19 bp, Homo sapiens
gcaggtggatgtggtcagc

SEQ ID NO: 7784598 - DNA, 22 bp, Homo sapiens
gcagggtgatagtgaggctcag

SEQ ID NO: 7784599 - DNA, 22 bp, Homo sapiens
gcagggtgccgacttcagggat

SEQ ID NO: 7784600 - DNA, 22 bp, Homo sapiens
gcagggtgatagtgaggctcag

SEQ ID NO: 7784601 - DNA, 22 bp, Homo sapiens
gcagggtgccgacttcagggat

SEQ ID NO: 7784602 - DNA, 22 bp, Homo sapiens
gcaggtggaagcagcagactca

SEQ ID NO: 7784603 - DNA, 22 bp, Homo sapiens
gcagggtggatggcagggccag

SEQ ID NO: 7784604 - DNA, 22 bp, Homo sapiens
gcaggtgggggtcggtgcatct

SEQ ID NO: 7784605 - DNA, 22 bp, Homo sapiens
gcaggtggtgggggagccgttc

SEQ ID NO: 7784606 - DNA, 23 bp, Homo sapiens
gcaggtggttcgaacagaagttt

SEQ ID NO: 7784607 - DNA, 22 bp, Homo sapiens
gcaggtggtggcgcgcgccctg

SEQ ID NO: 7784608 - DNA, 22 bp, Homo sapiens
gcaggtggtccccgtggagtgg

SEQ ID NO: 7784609 - DNA, 22 bp, Homo sapiens
gcatgtggtgctgaggctgtcg

SEQ ID NO: 7784610 - DNA, 22 bp, Homo sapiens
gcatgtggatatgttagggtga

SEQ ID NO: 7784611 - DNA, 22 bp, Homo sapiens
gcatgtggcccaaggaggctgt

SEQ ID NO: 7784612 - DNA, 22 bp, Homo sapiens
gcatgtgggaacacttaggcac

SEQ ID NO: 7784613 - DNA, 22 bp, Homo sapiens
gcatgtggccttcaggctggaa

SEQ ID NO: 7784614 - DNA, 22 bp, Homo sapiens
gccacagacagagagtctagtg

SEQ ID NO: 7784615 - DNA, 22 bp, Homo sapiens
gccacacttattctcatgcaca

SEQ ID NO: 7784616 - DNA, 22 bp, Homo sapiens
gccacagcccgagcaccatgag

SEQ ID NO: 7784617 - DNA, 22 bp, Homo sapiens
gccacagcagggccctctcagg

SEQ ID NO: 7784618 - DNA, 22 bp, Homo sapiens
gccagcagctcttgggcgggca

SEQ ID NO: 7784619 - DNA, 22 bp, Homo sapiens
gccagcagctgtggggtggcca

SEQ ID NO: 7784620 - DNA, 22 bp, Homo sapiens
gccagcagggaagccttgggct

SEQ ID NO: 7784621 - DNA, 22 bp, Homo sapiens
gccagatgccgtaaagatgggc

SEQ ID NO: 7784622 - DNA, 20 bp, Homo sapiens
gccagaggccggcaggggct

SEQ ID NO: 7784623 - DNA, 20 bp, Homo sapiens
gccagaggccggcaggggct

SEQ ID NO: 7784624 - DNA, 22 bp, Homo sapiens
gccacagctcacgttccccatt

SEQ ID NO: 7784625 - DNA, 22 bp, Homo sapiens
gccacagcggggccgctagagc

SEQ ID NO: 7784626 - DNA, 22 bp, Homo sapiens
gccacagcggggccgctagagc

SEQ ID NO: 7784627 - DNA, 22 bp, Homo sapiens
gccacaggaaagcaccctggag

SEQ ID NO: 7784628 - DNA, 22 bp, Homo sapiens
gcaggcagagaaggaacattta

SEQ ID NO: 7784629 - DNA, 22 bp, Homo sapiens
gcaggcactcctaggaccatca

SEQ ID NO: 7784630 - DNA, 21 bp, Homo sapiens
gcaggcactctagaggagctg

SEQ ID NO: 7784631 - DNA, 17 bp, Homo sapiens
gcaggcactgctgcctg

SEQ ID NO: 7784632 - DNA, 22 bp, Homo sapiens
gcaggctggaggctgttctggg

SEQ ID NO: 7784633 - DNA, 22 bp, Homo sapiens
gcaggctgctgagatccttagg

SEQ ID NO: 7784634 - DNA, 22 bp, Homo sapiens
gcaggctgccaccttctgagtt

SEQ ID NO: 7784635 - DNA, 22 bp, Homo sapiens
gcaggctgccctcttgtgttga

SEQ ID NO: 7784636 - DNA, 22 bp, Homo sapiens
gcaggcagaggtggaggagaca

SEQ ID NO: 7784637 - DNA, 22 bp, Homo sapiens
gcaggcagaggtggaggagaca

SEQ ID NO: 7784638 - DNA, 22 bp, Homo sapiens
gcaggctttgacttggggcaac

SEQ ID NO: 7784639 - DNA, 22 bp, Homo sapiens
gcaggctttgacttggggcagc

SEQ ID NO: 7784640 - DNA, 19 bp, Homo sapiens
gcaggcttgggtctcccca

SEQ ID NO: 7784641 - DNA, 22 bp, Homo sapiens
gcaggcttgggacgagctggag

SEQ ID NO: 7784642 - DNA, 22 bp, Homo sapiens
gcagggacgccagggacagcaa

SEQ ID NO: 7784643 - DNA, 21 bp, Homo sapiens
gcaggctggtcaaacctcagt

SEQ ID NO: 7784644 - DNA, 21 bp, Homo sapiens
gcaggctggtcaaacctcagt

SEQ ID NO: 7784645 - DNA, 22 bp, Homo sapiens
gcaggctggggtagccccactt

SEQ ID NO: 7784646 - DNA, 22 bp, Homo sapiens
gcaggcttcaagcacagctttt

SEQ ID NO: 7784647 - DNA, 22 bp, Homo sapiens
gcaggctggtctgaccatccct

SEQ ID NO: 7784648 - DNA, 22 bp, Homo sapiens
gcagggcacagacagtgccaag

SEQ ID NO: 7784649 - DNA, 22 bp, Homo sapiens
gcagggcagaaggtgctgagga

SEQ ID NO: 7784650 - DNA, 22 bp, Homo sapiens
gcagggcagagggagaatctct

SEQ ID NO: 7784651 - DNA, 22 bp, Homo sapiens
gcagggcagacctccagcctat

SEQ ID NO: 7784652 - DNA, 22 bp, Homo sapiens
gcagggcacaaggacgcacagg

SEQ ID NO: 7784653 - DNA, 20 bp, Homo sapiens
gcagggcaagggatatgaaa

SEQ ID NO: 7784654 - DNA, 22 bp, Homo sapiens
gcagggcaaatgtggaaaggag

SEQ ID NO: 7784655 - DNA, 22 bp, Homo sapiens
gcaggggctactctgagcttcc

SEQ ID NO: 7784656 - DNA, 22 bp, Homo sapiens
gcagggcagccacaggccccct

SEQ ID NO: 7784657 - DNA, 22 bp, Homo sapiens
gcaggggctgagcaccagcggg

SEQ ID NO: 7784658 - DNA, 22 bp, Homo sapiens
gcaggggctgctgggaactcgg

SEQ ID NO: 7784659 - DNA, 22 bp, Homo sapiens
gcaggcaccacggctcaggtct

SEQ ID NO: 7784660 - DNA, 22 bp, Homo sapiens
gcaggcaccgcggcggcaggtt

SEQ ID NO: 7784661 - DNA, 22 bp, Homo sapiens
gcaggagccacttcagggatgc

SEQ ID NO: 7784662 - DNA, 22 bp, Homo sapiens
gcaggagccctggcatgttctt

SEQ ID NO: 7784663 - DNA, 22 bp, Homo sapiens
gcaggagccagggattccagga

SEQ ID NO: 7784664 - DNA, 22 bp, Homo sapiens
gcaggagccaggccgagctggt

SEQ ID NO: 7784665 - DNA, 22 bp, Homo sapiens
gcaggagctcgtttccaggctg

SEQ ID NO: 7784666 - DNA, 22 bp, Homo sapiens
gcaggagctcgtttccaggctg

SEQ ID NO: 7784667 - DNA, 22 bp, Homo sapiens
gcaggagctcgtttccaggctg

SEQ ID NO: 7784668 - DNA, 22 bp, Homo sapiens
gcaggagctgctctcctgacga

SEQ ID NO: 7784669 - DNA, 22 bp, Homo sapiens
gcaggagaacaaagcaagctgc

SEQ ID NO: 7784670 - DNA, 22 bp, Homo sapiens
gcagctgatggaagtcctattg

SEQ ID NO: 7784671 - DNA, 22 bp, Homo sapiens
gcaggacagacccaagcagtct

SEQ ID NO: 7784672 - DNA, 22 bp, Homo sapiens
gcaggacagcaggatgcttaga

SEQ ID NO: 7784673 - DNA, 22 bp, Homo sapiens
gcagctgacatctggctgggcc

SEQ ID NO: 7784674 - DNA, 22 bp, Homo sapiens
gcagctgagcgtgaggaagagt

SEQ ID NO: 7784675 - DNA, 22 bp, Homo sapiens
gcagctgagagaagaacagggc

SEQ ID NO: 7784676 - DNA, 22 bp, Homo sapiens
gcaggacattcagtgaatgggc

SEQ ID NO: 7784677 - DNA, 22 bp, Homo sapiens
gcaggacaggcgttggtccagt

SEQ ID NO: 7784678 - DNA, 22 bp, Homo sapiens
gcaggacaggcgttggtccagt

SEQ ID NO: 7784679 - DNA, 22 bp, Homo sapiens
gcagctgaaagggatctctaca

SEQ ID NO: 7784680 - DNA, 20 bp, Homo sapiens
gcagctgaaagtatgacacc

SEQ ID NO: 7784681 - DNA, 22 bp, Homo sapiens
gcagctgaagctgcagttccag

SEQ ID NO: 7784682 - DNA, 22 bp, Homo sapiens
gcagctgaatgtccattgctgc

SEQ ID NO: 7784683 - DNA, 22 bp, Homo sapiens
gcagctgacatctggctgggcc

SEQ ID NO: 7784684 - DNA, 18 bp, Homo sapiens
gcagctgacactggagtt

SEQ ID NO: 7784685 - DNA, 21 bp, Homo sapiens
gcagagccggggcgagaaggc

SEQ ID NO: 7784686 - DNA, 22 bp, Homo sapiens
gcagcgctgtaggcccaaggca

SEQ ID NO: 7784687 - DNA, 22 bp, Homo sapiens
gcagcgtggggctgagtcagct

SEQ ID NO: 7784688 - DNA, 22 bp, Homo sapiens
gcagcctctgcagttcaggagg

SEQ ID NO: 7784689 - DNA, 16 bp, Homo sapiens
gcagagctcagggact

SEQ ID NO: 7784690 - DNA, 22 bp, Homo sapiens
gataatatctggtttattcacc

SEQ ID NO: 7784691 - DNA, 22 bp, Homo sapiens
gataataagcacagcaggatgt

SEQ ID NO: 7784692 - DNA, 19 bp, Homo sapiens
gataagtttccaggtaact

SEQ ID NO: 7784693 - DNA, 19 bp, Homo sapiens
gatataaagagatggtgaa

SEQ ID NO: 7784694 - DNA, 22 bp, Homo sapiens
gatatacaatccacagttgatt

SEQ ID NO: 7784695 - DNA, 22 bp, Homo sapiens
gatataaattaatcaagtgcaa

SEQ ID NO: 7784696 - DNA, 22 bp, Homo sapiens
gatacccagcaaaatgcaggag

SEQ ID NO: 7784697 - DNA, 22 bp, Homo sapiens
gataccttttgttggaatttcc

SEQ ID NO: 7784698 - DNA, 22 bp, Homo sapiens
gatagaaagaatatagattcca

SEQ ID NO: 7784699 - DNA, 22 bp, Homo sapiens
gatagataaaactatattttca

SEQ ID NO: 7784700 - DNA, 22 bp, Homo sapiens
gatagagactataatgctcttt

SEQ ID NO: 7784701 - DNA, 22 bp, Homo sapiens
gatagaaaggtgttgaaatcca

SEQ ID NO: 7784702 - DNA, 22 bp, Homo sapiens
gatagaaagagtggttcttttt

SEQ ID NO: 7784703 - DNA, 22 bp, Homo sapiens
gatagaaagagtggttcttttt

SEQ ID NO: 7784704 - DNA, 22 bp, Homo sapiens
gatattttgagaaatcctatga

SEQ ID NO: 7784705 - DNA, 22 bp, Homo sapiens
gatattttgagaaatcctatga

SEQ ID NO: 7784706 - DNA, 18 bp, Homo sapiens
gatatataggaggaaagt

SEQ ID NO: 7784707 - DNA, 18 bp, Homo sapiens
gatatataggaggaaagt

SEQ ID NO: 7784708 - DNA, 22 bp, Homo sapiens
gatatacagagcattctttgat

SEQ ID NO: 7784709 - DNA, 22 bp, Homo sapiens
gatatacataggtttctatgca

SEQ ID NO: 7784710 - DNA, 22 bp, Homo sapiens
gatcaatactattaagatcata

SEQ ID NO: 7784711 - DNA, 22 bp, Homo sapiens
gatcaggaatattggaaagtac

SEQ ID NO: 7784712 - DNA, 22 bp, Homo sapiens
gatcaggagatggcctcagacc

SEQ ID NO: 7784713 - DNA, 22 bp, Homo sapiens
gatcaggacatagctataggct

SEQ ID NO: 7784714 - DNA, 22 bp, Homo sapiens
gatcaggacatagctataggct

SEQ ID NO: 7784715 - DNA, 19 bp, Homo sapiens
gatcaggagccgacaactg

SEQ ID NO: 7784716 - DNA, 18 bp, Homo sapiens
gatcaggatcaatcaccc

SEQ ID NO: 7784717 - DNA, 20 bp, Homo sapiens
gatcaggaagcggcttggga

SEQ ID NO: 7784718 - DNA, 22 bp, Homo sapiens
gatgaacatttaaagcctcttg

SEQ ID NO: 7784719 - DNA, 22 bp, Homo sapiens
gatgaaatttgggcaggttaaa

SEQ ID NO: 7784720 - DNA, 22 bp, Homo sapiens
gatgaacatattcctctccaga

SEQ ID NO: 7784721 - DNA, 22 bp, Homo sapiens
gatgagaaatggacaggagtgg

SEQ ID NO: 7784722 - DNA, 22 bp, Homo sapiens
gatgagcattgtttcatgtgtt

SEQ ID NO: 7784723 - DNA, 22 bp, Homo sapiens
gatgcaaagcatttttgtgtgt

SEQ ID NO: 7784724 - DNA, 22 bp, Homo sapiens
gatgcacggtcatgtcttttca

SEQ ID NO: 7784725 - DNA, 22 bp, Homo sapiens
gatgcagggctggcaggagctt

SEQ ID NO: 7784726 - DNA, 22 bp, Homo sapiens
gatgcaaaagtatcattttaat

SEQ ID NO: 7784727 - DNA, 22 bp, Homo sapiens
gatgattttgttggtgattcaa

SEQ ID NO: 7784728 - DNA, 22 bp, Homo sapiens
gatgattacacttttaaaacag

SEQ ID NO: 7784729 - DNA, 22 bp, Homo sapiens
gatgaaatgctgagcctgagtt

SEQ ID NO: 7784730 - DNA, 22 bp, Homo sapiens
gatgaaatgtgaaagttctggg

SEQ ID NO: 7784731 - DNA, 22 bp, Homo sapiens
gatgaaatttgaaaatagtgtt

SEQ ID NO: 7784732 - DNA, 22 bp, Homo sapiens
gatgaaattgttttgatacttt

SEQ ID NO: 7784733 - DNA, 22 bp, Homo sapiens
gatgaaattcagaattgagggg

SEQ ID NO: 7784734 - DNA, 20 bp, Homo sapiens
gatgaaatcactgggcagcc

SEQ ID NO: 7784735 - DNA, 22 bp, Homo sapiens
gatgaaatagcaaaggcatttg

SEQ ID NO: 7784736 - DNA, 22 bp, Homo sapiens
gatgaaatagaattaatttagg

SEQ ID NO: 7784737 - DNA, 17 bp, Homo sapiens
gatgaaatgatgcacac

SEQ ID NO: 7784738 - DNA, 22 bp, Homo sapiens
gatgaaatccagatcacaggtg

SEQ ID NO: 7784739 - DNA, 22 bp, Homo sapiens
gatgaaaaattgctgtgtcata

SEQ ID NO: 7784740 - DNA, 22 bp, Homo sapiens
gatgaaaaattgctgtgtcata

SEQ ID NO: 7784741 - DNA, 22 bp, Homo sapiens
gatgaaaaattgctgtgtcata

SEQ ID NO: 7784742 - DNA, 22 bp, Homo sapiens
gatcttgagcaagttgtgtaac

SEQ ID NO: 7784743 - DNA, 22 bp, Homo sapiens
gatcccttgggccaaggagttg

SEQ ID NO: 7784744 - DNA, 22 bp, Homo sapiens
gatccagcttctacacagagct

SEQ ID NO: 7784745 - DNA, 22 bp, Homo sapiens
gatccagatatttgggctggta

SEQ ID NO: 7784746 - DNA, 22 bp, Homo sapiens
gatcatttgcaggaaacattaa

SEQ ID NO: 7784747 - DNA, 22 bp, Homo sapiens
gagtctttctgggcttgttctt

SEQ ID NO: 7784748 - DNA, 22 bp, Homo sapiens
gagtctttggtaaagtctgctg

SEQ ID NO: 7784749 - DNA, 22 bp, Homo sapiens
gagtgacggctcatctctggaa

SEQ ID NO: 7784750 - DNA, 18 bp, Homo sapiens
gagtctttgttactgctg

SEQ ID NO: 7784751 - DNA, 22 bp, Homo sapiens
gagtcctgtaactttcttccta

SEQ ID NO: 7784752 - DNA, 19 bp, Homo sapiens
gagtcctgtgctccttgtt

SEQ ID NO: 7784753 - DNA, 22 bp, Homo sapiens
gagtcctgttgtcccagatggg

SEQ ID NO: 7784754 - DNA, 22 bp, Homo sapiens
gagtcctggaaccctgaatgct

SEQ ID NO: 7784755 - DNA, 22 bp, Homo sapiens
gagtcctgctttcaattctttt

SEQ ID NO: 7784756 - DNA, 22 bp, Homo sapiens
gagtcctgcccttgtgtagtcc

SEQ ID NO: 7784757 - DNA, 22 bp, Homo sapiens
gagtcctgatccttagctctcc

SEQ ID NO: 7784758 - DNA, 22 bp, Homo sapiens
gagtcctgaatcctgtggcaac

SEQ ID NO: 7784759 - DNA, 21 bp, Homo sapiens
gagtcctggctagggtggcag

SEQ ID NO: 7784760 - DNA, 22 bp, Homo sapiens
gagtcctggagaaacgcaggtg

SEQ ID NO: 7784761 - DNA, 22 bp, Homo sapiens
gagtctctggaggggtcagacc

SEQ ID NO: 7784762 - DNA, 22 bp, Homo sapiens
gagtctatctcactcccccagg

SEQ ID NO: 7784763 - DNA, 22 bp, Homo sapiens
gagtggagcaaaagaggtagat

SEQ ID NO: 7784764 - DNA, 22 bp, Homo sapiens
gagtgcttgcatatttattgtc

SEQ ID NO: 7784765 - DNA, 22 bp, Homo sapiens
gagtggagatcgtgccactgca

SEQ ID NO: 7784766 - DNA, 22 bp, Homo sapiens
gagtggcatatgtgcctgtgaa

SEQ ID NO: 7784767 - DNA, 22 bp, Homo sapiens
gagtggggctttaaaggctcag

SEQ ID NO: 7784768 - DNA, 22 bp, Homo sapiens
gagtgctccgtcttggacaggg

SEQ ID NO: 7784769 - DNA, 21 bp, Homo sapiens
gagtgctcagttaagtggaga

SEQ ID NO: 7784770 - DNA, 22 bp, Homo sapiens
gagtgccaagagaagaggctgg

SEQ ID NO: 7784771 - DNA, 22 bp, Homo sapiens
gagtgccaagagaagaggctgg

SEQ ID NO: 7784772 - DNA, 22 bp, Homo sapiens
gataaacacaaggtgatttcat

SEQ ID NO: 7784773 - DNA, 22 bp, Homo sapiens
gataaaattcttattttacccg

SEQ ID NO: 7784774 - DNA, 22 bp, Homo sapiens
gataaactggaaccattgcctc

SEQ ID NO: 7784775 - DNA, 22 bp, Homo sapiens
gataacaatatgaagtagatat

SEQ ID NO: 7784776 - DNA, 22 bp, Homo sapiens
gataacatacttgcatgtgtat

SEQ ID NO: 7784777 - DNA, 22 bp, Homo sapiens
gataacatggttagtgttttta

SEQ ID NO: 7784778 - DNA, 22 bp, Homo sapiens
gataacattttgaagtgctagt

SEQ ID NO: 7784779 - DNA, 20 bp, Homo sapiens
gataaattgtctcttaagtg

SEQ ID NO: 7784780 - DNA, 22 bp, Homo sapiens
gataaacttgtggagttttggt

SEQ ID NO: 7784781 - DNA, 22 bp, Homo sapiens
gagtttctccagtgctagttgt

SEQ ID NO: 7784782 - DNA, 22 bp, Homo sapiens
gagttgcctctaagtccctggt

SEQ ID NO: 7784783 - DNA, 22 bp, Homo sapiens
gagtttatgtctttcattgttc

SEQ ID NO: 7784784 - DNA, 21 bp, Homo sapiens
gagtgtcagcaagaggtttgg

SEQ ID NO: 7784785 - DNA, 22 bp, Homo sapiens
gagtgtcacagggtaattgttt

SEQ ID NO: 7784786 - DNA, 22 bp, Homo sapiens
gagtgtcaaggctctctttggc

SEQ ID NO: 7784787 - DNA, 22 bp, Homo sapiens
gagtgtcacttgatgcagggca

SEQ ID NO: 7784788 - DNA, 22 bp, Homo sapiens
gagtgtcagtgcctggcttgtt

SEQ ID NO: 7784789 - DNA, 22 bp, Homo sapiens
gagtgtcagcagggcagagcac

SEQ ID NO: 7784790 - DNA, 22 bp, Homo sapiens
gagtgtcagtgcttggggctac

SEQ ID NO: 7784791 - DNA, 18 bp, Homo sapiens
gagtgtggcactgggccc

SEQ ID NO: 7784792 - DNA, 22 bp, Homo sapiens
gagttaaagtacctttgtatgt

SEQ ID NO: 7784793 - DNA, 22 bp, Homo sapiens
gagttaaaagccctctcagcag

SEQ ID NO: 7784794 - DNA, 22 bp, Homo sapiens
gagtgttttactcaaagaaaga

SEQ ID NO: 7784795 - DNA, 22 bp, Homo sapiens
gagtcacatactatgtaataga

SEQ ID NO: 7784796 - DNA, 22 bp, Homo sapiens
gagtcagaaactcactctatag

SEQ ID NO: 7784797 - DNA, 22 bp, Homo sapiens
gagtcagaaagtagtgtgccta

SEQ ID NO: 7784798 - DNA, 22 bp, Homo sapiens
gaggtggtttgtggtgactcat

SEQ ID NO: 7784799 - DNA, 22 bp, Homo sapiens
gaggtggtcgaggaggggtacc

SEQ ID NO: 7784800 - DNA, 19 bp, Homo sapiens
gaggtgggtccccgcagcc

SEQ ID NO: 7784801 - DNA, 19 bp, Homo sapiens
gaggtgggtccccgcagcc

SEQ ID NO: 7784802 - DNA, 22 bp, Homo sapiens
gaggtgggtgtatcacaggtca

SEQ ID NO: 7784803 - DNA, 22 bp, Homo sapiens
gaggtgggtgtatcacaggtca

SEQ ID NO: 7784804 - DNA, 22 bp, Homo sapiens
gagtcaggagtcctgtgtgaga

SEQ ID NO: 7784805 - DNA, 22 bp, Homo sapiens
gagtcagaccgactgggctcat

SEQ ID NO: 7784806 - DNA, 22 bp, Homo sapiens
gagtcagatgaagataaaaggg

SEQ ID NO: 7784807 - DNA, 22 bp, Homo sapiens
gagtcagattgcagacagggct

SEQ ID NO: 7784808 - DNA, 22 bp, Homo sapiens
gagtcagacagggtcacccaga

SEQ ID NO: 7784809 - DNA, 22 bp, Homo sapiens
gagtcagaattgtattttaaac

SEQ ID NO: 7784810 - DNA, 22 bp, Homo sapiens
gagtcagaatgtcctcctgcgg

SEQ ID NO: 7784811 - DNA, 22 bp, Homo sapiens
gagtcagaagaaactatttaca

SEQ ID NO: 7784812 - DNA, 22 bp, Homo sapiens
gagtccagttgttcacagaggc

SEQ ID NO: 7784813 - DNA, 22 bp, Homo sapiens
gagtcctcaacggggagaggcg

SEQ ID NO: 7784814 - DNA, 22 bp, Homo sapiens
gagtcctcagatagaaagtgcg

SEQ ID NO: 7784815 - DNA, 22 bp, Homo sapiens
gagtcaggctagggtgacaggc

SEQ ID NO: 7784816 - DNA, 22 bp, Homo sapiens
gaggtaggtgtaggaggcctgc

SEQ ID NO: 7784817 - DNA, 22 bp, Homo sapiens
gaggtcaggctcaagctgggcc

SEQ ID NO: 7784818 - DNA, 22 bp, Homo sapiens
gaggtcaggcttgcagcagggt

SEQ ID NO: 7784819 - DNA, 22 bp, Homo sapiens
gaggtcaggggagaggctgatg

SEQ ID NO: 7784820 - DNA, 22 bp, Homo sapiens
gaggtccactgaggcaacaggg

SEQ ID NO: 7784821 - DNA, 22 bp, Homo sapiens
gaggtccagccaagcggcaagg

SEQ ID NO: 7784822 - DNA, 22 bp, Homo sapiens
gaggtccagggtggggcctgag

SEQ ID NO: 7784823 - DNA, 22 bp, Homo sapiens
gaggtccagggtggggcctgag

SEQ ID NO: 7784824 - DNA, 22 bp, Homo sapiens
gaggtgggcggatcacaaggtc

SEQ ID NO: 7784825 - DNA, 22 bp, Homo sapiens
gaggtgggcggatcacaaggtc

SEQ ID NO: 7784826 - DNA, 22 bp, Homo sapiens
gaggtgggatgtgtgtgctact

SEQ ID NO: 7784827 - DNA, 22 bp, Homo sapiens
gaggggcaatgagggaaagagt

SEQ ID NO: 7784828 - DNA, 22 bp, Homo sapiens
gaggggagtgtcctccgggccc

SEQ ID NO: 7784829 - DNA, 22 bp, Homo sapiens
gagggcaggggtcttgcacggt

SEQ ID NO: 7784830 - DNA, 20 bp, Homo sapiens
gagggcaggcacccatttca

SEQ ID NO: 7784831 - DNA, 22 bp, Homo sapiens
gagggcagtagcctcgtaccct

SEQ ID NO: 7784832 - DNA, 22 bp, Homo sapiens
gagggccaatggatttcaactg

SEQ ID NO: 7784833 - DNA, 22 bp, Homo sapiens
gagggcagtgaattttgaagct

SEQ ID NO: 7784834 - DNA, 22 bp, Homo sapiens
gagggccaaagagcaagagcct

SEQ ID NO: 7784835 - DNA, 22 bp, Homo sapiens
gaggctgggggctgccttcctc

SEQ ID NO: 7784836 - DNA, 22 bp, Homo sapiens
gaggctgggggctgccttcctc

SEQ ID NO: 7784837 - DNA, 22 bp, Homo sapiens
gaggctgggaagtccaagatca

SEQ ID NO: 7784838 - DNA, 22 bp, Homo sapiens
gaggctgggaagtccaatatca

SEQ ID NO: 7784839 - DNA, 22 bp, Homo sapiens
gaggctgggaagtccaatatca

SEQ ID NO: 7784840 - DNA, 22 bp, Homo sapiens
gaggctgggaagtccaagacca

SEQ ID NO: 7784841 - DNA, 22 bp, Homo sapiens
gaggctgggaagtccaagacca

SEQ ID NO: 7784842 - DNA, 22 bp, Homo sapiens
gaggctgggaagtccaagacca

SEQ ID NO: 7784843 - DNA, 22 bp, Homo sapiens
gaggctgggaagtccaagatca

SEQ ID NO: 7784844 - DNA, 22 bp, Homo sapiens
gagggcagagtctaatgatgca

SEQ ID NO: 7784845 - DNA, 16 bp, Homo sapiens
gagggcagaggcggaa

SEQ ID NO: 7784846 - DNA, 22 bp, Homo sapiens
gagggatgcagaaacagaggcc

SEQ ID NO: 7784847 - DNA, 22 bp, Homo sapiens
gaggcctgaggctgcctggagc

SEQ ID NO: 7784848 - DNA, 22 bp, Homo sapiens
gaggctggaatattagaaatgt

SEQ ID NO: 7784849 - DNA, 22 bp, Homo sapiens
gaggctggaatattagaaatgt

SEQ ID NO: 7784850 - DNA, 22 bp, Homo sapiens
gaggctggacgtgcatttctac

SEQ ID NO: 7784851 - DNA, 22 bp, Homo sapiens
gaggctggacgtgcatttctac

SEQ ID NO: 7784852 - DNA, 22 bp, Homo sapiens
gaggctgcccaactggagtgga

SEQ ID NO: 7784853 - DNA, 22 bp, Homo sapiens
gaggctggaggtcaaagatgaa

SEQ ID NO: 7784854 - DNA, 22 bp, Homo sapiens
gaggctggaggtcaaagatgaa

SEQ ID NO: 7784855 - DNA, 22 bp, Homo sapiens
gaggctggagatattccaatct

SEQ ID NO: 7784856 - DNA, 22 bp, Homo sapiens
gaggctggagatattccaatct

SEQ ID NO: 7784857 - DNA, 22 bp, Homo sapiens
gaggctggcagaaaagcacagg

SEQ ID NO: 7784858 - DNA, 22 bp, Homo sapiens
gaggctggcagaaaagcacagg

SEQ ID NO: 7784859 - DNA, 16 bp, Homo sapiens
gaggctggcagatgtc

SEQ ID NO: 7784860 - DNA, 16 bp, Homo sapiens
gaggctggcagatgtc

SEQ ID NO: 7784861 - DNA, 22 bp, Homo sapiens
gagatatttattcatactgtca

SEQ ID NO: 7784862 - DNA, 22 bp, Homo sapiens
gagatataagatctagaaagga

SEQ ID NO: 7784863 - DNA, 22 bp, Homo sapiens
gagagtggatggagctgcgaag

SEQ ID NO: 7784864 - DNA, 22 bp, Homo sapiens
gagctggctaatactgacttat

SEQ ID NO: 7784865 - DNA, 22 bp, Homo sapiens
gagctggctccgccatgctgct

SEQ ID NO: 7784866 - DNA, 22 bp, Homo sapiens
gagctggctaatactgacttat

SEQ ID NO: 7784867 - DNA, 22 bp, Homo sapiens
gagctggctccgccatgctgct

SEQ ID NO: 7784868 - DNA, 22 bp, Homo sapiens
gagctggctgtggttgagtgca

SEQ ID NO: 7784869 - DNA, 22 bp, Homo sapiens
gagctggaggaccaggactggg

SEQ ID NO: 7784870 - DNA, 22 bp, Homo sapiens
gagctggaggcagtgctgaggt

SEQ ID NO: 7784871 - DNA, 22 bp, Homo sapiens
gagctggcacagaaggatctta

SEQ ID NO: 7784872 - DNA, 22 bp, Homo sapiens
gagctggcaatgacttgtgtat

SEQ ID NO: 7784873 - DNA, 22 bp, Homo sapiens
gagctggcaggaggctccccga

SEQ ID NO: 7784874 - DNA, 22 bp, Homo sapiens
gagctggccgcagagagggcag

SEQ ID NO: 7784875 - DNA, 22 bp, Homo sapiens
gaggacagcttagggcttcctg

SEQ ID NO: 7784876 - DNA, 22 bp, Homo sapiens
gaggaggctgaacaatgccctg

SEQ ID NO: 7784877 - DNA, 22 bp, Homo sapiens
gaggacagcttagggcttcctg

SEQ ID NO: 7784878 - DNA, 22 bp, Homo sapiens
gaggacagctctaactaaagtc

SEQ ID NO: 7784879 - DNA, 22 bp, Homo sapiens
gaggacagagccgcctggcaag

SEQ ID NO: 7784880 - DNA, 22 bp, Homo sapiens
gagctgggagctgggatttgga

SEQ ID NO: 7784881 - DNA, 22 bp, Homo sapiens
gagctgggagttatagcatgtt

SEQ ID NO: 7784882 - DNA, 18 bp, Homo sapiens
gagctgggagaaggaagg

SEQ ID NO: 7784883 - DNA, 23 bp, Homo sapiens
gaggagggtctgacaagtgtagc

SEQ ID NO: 7784884 - DNA, 22 bp, Homo sapiens
gaggagggagctggaagctctt

SEQ ID NO: 7784885 - DNA, 22 bp, Homo sapiens
gaggagggagctggaagctctt

SEQ ID NO: 7784886 - DNA, 22 bp, Homo sapiens
gaggagggagaattaggcttaa

SEQ ID NO: 7784887 - DNA, 22 bp, Homo sapiens
gaggaggcttccgggaggcacg

SEQ ID NO: 7784888 - DNA, 19 bp, Homo sapiens
gaggaggcttcagctttct

SEQ ID NO: 7784889 - DNA, 19 bp, Homo sapiens
gaggaggcttcagctttct

SEQ ID NO: 7784890 - DNA, 22 bp, Homo sapiens
gaggaggctgtttctctgcatt

SEQ ID NO: 7784891 - DNA, 22 bp, Homo sapiens
gaggaggctgtttctctgcatt

SEQ ID NO: 7784892 - DNA, 22 bp, Homo sapiens
gaggcagagtgcaccccaggag

SEQ ID NO: 7784893 - DNA, 22 bp, Homo sapiens
gaggcagaggttgttgcagtga

SEQ ID NO: 7784894 - DNA, 22 bp, Homo sapiens
gaggcagaggttgcagtgagct

SEQ ID NO: 7784895 - DNA, 22 bp, Homo sapiens
gaggcagagtcacaaagagtct

SEQ ID NO: 7784896 - DNA, 22 bp, Homo sapiens
gaggagggttggccttaggtag

SEQ ID NO: 7784897 - DNA, 22 bp, Homo sapiens
gaggcagaggttgcagtgagct

SEQ ID NO: 7784898 - DNA, 22 bp, Homo sapiens
gaggcagctgggctggtggttt

SEQ ID NO: 7784899 - DNA, 22 bp, Homo sapiens
gaggcagcagggctggttcctt

SEQ ID NO: 7784900 - DNA, 22 bp, Homo sapiens
gaggcccagtcctgcaagcacg

SEQ ID NO: 7784901 - DNA, 20 bp, Homo sapiens
gaggcctcagcctcagctcc

SEQ ID NO: 7784902 - DNA, 22 bp, Homo sapiens
gaggcctctgtcccaccaggga

SEQ ID NO: 7784903 - DNA, 22 bp, Homo sapiens
gaggcctgaggctgcctggagc

SEQ ID NO: 7784904 - DNA, 22 bp, Homo sapiens
gaggcctctgtcccgccaggga

SEQ ID NO: 7784905 - DNA, 22 bp, Homo sapiens
gaattcacttgtcttccatttt

SEQ ID NO: 7784906 - DNA, 22 bp, Homo sapiens
gaattctgggagagatctgaca

SEQ ID NO: 7784907 - DNA, 22 bp, Homo sapiens
gaattctaccagggcaagaggg

SEQ ID NO: 7784908 - DNA, 22 bp, Homo sapiens
gaattctaaccattaagccaag

SEQ ID NO: 7784909 - DNA, 22 bp, Homo sapiens
gaattctttgatcttaatcttg

SEQ ID NO: 7784910 - DNA, 23 bp, Homo sapiens
gaattcttaaggtcactaaagtc

SEQ ID NO: 7784911 - DNA, 22 bp, Homo sapiens
gaattcttctgtctttaactga

SEQ ID NO: 7784912 - DNA, 22 bp, Homo sapiens
gaattgtaagtaccagcatgct

SEQ ID NO: 7784913 - DNA, 22 bp, Homo sapiens
gaattgggggttttgcaaggca

SEQ ID NO: 7784914 - DNA, 22 bp, Homo sapiens
gaattgtattgatttttcagag

SEQ ID NO: 7784915 - DNA, 22 bp, Homo sapiens
gaatttaaggaccaagcatttt

SEQ ID NO: 7784916 - DNA, 22 bp, Homo sapiens
gaatttaagaggatgaatctgt

SEQ ID NO: 7784917 - DNA, 22 bp, Homo sapiens
gacacagagataggcctgtgtt

SEQ ID NO: 7784918 - DNA, 22 bp, Homo sapiens
gacacaggaaaagctccagccc

SEQ ID NO: 7784919 - DNA, 22 bp, Homo sapiens
gacacaggaatcaccttggatg

SEQ ID NO: 7784920 - DNA, 18 bp, Homo sapiens
gacacaggagagagtccc

SEQ ID NO: 7784921 - DNA, 23 bp, Homo sapiens
gacacaggagcacccagctgagc

SEQ ID NO: 7784922 - DNA, 20 bp, Homo sapiens
gacacaggcagtcctcagag

SEQ ID NO: 7784923 - DNA, 22 bp, Homo sapiens
gacacaggattcctggctctgc

SEQ ID NO: 7784924 - DNA, 22 bp, Homo sapiens
gacaggaacataaatgtaggag

SEQ ID NO: 7784925 - DNA, 19 bp, Homo sapiens
gacaggaaggctaccagta

SEQ ID NO: 7784926 - DNA, 22 bp, Homo sapiens
gacacaggggggcgctagaaga

SEQ ID NO: 7784927 - DNA, 22 bp, Homo sapiens
gacacagggggatgtgtggacg

SEQ ID NO: 7784928 - DNA, 22 bp, Homo sapiens
gacacagggacgtgctctgcct

SEQ ID NO: 7784929 - DNA, 22 bp, Homo sapiens
gacacaggtagaataaagtact

SEQ ID NO: 7784930 - DNA, 22 bp, Homo sapiens
gaaggccctgttttccctattt

SEQ ID NO: 7784931 - DNA, 22 bp, Homo sapiens
gaaggccctggtattcttgagg

SEQ ID NO: 7784932 - DNA, 22 bp, Homo sapiens
gaaggcccgccctgagcaaggg

SEQ ID NO: 7784933 - DNA, 22 bp, Homo sapiens
gaaggccctggtattcttgagg

SEQ ID NO: 7784934 - DNA, 21 bp, Homo sapiens
gaaggagaaagcaagtgctgc

SEQ ID NO: 7784935 - DNA, 22 bp, Homo sapiens
gaaggaagtgctcatactagtt

SEQ ID NO: 7784936 - DNA, 22 bp, Homo sapiens
gaaggcttgattgaggaatgcc

SEQ ID NO: 7784937 - DNA, 21 bp, Homo sapiens
gaaggcttctgcctggaggag

SEQ ID NO: 7784938 - DNA, 22 bp, Homo sapiens
gaaggcttcctgatgccaacca

SEQ ID NO: 7784939 - DNA, 22 bp, Homo sapiens
gaaggcttctccagggcttact

SEQ ID NO: 7784940 - DNA, 22 bp, Homo sapiens
gaaggcttcctggaggaggtgg

SEQ ID NO: 7784941 - DNA, 22 bp, Homo sapiens
gaaggcttcccacctgatattt

SEQ ID NO: 7784942 - DNA, 22 bp, Homo sapiens
gaaggcttcaaaaggtgtaatt

SEQ ID NO: 7784943 - DNA, 22 bp, Homo sapiens
gaaggcttattttctttgtaaa

SEQ ID NO: 7784944 - DNA, 22 bp, Homo sapiens
gaaggcttttctaccagatctt

SEQ ID NO: 7784945 - DNA, 22 bp, Homo sapiens
gaaggctttagagagatataaa

SEQ ID NO: 7784946 - DNA, 22 bp, Homo sapiens
gaaggcttggttttttcaacac

SEQ ID NO: 7784947 - DNA, 19 bp, Homo sapiens
gaaggcttttggtatgttt

SEQ ID NO: 7784948 - DNA, 22 bp, Homo sapiens
gaaggctttttgggtaattgta

SEQ ID NO: 7784949 - DNA, 22 bp, Homo sapiens
gaaggcttgcagctctgtggca

SEQ ID NO: 7784950 - DNA, 22 bp, Homo sapiens
gaaggcttgcaagtggttcata

SEQ ID NO: 7784951 - DNA, 20 bp, Homo sapiens
gaaggcttggacagtgacag

SEQ ID NO: 7784952 - DNA, 22 bp, Homo sapiens
gaaggcttgccgggaagcggca

SEQ ID NO: 7784953 - DNA, 22 bp, Homo sapiens
gaaggctgcgaggggagtgccg

SEQ ID NO: 7784954 - DNA, 22 bp, Homo sapiens
gaaggctgcatggaggctgtgg

SEQ ID NO: 7784955 - DNA, 22 bp, Homo sapiens
gaaggctgatgacagattctgc

SEQ ID NO: 7784956 - DNA, 22 bp, Homo sapiens
gaaggctgagcagacaggccaa

SEQ ID NO: 7784957 - DNA, 22 bp, Homo sapiens
gaaggctctggggattgagata

SEQ ID NO: 7784958 - DNA, 22 bp, Homo sapiens
gaaggctcttgaggccaggtaa

SEQ ID NO: 7784959 - DNA, 22 bp, Homo sapiens
gaaggctccttgagggaaggac

SEQ ID NO: 7784960 - DNA, 22 bp, Homo sapiens
gacccagggtttctgcacaggg

SEQ ID NO: 7784961 - DNA, 22 bp, Homo sapiens
gactggaaagcctgtcctcaga

SEQ ID NO: 7784962 - DNA, 22 bp, Homo sapiens
gacttaagtggtgtgataagtg

SEQ ID NO: 7784963 - DNA, 22 bp, Homo sapiens
gacttattcacgcagctatact

SEQ ID NO: 7784964 - DNA, 22 bp, Homo sapiens
gacttctgaattcctatcaggt

SEQ ID NO: 7784965 - DNA, 22 bp, Homo sapiens
gacttcatgtgcaagcgctttg

SEQ ID NO: 7784966 - DNA, 22 bp, Homo sapiens
gacttcataatattgagcatgt

SEQ ID NO: 7784967 - DNA, 22 bp, Homo sapiens
gacttcttcatgtcttttccac

SEQ ID NO: 7784968 - DNA, 22 bp, Homo sapiens
gacttctgttaacttgtaagag

SEQ ID NO: 7784969 - DNA, 22 bp, Homo sapiens
gacttgggtgtcggggcagtct

SEQ ID NO: 7784970 - DNA, 18 bp, Homo sapiens
gactttaaaacactgctc

SEQ ID NO: 7784971 - DNA, 22 bp, Homo sapiens
gacccagggtatccagagctgc

SEQ ID NO: 7784972 - DNA, 22 bp, Homo sapiens
gacccaggagagagggttgcat

SEQ ID NO: 7784973 - DNA, 22 bp, Homo sapiens
gacccaggctcgtgggacggct

SEQ ID NO: 7784974 - DNA, 22 bp, Homo sapiens
gacccaggcccaaggctgccag

SEQ ID NO: 7784975 - DNA, 22 bp, Homo sapiens
gacccagctaaccaggtgggga

SEQ ID NO: 7784976 - DNA, 18 bp, Homo sapiens
gacccaggaaagagtcct

SEQ ID NO: 7784977 - DNA, 18 bp, Homo sapiens
gacccaggaaagagtcct

SEQ ID NO: 7784978 - DNA, 22 bp, Homo sapiens
gacccagaggcctgacagtgtg

SEQ ID NO: 7784979 - DNA, 18 bp, Homo sapiens
gacccagcagatgggctt

SEQ ID NO: 7784980 - DNA, 22 bp, Homo sapiens
gacaggcaggccagggctgtgg

SEQ ID NO: 7784981 - DNA, 22 bp, Homo sapiens
gagaaaatcttgggtcaagaat

SEQ ID NO: 7784982 - DNA, 22 bp, Homo sapiens
gagaaacaacacttgatgcctt

SEQ ID NO: 7784983 - DNA, 22 bp, Homo sapiens
gagaaacaacacttgatgcctt

SEQ ID NO: 7784984 - DNA, 22 bp, Homo sapiens
gagaaaatagcatgtgtagtat

SEQ ID NO: 7784985 - DNA, 22 bp, Homo sapiens
gagagctgaggggcctggcact

SEQ ID NO: 7784986 - DNA, 22 bp, Homo sapiens
gagagctgcagccgagaggggg

SEQ ID NO: 7784987 - DNA, 22 bp, Homo sapiens
gagacagagatcttgctgagtc

SEQ ID NO: 7784988 - DNA, 22 bp, Homo sapiens
gagagcccttaggtttagagtt

SEQ ID NO: 7784989 - DNA, 22 bp, Homo sapiens
gagagctggccagcttcagtat

SEQ ID NO: 7784990 - DNA, 20 bp, Homo sapiens
gagagctggggatgaggctg

SEQ ID NO: 7784991 - DNA, 22 bp, Homo sapiens
gagagctgggttcaagtagctg

SEQ ID NO: 7784992 - DNA, 22 bp, Homo sapiens
gaaataattctgtgtctgaaca

SEQ ID NO: 7784993 - DNA, 22 bp, Homo sapiens
gaaatacaaagccagccatttt

SEQ ID NO: 7784994 - DNA, 22 bp, Homo sapiens
gaaatacaaagccagccatttt

SEQ ID NO: 7784995 - DNA, 22 bp, Homo sapiens
gaaatacaaatgcctagatcct

SEQ ID NO: 7784996 - DNA, 22 bp, Homo sapiens
gaaataatacagtgctcttctc

SEQ ID NO: 7784997 - DNA, 22 bp, Homo sapiens
gaaataatacagtgctcttctc

SEQ ID NO: 7784998 - DNA, 22 bp, Homo sapiens
gaacacatgattataaatgcta

SEQ ID NO: 7784999 - DNA, 22 bp, Homo sapiens
gaacacagtcaagggctgctgt

SEQ ID NO: 7785000 - DNA, 22 bp, Homo sapiens
gaacacaggtggcccggcaggg

SEQ ID NO: 7785001 - DNA, 22 bp, Homo sapiens
gaacacagcggggcttacccgg

SEQ ID NO: 7785002 - DNA, 22 bp, Homo sapiens
gaacacagcagggataaccact

SEQ ID NO: 7785003 - DNA, 22 bp, Homo sapiens
gaacacagaagaatttctaaga

SEQ ID NO: 7785004 - DNA, 22 bp, Homo sapiens
gaaatttattatctacatcatt

SEQ ID NO: 7785005 - DNA, 22 bp, Homo sapiens
gaaatttattatctacatcatt

SEQ ID NO: 7785006 - DNA, 22 bp, Homo sapiens
gaaatttacaactttctcatgg

SEQ ID NO: 7785007 - DNA, 22 bp, Homo sapiens
gaaatacaaatgcctagatcct

SEQ ID NO: 7785008 - DNA, 22 bp, Homo sapiens
gaaatacaattttgtcccagct

SEQ ID NO: 7785009 - DNA, 22 bp, Homo sapiens
gaaatacaattttgtcccagct

SEQ ID NO: 7785010 - DNA, 22 bp, Homo sapiens
gaacctctatatttgtgacatc

SEQ ID NO: 7785011 - DNA, 22 bp, Homo sapiens
gaactgggtccttgagtctaga

SEQ ID NO: 7785012 - DNA, 22 bp, Homo sapiens
gaactcattagcctgctttcag

SEQ ID NO: 7785013 - DNA, 21 bp, Homo sapiens
gaaaagcaagggagtagaaca

SEQ ID NO: 7785014 - DNA, 22 bp, Homo sapiens
gaaaacatccagagatagacct

SEQ ID NO: 7785015 - DNA, 22 bp, Homo sapiens
gaaaacatccagagatagacct

SEQ ID NO: 7785016 - DNA, 21 bp, Homo sapiens
gaaaagcaagggagtagaaca

SEQ ID NO: 7785017 - DNA, 22 bp, Homo sapiens
gaaaagctaggccagttcagct

SEQ ID NO: 7785018 - DNA, 22 bp, Homo sapiens
gaaaagggcaagagagagggca

SEQ ID NO: 7785019 - DNA, 22 bp, Homo sapiens
gaaaaggctctcactccctccg

SEQ ID NO: 7785020 - DNA, 22 bp, Homo sapiens
gaaaaggctgcccacttattga

SEQ ID NO: 7785021 - DNA, 22 bp, Homo sapiens
gaaaagggcaagagagagggca

SEQ ID NO: 7785022 - DNA, 22 bp, Homo sapiens
gaaaaggcagagttccggggaa

SEQ ID NO: 7785023 - DNA, 22 bp, Homo sapiens
gaaaaggcctccccataggaat

SEQ ID NO: 7785024 - DNA, 22 bp, Homo sapiens
gaaaaggccactcctaggagct

SEQ ID NO: 7785025 - DNA, 22 bp, Homo sapiens
ctttgtttatatttctcctcga

SEQ ID NO: 7785026 - DNA, 22 bp, Homo sapiens
gaaaggggcatgtagggatcac

SEQ ID NO: 7785027 - DNA, 22 bp, Homo sapiens
gaaaggtgccccataggcagga

SEQ ID NO: 7785028 - DNA, 18 bp, Homo sapiens
gaaagtgcggggcagggg

SEQ ID NO: 7785029 - DNA, 22 bp, Homo sapiens
gaaagtgcctcagtcctcttat

SEQ ID NO: 7785030 - DNA, 22 bp, Homo sapiens
gaaagtgccagaataggaggcc

SEQ ID NO: 7785031 - DNA, 22 bp, Homo sapiens
gaaagtgcatgtgcccaccatt

SEQ ID NO: 7785032 - DNA, 22 bp, Homo sapiens
gaaagtgcttttgagtgtgtgc

SEQ ID NO: 7785033 - DNA, 22 bp, Homo sapiens
gaaagtgctctctctatacaca

SEQ ID NO: 7785034 - DNA, 22 bp, Homo sapiens
gaaagtgcttagagtgtggtat

SEQ ID NO: 7785035 - DNA, 22 bp, Homo sapiens
gaaagtgctaggaagtgttaga

SEQ ID NO: 7785036 - DNA, 22 bp, Homo sapiens
gaaaggccatttctgagggttt

SEQ ID NO: 7785037 - DNA, 22 bp, Homo sapiens
gaaaggccagctcacagatgag

SEQ ID NO: 7785038 - DNA, 22 bp, Homo sapiens
gaaaggccaccatgccagggac

SEQ ID NO: 7785039 - DNA, 22 bp, Homo sapiens
gaaaggccacgtgccaagatta

SEQ ID NO: 7785040 - DNA, 22 bp, Homo sapiens
gaaaagtatgtttattttgact

SEQ ID NO: 7785041 - DNA, 22 bp, Homo sapiens
gaaaatacaaatagccttgaaa

SEQ ID NO: 7785042 - DNA, 21 bp, Homo sapiens
gaaaatacaatgagcttgacc

SEQ ID NO: 7785043 - DNA, 21 bp, Homo sapiens
gaaaatacaatgagcttgacc

SEQ ID NO: 7785044 - DNA, 22 bp, Homo sapiens
gaaaggcagtacagctgagcct

SEQ ID NO: 7785045 - DNA, 22 bp, Homo sapiens
cttctttgaaaaaggcagtcag

SEQ ID NO: 7785046 - DNA, 22 bp, Homo sapiens
cttctttcttttgatcacaggt

SEQ ID NO: 7785047 - DNA, 22 bp, Homo sapiens
cttctttcccaggcatgtttta

SEQ ID NO: 7785048 - DNA, 22 bp, Homo sapiens
cttctcttcctttgtcaactga

SEQ ID NO: 7785049 - DNA, 19 bp, Homo sapiens
cttcttgataaggttcttt

SEQ ID NO: 7785050 - DNA, 22 bp, Homo sapiens
cttctcttggtagttcttgttg

SEQ ID NO: 7785051 - DNA, 22 bp, Homo sapiens
cttctctctgcataggcatggg

SEQ ID NO: 7785052 - DNA, 22 bp, Homo sapiens
ctggctgtgaaatggcagtgtc

SEQ ID NO: 7785053 - DNA, 22 bp, Homo sapiens
cttctctccctggcactcagac

SEQ ID NO: 7785054 - DNA, 22 bp, Homo sapiens
cttctctccctggcactcagac

SEQ ID NO: 7785055 - DNA, 22 bp, Homo sapiens
cttctctccctggcactcagac

SEQ ID NO: 7785056 - DNA, 22 bp, Homo sapiens
cttctctcggtgcatccctcac

SEQ ID NO: 7785057 - DNA, 22 bp, Homo sapiens
ctggctggtctgagcagtcgca

SEQ ID NO: 7785058 - DNA, 22 bp, Homo sapiens
ctggctggttggggagaagaca

SEQ ID NO: 7785059 - DNA, 22 bp, Homo sapiens
ctggctggtttttaaagctagg

SEQ ID NO: 7785060 - DNA, 22 bp, Homo sapiens
ctggctgtcttctgggagctgt

SEQ ID NO: 7785061 - DNA, 22 bp, Homo sapiens
ctggctgtcttggaggaaggag

SEQ ID NO: 7785062 - DNA, 22 bp, Homo sapiens
ctggctgtgaaatggcagtgtc

SEQ ID NO: 7785063 - DNA, 22 bp, Homo sapiens
ctggctggagtgcaggtgagtg

SEQ ID NO: 7785064 - DNA, 22 bp, Homo sapiens
ctggctggagctgttgtaggct

SEQ ID NO: 7785065 - DNA, 22 bp, Homo sapiens
ctggctggaggtgagtcactga

SEQ ID NO: 7785066 - DNA, 22 bp, Homo sapiens
ctggctgggcagacagaatgct

SEQ ID NO: 7785067 - DNA, 22 bp, Homo sapiens
ctggctggggaagtcatttgat

SEQ ID NO: 7785068 - DNA, 22 bp, Homo sapiens
ctggctggggtaccagttgaac

SEQ ID NO: 7785069 - DNA, 22 bp, Homo sapiens
ctggctggtcatgtcatgagcc

SEQ ID NO: 7785070 - DNA, 22 bp, Homo sapiens
ctggctggtcctcggggacagc

SEQ ID NO: 7785071 - DNA, 22 bp, Homo sapiens
ctggctggtaatggaacgacag

SEQ ID NO: 7785072 - DNA, 22 bp, Homo sapiens
ctggctggggtccatcctctaa

SEQ ID NO: 7785073 - DNA, 22 bp, Homo sapiens
ctggctgggttccaggattcca

SEQ ID NO: 7785074 - DNA, 22 bp, Homo sapiens
cttggctgtctataggaaagag

SEQ ID NO: 7785075 - DNA, 22 bp, Homo sapiens
cttggctgtctataggaaagag

SEQ ID NO: 7785076 - DNA, 22 bp, Homo sapiens
cttggctgcttttgtgcacatt

SEQ ID NO: 7785077 - DNA, 22 bp, Homo sapiens
cttggctgtcataaggtcctgg

SEQ ID NO: 7785078 - DNA, 17 bp, Homo sapiens
cttggctgctgtgcgat

SEQ ID NO: 7785079 - DNA, 22 bp, Homo sapiens
cttggcagagggctgggctcag

SEQ ID NO: 7785080 - DNA, 18 bp, Homo sapiens
cttggctgatgggggtgt

SEQ ID NO: 7785081 - DNA, 22 bp, Homo sapiens
cttgaatgggccataagacggt

SEQ ID NO: 7785082 - DNA, 22 bp, Homo sapiens
cttgaatggtatgagagtaatt

SEQ ID NO: 7785083 - DNA, 22 bp, Homo sapiens
cttgaatgtcctgtggcaaagt

SEQ ID NO: 7785084 - DNA, 22 bp, Homo sapiens
cttgaatgtaaataatgtacag

SEQ ID NO: 7785085 - DNA, 23 bp, Homo sapiens
cttgaatgggatggaattcactg

SEQ ID NO: 7785086 - DNA, 22 bp, Homo sapiens
cttgaatgaaaccaactgatga

SEQ ID NO: 7785087 - DNA, 21 bp, Homo sapiens
cttggagttggttgaggatgc

SEQ ID NO: 7785088 - DNA, 22 bp, Homo sapiens
cttgaattgggggaagatcact

SEQ ID NO: 7785089 - DNA, 22 bp, Homo sapiens
cttggattccgtgaacttaacc

SEQ ID NO: 7785090 - DNA, 22 bp, Homo sapiens
cttggatttgggcccttaaatt

SEQ ID NO: 7785091 - DNA, 22 bp, Homo sapiens
cttggggaagccactgatccct

SEQ ID NO: 7785092 - DNA, 22 bp, Homo sapiens
ctttacaacctaagttgaagct

SEQ ID NO: 7785093 - DNA, 22 bp, Homo sapiens
ctttacaattcaagggaactct

SEQ ID NO: 7785094 - DNA, 22 bp, Homo sapiens
ctttagttgtatcagtcaagtt

SEQ ID NO: 7785095 - DNA, 19 bp, Homo sapiens
ctttgtcagaacatgcttc

SEQ ID NO: 7785096 - DNA, 22 bp, Homo sapiens
ctttgtatctaaatatcttgaa

SEQ ID NO: 7785097 - DNA, 22 bp, Homo sapiens
ctttggttctgtccttcccaga

SEQ ID NO: 7785098 - DNA, 21 bp, Homo sapiens
ctttggtttcctcctgccttc

SEQ ID NO: 7785099 - DNA, 22 bp, Homo sapiens
ctttggttctgtccttcccaga

SEQ ID NO: 7785100 - DNA, 22 bp, Homo sapiens
ctttatatattcccaggctgcc

SEQ ID NO: 7785101 - DNA, 22 bp, Homo sapiens
ctttatgactgagttgtcaatt

SEQ ID NO: 7785102 - DNA, 22 bp, Homo sapiens
ttgactttacagttttcttagg

SEQ ID NO: 7785103 - DNA, 22 bp, Homo sapiens
ttgactttatgtgtatgtttac

SEQ ID NO: 7785104 - DNA, 22 bp, Homo sapiens
ttgactttaaagctttgtctct

SEQ ID NO: 7785105 - DNA, 22 bp, Homo sapiens
ttgacttttcttggtcacatga

SEQ ID NO: 7785106 - DNA, 22 bp, Homo sapiens
ttgagctgtatacctatgactg

SEQ ID NO: 7785107 - DNA, 22 bp, Homo sapiens
ttgaggagcaggatgggaggct

SEQ ID NO: 7785108 - DNA, 22 bp, Homo sapiens
ttgaggaggacagaaacattta

SEQ ID NO: 7785109 - DNA, 22 bp, Homo sapiens
ttgataaaatgatgaaatcact

SEQ ID NO: 7785110 - DNA, 22 bp, Homo sapiens
ttgataaaatgatgaaatcact

SEQ ID NO: 7785111 - DNA, 22 bp, Homo sapiens
ttgataaaatgatgaaatcact

SEQ ID NO: 7785112 - DNA, 22 bp, Homo sapiens
ttgaggagtcaggggcacggaa

SEQ ID NO: 7785113 - DNA, 18 bp, Homo sapiens
ttgataaacaatttcatt

SEQ ID NO: 7785114 - DNA, 18 bp, Homo sapiens
ttgataaacaatttcatt

SEQ ID NO: 7785115 - DNA, 18 bp, Homo sapiens
ttgataaacaatttcatt

SEQ ID NO: 7785116 - DNA, 22 bp, Homo sapiens
ctattttaagaggccattaggt

SEQ ID NO: 7785117 - DNA, 22 bp, Homo sapiens
ctattttaacttgattacctct

SEQ ID NO: 7785118 - DNA, 22 bp, Homo sapiens
ttcttgtttattaagatataaa

SEQ ID NO: 7785119 - DNA, 22 bp, Homo sapiens
ttctttaaaatagtgagaaaga

SEQ ID NO: 7785120 - DNA, 22 bp, Homo sapiens
ttcttgttttgcccaagttgta

SEQ ID NO: 7785121 - DNA, 22 bp, Homo sapiens
ctattttaagaggccattaggt

SEQ ID NO: 7785122 - DNA, 22 bp, Homo sapiens
ttcttgttccatgaaagacaga

SEQ ID NO: 7785123 - DNA, 22 bp, Homo sapiens
ttcttgttccatgaaagacaga

SEQ ID NO: 7785124 - DNA, 19 bp, Homo sapiens
ctcagcacttttacacagg

SEQ ID NO: 7785125 - DNA, 22 bp, Homo sapiens
ctcagcagcagggaagaggtca

SEQ ID NO: 7785126 - DNA, 22 bp, Homo sapiens
ttccttttcttaaacatatgtg

SEQ ID NO: 7785127 - DNA, 22 bp, Homo sapiens
ttccttttcttctaccacatgt

SEQ ID NO: 7785128 - DNA, 22 bp, Homo sapiens
ctaggctgagctgggctgagct

SEQ ID NO: 7785129 - DNA, 22 bp, Homo sapiens
ctaggcagggtgctgtgccatg

SEQ ID NO: 7785130 - DNA, 22 bp, Homo sapiens
ctagggaatgagagactggatc

SEQ ID NO: 7785131 - DNA, 22 bp, Homo sapiens
ctaggcttgcagggtggacatg

SEQ ID NO: 7785132 - DNA, 22 bp, Homo sapiens
ctaggctgcagatgcatggaat

SEQ ID NO: 7785133 - DNA, 22 bp, Homo sapiens
ctaggctggagtgcagtggcac

SEQ ID NO: 7785134 - DNA, 22 bp, Homo sapiens
ctaggctggagtgcagtggcat

SEQ ID NO: 7785135 - DNA, 22 bp, Homo sapiens
ctaggctggagtgcattggcgt

SEQ ID NO: 7785136 - DNA, 22 bp, Homo sapiens
ctaggctgttcatgctcagacc

SEQ ID NO: 7785137 - DNA, 22 bp, Homo sapiens
ctaggctgtaacccctgccagg

SEQ ID NO: 7785138 - DNA, 22 bp, Homo sapiens
ctattttaacttgattacctct

SEQ ID NO: 7785139 - DNA, 22 bp, Homo sapiens
ctatttggggtagaagatggat

SEQ ID NO: 7785140 - DNA, 22 bp, Homo sapiens
ctatttggccaagctgcccaca

SEQ ID NO: 7785141 - DNA, 22 bp, Homo sapiens
ctatttctgcctaatgacctgt

SEQ ID NO: 7785142 - DNA, 22 bp, Homo sapiens
ctatttgaattgtcacaggcta

SEQ ID NO: 7785143 - DNA, 22 bp, Homo sapiens
ctatttggatgttagcctcagt

SEQ ID NO: 7785144 - DNA, 22 bp, Homo sapiens
ctatttctaaacctataagtga

SEQ ID NO: 7785145 - DNA, 23 bp, Homo sapiens
ctatttctcatagttcaggtctt

SEQ ID NO: 7785146 - DNA, 22 bp, Homo sapiens
ctagggagggatgttggcatga

SEQ ID NO: 7785147 - DNA, 22 bp, Homo sapiens
ctagggagtggcagagctggga

SEQ ID NO: 7785148 - DNA, 22 bp, Homo sapiens
ctatttattgtgggtatccagg

SEQ ID NO: 7785149 - DNA, 22 bp, Homo sapiens
ctattcaacttgactgtttcac

SEQ ID NO: 7785150 - DNA, 22 bp, Homo sapiens
ctattcaattttgctattgtag

SEQ ID NO: 7785151 - DNA, 22 bp, Homo sapiens
ttcccagaatgaatggatggag

SEQ ID NO: 7785152 - DNA, 22 bp, Homo sapiens
ttccctggttaaccattttctg

SEQ ID NO: 7785153 - DNA, 22 bp, Homo sapiens
ttcccttaaattatggcatcta

SEQ ID NO: 7785154 - DNA, 22 bp, Homo sapiens
ttcccttaaattatggcatcta

SEQ ID NO: 7785155 - DNA, 22 bp, Homo sapiens
ttcccttcctcactctacttgt

SEQ ID NO: 7785156 - DNA, 22 bp, Homo sapiens
ttccggaaggttctctagaatt

SEQ ID NO: 7785157 - DNA, 19 bp, Homo sapiens
ctaaggcaagaaactggac

SEQ ID NO: 7785158 - DNA, 22 bp, Homo sapiens
ctaaggcaccgaggcaggagcg

SEQ ID NO: 7785159 - DNA, 22 bp, Homo sapiens
ttccgagggctcggcggccgcc

SEQ ID NO: 7785160 - DNA, 21 bp, Homo sapiens
ttcccttctggttttgagaga

SEQ ID NO: 7785161 - DNA, 21 bp, Homo sapiens
ttcccttctggttttgagaga

SEQ ID NO: 7785162 - DNA, 22 bp, Homo sapiens
ttccaaagttattcaagcagta

SEQ ID NO: 7785163 - DNA, 22 bp, Homo sapiens
ttccaaagtgctggaattacat

SEQ ID NO: 7785164 - DNA, 22 bp, Homo sapiens
ttccaaaggctgcaccttgccc

SEQ ID NO: 7785165 - DNA, 22 bp, Homo sapiens
ttccaggatgggctgtcctact

SEQ ID NO: 7785166 - DNA, 22 bp, Homo sapiens
ttccatttggcacttcactgag

SEQ ID NO: 7785167 - DNA, 22 bp, Homo sapiens
ttccatttggcacttcactgag

SEQ ID NO: 7785168 - DNA, 22 bp, Homo sapiens
ttcccaagtctccaatgtggga

SEQ ID NO: 7785169 - DNA, 22 bp, Homo sapiens
ctaatatttttagaaatcacga

SEQ ID NO: 7785170 - DNA, 20 bp, Homo sapiens
ctaatattctactctaagga

SEQ ID NO: 7785171 - DNA, 22 bp, Homo sapiens
ctaaggcaggtccattccagga

SEQ ID NO: 7785172 - DNA, 17 bp, Homo sapiens
ctaagggcccactcttc

SEQ ID NO: 7785173 - DNA, 22 bp, Homo sapiens
ctaagtcatggaaagtgtgtgt

SEQ ID NO: 7785174 - DNA, 22 bp, Homo sapiens
ctacaaaagtaattgtggtttt

SEQ ID NO: 7785175 - DNA, 22 bp, Homo sapiens
ctacaaaagtaattgtggtttt

SEQ ID NO: 7785176 - DNA, 22 bp, Homo sapiens
ttccttccacttcaggattttg

SEQ ID NO: 7785177 - DNA, 22 bp, Homo sapiens
ttccttccgggcaccaggcact

SEQ ID NO: 7785178 - DNA, 22 bp, Homo sapiens
ttccttcctcctccagttctgg

SEQ ID NO: 7785179 - DNA, 22 bp, Homo sapiens
ctacaaatataaaacacagata

SEQ ID NO: 7785180 - DNA, 22 bp, Homo sapiens
ctacaaagtaccacagactggg

SEQ ID NO: 7785181 - DNA, 22 bp, Homo sapiens
ctacaaagtaccacagactggg

SEQ ID NO: 7785182 - DNA, 22 bp, Homo sapiens
ctacaaagctcttctacaggca

SEQ ID NO: 7785183 - DNA, 22 bp, Homo sapiens
ctacaaagaatttctctagctc

SEQ ID NO: 7785184 - DNA, 22 bp, Homo sapiens
ctacaaagaaagtatactggac

SEQ ID NO: 7785185 - DNA, 22 bp, Homo sapiens
cgctgggggaacagcgagggtg

SEQ ID NO: 7785186 - DNA, 22 bp, Homo sapiens
cgctgggggaacttcagccaat

SEQ ID NO: 7785187 - DNA, 22 bp, Homo sapiens
cgctgggggaacagcgagggtg

SEQ ID NO: 7785188 - DNA, 22 bp, Homo sapiens
cgctggggctttttgcttgaga

SEQ ID NO: 7785189 - DNA, 22 bp, Homo sapiens
cgctgggggaacttcagccaat

SEQ ID NO: 7785190 - DNA, 21 bp, Homo sapiens
cggaaaggactagggctcaga

SEQ ID NO: 7785191 - DNA, 22 bp, Homo sapiens
cggcaggtgtgctcactctgcc

SEQ ID NO: 7785192 - DNA, 22 bp, Homo sapiens
cggacaggctcctggagctcct

SEQ ID NO: 7785193 - DNA, 22 bp, Homo sapiens
ttcacataatctgcagcaagcg

SEQ ID NO: 7785194 - DNA, 22 bp, Homo sapiens
ttcacataatctgcagcaagcg

SEQ ID NO: 7785195 - DNA, 22 bp, Homo sapiens
ttcacataatgatacaaagctt

SEQ ID NO: 7785196 - DNA, 22 bp, Homo sapiens
ttcacataaatagatcacatca

SEQ ID NO: 7785197 - DNA, 22 bp, Homo sapiens
ttcacataaatagatcacatca

SEQ ID NO: 7785198 - DNA, 22 bp, Homo sapiens
ttcacataaaagctccaaagaa

SEQ ID NO: 7785199 - DNA, 22 bp, Homo sapiens
ttcacagtggtagtgcatttag

SEQ ID NO: 7785200 - DNA, 22 bp, Homo sapiens
cctgggtggttccggcaaggag

SEQ ID NO: 7785201 - DNA, 22 bp, Homo sapiens
ttcattcttgggatcagagagt

SEQ ID NO: 7785202 - DNA, 22 bp, Homo sapiens
ttcattcttcagagctgcgctt

SEQ ID NO: 7785203 - DNA, 22 bp, Homo sapiens
ttcattcttatttgtgatctgg

SEQ ID NO: 7785204 - DNA, 22 bp, Homo sapiens
ttcattcttgtctttgtatagt

SEQ ID NO: 7785205 - DNA, 22 bp, Homo sapiens
ttcattctgggctctaaggaac

SEQ ID NO: 7785206 - DNA, 22 bp, Homo sapiens
ttcattctgtttggaaaggtgg

SEQ ID NO: 7785207 - DNA, 19 bp, Homo sapiens
ttcattctcttattgttgt

SEQ ID NO: 7785208 - DNA, 22 bp, Homo sapiens
ttcattctcttagcatagtcct

SEQ ID NO: 7785209 - DNA, 19 bp, Homo sapiens
ttcattctcttattgttgt

SEQ ID NO: 7785210 - DNA, 19 bp, Homo sapiens
ttcattctcttattgttgt

SEQ ID NO: 7785211 - DNA, 20 bp, Homo sapiens
ttcattcattccacaacttc

SEQ ID NO: 7785212 - DNA, 22 bp, Homo sapiens
cggctgagcagtgctgatggaa

SEQ ID NO: 7785213 - DNA, 22 bp, Homo sapiens
ctcataatgtgactgtatttga

SEQ ID NO: 7785214 - DNA, 22 bp, Homo sapiens
ttggccagaggtttctctcatg

SEQ ID NO: 7785215 - DNA, 22 bp, Homo sapiens
ttggccaagggctctttaggct

SEQ ID NO: 7785216 - DNA, 22 bp, Homo sapiens
ttgggagttcctactgcggttt

SEQ ID NO: 7785217 - DNA, 22 bp, Homo sapiens
ttgcttttaatctttgtacatc

SEQ ID NO: 7785218 - DNA, 22 bp, Homo sapiens
ttgctttgtggtggttcttcca

SEQ ID NO: 7785219 - DNA, 22 bp, Homo sapiens
ttgctttgtggtggttcttcca

SEQ ID NO: 7785220 - DNA, 22 bp, Homo sapiens
ttgctttgttactgcagtttcc

SEQ ID NO: 7785221 - DNA, 22 bp, Homo sapiens
ttgatattcccgatttaaggta

SEQ ID NO: 7785222 - DNA, 22 bp, Homo sapiens
ttgatattagagtatttgtttg

SEQ ID NO: 7785223 - DNA, 22 bp, Homo sapiens
ttgtatttgattgtcatatcgt

SEQ ID NO: 7785224 - DNA, 22 bp, Homo sapiens
ttgtatttcttccggtctcatt

SEQ ID NO: 7785225 - DNA, 22 bp, Homo sapiens
ttgtatttgggtagtatagaga

SEQ ID NO: 7785226 - DNA, 22 bp, Homo sapiens
ttgtattttgttatgctactgc

SEQ ID NO: 7785227 - DNA, 22 bp, Homo sapiens
ttgtatttgggtagtatagaga

SEQ ID NO: 7785228 - DNA, 22 bp, Homo sapiens
ttgttaaatggatgcagaataa

SEQ ID NO: 7785229 - DNA, 22 bp, Homo sapiens
ttgttacagcagcaatagaaaa

SEQ ID NO: 7785230 - DNA, 22 bp, Homo sapiens
ttgttacacataataacatttt

SEQ ID NO: 7785231 - DNA, 22 bp, Homo sapiens
ttgttacagatcacatttctgc

SEQ ID NO: 7785232 - DNA, 22 bp, Homo sapiens
ttgttaaaatgaggtcattctg

SEQ ID NO: 7785233 - DNA, 22 bp, Homo sapiens
ttgtattttgttatgctactgc

SEQ ID NO: 7785234 - DNA, 22 bp, Homo sapiens
ttgtattttgttatgctactgc

SEQ ID NO: 7785235 - DNA, 22 bp, Homo sapiens
ctccagtgagtgagcaggcgac

SEQ ID NO: 7785236 - DNA, 22 bp, Homo sapiens
tttaaaaaactagtctgagtct

SEQ ID NO: 7785237 - DNA, 22 bp, Homo sapiens
tttaaatttagaagaaacactg

SEQ ID NO: 7785238 - DNA, 22 bp, Homo sapiens
tttaaatttgtgtttagagggt

SEQ ID NO: 7785239 - DNA, 22 bp, Homo sapiens
tttaaattctgtctgccgctta

SEQ ID NO: 7785240 - DNA, 22 bp, Homo sapiens
tttaaattctgtctgccgctta

SEQ ID NO: 7785241 - DNA, 22 bp, Homo sapiens
tttaaattatagttaatgtctg

SEQ ID NO: 7785242 - DNA, 22 bp, Homo sapiens
tttaaatttagaagaaacactg

SEQ ID NO: 7785243 - DNA, 22 bp, Homo sapiens
tttaaaaaactagtctgagtct

SEQ ID NO: 7785244 - DNA, 22 bp, Homo sapiens
tttaaaaggggtattaagtcca

SEQ ID NO: 7785245 - DNA, 22 bp, Homo sapiens
tttacatgagtagcagatgttc

SEQ ID NO: 7785246 - DNA, 22 bp, Homo sapiens
tttacacatacctctttaaagt

SEQ ID NO: 7785247 - DNA, 22 bp, Homo sapiens
tttacacatacctctttaaagt

SEQ ID NO: 7785248 - DNA, 22 bp, Homo sapiens
tttacatgtaatgttatacaaa

SEQ ID NO: 7785249 - DNA, 17 bp, Homo sapiens
tttagaatacaatgttt

SEQ ID NO: 7785250 - DNA, 22 bp, Homo sapiens
tttacatttccctctgtcagtt

SEQ ID NO: 7785251 - DNA, 22 bp, Homo sapiens
ctcctggctatgactacatttc

SEQ ID NO: 7785252 - DNA, 22 bp, Homo sapiens
tttagacaggggcaaaataagg

SEQ ID NO: 7785253 - DNA, 22 bp, Homo sapiens
tttagacatagctgaaatcatt

SEQ ID NO: 7785254 - DNA, 22 bp, Homo sapiens
tttagaatgtgactgtatttga

SEQ ID NO: 7785255 - DNA, 19 bp, Homo sapiens
ctctccagctccagtagct

SEQ ID NO: 7785256 - DNA, 22 bp, Homo sapiens
ctctccagccaggggcttcctg

SEQ ID NO: 7785257 - DNA, 22 bp, Homo sapiens
ctctcagaagtagcacgtgggc

SEQ ID NO: 7785258 - DNA, 19 bp, Homo sapiens
ctctcactcgccacatcct

SEQ ID NO: 7785259 - DNA, 22 bp, Homo sapiens
ctcctgggctgtcggcgctctg

SEQ ID NO: 7785260 - DNA, 22 bp, Homo sapiens
ctcctgggaggatgcggacccg

SEQ ID NO: 7785261 - DNA, 22 bp, Homo sapiens
ctcctgggctcaagtgatcctc

SEQ ID NO: 7785262 - DNA, 22 bp, Homo sapiens
ctctccctatgcctcccaggag

SEQ ID NO: 7785263 - DNA, 22 bp, Homo sapiens
ctctcccccacagcagccttct

SEQ ID NO: 7785264 - DNA, 22 bp, Homo sapiens
tttcagttgtcctgttaatagc

SEQ ID NO: 7785265 - DNA, 22 bp, Homo sapiens
tttcagttgttttagctctgtg

SEQ ID NO: 7785266 - DNA, 22 bp, Homo sapiens
ctctccagttacctaggtctga

SEQ ID NO: 7785267 - DNA, 22 bp, Homo sapiens
tttcagttcacctgggaacccg

SEQ ID NO: 7785268 - DNA, 22 bp, Homo sapiens
ctctccaggactttggcccaat

SEQ ID NO: 7785269 - DNA, 22 bp, Homo sapiens
ctctccaggagagcactttgag

SEQ ID NO: 7785270 - DNA, 22 bp, Homo sapiens
ctctggctggcattgctggact

SEQ ID NO: 7785271 - DNA, 19 bp, Homo sapiens
ctctggcttccaaagcatc

SEQ ID NO: 7785272 - DNA, 22 bp, Homo sapiens
tttgtcttggcctcagttttct

SEQ ID NO: 7785273 - DNA, 22 bp, Homo sapiens
tttgtacatcctaattctgagt

SEQ ID NO: 7785274 - DNA, 22 bp, Homo sapiens
tttgtcttgtaagttaaattca

SEQ ID NO: 7785275 - DNA, 22 bp, Homo sapiens
tttgtctttcccctcctcattg

SEQ ID NO: 7785276 - DNA, 22 bp, Homo sapiens
ctctgggcaggacgccaggcct

SEQ ID NO: 7785277 - DNA, 22 bp, Homo sapiens
ttttattctcagctccagagag

SEQ ID NO: 7785278 - DNA, 22 bp, Homo sapiens
ttttattctcaagacaatggga

SEQ ID NO: 7785279 - DNA, 22 bp, Homo sapiens
ctctggtcagtgaattcctagt

SEQ ID NO: 7785280 - DNA, 22 bp, Homo sapiens
ctctttgtggaacggcagtgtc

SEQ ID NO: 7785281 - DNA, 22 bp, Homo sapiens
ctctttggcgttggcagagcca

SEQ ID NO: 7785282 - DNA, 22 bp, Homo sapiens
ctctggtcttcaaggccacctc

SEQ ID NO: 7785283 - DNA, 22 bp, Homo sapiens
ctctttggcccccgatgattca

SEQ ID NO: 7785284 - DNA, 22 bp, Homo sapiens
ctctttggcccccgatgattca

SEQ ID NO: 7785285 - DNA, 19 bp, Homo sapiens
ctgaaaaacattctcagga

SEQ ID NO: 7785286 - DNA, 19 bp, Homo sapiens
ctgaaaaacattctcagga

SEQ ID NO: 7785287 - DNA, 22 bp, Homo sapiens
tttttaacctaccttaagagca

SEQ ID NO: 7785288 - DNA, 22 bp, Homo sapiens
tttttaagagattctccagtct

SEQ ID NO: 7785289 - DNA, 22 bp, Homo sapiens
tttttaagagtctggaaatagt

SEQ ID NO: 7785290 - DNA, 22 bp, Homo sapiens
tttttaagagtctggaaatagt

SEQ ID NO: 7785291 - DNA, 22 bp, Homo sapiens
tttttaagctcctttgatgtca

SEQ ID NO: 7785292 - DNA, 22 bp, Homo sapiens
tttttaagctcctttgatgtca

SEQ ID NO: 7785293 - DNA, 22 bp, Homo sapiens
tttttaagctcctttgatgtca

SEQ ID NO: 7785294 - DNA, 22 bp, Homo sapiens
ctgagaaggaagcctccactct

SEQ ID NO: 7785295 - DNA, 22 bp, Homo sapiens
ctgagaagcactgtctgcaaga

SEQ ID NO: 7785296 - DNA, 22 bp, Homo sapiens
ctgaagatgtctgagatgctca

SEQ ID NO: 7785297 - DNA, 22 bp, Homo sapiens
ctgaagaggacgcagcagcaag

SEQ ID NO: 7785298 - DNA, 22 bp, Homo sapiens
ctgaagaatgacagtgctttga

SEQ ID NO: 7785299 - DNA, 20 bp, Homo sapiens
ctgaagagactggaggggca

SEQ ID NO: 7785300 - DNA, 22 bp, Homo sapiens
ctgaagagaaagggagctcttc

SEQ ID NO: 7785301 - DNA, 22 bp, Homo sapiens
ctgaagagactggagggggcat

SEQ ID NO: 7785302 - DNA, 22 bp, Homo sapiens
ctgaaattctgcctctgcacaa

SEQ ID NO: 7785303 - DNA, 22 bp, Homo sapiens
ctgaaagcaaatacatgaatct

SEQ ID NO: 7785304 - DNA, 22 bp, Homo sapiens
ctgagtccagggacagaggcgt

SEQ ID NO: 7785305 - DNA, 22 bp, Homo sapiens
ctgagtccagggacagaggcgt

SEQ ID NO: 7785306 - DNA, 22 bp, Homo sapiens
ctgattttcaaaatgtgttaaa

SEQ ID NO: 7785307 - DNA, 22 bp, Homo sapiens
ctgatttacatatacaaaagat

SEQ ID NO: 7785308 - DNA, 22 bp, Homo sapiens
ctgatttagatttcacacgtga

SEQ ID NO: 7785309 - DNA, 17 bp, Homo sapiens
ctgatttattagcagac

SEQ ID NO: 7785310 - DNA, 22 bp, Homo sapiens
ctgcagagctaggctgagtgaa

SEQ ID NO: 7785311 - DNA, 22 bp, Homo sapiens
ctgcagagcatgaggaggtctg

SEQ ID NO: 7785312 - DNA, 22 bp, Homo sapiens
ctgagacacggagaggctgtgt

SEQ ID NO: 7785313 - DNA, 22 bp, Homo sapiens
ctgagacatggtttgactggca

SEQ ID NO: 7785314 - DNA, 22 bp, Homo sapiens
ctgagacattatgacaagtgga

SEQ ID NO: 7785315 - DNA, 22 bp, Homo sapiens
ctgagagagtaaagtagaatta

SEQ ID NO: 7785316 - DNA, 22 bp, Homo sapiens
ctgaggagaaagatggtccaag

SEQ ID NO: 7785317 - DNA, 22 bp, Homo sapiens
ctgaggagaaagatggtccaag

SEQ ID NO: 7785318 - DNA, 22 bp, Homo sapiens
ctgcctcatgctgcctgcagcc

SEQ ID NO: 7785319 - DNA, 22 bp, Homo sapiens
ctgcctccaggctcaccttgac

SEQ ID NO: 7785320 - DNA, 22 bp, Homo sapiens
ctgcctagcgccatctgcctct

SEQ ID NO: 7785321 - DNA, 22 bp, Homo sapiens
ctgcctctataggagtccacca

SEQ ID NO: 7785322 - DNA, 22 bp, Homo sapiens
ctgcctctataggagtccacca

SEQ ID NO: 7785323 - DNA, 22 bp, Homo sapiens
ctgcctcctgccgtgcagcttc

SEQ ID NO: 7785324 - DNA, 22 bp, Homo sapiens
ctgccaggtgagctccaggcct

SEQ ID NO: 7785325 - DNA, 22 bp, Homo sapiens
ctgccaggtgccagggcgcggc

SEQ ID NO: 7785326 - DNA, 22 bp, Homo sapiens
ctgccaggttggcgctcgctct

SEQ ID NO: 7785327 - DNA, 22 bp, Homo sapiens
ctgccatcctcaccagagcagc

SEQ ID NO: 7785328 - DNA, 22 bp, Homo sapiens
ctgccgtccatctacgtctcag

SEQ ID NO: 7785329 - DNA, 22 bp, Homo sapiens
ctgcctagaaaaccaggctcct

SEQ ID NO: 7785330 - DNA, 22 bp, Homo sapiens
ctgccatgctcaagaagtcttt

SEQ ID NO: 7785331 - DNA, 22 bp, Homo sapiens
ctgcagagggtttgagcatcct

SEQ ID NO: 7785332 - DNA, 22 bp, Homo sapiens
ctgcagcaagagaagtgctgac

SEQ ID NO: 7785333 - DNA, 22 bp, Homo sapiens
ctgccaggctgtcccaggtccg

SEQ ID NO: 7785334 - DNA, 22 bp, Homo sapiens
ctgccagggaggctgggaagtt

SEQ ID NO: 7785335 - DNA, 22 bp, Homo sapiens
ctgccaggcgatggattggctg

SEQ ID NO: 7785336 - DNA, 22 bp, Homo sapiens
ctgccaggggcctcacaggcca

SEQ ID NO: 7785337 - DNA, 22 bp, Homo sapiens
ctgccagggcatcctgtggtgg

SEQ ID NO: 7785338 - DNA, 22 bp, Homo sapiens
ctgccagggccctactcagttt

SEQ ID NO: 7785339 - DNA, 22 bp, Homo sapiens
ctgcagcatcctagggtctgtg

SEQ ID NO: 7785340 - DNA, 22 bp, Homo sapiens
ctgcagccacgagtcacagccc

SEQ ID NO: 7785341 - DNA, 22 bp, Homo sapiens
ctgccaggcctggggtgctgtc

SEQ ID NO: 7785342 - DNA, 22 bp, Homo sapiens
ctgccaggcctccgctgtcccc

SEQ ID NO: 7785343 - DNA, 22 bp, Homo sapiens
ctggctccaccccaggaggatg

SEQ ID NO: 7785344 - DNA, 22 bp, Homo sapiens
ctggcctggggcctcagctgct

SEQ ID NO: 7785345 - DNA, 23 bp, Homo sapiens
ctggctccgaagactccaggatc

SEQ ID NO: 7785346 - DNA, 22 bp, Homo sapiens
ctggctccctggacatggggcc

SEQ ID NO: 7785347 - DNA, 22 bp, Homo sapiens
ctggctccctctccctgagtca

SEQ ID NO: 7785348 - DNA, 22 bp, Homo sapiens
ctggctctaagtgtcagctccc

SEQ ID NO: 7785349 - DNA, 22 bp, Homo sapiens
ctggctctgtgggacctggcct

SEQ ID NO: 7785350 - DNA, 22 bp, Homo sapiens
ctggcctctgtgttcaccatag

SEQ ID NO: 7785351 - DNA, 22 bp, Homo sapiens
ctggcctggagcctctgggtgg

SEQ ID NO: 7785352 - DNA, 22 bp, Homo sapiens
ctggcctggcagggagggcatg

SEQ ID NO: 7785353 - DNA, 22 bp, Homo sapiens
ctggcccagagagcagagctta

SEQ ID NO: 7785354 - DNA, 22 bp, Homo sapiens
ctggccatgttgcctctgagac

SEQ ID NO: 7785355 - DNA, 20 bp, Homo sapiens
ctggcccaggatgatggcgc

SEQ ID NO: 7785356 - DNA, 22 bp, Homo sapiens
ctggcccaggctcctggggcac

SEQ ID NO: 7785357 - DNA, 21 bp, Homo sapiens
ctggcccagggatctgcattt

SEQ ID NO: 7785358 - DNA, 23 bp, Homo sapiens
ctggcccaggtgagaggttggtg

SEQ ID NO: 7785359 - DNA, 22 bp, Homo sapiens
ctggcccaggctcctggggcac

SEQ ID NO: 7785360 - DNA, 21 bp, Homo sapiens
ctggcccagggatctgcattt

SEQ ID NO: 7785361 - DNA, 22 bp, Homo sapiens
ctggcccagagctctggccttt

SEQ ID NO: 7785362 - DNA, 22 bp, Homo sapiens
ctggcccaggagagcaggcatt

SEQ ID NO: 7785363 - DNA, 22 bp, Homo sapiens
ctggcccaggaagacgtgtccc

SEQ ID NO: 7785364 - DNA, 22 bp, Homo sapiens
ctggcacatagtaggtgcacag

SEQ ID NO: 7785365 - DNA, 22 bp, Homo sapiens
ctggcaagaaatatatatctta

SEQ ID NO: 7785366 - DNA, 22 bp, Homo sapiens
ctggatccatcgggtcccgagt

SEQ ID NO: 7785367 - DNA, 22 bp, Homo sapiens
ctggatggtcccatgagcagct

SEQ ID NO: 7785368 - DNA, 22 bp, Homo sapiens
ctggatggtcccatgagcagct

SEQ ID NO: 7785369 - DNA, 22 bp, Homo sapiens
ctggcacatgctccctgagtgg

SEQ ID NO: 7785370 - DNA, 22 bp, Homo sapiens
ctggcacatgctccctgagtgg

SEQ ID NO: 7785371 - DNA, 22 bp, Homo sapiens
ctggcacatcactcctagttta

SEQ ID NO: 7785372 - DNA, 22 bp, Homo sapiens
ctggcacatgtgagccacatca

SEQ ID NO: 7785373 - DNA, 22 bp, Homo sapiens
ctggcacatagtcagcactcaa

SEQ ID NO: 7785374 - DNA, 22 bp, Homo sapiens
ctggcacatagtaggtgcacag

SEQ ID NO: 7785375 - DNA, 22 bp, Homo sapiens
ctggcagcagcttctggatcga

SEQ ID NO: 7785376 - DNA, 22 bp, Homo sapiens
ctggcagattggggtcagcagt

SEQ ID NO: 7785377 - DNA, 22 bp, Homo sapiens
ctggcagatagccacgcctgtc

SEQ ID NO: 7785378 - DNA, 22 bp, Homo sapiens
ctggcagagttgggtctcaaat

SEQ ID NO: 7785379 - DNA, 22 bp, Homo sapiens
ctggcagagtctgctgtctgca

SEQ ID NO: 7785380 - DNA, 22 bp, Homo sapiens
ctggcagaggatggggacccag

SEQ ID NO: 7785381 - DNA, 22 bp, Homo sapiens
ctggcagtctggtggaaggcct

SEQ ID NO: 7785382 - DNA, 22 bp, Homo sapiens
ctggcagtgacattgcaggtgc

SEQ ID NO: 7785383 - DNA, 22 bp, Homo sapiens
ctggcagttggcagggctgcca

SEQ ID NO: 7785384 - DNA, 22 bp, Homo sapiens
ctggcagtgtccagctcgtgat

SEQ ID NO: 7785385 - DNA, 22 bp, Homo sapiens
ctggcagtttgccaggagctcg

SEQ ID NO: 7785386 - DNA, 22 bp, Homo sapiens
ctggcagggctctttgggtgct

SEQ ID NO: 7785387 - DNA, 22 bp, Homo sapiens
ctggcagggctctttgggtgct

SEQ ID NO: 7785388 - DNA, 22 bp, Homo sapiens
ctggcagcattaacagagagca

SEQ ID NO: 7785389 - DNA, 22 bp, Homo sapiens
ctggcagggctctttgggtgct

SEQ ID NO: 7785390 - DNA, 22 bp, Homo sapiens
ctggcagcatggagcctgtgct

SEQ ID NO: 7785391 - DNA, 22 bp, Homo sapiens
ctggcagcaggtcacacgcaga

SEQ ID NO: 7785392 - DNA, 22 bp, Homo sapiens
ctggccaacatctggggcacat

SEQ ID NO: 7785393 - DNA, 22 bp, Homo sapiens
ctggcatgccttgggtgcctct

SEQ ID NO: 7785394 - DNA, 22 bp, Homo sapiens
ctggccaggcggcccctgcatg

SEQ ID NO: 7785395 - DNA, 22 bp, Homo sapiens
ctggccaggcggcccctgcatg

SEQ ID NO: 7785396 - DNA, 22 bp, Homo sapiens
ctggccaggctctcacgtggtc

SEQ ID NO: 7785397 - DNA, 22 bp, Homo sapiens
ctggccagtgcctgtgggcccc

SEQ ID NO: 7785398 - DNA, 22 bp, Homo sapiens
ctgcctggaatgccagcttctc

SEQ ID NO: 7785399 - DNA, 22 bp, Homo sapiens
ctgcctggagcattctgaaggt

SEQ ID NO: 7785400 - DNA, 22 bp, Homo sapiens
ctgcctggaccggcagccctcc

SEQ ID NO: 7785401 - DNA, 22 bp, Homo sapiens
ctgcctggccacaacccagggt

SEQ ID NO: 7785402 - DNA, 22 bp, Homo sapiens
ctgcctggcatggagaagagaa

SEQ ID NO: 7785403 - DNA, 22 bp, Homo sapiens
ctgcctggcatagtctggtcga

SEQ ID NO: 7785404 - DNA, 22 bp, Homo sapiens
ctgcctggcatagtctggtcga

SEQ ID NO: 7785405 - DNA, 22 bp, Homo sapiens
ctgcctggatgaatggcgcctt

SEQ ID NO: 7785406 - DNA, 17 bp, Homo sapiens
ctgcctggagtcccatc

SEQ ID NO: 7785407 - DNA, 20 bp, Homo sapiens
ctgcctggaggcctctacct

SEQ ID NO: 7785408 - DNA, 17 bp, Homo sapiens
ctgcctggagtcccatc

SEQ ID NO: 7785409 - DNA, 22 bp, Homo sapiens
ctgcctggcccagggatgggcc

SEQ ID NO: 7785410 - DNA, 22 bp, Homo sapiens
ctgcctggcctgatctccacgc

SEQ ID NO: 7785411 - DNA, 22 bp, Homo sapiens
ctgcctggcccagggatgggcc

SEQ ID NO: 7785412 - DNA, 22 bp, Homo sapiens
ctgcctggctaaactcaagtcg

SEQ ID NO: 7785413 - DNA, 22 bp, Homo sapiens
ctgcctgggccggccaccctct

SEQ ID NO: 7785414 - DNA, 22 bp, Homo sapiens
ctgcttctaagaacctgcagct

SEQ ID NO: 7785415 - DNA, 22 bp, Homo sapiens
ctggaagtataggggagatgat

SEQ ID NO: 7785416 - DNA, 19 bp, Homo sapiens
ctggaatgtggctggtgca

SEQ ID NO: 7785417 - DNA, 23 bp, Homo sapiens
ctggaagtgcttttatagctttg

SEQ ID NO: 7785418 - DNA, 22 bp, Homo sapiens
ctggacacaaacatctcctctg

SEQ ID NO: 7785419 - DNA, 22 bp, Homo sapiens
ctggacacactggagtctggca

SEQ ID NO: 7785420 - DNA, 22 bp, Homo sapiens
ctggaatgttctccagcatggc

SEQ ID NO: 7785421 - DNA, 22 bp, Homo sapiens
ctggacaggaagaattgggagc

SEQ ID NO: 7785422 - DNA, 22 bp, Homo sapiens
ctggacagatcccttgtagctt

SEQ ID NO: 7785423 - DNA, 22 bp, Homo sapiens
ctggacaggctggggactgcaa

SEQ ID NO: 7785424 - DNA, 22 bp, Homo sapiens
ctggaggggctggcatggtagc

SEQ ID NO: 7785425 - DNA, 22 bp, Homo sapiens
ctggagggcttctgcaggttac

SEQ ID NO: 7785426 - DNA, 22 bp, Homo sapiens
ctggaggggccatccacagtct

SEQ ID NO: 7785427 - DNA, 22 bp, Homo sapiens
ctggagggactttctcacggat

SEQ ID NO: 7785428 - DNA, 22 bp, Homo sapiens
ctggagggacaaggtatgcatt

SEQ ID NO: 7785429 - DNA, 22 bp, Homo sapiens
ctggagggctggactaaggaaa

SEQ ID NO: 7785430 - DNA, 22 bp, Homo sapiens
ctggagggctggactaaggaaa

SEQ ID NO: 7785431 - DNA, 22 bp, Homo sapiens
ctggagggcttctgcaggttac

SEQ ID NO: 7785432 - DNA, 22 bp, Homo sapiens
ctggagggggaaatgttcattg

SEQ ID NO: 7785433 - DNA, 22 bp, Homo sapiens
ctggagggggaaatgttcattg

SEQ ID NO: 7785434 - DNA, 22 bp, Homo sapiens
ctggagggtgagcctcatctct

SEQ ID NO: 7785435 - DNA, 21 bp, Homo sapiens
ctggagggtagagttgggctg

SEQ ID NO: 7785436 - DNA, 22 bp, Homo sapiens
ctggagggtggagagaagtctc

SEQ ID NO: 7785437 - DNA, 19 bp, Homo sapiens
ctggaggtagagggttagt

SEQ ID NO: 7785438 - DNA, 22 bp, Homo sapiens
ctggaggtctacagtggtagct

SEQ ID NO: 7785439 - DNA, 22 bp, Homo sapiens
ctggagttgggatgtgcctgga

SEQ ID NO: 7785440 - DNA, 22 bp, Homo sapiens
ctggagtctcttctgtagctac

SEQ ID NO: 7785441 - DNA, 21 bp, Homo sapiens
ctggagtcattttctgagtag

SEQ ID NO: 7785442 - DNA, 22 bp, Homo sapiens
ctggagtcactcatgtagctgc

SEQ ID NO: 7785443 - DNA, 18 bp, Homo sapiens
ctggagtcacagtgggga

SEQ ID NO: 7785444 - DNA, 22 bp, Homo sapiens
ctggacatttcgcacccttcca

SEQ ID NO: 7785445 - DNA, 21 bp, Homo sapiens
ctggactgaggagacagtcgc

SEQ ID NO: 7785446 - DNA, 20 bp, Homo sapiens
ctggacttgctgctcacctg

SEQ ID NO: 7785447 - DNA, 22 bp, Homo sapiens
ctggactttggcccatctgcca

SEQ ID NO: 7785448 - DNA, 22 bp, Homo sapiens
ctggaggacccctgcctggaag

SEQ ID NO: 7785449 - DNA, 22 bp, Homo sapiens
ctggaggcaaagcagaggcatg

SEQ ID NO: 7785450 - DNA, 22 bp, Homo sapiens
ctggagggacaaggtatgcatt

SEQ ID NO: 7785451 - DNA, 21 bp, Homo sapiens
ctggaggcaggtggtgccagg

SEQ ID NO: 7785452 - DNA, 21 bp, Homo sapiens
ctggaggcaggtggtgccagg

SEQ ID NO: 7785453 - DNA, 22 bp, Homo sapiens
ctggaggcagttgccccagtca

SEQ ID NO: 7785454 - DNA, 22 bp, Homo sapiens
cccccaccgtgttcctgctcgg

SEQ ID NO: 7785455 - DNA, 22 bp, Homo sapiens
cccccaccgtgttcctgctcgg

SEQ ID NO: 7785456 - DNA, 22 bp, Homo sapiens
cccccaccgtgttcctgctcgg

SEQ ID NO: 7785457 - DNA, 22 bp, Homo sapiens
cccccacctgaggacagtctta

SEQ ID NO: 7785458 - DNA, 22 bp, Homo sapiens
cccccaggctctgacacaggag

SEQ ID NO: 7785459 - DNA, 22 bp, Homo sapiens
cccccaggggctccgcctcgtg

SEQ ID NO: 7785460 - DNA, 22 bp, Homo sapiens
cccctcctggccacactgtcag

SEQ ID NO: 7785461 - DNA, 22 bp, Homo sapiens
cccctcctggccacactgtcag

SEQ ID NO: 7785462 - DNA, 22 bp, Homo sapiens
ccctaggcccaaagggtgacat

SEQ ID NO: 7785463 - DNA, 22 bp, Homo sapiens
ccctaggaattctatggccaag

SEQ ID NO: 7785464 - DNA, 22 bp, Homo sapiens
tgctggagactcactcaggtgc

SEQ ID NO: 7785465 - DNA, 22 bp, Homo sapiens
tgctggagacctgcttgcacca

SEQ ID NO: 7785466 - DNA, 22 bp, Homo sapiens
tgctggagacatagcaggcagc

SEQ ID NO: 7785467 - DNA, 22 bp, Homo sapiens
ccccagcccacaagcatattaa

SEQ ID NO: 7785468 - DNA, 22 bp, Homo sapiens
ccccagccttccatgggaattg

SEQ ID NO: 7785469 - DNA, 22 bp, Homo sapiens
ccccaggcctgttggatggcgc

SEQ ID NO: 7785470 - DNA, 22 bp, Homo sapiens
ccccaggcctgttggatggcgc

SEQ ID NO: 7785471 - DNA, 22 bp, Homo sapiens
ccccaggcagggcctaacagag

SEQ ID NO: 7785472 - DNA, 22 bp, Homo sapiens
tgctggagcatctgagagcatc

SEQ ID NO: 7785473 - DNA, 22 bp, Homo sapiens
tgctggagagctagttctgcag

SEQ ID NO: 7785474 - DNA, 22 bp, Homo sapiens
tgctggagatgaaagggccctg

SEQ ID NO: 7785475 - DNA, 22 bp, Homo sapiens
tgctggagatcattaatgttca

SEQ ID NO: 7785476 - DNA, 22 bp, Homo sapiens
ccccacctgtgcgtctgccgca

SEQ ID NO: 7785477 - DNA, 22 bp, Homo sapiens
ccccagcagactcagggcaggt

SEQ ID NO: 7785478 - DNA, 22 bp, Homo sapiens
ccccagcagcacctggggcagt

SEQ ID NO: 7785479 - DNA, 22 bp, Homo sapiens
ccccagcagcacctggggcagt

SEQ ID NO: 7785480 - DNA, 22 bp, Homo sapiens
ccccagccagcaggacctctga

SEQ ID NO: 7785481 - DNA, 22 bp, Homo sapiens
ccccagccagcaggacctctga

SEQ ID NO: 7785482 - DNA, 22 bp, Homo sapiens
ccccagccagcttgtagtagaa

SEQ ID NO: 7785483 - DNA, 22 bp, Homo sapiens
ccccagccagcttgtagtagaa

SEQ ID NO: 7785484 - DNA, 22 bp, Homo sapiens
tgctccatgcgctcggccggcg

SEQ ID NO: 7785485 - DNA, 22 bp, Homo sapiens
cccaggctgagttagaggtgtc

SEQ ID NO: 7785486 - DNA, 22 bp, Homo sapiens
tgcctgggagtgaccaagactc

SEQ ID NO: 7785487 - DNA, 22 bp, Homo sapiens
tgcctgggccttcccacctctg

SEQ ID NO: 7785488 - DNA, 22 bp, Homo sapiens
tgcctgggacatgctgtggact

SEQ ID NO: 7785489 - DNA, 22 bp, Homo sapiens
tgcctgggacatgctgtggact

SEQ ID NO: 7785490 - DNA, 22 bp, Homo sapiens
tgcctgggactgtactaaattt

SEQ ID NO: 7785491 - DNA, 20 bp, Homo sapiens
tgcctgggaaggcgtggagg

SEQ ID NO: 7785492 - DNA, 22 bp, Homo sapiens
tgctgagatagctgactaggca

SEQ ID NO: 7785493 - DNA, 22 bp, Homo sapiens
cccagggaggtagcaggagaaa

SEQ ID NO: 7785494 - DNA, 22 bp, Homo sapiens
cccagggaggtagcaggagaaa

SEQ ID NO: 7785495 - DNA, 22 bp, Homo sapiens
cccagggatgtggcagatgtta

SEQ ID NO: 7785496 - DNA, 22 bp, Homo sapiens
cccagggaggcccaggctctgc

SEQ ID NO: 7785497 - DNA, 20 bp, Homo sapiens
cccagggacctgagctccat

SEQ ID NO: 7785498 - DNA, 22 bp, Homo sapiens
cccagcctgtgacagccgtcct

SEQ ID NO: 7785499 - DNA, 22 bp, Homo sapiens
cccagcctggtgcactgtgggg

SEQ ID NO: 7785500 - DNA, 22 bp, Homo sapiens
cccagccttccaccctggacta

SEQ ID NO: 7785501 - DNA, 22 bp, Homo sapiens
cccagcctactctgccatagca

SEQ ID NO: 7785502 - DNA, 22 bp, Homo sapiens
cccagcctactctgccatagca

SEQ ID NO: 7785503 - DNA, 22 bp, Homo sapiens
tgcagggaggccccgcagccct

SEQ ID NO: 7785504 - DNA, 22 bp, Homo sapiens
tgcagggaatctgtggctggac

SEQ ID NO: 7785505 - DNA, 22 bp, Homo sapiens
cccagctacctctgctaggaga

SEQ ID NO: 7785506 - DNA, 17 bp, Homo sapiens
cccagctggcagtgccg

SEQ ID NO: 7785507 - DNA, 17 bp, Homo sapiens
cccagctggcagtgccg

SEQ ID NO: 7785508 - DNA, 22 bp, Homo sapiens
cccaggaaacccgaaggcgacc

SEQ ID NO: 7785509 - DNA, 22 bp, Homo sapiens
tgcattaagtgtctgcatatgg

SEQ ID NO: 7785510 - DNA, 20 bp, Homo sapiens
tgcattaagtggcattgagc

SEQ ID NO: 7785511 - DNA, 22 bp, Homo sapiens
tgcattaaggtaattgtataat

SEQ ID NO: 7785512 - DNA, 22 bp, Homo sapiens
tgcattaatttttgccaggttc

SEQ ID NO: 7785513 - DNA, 22 bp, Homo sapiens
tgcattaagcacacttttgaat

SEQ ID NO: 7785514 - DNA, 22 bp, Homo sapiens
tgcattaagaatttctgaggat

SEQ ID NO: 7785515 - DNA, 22 bp, Homo sapiens
tgcattaagggcctggagatac

SEQ ID NO: 7785516 - DNA, 22 bp, Homo sapiens
tgcattaaggccattgaaattt

SEQ ID NO: 7785517 - DNA, 22 bp, Homo sapiens
tgcatcaacctaatatcagctc

SEQ ID NO: 7785518 - DNA, 22 bp, Homo sapiens
tgcattaaaaccatcgaccatc

SEQ ID NO: 7785519 - DNA, 22 bp, Homo sapiens
tgcattaaaatgatggagaaat

SEQ ID NO: 7785520 - DNA, 22 bp, Homo sapiens
tgcattaaaatgtgcctctctt

SEQ ID NO: 7785521 - DNA, 22 bp, Homo sapiens
tgcattaaatataatctgttga

SEQ ID NO: 7785522 - DNA, 22 bp, Homo sapiens
tgccaagggtatgggcaagata

SEQ ID NO: 7785523 - DNA, 22 bp, Homo sapiens
tgccacagagactttcattgta

SEQ ID NO: 7785524 - DNA, 22 bp, Homo sapiens
tgccacagagactttcattgta

SEQ ID NO: 7785525 - DNA, 22 bp, Homo sapiens
tgccacagacaggacagaacag

SEQ ID NO: 7785526 - DNA, 22 bp, Homo sapiens
tgccacagacaggacagaacag

SEQ ID NO: 7785527 - DNA, 22 bp, Homo sapiens
tgccaagaggtccaggtgggaa

SEQ ID NO: 7785528 - DNA, 22 bp, Homo sapiens
tgcattcagttggtcagctttt

SEQ ID NO: 7785529 - DNA, 22 bp, Homo sapiens
tgccacagagcaattctgctga

SEQ ID NO: 7785530 - DNA, 22 bp, Homo sapiens
cccaggaggtggaggctgcagt

SEQ ID NO: 7785531 - DNA, 22 bp, Homo sapiens
cccaggaggtggaggctgcagt

SEQ ID NO: 7785532 - DNA, 22 bp, Homo sapiens
cccaggaggtggaggttgcggt

SEQ ID NO: 7785533 - DNA, 22 bp, Homo sapiens
cccaggaggtgtagctgcgtgg

SEQ ID NO: 7785534 - DNA, 22 bp, Homo sapiens
cccaggaggtgtagctgcgtgg

SEQ ID NO: 7785535 - DNA, 22 bp, Homo sapiens
tgccaggcctcaggagtctcca

SEQ ID NO: 7785536 - DNA, 21 bp, Homo sapiens
tgccaggcctgagctggggtc

SEQ ID NO: 7785537 - DNA, 22 bp, Homo sapiens
cccaggagttcgaggctgtagt

SEQ ID NO: 7785538 - DNA, 22 bp, Homo sapiens
cccaggatgtcgaggctgcagt

SEQ ID NO: 7785539 - DNA, 22 bp, Homo sapiens
cccaggatgtcgaggctgcagt

SEQ ID NO: 7785540 - DNA, 22 bp, Homo sapiens
tgccaggcgtggtggtgcgcac

SEQ ID NO: 7785541 - DNA, 22 bp, Homo sapiens
cccaggcactcttggtcatttt

SEQ ID NO: 7785542 - DNA, 22 bp, Homo sapiens
cccaggcacatccactctgtga

SEQ ID NO: 7785543 - DNA, 22 bp, Homo sapiens
cccaggcagagagctggtgagc

SEQ ID NO: 7785544 - DNA, 22 bp, Homo sapiens
cccaggcagagagctggtgagc

SEQ ID NO: 7785545 - DNA, 22 bp, Homo sapiens
cccaggcagaattagtgtttca

SEQ ID NO: 7785546 - DNA, 22 bp, Homo sapiens
cccaggcacactgaagtgacat

SEQ ID NO: 7785547 - DNA, 22 bp, Homo sapiens
cccaggcacatccactctgtga

SEQ ID NO: 7785548 - DNA, 22 bp, Homo sapiens
cccaggcacactgaagtgacat

SEQ ID NO: 7785549 - DNA, 22 bp, Homo sapiens
cccaggcagccccagaagcttg

SEQ ID NO: 7785550 - DNA, 22 bp, Homo sapiens
cccaggcagccccagaagcttg

SEQ ID NO: 7785551 - DNA, 22 bp, Homo sapiens
cccaggcagccccagaagcttg

SEQ ID NO: 7785552 - DNA, 22 bp, Homo sapiens
cccaggcagcctgcagggaagg

SEQ ID NO: 7785553 - DNA, 22 bp, Homo sapiens
cccaggcagcggggtctccttg

SEQ ID NO: 7785554 - DNA, 22 bp, Homo sapiens
cccaggcagtgctgatccctca

SEQ ID NO: 7785555 - DNA, 22 bp, Homo sapiens
cccaggcagtgctgatccctca

SEQ ID NO: 7785556 - DNA, 22 bp, Homo sapiens
cccaggcagtgtgtgcatgcgt

SEQ ID NO: 7785557 - DNA, 22 bp, Homo sapiens
cccaggcagggacgtgctctgg

SEQ ID NO: 7785558 - DNA, 22 bp, Homo sapiens
cccaggcagggacgtgctctgg

SEQ ID NO: 7785559 - DNA, 22 bp, Homo sapiens
cccaggcagggacgtgctctgg

SEQ ID NO: 7785560 - DNA, 22 bp, Homo sapiens
cccaggcaggagtgtggtggct

SEQ ID NO: 7785561 - DNA, 22 bp, Homo sapiens
tggcacaggagcactgccctgg

SEQ ID NO: 7785562 - DNA, 22 bp, Homo sapiens
tggcaaggccacaggtgcagtt

SEQ ID NO: 7785563 - DNA, 22 bp, Homo sapiens
tggcaaggccacaggtgcagtt

SEQ ID NO: 7785564 - DNA, 23 bp, Homo sapiens
tggcaaggaatgggatggagact

SEQ ID NO: 7785565 - DNA, 22 bp, Homo sapiens
tggcaaggctgtgggggcagag

SEQ ID NO: 7785566 - DNA, 22 bp, Homo sapiens
tggcagattttgaagacagaga

SEQ ID NO: 7785567 - DNA, 22 bp, Homo sapiens
tggcagatgtggtttgagacag

SEQ ID NO: 7785568 - DNA, 22 bp, Homo sapiens
tggcagatgtggcatagagcat

SEQ ID NO: 7785569 - DNA, 22 bp, Homo sapiens
tggcagatttaacattggaact

SEQ ID NO: 7785570 - DNA, 22 bp, Homo sapiens
tggcagattttctctggaggag

SEQ ID NO: 7785571 - DNA, 22 bp, Homo sapiens
tggcagatgtatatcacagctt

SEQ ID NO: 7785572 - DNA, 22 bp, Homo sapiens
tggcagatggcctggaaccaaa

SEQ ID NO: 7785573 - DNA, 22 bp, Homo sapiens
tggcagatgagccgcgctccaa

SEQ ID NO: 7785574 - DNA, 22 bp, Homo sapiens
tggcagcacggcatccactctc

SEQ ID NO: 7785575 - DNA, 22 bp, Homo sapiens
tggcagcacggcatccactctc

SEQ ID NO: 7785576 - DNA, 22 bp, Homo sapiens
tggcagctggagggcaatggcc

SEQ ID NO: 7785577 - DNA, 22 bp, Homo sapiens
tggcagctggctctgcgcaggc

SEQ ID NO: 7785578 - DNA, 22 bp, Homo sapiens
cctaggccctcaaagagcataa

SEQ ID NO: 7785579 - DNA, 23 bp, Homo sapiens
tggccaggcataaaggtgggtgg

SEQ ID NO: 7785580 - DNA, 22 bp, Homo sapiens
tggccaggaggctgcttctgac

SEQ ID NO: 7785581 - DNA, 22 bp, Homo sapiens
tggcagcttgaatgcagtcttt

SEQ ID NO: 7785582 - DNA, 22 bp, Homo sapiens
tggcagctgtgtccaggtagaa

SEQ ID NO: 7785583 - DNA, 22 bp, Homo sapiens
tggcagctgtctgtggggtctc

SEQ ID NO: 7785584 - DNA, 22 bp, Homo sapiens
tggcagctgtctgtggggtctc

SEQ ID NO: 7785585 - DNA, 22 bp, Homo sapiens
ccctcagttttccagtgtgggc

SEQ ID NO: 7785586 - DNA, 22 bp, Homo sapiens
ccctcagtctggctgggaagac

SEQ ID NO: 7785587 - DNA, 22 bp, Homo sapiens
ccctccagagcttgacctgctg

SEQ ID NO: 7785588 - DNA, 22 bp, Homo sapiens
ccctccagggagccatgctggg

SEQ ID NO: 7785589 - DNA, 22 bp, Homo sapiens
ccctccagccatggacccaggt

SEQ ID NO: 7785590 - DNA, 22 bp, Homo sapiens
ccctggactgttcagggcctga

SEQ ID NO: 7785591 - DNA, 22 bp, Homo sapiens
ccctgctgacaacttgattttg

SEQ ID NO: 7785592 - DNA, 22 bp, Homo sapiens
ccctgctgatgccttgattttg

SEQ ID NO: 7785593 - DNA, 22 bp, Homo sapiens
ccctggagatcgggagaggaag

SEQ ID NO: 7785594 - DNA, 20 bp, Homo sapiens
ccctggagagaagctccacg

SEQ ID NO: 7785595 - DNA, 20 bp, Homo sapiens
ccctggagagaagctccacg

SEQ ID NO: 7785596 - DNA, 22 bp, Homo sapiens
ccctggagaggactcacccctg

SEQ ID NO: 7785597 - DNA, 22 bp, Homo sapiens
tggagctgagagccaggctggc

SEQ ID NO: 7785598 - DNA, 23 bp, Homo sapiens
ccctggccttggggcacaggctg

SEQ ID NO: 7785599 - DNA, 17 bp, Homo sapiens
ccctggctctaggtgga

SEQ ID NO: 7785600 - DNA, 22 bp, Homo sapiens
ccctggctctgcctcagagccc

SEQ ID NO: 7785601 - DNA, 17 bp, Homo sapiens
ccctggctctaggtgga

SEQ ID NO: 7785602 - DNA, 22 bp, Homo sapiens
ccctggctctgcctcagagccc

SEQ ID NO: 7785603 - DNA, 20 bp, Homo sapiens
ccctggcctgtttcatgccc

SEQ ID NO: 7785604 - DNA, 22 bp, Homo sapiens
tggatgaaaaatgagaattttc

SEQ ID NO: 7785605 - DNA, 22 bp, Homo sapiens
tggatgaaatattgcatttatg

SEQ ID NO: 7785606 - DNA, 22 bp, Homo sapiens
tggatctatctccaggggtcct

SEQ ID NO: 7785607 - DNA, 22 bp, Homo sapiens
cctctcagtattgaactttata

SEQ ID NO: 7785608 - DNA, 22 bp, Homo sapiens
cctctcagcgattcctcttgga

SEQ ID NO: 7785609 - DNA, 22 bp, Homo sapiens
cctctccagcggcctcagggcc

SEQ ID NO: 7785610 - DNA, 23 bp, Homo sapiens
cctctccagacactgggccttgt

SEQ ID NO: 7785611 - DNA, 22 bp, Homo sapiens
cctctaaattgtttgaagttgg

SEQ ID NO: 7785612 - DNA, 22 bp, Homo sapiens
cctctacttaccactcagccag

SEQ ID NO: 7785613 - DNA, 22 bp, Homo sapiens
cctctcagccggactgtcaggc

SEQ ID NO: 7785614 - DNA, 22 bp, Homo sapiens
tggctgcctgatcgagcaggtg

SEQ ID NO: 7785615 - DNA, 22 bp, Homo sapiens
cctctctgtcacaccagtggcc

SEQ ID NO: 7785616 - DNA, 22 bp, Homo sapiens
cctctctgtgtggcctctccat

SEQ ID NO: 7785617 - DNA, 20 bp, Homo sapiens
cctctctgccctgcaaggcc

SEQ ID NO: 7785618 - DNA, 20 bp, Homo sapiens
cctctctgcatgctccctga

SEQ ID NO: 7785619 - DNA, 22 bp, Homo sapiens
cctctgagcctgtgtgcggcac

SEQ ID NO: 7785620 - DNA, 22 bp, Homo sapiens
cctctgagaccagctctgcacc

SEQ ID NO: 7785621 - DNA, 22 bp, Homo sapiens
cctctgagaccagctctgcacc

SEQ ID NO: 7785622 - DNA, 22 bp, Homo sapiens
cctctgacttctctttattggc

SEQ ID NO: 7785623 - DNA, 22 bp, Homo sapiens
cctctgactccacacttgaact

SEQ ID NO: 7785624 - DNA, 22 bp, Homo sapiens
cctctgggtgggaggccgggcg

SEQ ID NO: 7785625 - DNA, 22 bp, Homo sapiens
cctccagccttcctgaagagcc

SEQ ID NO: 7785626 - DNA, 22 bp, Homo sapiens
cctccaagtttgactcaggaca

SEQ ID NO: 7785627 - DNA, 22 bp, Homo sapiens
cctccagcattactggcccatg

SEQ ID NO: 7785628 - DNA, 22 bp, Homo sapiens
cctccctgtctacctgttgtgg

SEQ ID NO: 7785629 - DNA, 22 bp, Homo sapiens
tggctgaggtctggggcttctg

SEQ ID NO: 7785630 - DNA, 22 bp, Homo sapiens
cctcggctgggccttggccact

SEQ ID NO: 7785631 - DNA, 22 bp, Homo sapiens
cctcctctggtgctgccaaccc

SEQ ID NO: 7785632 - DNA, 20 bp, Homo sapiens
tggcccagtggggcagggtg

SEQ ID NO: 7785633 - DNA, 22 bp, Homo sapiens
tggccccattttacagatgaaa

SEQ ID NO: 7785634 - DNA, 20 bp, Homo sapiens
tggcccagtggggcagggtg

SEQ ID NO: 7785635 - DNA, 20 bp, Homo sapiens
tggcccagtggggcagggtg

SEQ ID NO: 7785636 - DNA, 22 bp, Homo sapiens
tggcccagcagttctgccccag

SEQ ID NO: 7785637 - DNA, 22 bp, Homo sapiens
tggcccagcagttctgccccag

SEQ ID NO: 7785638 - DNA, 22 bp, Homo sapiens
tggcccagtgcttatgctctga

SEQ ID NO: 7785639 - DNA, 22 bp, Homo sapiens
tggcccagtgcttatgctctga

SEQ ID NO: 7785640 - DNA, 22 bp, Homo sapiens
tggcccctgaggagcatcagcc

SEQ ID NO: 7785641 - DNA, 22 bp, Homo sapiens
tggcccctgaggagcgtcagcc

SEQ ID NO: 7785642 - DNA, 22 bp, Homo sapiens
tggcccgacctctgctcatgca

SEQ ID NO: 7785643 - DNA, 18 bp, Homo sapiens
tggccccttatcagtcct

SEQ ID NO: 7785644 - DNA, 22 bp, Homo sapiens
tggcccctggcacacggaggat

SEQ ID NO: 7785645 - DNA, 22 bp, Homo sapiens
tggccctgctatgatcctgcaa

SEQ ID NO: 7785646 - DNA, 22 bp, Homo sapiens
tggccctgctatgatcctgcaa

SEQ ID NO: 7785647 - DNA, 22 bp, Homo sapiens
tggccctgccgccacgacgtct

SEQ ID NO: 7785648 - DNA, 22 bp, Homo sapiens
tggccctgctggacacgcctgc

SEQ ID NO: 7785649 - DNA, 22 bp, Homo sapiens
tggctcagctgactcggcttct

SEQ ID NO: 7785650 - DNA, 22 bp, Homo sapiens
tggccctgctgggtcagagctg

SEQ ID NO: 7785651 - DNA, 22 bp, Homo sapiens
tggccctgctggccaaaggcta

SEQ ID NO: 7785652 - DNA, 22 bp, Homo sapiens
tggccctgctgtatcatctgct

SEQ ID NO: 7785653 - DNA, 22 bp, Homo sapiens
tggctcagtttctgcccagctg

SEQ ID NO: 7785654 - DNA, 22 bp, Homo sapiens
tggctcagtttctgcccagctg

SEQ ID NO: 7785655 - DNA, 22 bp, Homo sapiens
tggctcagtttgggggattgaa

SEQ ID NO: 7785656 - DNA, 22 bp, Homo sapiens
cctggctcgctgacctcagggg

SEQ ID NO: 7785657 - DNA, 22 bp, Homo sapiens
cctggctcgctgacctcagggg

SEQ ID NO: 7785658 - DNA, 22 bp, Homo sapiens
cctggctctagaggccactcct

SEQ ID NO: 7785659 - DNA, 22 bp, Homo sapiens
cctggctctagaggccactcct

SEQ ID NO: 7785660 - DNA, 22 bp, Homo sapiens
cctggctctgaagtccacatca

SEQ ID NO: 7785661 - DNA, 22 bp, Homo sapiens
cctggctcctgcctctgcaggg

SEQ ID NO: 7785662 - DNA, 22 bp, Homo sapiens
cctggctcctgcctctgcaggg

SEQ ID NO: 7785663 - DNA, 22 bp, Homo sapiens
cctggctcctgcacagatcttt

SEQ ID NO: 7785664 - DNA, 22 bp, Homo sapiens
cctggctccgtgtcacgtgccc

SEQ ID NO: 7785665 - DNA, 22 bp, Homo sapiens
cctggctcccggaacagggtct

SEQ ID NO: 7785666 - DNA, 22 bp, Homo sapiens
cctggctccctgcacagggctc

SEQ ID NO: 7785667 - DNA, 22 bp, Homo sapiens
cctggcctcctggccttctcat

SEQ ID NO: 7785668 - DNA, 19 bp, Homo sapiens
cctggccctgctgcgcggg

SEQ ID NO: 7785669 - DNA, 22 bp, Homo sapiens
cctggcctgtgaatctgagagc

SEQ ID NO: 7785670 - DNA, 22 bp, Homo sapiens
cctggccttaagggcagggagc

SEQ ID NO: 7785671 - DNA, 22 bp, Homo sapiens
cctggcctctccgagtaacctg

SEQ ID NO: 7785672 - DNA, 22 bp, Homo sapiens
cctggctccagctgcctgtcct

SEQ ID NO: 7785673 - DNA, 22 bp, Homo sapiens
tgtctcttctgcctccagctgt

SEQ ID NO: 7785674 - DNA, 22 bp, Homo sapiens
tgtctcttcagcccatggcttc

SEQ ID NO: 7785675 - DNA, 22 bp, Homo sapiens
tgtctcttcagcccatggcttc

SEQ ID NO: 7785676 - DNA, 22 bp, Homo sapiens
tgtctctgtgcatttgtgcttc

SEQ ID NO: 7785677 - DNA, 22 bp, Homo sapiens
tgtctcttactttgattcttgg

SEQ ID NO: 7785678 - DNA, 22 bp, Homo sapiens
tgtctcttggctctatcactta

SEQ ID NO: 7785679 - DNA, 22 bp, Homo sapiens
tgtctcttgagtttgttttaat

SEQ ID NO: 7785680 - DNA, 22 bp, Homo sapiens
tgtcctggagacacaaggtggt

SEQ ID NO: 7785681 - DNA, 22 bp, Homo sapiens
tgtctatttgaattatcctaat

SEQ ID NO: 7785682 - DNA, 20 bp, Homo sapiens
cctggcaggcgggttactta

SEQ ID NO: 7785683 - DNA, 20 bp, Homo sapiens
cctggcaggcgggttactta

SEQ ID NO: 7785684 - DNA, 22 bp, Homo sapiens
cctggcaggctggggacagtgc

SEQ ID NO: 7785685 - DNA, 22 bp, Homo sapiens
cctggcaggctggggacagtgc

SEQ ID NO: 7785686 - DNA, 22 bp, Homo sapiens
cctggcaggcaagaggaaggga

SEQ ID NO: 7785687 - DNA, 22 bp, Homo sapiens
cctggcaggactgttgtaagaa

SEQ ID NO: 7785688 - DNA, 22 bp, Homo sapiens
cctggcaggcccctcctggatt

SEQ ID NO: 7785689 - DNA, 22 bp, Homo sapiens
cctggcaggtagcattgaggag

SEQ ID NO: 7785690 - DNA, 22 bp, Homo sapiens
cctggcaggtggaggttgcagt

SEQ ID NO: 7785691 - DNA, 22 bp, Homo sapiens
cctggcaggtggcgccctcggc

SEQ ID NO: 7785692 - DNA, 22 bp, Homo sapiens
cctggcagtcaggggagtcctt

SEQ ID NO: 7785693 - DNA, 22 bp, Homo sapiens
cctggcagtcaggggagtcctt

SEQ ID NO: 7785694 - DNA, 22 bp, Homo sapiens
cctggcagcaggtgggcccgtg

SEQ ID NO: 7785695 - DNA, 22 bp, Homo sapiens
tgtcattatttgcctactgact

SEQ ID NO: 7785696 - DNA, 22 bp, Homo sapiens
cctggcagactgtgagggcagg

SEQ ID NO: 7785697 - DNA, 23 bp, Homo sapiens
cctggcagcaaacgaggaggtta

SEQ ID NO: 7785698 - DNA, 23 bp, Homo sapiens
cctggcagcaaacgaggaggtta

SEQ ID NO: 7785699 - DNA, 22 bp, Homo sapiens
cctggcagttcatcaaatggca

SEQ ID NO: 7785700 - DNA, 22 bp, Homo sapiens
cctggcagtggtgaagaagagg

SEQ ID NO: 7785701 - DNA, 22 bp, Homo sapiens
cctggcagttttgcccaggatt

SEQ ID NO: 7785702 - DNA, 22 bp, Homo sapiens
cctggccagtttccaggccctg

SEQ ID NO: 7785703 - DNA, 22 bp, Homo sapiens
cctggccagtttccaggccctg

SEQ ID NO: 7785704 - DNA, 22 bp, Homo sapiens
cctggccatagggcccaggaaa

SEQ ID NO: 7785705 - DNA, 22 bp, Homo sapiens
cctggccagggtctgggctgct

SEQ ID NO: 7785706 - DNA, 22 bp, Homo sapiens
cctggccaggctccaagtactg

SEQ ID NO: 7785707 - DNA, 22 bp, Homo sapiens
cctggccaggcatggagtcaca

SEQ ID NO: 7785708 - DNA, 22 bp, Homo sapiens
cctggccagcgccggctgctcg

SEQ ID NO: 7785709 - DNA, 22 bp, Homo sapiens
cctggccagctaattgcccatc

SEQ ID NO: 7785710 - DNA, 22 bp, Homo sapiens
cctggccatttgaacttcagac

SEQ ID NO: 7785711 - DNA, 22 bp, Homo sapiens
cctggccatagggcccaggaaa

SEQ ID NO: 7785712 - DNA, 22 bp, Homo sapiens
tgtcctcgtccgcctcgaactc

SEQ ID NO: 7785713 - DNA, 22 bp, Homo sapiens
tgtaaacatatgtatgtatgta

SEQ ID NO: 7785714 - DNA, 22 bp, Homo sapiens
tgtaaactcagtatgttttact

SEQ ID NO: 7785715 - DNA, 22 bp, Homo sapiens
tgtagggactgaggctggagag

SEQ ID NO: 7785716 - DNA, 20 bp, Homo sapiens
tgtaggtgtacagtaaggag

SEQ ID NO: 7785717 - DNA, 22 bp, Homo sapiens
cctggagaggcgctgcagagga

SEQ ID NO: 7785718 - DNA, 22 bp, Homo sapiens
cctggagattatttggtccaat

SEQ ID NO: 7785719 - DNA, 22 bp, Homo sapiens
tgtagtgaggaaagactggttg

SEQ ID NO: 7785720 - DNA, 22 bp, Homo sapiens
tgtagtaagtgcgcaataaata

SEQ ID NO: 7785721 - DNA, 22 bp, Homo sapiens
tgtagtagcattcacgaagtgt

SEQ ID NO: 7785722 - DNA, 22 bp, Homo sapiens
cctggagcaaaaatctaaggag

SEQ ID NO: 7785723 - DNA, 22 bp, Homo sapiens
cctggcacatagcaacccctcc

SEQ ID NO: 7785724 - DNA, 22 bp, Homo sapiens
cctggcacatagtgggcatgca

SEQ ID NO: 7785725 - DNA, 22 bp, Homo sapiens
cctggaggtggaggttgcagtg

SEQ ID NO: 7785726 - DNA, 22 bp, Homo sapiens
cctggcagaatattaaagtgca

SEQ ID NO: 7785727 - DNA, 22 bp, Homo sapiens
cctggcagacagcactgaagct

SEQ ID NO: 7785728 - DNA, 21 bp, Homo sapiens
cctggcagaagcctgatatgc

SEQ ID NO: 7785729 - DNA, 17 bp, Homo sapiens
tgtcatggctatggttg

SEQ ID NO: 7785730 - DNA, 22 bp, Homo sapiens
tgtcatggctgaaagtgggggc

SEQ ID NO: 7785731 - DNA, 22 bp, Homo sapiens
tgtcatgggcatttattgaggg

SEQ ID NO: 7785732 - DNA, 22 bp, Homo sapiens
tgtcatggggaaaataacagac

SEQ ID NO: 7785733 - DNA, 22 bp, Homo sapiens
tgtcatggacagattagatgag

SEQ ID NO: 7785734 - DNA, 22 bp, Homo sapiens
tgtcatggagcttatattccag

SEQ ID NO: 7785735 - DNA, 22 bp, Homo sapiens
tgtcatggactggatttctgct

SEQ ID NO: 7785736 - DNA, 22 bp, Homo sapiens
tgtcatggaggcctcccctaaa

SEQ ID NO: 7785737 - DNA, 22 bp, Homo sapiens
tgtcatggcactagagtggggt

SEQ ID NO: 7785738 - DNA, 22 bp, Homo sapiens
tgtcatggcactggtaggagtg

SEQ ID NO: 7785739 - DNA, 22 bp, Homo sapiens
tgtcatggcgttgtggggacta

SEQ ID NO: 7785740 - DNA, 22 bp, Homo sapiens
tgtcatggggttgttttgtaca

SEQ ID NO: 7785741 - DNA, 22 bp, Homo sapiens
tgtcatgggtctaaacattgat

SEQ ID NO: 7785742 - DNA, 22 bp, Homo sapiens
tgtcatggtagctgaaggatgt

SEQ ID NO: 7785743 - DNA, 22 bp, Homo sapiens
tgtcatggtgctatttaattag

SEQ ID NO: 7785744 - DNA, 22 bp, Homo sapiens
tgtcatggtatttgtgagctgc

SEQ ID NO: 7785745 - DNA, 22 bp, Homo sapiens
tgtcatggtctgtaaggagccc

SEQ ID NO: 7785746 - DNA, 22 bp, Homo sapiens
tgtcatgtctgtaaatacacca

SEQ ID NO: 7785747 - DNA, 22 bp, Homo sapiens
tgtatgtttctaaatgattgct

SEQ ID NO: 7785748 - DNA, 22 bp, Homo sapiens
tgtattaacattaataaaatgg

SEQ ID NO: 7785749 - DNA, 22 bp, Homo sapiens
tgtattatcaagtaaatacatg

SEQ ID NO: 7785750 - DNA, 22 bp, Homo sapiens
tgtattatgattgttgttcatg

SEQ ID NO: 7785751 - DNA, 22 bp, Homo sapiens
tgtattatgattgttgttcatg

SEQ ID NO: 7785752 - DNA, 22 bp, Homo sapiens
cctggagagctcgggccaggca

SEQ ID NO: 7785753 - DNA, 22 bp, Homo sapiens
cctggagacgaggctggaccat

SEQ ID NO: 7785754 - DNA, 22 bp, Homo sapiens
cctggagacctgatggcagcgg

SEQ ID NO: 7785755 - DNA, 22 bp, Homo sapiens
tggtgctgccaggctcctgcca

SEQ ID NO: 7785756 - DNA, 22 bp, Homo sapiens
tggtgctgccacctcctctgct

SEQ ID NO: 7785757 - DNA, 22 bp, Homo sapiens
tggtgctgccaggctcctgcca

SEQ ID NO: 7785758 - DNA, 22 bp, Homo sapiens
tggtgctgccacctcctctgct

SEQ ID NO: 7785759 - DNA, 22 bp, Homo sapiens
tggtgctgcaggtgggcacagt

SEQ ID NO: 7785760 - DNA, 22 bp, Homo sapiens
tggtgctgtgatacgaggcact

SEQ ID NO: 7785761 - DNA, 22 bp, Homo sapiens
tggtggccttgatggcatctgc

SEQ ID NO: 7785762 - DNA, 22 bp, Homo sapiens
tggtggctaccaggtcctgggg

SEQ ID NO: 7785763 - DNA, 17 bp, Homo sapiens
tggtggctggagtcagg

SEQ ID NO: 7785764 - DNA, 17 bp, Homo sapiens
tggtggctggagtcagg

SEQ ID NO: 7785765 - DNA, 22 bp, Homo sapiens
tggtggcttctgaggatggcga

SEQ ID NO: 7785766 - DNA, 19 bp, Homo sapiens
tggtcccatactgctggcc

SEQ ID NO: 7785767 - DNA, 22 bp, Homo sapiens
tggtcccattgttctgcccagg

SEQ ID NO: 7785768 - DNA, 22 bp, Homo sapiens
tggtccctaggaaagcagtgtt

SEQ ID NO: 7785769 - DNA, 22 bp, Homo sapiens
tggtccctagcacagctgtcct

SEQ ID NO: 7785770 - DNA, 22 bp, Homo sapiens
tggtagggacactatgcagaaa

SEQ ID NO: 7785771 - DNA, 17 bp, Homo sapiens
tggtccaggtggagcca

SEQ ID NO: 7785772 - DNA, 22 bp, Homo sapiens
tggtccagtcgttcctttcctt

SEQ ID NO: 7785773 - DNA, 18 bp, Homo sapiens
tggtccagttcagatata

SEQ ID NO: 7785774 - DNA, 22 bp, Homo sapiens
tggtccagtcgttcctttcctt

SEQ ID NO: 7785775 - DNA, 22 bp, Homo sapiens
tggtccagtaagggtggagaga

SEQ ID NO: 7785776 - DNA, 22 bp, Homo sapiens
tggtccagtaagggtggagaga

SEQ ID NO: 7785777 - DNA, 22 bp, Homo sapiens
cctgccatgccagcatgcccgt

SEQ ID NO: 7785778 - DNA, 22 bp, Homo sapiens
cctgcccactccaggagcaact

SEQ ID NO: 7785779 - DNA, 22 bp, Homo sapiens
tggtgctgacagttctgagtgc

SEQ ID NO: 7785780 - DNA, 22 bp, Homo sapiens
tggtgctgagatgaagtgctcc

SEQ ID NO: 7785781 - DNA, 22 bp, Homo sapiens
tggtgctgataatggcaggatt

SEQ ID NO: 7785782 - DNA, 17 bp, Homo sapiens
cctgcccagagacagat

SEQ ID NO: 7785783 - DNA, 22 bp, Homo sapiens
cctgggtcccatcccagagtga

SEQ ID NO: 7785784 - DNA, 22 bp, Homo sapiens
cctgggtctgtattggtaggta

SEQ ID NO: 7785785 - DNA, 22 bp, Homo sapiens
cctggggctcaagatggcgccg

SEQ ID NO: 7785786 - DNA, 22 bp, Homo sapiens
tgtgttcatgttgattcatagc

SEQ ID NO: 7785787 - DNA, 22 bp, Homo sapiens
tgtgttcatgtatgtatacata

SEQ ID NO: 7785788 - DNA, 22 bp, Homo sapiens
tgtgttcagtatgacattcaca

SEQ ID NO: 7785789 - DNA, 22 bp, Homo sapiens
tgtgttcaatgacttcatcttt

SEQ ID NO: 7785790 - DNA, 22 bp, Homo sapiens
cctgggctttgctggcaaggcc

SEQ ID NO: 7785791 - DNA, 22 bp, Homo sapiens
cctgggccttgacctcgtgggc

SEQ ID NO: 7785792 - DNA, 22 bp, Homo sapiens
cctgggctttggaacagtactt

SEQ ID NO: 7785793 - DNA, 22 bp, Homo sapiens
cctggggaatcttgcaggggaa

SEQ ID NO: 7785794 - DNA, 22 bp, Homo sapiens
cctgggcctctcaaagtgctgg

SEQ ID NO: 7785795 - DNA, 19 bp, Homo sapiens
cctgggcctccatcacccc

SEQ ID NO: 7785796 - DNA, 22 bp, Homo sapiens
cctgggcctcacccagctcttg

SEQ ID NO: 7785797 - DNA, 22 bp, Homo sapiens
cctgggagctgtggaaaggctg

SEQ ID NO: 7785798 - DNA, 19 bp, Homo sapiens
cctgggaggcggaggttgc

SEQ ID NO: 7785799 - DNA, 22 bp, Homo sapiens
tgtggcaggaagagcttctgag

SEQ ID NO: 7785800 - DNA, 20 bp, Homo sapiens
tgtggcaggatgagggcgga

SEQ ID NO: 7785801 - DNA, 22 bp, Homo sapiens
tgtggaaaaaccacaagtttgg

SEQ ID NO: 7785802 - DNA, 22 bp, Homo sapiens
tgtggcaggcattctgaggctg

SEQ ID NO: 7785803 - DNA, 18 bp, Homo sapiens
tgtggcaggggtgggaga

SEQ ID NO: 7785804 - DNA, 22 bp, Homo sapiens
tgtggcagggatactgaggcag

SEQ ID NO: 7785805 - DNA, 22 bp, Homo sapiens
cctgggcctcacccagctcttg

SEQ ID NO: 7785806 - DNA, 22 bp, Homo sapiens
cctgggcatcaacaagcagaga

SEQ ID NO: 7785807 - DNA, 22 bp, Homo sapiens
cctgggccaggcttgggaatgc

SEQ ID NO: 7785808 - DNA, 22 bp, Homo sapiens
tgtgaaccttggtgagtcagta

SEQ ID NO: 7785809 - DNA, 22 bp, Homo sapiens
tgtctttggaatatttagctga

SEQ ID NO: 7785810 - DNA, 22 bp, Homo sapiens
tgtctttatgcacactgacttg

SEQ ID NO: 7785811 - DNA, 22 bp, Homo sapiens
tgtctttatatatttggaaaat

SEQ ID NO: 7785812 - DNA, 23 bp, Homo sapiens
tgtctttgaatgggctgtagaca

SEQ ID NO: 7785813 - DNA, 22 bp, Homo sapiens
tgtgaagctggatcctggagct

SEQ ID NO: 7785814 - DNA, 22 bp, Homo sapiens
tgtgaggcctagacagcctggg

SEQ ID NO: 7785815 - DNA, 22 bp, Homo sapiens
cctggctgcagtttttgcagaa

SEQ ID NO: 7785816 - DNA, 20 bp, Homo sapiens
cctggctgcattcaggacgg

SEQ ID NO: 7785817 - DNA, 22 bp, Homo sapiens
tgtgaggagtaggctgagggtg

SEQ ID NO: 7785818 - DNA, 22 bp, Homo sapiens
cctggctgaggggccaaggacc

SEQ ID NO: 7785819 - DNA, 22 bp, Homo sapiens
cctggctgagcctccaggaaga

SEQ ID NO: 7785820 - DNA, 21 bp, Homo sapiens
cctggctgcacagttgctggt

SEQ ID NO: 7785821 - DNA, 22 bp, Homo sapiens
cctggctgaacaaagtccctcc

SEQ ID NO: 7785822 - DNA, 22 bp, Homo sapiens
cctggctgacagcttaattcca

SEQ ID NO: 7785823 - DNA, 23 bp, Homo sapiens
cctggctgacctgaaggtgtagt

SEQ ID NO: 7785824 - DNA, 22 bp, Homo sapiens
cctggctcttcagaggttccta

SEQ ID NO: 7785825 - DNA, 22 bp, Homo sapiens
cctggctcttctgtgtcagccc

SEQ ID NO: 7785826 - DNA, 19 bp, Homo sapiens
cctggctctgagcccagcc

SEQ ID NO: 7785827 - DNA, 22 bp, Homo sapiens
tgtctttacttagaagttcagg

SEQ ID NO: 7785828 - DNA, 22 bp, Homo sapiens
tgtctttacttagaagttcagg

SEQ ID NO: 7785829 - DNA, 22 bp, Homo sapiens
tgtctttagaaagaagcagaca

SEQ ID NO: 7785830 - DNA, 22 bp, Homo sapiens
tgtctttacttaataaatatac

SEQ ID NO: 7785831 - DNA, 22 bp, Homo sapiens
tgtctttagccagcagtcttct

SEQ ID NO: 7785832 - DNA, 22 bp, Homo sapiens
tgtctttagttttactgtctgg

SEQ ID NO: 7785833 - DNA, 22 bp, Homo sapiens
tgtctttagttgcttagatttg

SEQ ID NO: 7785834 - DNA, 23 bp, Homo sapiens
tgtctgtcatggaatttcaaggt

SEQ ID NO: 7785835 - DNA, 22 bp, Homo sapiens
tgtctggtgggttgacaggcag

SEQ ID NO: 7785836 - DNA, 22 bp, Homo sapiens
cctggctgccgagtgtgcagcg

SEQ ID NO: 7785837 - DNA, 22 bp, Homo sapiens
cctggctgccttgtgttgatct

SEQ ID NO: 7785838 - DNA, 22 bp, Homo sapiens
cctggctgcattttgctggatg

SEQ ID NO: 7785839 - DNA, 22 bp, Homo sapiens
cctggctgcattttgctggatg

SEQ ID NO: 7785840 - DNA, 22 bp, Homo sapiens
cctggctgctgtcactgaccat

SEQ ID NO: 7785841 - DNA, 19 bp, Homo sapiens
cctggctgtgaagcctgca

SEQ ID NO: 7785842 - DNA, 22 bp, Homo sapiens
cctggctgtgcatgtttctatg

SEQ ID NO: 7785843 - DNA, 22 bp, Homo sapiens
cctggctgtgcattgccggccc

SEQ ID NO: 7785844 - DNA, 22 bp, Homo sapiens
cctggctgtgcattgccggccc

SEQ ID NO: 7785845 - DNA, 22 bp, Homo sapiens
cctggctgtttatttcggggct

SEQ ID NO: 7785846 - DNA, 22 bp, Homo sapiens
cctggctgtgtgaccttggcaa

SEQ ID NO: 7785847 - DNA, 22 bp, Homo sapiens
cctggctgtgtgaccttggcaa

SEQ ID NO: 7785848 - DNA, 22 bp, Homo sapiens
cctggctgtggcggtgctctca

SEQ ID NO: 7785849 - DNA, 22 bp, Homo sapiens
cctggctgtttgagcggggaat

SEQ ID NO: 7785850 - DNA, 22 bp, Homo sapiens
cctggctgtttgagcggggaat

SEQ ID NO: 7785851 - DNA, 22 bp, Homo sapiens
cctggcttctataccaccaggt

SEQ ID NO: 7785852 - DNA, 20 bp, Homo sapiens
cctggctttgcagcatgaga

SEQ ID NO: 7785853 - DNA, 22 bp, Homo sapiens
cctgggagagctgcccgggtga

SEQ ID NO: 7785854 - DNA, 21 bp, Homo sapiens
cctgggagatcagctgccttc

SEQ ID NO: 7785855 - DNA, 22 bp, Homo sapiens
tgtgcccattacacagaggcat

SEQ ID NO: 7785856 - DNA, 22 bp, Homo sapiens
tgtgcttcttgcagctcctgta

SEQ ID NO: 7785857 - DNA, 21 bp, Homo sapiens
tgtgccagggatggggagccc

SEQ ID NO: 7785858 - DNA, 22 bp, Homo sapiens
tgtgccaggccctggggaccaa

SEQ ID NO: 7785859 - DNA, 22 bp, Homo sapiens
tgtgcccatccctctggagtgt

SEQ ID NO: 7785860 - DNA, 20 bp, Homo sapiens
tgtgcccagcagaggctgcc

SEQ ID NO: 7785861 - DNA, 22 bp, Homo sapiens
tgtgcccagactgcctcagtga

SEQ ID NO: 7785862 - DNA, 22 bp, Homo sapiens
tgtgcccagactgcctcagtga

SEQ ID NO: 7785863 - DNA, 22 bp, Homo sapiens
caggaaaatgtcaatggaaagc

SEQ ID NO: 7785864 - DNA, 22 bp, Homo sapiens
caggaaaatggaatcacctgta

SEQ ID NO: 7785865 - DNA, 22 bp, Homo sapiens
cagctttgattcactgcctagt

SEQ ID NO: 7785866 - DNA, 22 bp, Homo sapiens
cagctttgagcagccagtggca

SEQ ID NO: 7785867 - DNA, 22 bp, Homo sapiens
cagctttgagagttgcatttta

SEQ ID NO: 7785868 - DNA, 22 bp, Homo sapiens
cagctttgacctaaagtaggaa

SEQ ID NO: 7785869 - DNA, 22 bp, Homo sapiens
cagctttgaaacatggctctag

SEQ ID NO: 7785870 - DNA, 22 bp, Homo sapiens
cagctttattaatgattgtctt

SEQ ID NO: 7785871 - DNA, 22 bp, Homo sapiens
cagctttaggactcataataaa

SEQ ID NO: 7785872 - DNA, 22 bp, Homo sapiens
cagctttagagaaaacatattt

SEQ ID NO: 7785873 - DNA, 22 bp, Homo sapiens
cagctttagagaaaacatattt

SEQ ID NO: 7785874 - DNA, 22 bp, Homo sapiens
caggaaacggctattcttttgt

SEQ ID NO: 7785875 - DNA, 22 bp, Homo sapiens
caggaaacatatgtgcttgagg

SEQ ID NO: 7785876 - DNA, 22 bp, Homo sapiens
gttcacagcttcttaggtcata

SEQ ID NO: 7785877 - DNA, 22 bp, Homo sapiens
gttattcaatggcttataagga

SEQ ID NO: 7785878 - DNA, 22 bp, Homo sapiens
gttattaaagtatttgatgtta

SEQ ID NO: 7785879 - DNA, 22 bp, Homo sapiens
gttacatttattagaggtctct

SEQ ID NO: 7785880 - DNA, 22 bp, Homo sapiens
cagcttggcttccgctttactg

SEQ ID NO: 7785881 - DNA, 22 bp, Homo sapiens
cagcttgggagtttggttttat

SEQ ID NO: 7785882 - DNA, 22 bp, Homo sapiens
cagcttggcttcacattctgta

SEQ ID NO: 7785883 - DNA, 22 bp, Homo sapiens
cagcttgggggcgctggcctca

SEQ ID NO: 7785884 - DNA, 22 bp, Homo sapiens
cagcttgggtcaggtgcctgct

SEQ ID NO: 7785885 - DNA, 22 bp, Homo sapiens
cagcttggaggaggatctaaga

SEQ ID NO: 7785886 - DNA, 22 bp, Homo sapiens
cagcttgctaactggtaggggt

SEQ ID NO: 7785887 - DNA, 20 bp, Homo sapiens
cagcttggatgagaggctga

SEQ ID NO: 7785888 - DNA, 22 bp, Homo sapiens
cagcttctccagatgaccctca

SEQ ID NO: 7785889 - DNA, 22 bp, Homo sapiens
cagcttctagcatcggctttga

SEQ ID NO: 7785890 - DNA, 22 bp, Homo sapiens
cagcttctatttatctttgtgt

SEQ ID NO: 7785891 - DNA, 22 bp, Homo sapiens
cagcttctcagaaagctgaggt

SEQ ID NO: 7785892 - DNA, 22 bp, Homo sapiens
cagcttctcagaaagctgaggt

SEQ ID NO: 7785893 - DNA, 22 bp, Homo sapiens
cagcttctcgggagcgcatgtg

SEQ ID NO: 7785894 - DNA, 21 bp, Homo sapiens
cagcttctgaaggtgtaggaa

SEQ ID NO: 7785895 - DNA, 22 bp, Homo sapiens
cagcttctgagcaagccagggg

SEQ ID NO: 7785896 - DNA, 22 bp, Homo sapiens
cagctgtttgggcatggccaga

SEQ ID NO: 7785897 - DNA, 22 bp, Homo sapiens
cagcttcaactgcacagtcaac

SEQ ID NO: 7785898 - DNA, 22 bp, Homo sapiens
cagcttcagaagaagccgtgag

SEQ ID NO: 7785899 - DNA, 22 bp, Homo sapiens
cagcttcagcgtgacaccagtg

SEQ ID NO: 7785900 - DNA, 22 bp, Homo sapiens
cagcttcatgacaaacagtttt

SEQ ID NO: 7785901 - DNA, 22 bp, Homo sapiens
cagctgtgctgattgctcagta

SEQ ID NO: 7785902 - DNA, 22 bp, Homo sapiens
cagctgtgctgtattaagctct

SEQ ID NO: 7785903 - DNA, 22 bp, Homo sapiens
cagctgtgtaaacacatgtgta

SEQ ID NO: 7785904 - DNA, 22 bp, Homo sapiens
gtgttttattggtgcagtcaga

SEQ ID NO: 7785905 - DNA, 22 bp, Homo sapiens
gttacaaatgccaaagctgaga

SEQ ID NO: 7785906 - DNA, 22 bp, Homo sapiens
gttacaaatgtaaattctgggg

SEQ ID NO: 7785907 - DNA, 22 bp, Homo sapiens
gttacaaatgtaaattctgggg

SEQ ID NO: 7785908 - DNA, 22 bp, Homo sapiens
gttacaatgtccttacatgaaa

SEQ ID NO: 7785909 - DNA, 22 bp, Homo sapiens
gtgttttatggagtcataacgt

SEQ ID NO: 7785910 - DNA, 22 bp, Homo sapiens
gtgttttatcagacaaagtata

SEQ ID NO: 7785911 - DNA, 22 bp, Homo sapiens
gtgttttagtgctgctgagctg

SEQ ID NO: 7785912 - DNA, 22 bp, Homo sapiens
gtgttttaagaaagaagctcag

SEQ ID NO: 7785913 - DNA, 22 bp, Homo sapiens
gttggagtgcagcttgtgcgat

SEQ ID NO: 7785914 - DNA, 22 bp, Homo sapiens
caggaaagggatgggctgccac

SEQ ID NO: 7785915 - DNA, 22 bp, Homo sapiens
caggaaaggtgtgtcatgatgg

SEQ ID NO: 7785916 - DNA, 22 bp, Homo sapiens
caggaaattttgtgatctgttc

SEQ ID NO: 7785917 - DNA, 22 bp, Homo sapiens
caggaaatttaagagtgtacaa

SEQ ID NO: 7785918 - DNA, 22 bp, Homo sapiens
caggaaatttatgttctactta

SEQ ID NO: 7785919 - DNA, 22 bp, Homo sapiens
caggaaattggctatttgggat

SEQ ID NO: 7785920 - DNA, 22 bp, Homo sapiens
caggaaatttaagagtgtacaa

SEQ ID NO: 7785921 - DNA, 22 bp, Homo sapiens
caggaaattctttttaacagaa

SEQ ID NO: 7785922 - DNA, 22 bp, Homo sapiens
caggaaattctttttaacagaa

SEQ ID NO: 7785923 - DNA, 22 bp, Homo sapiens
caggaaattcttttgtttgtgc

SEQ ID NO: 7785924 - DNA, 22 bp, Homo sapiens
caggaaattgcaacagtctgag

SEQ ID NO: 7785925 - DNA, 22 bp, Homo sapiens
caggaaatgtataattttataa

SEQ ID NO: 7785926 - DNA, 22 bp, Homo sapiens
caggaaatgggtcgttttataa

SEQ ID NO: 7785927 - DNA, 23 bp, Homo sapiens
caggaaatgttcttgaagcctga

SEQ ID NO: 7785928 - DNA, 22 bp, Homo sapiens
caggaaattagtctctctgttg

SEQ ID NO: 7785929 - DNA, 22 bp, Homo sapiens
caggaaattcccagaaggactg

SEQ ID NO: 7785930 - DNA, 22 bp, Homo sapiens
caggaaattcaagagaggctgc

SEQ ID NO: 7785931 - DNA, 22 bp, Homo sapiens
caggaaattcaagagaggctgc

SEQ ID NO: 7785932 - DNA, 22 bp, Homo sapiens
caggaaatggggtttagttatt

SEQ ID NO: 7785933 - DNA, 22 bp, Homo sapiens
caggaaatggctgaataaattc

SEQ ID NO: 7785934 - DNA, 22 bp, Homo sapiens
caggaaataggcgtttgtcctc

SEQ ID NO: 7785935 - DNA, 22 bp, Homo sapiens
caggaaatagttcagtcaaact

SEQ ID NO: 7785936 - DNA, 22 bp, Homo sapiens
caggaaatagacactgtatgat

SEQ ID NO: 7785937 - DNA, 22 bp, Homo sapiens
caggaaataaatggtaatgcat

SEQ ID NO: 7785938 - DNA, 22 bp, Homo sapiens
caggaaataaaaagtatcttct

SEQ ID NO: 7785939 - DNA, 22 bp, Homo sapiens
gttcctgggaggcatgggctgg

SEQ ID NO: 7785940 - DNA, 22 bp, Homo sapiens
gttctgggaaggtggacctgtt

SEQ ID NO: 7785941 - DNA, 22 bp, Homo sapiens
gttcacagtctacatagtaaag

SEQ ID NO: 7785942 - DNA, 22 bp, Homo sapiens
gttcttaagaccacaataaaaa

SEQ ID NO: 7785943 - DNA, 22 bp, Homo sapiens
gttcttaaagattcatcaagca

SEQ ID NO: 7785944 - DNA, 22 bp, Homo sapiens
gttctgggttctgggttattgg

SEQ ID NO: 7785945 - DNA, 22 bp, Homo sapiens
gttctgggttcaaaccccggcc

SEQ ID NO: 7785946 - DNA, 22 bp, Homo sapiens
gttctgggtgatgaggttggct

SEQ ID NO: 7785947 - DNA, 22 bp, Homo sapiens
gttctgggtgatgaggttggct

SEQ ID NO: 7785948 - DNA, 22 bp, Homo sapiens
gttctgggtctggacacacaga

SEQ ID NO: 7785949 - DNA, 22 bp, Homo sapiens
gttctgggtagatgtatctttt

SEQ ID NO: 7785950 - DNA, 22 bp, Homo sapiens
gttctgggagatcttgagcttc

SEQ ID NO: 7785951 - DNA, 22 bp, Homo sapiens
gttgctgcaaaggagtgtaggt

SEQ ID NO: 7785952 - DNA, 22 bp, Homo sapiens
caggaagagaacatggaggctg

SEQ ID NO: 7785953 - DNA, 22 bp, Homo sapiens
caggaagaggtatcaccgagca

SEQ ID NO: 7785954 - DNA, 19 bp, Homo sapiens
caggaacatggagggaggg

SEQ ID NO: 7785955 - DNA, 22 bp, Homo sapiens
caggaagattagaccaagagct

SEQ ID NO: 7785956 - DNA, 22 bp, Homo sapiens
gtttacatatgtctgtctgcac

SEQ ID NO: 7785957 - DNA, 22 bp, Homo sapiens
gtttacatgcagaaaatcaatg

SEQ ID NO: 7785958 - DNA, 22 bp, Homo sapiens
gtttacatattttaattggtga

SEQ ID NO: 7785959 - DNA, 22 bp, Homo sapiens
gtttattccagcaatctgctta

SEQ ID NO: 7785960 - DNA, 22 bp, Homo sapiens
gtttattattcaacttcatgtt

SEQ ID NO: 7785961 - DNA, 18 bp, Homo sapiens
gtttacattactgaatag

SEQ ID NO: 7785962 - DNA, 22 bp, Homo sapiens
gtttacatgtactcattatact

SEQ ID NO: 7785963 - DNA, 22 bp, Homo sapiens
gtttacatgtaatgtgttattg

SEQ ID NO: 7785964 - DNA, 22 bp, Homo sapiens
gtttacatgcatgcaagaatga

SEQ ID NO: 7785965 - DNA, 22 bp, Homo sapiens
gtttacatgtttttctcttaca

SEQ ID NO: 7785966 - DNA, 22 bp, Homo sapiens
gtttacattaagtattagcatc

SEQ ID NO: 7785967 - DNA, 22 bp, Homo sapiens
gtttattgataaaagctggaca

SEQ ID NO: 7785968 - DNA, 22 bp, Homo sapiens
gtttcaaagcacagctcacatt

SEQ ID NO: 7785969 - DNA, 18 bp, Homo sapiens
gtttgctacattcacttg

SEQ ID NO: 7785970 - DNA, 22 bp, Homo sapiens
cagcccagccttgtctctttat

SEQ ID NO: 7785971 - DNA, 22 bp, Homo sapiens
cagcccagccttgtctctttat

SEQ ID NO: 7785972 - DNA, 22 bp, Homo sapiens
cagcccagcgcaaacaactggc

SEQ ID NO: 7785973 - DNA, 21 bp, Homo sapiens
cagcccagcttcttccccagt

SEQ ID NO: 7785974 - DNA, 22 bp, Homo sapiens
gtggcagaaactggcagaggag

SEQ ID NO: 7785975 - DNA, 22 bp, Homo sapiens
cagcccaggccgacagttcctc

SEQ ID NO: 7785976 - DNA, 22 bp, Homo sapiens
cagcccaggactgcaggtgttt

SEQ ID NO: 7785977 - DNA, 22 bp, Homo sapiens
cagcccaggactgcaggtgttt

SEQ ID NO: 7785978 - DNA, 22 bp, Homo sapiens
gtggcagaaactggcagaggag

SEQ ID NO: 7785979 - DNA, 22 bp, Homo sapiens
gtggcagagaacaaggagaggt

SEQ ID NO: 7785980 - DNA, 22 bp, Homo sapiens
gtggcagagaacaaggagaggt

SEQ ID NO: 7785981 - DNA, 22 bp, Homo sapiens
gtggcagagagcaagtgtctga

SEQ ID NO: 7785982 - DNA, 22 bp, Homo sapiens
gtggcagtcggaagtcaggaga

SEQ ID NO: 7785983 - DNA, 22 bp, Homo sapiens
gtggcagtcatcaaggacagat

SEQ ID NO: 7785984 - DNA, 22 bp, Homo sapiens
gtggcagtctcatctgtggctc

SEQ ID NO: 7785985 - DNA, 22 bp, Homo sapiens
gtggcaggttccgtagacagca

SEQ ID NO: 7785986 - DNA, 22 bp, Homo sapiens
gtggcagtgaggcaggagcagt

SEQ ID NO: 7785987 - DNA, 19 bp, Homo sapiens
gtggccagggcaggggctg

SEQ ID NO: 7785988 - DNA, 22 bp, Homo sapiens
gtggccaggtcagggacttgtg

SEQ ID NO: 7785989 - DNA, 22 bp, Homo sapiens
gtggccagtcccgatgcttgtt

SEQ ID NO: 7785990 - DNA, 22 bp, Homo sapiens
cagctctgtgcaggcctgggga

SEQ ID NO: 7785991 - DNA, 22 bp, Homo sapiens
cagctctgtctgtagaaacttc

SEQ ID NO: 7785992 - DNA, 22 bp, Homo sapiens
gtggcccacacagacagcatct

SEQ ID NO: 7785993 - DNA, 22 bp, Homo sapiens
cagctctgctggtggtgccagg

SEQ ID NO: 7785994 - DNA, 22 bp, Homo sapiens
gtggcttggaccagtcacagtg

SEQ ID NO: 7785995 - DNA, 22 bp, Homo sapiens
gtggcgaggggaggtcctggcg

SEQ ID NO: 7785996 - DNA, 22 bp, Homo sapiens
gtgggcaggccccaaagcaggg

SEQ ID NO: 7785997 - DNA, 22 bp, Homo sapiens
cagctgaacatgtagagcatct

SEQ ID NO: 7785998 - DNA, 22 bp, Homo sapiens
cagctcttttttgcagcagctg

SEQ ID NO: 7785999 - DNA, 22 bp, Homo sapiens
cagctgagctcccaggccatca

SEQ ID NO: 7786000 - DNA, 23 bp, Homo sapiens
cagctgaagcagcctgggctgga

SEQ ID NO: 7786001 - DNA, 22 bp, Homo sapiens
cagctgagtctgaggttctttg

SEQ ID NO: 7786002 - DNA, 22 bp, Homo sapiens
cagctgaggtcaaagaagcagg

SEQ ID NO: 7786003 - DNA, 22 bp, Homo sapiens
cagctgagttactctgaggtct

SEQ ID NO: 7786004 - DNA, 22 bp, Homo sapiens
cagctgagtgttggcatgttca

SEQ ID NO: 7786005 - DNA, 22 bp, Homo sapiens
cagctgctgcccttggctgcag

SEQ ID NO: 7786006 - DNA, 22 bp, Homo sapiens
cagctgctcttctggcctgtca

SEQ ID NO: 7786007 - DNA, 22 bp, Homo sapiens
cagctgctctggtggtctctcc

SEQ ID NO: 7786008 - DNA, 22 bp, Homo sapiens
cagctgcctgtctggaggcaat

SEQ ID NO: 7786009 - DNA, 22 bp, Homo sapiens
cagctggctgcggtgaggggac

SEQ ID NO: 7786010 - DNA, 22 bp, Homo sapiens
gtgggtggatcacctgaggtca

SEQ ID NO: 7786011 - DNA, 22 bp, Homo sapiens
cagctggctgcatgatgccaaa

SEQ ID NO: 7786012 - DNA, 22 bp, Homo sapiens
cagctggctccacctctgggct

SEQ ID NO: 7786013 - DNA, 22 bp, Homo sapiens
cagctggctccacctctgggct

SEQ ID NO: 7786014 - DNA, 22 bp, Homo sapiens
cagctggcgcctggggaccaga

SEQ ID NO: 7786015 - DNA, 22 bp, Homo sapiens
cagctggcgggcagagccgcca

SEQ ID NO: 7786016 - DNA, 22 bp, Homo sapiens
cagctggcgtggagtgattgca

SEQ ID NO: 7786017 - DNA, 22 bp, Homo sapiens
cagctggcgtggagtgattgca

SEQ ID NO: 7786018 - DNA, 22 bp, Homo sapiens
cagctggctccacctctgggct

SEQ ID NO: 7786019 - DNA, 22 bp, Homo sapiens
cagctggccccacagtagaggc

SEQ ID NO: 7786020 - DNA, 22 bp, Homo sapiens
cagctggccctttggtagcctt

SEQ ID NO: 7786021 - DNA, 22 bp, Homo sapiens
cagctggccccacagtagaggc

SEQ ID NO: 7786022 - DNA, 22 bp, Homo sapiens
cagctggccaatcagggcgccc

SEQ ID NO: 7786023 - DNA, 22 bp, Homo sapiens
cagctggcctgatccctgtggc

SEQ ID NO: 7786024 - DNA, 22 bp, Homo sapiens
cagctggcctgagcggtggcgg

SEQ ID NO: 7786025 - DNA, 22 bp, Homo sapiens
cagctggcctgagcggtggcgg

SEQ ID NO: 7786026 - DNA, 22 bp, Homo sapiens
gtggggagtgttctgtgattgg

SEQ ID NO: 7786027 - DNA, 22 bp, Homo sapiens
cagctgatttgagaaagaatga

SEQ ID NO: 7786028 - DNA, 22 bp, Homo sapiens
cagctgcctgtattgtcctcat

SEQ ID NO: 7786029 - DNA, 20 bp, Homo sapiens
cagctgcctggctctgggat

SEQ ID NO: 7786030 - DNA, 22 bp, Homo sapiens
cagctgcctatgacctagcctc

SEQ ID NO: 7786031 - DNA, 22 bp, Homo sapiens
cagctgcatgtctgtggtggtc

SEQ ID NO: 7786032 - DNA, 18 bp, Homo sapiens
cagctgcaggctcaggac

SEQ ID NO: 7786033 - DNA, 22 bp, Homo sapiens
gtgtctttattcctctatgttt

SEQ ID NO: 7786034 - DNA, 22 bp, Homo sapiens
gtgtcaaatccactcctctttt

SEQ ID NO: 7786035 - DNA, 22 bp, Homo sapiens
cagctgggtgatcttgggcagg

SEQ ID NO: 7786036 - DNA, 22 bp, Homo sapiens
cagctgggctaagagtagaggc

SEQ ID NO: 7786037 - DNA, 22 bp, Homo sapiens
cagctgggcctcctgagccctg

SEQ ID NO: 7786038 - DNA, 22 bp, Homo sapiens
cagctgtcttttctaaatatta

SEQ ID NO: 7786039 - DNA, 22 bp, Homo sapiens
cagctgtctcagggaggtgatc

SEQ ID NO: 7786040 - DNA, 22 bp, Homo sapiens
cagctggctgcggtgaggggac

SEQ ID NO: 7786041 - DNA, 22 bp, Homo sapiens
cagctggctgcggtgaggggac

SEQ ID NO: 7786042 - DNA, 22 bp, Homo sapiens
cagctggctgcggtgaggggac

SEQ ID NO: 7786043 - DNA, 22 bp, Homo sapiens
cagctggctggtcagtgcacaa

SEQ ID NO: 7786044 - DNA, 22 bp, Homo sapiens
gtgtgctgcccaactcgcagat

SEQ ID NO: 7786045 - DNA, 22 bp, Homo sapiens
caggatggtggcatgatcagaa

SEQ ID NO: 7786046 - DNA, 22 bp, Homo sapiens
caggatggtggcatgatcagaa

SEQ ID NO: 7786047 - DNA, 22 bp, Homo sapiens
caggatgatgttaattgaagtt

SEQ ID NO: 7786048 - DNA, 22 bp, Homo sapiens
caggatcctggctgcatggacg

SEQ ID NO: 7786049 - DNA, 22 bp, Homo sapiens
caggatccctggcctccgccca

SEQ ID NO: 7786050 - DNA, 22 bp, Homo sapiens
taagaaacatttttatgacagt

SEQ ID NO: 7786051 - DNA, 22 bp, Homo sapiens
taagaaacatttttatgacagt

SEQ ID NO: 7786052 - DNA, 22 bp, Homo sapiens
taactttaggaataggtaatct

SEQ ID NO: 7786053 - DNA, 22 bp, Homo sapiens
taagaaacatgatacttttcct

SEQ ID NO: 7786054 - DNA, 22 bp, Homo sapiens
taagaaacatgatacttttcct

SEQ ID NO: 7786055 - DNA, 22 bp, Homo sapiens
taagaaacatgattaatggcag

SEQ ID NO: 7786056 - DNA, 22 bp, Homo sapiens
taagaaacatgatacttttcct

SEQ ID NO: 7786057 - DNA, 22 bp, Homo sapiens
taacttgtgttacattactctt

SEQ ID NO: 7786058 - DNA, 19 bp, Homo sapiens
taacttgtagatatgaagt

SEQ ID NO: 7786059 - DNA, 22 bp, Homo sapiens
taacatttaaatttttcacata

SEQ ID NO: 7786060 - DNA, 22 bp, Homo sapiens
taacaatacccattctaattac

SEQ ID NO: 7786061 - DNA, 22 bp, Homo sapiens
taacaatacccattctaattac

SEQ ID NO: 7786062 - DNA, 22 bp, Homo sapiens
taacaaggagatggtgggtcat

SEQ ID NO: 7786063 - DNA, 22 bp, Homo sapiens
taacaaggcaatttgtgatcct

SEQ ID NO: 7786064 - DNA, 19 bp, Homo sapiens
taacaaagtctgaagtcag

SEQ ID NO: 7786065 - DNA, 22 bp, Homo sapiens
taacaactcagtttgttccttg

SEQ ID NO: 7786066 - DNA, 22 bp, Homo sapiens
taacaactggacaatgttgctc

SEQ ID NO: 7786067 - DNA, 22 bp, Homo sapiens
taacaacttgcttttatcttag

SEQ ID NO: 7786068 - DNA, 22 bp, Homo sapiens
taacattaggtagacataagcc

SEQ ID NO: 7786069 - DNA, 22 bp, Homo sapiens
taacattcttaacttagaaaca

SEQ ID NO: 7786070 - DNA, 22 bp, Homo sapiens
taacattgagtccactaaacag

SEQ ID NO: 7786071 - DNA, 22 bp, Homo sapiens
taaggcagaaatatgagcaggg

SEQ ID NO: 7786072 - DNA, 22 bp, Homo sapiens
taagcaaatagctagatcagag

SEQ ID NO: 7786073 - DNA, 22 bp, Homo sapiens
taagcaaataatgcatcaaggg

SEQ ID NO: 7786074 - DNA, 22 bp, Homo sapiens
taaggcagcctcagggtagggt

SEQ ID NO: 7786075 - DNA, 22 bp, Homo sapiens
caggcagaaattttgtttcatt

SEQ ID NO: 7786076 - DNA, 22 bp, Homo sapiens
caggcagaaagtattctgtgta

SEQ ID NO: 7786077 - DNA, 22 bp, Homo sapiens
taaggcagaggtaccactaggc

SEQ ID NO: 7786078 - DNA, 22 bp, Homo sapiens
taaggcagatgtggaatcaatt

SEQ ID NO: 7786079 - DNA, 19 bp, Homo sapiens
taaggcagcagtgacaggc

SEQ ID NO: 7786080 - DNA, 22 bp, Homo sapiens
taaggcagcataattaggccac

SEQ ID NO: 7786081 - DNA, 22 bp, Homo sapiens
taaggcagccgctcagagaggt

SEQ ID NO: 7786082 - DNA, 22 bp, Homo sapiens
taagatgtcaaagggtcacagt

SEQ ID NO: 7786083 - DNA, 22 bp, Homo sapiens
taagcaaagtttataaggctct

SEQ ID NO: 7786084 - DNA, 22 bp, Homo sapiens
taagatttttaaaatgtcctca

SEQ ID NO: 7786085 - DNA, 22 bp, Homo sapiens
caggcacatgggagctcatcat

SEQ ID NO: 7786086 - DNA, 22 bp, Homo sapiens
taagacaattcttcagtcacaa

SEQ ID NO: 7786087 - DNA, 22 bp, Homo sapiens
caggcacagtgttgctgttcaa

SEQ ID NO: 7786088 - DNA, 22 bp, Homo sapiens
caggcacagtgttgctgttcaa

SEQ ID NO: 7786089 - DNA, 17 bp, Homo sapiens
caggcacatgaagccag

SEQ ID NO: 7786090 - DNA, 22 bp, Homo sapiens
caggcacatgggagctcatcat

SEQ ID NO: 7786091 - DNA, 22 bp, Homo sapiens
caggcacagctgggcaattgcg

SEQ ID NO: 7786092 - DNA, 22 bp, Homo sapiens
caggcacagctaagactggcca

SEQ ID NO: 7786093 - DNA, 22 bp, Homo sapiens
caggcacaaatttctagataag

SEQ ID NO: 7786094 - DNA, 22 bp, Homo sapiens
caggcacaatgagcgccatctt

SEQ ID NO: 7786095 - DNA, 22 bp, Homo sapiens
caggcacaagatcggctagata

SEQ ID NO: 7786096 - DNA, 22 bp, Homo sapiens
caggcaaggaggcactgaggga

SEQ ID NO: 7786097 - DNA, 22 bp, Homo sapiens
caggcaaggagctggctcaagt

SEQ ID NO: 7786098 - DNA, 22 bp, Homo sapiens
caggcaagcaaggggtcttgaa

SEQ ID NO: 7786099 - DNA, 22 bp, Homo sapiens
caggattgagcaaatggattat

SEQ ID NO: 7786100 - DNA, 22 bp, Homo sapiens
caggcaagatccagaggctgct

SEQ ID NO: 7786101 - DNA, 22 bp, Homo sapiens
caggatggtgtgagtgtgagga

SEQ ID NO: 7786102 - DNA, 22 bp, Homo sapiens
caggcaggctgctttttgttca

SEQ ID NO: 7786103 - DNA, 22 bp, Homo sapiens
caggcaggagccagggattcca

SEQ ID NO: 7786104 - DNA, 22 bp, Homo sapiens
caggcagctgcgacaagagagc

SEQ ID NO: 7786105 - DNA, 22 bp, Homo sapiens
caggcagctgctgggttcagcc

SEQ ID NO: 7786106 - DNA, 22 bp, Homo sapiens
caggcagctgggtcaccgtccc

SEQ ID NO: 7786107 - DNA, 22 bp, Homo sapiens
caggcaggagacatttggttgg

SEQ ID NO: 7786108 - DNA, 22 bp, Homo sapiens
caggcagcatcagtctgctgta

SEQ ID NO: 7786109 - DNA, 22 bp, Homo sapiens
caggcagctctaatggaaagtg

SEQ ID NO: 7786110 - DNA, 22 bp, Homo sapiens
caggcagctctaatggaaagtg

SEQ ID NO: 7786111 - DNA, 22 bp, Homo sapiens
caggcagctgactgtcagatat

SEQ ID NO: 7786112 - DNA, 22 bp, Homo sapiens
caggcagagacgtcagtgtagg

SEQ ID NO: 7786113 - DNA, 22 bp, Homo sapiens
caggcagagaccctctcctaaa

SEQ ID NO: 7786114 - DNA, 22 bp, Homo sapiens
caggcagagaggagcatttaat

SEQ ID NO: 7786115 - DNA, 22 bp, Homo sapiens
caggcagagacgtcagtgtagg

SEQ ID NO: 7786116 - DNA, 22 bp, Homo sapiens
caggcagagaactcatccgtga

SEQ ID NO: 7786117 - DNA, 22 bp, Homo sapiens
caggcagagaactcatccgtga

SEQ ID NO: 7786118 - DNA, 22 bp, Homo sapiens
caggcagacatttttgacatag

SEQ ID NO: 7786119 - DNA, 22 bp, Homo sapiens
caggcagactttgagaatgatg

SEQ ID NO: 7786120 - DNA, 22 bp, Homo sapiens
caggcagaaggaagtaccaggc

SEQ ID NO: 7786121 - DNA, 22 bp, Homo sapiens
caggcagaaggaagtaccaggc

SEQ ID NO: 7786122 - DNA, 22 bp, Homo sapiens
caggcagaagaagtggaaggac

SEQ ID NO: 7786123 - DNA, 22 bp, Homo sapiens
caggcagaatgagattacttca

SEQ ID NO: 7786124 - DNA, 17 bp, Homo sapiens
caggcagacatgtaagc

SEQ ID NO: 7786125 - DNA, 22 bp, Homo sapiens
caggcagaaggaagtaccaggc

SEQ ID NO: 7786126 - DNA, 22 bp, Homo sapiens
caggcagaatgaccgacctcgc

SEQ ID NO: 7786127 - DNA, 22 bp, Homo sapiens
caggcagaaggaagtaccaggc

SEQ ID NO: 7786128 - DNA, 22 bp, Homo sapiens
caggcagagccaatcgtggggt

SEQ ID NO: 7786129 - DNA, 22 bp, Homo sapiens
caggcagagcaactggtccaga

SEQ ID NO: 7786130 - DNA, 22 bp, Homo sapiens
caggcagagcaactggtccaga

SEQ ID NO: 7786131 - DNA, 22 bp, Homo sapiens
tacagtaaagctgctatgaatt

SEQ ID NO: 7786132 - DNA, 22 bp, Homo sapiens
tacagtaaatgtggtagaaact

SEQ ID NO: 7786133 - DNA, 22 bp, Homo sapiens
tacaggtggtaaaaatattgtt

SEQ ID NO: 7786134 - DNA, 22 bp, Homo sapiens
tacagtaaatgtggtagaaact

SEQ ID NO: 7786135 - DNA, 22 bp, Homo sapiens
tacagtaacatgttgtacaagc

SEQ ID NO: 7786136 - DNA, 22 bp, Homo sapiens
tacagtaaccagtctacttaga

SEQ ID NO: 7786137 - DNA, 22 bp, Homo sapiens
tacagtaaccttatttgtcatt

SEQ ID NO: 7786138 - DNA, 22 bp, Homo sapiens
tacatcaagataaaaactgtca

SEQ ID NO: 7786139 - DNA, 20 bp, Homo sapiens
tacaaattttccatgtttcc

SEQ ID NO: 7786140 - DNA, 22 bp, Homo sapiens
tacaaactaacatgtctcatcc

SEQ ID NO: 7786141 - DNA, 22 bp, Homo sapiens
caggcagggagctggaaaggat

SEQ ID NO: 7786142 - DNA, 22 bp, Homo sapiens
tacaagttccattttgaaagtg

SEQ ID NO: 7786143 - DNA, 21 bp, Homo sapiens
tacaagttgcttttgaagtcc

SEQ ID NO: 7786144 - DNA, 23 bp, Homo sapiens
caggagggaatgaagttagacaa

SEQ ID NO: 7786145 - DNA, 22 bp, Homo sapiens
caggaggcgtcttcagtttgtt

SEQ ID NO: 7786146 - DNA, 22 bp, Homo sapiens
caggaggcccggccacagccca

SEQ ID NO: 7786147 - DNA, 22 bp, Homo sapiens
caggaggcgtcttcagtttgtt

SEQ ID NO: 7786148 - DNA, 22 bp, Homo sapiens
caggaggctttgggatccaagt

SEQ ID NO: 7786149 - DNA, 22 bp, Homo sapiens
caggaggccaactgtgggactt

SEQ ID NO: 7786150 - DNA, 22 bp, Homo sapiens
caggaggcatcatggagcggac

SEQ ID NO: 7786151 - DNA, 22 bp, Homo sapiens
caggaggcccaaagggcgcaga

SEQ ID NO: 7786152 - DNA, 22 bp, Homo sapiens
caggaggcccggccacagccca

SEQ ID NO: 7786153 - DNA, 22 bp, Homo sapiens
caggaggcccacaggcccctgc

SEQ ID NO: 7786154 - DNA, 22 bp, Homo sapiens
caggagtgtctccacacagcaa

SEQ ID NO: 7786155 - DNA, 22 bp, Homo sapiens
caggagtgtcgggtcactaggt

SEQ ID NO: 7786156 - DNA, 22 bp, Homo sapiens
taacaaagtaccatagattggg

SEQ ID NO: 7786157 - DNA, 22 bp, Homo sapiens
caggagtgttgattgctcagga

SEQ ID NO: 7786158 - DNA, 22 bp, Homo sapiens
caggatagaaaggccatggagt

SEQ ID NO: 7786159 - DNA, 22 bp, Homo sapiens
caggataaatagtaaatgtaag

SEQ ID NO: 7786160 - DNA, 20 bp, Homo sapiens
caggaggcaaggtcaaggtc

SEQ ID NO: 7786161 - DNA, 22 bp, Homo sapiens
caggaggaaatgtgaccctgct

SEQ ID NO: 7786162 - DNA, 22 bp, Homo sapiens
caggaggaaatgtgaccctgct

SEQ ID NO: 7786163 - DNA, 22 bp, Homo sapiens
caggaggaaagttccactcaac

SEQ ID NO: 7786164 - DNA, 22 bp, Homo sapiens
caggaggaaatgtgaccctgct

SEQ ID NO: 7786165 - DNA, 22 bp, Homo sapiens
caggaggcagcgctctcaggac

SEQ ID NO: 7786166 - DNA, 22 bp, Homo sapiens
caggaggcagaggatgcccagt

SEQ ID NO: 7786167 - DNA, 22 bp, Homo sapiens
caggaggcagaggatgcccagt

SEQ ID NO: 7786168 - DNA, 22 bp, Homo sapiens
caggaggcagaggttgcagcga

SEQ ID NO: 7786169 - DNA, 22 bp, Homo sapiens
caggaggcagaggttgcagtga

SEQ ID NO: 7786170 - DNA, 22 bp, Homo sapiens
caggaggcagaggttgcagtga

SEQ ID NO: 7786171 - DNA, 22 bp, Homo sapiens
taaatgtataggcactaaacct

SEQ ID NO: 7786172 - DNA, 22 bp, Homo sapiens
taaatgtcaatgtgatttataa

SEQ ID NO: 7786173 - DNA, 22 bp, Homo sapiens
caggagctgggtctggaagcag

SEQ ID NO: 7786174 - DNA, 22 bp, Homo sapiens
caggagcttctgcccatggcca

SEQ ID NO: 7786175 - DNA, 22 bp, Homo sapiens
caggaggaaactggattcactt

SEQ ID NO: 7786176 - DNA, 22 bp, Homo sapiens
caggagctgggtctggaagcag

SEQ ID NO: 7786177 - DNA, 22 bp, Homo sapiens
caggagagatatgagtccccac

SEQ ID NO: 7786178 - DNA, 22 bp, Homo sapiens
caggagagatatgagtccccac

SEQ ID NO: 7786179 - DNA, 22 bp, Homo sapiens
caggagaggaggctacttctta

SEQ ID NO: 7786180 - DNA, 22 bp, Homo sapiens
caggagagcccgggtccgggct

SEQ ID NO: 7786181 - DNA, 22 bp, Homo sapiens
caggagccctggtgggtggaca

SEQ ID NO: 7786182 - DNA, 22 bp, Homo sapiens
caggagccgccaggcacgttgg

SEQ ID NO: 7786183 - DNA, 22 bp, Homo sapiens
caggagccctggtgggtggaca

SEQ ID NO: 7786184 - DNA, 22 bp, Homo sapiens
caggagcccgttgctccggcgg

SEQ ID NO: 7786185 - DNA, 22 bp, Homo sapiens
caggagctactcaggttgggtt

SEQ ID NO: 7786186 - DNA, 22 bp, Homo sapiens
caggagctggataggaccacaa

SEQ ID NO: 7786187 - DNA, 22 bp, Homo sapiens
caggagctcttaaggatgtgat

SEQ ID NO: 7786188 - DNA, 22 bp, Homo sapiens
caggagctctcatcgtcagggc

SEQ ID NO: 7786189 - DNA, 22 bp, Homo sapiens
taaatgcttagattcatagaaa

SEQ ID NO: 7786190 - DNA, 22 bp, Homo sapiens
taaatcaagaatatcagcttgt

SEQ ID NO: 7786191 - DNA, 22 bp, Homo sapiens
taaatcacaaattttctcattt

SEQ ID NO: 7786192 - DNA, 22 bp, Homo sapiens
taaatatcagtccagctcttcc

SEQ ID NO: 7786193 - DNA, 22 bp, Homo sapiens
taaagtgagtacaaaatgaggg

SEQ ID NO: 7786194 - DNA, 22 bp, Homo sapiens
taaatagaatctaaactgctca

SEQ ID NO: 7786195 - DNA, 22 bp, Homo sapiens
taaagccacgctggaaatcagg

SEQ ID NO: 7786196 - DNA, 22 bp, Homo sapiens
taaagccacgctggaaatcagg

SEQ ID NO: 7786197 - DNA, 22 bp, Homo sapiens
taaagccacgctggaaatcagg

SEQ ID NO: 7786198 - DNA, 22 bp, Homo sapiens
taaagtcatctttaaacatgcc

SEQ ID NO: 7786199 - DNA, 22 bp, Homo sapiens
taaagtcatctttacatctttg

SEQ ID NO: 7786200 - DNA, 22 bp, Homo sapiens
taaagtcatctttaaacatgcc

SEQ ID NO: 7786201 - DNA, 22 bp, Homo sapiens
taaagtcatctttacatctttg

SEQ ID NO: 7786202 - DNA, 22 bp, Homo sapiens
taaagtcacagagcaggtgcaa

SEQ ID NO: 7786203 - DNA, 23 bp, Homo sapiens
taaagtcacatattagagtgagc

SEQ ID NO: 7786204 - DNA, 22 bp, Homo sapiens
caggaatgggtgacagtcagct

SEQ ID NO: 7786205 - DNA, 22 bp, Homo sapiens
caggaatgccaaccagtgcatg

SEQ ID NO: 7786206 - DNA, 22 bp, Homo sapiens
caggacaggtgttctagatcag

SEQ ID NO: 7786207 - DNA, 22 bp, Homo sapiens
caggacagtataggctttagga

SEQ ID NO: 7786208 - DNA, 22 bp, Homo sapiens
caggacaggccctgtggggtct

SEQ ID NO: 7786209 - DNA, 22 bp, Homo sapiens
caggacagtataggctttagga

SEQ ID NO: 7786210 - DNA, 22 bp, Homo sapiens
caggacagctgggccaccacca

SEQ ID NO: 7786211 - DNA, 22 bp, Homo sapiens
caggacaggagtggggtcaaag

SEQ ID NO: 7786212 - DNA, 22 bp, Homo sapiens
caggacagctcaacacctcctc

SEQ ID NO: 7786213 - DNA, 22 bp, Homo sapiens
caggaagctgtgaaggagacgg

SEQ ID NO: 7786214 - DNA, 22 bp, Homo sapiens
caggaagctgtgaaggagacgg

SEQ ID NO: 7786215 - DNA, 22 bp, Homo sapiens
caggaagctggtcagatcctgt

SEQ ID NO: 7786216 - DNA, 22 bp, Homo sapiens
caggaagctgagctgcactgca

SEQ ID NO: 7786217 - DNA, 23 bp, Homo sapiens
caggaagcagatggggtagaaga

SEQ ID NO: 7786218 - DNA, 22 bp, Homo sapiens
caggaagctcttagcagtcacc

SEQ ID NO: 7786219 - DNA, 22 bp, Homo sapiens
caggacagtgcaggtccatcct

SEQ ID NO: 7786220 - DNA, 22 bp, Homo sapiens
taaactactgggcaaggacagg

SEQ ID NO: 7786221 - DNA, 22 bp, Homo sapiens
taaactacccatgacagtttca

SEQ ID NO: 7786222 - DNA, 22 bp, Homo sapiens
taaaccttcatgatggtcatta

SEQ ID NO: 7786223 - DNA, 18 bp, Homo sapiens
taaacctttcttgtggca

SEQ ID NO: 7786224 - DNA, 22 bp, Homo sapiens
taaactatctgtgtttgaagtt

SEQ ID NO: 7786225 - DNA, 22 bp, Homo sapiens
taaacatttgttattcttgttt

SEQ ID NO: 7786226 - DNA, 22 bp, Homo sapiens
taaacatttgttattcttgttt

SEQ ID NO: 7786227 - DNA, 22 bp, Homo sapiens
taaacatttgttattcttgttt

SEQ ID NO: 7786228 - DNA, 22 bp, Homo sapiens
taaacatttgttattcttgttt

SEQ ID NO: 7786229 - DNA, 22 bp, Homo sapiens
taaaccttatttgaataccaac

SEQ ID NO: 7786230 - DNA, 22 bp, Homo sapiens
caggagaaggtttggagtgcag

SEQ ID NO: 7786231 - DNA, 22 bp, Homo sapiens
caggacagtttgctttgccctg

SEQ ID NO: 7786232 - DNA, 19 bp, Homo sapiens
caggacagtttgccaagaa

SEQ ID NO: 7786233 - DNA, 22 bp, Homo sapiens
caggacagttggcatctgctgc

SEQ ID NO: 7786234 - DNA, 22 bp, Homo sapiens
taaaaatcttatgaatggcaag

SEQ ID NO: 7786235 - DNA, 22 bp, Homo sapiens
taaaaagttgaaaggacttatc

SEQ ID NO: 7786236 - DNA, 22 bp, Homo sapiens
taaaaagtagtgagaatggcgc

SEQ ID NO: 7786237 - DNA, 22 bp, Homo sapiens
taaaatgacttcctccaacatc

SEQ ID NO: 7786238 - DNA, 22 bp, Homo sapiens
taaaatcattctggtgtcagta

SEQ ID NO: 7786239 - DNA, 22 bp, Homo sapiens
taaaatcatgacagattgacat

SEQ ID NO: 7786240 - DNA, 22 bp, Homo sapiens
taaaaagcagctgagattttct

SEQ ID NO: 7786241 - DNA, 19 bp, Homo sapiens
taaaaactgaaggaagcag

SEQ ID NO: 7786242 - DNA, 22 bp, Homo sapiens
gttttcctgagcccagagatgc

SEQ ID NO: 7786243 - DNA, 22 bp, Homo sapiens
gttttcctgagcccagagatgc

SEQ ID NO: 7786244 - DNA, 20 bp, Homo sapiens
ccagacagcacctgcctggt

SEQ ID NO: 7786245 - DNA, 18 bp, Homo sapiens
ccagagctggctcctcgc

SEQ ID NO: 7786246 - DNA, 22 bp, Homo sapiens
ccagaggaaaaatatctcccta

SEQ ID NO: 7786247 - DNA, 22 bp, Homo sapiens
tctcctgggaggacaaggaagg

SEQ ID NO: 7786248 - DNA, 22 bp, Homo sapiens
tctcccacagtctcccatggct

SEQ ID NO: 7786249 - DNA, 22 bp, Homo sapiens
tctcccacagccgtgcttcaag

SEQ ID NO: 7786250 - DNA, 22 bp, Homo sapiens
tctcccaagggcacattcaagg

SEQ ID NO: 7786251 - DNA, 22 bp, Homo sapiens
tctcccaaggcacagaaagagt

SEQ ID NO: 7786252 - DNA, 22 bp, Homo sapiens
tctcccaagcctggcaggggca

SEQ ID NO: 7786253 - DNA, 21 bp, Homo sapiens
tctctacactttcactaggct

SEQ ID NO: 7786254 - DNA, 22 bp, Homo sapiens
tctctaagataggaatacagtt

SEQ ID NO: 7786255 - DNA, 22 bp, Homo sapiens
tctctaggcagtgtcagaatca

SEQ ID NO: 7786256 - DNA, 22 bp, Homo sapiens
tctctaggttgatataaattat

SEQ ID NO: 7786257 - DNA, 22 bp, Homo sapiens
ccagaggagggctctgatgagg

SEQ ID NO: 7786258 - DNA, 22 bp, Homo sapiens
ccagaggacttgggggctgaat

SEQ ID NO: 7786259 - DNA, 17 bp, Homo sapiens
ccagatgccctgtctcc

SEQ ID NO: 7786260 - DNA, 22 bp, Homo sapiens
ccagatatcactgccgtgttgt

SEQ ID NO: 7786261 - DNA, 22 bp, Homo sapiens
ccagaggtgctgggagaggtct

SEQ ID NO: 7786262 - DNA, 22 bp, Homo sapiens
ccacagtccgggctggcaggac

SEQ ID NO: 7786263 - DNA, 22 bp, Homo sapiens
ccacagtctatgcaacaaggtc

SEQ ID NO: 7786264 - DNA, 22 bp, Homo sapiens
ccacagtgaaatcttgatggag

SEQ ID NO: 7786265 - DNA, 22 bp, Homo sapiens
ccacagtgagttagattgacca

SEQ ID NO: 7786266 - DNA, 23 bp, Homo sapiens
ccactctcccaccatatctgtat

SEQ ID NO: 7786267 - DNA, 21 bp, Homo sapiens
ccactctgagtgttgaacaga

SEQ ID NO: 7786268 - DNA, 22 bp, Homo sapiens
ccactctgatttcaagggagat

SEQ ID NO: 7786269 - DNA, 20 bp, Homo sapiens
tcctggtcatgtggctgggc

SEQ ID NO: 7786270 - DNA, 22 bp, Homo sapiens
tcctggggagggttctggctcc

SEQ ID NO: 7786271 - DNA, 22 bp, Homo sapiens
ccacagggtcagccactctgca

SEQ ID NO: 7786272 - DNA, 22 bp, Homo sapiens
tcctggtggatagaagccaagg

SEQ ID NO: 7786273 - DNA, 22 bp, Homo sapiens
ccagaagcaaaacagacagttt

SEQ ID NO: 7786274 - DNA, 22 bp, Homo sapiens
ccagaatccaaaacgttttgag

SEQ ID NO: 7786275 - DNA, 22 bp, Homo sapiens
ccagaagtggctttctcaggga

SEQ ID NO: 7786276 - DNA, 22 bp, Homo sapiens
ccagaagtcaggaatgagtctt

SEQ ID NO: 7786277 - DNA, 22 bp, Homo sapiens
ccagaagtcaatgcagatgtga

SEQ ID NO: 7786278 - DNA, 22 bp, Homo sapiens
ccagaaaagcatctggttcttt

SEQ ID NO: 7786279 - DNA, 22 bp, Homo sapiens
ccactgcctatttgcagggccc

SEQ ID NO: 7786280 - DNA, 22 bp, Homo sapiens
ccactgcctctccagggccatc

SEQ ID NO: 7786281 - DNA, 22 bp, Homo sapiens
ccactgccagctttgtcctccc

SEQ ID NO: 7786282 - DNA, 22 bp, Homo sapiens
ccactgccatgggctaggcatg

SEQ ID NO: 7786283 - DNA, 22 bp, Homo sapiens
ccactgcactccagccttggca

SEQ ID NO: 7786284 - DNA, 22 bp, Homo sapiens
ccactgcacttcagcctgggtg

SEQ ID NO: 7786285 - DNA, 22 bp, Homo sapiens
ccactgcacttcagcctgggtg

SEQ ID NO: 7786286 - DNA, 22 bp, Homo sapiens
ccacacagataagtgttttcta

SEQ ID NO: 7786287 - DNA, 22 bp, Homo sapiens
ccacaagactctgtcagcataa

SEQ ID NO: 7786288 - DNA, 22 bp, Homo sapiens
ccacaagatgcaaactctaaca

SEQ ID NO: 7786289 - DNA, 22 bp, Homo sapiens
ccaattttattcttctgcaagt

SEQ ID NO: 7786290 - DNA, 20 bp, Homo sapiens
tcctcccccacctttgcagc

SEQ ID NO: 7786291 - DNA, 22 bp, Homo sapiens
tcctccccaaagcccagcctgg

SEQ ID NO: 7786292 - DNA, 22 bp, Homo sapiens
tcctccccaaagcccagcctgg

SEQ ID NO: 7786293 - DNA, 22 bp, Homo sapiens
tcctccccaaagcccagcctgg

SEQ ID NO: 7786294 - DNA, 22 bp, Homo sapiens
tcctcccacataggacaatggg

SEQ ID NO: 7786295 - DNA, 22 bp, Homo sapiens
tcctcccacataggacaatggg

SEQ ID NO: 7786296 - DNA, 22 bp, Homo sapiens
ccaaatgtgcctgtttcaacaa

SEQ ID NO: 7786297 - DNA, 23 bp, Homo sapiens
tcctcccaaatttcagcctcatt

SEQ ID NO: 7786298 - DNA, 23 bp, Homo sapiens
tcctcccaaatttcagcctcatt

SEQ ID NO: 7786299 - DNA, 22 bp, Homo sapiens
ccaaatagtctttcattgaatt

SEQ ID NO: 7786300 - DNA, 22 bp, Homo sapiens
ccaaatcaccagcacgatcatt

SEQ ID NO: 7786301 - DNA, 22 bp, Homo sapiens
ccaaagtgctggggttacaggc

SEQ ID NO: 7786302 - DNA, 17 bp, Homo sapiens
ccacagcctggcacttg

SEQ ID NO: 7786303 - DNA, 22 bp, Homo sapiens
ccacagctcctcagcctctttc

SEQ ID NO: 7786304 - DNA, 22 bp, Homo sapiens
ccacagcacctgcagccagttg

SEQ ID NO: 7786305 - DNA, 22 bp, Homo sapiens
ccacagcatgcaggcctgacac

SEQ ID NO: 7786306 - DNA, 22 bp, Homo sapiens
ccacagcaggactggagccgcc

SEQ ID NO: 7786307 - DNA, 22 bp, Homo sapiens
ccacagaatgatgacacttcag

SEQ ID NO: 7786308 - DNA, 20 bp, Homo sapiens
tcctgcagttcctaggaggg

SEQ ID NO: 7786309 - DNA, 22 bp, Homo sapiens
tccctgcctgacagcacccacc

SEQ ID NO: 7786310 - DNA, 17 bp, Homo sapiens
catttgctggttggctc

SEQ ID NO: 7786311 - DNA, 22 bp, Homo sapiens
catttgcaagagataaatgttt

SEQ ID NO: 7786312 - DNA, 22 bp, Homo sapiens
catttgcaaaccaacaagatga

SEQ ID NO: 7786313 - DNA, 22 bp, Homo sapiens
catttgaaattcttagaacaaa

SEQ ID NO: 7786314 - DNA, 22 bp, Homo sapiens
ccaaagtgctaggattacaggc

SEQ ID NO: 7786315 - DNA, 22 bp, Homo sapiens
ccaaagtgctgggattacaggt

SEQ ID NO: 7786316 - DNA, 22 bp, Homo sapiens
ccaaagtgctgggattacaggc

SEQ ID NO: 7786317 - DNA, 22 bp, Homo sapiens
ccaaagtgctgagattacaggt

SEQ ID NO: 7786318 - DNA, 22 bp, Homo sapiens
ccaaagtgctaggattacaggt

SEQ ID NO: 7786319 - DNA, 17 bp, Homo sapiens
tccaggcagcaactgag

SEQ ID NO: 7786320 - DNA, 23 bp, Homo sapiens
tccaggcacgcatttcttctagc

SEQ ID NO: 7786321 - DNA, 22 bp, Homo sapiens
catttagaaactgtttttaaca

SEQ ID NO: 7786322 - DNA, 22 bp, Homo sapiens
catttattagttagttcgatgt

SEQ ID NO: 7786323 - DNA, 21 bp, Homo sapiens
tcccagggccaggtgccatca

SEQ ID NO: 7786324 - DNA, 22 bp, Homo sapiens
tcccagggtcagtggtgaggcc

SEQ ID NO: 7786325 - DNA, 22 bp, Homo sapiens
tcccagggtcagtggtgaggcc

SEQ ID NO: 7786326 - DNA, 22 bp, Homo sapiens
tcccagggcttttctcatgctt

SEQ ID NO: 7786327 - DNA, 22 bp, Homo sapiens
tcccagggctctagagtgctgg

SEQ ID NO: 7786328 - DNA, 21 bp, Homo sapiens
ccagcccagctgtgtcccagc

SEQ ID NO: 7786329 - DNA, 22 bp, Homo sapiens
ccagccatgggccacctagctg

SEQ ID NO: 7786330 - DNA, 22 bp, Homo sapiens
ccagcccctatcctcgctccac

SEQ ID NO: 7786331 - DNA, 22 bp, Homo sapiens
ccagcccgaatccctaaagcaa

SEQ ID NO: 7786332 - DNA, 22 bp, Homo sapiens
tctgaggcccagttcaactctt

SEQ ID NO: 7786333 - DNA, 22 bp, Homo sapiens
tctgaggagttgggccagtgct

SEQ ID NO: 7786334 - DNA, 22 bp, Homo sapiens
tctgaaataggaaagcaaatgg

SEQ ID NO: 7786335 - DNA, 22 bp, Homo sapiens
tctcttggtgacttaaaatgtt

SEQ ID NO: 7786336 - DNA, 22 bp, Homo sapiens
tctcttggtgatagtctttctt

SEQ ID NO: 7786337 - DNA, 22 bp, Homo sapiens
tctgaaatattggtaatacttt

SEQ ID NO: 7786338 - DNA, 22 bp, Homo sapiens
tctctcttgtcaccccatctgc

SEQ ID NO: 7786339 - DNA, 22 bp, Homo sapiens
tctcttgatatattacatagag

SEQ ID NO: 7786340 - DNA, 22 bp, Homo sapiens
tctcttgactgctaaaattaga

SEQ ID NO: 7786341 - DNA, 22 bp, Homo sapiens
tctcttgactgctaaaattaga

SEQ ID NO: 7786342 - DNA, 22 bp, Homo sapiens
tctcttgaagattgaagacaaa

SEQ ID NO: 7786343 - DNA, 22 bp, Homo sapiens
tctcttgggaggaaagagagaa

SEQ ID NO: 7786344 - DNA, 22 bp, Homo sapiens
tctcttggaggttcttcctgtt

SEQ ID NO: 7786345 - DNA, 22 bp, Homo sapiens
tctcttggaaagcttgcccact

SEQ ID NO: 7786346 - DNA, 22 bp, Homo sapiens
tctcttggaacacttgctctta

SEQ ID NO: 7786347 - DNA, 22 bp, Homo sapiens
tctcttggaaagcttgcccact

SEQ ID NO: 7786348 - DNA, 22 bp, Homo sapiens
tctcttggacatgtggctctgc

SEQ ID NO: 7786349 - DNA, 22 bp, Homo sapiens
tctcttggacatgtggctctgc

SEQ ID NO: 7786350 - DNA, 22 bp, Homo sapiens
ccagctctagccccatgtggct

SEQ ID NO: 7786351 - DNA, 22 bp, Homo sapiens
ccagctcctcttcccagtgtca

SEQ ID NO: 7786352 - DNA, 22 bp, Homo sapiens
tctgccagctctgtgggtctcg

SEQ ID NO: 7786353 - DNA, 20 bp, Homo sapiens
tctgccactgcactctgccc

SEQ ID NO: 7786354 - DNA, 22 bp, Homo sapiens
tctgccagaagccagggtctgg

SEQ ID NO: 7786355 - DNA, 19 bp, Homo sapiens
tctgcctctggtcaggctc

SEQ ID NO: 7786356 - DNA, 21 bp, Homo sapiens
tctgccagctgaagaggtgga

SEQ ID NO: 7786357 - DNA, 22 bp, Homo sapiens
tctgccagcttctggtggttgc

SEQ ID NO: 7786358 - DNA, 22 bp, Homo sapiens
tctgcctcctgcttgtcccgac

SEQ ID NO: 7786359 - DNA, 22 bp, Homo sapiens
tctgccaggcattgtgctgctc

SEQ ID NO: 7786360 - DNA, 22 bp, Homo sapiens
ccagccttctgagctgcctgga

SEQ ID NO: 7786361 - DNA, 22 bp, Homo sapiens
ccagccttcacctgctctggtc

SEQ ID NO: 7786362 - DNA, 22 bp, Homo sapiens
ccagctagtaagcacctgcatc

SEQ ID NO: 7786363 - DNA, 22 bp, Homo sapiens
ccagctcagggtcacatggcac

SEQ ID NO: 7786364 - DNA, 22 bp, Homo sapiens
ccagctcatctcagtgaaatgc

SEQ ID NO: 7786365 - DNA, 22 bp, Homo sapiens
ccagctccaagtttgggcatca

SEQ ID NO: 7786366 - DNA, 22 bp, Homo sapiens
ccagcctggggaggcagcttct

SEQ ID NO: 7786367 - DNA, 22 bp, Homo sapiens
ccagcctggggaggcagcttct

SEQ ID NO: 7786368 - DNA, 22 bp, Homo sapiens
ccagcctggagggcagtggtgg

SEQ ID NO: 7786369 - DNA, 22 bp, Homo sapiens
ccagcctcatcatattcctgct

SEQ ID NO: 7786370 - DNA, 22 bp, Homo sapiens
ccagcctggactgggtcttgtg

SEQ ID NO: 7786371 - DNA, 22 bp, Homo sapiens
tctgagtgatcagatgcattgc

SEQ ID NO: 7786372 - DNA, 22 bp, Homo sapiens
tctggctgttttagatgagctc

SEQ ID NO: 7786373 - DNA, 22 bp, Homo sapiens
tctggctgttaggcctgacctt

SEQ ID NO: 7786374 - DNA, 22 bp, Homo sapiens
tctggctgttaggcctgacctt

SEQ ID NO: 7786375 - DNA, 22 bp, Homo sapiens
tctggctgttgttaggttcctg

SEQ ID NO: 7786376 - DNA, 22 bp, Homo sapiens
ccagctggtttatattccccac

SEQ ID NO: 7786377 - DNA, 22 bp, Homo sapiens
ccagctgtaggcagggggttta

SEQ ID NO: 7786378 - DNA, 22 bp, Homo sapiens
ccagctgtcagtgtgaaaataa

SEQ ID NO: 7786379 - DNA, 22 bp, Homo sapiens
ccagctgtgctgttggcttgtc

SEQ ID NO: 7786380 - DNA, 22 bp, Homo sapiens
ccagctgtttctgatgctaggc

SEQ ID NO: 7786381 - DNA, 22 bp, Homo sapiens
ccagctgtcttgagaggaggca

SEQ ID NO: 7786382 - DNA, 22 bp, Homo sapiens
ccagctgtgccggggacctggg

SEQ ID NO: 7786383 - DNA, 22 bp, Homo sapiens
ccagctgtgcctaggagcaggg

SEQ ID NO: 7786384 - DNA, 22 bp, Homo sapiens
tctgcctctttcaggcctggca

SEQ ID NO: 7786385 - DNA, 22 bp, Homo sapiens
tctgcctctttcaggcctggca

SEQ ID NO: 7786386 - DNA, 19 bp, Homo sapiens
tctgcctctggtcaggctc

SEQ ID NO: 7786387 - DNA, 19 bp, Homo sapiens
tctgcctctggtcaggctc

SEQ ID NO: 7786388 - DNA, 22 bp, Homo sapiens
ccagctggtgacatccccaacc

SEQ ID NO: 7786389 - DNA, 22 bp, Homo sapiens
ccagctggtgggtctttctctg

SEQ ID NO: 7786390 - DNA, 22 bp, Homo sapiens
ccagctggggaagtggggcata

SEQ ID NO: 7786391 - DNA, 22 bp, Homo sapiens
ccagctgggtccctgctggggc

SEQ ID NO: 7786392 - DNA, 22 bp, Homo sapiens
ccagctggggaagtggggcata

SEQ ID NO: 7786393 - DNA, 22 bp, Homo sapiens
ccagctgggattaagggaaaat

SEQ ID NO: 7786394 - DNA, 22 bp, Homo sapiens
ccaggaagctctgctccacggg

SEQ ID NO: 7786395 - DNA, 22 bp, Homo sapiens
ccaggaagctctgctccacggg

SEQ ID NO: 7786396 - DNA, 22 bp, Homo sapiens
ccaggaagctctgctccacggg

SEQ ID NO: 7786397 - DNA, 21 bp, Homo sapiens
ccaggaaggactgagctccct

SEQ ID NO: 7786398 - DNA, 22 bp, Homo sapiens
ccaggagcctgggccaggctgg

SEQ ID NO: 7786399 - DNA, 22 bp, Homo sapiens
ccaggaagcataatgtagtggg

SEQ ID NO: 7786400 - DNA, 23 bp, Homo sapiens
ccaggaagaggccatccacagtc

SEQ ID NO: 7786401 - DNA, 23 bp, Homo sapiens
ccaggaagaggccatccacagtc

SEQ ID NO: 7786402 - DNA, 22 bp, Homo sapiens
ccaggaagacacatgctcatcc

SEQ ID NO: 7786403 - DNA, 22 bp, Homo sapiens
ccaggaagcctgtgtctctgga

SEQ ID NO: 7786404 - DNA, 22 bp, Homo sapiens
ccaggaaccgatgatcagaggg

SEQ ID NO: 7786405 - DNA, 22 bp, Homo sapiens
ccaggaaatagtgctgtgatct

SEQ ID NO: 7786406 - DNA, 22 bp, Homo sapiens
ccaggaagaaacagtctttata

SEQ ID NO: 7786407 - DNA, 22 bp, Homo sapiens
tctgtcttagccatctcaggct

SEQ ID NO: 7786408 - DNA, 22 bp, Homo sapiens
tctgtcttagcatctttgctca

SEQ ID NO: 7786409 - DNA, 22 bp, Homo sapiens
tctgtcttggccagccatctgg

SEQ ID NO: 7786410 - DNA, 17 bp, Homo sapiens
tctgtcttgactgtcac

SEQ ID NO: 7786411 - DNA, 21 bp, Homo sapiens
tctgtcttcctcagcctaagg

SEQ ID NO: 7786412 - DNA, 22 bp, Homo sapiens
tcattttgcagagctgaggaac

SEQ ID NO: 7786413 - DNA, 22 bp, Homo sapiens
tcattttgcctgccatttgagt

SEQ ID NO: 7786414 - DNA, 22 bp, Homo sapiens
tcattttggccatgatacagac

SEQ ID NO: 7786415 - DNA, 22 bp, Homo sapiens
catgcaaagcgttttgaccagc

SEQ ID NO: 7786416 - DNA, 22 bp, Homo sapiens
catgcaaaggtcaagatcagga

SEQ ID NO: 7786417 - DNA, 22 bp, Homo sapiens
catgcaaaggtcaagatcagga

SEQ ID NO: 7786418 - DNA, 22 bp, Homo sapiens
catgcaaatggtggctaaatgg

SEQ ID NO: 7786419 - DNA, 22 bp, Homo sapiens
catgcaaatgtgctaatctgaa

SEQ ID NO: 7786420 - DNA, 20 bp, Homo sapiens
catgcaacagattatttccc

SEQ ID NO: 7786421 - DNA, 22 bp, Homo sapiens
catgcaagaagatagattaaat

SEQ ID NO: 7786422 - DNA, 22 bp, Homo sapiens
catgcaaacacgtaaacattca

SEQ ID NO: 7786423 - DNA, 23 bp, Homo sapiens
catgcaaacactattgcatttgg

SEQ ID NO: 7786424 - DNA, 22 bp, Homo sapiens
catgcaaaatgtattttattag

SEQ ID NO: 7786425 - DNA, 22 bp, Homo sapiens
catggctgaggcagaggactga

SEQ ID NO: 7786426 - DNA, 22 bp, Homo sapiens
catggctgcctgtggacactgc

SEQ ID NO: 7786427 - DNA, 22 bp, Homo sapiens
catggccagccctgaggttcag

SEQ ID NO: 7786428 - DNA, 22 bp, Homo sapiens
catggctgcgagaagagtgggt

SEQ ID NO: 7786429 - DNA, 22 bp, Homo sapiens
catggcttgctagtggcccaag

SEQ ID NO: 7786430 - DNA, 22 bp, Homo sapiens
catggcttagaagttccagccc

SEQ ID NO: 7786431 - DNA, 22 bp, Homo sapiens
catggcttcgtcacagagggca

SEQ ID NO: 7786432 - DNA, 22 bp, Homo sapiens
catggcttaccccaggagcagc

SEQ ID NO: 7786433 - DNA, 22 bp, Homo sapiens
tccaggcaaagtgctgggctgc

SEQ ID NO: 7786434 - DNA, 19 bp, Homo sapiens
catgtgcatgagcacagga

SEQ ID NO: 7786435 - DNA, 22 bp, Homo sapiens
catgtgcagactctgacaggct

SEQ ID NO: 7786436 - DNA, 22 bp, Homo sapiens
catgtgcatccttaatctccct

SEQ ID NO: 7786437 - DNA, 22 bp, Homo sapiens
catgtgcagacggtgggctgga

SEQ ID NO: 7786438 - DNA, 22 bp, Homo sapiens
catgtctttcaaaccacacagt

SEQ ID NO: 7786439 - DNA, 22 bp, Homo sapiens
catgtacatgcctactatcaat

SEQ ID NO: 7786440 - DNA, 22 bp, Homo sapiens
tccagccacttgcacagttaaa

SEQ ID NO: 7786441 - DNA, 22 bp, Homo sapiens
tccagccaggatggcccaggga

SEQ ID NO: 7786442 - DNA, 22 bp, Homo sapiens
tccagccatgcatgacaatcac

SEQ ID NO: 7786443 - DNA, 22 bp, Homo sapiens
catctttaaaggggagacaccc

SEQ ID NO: 7786444 - DNA, 22 bp, Homo sapiens
tcagttctgctagaaaaacagt

SEQ ID NO: 7786445 - DNA, 22 bp, Homo sapiens
tcagttctaagtgctttacatg

SEQ ID NO: 7786446 - DNA, 22 bp, Homo sapiens
tcagttctaagtgctttacatg

SEQ ID NO: 7786447 - DNA, 22 bp, Homo sapiens
tcagttctttatttcacagtga

SEQ ID NO: 7786448 - DNA, 22 bp, Homo sapiens
tcagttcttattttcatgaata

SEQ ID NO: 7786449 - DNA, 22 bp, Homo sapiens
tcagttcttagtaatgcagtct

SEQ ID NO: 7786450 - DNA, 22 bp, Homo sapiens
catctttgaactctgtataaac

SEQ ID NO: 7786451 - DNA, 22 bp, Homo sapiens
catctttatttatatagacagg

SEQ ID NO: 7786452 - DNA, 22 bp, Homo sapiens
catgagtgtgccagtctgatat

SEQ ID NO: 7786453 - DNA, 22 bp, Homo sapiens
tcagtttatagatattgctgat

SEQ ID NO: 7786454 - DNA, 21 bp, Homo sapiens
catgataatgaaggtgttatt

SEQ ID NO: 7786455 - DNA, 22 bp, Homo sapiens
catgatggttcttacaaaggtg

SEQ ID NO: 7786456 - DNA, 22 bp, Homo sapiens
tcatggggctcttcaagtggag

SEQ ID NO: 7786457 - DNA, 22 bp, Homo sapiens
tcatggggtgaattagtatgct

SEQ ID NO: 7786458 - DNA, 22 bp, Homo sapiens
tcatggggtagaagcatgttta

SEQ ID NO: 7786459 - DNA, 22 bp, Homo sapiens
tcatggggccacagctgccagc

SEQ ID NO: 7786460 - DNA, 22 bp, Homo sapiens
tcatggggaaagcccgccctca

SEQ ID NO: 7786461 - DNA, 22 bp, Homo sapiens
catgattatgtgttagagtttg

SEQ ID NO: 7786462 - DNA, 22 bp, Homo sapiens
catgatttactaaaatttgttt

SEQ ID NO: 7786463 - DNA, 22 bp, Homo sapiens
tcatggggtgacagaagggagg

SEQ ID NO: 7786464 - DNA, 22 bp, Homo sapiens
tcatggggtttggctggatgtc

SEQ ID NO: 7786465 - DNA, 22 bp, Homo sapiens
tcatgtattgaaaagcatttta

SEQ ID NO: 7786466 - DNA, 22 bp, Homo sapiens
tcatgtatttgtgatagatgac

SEQ ID NO: 7786467 - DNA, 21 bp, Homo sapiens
tcatgtaatgcatgaagtaaa

SEQ ID NO: 7786468 - DNA, 22 bp, Homo sapiens
tcatttcaatgatactactaag

SEQ ID NO: 7786469 - DNA, 18 bp, Homo sapiens
tcatttgttttgcatgaa

SEQ ID NO: 7786470 - DNA, 22 bp, Homo sapiens
tcatttgtttaggtagcaccat

SEQ ID NO: 7786471 - DNA, 22 bp, Homo sapiens
tcagaagtccccagtcaaggag

SEQ ID NO: 7786472 - DNA, 22 bp, Homo sapiens
tcagaagtattatgctaaagga

SEQ ID NO: 7786473 - DNA, 22 bp, Homo sapiens
tcagaagtccaataccatggga

SEQ ID NO: 7786474 - DNA, 22 bp, Homo sapiens
tcagaagtcacttaggaaaggg

SEQ ID NO: 7786475 - DNA, 22 bp, Homo sapiens
tcagaaggtttttagcaaagga

SEQ ID NO: 7786476 - DNA, 22 bp, Homo sapiens
tcagaaggtggaggttgcagtg

SEQ ID NO: 7786477 - DNA, 23 bp, Homo sapiens
tcagaaggtgccactgacgcttt

SEQ ID NO: 7786478 - DNA, 20 bp, Homo sapiens
tcagaaggctccagagcaga

SEQ ID NO: 7786479 - DNA, 22 bp, Homo sapiens
tcagaaggtactgaagacatgg

SEQ ID NO: 7786480 - DNA, 22 bp, Homo sapiens
tcagaaggtacagaagggaggt

SEQ ID NO: 7786481 - DNA, 22 bp, Homo sapiens
cagtttctctcatacatatttg

SEQ ID NO: 7786482 - DNA, 22 bp, Homo sapiens
cagtttctgtggtctcttttca

SEQ ID NO: 7786483 - DNA, 22 bp, Homo sapiens
cagtttcttcatctgcagaatc

SEQ ID NO: 7786484 - DNA, 22 bp, Homo sapiens
cagtttcttcatcagttaagca

SEQ ID NO: 7786485 - DNA, 22 bp, Homo sapiens
cagtttcttcaattcagacact

SEQ ID NO: 7786486 - DNA, 22 bp, Homo sapiens
cagtttcttatcttcaaaattg

SEQ ID NO: 7786487 - DNA, 22 bp, Homo sapiens
cagtttcttatcttcaaaattg

SEQ ID NO: 7786488 - DNA, 22 bp, Homo sapiens
cagtttctgttttaaatagcag

SEQ ID NO: 7786489 - DNA, 22 bp, Homo sapiens
cagtttctgttttaaatagcag

SEQ ID NO: 7786490 - DNA, 19 bp, Homo sapiens
cagtttgtccagaggggac

SEQ ID NO: 7786491 - DNA, 22 bp, Homo sapiens
cagtttgtatttattactcata

SEQ ID NO: 7786492 - DNA, 22 bp, Homo sapiens
cagtttgtatttattactcata

SEQ ID NO: 7786493 - DNA, 22 bp, Homo sapiens
catacatttatacacatctatg

SEQ ID NO: 7786494 - DNA, 22 bp, Homo sapiens
catacattgctcattcagtatc

SEQ ID NO: 7786495 - DNA, 22 bp, Homo sapiens
catacattgctcattcagtatc

SEQ ID NO: 7786496 - DNA, 22 bp, Homo sapiens
tcagctgcagtttcacaagcac

SEQ ID NO: 7786497 - DNA, 22 bp, Homo sapiens
catagaaaagagtaggtaatgt

SEQ ID NO: 7786498 - DNA, 22 bp, Homo sapiens
catacttttgccctgacattct

SEQ ID NO: 7786499 - DNA, 21 bp, Homo sapiens
cataccattctctaagcaaaa

SEQ ID NO: 7786500 - DNA, 22 bp, Homo sapiens
catacctttctcaagcacatgt

SEQ ID NO: 7786501 - DNA, 22 bp, Homo sapiens
tcagctctgtgtacagttagca

SEQ ID NO: 7786502 - DNA, 22 bp, Homo sapiens
tcagccctgggcttcctcatgg

SEQ ID NO: 7786503 - DNA, 22 bp, Homo sapiens
tcagctgaagtggagaagcaga

SEQ ID NO: 7786504 - DNA, 22 bp, Homo sapiens
tcagctgagctccagctcatag

SEQ ID NO: 7786505 - DNA, 22 bp, Homo sapiens
tcagctgagttctagagcactc

SEQ ID NO: 7786506 - DNA, 22 bp, Homo sapiens
catcacagtttgtcagaaatca

SEQ ID NO: 7786507 - DNA, 22 bp, Homo sapiens
catcacaggcattttgagtgtc

SEQ ID NO: 7786508 - DNA, 22 bp, Homo sapiens
catcacatctactataagtgat

SEQ ID NO: 7786509 - DNA, 22 bp, Homo sapiens
catcacatgcctatcatgagct

SEQ ID NO: 7786510 - DNA, 22 bp, Homo sapiens
catccaggctgaagtgcagtgg

SEQ ID NO: 7786511 - DNA, 22 bp, Homo sapiens
catcatcttgaatgactgtgat

SEQ ID NO: 7786512 - DNA, 22 bp, Homo sapiens
catccagaccgtgccatgctgc

SEQ ID NO: 7786513 - DNA, 22 bp, Homo sapiens
catcacagatgttgtgtggagt

SEQ ID NO: 7786514 - DNA, 22 bp, Homo sapiens
catcacagaaataaacatacct

SEQ ID NO: 7786515 - DNA, 22 bp, Homo sapiens
catcacaaatgtaataatgtct

SEQ ID NO: 7786516 - DNA, 20 bp, Homo sapiens
tcagggcatgggacagcccc

SEQ ID NO: 7786517 - DNA, 20 bp, Homo sapiens
tcagggcatgggacagcccc

SEQ ID NO: 7786518 - DNA, 22 bp, Homo sapiens
tcaggaagtggtaaaggatgtt

SEQ ID NO: 7786519 - DNA, 22 bp, Homo sapiens
tcaggaagttgaggcgtagaga

SEQ ID NO: 7786520 - DNA, 22 bp, Homo sapiens
tcaggaagtctcaattagctac

SEQ ID NO: 7786521 - DNA, 22 bp, Homo sapiens
tcaggaagtgctgaggctgctt

SEQ ID NO: 7786522 - DNA, 22 bp, Homo sapiens
catataaatacaacatgtgtta

SEQ ID NO: 7786523 - DNA, 22 bp, Homo sapiens
catatacacttccacctctgtg

SEQ ID NO: 7786524 - DNA, 22 bp, Homo sapiens
catagacaaagatcagaagagt

SEQ ID NO: 7786525 - DNA, 23 bp, Homo sapiens
catatgaattttagaggcagttt

SEQ ID NO: 7786526 - DNA, 22 bp, Homo sapiens
catatcttctgacatgatcagg

SEQ ID NO: 7786527 - DNA, 22 bp, Homo sapiens
catatcaaagagaaggatagga

SEQ ID NO: 7786528 - DNA, 20 bp, Homo sapiens
catatatacctagaagtgga

SEQ ID NO: 7786529 - DNA, 22 bp, Homo sapiens
catatactgcatacatatgtgt

SEQ ID NO: 7786530 - DNA, 22 bp, Homo sapiens
catatacacttccacctctgtg

SEQ ID NO: 7786531 - DNA, 22 bp, Homo sapiens
catatattctggttttcactgg

SEQ ID NO: 7786532 - DNA, 20 bp, Homo sapiens
catatatacctagaagtgga

SEQ ID NO: 7786533 - DNA, 22 bp, Homo sapiens
tataagtctggcatatgtatgc

SEQ ID NO: 7786534 - DNA, 22 bp, Homo sapiens
tataagatacttggcatagtgc

SEQ ID NO: 7786535 - DNA, 22 bp, Homo sapiens
caggggcctggctgtctaggaa

SEQ ID NO: 7786536 - DNA, 22 bp, Homo sapiens
cagggtggaaaagctagttgga

SEQ ID NO: 7786537 - DNA, 22 bp, Homo sapiens
cagggtggaacaggcaatactt

SEQ ID NO: 7786538 - DNA, 22 bp, Homo sapiens
cagggtggaacaggcaatactt

SEQ ID NO: 7786539 - DNA, 22 bp, Homo sapiens
cagggtggaagctgtagagtgg

SEQ ID NO: 7786540 - DNA, 22 bp, Homo sapiens
caggtctgcaggctggagtcca

SEQ ID NO: 7786541 - DNA, 22 bp, Homo sapiens
caggtctggcatcagctgtgtg

SEQ ID NO: 7786542 - DNA, 22 bp, Homo sapiens
tatacagttaagtttcttcagt

SEQ ID NO: 7786543 - DNA, 22 bp, Homo sapiens
cagggtggcactcagcgcatct

SEQ ID NO: 7786544 - DNA, 22 bp, Homo sapiens
cagggtggcacatcacagcatt

SEQ ID NO: 7786545 - DNA, 22 bp, Homo sapiens
cagggtggaagctgtagagtgg

SEQ ID NO: 7786546 - DNA, 22 bp, Homo sapiens
cagggtggaatggaatgctggc

SEQ ID NO: 7786547 - DNA, 22 bp, Homo sapiens
cagggtggcacatcacagcatt

SEQ ID NO: 7786548 - DNA, 22 bp, Homo sapiens
tatacagtcttttgctatattc

SEQ ID NO: 7786549 - DNA, 22 bp, Homo sapiens
tatggcaatatgtatcaagatc

SEQ ID NO: 7786550 - DNA, 22 bp, Homo sapiens
tatggcaattgtctaagtttta

SEQ ID NO: 7786551 - DNA, 22 bp, Homo sapiens
tatgcacagttacaagaatatc

SEQ ID NO: 7786552 - DNA, 22 bp, Homo sapiens
tatctctttattgacaataaaa

SEQ ID NO: 7786553 - DNA, 22 bp, Homo sapiens
tatctgatacaacagaataaca

SEQ ID NO: 7786554 - DNA, 22 bp, Homo sapiens
tattgctatgagcattgttctt

SEQ ID NO: 7786555 - DNA, 22 bp, Homo sapiens
tattgctttctcagacgtttag

SEQ ID NO: 7786556 - DNA, 22 bp, Homo sapiens
tattaaagggaagttatgcatg

SEQ ID NO: 7786557 - DNA, 22 bp, Homo sapiens
tattaaatatatctgttagttg

SEQ ID NO: 7786558 - DNA, 22 bp, Homo sapiens
cagtgattttctcagaacttga

SEQ ID NO: 7786559 - DNA, 22 bp, Homo sapiens
cagtgcaattacaagctaattc

SEQ ID NO: 7786560 - DNA, 22 bp, Homo sapiens
cagtgcaatgttaaataggaaa

SEQ ID NO: 7786561 - DNA, 22 bp, Homo sapiens
cagtgcaatattcaaagtggag

SEQ ID NO: 7786562 - DNA, 20 bp, Homo sapiens
cagtgaggaggtgctggggg

SEQ ID NO: 7786563 - DNA, 22 bp, Homo sapiens
cagtctcaccctggaggcccca

SEQ ID NO: 7786564 - DNA, 22 bp, Homo sapiens
cagtgagtaagtagacagctta

SEQ ID NO: 7786565 - DNA, 22 bp, Homo sapiens
cagtgaggtggatggatggcct

SEQ ID NO: 7786566 - DNA, 22 bp, Homo sapiens
cagtgagttcatcaagacatga

SEQ ID NO: 7786567 - DNA, 17 bp, Homo sapiens
cagtgatcattacatta

SEQ ID NO: 7786568 - DNA, 22 bp, Homo sapiens
tatttaccctggcagctgtagc

SEQ ID NO: 7786569 - DNA, 22 bp, Homo sapiens
tatttagttatctttcataaaa

SEQ ID NO: 7786570 - DNA, 20 bp, Homo sapiens
tatttagattcaagtatgga

SEQ ID NO: 7786571 - DNA, 22 bp, Homo sapiens
tatttagctggagtcagtgctt

SEQ ID NO: 7786572 - DNA, 20 bp, Homo sapiens
tatttacaacttagagcctc

SEQ ID NO: 7786573 - DNA, 22 bp, Homo sapiens
tattggaagtgaacaccaggct

SEQ ID NO: 7786574 - DNA, 22 bp, Homo sapiens
cagtcctctcactcaggccttt

SEQ ID NO: 7786575 - DNA, 22 bp, Homo sapiens
cagtcctggggaccaggctgag

SEQ ID NO: 7786576 - DNA, 22 bp, Homo sapiens
cagtcctggggaccaggctgag

SEQ ID NO: 7786577 - DNA, 22 bp, Homo sapiens
cagtcctggggaccaggctgag

SEQ ID NO: 7786578 - DNA, 20 bp, Homo sapiens
cagtcctgtccctgctgccc

SEQ ID NO: 7786579 - DNA, 18 bp, Homo sapiens
cagtcctgtttctacagg

SEQ ID NO: 7786580 - DNA, 22 bp, Homo sapiens
cagtcctgttcctggagtagtt

SEQ ID NO: 7786581 - DNA, 22 bp, Homo sapiens
cagtcctgtgtcccttggtggg

SEQ ID NO: 7786582 - DNA, 22 bp, Homo sapiens
cagtcctgtctttatgacttca

SEQ ID NO: 7786583 - DNA, 22 bp, Homo sapiens
cagtcctgtgtcccttggtggg

SEQ ID NO: 7786584 - DNA, 22 bp, Homo sapiens
cagtccttgatccaatagtggg

SEQ ID NO: 7786585 - DNA, 22 bp, Homo sapiens
cagtgctgtgtttgctgcctgg

SEQ ID NO: 7786586 - DNA, 22 bp, Homo sapiens
cagtgctgcatctccatgccag

SEQ ID NO: 7786587 - DNA, 22 bp, Homo sapiens
cagtgctgcaggcgcctgcggt

SEQ ID NO: 7786588 - DNA, 22 bp, Homo sapiens
cagtgctgccaaagggaccttg

SEQ ID NO: 7786589 - DNA, 22 bp, Homo sapiens
cagtgcagaggccagggaggat

SEQ ID NO: 7786590 - DNA, 22 bp, Homo sapiens
tcagaaggatgtgcaggtggca

SEQ ID NO: 7786591 - DNA, 19 bp, Homo sapiens
tcagaaggcaggagaggcc

SEQ ID NO: 7786592 - DNA, 22 bp, Homo sapiens
tcagaaggaagaagtcatggga

SEQ ID NO: 7786593 - DNA, 22 bp, Homo sapiens
tcagaaggaaacgatgccagct

SEQ ID NO: 7786594 - DNA, 22 bp, Homo sapiens
tcagaagctggtgtcctttgaa

SEQ ID NO: 7786595 - DNA, 22 bp, Homo sapiens
tcagaaatgtaagctgatgact

SEQ ID NO: 7786596 - DNA, 22 bp, Homo sapiens
tgttaaaaattcagctctagat

SEQ ID NO: 7786597 - DNA, 22 bp, Homo sapiens
tgttaaaaccacaggtgaggac

SEQ ID NO: 7786598 - DNA, 22 bp, Homo sapiens
tgttaaaaatgcagattcctat

SEQ ID NO: 7786599 - DNA, 22 bp, Homo sapiens
tgtgtcaagtggaatttcaggg

SEQ ID NO: 7786600 - DNA, 22 bp, Homo sapiens
tgtgtcaaggcatcagcccagc

SEQ ID NO: 7786601 - DNA, 22 bp, Homo sapiens
tgtgtcaattttcattcctact

SEQ ID NO: 7786602 - DNA, 22 bp, Homo sapiens
tgtgtcaatttatgtcattcat

SEQ ID NO: 7786603 - DNA, 22 bp, Homo sapiens
tgtgtcaagacatttagtcatt

SEQ ID NO: 7786604 - DNA, 22 bp, Homo sapiens
tgtgtcaacctgtggccgggtg

SEQ ID NO: 7786605 - DNA, 22 bp, Homo sapiens
tgtgtcaaattgttttacacag

SEQ ID NO: 7786606 - DNA, 22 bp, Homo sapiens
tgtgtcaaagtgtggagtattt

SEQ ID NO: 7786607 - DNA, 22 bp, Homo sapiens
tgtgtcaacaacagccttggat

SEQ ID NO: 7786608 - DNA, 22 bp, Homo sapiens
tgtgtacttttgtttctaagcc

SEQ ID NO: 7786609 - DNA, 22 bp, Homo sapiens
tgtgtagaaagatctccaagat

SEQ ID NO: 7786610 - DNA, 22 bp, Homo sapiens
tgtgtcaaagtcaggtgtcact

SEQ ID NO: 7786611 - DNA, 22 bp, Homo sapiens
tgtgtattctgaggtaggtata

SEQ ID NO: 7786612 - DNA, 22 bp, Homo sapiens
tgtgtattaccattttacagct

SEQ ID NO: 7786613 - DNA, 22 bp, Homo sapiens
tgtgtgcatgttaatgagaaaa

SEQ ID NO: 7786614 - DNA, 22 bp, Homo sapiens
tgtgtgcattagcattctaggg

SEQ ID NO: 7786615 - DNA, 19 bp, Homo sapiens
tgtgggcaagggatggcag

SEQ ID NO: 7786616 - DNA, 22 bp, Homo sapiens
tgtgggcaaagggtagctgggt

SEQ ID NO: 7786617 - DNA, 22 bp, Homo sapiens
tgtgggaggtctggaaggctcc

SEQ ID NO: 7786618 - DNA, 22 bp, Homo sapiens
tgtgggaggtctggaaggctcc

SEQ ID NO: 7786619 - DNA, 22 bp, Homo sapiens
tgtgggccctaggcaccttgtc

SEQ ID NO: 7786620 - DNA, 20 bp, Homo sapiens
tgtgggcccttggctggcaa

SEQ ID NO: 7786621 - DNA, 22 bp, Homo sapiens
tgtgggcaggcccgggtctgag

SEQ ID NO: 7786622 - DNA, 22 bp, Homo sapiens
tgtgggaggaattagaatggga

SEQ ID NO: 7786623 - DNA, 22 bp, Homo sapiens
tgtgggaggaacacagccagaa

SEQ ID NO: 7786624 - DNA, 22 bp, Homo sapiens
tgtgggaggaacacagccagaa

SEQ ID NO: 7786625 - DNA, 22 bp, Homo sapiens
tgtgggagaaggaagcaagctg

SEQ ID NO: 7786626 - DNA, 22 bp, Homo sapiens
tgtgggagaaggaagcaagctg

SEQ ID NO: 7786627 - DNA, 22 bp, Homo sapiens
tgtgggagaaggaagcaagctg

SEQ ID NO: 7786628 - DNA, 22 bp, Homo sapiens
tgtggaagggacactggactgg

SEQ ID NO: 7786629 - DNA, 22 bp, Homo sapiens
tgtggctgactcctggtcccca

SEQ ID NO: 7786630 - DNA, 22 bp, Homo sapiens
tgtggctctcctcctgctgccc

SEQ ID NO: 7786631 - DNA, 22 bp, Homo sapiens
tgttgagactgagggagtcagc

SEQ ID NO: 7786632 - DNA, 22 bp, Homo sapiens
tgtttaaatagaacatactgca

SEQ ID NO: 7786633 - DNA, 21 bp, Homo sapiens
tgtttactccctgcaagcacg

SEQ ID NO: 7786634 - DNA, 22 bp, Homo sapiens
tgtttaagctgatgaggtatcg

SEQ ID NO: 7786635 - DNA, 22 bp, Homo sapiens
tgtttatagggtctgtcacttg

SEQ ID NO: 7786636 - DNA, 18 bp, Homo sapiens
tgtttattctcctgacag

SEQ ID NO: 7786637 - DNA, 22 bp, Homo sapiens
tgtttattgctgcaattgtgcc

SEQ ID NO: 7786638 - DNA, 22 bp, Homo sapiens
tgttcttagcaggagcatctat

SEQ ID NO: 7786639 - DNA, 22 bp, Homo sapiens
tgttcttatgaattcaagacac

SEQ ID NO: 7786640 - DNA, 22 bp, Homo sapiens
tgttcttatgatgaagcactga

SEQ ID NO: 7786641 - DNA, 22 bp, Homo sapiens
tgttcttaacttttgtgtatat

SEQ ID NO: 7786642 - DNA, 22 bp, Homo sapiens
tgttcttacggaacttatcttt

SEQ ID NO: 7786643 - DNA, 22 bp, Homo sapiens
tgttcttacggaacttatcttt

SEQ ID NO: 7786644 - DNA, 22 bp, Homo sapiens
tgttaggactccccagaagctg

SEQ ID NO: 7786645 - DNA, 22 bp, Homo sapiens
tgttctttagcagaccatgttg

SEQ ID NO: 7786646 - DNA, 22 bp, Homo sapiens
ttaaaatttccccaccatgtat

SEQ ID NO: 7786647 - DNA, 22 bp, Homo sapiens
ttaaaatttccccaccatgtat

SEQ ID NO: 7786648 - DNA, 22 bp, Homo sapiens
ttaaaattatggcccatttgga

SEQ ID NO: 7786649 - DNA, 22 bp, Homo sapiens
ttaaaattatggcccatttgga

SEQ ID NO: 7786650 - DNA, 22 bp, Homo sapiens
ttaaacatttttgatgatcgat

SEQ ID NO: 7786651 - DNA, 22 bp, Homo sapiens
ttaaacagtatatctgagcaag

SEQ ID NO: 7786652 - DNA, 22 bp, Homo sapiens
ttaaaaatatgtagggcccgat

SEQ ID NO: 7786653 - DNA, 22 bp, Homo sapiens
ttaaaagagacttcctttgttt

SEQ ID NO: 7786654 - DNA, 22 bp, Homo sapiens
ttaaaagagacttcctttgttt

SEQ ID NO: 7786655 - DNA, 22 bp, Homo sapiens
ttaaaagaatcctgttatcctc

SEQ ID NO: 7786656 - DNA, 22 bp, Homo sapiens
ttaaaaccatcagctgtaagat

SEQ ID NO: 7786657 - DNA, 22 bp, Homo sapiens
ttaaaacagcgtgaatctggca

SEQ ID NO: 7786658 - DNA, 22 bp, Homo sapiens
tgttttaatctcccattgctct

SEQ ID NO: 7786659 - DNA, 22 bp, Homo sapiens
tgttttaagagcgcactttata

SEQ ID NO: 7786660 - DNA, 22 bp, Homo sapiens
tgttttatgagccatataacct

SEQ ID NO: 7786661 - DNA, 22 bp, Homo sapiens
tgttttatgagccatataacct

SEQ ID NO: 7786662 - DNA, 22 bp, Homo sapiens
tgttttatcaagatggcatgtc

SEQ ID NO: 7786663 - DNA, 22 bp, Homo sapiens
tgttttagttctgtcttgcatg

SEQ ID NO: 7786664 - DNA, 18 bp, Homo sapiens
tgtttatttttctcttac

SEQ ID NO: 7786665 - DNA, 22 bp, Homo sapiens
tgtttcaaaacagtgataattt

SEQ ID NO: 7786666 - DNA, 22 bp, Homo sapiens
tgtttcaaagaaagaaaatata

SEQ ID NO: 7786667 - DNA, 22 bp, Homo sapiens
tgtttgtcatcattgtgagaga

SEQ ID NO: 7786668 - DNA, 22 bp, Homo sapiens
tgtctgaaacttggtcctatgc

SEQ ID NO: 7786669 - DNA, 20 bp, Homo sapiens
tgtctgaaaaggaagctatc

SEQ ID NO: 7786670 - DNA, 22 bp, Homo sapiens
tgtctgaaagaggacgagctgg

SEQ ID NO: 7786671 - DNA, 22 bp, Homo sapiens
tgtctgagtggtgcaaggctga

SEQ ID NO: 7786672 - DNA, 22 bp, Homo sapiens
tgtctgctaaattactattaca

SEQ ID NO: 7786673 - DNA, 22 bp, Homo sapiens
tgtctgaattttggaatcaagt

SEQ ID NO: 7786674 - DNA, 22 bp, Homo sapiens
tgtctgaggaagtcagcccttt

SEQ ID NO: 7786675 - DNA, 22 bp, Homo sapiens
tgtctgaaggcaggtggagaac

SEQ ID NO: 7786676 - DNA, 22 bp, Homo sapiens
tgtctgaatcgcttcctagagg

SEQ ID NO: 7786677 - DNA, 22 bp, Homo sapiens
tgtctgaatctcggtttcctca

SEQ ID NO: 7786678 - DNA, 22 bp, Homo sapiens
tgtctgaattcaagaaattcaa

SEQ ID NO: 7786679 - DNA, 22 bp, Homo sapiens
tgtctgaacaaactctgcctcc

SEQ ID NO: 7786680 - DNA, 22 bp, Homo sapiens
tgtctgaacgaagtaggtccac

SEQ ID NO: 7786681 - DNA, 22 bp, Homo sapiens
tgtctgaactgcactgaaagac

SEQ ID NO: 7786682 - DNA, 22 bp, Homo sapiens
tgtctgaagcagccagtgctgt

SEQ ID NO: 7786683 - DNA, 22 bp, Homo sapiens
tgtctaggtctaggttggcaat

SEQ ID NO: 7786684 - DNA, 22 bp, Homo sapiens
tgtctccacaggtgtcagctca

SEQ ID NO: 7786685 - DNA, 22 bp, Homo sapiens
tgtcgcagctgaaaatctcaat

SEQ ID NO: 7786686 - DNA, 22 bp, Homo sapiens
tgtctaatgaattaattaatta

SEQ ID NO: 7786687 - DNA, 22 bp, Homo sapiens
tgtctcccaggtgtgcccagtg

SEQ ID NO: 7786688 - DNA, 22 bp, Homo sapiens
tgtctctagggcaatgtgaact

SEQ ID NO: 7786689 - DNA, 22 bp, Homo sapiens
tgtcttctgtattcaagtctat

SEQ ID NO: 7786690 - DNA, 22 bp, Homo sapiens
tgtcttgactttagagccagga

SEQ ID NO: 7786691 - DNA, 22 bp, Homo sapiens
tgtctttaaaattaaacacatc

SEQ ID NO: 7786692 - DNA, 23 bp, Homo sapiens
tgtctttgttaggactgtgttta

SEQ ID NO: 7786693 - DNA, 23 bp, Homo sapiens
tgtctttgttaggactgtgttta

SEQ ID NO: 7786694 - DNA, 22 bp, Homo sapiens
tgtctttgtgtacaggatcgcc

SEQ ID NO: 7786695 - DNA, 22 bp, Homo sapiens
tgtcttttacctaatgagctgg

SEQ ID NO: 7786696 - DNA, 21 bp, Homo sapiens
tgtctttggcctcattcccag

SEQ ID NO: 7786697 - DNA, 22 bp, Homo sapiens
tgtctttggggctgtacctgtt

SEQ ID NO: 7786698 - DNA, 22 bp, Homo sapiens
tgtctttaattctacatatctc

SEQ ID NO: 7786699 - DNA, 22 bp, Homo sapiens
tgtcttttggagcatctttctt

SEQ ID NO: 7786700 - DNA, 22 bp, Homo sapiens
tgtgaaaagggctttgtacaaa

SEQ ID NO: 7786701 - DNA, 22 bp, Homo sapiens
tgtgaaaagcgtgtgttctagg

SEQ ID NO: 7786702 - DNA, 19 bp, Homo sapiens
tgtctgctgatgactctat

SEQ ID NO: 7786703 - DNA, 22 bp, Homo sapiens
tgtctgttattggtgtataaga

SEQ ID NO: 7786704 - DNA, 18 bp, Homo sapiens
tgtgcaatattaaccacc

SEQ ID NO: 7786705 - DNA, 22 bp, Homo sapiens
tgtgcaataatcatagtgattt

SEQ ID NO: 7786706 - DNA, 22 bp, Homo sapiens
tgtgcagagtaaggcagctgtt

SEQ ID NO: 7786707 - DNA, 22 bp, Homo sapiens
tgtgcctcatgtatctggatga

SEQ ID NO: 7786708 - DNA, 22 bp, Homo sapiens
tgtgccctgttaaatgcacagt

SEQ ID NO: 7786709 - DNA, 22 bp, Homo sapiens
tgtgctctacctcagtgtcatt

SEQ ID NO: 7786710 - DNA, 22 bp, Homo sapiens
tgtgctctgcaatcagttcttt

SEQ ID NO: 7786711 - DNA, 22 bp, Homo sapiens
tgtggaaaagccccacaggact

SEQ ID NO: 7786712 - DNA, 22 bp, Homo sapiens
tgtggaaagtcaagttccagga

SEQ ID NO: 7786713 - DNA, 22 bp, Homo sapiens
tgtgctgagtgatcccattcct

SEQ ID NO: 7786714 - DNA, 22 bp, Homo sapiens
tgtgacttttcacaggctggtc

SEQ ID NO: 7786715 - DNA, 22 bp, Homo sapiens
tgtgagaagggcatgcagggag

SEQ ID NO: 7786716 - DNA, 22 bp, Homo sapiens
tgtgactggcttatttcactta

SEQ ID NO: 7786717 - DNA, 20 bp, Homo sapiens
tgtgagagggtggcttgccc

SEQ ID NO: 7786718 - DNA, 22 bp, Homo sapiens
tgtgagtctaggtcagggtgtt

SEQ ID NO: 7786719 - DNA, 22 bp, Homo sapiens
tgtgagtgacagttcccttggt

SEQ ID NO: 7786720 - DNA, 22 bp, Homo sapiens
tgtgatatttgagtattgtcaa

SEQ ID NO: 7786721 - DNA, 22 bp, Homo sapiens
tgtgattactgaatagaaaata

SEQ ID NO: 7786722 - DNA, 22 bp, Homo sapiens
tgtgattagctgaatacactgg

SEQ ID NO: 7786723 - DNA, 22 bp, Homo sapiens
tgtgattatttgattaacatgt

SEQ ID NO: 7786724 - DNA, 22 bp, Homo sapiens
tgtgattatattgtagtacatt

SEQ ID NO: 7786725 - DNA, 22 bp, Homo sapiens
ttccagccagatttgctgggtt

SEQ ID NO: 7786726 - DNA, 22 bp, Homo sapiens
ttccagccactttatactgcta

SEQ ID NO: 7786727 - DNA, 22 bp, Homo sapiens
ttccagccatggtttccctatg

SEQ ID NO: 7786728 - DNA, 20 bp, Homo sapiens
ttccagccgccacttccgcc

SEQ ID NO: 7786729 - DNA, 22 bp, Homo sapiens
ttccagcccgcgacttgttcag

SEQ ID NO: 7786730 - DNA, 22 bp, Homo sapiens
ttccagcctttatccatccaga

SEQ ID NO: 7786731 - DNA, 22 bp, Homo sapiens
ttccagctaactcacatccctt

SEQ ID NO: 7786732 - DNA, 22 bp, Homo sapiens
ttccagagttgggggagtggtt

SEQ ID NO: 7786733 - DNA, 22 bp, Homo sapiens
ttccagcaggcagacaggagat

SEQ ID NO: 7786734 - DNA, 22 bp, Homo sapiens
ttccagaggcttcagggaagaa

SEQ ID NO: 7786735 - DNA, 22 bp, Homo sapiens
ttccagaggggaggtggcagcc

SEQ ID NO: 7786736 - DNA, 22 bp, Homo sapiens
ttccagagtattggtagctata

SEQ ID NO: 7786737 - DNA, 22 bp, Homo sapiens
ttccagaggttctcagccctgt

SEQ ID NO: 7786738 - DNA, 22 bp, Homo sapiens
ttccagagtccatgttggctca

SEQ ID NO: 7786739 - DNA, 23 bp, Homo sapiens
ttccagagtcttcgacggtaggc

SEQ ID NO: 7786740 - DNA, 22 bp, Homo sapiens
ttcattactgaattctcactac

SEQ ID NO: 7786741 - DNA, 17 bp, Homo sapiens
ttcattaataaaagcaa

SEQ ID NO: 7786742 - DNA, 17 bp, Homo sapiens
ttcattaataaaagcaa

SEQ ID NO: 7786743 - DNA, 20 bp, Homo sapiens
ttcattcacgtagctgttga

SEQ ID NO: 7786744 - DNA, 22 bp, Homo sapiens
ttcattcatctctaaaatgcct

SEQ ID NO: 7786745 - DNA, 22 bp, Homo sapiens
ttcattcaggtgtatttatggg

SEQ ID NO: 7786746 - DNA, 22 bp, Homo sapiens
ttccagaggctctaggggagaa

SEQ ID NO: 7786747 - DNA, 22 bp, Homo sapiens
ttccagaggcctgggcacactc

SEQ ID NO: 7786748 - DNA, 23 bp, Homo sapiens
ttccagaggaagaagtcatgact

SEQ ID NO: 7786749 - DNA, 22 bp, Homo sapiens
ttcattgatttaacaaacaagt

SEQ ID NO: 7786750 - DNA, 21 bp, Homo sapiens
ttcattgaactatttgtggag

SEQ ID NO: 7786751 - DNA, 22 bp, Homo sapiens
ttcattgaagcacaagtgatct

SEQ ID NO: 7786752 - DNA, 22 bp, Homo sapiens
ttcattgactggttcgttaagt

SEQ ID NO: 7786753 - DNA, 22 bp, Homo sapiens
ttcattgaaggagggacttgct

SEQ ID NO: 7786754 - DNA, 22 bp, Homo sapiens
ttcattgagtataggggtatac

SEQ ID NO: 7786755 - DNA, 23 bp, Homo sapiens
ttcattgagctgttcttgaggat

SEQ ID NO: 7786756 - DNA, 22 bp, Homo sapiens
ttcattgagctgtacacttagg

SEQ ID NO: 7786757 - DNA, 22 bp, Homo sapiens
ttcattgattccaggctcttct

SEQ ID NO: 7786758 - DNA, 23 bp, Homo sapiens
ttcattgattgcaaggagattgg

SEQ ID NO: 7786759 - DNA, 22 bp, Homo sapiens
ttcattgatgtggtttaatgta

SEQ ID NO: 7786760 - DNA, 22 bp, Homo sapiens
ttcattgatgtggtttaatgta

SEQ ID NO: 7786761 - DNA, 22 bp, Homo sapiens
ttcattgatagttttatgtatg

SEQ ID NO: 7786762 - DNA, 22 bp, Homo sapiens
ttcattgagtggtttattctaa

SEQ ID NO: 7786763 - DNA, 22 bp, Homo sapiens
ttcattgagttactgcctgggc

SEQ ID NO: 7786764 - DNA, 22 bp, Homo sapiens
ttcattgatagttttatgtatg

SEQ ID NO: 7786765 - DNA, 19 bp, Homo sapiens
ttcattctttctacttacc

SEQ ID NO: 7786766 - DNA, 19 bp, Homo sapiens
ttcattctttctacttacc

SEQ ID NO: 7786767 - DNA, 22 bp, Homo sapiens
ttcattctttgaatctgaggta

SEQ ID NO: 7786768 - DNA, 22 bp, Homo sapiens
ttcattgaaatacagtcttgac

SEQ ID NO: 7786769 - DNA, 22 bp, Homo sapiens
ttcattgaaatgtttctagctg

SEQ ID NO: 7786770 - DNA, 22 bp, Homo sapiens
ttcattgaaccactttattctt

SEQ ID NO: 7786771 - DNA, 22 bp, Homo sapiens
ttcattgaaattaagcccaact

SEQ ID NO: 7786772 - DNA, 22 bp, Homo sapiens
ttcattcttttacatgtgaata

SEQ ID NO: 7786773 - DNA, 22 bp, Homo sapiens
ttcattcttttacatgtgaata

SEQ ID NO: 7786774 - DNA, 22 bp, Homo sapiens
ttcattcatgtattgtctatgg

SEQ ID NO: 7786775 - DNA, 22 bp, Homo sapiens
ttcattcttgtctttgtatagt

SEQ ID NO: 7786776 - DNA, 22 bp, Homo sapiens
ttcattcttgtctttgtatagt

SEQ ID NO: 7786777 - DNA, 22 bp, Homo sapiens
ttcagcttgcttagtctccttc

SEQ ID NO: 7786778 - DNA, 23 bp, Homo sapiens
ttcaggaaatgaatacagacaca

SEQ ID NO: 7786779 - DNA, 22 bp, Homo sapiens
ttcagcattggtatgaaaaccc

SEQ ID NO: 7786780 - DNA, 22 bp, Homo sapiens
ttcagcagtcgtccaggaaaag

SEQ ID NO: 7786781 - DNA, 22 bp, Homo sapiens
ttcagcagtgcagacacccagt

SEQ ID NO: 7786782 - DNA, 22 bp, Homo sapiens
ttcactatgcttggaaacttct

SEQ ID NO: 7786783 - DNA, 22 bp, Homo sapiens
ttcactataaagtttcaacttt

SEQ ID NO: 7786784 - DNA, 22 bp, Homo sapiens
ttcaccatttcccactaaacca

SEQ ID NO: 7786785 - DNA, 22 bp, Homo sapiens
ttcaccattacatacaaagatg

SEQ ID NO: 7786786 - DNA, 23 bp, Homo sapiens
ttatttggattttagtggaaaga

SEQ ID NO: 7786787 - DNA, 22 bp, Homo sapiens
ttatttctactattttgcctga

SEQ ID NO: 7786788 - DNA, 22 bp, Homo sapiens
ttatttcctgacacagctgatt

SEQ ID NO: 7786789 - DNA, 22 bp, Homo sapiens
ttatttcctctctaatagggta

SEQ ID NO: 7786790 - DNA, 22 bp, Homo sapiens
ttatttcttgtctatgtagcca

SEQ ID NO: 7786791 - DNA, 22 bp, Homo sapiens
ttcacattgtgcagattatggt

SEQ ID NO: 7786792 - DNA, 22 bp, Homo sapiens
ttcacattgttttaatgtgaat

SEQ ID NO: 7786793 - DNA, 22 bp, Homo sapiens
ttcacatttcataccacagctt

SEQ ID NO: 7786794 - DNA, 22 bp, Homo sapiens
ttcaccataatgcaaagtggga

SEQ ID NO: 7786795 - DNA, 22 bp, Homo sapiens
ttcaccatgggatgacaacagt

SEQ ID NO: 7786796 - DNA, 22 bp, Homo sapiens
ttcacatttgcccttatgtgtg

SEQ ID NO: 7786797 - DNA, 22 bp, Homo sapiens
ttcacatttgaaaggaaagata

SEQ ID NO: 7786798 - DNA, 20 bp, Homo sapiens
ttcacatttctgtagtgatt

SEQ ID NO: 7786799 - DNA, 22 bp, Homo sapiens
ttaataaagtatgaattggaaa

SEQ ID NO: 7786800 - DNA, 22 bp, Homo sapiens
ttaataacattgtgtatcaccc

SEQ ID NO: 7786801 - DNA, 22 bp, Homo sapiens
ttaatacaagcatatgcacaca

SEQ ID NO: 7786802 - DNA, 22 bp, Homo sapiens
ttaatacaactgttgtcactgg

SEQ ID NO: 7786803 - DNA, 22 bp, Homo sapiens
ttaatacaagcatatgcacaca

SEQ ID NO: 7786804 - DNA, 22 bp, Homo sapiens
ttaatacagtctccagaagtaa

SEQ ID NO: 7786805 - DNA, 22 bp, Homo sapiens
ttaatacagaagcaagacactg

SEQ ID NO: 7786806 - DNA, 22 bp, Homo sapiens
ttaatggcagggcagaatatta

SEQ ID NO: 7786807 - DNA, 22 bp, Homo sapiens
ttaatgtatggggttgagatga

SEQ ID NO: 7786808 - DNA, 22 bp, Homo sapiens
ttaaagaatagtgcccctattg

SEQ ID NO: 7786809 - DNA, 22 bp, Homo sapiens
ttaaagagaactcaatgaatga

SEQ ID NO: 7786810 - DNA, 22 bp, Homo sapiens
ttaaagaggcatgggaatgtat

SEQ ID NO: 7786811 - DNA, 22 bp, Homo sapiens
ttaataaagtatgaattggaaa

SEQ ID NO: 7786812 - DNA, 22 bp, Homo sapiens
ttaataaagtatgaattggaaa

SEQ ID NO: 7786813 - DNA, 22 bp, Homo sapiens
ttaataaagtatgaattggaaa

SEQ ID NO: 7786814 - DNA, 22 bp, Homo sapiens
ttaaagagtctactgcacatcc

SEQ ID NO: 7786815 - DNA, 22 bp, Homo sapiens
ttaatgttttaagttatagaga

SEQ ID NO: 7786816 - DNA, 20 bp, Homo sapiens
ttacaaagaggcatcgcttt

SEQ ID NO: 7786817 - DNA, 22 bp, Homo sapiens
ttaattaattagttaagcatgt

SEQ ID NO: 7786818 - DNA, 22 bp, Homo sapiens
ttacaaagtttaaggtggcact

SEQ ID NO: 7786819 - DNA, 22 bp, Homo sapiens
ttacaaagttctgagttcaaac

SEQ ID NO: 7786820 - DNA, 22 bp, Homo sapiens
ttacaaagtgttatgataaaca

SEQ ID NO: 7786821 - DNA, 21 bp, Homo sapiens
ttacaaagctacagatgttgc

SEQ ID NO: 7786822 - DNA, 22 bp, Homo sapiens
ttacaacaaaggcacgtgcatg

SEQ ID NO: 7786823 - DNA, 17 bp, Homo sapiens
ttacaacaattcatgag

SEQ ID NO: 7786824 - DNA, 22 bp, Homo sapiens
ttacaacaccaggcagtatcct

SEQ ID NO: 7786825 - DNA, 22 bp, Homo sapiens
ttacaacaccaggcagtatcct

SEQ ID NO: 7786826 - DNA, 17 bp, Homo sapiens
ttacaacaattcatgag

SEQ ID NO: 7786827 - DNA, 22 bp, Homo sapiens
ttacaacagacacatattctaa

SEQ ID NO: 7786828 - DNA, 22 bp, Homo sapiens
ttacaacagacacatattctaa

SEQ ID NO: 7786829 - DNA, 22 bp, Homo sapiens
ttacaacactacttatccttga

SEQ ID NO: 7786830 - DNA, 21 bp, Homo sapiens
ttacaacatttgtgttctatg

SEQ ID NO: 7786831 - DNA, 22 bp, Homo sapiens
ttacaacttgcagaggatgttg

SEQ ID NO: 7786832 - DNA, 22 bp, Homo sapiens
ttacaacttgcagaggatgttg

SEQ ID NO: 7786833 - DNA, 22 bp, Homo sapiens
ttacatgactgcccttgtcagg

SEQ ID NO: 7786834 - DNA, 22 bp, Homo sapiens
ttacatgttctcatacacagag

SEQ ID NO: 7786835 - DNA, 22 bp, Homo sapiens
ttacatgtggtgtgaagaagag

SEQ ID NO: 7786836 - DNA, 22 bp, Homo sapiens
ttacattcttggaatcttgttt

SEQ ID NO: 7786837 - DNA, 22 bp, Homo sapiens
ttacattcttatctcagttatt

SEQ ID NO: 7786838 - DNA, 21 bp, Homo sapiens
ttacattcagaggagtggaag

SEQ ID NO: 7786839 - DNA, 22 bp, Homo sapiens
ttacattcccagtgtgcagcat

SEQ ID NO: 7786840 - DNA, 22 bp, Homo sapiens
ttacattcattgaagtgattca

SEQ ID NO: 7786841 - DNA, 22 bp, Homo sapiens
ttacattcaatttctagaggta

SEQ ID NO: 7786842 - DNA, 22 bp, Homo sapiens
ttacattcagaaagatttgagt

SEQ ID NO: 7786843 - DNA, 22 bp, Homo sapiens
ttacattcaaggaactcattct

SEQ ID NO: 7786844 - DNA, 22 bp, Homo sapiens
ttacatttcccccttggaggct

SEQ ID NO: 7786845 - DNA, 22 bp, Homo sapiens
ttacatttggctatgtcctcta

SEQ ID NO: 7786846 - DNA, 22 bp, Homo sapiens
ttacattttagttaacctgtga

SEQ ID NO: 7786847 - DNA, 22 bp, Homo sapiens
ttacacaaacacattccagata

SEQ ID NO: 7786848 - DNA, 22 bp, Homo sapiens
ttacacaaaaataagatatggc

SEQ ID NO: 7786849 - DNA, 22 bp, Homo sapiens
ttacacaaaaataagatatggc

SEQ ID NO: 7786850 - DNA, 22 bp, Homo sapiens
ttacacaaaaataagatatggc

SEQ ID NO: 7786851 - DNA, 22 bp, Homo sapiens
ttacagagctcatttctaaggg

SEQ ID NO: 7786852 - DNA, 22 bp, Homo sapiens
ttacagagctgggtggagagag

SEQ ID NO: 7786853 - DNA, 22 bp, Homo sapiens
ttacagaggcttccagggccca

SEQ ID NO: 7786854 - DNA, 17 bp, Homo sapiens
ttacagaggtaattaag

SEQ ID NO: 7786855 - DNA, 22 bp, Homo sapiens
ttacagaggtatgtatgtctct

SEQ ID NO: 7786856 - DNA, 22 bp, Homo sapiens
ttacagagggcttctctgaact

SEQ ID NO: 7786857 - DNA, 22 bp, Homo sapiens
ttacagagaggtgattgtgaag

SEQ ID NO: 7786858 - DNA, 22 bp, Homo sapiens
ttacagagcctcattttagaga

SEQ ID NO: 7786859 - DNA, 22 bp, Homo sapiens
ttacagagataaactgtaagtg

SEQ ID NO: 7786860 - DNA, 22 bp, Homo sapiens
ttacagagttcgcacctggtgg

SEQ ID NO: 7786861 - DNA, 22 bp, Homo sapiens
ttacagagtagggaattgaagt

SEQ ID NO: 7786862 - DNA, 22 bp, Homo sapiens
ttacagagtagtgcagaactca

SEQ ID NO: 7786863 - DNA, 22 bp, Homo sapiens
ttacagagtggtctggctatgt

SEQ ID NO: 7786864 - DNA, 22 bp, Homo sapiens
ttacaagtactgaatatgattt

SEQ ID NO: 7786865 - DNA, 22 bp, Homo sapiens
ttacaattgagtctattgtatg

SEQ ID NO: 7786866 - DNA, 22 bp, Homo sapiens
ttacaattgagtctattgtatg

SEQ ID NO: 7786867 - DNA, 22 bp, Homo sapiens
ttacaattgagtctattgtatg

SEQ ID NO: 7786868 - DNA, 22 bp, Homo sapiens
ttacaagcagctacatatcaca

SEQ ID NO: 7786869 - DNA, 22 bp, Homo sapiens
ttacaagataacggagaaagca

SEQ ID NO: 7786870 - DNA, 22 bp, Homo sapiens
ttacaagacagtgtggtaaata

SEQ ID NO: 7786871 - DNA, 22 bp, Homo sapiens
ttagataacagtagaatatcaa

SEQ ID NO: 7786872 - DNA, 22 bp, Homo sapiens
ttagataatgtagagatatgag

SEQ ID NO: 7786873 - DNA, 22 bp, Homo sapiens
ttagataacagtagaatatcaa

SEQ ID NO: 7786874 - DNA, 22 bp, Homo sapiens
ttagataatgtagagatatgag

SEQ ID NO: 7786875 - DNA, 22 bp, Homo sapiens
ttagatcaatactaaagaagtt

SEQ ID NO: 7786876 - DNA, 22 bp, Homo sapiens
ttagaacatagcaacagaatta

SEQ ID NO: 7786877 - DNA, 22 bp, Homo sapiens
ttagaacaatattctccctaca

SEQ ID NO: 7786878 - DNA, 22 bp, Homo sapiens
ttagaaatacaagtgaggttga

SEQ ID NO: 7786879 - DNA, 22 bp, Homo sapiens
ttagaaatacaagtgaggttga

SEQ ID NO: 7786880 - DNA, 22 bp, Homo sapiens
ttacattttgcacagatgtccc

SEQ ID NO: 7786881 - DNA, 22 bp, Homo sapiens
ttagcaaacctggactacagat

SEQ ID NO: 7786882 - DNA, 22 bp, Homo sapiens
ttagatcattttgaactaattt

SEQ ID NO: 7786883 - DNA, 22 bp, Homo sapiens
ttagatgtgcaggacttttatc

SEQ ID NO: 7786884 - DNA, 22 bp, Homo sapiens
ttagatttacaagcactgttta

SEQ ID NO: 7786885 - DNA, 22 bp, Homo sapiens
ttagatttacaagcactgttta

SEQ ID NO: 7786886 - DNA, 22 bp, Homo sapiens
ttagggttacaccagcctcctg

SEQ ID NO: 7786887 - DNA, 22 bp, Homo sapiens
ttagggttacaccagcctcctg

SEQ ID NO: 7786888 - DNA, 22 bp, Homo sapiens
ttagggttacaccagcctcctg

SEQ ID NO: 7786889 - DNA, 22 bp, Homo sapiens
ttagtaattagaaagtaattct

SEQ ID NO: 7786890 - DNA, 22 bp, Homo sapiens
ttatgatttagaaagattcact

SEQ ID NO: 7786891 - DNA, 22 bp, Homo sapiens
ttatgagactgttttacacact

SEQ ID NO: 7786892 - DNA, 22 bp, Homo sapiens
ttatgatttgccacagattggt

SEQ ID NO: 7786893 - DNA, 22 bp, Homo sapiens
ttatgatttgccacagattggt

SEQ ID NO: 7786894 - DNA, 22 bp, Homo sapiens
ttattattgattcgctctcaaa

SEQ ID NO: 7786895 - DNA, 22 bp, Homo sapiens
ttattattccccaagtcattat

SEQ ID NO: 7786896 - DNA, 22 bp, Homo sapiens
ttatctgaaaacctcaaaatat

SEQ ID NO: 7786897 - DNA, 22 bp, Homo sapiens
ttatctgaaaacctcaaaatat

SEQ ID NO: 7786898 - DNA, 22 bp, Homo sapiens
ttagtcaatagtgaatatagag

SEQ ID NO: 7786899 - DNA, 22 bp, Homo sapiens
ttagtcaatagtgaatatagag

SEQ ID NO: 7786900 - DNA, 22 bp, Homo sapiens
ttagtcaaatcattctgtttct

SEQ ID NO: 7786901 - DNA, 22 bp, Homo sapiens
ttagtgatcaaaatcaaaattg

SEQ ID NO: 7786902 - DNA, 22 bp, Homo sapiens
ttattccatagaagtcaaggaa

SEQ ID NO: 7786903 - DNA, 22 bp, Homo sapiens
ttattcagtgcatatattaaaa

SEQ ID NO: 7786904 - DNA, 22 bp, Homo sapiens
ttattcagtttgtgtagaggtg

SEQ ID NO: 7786905 - DNA, 22 bp, Homo sapiens
ttattcattaacagggaccaaa

SEQ ID NO: 7786906 - DNA, 22 bp, Homo sapiens
ttattcttggatctgagtctct

SEQ ID NO: 7786907 - DNA, 22 bp, Homo sapiens
ttattcttggatctgagtctct

SEQ ID NO: 7786908 - DNA, 22 bp, Homo sapiens
ttatttccaaactggatatacc

SEQ ID NO: 7786909 - DNA, 22 bp, Homo sapiens
tggtataagctgtgtcagagcc

SEQ ID NO: 7786910 - DNA, 22 bp, Homo sapiens
tggtagtcggcctcggtggctc

SEQ ID NO: 7786911 - DNA, 20 bp, Homo sapiens
tggtatcaattactagattg

SEQ ID NO: 7786912 - DNA, 21 bp, Homo sapiens
tggtatcaaactatacaatat

SEQ ID NO: 7786913 - DNA, 22 bp, Homo sapiens
tggtatcaaacaattaattaga

SEQ ID NO: 7786914 - DNA, 22 bp, Homo sapiens
tggtatttccaggcttatggta

SEQ ID NO: 7786915 - DNA, 22 bp, Homo sapiens
tggtcaagggacagagctgaac

SEQ ID NO: 7786916 - DNA, 22 bp, Homo sapiens
tggtcaaggcttggagatagta

SEQ ID NO: 7786917 - DNA, 22 bp, Homo sapiens
tggtcaagattacacactggtg

SEQ ID NO: 7786918 - DNA, 22 bp, Homo sapiens
tggtcaagttaagataaggtga

SEQ ID NO: 7786919 - DNA, 22 bp, Homo sapiens
tggtaagaataggggctttgga

SEQ ID NO: 7786920 - DNA, 22 bp, Homo sapiens
tggtaagataagagccaggcct

SEQ ID NO: 7786921 - DNA, 22 bp, Homo sapiens
tgggttggaagcaggaggcacc

SEQ ID NO: 7786922 - DNA, 19 bp, Homo sapiens
tgggttggaagggaatgaa

SEQ ID NO: 7786923 - DNA, 18 bp, Homo sapiens
tgggtggtttttctctcc

SEQ ID NO: 7786924 - DNA, 22 bp, Homo sapiens
tgggtggtttatgagtgggttt

SEQ ID NO: 7786925 - DNA, 22 bp, Homo sapiens
tgggtggtggcagtaatgagaa

SEQ ID NO: 7786926 - DNA, 22 bp, Homo sapiens
tgggtggtcttgcttcccagga

SEQ ID NO: 7786927 - DNA, 17 bp, Homo sapiens
tgggtggtagggagagg

SEQ ID NO: 7786928 - DNA, 22 bp, Homo sapiens
tgggtggtccaggctcagcaga

SEQ ID NO: 7786929 - DNA, 22 bp, Homo sapiens
tgggtgaggatgatgaggcagc

SEQ ID NO: 7786930 - DNA, 22 bp, Homo sapiens
tgggtgagtggagggcattcta

SEQ ID NO: 7786931 - DNA, 22 bp, Homo sapiens
tgggtgagggacaaaagtttct

SEQ ID NO: 7786932 - DNA, 22 bp, Homo sapiens
tgggtgagtgggaaaagcccag

SEQ ID NO: 7786933 - DNA, 22 bp, Homo sapiens
tgggtgagcggctgcacacccg

SEQ ID NO: 7786934 - DNA, 22 bp, Homo sapiens
tgggtgaggagaggctgtctaa

SEQ ID NO: 7786935 - DNA, 20 bp, Homo sapiens
tgggtgagagtgtttgctct

SEQ ID NO: 7786936 - DNA, 22 bp, Homo sapiens
tgggtgccaacctctggtggcc

SEQ ID NO: 7786937 - DNA, 22 bp, Homo sapiens
tgggtgctctgcgaccgtaggg

SEQ ID NO: 7786938 - DNA, 22 bp, Homo sapiens
tgggggtgaaagtctggacagt

SEQ ID NO: 7786939 - DNA, 22 bp, Homo sapiens
tgggggtgaaagtctggacagt

SEQ ID NO: 7786940 - DNA, 21 bp, Homo sapiens
tgggggtgaggcctaggaatc

SEQ ID NO: 7786941 - DNA, 22 bp, Homo sapiens
tgggggtgccctatgaggaagc

SEQ ID NO: 7786942 - DNA, 22 bp, Homo sapiens
tggggtcgagggttctctggca

SEQ ID NO: 7786943 - DNA, 22 bp, Homo sapiens
tggggtgaatctttgttgtccg

SEQ ID NO: 7786944 - DNA, 22 bp, Homo sapiens
tggggtgtgagaagtagaggga

SEQ ID NO: 7786945 - DNA, 22 bp, Homo sapiens
tggggtgtgctcagagcagggg

SEQ ID NO: 7786946 - DNA, 22 bp, Homo sapiens
tggggtgggcatgcgctgtcct

SEQ ID NO: 7786947 - DNA, 22 bp, Homo sapiens
tggggtgggcatgcgctgtcct

SEQ ID NO: 7786948 - DNA, 22 bp, Homo sapiens
tggggtggggttactcattctg

SEQ ID NO: 7786949 - DNA, 22 bp, Homo sapiens
tggggtggaacccttctgctgg

SEQ ID NO: 7786950 - DNA, 22 bp, Homo sapiens
tggggtgaggcagccacattta

SEQ ID NO: 7786951 - DNA, 22 bp, Homo sapiens
tggggtgacagtgcagtggtca

SEQ ID NO: 7786952 - DNA, 22 bp, Homo sapiens
tggggtgagattcagatattca

SEQ ID NO: 7786953 - DNA, 22 bp, Homo sapiens
tggggtggatagaaagtgatgt

SEQ ID NO: 7786954 - DNA, 22 bp, Homo sapiens
tggggttgcctcccgccctgga

SEQ ID NO: 7786955 - DNA, 23 bp, Homo sapiens
tggggttgaattgtagctgtgcc

SEQ ID NO: 7786956 - DNA, 22 bp, Homo sapiens
tggggttgaagaaaggatctag

SEQ ID NO: 7786957 - DNA, 22 bp, Homo sapiens
tgggtagcagggctgagctgtg

SEQ ID NO: 7786958 - DNA, 22 bp, Homo sapiens
tgggtccatggaacagaggtgc

SEQ ID NO: 7786959 - DNA, 22 bp, Homo sapiens
tgggtgaccccagaagaggatc

SEQ ID NO: 7786960 - DNA, 22 bp, Homo sapiens
tgggggagccttcacagtagct

SEQ ID NO: 7786961 - DNA, 22 bp, Homo sapiens
tgggggagtatagtctggcctc

SEQ ID NO: 7786962 - DNA, 22 bp, Homo sapiens
tgggggcacttcgaggtcgcct

SEQ ID NO: 7786963 - DNA, 22 bp, Homo sapiens
tgggggcacttcgaggtcgcct

SEQ ID NO: 7786964 - DNA, 22 bp, Homo sapiens
tgggggcacttcgaggtcgcct

SEQ ID NO: 7786965 - DNA, 22 bp, Homo sapiens
tgggggcacttcgaggtcgcct

SEQ ID NO: 7786966 - DNA, 22 bp, Homo sapiens
tgggggcagccaggctgtcaag

SEQ ID NO: 7786967 - DNA, 22 bp, Homo sapiens
tgggggcagaggattcaggaat

SEQ ID NO: 7786968 - DNA, 22 bp, Homo sapiens
tgggggcagccaggctgtcaag

SEQ ID NO: 7786969 - DNA, 22 bp, Homo sapiens
tgggggcatggaccagcctggc

SEQ ID NO: 7786970 - DNA, 22 bp, Homo sapiens
tgggggagagtttagatgattt

SEQ ID NO: 7786971 - DNA, 22 bp, Homo sapiens
tgggggagagtgcaagcatgaa

SEQ ID NO: 7786972 - DNA, 22 bp, Homo sapiens
tggggctgtccttagtctgaga

SEQ ID NO: 7786973 - DNA, 22 bp, Homo sapiens
tggggctgtcccggtttggcga

SEQ ID NO: 7786974 - DNA, 22 bp, Homo sapiens
tggggctggggatcttgagcct

SEQ ID NO: 7786975 - DNA, 22 bp, Homo sapiens
tggggctggctattgtctccct

SEQ ID NO: 7786976 - DNA, 22 bp, Homo sapiens
tggggctaacgagagagcagag

SEQ ID NO: 7786977 - DNA, 22 bp, Homo sapiens
tggggcctggtcagagctgcac

SEQ ID NO: 7786978 - DNA, 22 bp, Homo sapiens
tggggcctgaggtggagctgca

SEQ ID NO: 7786979 - DNA, 22 bp, Homo sapiens
tggggctgaggagcctcactct

SEQ ID NO: 7786980 - DNA, 22 bp, Homo sapiens
tggggccagcggggaggactca

SEQ ID NO: 7786981 - DNA, 22 bp, Homo sapiens
tggggccaggtggctgcaggtc

SEQ ID NO: 7786982 - DNA, 22 bp, Homo sapiens
tggggcacagctgagaaagcac

SEQ ID NO: 7786983 - DNA, 22 bp, Homo sapiens
tggggccacagcctcctagctt

SEQ ID NO: 7786984 - DNA, 22 bp, Homo sapiens
tggggccagagctgcagggagc

SEQ ID NO: 7786985 - DNA, 22 bp, Homo sapiens
tggggccagagatggggcgcag

SEQ ID NO: 7786986 - DNA, 23 bp, Homo sapiens
tggggagggaagtcatttctgta

SEQ ID NO: 7786987 - DNA, 22 bp, Homo sapiens
tggggacattcatgcaggttgt

SEQ ID NO: 7786988 - DNA, 22 bp, Homo sapiens
tggggacagggctcagcaattt

SEQ ID NO: 7786989 - DNA, 22 bp, Homo sapiens
tggggacaggagacttacagct

SEQ ID NO: 7786990 - DNA, 22 bp, Homo sapiens
tggggaccagattagaccatgg

SEQ ID NO: 7786991 - DNA, 22 bp, Homo sapiens
tggggacccggactcctgggtc

SEQ ID NO: 7786992 - DNA, 22 bp, Homo sapiens
tggggaggaagtcagatttcag

SEQ ID NO: 7786993 - DNA, 22 bp, Homo sapiens
tggggagtgatgcctcggataa

SEQ ID NO: 7786994 - DNA, 22 bp, Homo sapiens
tggggagtgatgcctcggataa

SEQ ID NO: 7786995 - DNA, 22 bp, Homo sapiens
tggggaggttcgggaatcttgt

SEQ ID NO: 7786996 - DNA, 21 bp, Homo sapiens
tggggaggggacctgattatg

SEQ ID NO: 7786997 - DNA, 22 bp, Homo sapiens
tggggatgaaacccaggcatct

SEQ ID NO: 7786998 - DNA, 20 bp, Homo sapiens
tggggagttgagcacgagca

SEQ ID NO: 7786999 - DNA, 16 bp, Homo sapiens
tggggatggggaagag

SEQ ID NO: 7787000 - DNA, 22 bp, Homo sapiens
tggggatgtaaatgaggtgata

SEQ ID NO: 7787001 - DNA, 22 bp, Homo sapiens
tggggaaactatttccttgtcc

SEQ ID NO: 7787002 - DNA, 22 bp, Homo sapiens
tggggaaagacattcatacagt

SEQ ID NO: 7787003 - DNA, 22 bp, Homo sapiens
tggggaaagatagttttctcta

SEQ ID NO: 7787004 - DNA, 22 bp, Homo sapiens
tggggaaaggaaagttaacctg

SEQ ID NO: 7787005 - DNA, 20 bp, Homo sapiens
tggggaaagccatcgatgag

SEQ ID NO: 7787006 - DNA, 22 bp, Homo sapiens
tggggaaagggatggctcccgc

SEQ ID NO: 7787007 - DNA, 22 bp, Homo sapiens
tggggaaaggagagcattattt

SEQ ID NO: 7787008 - DNA, 22 bp, Homo sapiens
tggggaaagttcttgaaagtaa

SEQ ID NO: 7787009 - DNA, 22 bp, Homo sapiens
tggggaaatgtcctgccttccc

SEQ ID NO: 7787010 - DNA, 22 bp, Homo sapiens
tggggaagacagcagacactgt

SEQ ID NO: 7787011 - DNA, 22 bp, Homo sapiens
tggggacacagaggttcgttgg

SEQ ID NO: 7787012 - DNA, 22 bp, Homo sapiens
tggggacacagagccaaactat

SEQ ID NO: 7787013 - DNA, 22 bp, Homo sapiens
tggggaagggcaccctggagac

SEQ ID NO: 7787014 - DNA, 22 bp, Homo sapiens
tggggaaggcggagcttgcagc

SEQ ID NO: 7787015 - DNA, 17 bp, Homo sapiens
tggggaagctcagattt

SEQ ID NO: 7787016 - DNA, 18 bp, Homo sapiens
tgggctgcctggcctctg

SEQ ID NO: 7787017 - DNA, 22 bp, Homo sapiens
tggggaaaagcgttaggagttc

SEQ ID NO: 7787018 - DNA, 22 bp, Homo sapiens
tggggaaaacagaggaaattag

SEQ ID NO: 7787019 - DNA, 22 bp, Homo sapiens
tggggaaaatgcagaagattac

SEQ ID NO: 7787020 - DNA, 22 bp, Homo sapiens
tggggaaaatgcttgtagtcag

SEQ ID NO: 7787021 - DNA, 22 bp, Homo sapiens
tggggaaaatgcttgtagtcag

SEQ ID NO: 7787022 - DNA, 23 bp, Homo sapiens
tgggcttctgagaaagcacctaa

SEQ ID NO: 7787023 - DNA, 22 bp, Homo sapiens
tgggcttaggtcggaggcggcc

SEQ ID NO: 7787024 - DNA, 22 bp, Homo sapiens
tgggcttaggtcggaggcggcc

SEQ ID NO: 7787025 - DNA, 22 bp, Homo sapiens
tgggcagagtagctcagaagaa

SEQ ID NO: 7787026 - DNA, 22 bp, Homo sapiens
tgggcagaggacagggaagatc

SEQ ID NO: 7787027 - DNA, 22 bp, Homo sapiens
tgggatgggatctcgctgtgtc

SEQ ID NO: 7787028 - DNA, 22 bp, Homo sapiens
tgggatgagttgttaggactga

SEQ ID NO: 7787029 - DNA, 22 bp, Homo sapiens
tgggatggcatcctgggccttg

SEQ ID NO: 7787030 - DNA, 18 bp, Homo sapiens
tgggagtgggagtggata

SEQ ID NO: 7787031 - DNA, 22 bp, Homo sapiens
tgggagtgcacctgggacacga

SEQ ID NO: 7787032 - DNA, 22 bp, Homo sapiens
tgggagtgatacagtatggaat

SEQ ID NO: 7787033 - DNA, 22 bp, Homo sapiens
tgggatgaatacaatgggatca

SEQ ID NO: 7787034 - DNA, 17 bp, Homo sapiens
tgggatccgtctctgtg

SEQ ID NO: 7787035 - DNA, 22 bp, Homo sapiens
tgggaggcttccagaccttgct

SEQ ID NO: 7787036 - DNA, 22 bp, Homo sapiens
tgggaggccgaggcaggtggat

SEQ ID NO: 7787037 - DNA, 22 bp, Homo sapiens
tgggaggcttccagaccttgct

SEQ ID NO: 7787038 - DNA, 22 bp, Homo sapiens
tgggagtgatacagtatggaat

SEQ ID NO: 7787039 - DNA, 22 bp, Homo sapiens
tgggagtcatcgtgtttggatc

SEQ ID NO: 7787040 - DNA, 20 bp, Homo sapiens
tgggagtacaatcatgagca

SEQ ID NO: 7787041 - DNA, 22 bp, Homo sapiens
tgggagtagatgaggagtgggc

SEQ ID NO: 7787042 - DNA, 22 bp, Homo sapiens
tgggagtcactgttgttgaggg

SEQ ID NO: 7787043 - DNA, 22 bp, Homo sapiens
tgggaggcaggtaggtgatgat

SEQ ID NO: 7787044 - DNA, 22 bp, Homo sapiens
tgggaggcaggtaggtgatgat

SEQ ID NO: 7787045 - DNA, 22 bp, Homo sapiens
tgggaggccaaggcaggcggat

SEQ ID NO: 7787046 - DNA, 22 bp, Homo sapiens
tgggaggccaaggcaggcggat

SEQ ID NO: 7787047 - DNA, 22 bp, Homo sapiens
tgggaggcccaggcctggcagg

SEQ ID NO: 7787048 - DNA, 22 bp, Homo sapiens
tgggaggcccaggcctggcagg

SEQ ID NO: 7787049 - DNA, 22 bp, Homo sapiens
tgggaggccgaggcaggtggat

SEQ ID NO: 7787050 - DNA, 22 bp, Homo sapiens
tgggaggccgaggcaggtggat

SEQ ID NO: 7787051 - DNA, 22 bp, Homo sapiens
tgggaggccgaggcaggtggat

SEQ ID NO: 7787052 - DNA, 22 bp, Homo sapiens
tgggcaggttgttatttgacat

SEQ ID NO: 7787053 - DNA, 22 bp, Homo sapiens
tgggcatctctgctgccggcct

SEQ ID NO: 7787054 - DNA, 19 bp, Homo sapiens
tgggcaggttcagtaatgg

SEQ ID NO: 7787055 - DNA, 22 bp, Homo sapiens
tgggccagctgaagtgccgccc

SEQ ID NO: 7787056 - DNA, 22 bp, Homo sapiens
tgggccagctgaagtgccgccc

SEQ ID NO: 7787057 - DNA, 22 bp, Homo sapiens
tgggccagctccctgcccctgg

SEQ ID NO: 7787058 - DNA, 22 bp, Homo sapiens
tgggccacgggggtggagagct

SEQ ID NO: 7787059 - DNA, 22 bp, Homo sapiens
tgggccagcactgggtgctcat

SEQ ID NO: 7787060 - DNA, 22 bp, Homo sapiens
tgggccacaagccatgggacca

SEQ ID NO: 7787061 - DNA, 22 bp, Homo sapiens
tgggcagggagctggaaccaca

SEQ ID NO: 7787062 - DNA, 22 bp, Homo sapiens
tgggcaggagagaagctaaaga

SEQ ID NO: 7787063 - DNA, 23 bp, Homo sapiens
tgggcagcttctgcatgcccacc

SEQ ID NO: 7787064 - DNA, 23 bp, Homo sapiens
tgggcagcttctgcatgcccacc

SEQ ID NO: 7787065 - DNA, 22 bp, Homo sapiens
tgggcagcttccacttagttag

SEQ ID NO: 7787066 - DNA, 22 bp, Homo sapiens
tgggcagggatctcttttgcaa

SEQ ID NO: 7787067 - DNA, 22 bp, Homo sapiens
tgggcagggagctggaaccaca

SEQ ID NO: 7787068 - DNA, 22 bp, Homo sapiens
tgggcagggagctggaaccaca

SEQ ID NO: 7787069 - DNA, 22 bp, Homo sapiens
tgggcaggggccctgcttccgt

SEQ ID NO: 7787070 - DNA, 22 bp, Homo sapiens
tgggcaggggccctgcttccgt

SEQ ID NO: 7787071 - DNA, 21 bp, Homo sapiens
tgggcagatggcagtgtggct

SEQ ID NO: 7787072 - DNA, 22 bp, Homo sapiens
tgggcagatgtggctctccttg

SEQ ID NO: 7787073 - DNA, 22 bp, Homo sapiens
tgggcagcaaagactgtgtgct

SEQ ID NO: 7787074 - DNA, 22 bp, Homo sapiens
tgggcagcagcaaagccagact

SEQ ID NO: 7787075 - DNA, 22 bp, Homo sapiens
tgggcgaggcccagggctgcgt

SEQ ID NO: 7787076 - DNA, 22 bp, Homo sapiens
tgggctgcaccctcagcctctg

SEQ ID NO: 7787077 - DNA, 22 bp, Homo sapiens
tgggctgagtgtggaactagtt

SEQ ID NO: 7787078 - DNA, 19 bp, Homo sapiens
tgggcctctcatatctgcc

SEQ ID NO: 7787079 - DNA, 22 bp, Homo sapiens
tgggcctcctttccattcagag

SEQ ID NO: 7787080 - DNA, 20 bp, Homo sapiens
tgggcctctggtgcctctgg

SEQ ID NO: 7787081 - DNA, 22 bp, Homo sapiens
tgggcctgccccaggcttcagc

SEQ ID NO: 7787082 - DNA, 22 bp, Homo sapiens
tgggcctgatttatcatcttca

SEQ ID NO: 7787083 - DNA, 22 bp, Homo sapiens
tgggccaggtctgtgtcagctg

SEQ ID NO: 7787084 - DNA, 22 bp, Homo sapiens
tgggccaggtctgtgtcagctg

SEQ ID NO: 7787085 - DNA, 22 bp, Homo sapiens
tgggccaggtctgcggtcattt

SEQ ID NO: 7787086 - DNA, 22 bp, Homo sapiens
tgggccaggggcctcttctgat

SEQ ID NO: 7787087 - DNA, 23 bp, Homo sapiens
tgggccagggagtccggtttctt

SEQ ID NO: 7787088 - DNA, 22 bp, Homo sapiens
tgggccagggcacccagtccag

SEQ ID NO: 7787089 - DNA, 22 bp, Homo sapiens
tgggccaggcatgtgatcagca

SEQ ID NO: 7787090 - DNA, 22 bp, Homo sapiens
tgggccaggcatgtgatcagca

SEQ ID NO: 7787091 - DNA, 22 bp, Homo sapiens
tgggccagtcctgcctaaggtg

SEQ ID NO: 7787092 - DNA, 22 bp, Homo sapiens
tgggccagtccagccccaggga

SEQ ID NO: 7787093 - DNA, 22 bp, Homo sapiens
tgggccagtccagccccaggga

SEQ ID NO: 7787094 - DNA, 22 bp, Homo sapiens
tgggccagtagctactcgcaag

SEQ ID NO: 7787095 - DNA, 22 bp, Homo sapiens
tgggccagtagctactcgcaag

SEQ ID NO: 7787096 - DNA, 17 bp, Homo sapiens
tgggccagtagaaggga

SEQ ID NO: 7787097 - DNA, 22 bp, Homo sapiens
tgggccaggtgcagtgctttag

SEQ ID NO: 7787098 - DNA, 22 bp, Homo sapiens
tgggccaggtgcagtgctttag

SEQ ID NO: 7787099 - DNA, 21 bp, Homo sapiens
tgggccagtagaaaggaaggc

SEQ ID NO: 7787100 - DNA, 22 bp, Homo sapiens
tgggcctcctgccctggcctag

SEQ ID NO: 7787101 - DNA, 21 bp, Homo sapiens
tgggcctcaggcagctgtgac

SEQ ID NO: 7787102 - DNA, 22 bp, Homo sapiens
tgggcctcagtttgcttaatgt

SEQ ID NO: 7787103 - DNA, 22 bp, Homo sapiens
tgggcctcatcttcaatgagtc

SEQ ID NO: 7787104 - DNA, 22 bp, Homo sapiens
tgggcctcatgcccagccaccc

SEQ ID NO: 7787105 - DNA, 22 bp, Homo sapiens
tgggccagtcctgcctaaggtg

SEQ ID NO: 7787106 - DNA, 22 bp, Homo sapiens
tgggccagttggaatggatact

SEQ ID NO: 7787107 - DNA, 22 bp, Homo sapiens
tgggccagtttctcattgaaat

SEQ ID NO: 7787108 - DNA, 22 bp, Homo sapiens
tgggcctcaccttcttggcagc

SEQ ID NO: 7787109 - DNA, 21 bp, Homo sapiens
tgtcagaaataagcatgtgat

SEQ ID NO: 7787110 - DNA, 19 bp, Homo sapiens
tgtcactgtcatggcccag

SEQ ID NO: 7787111 - DNA, 22 bp, Homo sapiens
tgtcatagtgtggtagcagtgg

SEQ ID NO: 7787112 - DNA, 22 bp, Homo sapiens
tgtccaggaccctattctcact

SEQ ID NO: 7787113 - DNA, 22 bp, Homo sapiens
tgtcattttgtctcactgctat

SEQ ID NO: 7787114 - DNA, 22 bp, Homo sapiens
tgtcattttctaatctgttgtc

SEQ ID NO: 7787115 - DNA, 22 bp, Homo sapiens
tgtcattttcagcttatgcttc

SEQ ID NO: 7787116 - DNA, 22 bp, Homo sapiens
tgtcattttagtgcatcactca

SEQ ID NO: 7787117 - DNA, 22 bp, Homo sapiens
tgtcatttcacaatatcactca

SEQ ID NO: 7787118 - DNA, 22 bp, Homo sapiens
tgtcatttattttgctgtctgt

SEQ ID NO: 7787119 - DNA, 22 bp, Homo sapiens
tgtcatttggactttggtatta

SEQ ID NO: 7787120 - DNA, 22 bp, Homo sapiens
tgtcatttcctgaatgctgagt

SEQ ID NO: 7787121 - DNA, 22 bp, Homo sapiens
tgtcatttggtgccaggaaaga

SEQ ID NO: 7787122 - DNA, 23 bp, Homo sapiens
tgtcattgtgactacagaaccag

SEQ ID NO: 7787123 - DNA, 22 bp, Homo sapiens
tgtcatttaaagctttccagat

SEQ ID NO: 7787124 - DNA, 22 bp, Homo sapiens
tgtcatttaatagatatgatgg

SEQ ID NO: 7787125 - DNA, 22 bp, Homo sapiens
tgtcatttagtcctctgtgtgt

SEQ ID NO: 7787126 - DNA, 18 bp, Homo sapiens
tgtcatctgtttaaaacc

SEQ ID NO: 7787127 - DNA, 22 bp, Homo sapiens
tgtcatctcttgcaggaagcct

SEQ ID NO: 7787128 - DNA, 22 bp, Homo sapiens
tgtcatcagcatataagacagt

SEQ ID NO: 7787129 - DNA, 22 bp, Homo sapiens
tgtcatatctattaaatgtcta

SEQ ID NO: 7787130 - DNA, 22 bp, Homo sapiens
tgtcatatagatattagacagg

SEQ ID NO: 7787131 - DNA, 22 bp, Homo sapiens
tgtcatatgttgatgaaagaga

SEQ ID NO: 7787132 - DNA, 22 bp, Homo sapiens
tgtcctagagacatcagatgtt

SEQ ID NO: 7787133 - DNA, 22 bp, Homo sapiens
tgtcctggccaaggccttgctt

SEQ ID NO: 7787134 - DNA, 22 bp, Homo sapiens
tgtcctgggccggcgactggtc

SEQ ID NO: 7787135 - DNA, 22 bp, Homo sapiens
tgtcctgggaatgggatgcagt

SEQ ID NO: 7787136 - DNA, 22 bp, Homo sapiens
tgtcctgtgcactgtagcatgt

SEQ ID NO: 7787137 - DNA, 22 bp, Homo sapiens
tgtcctgtgccaccttcctgag

SEQ ID NO: 7787138 - DNA, 22 bp, Homo sapiens
tgtcctggtgctccaggtggct

SEQ ID NO: 7787139 - DNA, 22 bp, Homo sapiens
tgtccctttgtgttctgaaact

SEQ ID NO: 7787140 - DNA, 22 bp, Homo sapiens
tgtccctggactccaggagcca

SEQ ID NO: 7787141 - DNA, 22 bp, Homo sapiens
tgtcccagggaaggcccagcac

SEQ ID NO: 7787142 - DNA, 22 bp, Homo sapiens
tgtccaggtggcctctgctgct

SEQ ID NO: 7787143 - DNA, 22 bp, Homo sapiens
tgtccaggtggcctctgctgct

SEQ ID NO: 7787144 - DNA, 22 bp, Homo sapiens
tgtccagggggcttacctggag

SEQ ID NO: 7787145 - DNA, 22 bp, Homo sapiens
tgtccaggtcagcagcagggac

SEQ ID NO: 7787146 - DNA, 22 bp, Homo sapiens
tgtccagggatggggtcaggga

SEQ ID NO: 7787147 - DNA, 20 bp, Homo sapiens
tgtccaggggatcgttggcc

SEQ ID NO: 7787148 - DNA, 22 bp, Homo sapiens
tgtccaggctcccttggtgctg

SEQ ID NO: 7787149 - DNA, 22 bp, Homo sapiens
tgtccaggcggccttgcctgtt

SEQ ID NO: 7787150 - DNA, 22 bp, Homo sapiens
tgtagactttctttgtgttagt

SEQ ID NO: 7787151 - DNA, 22 bp, Homo sapiens
tgtagatgtagacacaggtcta

SEQ ID NO: 7787152 - DNA, 22 bp, Homo sapiens
tgtagatatagaaaaagactga

SEQ ID NO: 7787153 - DNA, 22 bp, Homo sapiens
tgtagctctccagccagcaagg

SEQ ID NO: 7787154 - DNA, 22 bp, Homo sapiens
tgtagaaaattggagcattcat

SEQ ID NO: 7787155 - DNA, 22 bp, Homo sapiens
tgtacttgcttattagaaatct

SEQ ID NO: 7787156 - DNA, 18 bp, Homo sapiens
tgtagaaaagataggaat

SEQ ID NO: 7787157 - DNA, 22 bp, Homo sapiens
tgtagaaactacacatgcaaca

SEQ ID NO: 7787158 - DNA, 22 bp, Homo sapiens
tgtactgtattcatctttaact

SEQ ID NO: 7787159 - DNA, 22 bp, Homo sapiens
tgtacttgaacttgactgtaga

SEQ ID NO: 7787160 - DNA, 22 bp, Homo sapiens
tgtatacaggcataagagatac

SEQ ID NO: 7787161 - DNA, 22 bp, Homo sapiens
tgtatataagcatttacttgtt

SEQ ID NO: 7787162 - DNA, 22 bp, Homo sapiens
tgtatcccctgcaggttgctat

SEQ ID NO: 7787163 - DNA, 22 bp, Homo sapiens
tgtatcttagtgtgaaaatatt

SEQ ID NO: 7787164 - DNA, 22 bp, Homo sapiens
tgtatcttcagtttgtctttcc

SEQ ID NO: 7787165 - DNA, 22 bp, Homo sapiens
tgtatctttctgtacttttatg

SEQ ID NO: 7787166 - DNA, 22 bp, Homo sapiens
tgtatattgttctgtctcttca

SEQ ID NO: 7787167 - DNA, 22 bp, Homo sapiens
tgtcacagagcgtgcaacagaa

SEQ ID NO: 7787168 - DNA, 22 bp, Homo sapiens
tgtcaaagacagaaggaaatgg

SEQ ID NO: 7787169 - DNA, 22 bp, Homo sapiens
tgtcaaaatgactttactacag

SEQ ID NO: 7787170 - DNA, 22 bp, Homo sapiens
tgtcaaaatgactttactacag

SEQ ID NO: 7787171 - DNA, 22 bp, Homo sapiens
tgtatttttagacctttagacc

SEQ ID NO: 7787172 - DNA, 22 bp, Homo sapiens
tgtatttttagacctttagacc

SEQ ID NO: 7787173 - DNA, 22 bp, Homo sapiens
tgtcaaaaagctgggacaagca

SEQ ID NO: 7787174 - DNA, 22 bp, Homo sapiens
tgtatttttaggaatgcgctat

SEQ ID NO: 7787175 - DNA, 22 bp, Homo sapiens
tgtatttttaggaatgcgctat

SEQ ID NO: 7787176 - DNA, 22 bp, Homo sapiens
tgtcacagtctcgtgagcatct

SEQ ID NO: 7787177 - DNA, 22 bp, Homo sapiens
tgtcacagatcgtttttgagct

SEQ ID NO: 7787178 - DNA, 21 bp, Homo sapiens
tgtcacagattctcagcttgc

SEQ ID NO: 7787179 - DNA, 22 bp, Homo sapiens
tgtcacagggataccatggggc

SEQ ID NO: 7787180 - DNA, 22 bp, Homo sapiens
tgtcacatgaagccaacatagc

SEQ ID NO: 7787181 - DNA, 22 bp, Homo sapiens
tgtcacataatttatctgtagg

SEQ ID NO: 7787182 - DNA, 22 bp, Homo sapiens
tgtcacatgacacaaatatcta

SEQ ID NO: 7787183 - DNA, 22 bp, Homo sapiens
tgtcacattgaatatgatttat

SEQ ID NO: 7787184 - DNA, 18 bp, Homo sapiens
tgtatttctaacagctaa

SEQ ID NO: 7787185 - DNA, 22 bp, Homo sapiens
tgtatttctgctttctctagta

SEQ ID NO: 7787186 - DNA, 22 bp, Homo sapiens
tgtattttctgaagataatcaa

SEQ ID NO: 7787187 - DNA, 22 bp, Homo sapiens
tgtattttctgaagataatcaa

SEQ ID NO: 7787188 - DNA, 22 bp, Homo sapiens
tgtattttctgaggagcattag

SEQ ID NO: 7787189 - DNA, 22 bp, Homo sapiens
tgtattttctgaggagcattag

SEQ ID NO: 7787190 - DNA, 22 bp, Homo sapiens
tgtattttcagagtggcatttc

SEQ ID NO: 7787191 - DNA, 22 bp, Homo sapiens
tgtattttgagtccaatctcct

SEQ ID NO: 7787192 - DNA, 22 bp, Homo sapiens
tgtattttgtgaggatcactct

SEQ ID NO: 7787193 - DNA, 22 bp, Homo sapiens
tgtattttgtgaggatcactct

SEQ ID NO: 7787194 - DNA, 22 bp, Homo sapiens
tgtatttaagctttacctaaaa

SEQ ID NO: 7787195 - DNA, 22 bp, Homo sapiens
tgtattgtaagtggttatatgc

SEQ ID NO: 7787196 - DNA, 22 bp, Homo sapiens
tgtatgcataaaattatttaca

SEQ ID NO: 7787197 - DNA, 17 bp, Homo sapiens
tgtatgcatatgctttt

SEQ ID NO: 7787198 - DNA, 22 bp, Homo sapiens
tgtatgcaccattgtattacct

SEQ ID NO: 7787199 - DNA, 22 bp, Homo sapiens
tgtatgcaccattgtattacct

SEQ ID NO: 7787200 - DNA, 22 bp, Homo sapiens
tggtcctggagagtgttccata

SEQ ID NO: 7787201 - DNA, 22 bp, Homo sapiens
tggtcctgggcacagtatatgc

SEQ ID NO: 7787202 - DNA, 22 bp, Homo sapiens
tggtcaggtacctctggctgtc

SEQ ID NO: 7787203 - DNA, 22 bp, Homo sapiens
tggtcaggattctcagcccttc

SEQ ID NO: 7787204 - DNA, 22 bp, Homo sapiens
tggtcagaactcagcgtgcttg

SEQ ID NO: 7787205 - DNA, 22 bp, Homo sapiens
tggtcagaaggaagggctccta

SEQ ID NO: 7787206 - DNA, 22 bp, Homo sapiens
tggtctctctcctgcaacaact

SEQ ID NO: 7787207 - DNA, 22 bp, Homo sapiens
tggtcgaccagttggaaagtaa

SEQ ID NO: 7787208 - DNA, 19 bp, Homo sapiens
tggtctctgtctctttgca

SEQ ID NO: 7787209 - DNA, 22 bp, Homo sapiens
tggtgagaagttttgagattct

SEQ ID NO: 7787210 - DNA, 22 bp, Homo sapiens
tggtgagataactttcggcaag

SEQ ID NO: 7787211 - DNA, 22 bp, Homo sapiens
tggtgagagctgaccgtgcgag

SEQ ID NO: 7787212 - DNA, 20 bp, Homo sapiens
tggtgagagcacctgatggg

SEQ ID NO: 7787213 - DNA, 22 bp, Homo sapiens
tggtgagaccttgttccttatg

SEQ ID NO: 7787214 - DNA, 22 bp, Homo sapiens
tggtgagatgtatggagggttg

SEQ ID NO: 7787215 - DNA, 22 bp, Homo sapiens
tggtgagctctttagactggga

SEQ ID NO: 7787216 - DNA, 22 bp, Homo sapiens
tggtgccattagccctgctgtt

SEQ ID NO: 7787217 - DNA, 22 bp, Homo sapiens
tggtgccattagccctgctgtt

SEQ ID NO: 7787218 - DNA, 22 bp, Homo sapiens
tggtgccattagccctgctgtt

SEQ ID NO: 7787219 - DNA, 22 bp, Homo sapiens
tggtgccaccctccttcagctg

SEQ ID NO: 7787220 - DNA, 22 bp, Homo sapiens
tggtgccacttcttaggctggt

SEQ ID NO: 7787221 - DNA, 22 bp, Homo sapiens
tggtgccatcatagctcactgc

SEQ ID NO: 7787222 - DNA, 22 bp, Homo sapiens
tggtgccatcatagctcactgc

SEQ ID NO: 7787223 - DNA, 22 bp, Homo sapiens
tggtgccacaagaatacaaagc

SEQ ID NO: 7787224 - DNA, 23 bp, Homo sapiens
tggtgccacagctgaagtcaggt

SEQ ID NO: 7787225 - DNA, 22 bp, Homo sapiens
tggtgccaagcatgaggactct

SEQ ID NO: 7787226 - DNA, 22 bp, Homo sapiens
tggtgccaccctccttcagctg

SEQ ID NO: 7787227 - DNA, 22 bp, Homo sapiens
tggtggagtttctctttcaaac

SEQ ID NO: 7787228 - DNA, 21 bp, Homo sapiens
tggtggagtgtgctgagcatg

SEQ ID NO: 7787229 - DNA, 19 bp, Homo sapiens
tggtggaggtgcacctgac

SEQ ID NO: 7787230 - DNA, 22 bp, Homo sapiens
tggtggaggtgcatttcggagc

SEQ ID NO: 7787231 - DNA, 22 bp, Homo sapiens
tggtggagggaactatttccag

SEQ ID NO: 7787232 - DNA, 22 bp, Homo sapiens
tggtggagcctaggctaagtct

SEQ ID NO: 7787233 - DNA, 22 bp, Homo sapiens
tggtggagagacagtgtattgg

SEQ ID NO: 7787234 - DNA, 22 bp, Homo sapiens
tggtgggagtgacgttgccttc

SEQ ID NO: 7787235 - DNA, 22 bp, Homo sapiens
tggtgggagtgagggcatgcca

SEQ ID NO: 7787236 - DNA, 22 bp, Homo sapiens
tggtgggcacagtgcccaggct

SEQ ID NO: 7787237 - DNA, 22 bp, Homo sapiens
tggtgggagtccgctgtgctgc

SEQ ID NO: 7787238 - DNA, 22 bp, Homo sapiens
tggtgggcacagtgcccaggct

SEQ ID NO: 7787239 - DNA, 22 bp, Homo sapiens
tggtgggcacagtgcccaggct

SEQ ID NO: 7787240 - DNA, 22 bp, Homo sapiens
tggtggcagagcaagagctgga

SEQ ID NO: 7787241 - DNA, 22 bp, Homo sapiens
tggtggcagtgagaaggagagg

SEQ ID NO: 7787242 - DNA, 15 bp, Homo sapiens
tggtggtgttgagac

SEQ ID NO: 7787243 - DNA, 22 bp, Homo sapiens
tggtgtcaggcactagcatgca

SEQ ID NO: 7787244 - DNA, 22 bp, Homo sapiens
tggtggtccacaaatgggtaca

SEQ ID NO: 7787245 - DNA, 18 bp, Homo sapiens
tggtggtgacagggtcat

SEQ ID NO: 7787246 - DNA, 22 bp, Homo sapiens
tggtggtcaaagccagtgttct

SEQ ID NO: 7787247 - DNA, 23 bp, Homo sapiens
tggtggtcagccctttctggagg

SEQ ID NO: 7787248 - DNA, 22 bp, Homo sapiens
tggtgtgttagagctcagggca

SEQ ID NO: 7787249 - DNA, 22 bp, Homo sapiens
tggtgttgaacctcagcagggg

SEQ ID NO: 7787250 - DNA, 23 bp, Homo sapiens
tggttgcagtgccaagtatcacg

SEQ ID NO: 7787251 - DNA, 19 bp, Homo sapiens
tggttgtgcacgggttggt

SEQ ID NO: 7787252 - DNA, 22 bp, Homo sapiens
tggttgtgcacggagctgcagg

SEQ ID NO: 7787253 - DNA, 22 bp, Homo sapiens
tggttctaaaggactatacaga

SEQ ID NO: 7787254 - DNA, 22 bp, Homo sapiens
tggttctaggctttgtcttttg

SEQ ID NO: 7787255 - DNA, 22 bp, Homo sapiens
tgtaaaataccattccttgtca

SEQ ID NO: 7787256 - DNA, 22 bp, Homo sapiens
tggttttatttatgttgagtca

SEQ ID NO: 7787257 - DNA, 22 bp, Homo sapiens
tgtaaagatccttagcaacatc

SEQ ID NO: 7787258 - DNA, 22 bp, Homo sapiens
tgtaaacaaatgcattcttgct

SEQ ID NO: 7787259 - DNA, 22 bp, Homo sapiens
tgtaaataatgcatgtaaatca

SEQ ID NO: 7787260 - DNA, 22 bp, Homo sapiens
tgtaagattctaagagttaatg

SEQ ID NO: 7787261 - DNA, 22 bp, Homo sapiens
tgtaagatttgctatgtgttgt

SEQ ID NO: 7787262 - DNA, 22 bp, Homo sapiens
tgtaagaacaactgtcaaatgt

SEQ ID NO: 7787263 - DNA, 22 bp, Homo sapiens
tgtaattttctcaagtttctac

SEQ ID NO: 7787264 - DNA, 22 bp, Homo sapiens
tgtaagtacattgaaacatctt

SEQ ID NO: 7787265 - DNA, 22 bp, Homo sapiens
tgtaagtagaacaacataatct

SEQ ID NO: 7787266 - DNA, 22 bp, Homo sapiens
tgtacaaagagtatagctttga

SEQ ID NO: 7787267 - DNA, 22 bp, Homo sapiens
tgtaattttctcaagtttctac

SEQ ID NO: 7787268 - DNA, 22 bp, Homo sapiens
tgtacaaagttaaacctatata

SEQ ID NO: 7787269 - DNA, 22 bp, Homo sapiens
tgtacaaaggtactttgatgtt

SEQ ID NO: 7787270 - DNA, 22 bp, Homo sapiens
tgtacaaagccagaactcccaa

SEQ ID NO: 7787271 - DNA, 23 bp, Homo sapiens
tgtaaattttgtagtcacatttt

SEQ ID NO: 7787272 - DNA, 22 bp, Homo sapiens
tgtaaattgaaggaaatttgtg

SEQ ID NO: 7787273 - DNA, 22 bp, Homo sapiens
tgtaacagtaagcctgtgagct

SEQ ID NO: 7787274 - DNA, 22 bp, Homo sapiens
tgtaacatcacagtgatgtttg

SEQ ID NO: 7787275 - DNA, 22 bp, Homo sapiens
tgtacacaacctacagtctgct

SEQ ID NO: 7787276 - DNA, 22 bp, Homo sapiens
tgtacaaattcagttctagggt

SEQ ID NO: 7787277 - DNA, 22 bp, Homo sapiens
tgtacaaattcagttctagggt

SEQ ID NO: 7787278 - DNA, 22 bp, Homo sapiens
tgtacaaattcagttctagggt

SEQ ID NO: 7787279 - DNA, 22 bp, Homo sapiens
tgtacaaattcattgaactgta

SEQ ID NO: 7787280 - DNA, 22 bp, Homo sapiens
tgtacagctgccttttttactt

SEQ ID NO: 7787281 - DNA, 22 bp, Homo sapiens
tgcttaaacatactatttatat

SEQ ID NO: 7787282 - DNA, 22 bp, Homo sapiens
tgcttaaacacatacatacata

SEQ ID NO: 7787283 - DNA, 22 bp, Homo sapiens
tgcttaaacacatacatacata

SEQ ID NO: 7787284 - DNA, 22 bp, Homo sapiens
tgcttaaagtagtggattgtta

SEQ ID NO: 7787285 - DNA, 22 bp, Homo sapiens
tgcttaaaccctgatcatgtgt

SEQ ID NO: 7787286 - DNA, 22 bp, Homo sapiens
tgcttaaacatccagacagtat

SEQ ID NO: 7787287 - DNA, 18 bp, Homo sapiens
tgcttacaggagttcctg

SEQ ID NO: 7787288 - DNA, 22 bp, Homo sapiens
tgcttataatgttactgacaac

SEQ ID NO: 7787289 - DNA, 22 bp, Homo sapiens
tgcttaatcaagaagcctattt

SEQ ID NO: 7787290 - DNA, 22 bp, Homo sapiens
tgcttaatattgtgatgtaata

SEQ ID NO: 7787291 - DNA, 22 bp, Homo sapiens
tgcttaataggagttgaacatt

SEQ ID NO: 7787292 - DNA, 22 bp, Homo sapiens
tgcttaaaaagctccatcaata

SEQ ID NO: 7787293 - DNA, 22 bp, Homo sapiens
tgcttaaaaacagtatggtagt

SEQ ID NO: 7787294 - DNA, 22 bp, Homo sapiens
tgcttaaaatagttcatttttg

SEQ ID NO: 7787295 - DNA, 22 bp, Homo sapiens
tgcttaaaatgatgattatttt

SEQ ID NO: 7787296 - DNA, 22 bp, Homo sapiens
tgctgtctgtttactggctata

SEQ ID NO: 7787297 - DNA, 22 bp, Homo sapiens
tgcttcacaagaattcaggacc

SEQ ID NO: 7787298 - DNA, 22 bp, Homo sapiens
tgcttattctttccacaattca

SEQ ID NO: 7787299 - DNA, 22 bp, Homo sapiens
tgcttcaaggacactgactttt

SEQ ID NO: 7787300 - DNA, 22 bp, Homo sapiens
tgcttatttgaatttattctca

SEQ ID NO: 7787301 - DNA, 22 bp, Homo sapiens
tgcttatttaggtagatattaa

SEQ ID NO: 7787302 - DNA, 22 bp, Homo sapiens
tgcttcattaaaacaatatttt

SEQ ID NO: 7787303 - DNA, 22 bp, Homo sapiens
tgcttccagttcctcaccacat

SEQ ID NO: 7787304 - DNA, 22 bp, Homo sapiens
tgcttcatgaggtagtggcagt

SEQ ID NO: 7787305 - DNA, 21 bp, Homo sapiens
tgcttctctagatcaactact

SEQ ID NO: 7787306 - DNA, 22 bp, Homo sapiens
tgcttctcccaaccagggcctg

SEQ ID NO: 7787307 - DNA, 23 bp, Homo sapiens
tgcttctctgcttgacagttctg

SEQ ID NO: 7787308 - DNA, 22 bp, Homo sapiens
tgcttccctcacttcacctggc

SEQ ID NO: 7787309 - DNA, 22 bp, Homo sapiens
tgcttctaatctactgcattag

SEQ ID NO: 7787310 - DNA, 22 bp, Homo sapiens
tgcttctgcaggagctcctgat

SEQ ID NO: 7787311 - DNA, 22 bp, Homo sapiens
tgctggggcagaagagccaaga

SEQ ID NO: 7787312 - DNA, 22 bp, Homo sapiens
tgctggggcagaagagccaaga

SEQ ID NO: 7787313 - DNA, 16 bp, Homo sapiens
tgctggggcgccgtcc

SEQ ID NO: 7787314 - DNA, 22 bp, Homo sapiens
tgctggggatccgtaccaaccc

SEQ ID NO: 7787315 - DNA, 22 bp, Homo sapiens
tgctggggatccgtaccaaccc

SEQ ID NO: 7787316 - DNA, 20 bp, Homo sapiens
tgctggggacatacagggtg

SEQ ID NO: 7787317 - DNA, 22 bp, Homo sapiens
tgctggggagtgattgaccatc

SEQ ID NO: 7787318 - DNA, 20 bp, Homo sapiens
tgctggggacatacagggtg

SEQ ID NO: 7787319 - DNA, 22 bp, Homo sapiens
tgctggggtcatggggcgcccg

SEQ ID NO: 7787320 - DNA, 22 bp, Homo sapiens
tgctggggtcatggggcgcccg

SEQ ID NO: 7787321 - DNA, 22 bp, Homo sapiens
tgctggggtcatggggcgcccg

SEQ ID NO: 7787322 - DNA, 23 bp, Homo sapiens
tgctggggtagtttgtggcacag

SEQ ID NO: 7787323 - DNA, 23 bp, Homo sapiens
tgctggggtagtttgtggcacag

SEQ ID NO: 7787324 - DNA, 22 bp, Homo sapiens
tgctggggtctctccggtgccc

SEQ ID NO: 7787325 - DNA, 22 bp, Homo sapiens
tgctggtggagaaagtggaggt

SEQ ID NO: 7787326 - DNA, 21 bp, Homo sapiens
tgctggtgagctcatgtggct

SEQ ID NO: 7787327 - DNA, 22 bp, Homo sapiens
tgctggtaccgcgcctccgcca

SEQ ID NO: 7787328 - DNA, 22 bp, Homo sapiens
tgctgggtggttgctcctcccg

SEQ ID NO: 7787329 - DNA, 23 bp, Homo sapiens
tgctggtgtttttgggaccaggg

SEQ ID NO: 7787330 - DNA, 22 bp, Homo sapiens
tgctgggcttcaactgcctgag

SEQ ID NO: 7787331 - DNA, 22 bp, Homo sapiens
tgctgggctagaagctgaggcc

SEQ ID NO: 7787332 - DNA, 22 bp, Homo sapiens
tgctggcttcctgtgcacagca

SEQ ID NO: 7787333 - DNA, 22 bp, Homo sapiens
tgctggcttcctgtgcacagca

SEQ ID NO: 7787334 - DNA, 22 bp, Homo sapiens
tgctggcacgtgactgggaagt

SEQ ID NO: 7787335 - DNA, 22 bp, Homo sapiens
tgctggcacgaaagggtgtcca

SEQ ID NO: 7787336 - DNA, 20 bp, Homo sapiens
tgctggcacgggtggactcc

SEQ ID NO: 7787337 - DNA, 22 bp, Homo sapiens
tgctggcatggtcttggtgaca

SEQ ID NO: 7787338 - DNA, 20 bp, Homo sapiens
tgctggcatgcaagagggaa

SEQ ID NO: 7787339 - DNA, 22 bp, Homo sapiens
tgctggcatcttaatgttctgt

SEQ ID NO: 7787340 - DNA, 23 bp, Homo sapiens
tgctggagtttactcaggccagc

SEQ ID NO: 7787341 - DNA, 22 bp, Homo sapiens
tgctggagtggcactgtgtggc

SEQ ID NO: 7787342 - DNA, 22 bp, Homo sapiens
tgctggagtgcagtggcttaac

SEQ ID NO: 7787343 - DNA, 22 bp, Homo sapiens
tgctggagtgagtggtttctta

SEQ ID NO: 7787344 - DNA, 22 bp, Homo sapiens
tgctggagttcgacattgcaaa

SEQ ID NO: 7787345 - DNA, 22 bp, Homo sapiens
tgctggagtctcttgaccctgg

SEQ ID NO: 7787346 - DNA, 22 bp, Homo sapiens
tgctggagtaacaagacactca

SEQ ID NO: 7787347 - DNA, 19 bp, Homo sapiens
tgctggagtgacattctga

SEQ ID NO: 7787348 - DNA, 22 bp, Homo sapiens
tgctggagtgagattatgagtt

SEQ ID NO: 7787349 - DNA, 22 bp, Homo sapiens
tgctggaggggatgccttcact

SEQ ID NO: 7787350 - DNA, 22 bp, Homo sapiens
tgctggaggggcctgaccagga

SEQ ID NO: 7787351 - DNA, 22 bp, Homo sapiens
tgctggaggagtttactgtggc

SEQ ID NO: 7787352 - DNA, 22 bp, Homo sapiens
tgctggaggcagtggaggtgcc

SEQ ID NO: 7787353 - DNA, 22 bp, Homo sapiens
tgctggaggcagtggaggtgcc

SEQ ID NO: 7787354 - DNA, 22 bp, Homo sapiens
tgctggaggccagaagtctgag

SEQ ID NO: 7787355 - DNA, 22 bp, Homo sapiens
tgctggaggccagaagtctgag

SEQ ID NO: 7787356 - DNA, 17 bp, Homo sapiens
tgctggaggcggggtat

SEQ ID NO: 7787357 - DNA, 22 bp, Homo sapiens
tgctggaggcctgactgtgttt

SEQ ID NO: 7787358 - DNA, 23 bp, Homo sapiens
tgctggcttccagctgctccctc

SEQ ID NO: 7787359 - DNA, 22 bp, Homo sapiens
tgctggcttagatatcactgcc

SEQ ID NO: 7787360 - DNA, 22 bp, Homo sapiens
tgctggctgttctagggaggcc

SEQ ID NO: 7787361 - DNA, 22 bp, Homo sapiens
tgctggctgtccctacctggct

SEQ ID NO: 7787362 - DNA, 22 bp, Homo sapiens
tgctggctgttctagggaggcc

SEQ ID NO: 7787363 - DNA, 23 bp, Homo sapiens
tgctggctgtgttattgccaaca

SEQ ID NO: 7787364 - DNA, 22 bp, Homo sapiens
tgctggctgtatatgtgagagt

SEQ ID NO: 7787365 - DNA, 22 bp, Homo sapiens
tgctggctgtatatgtgagagt

SEQ ID NO: 7787366 - DNA, 22 bp, Homo sapiens
tgctggctgggctgctggagac

SEQ ID NO: 7787367 - DNA, 22 bp, Homo sapiens
tgctggctggcctggcctggac

SEQ ID NO: 7787368 - DNA, 22 bp, Homo sapiens
tgctggctggatcagagattgg

SEQ ID NO: 7787369 - DNA, 22 bp, Homo sapiens
tgctggctggcctggcctggac

SEQ ID NO: 7787370 - DNA, 22 bp, Homo sapiens
tgctggctgggctgctggagac

SEQ ID NO: 7787371 - DNA, 22 bp, Homo sapiens
tgctggctggagtgcctctgga

SEQ ID NO: 7787372 - DNA, 22 bp, Homo sapiens
tgctggctgccaggttccctgt

SEQ ID NO: 7787373 - DNA, 22 bp, Homo sapiens
tgctggctgcagtgctgtcaaa

SEQ ID NO: 7787374 - DNA, 22 bp, Homo sapiens
tgctggctgccaggttccctgt

SEQ ID NO: 7787375 - DNA, 22 bp, Homo sapiens
tgctggctactgatggcaggcc

SEQ ID NO: 7787376 - DNA, 22 bp, Homo sapiens
tgctggctactgatggcaggcc

SEQ ID NO: 7787377 - DNA, 22 bp, Homo sapiens
tgctggctccaacctggcatct

SEQ ID NO: 7787378 - DNA, 22 bp, Homo sapiens
tgctggctccaacctggcatct

SEQ ID NO: 7787379 - DNA, 22 bp, Homo sapiens
tgctggctcagtttgcagactc

SEQ ID NO: 7787380 - DNA, 22 bp, Homo sapiens
tgctggctctaggctgagacag

SEQ ID NO: 7787381 - DNA, 22 bp, Homo sapiens
tgctggctctaggctgagacag

SEQ ID NO: 7787382 - DNA, 22 bp, Homo sapiens
tgctggctctgggccaagcagg

SEQ ID NO: 7787383 - DNA, 22 bp, Homo sapiens
tgctggctcctcgaggcttcgt

SEQ ID NO: 7787384 - DNA, 22 bp, Homo sapiens
tgctggctcccaggagccgctg

SEQ ID NO: 7787385 - DNA, 21 bp, Homo sapiens
tgctggctgaaaggcacagag

SEQ ID NO: 7787386 - DNA, 22 bp, Homo sapiens
tgctggctgaggcctgagcggg

SEQ ID NO: 7787387 - DNA, 22 bp, Homo sapiens
tgctggctgaggcctgagcggg

SEQ ID NO: 7787388 - DNA, 22 bp, Homo sapiens
tgctggctgaggcctgagcggg

SEQ ID NO: 7787389 - DNA, 21 bp, Homo sapiens
tgctggctgaaaggcacagag

SEQ ID NO: 7787390 - DNA, 23 bp, Homo sapiens
tgctggctgaaacagccaaagga

SEQ ID NO: 7787391 - DNA, 22 bp, Homo sapiens
tgctgcttggaaatggggctga

SEQ ID NO: 7787392 - DNA, 19 bp, Homo sapiens
tgctgctgtccttgcaggg

SEQ ID NO: 7787393 - DNA, 22 bp, Homo sapiens
tgctggagaagctcctgggact

SEQ ID NO: 7787394 - DNA, 22 bp, Homo sapiens
tgctggagaagctcctgggact

SEQ ID NO: 7787395 - DNA, 22 bp, Homo sapiens
tgctggagaagctcctgggact

SEQ ID NO: 7787396 - DNA, 23 bp, Homo sapiens
tgctggagaagcaaagttctgag

SEQ ID NO: 7787397 - DNA, 22 bp, Homo sapiens
tgctggagaactgctctgtgtt

SEQ ID NO: 7787398 - DNA, 22 bp, Homo sapiens
tgctggagaactgctctgtgtt

SEQ ID NO: 7787399 - DNA, 23 bp, Homo sapiens
tgctggagaagcaaagttctgag

SEQ ID NO: 7787400 - DNA, 23 bp, Homo sapiens
tgctggagacaagtgtgagaagg

SEQ ID NO: 7787401 - DNA, 23 bp, Homo sapiens
tgctggagacaagtgtgagaagg

SEQ ID NO: 7787402 - DNA, 22 bp, Homo sapiens
tgctggagctccgggctgtagg

SEQ ID NO: 7787403 - DNA, 22 bp, Homo sapiens
tgctggagcggaggtgagccag

SEQ ID NO: 7787404 - DNA, 22 bp, Homo sapiens
tgctggaggagaaggttgctca

SEQ ID NO: 7787405 - DNA, 22 bp, Homo sapiens
tgctggagaaagtttttctgaa

SEQ ID NO: 7787406 - DNA, 22 bp, Homo sapiens
tgctggaatttttctaggattt

SEQ ID NO: 7787407 - DNA, 22 bp, Homo sapiens
tgctggaaagttaaattttgga

SEQ ID NO: 7787408 - DNA, 23 bp, Homo sapiens
tgctgccaagcacgagttgagtt

SEQ ID NO: 7787409 - DNA, 22 bp, Homo sapiens
tgctgccagccaggccatggag

SEQ ID NO: 7787410 - DNA, 22 bp, Homo sapiens
tgctgccacctgtggtagtctg

SEQ ID NO: 7787411 - DNA, 21 bp, Homo sapiens
tgctgctgatcggggttggct

SEQ ID NO: 7787412 - DNA, 22 bp, Homo sapiens
tgctgctgacatttggggcttg

SEQ ID NO: 7787413 - DNA, 22 bp, Homo sapiens
tgctgcctccttcctgccagga

SEQ ID NO: 7787414 - DNA, 22 bp, Homo sapiens
tgctgcctccaactcctgggct

SEQ ID NO: 7787415 - DNA, 22 bp, Homo sapiens
tgctgcctcagcttcctgggct

SEQ ID NO: 7787416 - DNA, 22 bp, Homo sapiens
tgctgaggaggtggctgtgctt

SEQ ID NO: 7787417 - DNA, 22 bp, Homo sapiens
tgctgaggaggtggctgtgctt

SEQ ID NO: 7787418 - DNA, 22 bp, Homo sapiens
tgctgaaacaataacatactgg

SEQ ID NO: 7787419 - DNA, 22 bp, Homo sapiens
tgctgagcgcatccggcggccg

SEQ ID NO: 7787420 - DNA, 20 bp, Homo sapiens
tgctgaggttgacatgccca

SEQ ID NO: 7787421 - DNA, 20 bp, Homo sapiens
tgctgaggcctgaggcctgg

SEQ ID NO: 7787422 - DNA, 22 bp, Homo sapiens
tgctgagggagcatcaaagaaa

SEQ ID NO: 7787423 - DNA, 22 bp, Homo sapiens
tgctgaggtcaccttgctgcta

SEQ ID NO: 7787424 - DNA, 22 bp, Homo sapiens
tgctcctgaggttggagatcca

SEQ ID NO: 7787425 - DNA, 21 bp, Homo sapiens
tgctccaggagggggcagtcc

SEQ ID NO: 7787426 - DNA, 17 bp, Homo sapiens
tgctcctgggacaagga

SEQ ID NO: 7787427 - DNA, 22 bp, Homo sapiens
tgctctggctgggatgagtgca

SEQ ID NO: 7787428 - DNA, 20 bp, Homo sapiens
tgcctggcctttctctgccc

SEQ ID NO: 7787429 - DNA, 20 bp, Homo sapiens
tgcctggcctttctctgccc

SEQ ID NO: 7787430 - DNA, 22 bp, Homo sapiens
tgcctggccctgacagccctgg

SEQ ID NO: 7787431 - DNA, 22 bp, Homo sapiens
tgcctggccctgacagccctgg

SEQ ID NO: 7787432 - DNA, 22 bp, Homo sapiens
tgcctggctctatcagtggtgg

SEQ ID NO: 7787433 - DNA, 22 bp, Homo sapiens
tgcctggctgaggtgacaggtt

SEQ ID NO: 7787434 - DNA, 22 bp, Homo sapiens
tgcctggctgaggtgacaggtt

SEQ ID NO: 7787435 - DNA, 22 bp, Homo sapiens
tgcctggctgggctgctcatgg

SEQ ID NO: 7787436 - DNA, 22 bp, Homo sapiens
tgcctggggattgctctgggcc

SEQ ID NO: 7787437 - DNA, 22 bp, Homo sapiens
tgcctgggtccaggccaagcct

SEQ ID NO: 7787438 - DNA, 22 bp, Homo sapiens
tgcctgggtgccctctgctcct

SEQ ID NO: 7787439 - DNA, 22 bp, Homo sapiens
tgcctgggttcccaccccaaag

SEQ ID NO: 7787440 - DNA, 22 bp, Homo sapiens
tgcctggtatttgaataaagag

SEQ ID NO: 7787441 - DNA, 22 bp, Homo sapiens
tgcctgtcttcaggagtgtcac

SEQ ID NO: 7787442 - DNA, 22 bp, Homo sapiens
tgccttcttgaatatggttctt

SEQ ID NO: 7787443 - DNA, 22 bp, Homo sapiens
tgccttcttgaatatggttctt

SEQ ID NO: 7787444 - DNA, 22 bp, Homo sapiens
tgcctgtgcccttcttggcatt

SEQ ID NO: 7787445 - DNA, 22 bp, Homo sapiens
tgcgatggcgtagacaaatccc

SEQ ID NO: 7787446 - DNA, 22 bp, Homo sapiens
tgcctttgcaattgaggaggat

SEQ ID NO: 7787447 - DNA, 22 bp, Homo sapiens
tgcggaaggcagcgcagggtgg

SEQ ID NO: 7787448 - DNA, 22 bp, Homo sapiens
tgcgcggctcagtcatctccag

SEQ ID NO: 7787449 - DNA, 22 bp, Homo sapiens
tgcgcggctcagtcatctccag

SEQ ID NO: 7787450 - DNA, 22 bp, Homo sapiens
tgcgcccagccaagtctggcac

SEQ ID NO: 7787451 - DNA, 22 bp, Homo sapiens
tgcgttgcgctcctgcagcagg

SEQ ID NO: 7787452 - DNA, 22 bp, Homo sapiens
tgcgttgcgctcctgcagcagg

SEQ ID NO: 7787453 - DNA, 22 bp, Homo sapiens
tgctatttggcacttttgacct

SEQ ID NO: 7787454 - DNA, 22 bp, Homo sapiens
tgctatttctatctcatttaaa

SEQ ID NO: 7787455 - DNA, 22 bp, Homo sapiens
tgctatttctatctcatttaaa

SEQ ID NO: 7787456 - DNA, 22 bp, Homo sapiens
tgctagtgtgtgagatgttcaa

SEQ ID NO: 7787457 - DNA, 22 bp, Homo sapiens
tgctataagaattatattactc

SEQ ID NO: 7787458 - DNA, 22 bp, Homo sapiens
tgctattacctgctggacagtc

SEQ ID NO: 7787459 - DNA, 22 bp, Homo sapiens
tgctattaatgaggctgcattt

SEQ ID NO: 7787460 - DNA, 22 bp, Homo sapiens
tgctatttaacttttatgtgta

SEQ ID NO: 7787461 - DNA, 22 bp, Homo sapiens
tgctattagaagccatgctgtt

SEQ ID NO: 7787462 - DNA, 22 bp, Homo sapiens
tgctattattgtcaccactgta

SEQ ID NO: 7787463 - DNA, 22 bp, Homo sapiens
tgctcactgaactcttgctgtc

SEQ ID NO: 7787464 - DNA, 22 bp, Homo sapiens
tgctcattaggactgcaaattc

SEQ ID NO: 7787465 - DNA, 22 bp, Homo sapiens
tggaaacacccacgcatgcata

SEQ ID NO: 7787466 - DNA, 22 bp, Homo sapiens
tggaaaatgtgactattctaaa

SEQ ID NO: 7787467 - DNA, 22 bp, Homo sapiens
tggaaatgtttcttgagctcag

SEQ ID NO: 7787468 - DNA, 22 bp, Homo sapiens
tggaaccatcaaagagatcctg

SEQ ID NO: 7787469 - DNA, 22 bp, Homo sapiens
tggaacgtcgtaatgttggtta

SEQ ID NO: 7787470 - DNA, 22 bp, Homo sapiens
tggaaatacaagaagtatgtca

SEQ ID NO: 7787471 - DNA, 22 bp, Homo sapiens
tggaaatattgggtaatagttg

SEQ ID NO: 7787472 - DNA, 22 bp, Homo sapiens
tggaaatatgctccattctttt

SEQ ID NO: 7787473 - DNA, 22 bp, Homo sapiens
tggaaatatacaatgtgtctct

SEQ ID NO: 7787474 - DNA, 22 bp, Homo sapiens
tggaaatagatagtatcattca

SEQ ID NO: 7787475 - DNA, 22 bp, Homo sapiens
tggaaatagatagtatcattca

SEQ ID NO: 7787476 - DNA, 22 bp, Homo sapiens
tggaaatagtaatgcataagtg

SEQ ID NO: 7787477 - DNA, 22 bp, Homo sapiens
tgcttgtgagagttttttcaga

SEQ ID NO: 7787478 - DNA, 22 bp, Homo sapiens
tgctttaacataagatatcttt

SEQ ID NO: 7787479 - DNA, 22 bp, Homo sapiens
tgcttctggggacaggctgcct

SEQ ID NO: 7787480 - DNA, 22 bp, Homo sapiens
tgcttctggcacttgagggggt

SEQ ID NO: 7787481 - DNA, 22 bp, Homo sapiens
tgcttctttactataggcaatt

SEQ ID NO: 7787482 - DNA, 22 bp, Homo sapiens
tgcttctttaaatgatagtcaa

SEQ ID NO: 7787483 - DNA, 22 bp, Homo sapiens
tgctttctcctgtctgaaagat

SEQ ID NO: 7787484 - DNA, 21 bp, Homo sapiens
tgctttatgggaaaaatgtca

SEQ ID NO: 7787485 - DNA, 22 bp, Homo sapiens
tgctttataacttagtttatgg

SEQ ID NO: 7787486 - DNA, 22 bp, Homo sapiens
tggaagctcaaggcagggtgag

SEQ ID NO: 7787487 - DNA, 22 bp, Homo sapiens
tggaaggaagccaaggaaggtt

SEQ ID NO: 7787488 - DNA, 22 bp, Homo sapiens
tggaaggaaaggtagcagagaa

SEQ ID NO: 7787489 - DNA, 22 bp, Homo sapiens
tggaagcatcacttcttgcctg

SEQ ID NO: 7787490 - DNA, 22 bp, Homo sapiens
tggaagcagtgattcttgtctg

SEQ ID NO: 7787491 - DNA, 22 bp, Homo sapiens
tggaagcacttgggttttgttg

SEQ ID NO: 7787492 - DNA, 22 bp, Homo sapiens
tggaagagggagctgggtggcc

SEQ ID NO: 7787493 - DNA, 22 bp, Homo sapiens
tggaagaggtggaagtggcttc

SEQ ID NO: 7787494 - DNA, 22 bp, Homo sapiens
tggaagatcaaccaggattgac

SEQ ID NO: 7787495 - DNA, 22 bp, Homo sapiens
tggaagagcaggcagacaatgc

SEQ ID NO: 7787496 - DNA, 22 bp, Homo sapiens
tggaagtgtctacatgtggagt

SEQ ID NO: 7787497 - DNA, 21 bp, Homo sapiens
tggaagtcttgagtagggggc

SEQ ID NO: 7787498 - DNA, 22 bp, Homo sapiens
tggaagtccctgtgtgtggcct

SEQ ID NO: 7787499 - DNA, 22 bp, Homo sapiens
tggaagtgagaagtttcctcag

SEQ ID NO: 7787500 - DNA, 22 bp, Homo sapiens
tggaagtgattacaatgtagta

SEQ ID NO: 7787501 - DNA, 22 bp, Homo sapiens
tggaagtgctaaactggagtgt

SEQ ID NO: 7787502 - DNA, 22 bp, Homo sapiens
tggaaggggccaggcgcggagt

SEQ ID NO: 7787503 - DNA, 22 bp, Homo sapiens
tggaaggggttacgcagcagga

SEQ ID NO: 7787504 - DNA, 22 bp, Homo sapiens
tggaaggcaacggagtgagctg

SEQ ID NO: 7787505 - DNA, 20 bp, Homo sapiens
tggacacagccctgttgagt

SEQ ID NO: 7787506 - DNA, 18 bp, Homo sapiens
tggacacatggcctgggt

SEQ ID NO: 7787507 - DNA, 23 bp, Homo sapiens
tggacaggacccccttcggaccc

SEQ ID NO: 7787508 - DNA, 22 bp, Homo sapiens
tggacagcttgcagagccaccc

SEQ ID NO: 7787509 - DNA, 22 bp, Homo sapiens
tggacaggcaagcaagacatac

SEQ ID NO: 7787510 - DNA, 22 bp, Homo sapiens
tggacaggatctgagactgaga

SEQ ID NO: 7787511 - DNA, 22 bp, Homo sapiens
tggacaggatagtgcagtacgc

SEQ ID NO: 7787512 - DNA, 22 bp, Homo sapiens
tggacaaatagcatgacacttg

SEQ ID NO: 7787513 - DNA, 22 bp, Homo sapiens
tggaatggaaacaaactgagga

SEQ ID NO: 7787514 - DNA, 22 bp, Homo sapiens
tggaatgaatatgttttaagga

SEQ ID NO: 7787515 - DNA, 22 bp, Homo sapiens
tggaatgcagtgggagcttacc

SEQ ID NO: 7787516 - DNA, 22 bp, Homo sapiens
tggaccagcagccccagtgcct

SEQ ID NO: 7787517 - DNA, 22 bp, Homo sapiens
tggaccagcagccccagtgcct

SEQ ID NO: 7787518 - DNA, 22 bp, Homo sapiens
tggaccagcagccccagtgcct

SEQ ID NO: 7787519 - DNA, 21 bp, Homo sapiens
tggaccaggaaggtggtggtg

SEQ ID NO: 7787520 - DNA, 22 bp, Homo sapiens
tggaccagctcctcgggagacg

SEQ ID NO: 7787521 - DNA, 22 bp, Homo sapiens
tggaccagggtcccagagtatg

SEQ ID NO: 7787522 - DNA, 22 bp, Homo sapiens
tggacccaccccagggcctgct

SEQ ID NO: 7787523 - DNA, 21 bp, Homo sapiens
tggacattatggagagagtag

SEQ ID NO: 7787524 - DNA, 22 bp, Homo sapiens
tggacaggtgagtgactcaggg

SEQ ID NO: 7787525 - DNA, 18 bp, Homo sapiens
tggacagggtggagaaaa

SEQ ID NO: 7787526 - DNA, 23 bp, Homo sapiens
tggacagggtaactggtggtttt

SEQ ID NO: 7787527 - DNA, 22 bp, Homo sapiens
tggacaggggctgctgttgtca

SEQ ID NO: 7787528 - DNA, 20 bp, Homo sapiens
tggacaggggcataggttgc

SEQ ID NO: 7787529 - DNA, 22 bp, Homo sapiens
tggacaggctcctaggggttcc

SEQ ID NO: 7787530 - DNA, 22 bp, Homo sapiens
tggacagggcagagaccgagtc

SEQ ID NO: 7787531 - DNA, 23 bp, Homo sapiens
tggaccctgcacaccagctctac

SEQ ID NO: 7787532 - DNA, 22 bp, Homo sapiens
tggacccaggcaggtctgtcct

SEQ ID NO: 7787533 - DNA, 22 bp, Homo sapiens
tggactctgaactggcactgac

SEQ ID NO: 7787534 - DNA, 22 bp, Homo sapiens
tggactctatgatgcgccagca

SEQ ID NO: 7787535 - DNA, 22 bp, Homo sapiens
tggactctaagcagaggatcta

SEQ ID NO: 7787536 - DNA, 22 bp, Homo sapiens
tggagaggagcaccatggccat

SEQ ID NO: 7787537 - DNA, 22 bp, Homo sapiens
tggagaggttgaataacttgtc

SEQ ID NO: 7787538 - DNA, 22 bp, Homo sapiens
tggagaggagcaccatggccat

SEQ ID NO: 7787539 - DNA, 22 bp, Homo sapiens
tggagaggtttaaacaaaagtt

SEQ ID NO: 7787540 - DNA, 22 bp, Homo sapiens
tggagcagcattcatccagcag

SEQ ID NO: 7787541 - DNA, 22 bp, Homo sapiens
tggagcagaggctgaggttggg

SEQ ID NO: 7787542 - DNA, 19 bp, Homo sapiens
tggagaggaaatgctgctc

SEQ ID NO: 7787543 - DNA, 19 bp, Homo sapiens
tggagaggaaatgctgctc

SEQ ID NO: 7787544 - DNA, 22 bp, Homo sapiens
tggagagctgttgaaatgcaga

SEQ ID NO: 7787545 - DNA, 22 bp, Homo sapiens
tggagaggaaagtgcagttttg

SEQ ID NO: 7787546 - DNA, 21 bp, Homo sapiens
tggagagcccttgcctgagtc

SEQ ID NO: 7787547 - DNA, 22 bp, Homo sapiens
tggagaagattggtcaccattc

SEQ ID NO: 7787548 - DNA, 22 bp, Homo sapiens
tggagaaaaggttgaatccatc

SEQ ID NO: 7787549 - DNA, 22 bp, Homo sapiens
tggagaagtcaaagtgaacagg

SEQ ID NO: 7787550 - DNA, 22 bp, Homo sapiens
tggagagaagaggcagtgtgct

SEQ ID NO: 7787551 - DNA, 22 bp, Homo sapiens
tggagccagtgttgcccaacac

SEQ ID NO: 7787552 - DNA, 22 bp, Homo sapiens
tggagccagtgttgcccaacac

SEQ ID NO: 7787553 - DNA, 22 bp, Homo sapiens
tggagccaggctggccctgcca

SEQ ID NO: 7787554 - DNA, 18 bp, Homo sapiens
tggagccattgccaccat

SEQ ID NO: 7787555 - DNA, 18 bp, Homo sapiens
tggagccattgccaccat

SEQ ID NO: 7787556 - DNA, 22 bp, Homo sapiens
tggagcccacggatgtcgcttt

SEQ ID NO: 7787557 - DNA, 18 bp, Homo sapiens
tggagccattgccaccat

SEQ ID NO: 7787558 - DNA, 22 bp, Homo sapiens
tggagccaggctggccctgcca

SEQ ID NO: 7787559 - DNA, 22 bp, Homo sapiens
tggagccagcgagccgaggcgg

SEQ ID NO: 7787560 - DNA, 22 bp, Homo sapiens
tggagccagcccaggcccctct

SEQ ID NO: 7787561 - DNA, 22 bp, Homo sapiens
tggagccagcccaggcccctct

SEQ ID NO: 7787562 - DNA, 22 bp, Homo sapiens
tggagccagcccaggcccctct

SEQ ID NO: 7787563 - DNA, 22 bp, Homo sapiens
tggagccagagcgcagcctggg

SEQ ID NO: 7787564 - DNA, 22 bp, Homo sapiens
tggagcaggaagtctatggctg

SEQ ID NO: 7787565 - DNA, 18 bp, Homo sapiens
tggagcaggaagcctggc

SEQ ID NO: 7787566 - DNA, 20 bp, Homo sapiens
tggagggattgttggcaaat

SEQ ID NO: 7787567 - DNA, 22 bp, Homo sapiens
tggagggcatctgtggtcaggc

SEQ ID NO: 7787568 - DNA, 22 bp, Homo sapiens
tggagggcgcttagatggaggg

SEQ ID NO: 7787569 - DNA, 22 bp, Homo sapiens
tggagggaacccaggctgctct

SEQ ID NO: 7787570 - DNA, 22 bp, Homo sapiens
tggagggctaagctgagggata

SEQ ID NO: 7787571 - DNA, 22 bp, Homo sapiens
tggagggctctttcacctggta

SEQ ID NO: 7787572 - DNA, 20 bp, Homo sapiens
tggaggtggtctgctgtcct

SEQ ID NO: 7787573 - DNA, 22 bp, Homo sapiens
tggaggtgggagggactgtcct

SEQ ID NO: 7787574 - DNA, 22 bp, Homo sapiens
tggaggtggcacaagggaggtc

SEQ ID NO: 7787575 - DNA, 22 bp, Homo sapiens
tggagtctgtgatgctctgggt

SEQ ID NO: 7787576 - DNA, 20 bp, Homo sapiens
tggagtctgacagatgggta

SEQ ID NO: 7787577 - DNA, 22 bp, Homo sapiens
tggaggtgtataaggtagcttc

SEQ ID NO: 7787578 - DNA, 16 bp, Homo sapiens
tggaggtgtttctagt

SEQ ID NO: 7787579 - DNA, 22 bp, Homo sapiens
tggaggtgtccaactcgtgggt

SEQ ID NO: 7787580 - DNA, 22 bp, Homo sapiens
tggatggctggggaagagcagg

SEQ ID NO: 7787581 - DNA, 22 bp, Homo sapiens
tggatggccccactggatccat

SEQ ID NO: 7787582 - DNA, 22 bp, Homo sapiens
tggatggattgacgaaggcagc

SEQ ID NO: 7787583 - DNA, 22 bp, Homo sapiens
tggagttctcaggtgagggctt

SEQ ID NO: 7787584 - DNA, 22 bp, Homo sapiens
tggagtgggcaatgtaggcaag

SEQ ID NO: 7787585 - DNA, 22 bp, Homo sapiens
tggataaactcactgtaagttg

SEQ ID NO: 7787586 - DNA, 22 bp, Homo sapiens
tggataaaatctgtaaggctca

SEQ ID NO: 7787587 - DNA, 22 bp, Homo sapiens
tggaggaaaattactggggtct

SEQ ID NO: 7787588 - DNA, 22 bp, Homo sapiens
tggaggagtgtgattgtctgcc

SEQ ID NO: 7787589 - DNA, 22 bp, Homo sapiens
tggaggagggctggtgtctgta

SEQ ID NO: 7787590 - DNA, 22 bp, Homo sapiens
tggaggagggctggtgtctgta

SEQ ID NO: 7787591 - DNA, 22 bp, Homo sapiens
tggaggaaaaaaccaggcagag

SEQ ID NO: 7787592 - DNA, 22 bp, Homo sapiens
tggaggcagtaactgagcaaca

SEQ ID NO: 7787593 - DNA, 22 bp, Homo sapiens
tggctaacaaggtgaaaccccg

SEQ ID NO: 7787594 - DNA, 22 bp, Homo sapiens
tggcggtgacggcggcgcctgg

SEQ ID NO: 7787595 - DNA, 20 bp, Homo sapiens
tggcggggatgagggagtta

SEQ ID NO: 7787596 - DNA, 21 bp, Homo sapiens
tggcggggacttgtggctgcc

SEQ ID NO: 7787597 - DNA, 21 bp, Homo sapiens
tggcggggacttgtggctgcc

SEQ ID NO: 7787598 - DNA, 21 bp, Homo sapiens
tggcggggacttgtggctgcc

SEQ ID NO: 7787599 - DNA, 22 bp, Homo sapiens
tggctattgagtgatctctaga

SEQ ID NO: 7787600 - DNA, 22 bp, Homo sapiens
tggctcagatgctcttccagtg

SEQ ID NO: 7787601 - DNA, 22 bp, Homo sapiens
tggctcagatgctcttccagtg

SEQ ID NO: 7787602 - DNA, 18 bp, Homo sapiens
tggctcagatggctttaa

SEQ ID NO: 7787603 - DNA, 22 bp, Homo sapiens
tggctcagatttttgtaggctt

SEQ ID NO: 7787604 - DNA, 22 bp, Homo sapiens
tggctcagagccttgagagctg

SEQ ID NO: 7787605 - DNA, 22 bp, Homo sapiens
tggctcagagcagggactctgg

SEQ ID NO: 7787606 - DNA, 22 bp, Homo sapiens
tggctcagaaggctgccttcac

SEQ ID NO: 7787607 - DNA, 22 bp, Homo sapiens
tggctcagaaggctgccttcac

SEQ ID NO: 7787608 - DNA, 22 bp, Homo sapiens
tggcgaggccaggccagggcct

SEQ ID NO: 7787609 - DNA, 22 bp, Homo sapiens
tggcgcagtttctctgctgcct

SEQ ID NO: 7787610 - DNA, 22 bp, Homo sapiens
tggcctggctcacagtgagatt

SEQ ID NO: 7787611 - DNA, 22 bp, Homo sapiens
tggcctggccctgaggccctgt

SEQ ID NO: 7787612 - DNA, 22 bp, Homo sapiens
tggcctggtgtctgcgaggcct

SEQ ID NO: 7787613 - DNA, 22 bp, Homo sapiens
tggcctggttgttgctgccgtt

SEQ ID NO: 7787614 - DNA, 22 bp, Homo sapiens
tggctccaggggacacgcagta

SEQ ID NO: 7787615 - DNA, 22 bp, Homo sapiens
tggctccatcatccatgcaaga

SEQ ID NO: 7787616 - DNA, 22 bp, Homo sapiens
tggctccatcatccatgcaaga

SEQ ID NO: 7787617 - DNA, 22 bp, Homo sapiens
tggctcagttaggtcagaaaca

SEQ ID NO: 7787618 - DNA, 20 bp, Homo sapiens
tggctccagcctcccctacc

SEQ ID NO: 7787619 - DNA, 23 bp, Homo sapiens
tggctccaggagaagccagaagc

SEQ ID NO: 7787620 - DNA, 22 bp, Homo sapiens
tggctccagatttcctgctgca

SEQ ID NO: 7787621 - DNA, 22 bp, Homo sapiens
tggctccagatttcctgctgca

SEQ ID NO: 7787622 - DNA, 22 bp, Homo sapiens
tggctcagtgacattcctccca

SEQ ID NO: 7787623 - DNA, 22 bp, Homo sapiens
tggctcagtgcattcacagtaa

SEQ ID NO: 7787624 - DNA, 22 bp, Homo sapiens
tggctcagtggcagccgcagct

SEQ ID NO: 7787625 - DNA, 22 bp, Homo sapiens
tggctcagtggcagccgcagct

SEQ ID NO: 7787626 - DNA, 22 bp, Homo sapiens
tggctcagtcatggatgagtaa

SEQ ID NO: 7787627 - DNA, 22 bp, Homo sapiens
tggctcaggggtctggctctgt

SEQ ID NO: 7787628 - DNA, 22 bp, Homo sapiens
tggctcagggtccccaaatggt

SEQ ID NO: 7787629 - DNA, 22 bp, Homo sapiens
tggctcagctttccccatctgg

SEQ ID NO: 7787630 - DNA, 22 bp, Homo sapiens
tggctcaggataattttcccaa

SEQ ID NO: 7787631 - DNA, 22 bp, Homo sapiens
tggctcaggcttgaaaatagat

SEQ ID NO: 7787632 - DNA, 22 bp, Homo sapiens
tggctcagccagccctaggaac

SEQ ID NO: 7787633 - DNA, 22 bp, Homo sapiens
tggctcagcattcactggtctt

SEQ ID NO: 7787634 - DNA, 22 bp, Homo sapiens
tggctcagcaggttagaaacta

SEQ ID NO: 7787635 - DNA, 22 bp, Homo sapiens
tggctgcagatcaagggcaggc

SEQ ID NO: 7787636 - DNA, 22 bp, Homo sapiens
tggctgattgatttcctatgta

SEQ ID NO: 7787637 - DNA, 21 bp, Homo sapiens
tggctgcaagcagctgcctcc

SEQ ID NO: 7787638 - DNA, 20 bp, Homo sapiens
tggctgcacaccaggacagg

SEQ ID NO: 7787639 - DNA, 22 bp, Homo sapiens
tggctggaagtcagaaatggga

SEQ ID NO: 7787640 - DNA, 22 bp, Homo sapiens
tggctgcagatctgtgggacac

SEQ ID NO: 7787641 - DNA, 22 bp, Homo sapiens
tggctgaggagggtcttctggt

SEQ ID NO: 7787642 - DNA, 22 bp, Homo sapiens
tggctgaggagggtcttctggt

SEQ ID NO: 7787643 - DNA, 22 bp, Homo sapiens
tggctgaagtgggcaggaggga

SEQ ID NO: 7787644 - DNA, 22 bp, Homo sapiens
tggctgagccacttgttcagat

SEQ ID NO: 7787645 - DNA, 22 bp, Homo sapiens
tggctctggggacagtaagtcc

SEQ ID NO: 7787646 - DNA, 22 bp, Homo sapiens
tggctctggattaatctaggaa

SEQ ID NO: 7787647 - DNA, 23 bp, Homo sapiens
tggctctgtgtcacatacaggat

SEQ ID NO: 7787648 - DNA, 20 bp, Homo sapiens
tggctctcaccctgtgcgat

SEQ ID NO: 7787649 - DNA, 23 bp, Homo sapiens
tggctctgagaggttcagatgct

SEQ ID NO: 7787650 - DNA, 22 bp, Homo sapiens
tgggagaaactgtctctcccac

SEQ ID NO: 7787651 - DNA, 22 bp, Homo sapiens
tgggagaacactgctctggatg

SEQ ID NO: 7787652 - DNA, 22 bp, Homo sapiens
tgggagaaagaaccctgagtga

SEQ ID NO: 7787653 - DNA, 22 bp, Homo sapiens
tgggagaacccagggtcaggct

SEQ ID NO: 7787654 - DNA, 22 bp, Homo sapiens
tgggagaagcagcagccaagtg

SEQ ID NO: 7787655 - DNA, 22 bp, Homo sapiens
tgggagaagcatggggtgcaga

SEQ ID NO: 7787656 - DNA, 22 bp, Homo sapiens
tgggagaatcttgctctgctac

SEQ ID NO: 7787657 - DNA, 22 bp, Homo sapiens
tgggagacactggtgggagctt

SEQ ID NO: 7787658 - DNA, 21 bp, Homo sapiens
tgggagacacagccttgagct

SEQ ID NO: 7787659 - DNA, 21 bp, Homo sapiens
tgggagaccgccttcctggga

SEQ ID NO: 7787660 - DNA, 21 bp, Homo sapiens
tgggagagggctcagctaccc

SEQ ID NO: 7787661 - DNA, 22 bp, Homo sapiens
tgggagatattgctgtggctgt

SEQ ID NO: 7787662 - DNA, 22 bp, Homo sapiens
tgggagcaagctacttagggaa

SEQ ID NO: 7787663 - DNA, 22 bp, Homo sapiens
tgggagcaaatgactgggagat

SEQ ID NO: 7787664 - DNA, 22 bp, Homo sapiens
tgggagcaaatgactgggagat

SEQ ID NO: 7787665 - DNA, 22 bp, Homo sapiens
tgggagcagctttgcgagggag

SEQ ID NO: 7787666 - DNA, 22 bp, Homo sapiens
tgggagcagcattgccatgtgc

SEQ ID NO: 7787667 - DNA, 22 bp, Homo sapiens
tgggagcagccaacatggcctt

SEQ ID NO: 7787668 - DNA, 22 bp, Homo sapiens
tgggagcaccctgaggagcttc

SEQ ID NO: 7787669 - DNA, 22 bp, Homo sapiens
tgggagcaccctgaggagcttc

SEQ ID NO: 7787670 - DNA, 22 bp, Homo sapiens
tgggagcaagctggtgctggag

SEQ ID NO: 7787671 - DNA, 22 bp, Homo sapiens
tgggagcaccttgagggcagaa

SEQ ID NO: 7787672 - DNA, 22 bp, Homo sapiens
tgggagcactctttgggaagca

SEQ ID NO: 7787673 - DNA, 22 bp, Homo sapiens
tgggaggatcgcttgagcccag

SEQ ID NO: 7787674 - DNA, 22 bp, Homo sapiens
tgggaggatctcttgaggccag

SEQ ID NO: 7787675 - DNA, 22 bp, Homo sapiens
tgggaggcagaagttgactgga

SEQ ID NO: 7787676 - DNA, 22 bp, Homo sapiens
tgggaggcagaagttgactgga

SEQ ID NO: 7787677 - DNA, 22 bp, Homo sapiens
tgggaggcagaagttgactgga

SEQ ID NO: 7787678 - DNA, 22 bp, Homo sapiens
tgggactcactcttttggccag

SEQ ID NO: 7787679 - DNA, 22 bp, Homo sapiens
tgggaccagataaagggaggtc

SEQ ID NO: 7787680 - DNA, 21 bp, Homo sapiens
tgggacagtgatggctcctcc

SEQ ID NO: 7787681 - DNA, 22 bp, Homo sapiens
tgggaccacactttgaacaaca

SEQ ID NO: 7787682 - DNA, 22 bp, Homo sapiens
tgggaccaagtcatttctttag

SEQ ID NO: 7787683 - DNA, 22 bp, Homo sapiens
tgggacagttgtcctccactct

SEQ ID NO: 7787684 - DNA, 22 bp, Homo sapiens
tgggaatgggcctagaaggctg

SEQ ID NO: 7787685 - DNA, 22 bp, Homo sapiens
tgggaagcattaatgatagggg

SEQ ID NO: 7787686 - DNA, 22 bp, Homo sapiens
tgggaagggagtttcttggagt

SEQ ID NO: 7787687 - DNA, 22 bp, Homo sapiens
tgggaagctactcatgcaggca

SEQ ID NO: 7787688 - DNA, 22 bp, Homo sapiens
tgggaaggtgtagaaagaacaa

SEQ ID NO: 7787689 - DNA, 22 bp, Homo sapiens
tgggaaggtacacgggaaagag

SEQ ID NO: 7787690 - DNA, 22 bp, Homo sapiens
tgggaagggtcaacagctggaa

SEQ ID NO: 7787691 - DNA, 22 bp, Homo sapiens
tgggaagggtcaacagctggaa

SEQ ID NO: 7787692 - DNA, 22 bp, Homo sapiens
tggcttcaaaatctagtggtct

SEQ ID NO: 7787693 - DNA, 22 bp, Homo sapiens
tggcttcacaatttcataacta

SEQ ID NO: 7787694 - DNA, 22 bp, Homo sapiens
tggctgtgtgccaggctgtctg

SEQ ID NO: 7787695 - DNA, 22 bp, Homo sapiens
tggctgtgtccctgtccagagt

SEQ ID NO: 7787696 - DNA, 22 bp, Homo sapiens
tggctgtgtcatcatagctgtg

SEQ ID NO: 7787697 - DNA, 22 bp, Homo sapiens
tggctgtgggatatgtgactga

SEQ ID NO: 7787698 - DNA, 22 bp, Homo sapiens
tggctggggccacagttttcct

SEQ ID NO: 7787699 - DNA, 22 bp, Homo sapiens
tggctgggggtgctatagctgc

SEQ ID NO: 7787700 - DNA, 22 bp, Homo sapiens
tggctggagagggtcccatgag

SEQ ID NO: 7787701 - DNA, 22 bp, Homo sapiens
tggctggagaacttggggatct

SEQ ID NO: 7787702 - DNA, 22 bp, Homo sapiens
tggctggacctgggctggaatt

SEQ ID NO: 7787703 - DNA, 22 bp, Homo sapiens
tggctggacagtgggcagtgga

SEQ ID NO: 7787704 - DNA, 22 bp, Homo sapiens
tggctggacagtgggcagtgga

SEQ ID NO: 7787705 - DNA, 22 bp, Homo sapiens
tggctggaggcatgcaagctcc

SEQ ID NO: 7787706 - DNA, 22 bp, Homo sapiens
tggctggagggttagtgagata

SEQ ID NO: 7787707 - DNA, 22 bp, Homo sapiens
tggctggagggttagtgagata

SEQ ID NO: 7787708 - DNA, 22 bp, Homo sapiens
tggctggagcgccctcctctgc

SEQ ID NO: 7787709 - DNA, 22 bp, Homo sapiens
tggctggagcattccttgtctt

SEQ ID NO: 7787710 - DNA, 22 bp, Homo sapiens
tggctggagcccctcaagagca

SEQ ID NO: 7787711 - DNA, 22 bp, Homo sapiens
tggctggagtataggagtagga

SEQ ID NO: 7787712 - DNA, 22 bp, Homo sapiens
tggctggatatcaggcaagggg

SEQ ID NO: 7787713 - DNA, 22 bp, Homo sapiens
tggctggatgtgagatcaagag

SEQ ID NO: 7787714 - DNA, 23 bp, Homo sapiens
tggctggcagaaactgaagcatg

SEQ ID NO: 7787715 - DNA, 22 bp, Homo sapiens
tggctggcaaggctggagtcag

SEQ ID NO: 7787716 - DNA, 18 bp, Homo sapiens
tggctggcagtgggcagc

SEQ ID NO: 7787717 - DNA, 22 bp, Homo sapiens
tggctggcagtaggctagtggc

SEQ ID NO: 7787718 - DNA, 22 bp, Homo sapiens
tggctggcagtaggctagtggc

SEQ ID NO: 7787719 - DNA, 23 bp, Homo sapiens
tggctggcagaaactgaagcatg

SEQ ID NO: 7787720 - DNA, 22 bp, Homo sapiens
tggctggccctgggagtgcaga

SEQ ID NO: 7787721 - DNA, 22 bp, Homo sapiens
tggctggcgccgggctagccac

SEQ ID NO: 7787722 - DNA, 22 bp, Homo sapiens
tggctggcagttatctttggat

SEQ ID NO: 7787723 - DNA, 22 bp, Homo sapiens
tggctggcatagccattgctcc

SEQ ID NO: 7787724 - DNA, 22 bp, Homo sapiens
tggctggcatagccattgctcc

SEQ ID NO: 7787725 - DNA, 22 bp, Homo sapiens
tggctggccctgggagtgcaga

SEQ ID NO: 7787726 - DNA, 22 bp, Homo sapiens
tggctggctagaatggaaatgt

SEQ ID NO: 7787727 - DNA, 23 bp, Homo sapiens
tggctggcgcctgcctcaccctg

SEQ ID NO: 7787728 - DNA, 22 bp, Homo sapiens
tggctggcgttggggccagtga

SEQ ID NO: 7787729 - DNA, 22 bp, Homo sapiens
tggctgggagctggaactgggc

SEQ ID NO: 7787730 - DNA, 22 bp, Homo sapiens
tggcttcaggagcacctggctt

SEQ ID NO: 7787731 - DNA, 22 bp, Homo sapiens
tggcttcagacttctgctacgt

SEQ ID NO: 7787732 - DNA, 22 bp, Homo sapiens
tggcttcctaggagcccgtgct

SEQ ID NO: 7787733 - DNA, 17 bp, Homo sapiens
tggcttccctgggccac

SEQ ID NO: 7787734 - DNA, 22 bp, Homo sapiens
tggcttccgccgcgggcctcgg

SEQ ID NO: 7787735 - DNA, 22 bp, Homo sapiens
tggcttcctgcacagtgtctgc

SEQ ID NO: 7787736 - DNA, 19 bp, Homo sapiens
tggcttcctgactctcatc

SEQ ID NO: 7787737 - DNA, 22 bp, Homo sapiens
tggcttcctgcatggatcctct

SEQ ID NO: 7787738 - DNA, 22 bp, Homo sapiens
tggcttctagagcccatccttc

SEQ ID NO: 7787739 - DNA, 22 bp, Homo sapiens
tggcttcctgtttcccagaaag

SEQ ID NO: 7787740 - DNA, 22 bp, Homo sapiens
tggcttctagtttgaggaaaaa

SEQ ID NO: 7787741 - DNA, 22 bp, Homo sapiens
tggcttctggggtggcctgcat

SEQ ID NO: 7787742 - DNA, 22 bp, Homo sapiens
tggcttctgctcccagaatgat

SEQ ID NO: 7787743 - DNA, 22 bp, Homo sapiens
tggcttctgctcccagaatgat

SEQ ID NO: 7787744 - DNA, 22 bp, Homo sapiens
tggcttctgagtctcctgacat

SEQ ID NO: 7787745 - DNA, 20 bp, Homo sapiens
tggcttctcttcactcctgt

SEQ ID NO: 7787746 - DNA, 22 bp, Homo sapiens
tggcttctcccgacaccctggc

SEQ ID NO: 7787747 - DNA, 22 bp, Homo sapiens
tggcttctccctacaacatgcc

SEQ ID NO: 7787748 - DNA, 22 bp, Homo sapiens
tgggaagaagcagagaactgga

SEQ ID NO: 7787749 - DNA, 22 bp, Homo sapiens
tgggaactctctgggaggcatc

SEQ ID NO: 7787750 - DNA, 22 bp, Homo sapiens
tgggaaagtgttgaggtgtctt

SEQ ID NO: 7787751 - DNA, 22 bp, Homo sapiens
tgggaaagtgttgaggtgtctt

SEQ ID NO: 7787752 - DNA, 22 bp, Homo sapiens
tgggaaagtgtagcctgcaggc

SEQ ID NO: 7787753 - DNA, 18 bp, Homo sapiens
tggcttcttgagctaaca

SEQ ID NO: 7787754 - DNA, 22 bp, Homo sapiens
tggcttcttagaccagtggcct

SEQ ID NO: 7787755 - DNA, 22 bp, Homo sapiens
tgggaaagccagcagtgtcacc

SEQ ID NO: 7787756 - DNA, 22 bp, Homo sapiens
tgggaaagtaattgtcatcctt

SEQ ID NO: 7787757 - DNA, 22 bp, Homo sapiens
tgggaaagactcaggacaggag

SEQ ID NO: 7787758 - DNA, 22 bp, Homo sapiens
tgggaaagactcaggacaggag

SEQ ID NO: 7787759 - DNA, 22 bp, Homo sapiens
tggcagagtaggatggccctgt

SEQ ID NO: 7787760 - DNA, 22 bp, Homo sapiens
tggcagagttcgctgtgccttt

SEQ ID NO: 7787761 - DNA, 22 bp, Homo sapiens
tggcagataacctgctgtgccc

SEQ ID NO: 7787762 - DNA, 22 bp, Homo sapiens
tggcagataaaataatagggaa

SEQ ID NO: 7787763 - DNA, 22 bp, Homo sapiens
tggcagatacccaggcaaatgg

SEQ ID NO: 7787764 - DNA, 22 bp, Homo sapiens
tggcagcagtggaggtagaaag

SEQ ID NO: 7787765 - DNA, 22 bp, Homo sapiens
tggcagcatgtcccggcctcag

SEQ ID NO: 7787766 - DNA, 22 bp, Homo sapiens
tggcagcctcagacaaggacct

SEQ ID NO: 7787767 - DNA, 22 bp, Homo sapiens
tggcagcctggaatctctcagc

SEQ ID NO: 7787768 - DNA, 22 bp, Homo sapiens
tggcagccttctctgagaaggt

SEQ ID NO: 7787769 - DNA, 22 bp, Homo sapiens
tggcagctacagacagaggtga

SEQ ID NO: 7787770 - DNA, 22 bp, Homo sapiens
tggcagctcctggggccagcac

SEQ ID NO: 7787771 - DNA, 22 bp, Homo sapiens
tggcaggaaataccctgcctag

SEQ ID NO: 7787772 - DNA, 22 bp, Homo sapiens
tggcaggaaaaagggccagagg

SEQ ID NO: 7787773 - DNA, 22 bp, Homo sapiens
tggcagctgccatgtccacgtg

SEQ ID NO: 7787774 - DNA, 22 bp, Homo sapiens
tggcagctgcaggcctcctgag

SEQ ID NO: 7787775 - DNA, 22 bp, Homo sapiens
tggcagctgcaggcctcctgag

SEQ ID NO: 7787776 - DNA, 22 bp, Homo sapiens
tggcagctgaatggctggatgg

SEQ ID NO: 7787777 - DNA, 22 bp, Homo sapiens
tggcagctgattagatggtgcc

SEQ ID NO: 7787778 - DNA, 22 bp, Homo sapiens
tggcagctgaggggaggctttg

SEQ ID NO: 7787779 - DNA, 22 bp, Homo sapiens
tggcaggagcctgcggggaggt

SEQ ID NO: 7787780 - DNA, 20 bp, Homo sapiens
tggcaggaggcagcagtgga

SEQ ID NO: 7787781 - DNA, 20 bp, Homo sapiens
tggcaggaatagggccagag

SEQ ID NO: 7787782 - DNA, 22 bp, Homo sapiens
tggcaggaaggagactcagccc

SEQ ID NO: 7787783 - DNA, 22 bp, Homo sapiens
tggcagggagttcgttcacaac

SEQ ID NO: 7787784 - DNA, 22 bp, Homo sapiens
tggcagggagttcgttcacaac

SEQ ID NO: 7787785 - DNA, 19 bp, Homo sapiens
tggcagggagtgatattag

SEQ ID NO: 7787786 - DNA, 18 bp, Homo sapiens
tggcagggaggaaatata

SEQ ID NO: 7787787 - DNA, 22 bp, Homo sapiens
tggcaggcagtgtgggagctgg

SEQ ID NO: 7787788 - DNA, 21 bp, Homo sapiens
tggcaggcagctggaagcttg

SEQ ID NO: 7787789 - DNA, 22 bp, Homo sapiens
tggcagggcctgctcatcatcc

SEQ ID NO: 7787790 - DNA, 22 bp, Homo sapiens
tggcagggcctgaatcttatac

SEQ ID NO: 7787791 - DNA, 22 bp, Homo sapiens
tggcagggcctaccccaatatc

SEQ ID NO: 7787792 - DNA, 22 bp, Homo sapiens
tggcagggagttgcaggatttc

SEQ ID NO: 7787793 - DNA, 18 bp, Homo sapiens
tggcaggggcagtacgcc

SEQ ID NO: 7787794 - DNA, 21 bp, Homo sapiens
tggcaggggtagtagtacagc

SEQ ID NO: 7787795 - DNA, 22 bp, Homo sapiens
tggcagggtacaccttaacacc

SEQ ID NO: 7787796 - DNA, 22 bp, Homo sapiens
tggcagggtacaccttaacacc

SEQ ID NO: 7787797 - DNA, 22 bp, Homo sapiens
tggcaggggaggtgcttgctta

SEQ ID NO: 7787798 - DNA, 18 bp, Homo sapiens
tggcaggggcagtacgcc

SEQ ID NO: 7787799 - DNA, 22 bp, Homo sapiens
tggcagagcccagactccagtc

SEQ ID NO: 7787800 - DNA, 22 bp, Homo sapiens
tggcagagctggctgcggatga

SEQ ID NO: 7787801 - DNA, 22 bp, Homo sapiens
tggcagagagagtgcagtcgac

SEQ ID NO: 7787802 - DNA, 22 bp, Homo sapiens
tggcagagagactctccttgat

SEQ ID NO: 7787803 - DNA, 22 bp, Homo sapiens
tggcagagacaaggccgggcct

SEQ ID NO: 7787804 - DNA, 22 bp, Homo sapiens
tggcactgaaaaaggagaggtt

SEQ ID NO: 7787805 - DNA, 22 bp, Homo sapiens
tggcacctgaacttagaggtgt

SEQ ID NO: 7787806 - DNA, 22 bp, Homo sapiens
tggcacctggtgcagggtggcc

SEQ ID NO: 7787807 - DNA, 22 bp, Homo sapiens
tggcaccaccagacaccaggag

SEQ ID NO: 7787808 - DNA, 22 bp, Homo sapiens
tggcacatagaaaaggatcaat

SEQ ID NO: 7787809 - DNA, 22 bp, Homo sapiens
tggcacatagtaggtgctcaat

SEQ ID NO: 7787810 - DNA, 22 bp, Homo sapiens
tggcacacagagaagacacttg

SEQ ID NO: 7787811 - DNA, 22 bp, Homo sapiens
tggcacagaaaaatgctccatt

SEQ ID NO: 7787812 - DNA, 22 bp, Homo sapiens
tggcaatgaggtcagatgtctt

SEQ ID NO: 7787813 - DNA, 22 bp, Homo sapiens
tggcacagacagcacagcaatg

SEQ ID NO: 7787814 - DNA, 20 bp, Homo sapiens
tggcacagaacccttgccta

SEQ ID NO: 7787815 - DNA, 22 bp, Homo sapiens
tggcacagcttgtcataaactc

SEQ ID NO: 7787816 - DNA, 22 bp, Homo sapiens
tggcacagcccattcagagaag

SEQ ID NO: 7787817 - DNA, 22 bp, Homo sapiens
tggcacagagggacccagcagc

SEQ ID NO: 7787818 - DNA, 22 bp, Homo sapiens
tggatttagttcttcacaggcc

SEQ ID NO: 7787819 - DNA, 22 bp, Homo sapiens
tggatttaaggcagagagggcc

SEQ ID NO: 7787820 - DNA, 22 bp, Homo sapiens
tggatttaacagaataccaggt

SEQ ID NO: 7787821 - DNA, 21 bp, Homo sapiens
tggattgaggtgacagtgtgc

SEQ ID NO: 7787822 - DNA, 22 bp, Homo sapiens
tggatttattaggttggtgaaa

SEQ ID NO: 7787823 - DNA, 22 bp, Homo sapiens
tggattcatgctgggatttttc

SEQ ID NO: 7787824 - DNA, 22 bp, Homo sapiens
tggattcacaccattctcctgc

SEQ ID NO: 7787825 - DNA, 22 bp, Homo sapiens
tggattctcatgggaccagtag

SEQ ID NO: 7787826 - DNA, 22 bp, Homo sapiens
tggattctaatgcacttcaaat

SEQ ID NO: 7787827 - DNA, 18 bp, Homo sapiens
tggattgaattgagaggt

SEQ ID NO: 7787828 - DNA, 22 bp, Homo sapiens
tggattgataaaatgggatgtt

SEQ ID NO: 7787829 - DNA, 22 bp, Homo sapiens
tggattctgggctgtttgcatt

SEQ ID NO: 7787830 - DNA, 18 bp, Homo sapiens
tggattgaattgagaggt

SEQ ID NO: 7787831 - DNA, 22 bp, Homo sapiens
tggattctgggagagttctata

SEQ ID NO: 7787832 - DNA, 22 bp, Homo sapiens
tggatgggttgaaatgtgagcc

SEQ ID NO: 7787833 - DNA, 22 bp, Homo sapiens
tggatgggttgaaatgtgagcc

SEQ ID NO: 7787834 - DNA, 17 bp, Homo sapiens
tggatgtgggatctgga

SEQ ID NO: 7787835 - DNA, 22 bp, Homo sapiens
tggcaatattaacagtacttat

SEQ ID NO: 7787836 - DNA, 22 bp, Homo sapiens
tggcaaagattaccacatctac

SEQ ID NO: 7787837 - DNA, 22 bp, Homo sapiens
tggcctgccccgagatcctggc

SEQ ID NO: 7787838 - DNA, 22 bp, Homo sapiens
tggcctgcaaagtcttcttgct

SEQ ID NO: 7787839 - DNA, 23 bp, Homo sapiens
tggcctgcagagtttctgctggg

SEQ ID NO: 7787840 - DNA, 20 bp, Homo sapiens
tggcctctgtagaggccaag

SEQ ID NO: 7787841 - DNA, 22 bp, Homo sapiens
tggcctctggctgaggactaac

SEQ ID NO: 7787842 - DNA, 20 bp, Homo sapiens
tggcctctgagatgccacgg

SEQ ID NO: 7787843 - DNA, 22 bp, Homo sapiens
tggcctcttaaggatgacacaa

SEQ ID NO: 7787844 - DNA, 22 bp, Homo sapiens
tggcctcttaggacatcctcta

SEQ ID NO: 7787845 - DNA, 22 bp, Homo sapiens
tggcctgccttcgctgagctga

SEQ ID NO: 7787846 - DNA, 22 bp, Homo sapiens
tggccctgtgtcctgctgccag

SEQ ID NO: 7787847 - DNA, 22 bp, Homo sapiens
tggccctgtggcttcagaacag

SEQ ID NO: 7787848 - DNA, 22 bp, Homo sapiens
tggccctgtgtcctgctgccag

SEQ ID NO: 7787849 - DNA, 22 bp, Homo sapiens
tggccctgtgtgcaggctgcac

SEQ ID NO: 7787850 - DNA, 22 bp, Homo sapiens
tggccctgtgtgcaggctgcac

SEQ ID NO: 7787851 - DNA, 23 bp, Homo sapiens
tggccctgtgcatgctgcttccc

SEQ ID NO: 7787852 - DNA, 23 bp, Homo sapiens
tggccctgtgcatgctgcttccc

SEQ ID NO: 7787853 - DNA, 22 bp, Homo sapiens
tggccctgtggcttcagaacag

SEQ ID NO: 7787854 - DNA, 22 bp, Homo sapiens
tggccctgtggaggtcagtgag

SEQ ID NO: 7787855 - DNA, 22 bp, Homo sapiens
tggcctagagaagccaaaagat

SEQ ID NO: 7787856 - DNA, 22 bp, Homo sapiens
tggcctcaaccgtcctaagcac

SEQ ID NO: 7787857 - DNA, 20 bp, Homo sapiens
tggccctgttttctccaggc

SEQ ID NO: 7787858 - DNA, 22 bp, Homo sapiens
tggccctgttctgtacctcata

SEQ ID NO: 7787859 - DNA, 22 bp, Homo sapiens
tggccctgttctgtacctcata

SEQ ID NO: 7787860 - DNA, 20 bp, Homo sapiens
tggccctgttttctccaggc

SEQ ID NO: 7787861 - DNA, 22 bp, Homo sapiens
tggccctgggcagaggcaacat

SEQ ID NO: 7787862 - DNA, 22 bp, Homo sapiens
tggccctgggcagaggcaacat

SEQ ID NO: 7787863 - DNA, 22 bp, Homo sapiens
tggccctggctgagttagattt

SEQ ID NO: 7787864 - DNA, 21 bp, Homo sapiens
tggccctggccacggctgcca

SEQ ID NO: 7787865 - DNA, 21 bp, Homo sapiens
tggccctggccacggctgcca

SEQ ID NO: 7787866 - DNA, 22 bp, Homo sapiens
tggccctgccactcactgctga

SEQ ID NO: 7787867 - DNA, 22 bp, Homo sapiens
tggccctgccactcactgctga

SEQ ID NO: 7787868 - DNA, 22 bp, Homo sapiens
tggccctgccctcttcatcttt

SEQ ID NO: 7787869 - DNA, 22 bp, Homo sapiens
tggccctgccgcactatcctca

SEQ ID NO: 7787870 - DNA, 22 bp, Homo sapiens
tggccctggtggcacagcctgc

SEQ ID NO: 7787871 - DNA, 22 bp, Homo sapiens
tggccctgggtggaatgtccca

SEQ ID NO: 7787872 - DNA, 22 bp, Homo sapiens
tggccctgggcatctttcgtga

SEQ ID NO: 7787873 - DNA, 22 bp, Homo sapiens
tggccctgtgactgagttctag

SEQ ID NO: 7787874 - DNA, 22 bp, Homo sapiens
tggccctgtctgcacacaggat

SEQ ID NO: 7787875 - DNA, 22 bp, Homo sapiens
tggccctgtctgcacacaggat

SEQ ID NO: 7787876 - DNA, 22 bp, Homo sapiens
tggccctgtccctggagcctgg

SEQ ID NO: 7787877 - DNA, 22 bp, Homo sapiens
tggccctgtcctcatttcatct

SEQ ID NO: 7787878 - DNA, 22 bp, Homo sapiens
tggcccagctcagggtgggcgg

SEQ ID NO: 7787879 - DNA, 22 bp, Homo sapiens
tggcccagctcagggtgggcgg

SEQ ID NO: 7787880 - DNA, 22 bp, Homo sapiens
tggcccagctgcagatggtgga

SEQ ID NO: 7787881 - DNA, 22 bp, Homo sapiens
tggcccagccctgctctagggc

SEQ ID NO: 7787882 - DNA, 22 bp, Homo sapiens
tggcccagccctgctctagggc

SEQ ID NO: 7787883 - DNA, 22 bp, Homo sapiens
tggcccaagtctgctagaagag

SEQ ID NO: 7787884 - DNA, 15 bp, Homo sapiens
tggcccacccgttga

SEQ ID NO: 7787885 - DNA, 22 bp, Homo sapiens
tggcccagccctgctctagggc

SEQ ID NO: 7787886 - DNA, 22 bp, Homo sapiens
tggcccagactctgctcttatc

SEQ ID NO: 7787887 - DNA, 22 bp, Homo sapiens
tggccagtggggttgagcagga

SEQ ID NO: 7787888 - DNA, 22 bp, Homo sapiens
tggccagtgtgtgctgccggct

SEQ ID NO: 7787889 - DNA, 22 bp, Homo sapiens
tggccagtgtcggaggccagga

SEQ ID NO: 7787890 - DNA, 22 bp, Homo sapiens
tggccagtgttggctagggaca

SEQ ID NO: 7787891 - DNA, 22 bp, Homo sapiens
tggccagtgtgtgctgccggct

SEQ ID NO: 7787892 - DNA, 22 bp, Homo sapiens
tggccagtctgtggaagccagg

SEQ ID NO: 7787893 - DNA, 22 bp, Homo sapiens
tggccagtcttagctgtgcctg

SEQ ID NO: 7787894 - DNA, 22 bp, Homo sapiens
tggccagtgcctgccagtgcag

SEQ ID NO: 7787895 - DNA, 22 bp, Homo sapiens
tggccagtttgctcaggcagtc

SEQ ID NO: 7787896 - DNA, 22 bp, Homo sapiens
tggccagtttgctcaggcagtc

SEQ ID NO: 7787897 - DNA, 22 bp, Homo sapiens
tggccagttgaagacaatgctc

SEQ ID NO: 7787898 - DNA, 22 bp, Homo sapiens
tggccatgggatagtgcagggg

SEQ ID NO: 7787899 - DNA, 22 bp, Homo sapiens
tggccatgacatggaggctttg

SEQ ID NO: 7787900 - DNA, 22 bp, Homo sapiens
tggccatgaaggaggcagcaga

SEQ ID NO: 7787901 - DNA, 22 bp, Homo sapiens
tggccatgggatagtgcagggg

SEQ ID NO: 7787902 - DNA, 22 bp, Homo sapiens
tggcccaaagcagcccagcagg

SEQ ID NO: 7787903 - DNA, 22 bp, Homo sapiens
tggcccaggcgaggtgggcaga

SEQ ID NO: 7787904 - DNA, 22 bp, Homo sapiens
tggcccaggcgaggtgggcaga

SEQ ID NO: 7787905 - DNA, 22 bp, Homo sapiens
tggcccagggagttcatggtgt

SEQ ID NO: 7787906 - DNA, 22 bp, Homo sapiens
tggcccaggccaaagccctgga

SEQ ID NO: 7787907 - DNA, 22 bp, Homo sapiens
tggcccaggcgaggtgggcaga

SEQ ID NO: 7787908 - DNA, 22 bp, Homo sapiens
tggcccaggaggccagagggca

SEQ ID NO: 7787909 - DNA, 22 bp, Homo sapiens
tggcccaggaggccagagggca

SEQ ID NO: 7787910 - DNA, 22 bp, Homo sapiens
tggcccagctgcagatggtgga

SEQ ID NO: 7787911 - DNA, 22 bp, Homo sapiens
tggcccaggaggccagagggca

SEQ ID NO: 7787912 - DNA, 22 bp, Homo sapiens
tggcccaggtctctctgagccc

SEQ ID NO: 7787913 - DNA, 22 bp, Homo sapiens
tggcccaggtctctctgagccc

SEQ ID NO: 7787914 - DNA, 22 bp, Homo sapiens
tggcccagggtctacagcctca

SEQ ID NO: 7787915 - DNA, 22 bp, Homo sapiens
tggcccagggtctacagcctca

SEQ ID NO: 7787916 - DNA, 22 bp, Homo sapiens
tggcccagggcacagcagggag

SEQ ID NO: 7787917 - DNA, 22 bp, Homo sapiens
tggcccaggggctcttggtgtt

SEQ ID NO: 7787918 - DNA, 22 bp, Homo sapiens
tggcccagggcacagcagggag

SEQ ID NO: 7787919 - DNA, 22 bp, Homo sapiens
tggcccaggggctcttggtgtt

SEQ ID NO: 7787920 - DNA, 22 bp, Homo sapiens
tggccctgacaggtcctgggca

SEQ ID NO: 7787921 - DNA, 22 bp, Homo sapiens
tggccctgacacgtggtactgg

SEQ ID NO: 7787922 - DNA, 22 bp, Homo sapiens
tggccctgacttggaggcctga

SEQ ID NO: 7787923 - DNA, 22 bp, Homo sapiens
tggccctgaggacccagtgtgg

SEQ ID NO: 7787924 - DNA, 22 bp, Homo sapiens
tggccctgactgatgtggaggg

SEQ ID NO: 7787925 - DNA, 22 bp, Homo sapiens
tggccctgcacccagagcagtt

SEQ ID NO: 7787926 - DNA, 22 bp, Homo sapiens
tggccctgcacccagagcagtt

SEQ ID NO: 7787927 - DNA, 22 bp, Homo sapiens
tggccctgcagaactagcctgg

SEQ ID NO: 7787928 - DNA, 22 bp, Homo sapiens
tggccctgcagaactagcctgg

SEQ ID NO: 7787929 - DNA, 22 bp, Homo sapiens
tggccctgagggctcggagcca

SEQ ID NO: 7787930 - DNA, 22 bp, Homo sapiens
tggccctgaggacccagtgtgg

SEQ ID NO: 7787931 - DNA, 22 bp, Homo sapiens
tggccctgaggggctgtgcccc

SEQ ID NO: 7787932 - DNA, 22 bp, Homo sapiens
tggccctgaggggctgtgcccc

SEQ ID NO: 7787933 - DNA, 17 bp, Homo sapiens
tggccctagactccagc

SEQ ID NO: 7787934 - DNA, 22 bp, Homo sapiens
tggccctatttggaaatagagc

SEQ ID NO: 7787935 - DNA, 23 bp, Homo sapiens
tggccctgaatctgtcctggagg

SEQ ID NO: 7787936 - DNA, 22 bp, Homo sapiens
tggccctgaatcaaggccagca

SEQ ID NO: 7787937 - DNA, 22 bp, Homo sapiens
tggccctgaaggccttgagcat

SEQ ID NO: 7787938 - DNA, 22 bp, Homo sapiens
tggcccagtcagcaggagaggg

SEQ ID NO: 7787939 - DNA, 22 bp, Homo sapiens
tggcccgccggaagaagatgtc

SEQ ID NO: 7787940 - DNA, 22 bp, Homo sapiens
tggcccagtcagcaggagaggg

SEQ ID NO: 7787941 - DNA, 22 bp, Homo sapiens
tggcccagtatgtataatctta

SEQ ID NO: 7787942 - DNA, 22 bp, Homo sapiens
tggcccaggtgcaagagacaga

SEQ ID NO: 7787943 - DNA, 22 bp, Homo sapiens
tggcccaggtgcaagagacaga

SEQ ID NO: 7787944 - DNA, 22 bp, Homo sapiens
tggcccaggtgcacccagaggc

SEQ ID NO: 7787945 - DNA, 22 bp, Homo sapiens
tggcccagtagaaaagggatcg

SEQ ID NO: 7787946 - DNA, 22 bp, Homo sapiens
tggcccaggtgcacccagaggc

SEQ ID NO: 7787947 - DNA, 22 bp, Homo sapiens
tggcagtggcatcaccccaata

SEQ ID NO: 7787948 - DNA, 22 bp, Homo sapiens
tggcagtggcatcaccccaata

SEQ ID NO: 7787949 - DNA, 22 bp, Homo sapiens
tggcatctccgacagtcttgat

SEQ ID NO: 7787950 - DNA, 22 bp, Homo sapiens
tggcatgaagtcagcagctggg

SEQ ID NO: 7787951 - DNA, 22 bp, Homo sapiens
tggcatgataggaggtgcagaa

SEQ ID NO: 7787952 - DNA, 22 bp, Homo sapiens
tggcatggactagtgctgaggt

SEQ ID NO: 7787953 - DNA, 22 bp, Homo sapiens
tggcaggtttcgttaaaaatgg

SEQ ID NO: 7787954 - DNA, 22 bp, Homo sapiens
tggcagtcccctgtgcctggaa

SEQ ID NO: 7787955 - DNA, 22 bp, Homo sapiens
tggcagtgatgcggcaggacat

SEQ ID NO: 7787956 - DNA, 22 bp, Homo sapiens
tggcagtgaaccaaggctccaa

SEQ ID NO: 7787957 - DNA, 22 bp, Homo sapiens
tggcagggtggcaacttttggt

SEQ ID NO: 7787958 - DNA, 22 bp, Homo sapiens
tggcagggtgccagttgcgagt

SEQ ID NO: 7787959 - DNA, 22 bp, Homo sapiens
tggcagggtgccagttgcgagt

SEQ ID NO: 7787960 - DNA, 22 bp, Homo sapiens
tggcagggtcttgctgtgttgc

SEQ ID NO: 7787961 - DNA, 22 bp, Homo sapiens
tggcagggtcttgctgtgttgc

SEQ ID NO: 7787962 - DNA, 22 bp, Homo sapiens
tggcagggtcttgctgtgttgc

SEQ ID NO: 7787963 - DNA, 22 bp, Homo sapiens
tggcaggtgcctgtaatctcag

SEQ ID NO: 7787964 - DNA, 18 bp, Homo sapiens
tggcaggtccagctgtgg

SEQ ID NO: 7787965 - DNA, 22 bp, Homo sapiens
tggccacactgcccccactggg

SEQ ID NO: 7787966 - DNA, 23 bp, Homo sapiens
tggccacagtccatgcatgccca

SEQ ID NO: 7787967 - DNA, 22 bp, Homo sapiens
tggccacatgcgtctgtgaggc

SEQ ID NO: 7787968 - DNA, 22 bp, Homo sapiens
tggccacccctttctctgcact

SEQ ID NO: 7787969 - DNA, 22 bp, Homo sapiens
tggccacccagctgacgccttc

SEQ ID NO: 7787970 - DNA, 22 bp, Homo sapiens
tggccactcctccctgcaggct

SEQ ID NO: 7787971 - DNA, 22 bp, Homo sapiens
tggccactcagggatgcaggaa

SEQ ID NO: 7787972 - DNA, 21 bp, Homo sapiens
tggccagctggagtctccaca

SEQ ID NO: 7787973 - DNA, 22 bp, Homo sapiens
tggccagcacttagcccttacc

SEQ ID NO: 7787974 - DNA, 22 bp, Homo sapiens
tggccagccctcttcccacact

SEQ ID NO: 7787975 - DNA, 22 bp, Homo sapiens
tggccaggctggtctggaacgc

SEQ ID NO: 7787976 - DNA, 22 bp, Homo sapiens
tggccaggcctcttggtgccca

SEQ ID NO: 7787977 - DNA, 22 bp, Homo sapiens
tggccaggctggtctggaacgc

SEQ ID NO: 7787978 - DNA, 19 bp, Homo sapiens
tggccaggtactgtctgct

SEQ ID NO: 7787979 - DNA, 22 bp, Homo sapiens
tggccagtagataggcaggcaa

SEQ ID NO: 7787980 - DNA, 22 bp, Homo sapiens
tggccagtaatagcttctggtg

SEQ ID NO: 7787981 - DNA, 22 bp, Homo sapiens
tggccagtaatagcttctggtg

SEQ ID NO: 7787982 - DNA, 19 bp, Homo sapiens
tggccaggtactgtctgct

SEQ ID NO: 7787983 - DNA, 22 bp, Homo sapiens
tgaaatatccagcccagcagga

SEQ ID NO: 7787984 - DNA, 22 bp, Homo sapiens
tgaaatagtctaaaaaaccaga

SEQ ID NO: 7787985 - DNA, 22 bp, Homo sapiens
tgaaataggaaacagatgtttc

SEQ ID NO: 7787986 - DNA, 22 bp, Homo sapiens
tgaaatcataacagtttggctt

SEQ ID NO: 7787987 - DNA, 22 bp, Homo sapiens
tgaaatcagtatgtctttctca

SEQ ID NO: 7787988 - DNA, 22 bp, Homo sapiens
tgaaatcaataattggtgattg

SEQ ID NO: 7787989 - DNA, 22 bp, Homo sapiens
tgaaatatttagagagtaagtt

SEQ ID NO: 7787990 - DNA, 22 bp, Homo sapiens
tgaaagagtttgacatgattct

SEQ ID NO: 7787991 - DNA, 22 bp, Homo sapiens
tgaaagatgctcaatgaatggt

SEQ ID NO: 7787992 - DNA, 22 bp, Homo sapiens
tgaaagcactcacttctgctct

SEQ ID NO: 7787993 - DNA, 22 bp, Homo sapiens
tgaaatgttgccatgaggtctc

SEQ ID NO: 7787994 - DNA, 22 bp, Homo sapiens
tgaaatgtttatctctcctgct

SEQ ID NO: 7787995 - DNA, 22 bp, Homo sapiens
tgaaatgtttgggtccagaagt

SEQ ID NO: 7787996 - DNA, 22 bp, Homo sapiens
tgaaatcattgccaagtattga

SEQ ID NO: 7787997 - DNA, 22 bp, Homo sapiens
tgaaatcatgagatagtgtcac

SEQ ID NO: 7787998 - DNA, 22 bp, Homo sapiens
tgaacatgctgttgatggcctg

SEQ ID NO: 7787999 - DNA, 22 bp, Homo sapiens
tgaaccaggcacatttcctaca

SEQ ID NO: 7788000 - DNA, 22 bp, Homo sapiens
tgaacattgtcacattcctagc

SEQ ID NO: 7788001 - DNA, 22 bp, Homo sapiens
tgaactttgtagtaatggagat

SEQ ID NO: 7788002 - DNA, 18 bp, Homo sapiens
tgaactttggtgtctctc

SEQ ID NO: 7788003 - DNA, 22 bp, Homo sapiens
tgaactttcacaagaatatgct

SEQ ID NO: 7788004 - DNA, 22 bp, Homo sapiens
tgaacttgaattttggaaatac

SEQ ID NO: 7788005 - DNA, 22 bp, Homo sapiens
tgaacttcagtgcataattatc

SEQ ID NO: 7788006 - DNA, 22 bp, Homo sapiens
tgaactcctgacctcatgatcc

SEQ ID NO: 7788007 - DNA, 22 bp, Homo sapiens
tgaactgagcagtttcctggga

SEQ ID NO: 7788008 - DNA, 18 bp, Homo sapiens
tgaaattgcatccatgag

SEQ ID NO: 7788009 - DNA, 22 bp, Homo sapiens
tgaacaactgcaaaaatctcca

SEQ ID NO: 7788010 - DNA, 22 bp, Homo sapiens
tgaacaaatgaatcagtgtagc

SEQ ID NO: 7788011 - DNA, 22 bp, Homo sapiens
tgaacacacacctatgtacaaa

SEQ ID NO: 7788012 - DNA, 18 bp, Homo sapiens
tgaacttttcctgctgct

SEQ ID NO: 7788013 - DNA, 22 bp, Homo sapiens
tgaacttttatttgatgacagg

SEQ ID NO: 7788014 - DNA, 22 bp, Homo sapiens
tgaagaaacgcagagaggtagg

SEQ ID NO: 7788015 - DNA, 22 bp, Homo sapiens
tgaagaacgtgagatccagaaa

SEQ ID NO: 7788016 - DNA, 22 bp, Homo sapiens
tgaagcagttactgggtgttaa

SEQ ID NO: 7788017 - DNA, 19 bp, Homo sapiens
tgaagcaggcagagaagat

SEQ ID NO: 7788018 - DNA, 22 bp, Homo sapiens
tgaaaaaacaagttggcccatt

SEQ ID NO: 7788019 - DNA, 22 bp, Homo sapiens
tgaaaaacactaattggaaagc

SEQ ID NO: 7788020 - DNA, 22 bp, Homo sapiens
tctttttatattgacaaaaggt

SEQ ID NO: 7788021 - DNA, 22 bp, Homo sapiens
tctttttttcctgtgcagagct

SEQ ID NO: 7788022 - DNA, 22 bp, Homo sapiens
tctttttatattgacaaaaggt

SEQ ID NO: 7788023 - DNA, 22 bp, Homo sapiens
tctttttatattgacaaaaggt

SEQ ID NO: 7788024 - DNA, 22 bp, Homo sapiens
tcttttgttgcctacttattaa

SEQ ID NO: 7788025 - DNA, 22 bp, Homo sapiens
tcttttgttgcctacttattaa

SEQ ID NO: 7788026 - DNA, 22 bp, Homo sapiens
tgaaaatatagttttccagact

SEQ ID NO: 7788027 - DNA, 22 bp, Homo sapiens
tgaaaagtgatcatggattagg

SEQ ID NO: 7788028 - DNA, 22 bp, Homo sapiens
tgaaaagtcttatattgtctga

SEQ ID NO: 7788029 - DNA, 22 bp, Homo sapiens
tgaaaattgttgtacttgataa

SEQ ID NO: 7788030 - DNA, 22 bp, Homo sapiens
tgaaaatttccatcagttatat

SEQ ID NO: 7788031 - DNA, 22 bp, Homo sapiens
tgaaaatttccatcagttatat

SEQ ID NO: 7788032 - DNA, 22 bp, Homo sapiens
tgaaaattcatctcatagcaga

SEQ ID NO: 7788033 - DNA, 22 bp, Homo sapiens
tgaaaattaagcagatgaatga

SEQ ID NO: 7788034 - DNA, 17 bp, Homo sapiens
tgaaagaatcagggaga

SEQ ID NO: 7788035 - DNA, 22 bp, Homo sapiens
tgaaactaggccaatcaaatta

SEQ ID NO: 7788036 - DNA, 21 bp, Homo sapiens
tgaaactacctacaagctacc

SEQ ID NO: 7788037 - DNA, 22 bp, Homo sapiens
tgaaacatttgatgatctttgg

SEQ ID NO: 7788038 - DNA, 23 bp, Homo sapiens
tgaaacatttagggtagaatttc

SEQ ID NO: 7788039 - DNA, 22 bp, Homo sapiens
tgaaacattgcactgtatgaat

SEQ ID NO: 7788040 - DNA, 22 bp, Homo sapiens
tgaaacattatagaatatttat

SEQ ID NO: 7788041 - DNA, 22 bp, Homo sapiens
tgaaacattatagaatatttat

SEQ ID NO: 7788042 - DNA, 22 bp, Homo sapiens
tgaaacattaggaaatcattat

SEQ ID NO: 7788043 - DNA, 22 bp, Homo sapiens
tgaaacataaagttatcttcag

SEQ ID NO: 7788044 - DNA, 22 bp, Homo sapiens
tgaaacagtctccagacttgga

SEQ ID NO: 7788045 - DNA, 20 bp, Homo sapiens
tctttgtgtcagatggacag

SEQ ID NO: 7788046 - DNA, 22 bp, Homo sapiens
tctttgtgttcaggagccacgt

SEQ ID NO: 7788047 - DNA, 22 bp, Homo sapiens
tctttgtttgcctttatcaaga

SEQ ID NO: 7788048 - DNA, 22 bp, Homo sapiens
tctttgtttgtactgttagaat

SEQ ID NO: 7788049 - DNA, 22 bp, Homo sapiens
tcttttaagcctctggcatagg

SEQ ID NO: 7788050 - DNA, 21 bp, Homo sapiens
tcttttaacaccaggaattcc

SEQ ID NO: 7788051 - DNA, 22 bp, Homo sapiens
tcttttagagcatttctgattc

SEQ ID NO: 7788052 - DNA, 22 bp, Homo sapiens
tcttttagtaataaatatttgt

SEQ ID NO: 7788053 - DNA, 21 bp, Homo sapiens
tcttttctctgcaggattcct

SEQ ID NO: 7788054 - DNA, 18 bp, Homo sapiens
tcttttccttccacttcc

SEQ ID NO: 7788055 - DNA, 22 bp, Homo sapiens
tcttttcattgagaacacactg

SEQ ID NO: 7788056 - DNA, 22 bp, Homo sapiens
tcttttccttccctacagatct

SEQ ID NO: 7788057 - DNA, 22 bp, Homo sapiens
tcttttcacagacaaatggaga

SEQ ID NO: 7788058 - DNA, 19 bp, Homo sapiens
tcttttcacgcattttgaa

SEQ ID NO: 7788059 - DNA, 23 bp, Homo sapiens
tcttttcaatggttctttatgtg

SEQ ID NO: 7788060 - DNA, 23 bp, Homo sapiens
tcttttcaatggttctttatgtg

SEQ ID NO: 7788061 - DNA, 22 bp, Homo sapiens
tctttgtactttctggctgtcc

SEQ ID NO: 7788062 - DNA, 22 bp, Homo sapiens
tctttgtaagttatatgtagta

SEQ ID NO: 7788063 - DNA, 22 bp, Homo sapiens
tctttggcatttaggagcagga

SEQ ID NO: 7788064 - DNA, 22 bp, Homo sapiens
tctttggcatttaggagcagga

SEQ ID NO: 7788065 - DNA, 22 bp, Homo sapiens
tctttggcatcagggccagcta

SEQ ID NO: 7788066 - DNA, 22 bp, Homo sapiens
tctttggcatcagggccagcta

SEQ ID NO: 7788067 - DNA, 22 bp, Homo sapiens
tctttggatcccaactggctgg

SEQ ID NO: 7788068 - DNA, 22 bp, Homo sapiens
tctttggatgcgttacttttac

SEQ ID NO: 7788069 - DNA, 22 bp, Homo sapiens
tctttggatctcaaggtggcag

SEQ ID NO: 7788070 - DNA, 22 bp, Homo sapiens
tctttggaatgctagcattcta

SEQ ID NO: 7788071 - DNA, 22 bp, Homo sapiens
tctttggaagctttcagagaag

SEQ ID NO: 7788072 - DNA, 22 bp, Homo sapiens
tctttgcattcctgtgtgcttt

SEQ ID NO: 7788073 - DNA, 22 bp, Homo sapiens
tctttgattttgttactaagac

SEQ ID NO: 7788074 - DNA, 22 bp, Homo sapiens
tctttgcagaacgatgaagatg

SEQ ID NO: 7788075 - DNA, 22 bp, Homo sapiens
tgactgaggcagcctgagttat

SEQ ID NO: 7788076 - DNA, 22 bp, Homo sapiens
tgacttctagcatttagcaacc

SEQ ID NO: 7788077 - DNA, 22 bp, Homo sapiens
tgacttcctgcactcaggtgat

SEQ ID NO: 7788078 - DNA, 22 bp, Homo sapiens
tgacttccagcaacttcctcca

SEQ ID NO: 7788079 - DNA, 22 bp, Homo sapiens
tgactcttaaatatactgttga

SEQ ID NO: 7788080 - DNA, 22 bp, Homo sapiens
tgactcctggtatggatgacag

SEQ ID NO: 7788081 - DNA, 22 bp, Homo sapiens
tgacggtatttagggagcagcg

SEQ ID NO: 7788082 - DNA, 22 bp, Homo sapiens
tgacatttttataagagtcaaa

SEQ ID NO: 7788083 - DNA, 18 bp, Homo sapiens
tgacatttccagagtgta

SEQ ID NO: 7788084 - DNA, 22 bp, Homo sapiens
tgacatttatcaaagaaatggt

SEQ ID NO: 7788085 - DNA, 21 bp, Homo sapiens
tgacatttagtagcattgtca

SEQ ID NO: 7788086 - DNA, 22 bp, Homo sapiens
tgacaggaggcttgaggccagg

SEQ ID NO: 7788087 - DNA, 22 bp, Homo sapiens
tgacaggagggttgtggcaggg

SEQ ID NO: 7788088 - DNA, 22 bp, Homo sapiens
tgacaggagtggctagtgggag

SEQ ID NO: 7788089 - DNA, 22 bp, Homo sapiens
tgacaggatagtaggaagatct

SEQ ID NO: 7788090 - DNA, 22 bp, Homo sapiens
tgacaggattggttgcttctga

SEQ ID NO: 7788091 - DNA, 22 bp, Homo sapiens
tgacaggatgatgagcaggggg

SEQ ID NO: 7788092 - DNA, 22 bp, Homo sapiens
tgacagggacagtggagatgga

SEQ ID NO: 7788093 - DNA, 22 bp, Homo sapiens
tgacaggaaacatgcagtgatt

SEQ ID NO: 7788094 - DNA, 22 bp, Homo sapiens
tgacaggacagagaaatgacct

SEQ ID NO: 7788095 - DNA, 22 bp, Homo sapiens
tgacagcctcactttgttaatt

SEQ ID NO: 7788096 - DNA, 22 bp, Homo sapiens
tgacagcccacctcacaggatt

SEQ ID NO: 7788097 - DNA, 22 bp, Homo sapiens
tgacagccatgatccttactgt

SEQ ID NO: 7788098 - DNA, 22 bp, Homo sapiens
tgacagcataacactggtcttg

SEQ ID NO: 7788099 - DNA, 21 bp, Homo sapiens
tgacagcatagagcagggagg

SEQ ID NO: 7788100 - DNA, 18 bp, Homo sapiens
tgacagaacctggagcct

SEQ ID NO: 7788101 - DNA, 22 bp, Homo sapiens
tgacagaaatagttcttaattt

SEQ ID NO: 7788102 - DNA, 22 bp, Homo sapiens
tgaaggcacgtgggtggatact

SEQ ID NO: 7788103 - DNA, 22 bp, Homo sapiens
tgaagccacactagcttgtcct

SEQ ID NO: 7788104 - DNA, 21 bp, Homo sapiens
tgaagcctgaggcatagcccc

SEQ ID NO: 7788105 - DNA, 22 bp, Homo sapiens
tgaaggcttggtggcagcctct

SEQ ID NO: 7788106 - DNA, 22 bp, Homo sapiens
tgaaggctttttaaagcatttg

SEQ ID NO: 7788107 - DNA, 22 bp, Homo sapiens
tgaaggctgggctcagccagct

SEQ ID NO: 7788108 - DNA, 23 bp, Homo sapiens
tgaaggccctggagccacgaggc

SEQ ID NO: 7788109 - DNA, 22 bp, Homo sapiens
tgaaggcctaacttccagtgct

SEQ ID NO: 7788110 - DNA, 22 bp, Homo sapiens
tgaaggcccagccacagaatgg

SEQ ID NO: 7788111 - DNA, 22 bp, Homo sapiens
tgaaggccagcagagtgaaggc

SEQ ID NO: 7788112 - DNA, 22 bp, Homo sapiens
tgaaggccagggatttgcagcc

SEQ ID NO: 7788113 - DNA, 22 bp, Homo sapiens
tgaagtttcttgaatcttggag

SEQ ID NO: 7788114 - DNA, 22 bp, Homo sapiens
tgaagttttctggttgattaag

SEQ ID NO: 7788115 - DNA, 22 bp, Homo sapiens
tgaataaattgagagcgaatgt

SEQ ID NO: 7788116 - DNA, 22 bp, Homo sapiens
tgaataaattgagagcgaatgt

SEQ ID NO: 7788117 - DNA, 22 bp, Homo sapiens
tgacaaaccagtagcaataaag

SEQ ID NO: 7788118 - DNA, 22 bp, Homo sapiens
tgacaaaactgcaattactttt

SEQ ID NO: 7788119 - DNA, 22 bp, Homo sapiens
tgacaaaactgcaattactttt

SEQ ID NO: 7788120 - DNA, 22 bp, Homo sapiens
tgacaaagaggaacagcagggg

SEQ ID NO: 7788121 - DNA, 22 bp, Homo sapiens
tgacaattgttgtgaattcttc

SEQ ID NO: 7788122 - DNA, 22 bp, Homo sapiens
tgacaattgtgggcagtttgtg

SEQ ID NO: 7788123 - DNA, 22 bp, Homo sapiens
tgacaaattcatatttcagagg

SEQ ID NO: 7788124 - DNA, 22 bp, Homo sapiens
tgacaaatgttaattcagtgga

SEQ ID NO: 7788125 - DNA, 22 bp, Homo sapiens
tgaattcttttagaattcagtg

SEQ ID NO: 7788126 - DNA, 21 bp, Homo sapiens
tgaatttccctctatcattct

SEQ ID NO: 7788127 - DNA, 22 bp, Homo sapiens
tgaatggatataacaacagtgt

SEQ ID NO: 7788128 - DNA, 22 bp, Homo sapiens
tgaatgagaacactgaaagagg

SEQ ID NO: 7788129 - DNA, 23 bp, Homo sapiens
tgaatgtttattctcggtgcaga

SEQ ID NO: 7788130 - DNA, 22 bp, Homo sapiens
tgaatgtttgatgagaaataga

SEQ ID NO: 7788131 - DNA, 21 bp, Homo sapiens
tgaatagggccagaaccaaag

SEQ ID NO: 7788132 - DNA, 22 bp, Homo sapiens
tgaatactatttcataatgtgg

SEQ ID NO: 7788133 - DNA, 22 bp, Homo sapiens
tgagtaacacagtatgcttaca

SEQ ID NO: 7788134 - DNA, 22 bp, Homo sapiens
tgagtattttaagttctcaatc

SEQ ID NO: 7788135 - DNA, 22 bp, Homo sapiens
tgaggtgtgtccccagggaggt

SEQ ID NO: 7788136 - DNA, 22 bp, Homo sapiens
tgaggtggttactgtggtgctc

SEQ ID NO: 7788137 - DNA, 22 bp, Homo sapiens
tgaggggcggcctgcagaggcc

SEQ ID NO: 7788138 - DNA, 22 bp, Homo sapiens
tgaggtctgcagggctgtgcat

SEQ ID NO: 7788139 - DNA, 22 bp, Homo sapiens
tgagggagagggcgaaaatgaa

SEQ ID NO: 7788140 - DNA, 22 bp, Homo sapiens
tgagggagcacacactgaagtg

SEQ ID NO: 7788141 - DNA, 22 bp, Homo sapiens
tgaggcttgtctcagatggggg

SEQ ID NO: 7788142 - DNA, 22 bp, Homo sapiens
tgaggcttggcaaaagagtggt

SEQ ID NO: 7788143 - DNA, 22 bp, Homo sapiens
tgaggctttatgtaagggtgca

SEQ ID NO: 7788144 - DNA, 22 bp, Homo sapiens
tgagggaggcctccatctgcca

SEQ ID NO: 7788145 - DNA, 20 bp, Homo sapiens
tgagggagtattgatttccc

SEQ ID NO: 7788146 - DNA, 22 bp, Homo sapiens
tgagggaggccctttgagcaga

SEQ ID NO: 7788147 - DNA, 22 bp, Homo sapiens
tgagggaggccctttgagcaga

SEQ ID NO: 7788148 - DNA, 22 bp, Homo sapiens
tgagggagcacacactgaagtg

SEQ ID NO: 7788149 - DNA, 22 bp, Homo sapiens
tgagggagctgacctttctgtg

SEQ ID NO: 7788150 - DNA, 22 bp, Homo sapiens
tgaggggagacagagtggactc

SEQ ID NO: 7788151 - DNA, 22 bp, Homo sapiens
tgagggagtgtggatacagtag

SEQ ID NO: 7788152 - DNA, 22 bp, Homo sapiens
tgagggagtgtggatacagtag

SEQ ID NO: 7788153 - DNA, 19 bp, Homo sapiens
tgaggggaggagaggcctg

SEQ ID NO: 7788154 - DNA, 22 bp, Homo sapiens
tgaggggatacggtacacattg

SEQ ID NO: 7788155 - DNA, 22 bp, Homo sapiens
tgaggggaggttggggcacatc

SEQ ID NO: 7788156 - DNA, 22 bp, Homo sapiens
tgaggcttccaacatgtgagaa

SEQ ID NO: 7788157 - DNA, 21 bp, Homo sapiens
tgaggctgttgtaccagggag

SEQ ID NO: 7788158 - DNA, 21 bp, Homo sapiens
tgaggctgttgtaccagggag

SEQ ID NO: 7788159 - DNA, 22 bp, Homo sapiens
tgaggcttagagaagatgggat

SEQ ID NO: 7788160 - DNA, 22 bp, Homo sapiens
tgaggctgttctaccagggcca

SEQ ID NO: 7788161 - DNA, 22 bp, Homo sapiens
tgaggctggcaaggctggtatt

SEQ ID NO: 7788162 - DNA, 22 bp, Homo sapiens
tgaggctgccttgggaagaggg

SEQ ID NO: 7788163 - DNA, 22 bp, Homo sapiens
tgaggctctgcttctgtggctc

SEQ ID NO: 7788164 - DNA, 21 bp, Homo sapiens
tgaggctctgttgtgcctgca

SEQ ID NO: 7788165 - DNA, 22 bp, Homo sapiens
tgaggctcagagaagtgctgtt

SEQ ID NO: 7788166 - DNA, 22 bp, Homo sapiens
tgaggaagtggttgtatggttt

SEQ ID NO: 7788167 - DNA, 22 bp, Homo sapiens
tgaggaagttgatctcatcagt

SEQ ID NO: 7788168 - DNA, 22 bp, Homo sapiens
tgaggaagttgtttctcttcta

SEQ ID NO: 7788169 - DNA, 22 bp, Homo sapiens
tgaggaagttgatctcatcagt

SEQ ID NO: 7788170 - DNA, 22 bp, Homo sapiens
tgaggaagcaaaggcttgtgtg

SEQ ID NO: 7788171 - DNA, 22 bp, Homo sapiens
tgaggaagcaaaggcttgtgtg

SEQ ID NO: 7788172 - DNA, 22 bp, Homo sapiens
tgaggaagccaaacagctacac

SEQ ID NO: 7788173 - DNA, 22 bp, Homo sapiens
tgaggaagccaaacagctacac

SEQ ID NO: 7788174 - DNA, 22 bp, Homo sapiens
tgaggaaggaattgaggtttta

SEQ ID NO: 7788175 - DNA, 19 bp, Homo sapiens
tgaggagcagctggttgat

SEQ ID NO: 7788176 - DNA, 22 bp, Homo sapiens
tgaggagccactctagcagtca

SEQ ID NO: 7788177 - DNA, 22 bp, Homo sapiens
tgaggaggcccaggttggggct

SEQ ID NO: 7788178 - DNA, 22 bp, Homo sapiens
tgaggaggtcagagtctggctg

SEQ ID NO: 7788179 - DNA, 22 bp, Homo sapiens
tgaggcaggacatggacaactg

SEQ ID NO: 7788180 - DNA, 22 bp, Homo sapiens
tgaggccaggatcccaggctct

SEQ ID NO: 7788181 - DNA, 22 bp, Homo sapiens
tgaggccaatgaccctgggcag

SEQ ID NO: 7788182 - DNA, 22 bp, Homo sapiens
tgaggccacaggaaagggcccg

SEQ ID NO: 7788183 - DNA, 22 bp, Homo sapiens
tgaggccacttccccacagccc

SEQ ID NO: 7788184 - DNA, 22 bp, Homo sapiens
tgaggccacaggaaagggcccg

SEQ ID NO: 7788185 - DNA, 22 bp, Homo sapiens
tgaggccacttccccacagccc

SEQ ID NO: 7788186 - DNA, 22 bp, Homo sapiens
tgaggccagccacagccaccct

SEQ ID NO: 7788187 - DNA, 22 bp, Homo sapiens
tgaggccagccacagccaccct

SEQ ID NO: 7788188 - DNA, 19 bp, Homo sapiens
tgaggccagctggcatttt

SEQ ID NO: 7788189 - DNA, 22 bp, Homo sapiens
tgaggccaggacccccagcagg

SEQ ID NO: 7788190 - DNA, 22 bp, Homo sapiens
tgaggccaggacccccagcagg

SEQ ID NO: 7788191 - DNA, 19 bp, Homo sapiens
tgaggccaaggtcacagat

SEQ ID NO: 7788192 - DNA, 22 bp, Homo sapiens
tgagctcatagctcttattatg

SEQ ID NO: 7788193 - DNA, 22 bp, Homo sapiens
tgagctgagtggcaggtctcag

SEQ ID NO: 7788194 - DNA, 22 bp, Homo sapiens
tgagctgagaacacttgggcta

SEQ ID NO: 7788195 - DNA, 19 bp, Homo sapiens
tgagctgccgtcttccctg

SEQ ID NO: 7788196 - DNA, 19 bp, Homo sapiens
tgagctgctgctgcccatc

SEQ ID NO: 7788197 - DNA, 22 bp, Homo sapiens
tgagctgcaagaaaatttcagt

SEQ ID NO: 7788198 - DNA, 22 bp, Homo sapiens
tgagctggaggacaggagggta

SEQ ID NO: 7788199 - DNA, 22 bp, Homo sapiens
tgagctggtcactccttctgaa

SEQ ID NO: 7788200 - DNA, 22 bp, Homo sapiens
tgagctggttcttgaggcatga

SEQ ID NO: 7788201 - DNA, 22 bp, Homo sapiens
tgagcttccctcctgcactaca

SEQ ID NO: 7788202 - DNA, 22 bp, Homo sapiens
tgagcttttaatatacaggtgt

SEQ ID NO: 7788203 - DNA, 22 bp, Homo sapiens
tgagccgtggtctctgagggtg

SEQ ID NO: 7788204 - DNA, 22 bp, Homo sapiens
tgagccgtggtctctgagggtg

SEQ ID NO: 7788205 - DNA, 22 bp, Homo sapiens
tgagcccatgtagcacttccat

SEQ ID NO: 7788206 - DNA, 22 bp, Homo sapiens
tgagccaggtctcactcacctt

SEQ ID NO: 7788207 - DNA, 22 bp, Homo sapiens
tgagccaggttaagacaggagc

SEQ ID NO: 7788208 - DNA, 22 bp, Homo sapiens
tgagccaggttttccatcattc

SEQ ID NO: 7788209 - DNA, 22 bp, Homo sapiens
tgagccagtctgtctgggtgaa

SEQ ID NO: 7788210 - DNA, 22 bp, Homo sapiens
tgagccagtggaagatggcagt

SEQ ID NO: 7788211 - DNA, 22 bp, Homo sapiens
tgagccagtggaagatggcagt

SEQ ID NO: 7788212 - DNA, 22 bp, Homo sapiens
tgagcctgctgtcgctggaccc

SEQ ID NO: 7788213 - DNA, 22 bp, Homo sapiens
tgagcctggcggaagcagcgtg

SEQ ID NO: 7788214 - DNA, 22 bp, Homo sapiens
tgagcctgcaataagcacagcc

SEQ ID NO: 7788215 - DNA, 22 bp, Homo sapiens
tgagcctgggagatggaggctg

SEQ ID NO: 7788216 - DNA, 22 bp, Homo sapiens
tgagctagggctggtgaggagc

SEQ ID NO: 7788217 - DNA, 22 bp, Homo sapiens
tgagctaggtcctgtgtcagct

SEQ ID NO: 7788218 - DNA, 22 bp, Homo sapiens
tgagcagatggaggcttctgca

SEQ ID NO: 7788219 - DNA, 22 bp, Homo sapiens
tgagcagaggccagcacctggg

SEQ ID NO: 7788220 - DNA, 22 bp, Homo sapiens
tgagcagaggagtgacgtaggt

SEQ ID NO: 7788221 - DNA, 23 bp, Homo sapiens
tgagcaagtgaccaactgtctgt

SEQ ID NO: 7788222 - DNA, 22 bp, Homo sapiens
tgagcagcaggatcttctggta

SEQ ID NO: 7788223 - DNA, 23 bp, Homo sapiens
tgagcagctaaaggtgatgcggg

SEQ ID NO: 7788224 - DNA, 22 bp, Homo sapiens
tgagcaggactcactgcagcct

SEQ ID NO: 7788225 - DNA, 19 bp, Homo sapiens
tgagcatgcgagctgagaa

SEQ ID NO: 7788226 - DNA, 22 bp, Homo sapiens
tgagcatggtgggtgcagagca

SEQ ID NO: 7788227 - DNA, 22 bp, Homo sapiens
tgagcagttcgacttcttcccc

SEQ ID NO: 7788228 - DNA, 22 bp, Homo sapiens
tgagcagtggcaccaggtcacc

SEQ ID NO: 7788229 - DNA, 22 bp, Homo sapiens
tgagcagggagctgggctgagc

SEQ ID NO: 7788230 - DNA, 22 bp, Homo sapiens
tgagccaaggcctcaagaattt

SEQ ID NO: 7788231 - DNA, 22 bp, Homo sapiens
tgagcattggatcaaatgactt

SEQ ID NO: 7788232 - DNA, 22 bp, Homo sapiens
tgagccagataagggctcacgc

SEQ ID NO: 7788233 - DNA, 22 bp, Homo sapiens
tgagccaggctccatgccacct

SEQ ID NO: 7788234 - DNA, 22 bp, Homo sapiens
tgagccaggctcaagtgatcct

SEQ ID NO: 7788235 - DNA, 21 bp, Homo sapiens
tgagccaggctgacggctgtg

SEQ ID NO: 7788236 - DNA, 22 bp, Homo sapiens
tgagccaggcactgctcctgga

SEQ ID NO: 7788237 - DNA, 22 bp, Homo sapiens
tgagccaggagtttgaggctgt

SEQ ID NO: 7788238 - DNA, 22 bp, Homo sapiens
tgagccagccttgcagctgtgc

SEQ ID NO: 7788239 - DNA, 22 bp, Homo sapiens
tgagccagcaggcctccagtgg

SEQ ID NO: 7788240 - DNA, 18 bp, Homo sapiens
tgagaaccatgttcattc

SEQ ID NO: 7788241 - DNA, 22 bp, Homo sapiens
tgagaacggatactaagggctg

SEQ ID NO: 7788242 - DNA, 22 bp, Homo sapiens
tgagaacctcgaagattttgcc

SEQ ID NO: 7788243 - DNA, 22 bp, Homo sapiens
tgagaaccatgaaaagctgtca

SEQ ID NO: 7788244 - DNA, 22 bp, Homo sapiens
tgagaaccacgactgtgcttaa

SEQ ID NO: 7788245 - DNA, 22 bp, Homo sapiens
tgagaaccatgaaaagctgtca

SEQ ID NO: 7788246 - DNA, 22 bp, Homo sapiens
tgagaaccacctggaggtgact

SEQ ID NO: 7788247 - DNA, 22 bp, Homo sapiens
tgagaaccaagaccaagggcct

SEQ ID NO: 7788248 - DNA, 22 bp, Homo sapiens
tgagaacattcctcttcctggc

SEQ ID NO: 7788249 - DNA, 23 bp, Homo sapiens
tgagaaattttgattcagtagga

SEQ ID NO: 7788250 - DNA, 22 bp, Homo sapiens
tgagaagatttgctcttctgag

SEQ ID NO: 7788251 - DNA, 22 bp, Homo sapiens
tgagaagattgggcagagtgga

SEQ ID NO: 7788252 - DNA, 18 bp, Homo sapiens
tgagaaactgacacatgg

SEQ ID NO: 7788253 - DNA, 22 bp, Homo sapiens
tgagaaagtgggtgcctagcaa

SEQ ID NO: 7788254 - DNA, 22 bp, Homo sapiens
tgagaaatattgcacagtgagg

SEQ ID NO: 7788255 - DNA, 19 bp, Homo sapiens
tgagaaattccacaggatg

SEQ ID NO: 7788256 - DNA, 22 bp, Homo sapiens
tgagaaatggcagcattactgg

SEQ ID NO: 7788257 - DNA, 22 bp, Homo sapiens
tgagaattttttgtcatgcatt

SEQ ID NO: 7788258 - DNA, 22 bp, Homo sapiens
tgagaatttgcatttctaacaa

SEQ ID NO: 7788259 - DNA, 17 bp, Homo sapiens
tgagacagggcaggccc

SEQ ID NO: 7788260 - DNA, 22 bp, Homo sapiens
tgagatgaataactcctgctaa

SEQ ID NO: 7788261 - DNA, 22 bp, Homo sapiens
tgagatgaataactcctgctaa

SEQ ID NO: 7788262 - DNA, 22 bp, Homo sapiens
tgagatggagccactgcactct

SEQ ID NO: 7788263 - DNA, 22 bp, Homo sapiens
tgagatggagtcttgctctgtt

SEQ ID NO: 7788264 - DNA, 22 bp, Homo sapiens
tgagatcacttacgtggctgca

SEQ ID NO: 7788265 - DNA, 22 bp, Homo sapiens
tgagacttgtgagtccttctag

SEQ ID NO: 7788266 - DNA, 22 bp, Homo sapiens
tgagagagcctgaatctcttac

SEQ ID NO: 7788267 - DNA, 21 bp, Homo sapiens
tgagagagtagcaggacatat

SEQ ID NO: 7788268 - DNA, 18 bp, Homo sapiens
tgagaggctattttttgc

SEQ ID NO: 7788269 - DNA, 22 bp, Homo sapiens
tgagaggctagatcagctctgt

SEQ ID NO: 7788270 - DNA, 18 bp, Homo sapiens
tgagaggcaggtagagga

SEQ ID NO: 7788271 - DNA, 22 bp, Homo sapiens
tgagaggcgctcactctcaggt

SEQ ID NO: 7788272 - DNA, 22 bp, Homo sapiens
tgagaggcgctcactctcaggt

SEQ ID NO: 7788273 - DNA, 22 bp, Homo sapiens
tgagaggtaggaaatgaacaag

SEQ ID NO: 7788274 - DNA, 22 bp, Homo sapiens
tgcagaattatggtgctggctt

SEQ ID NO: 7788275 - DNA, 22 bp, Homo sapiens
tgcagaggagctggaaggctgg

SEQ ID NO: 7788276 - DNA, 22 bp, Homo sapiens
tgcagaggctggctcgccgggt

SEQ ID NO: 7788277 - DNA, 22 bp, Homo sapiens
tgcagagggaaaaggtgctcct

SEQ ID NO: 7788278 - DNA, 22 bp, Homo sapiens
tgcagaggcgccgtgggtgggg

SEQ ID NO: 7788279 - DNA, 22 bp, Homo sapiens
tgcagaggagtcagcctgggca

SEQ ID NO: 7788280 - DNA, 22 bp, Homo sapiens
tgcagaggagctggaaggctgg

SEQ ID NO: 7788281 - DNA, 22 bp, Homo sapiens
tgcagaggagctggaaggctgg

SEQ ID NO: 7788282 - DNA, 22 bp, Homo sapiens
tgcagagggagtgacggttcac

SEQ ID NO: 7788283 - DNA, 19 bp, Homo sapiens
tgcagagggtaggaaggcc

SEQ ID NO: 7788284 - DNA, 23 bp, Homo sapiens
tgcagagggactgaagccagctt

SEQ ID NO: 7788285 - DNA, 21 bp, Homo sapiens
tgcagataattgaaagctgac

SEQ ID NO: 7788286 - DNA, 22 bp, Homo sapiens
tgcagatgaatgctgagacact

SEQ ID NO: 7788287 - DNA, 22 bp, Homo sapiens
tgcagatggggatcagtggctc

SEQ ID NO: 7788288 - DNA, 22 bp, Homo sapiens
tgcagatggggatcagtggctc

SEQ ID NO: 7788289 - DNA, 22 bp, Homo sapiens
tgcagcaccacacctggctaat

SEQ ID NO: 7788290 - DNA, 20 bp, Homo sapiens
tgcagcacgggccctttcca

SEQ ID NO: 7788291 - DNA, 20 bp, Homo sapiens
tgcacagggtgggaagcaac

SEQ ID NO: 7788292 - DNA, 22 bp, Homo sapiens
tgcacagggagggggccagctc

SEQ ID NO: 7788293 - DNA, 23 bp, Homo sapiens
tgcacaggacggccttataagta

SEQ ID NO: 7788294 - DNA, 22 bp, Homo sapiens
tgcacacagtggacaagtcttg

SEQ ID NO: 7788295 - DNA, 22 bp, Homo sapiens
tgcacccatagcacacactcct

SEQ ID NO: 7788296 - DNA, 22 bp, Homo sapiens
tgcaccacccgtgggaggactg

SEQ ID NO: 7788297 - DNA, 22 bp, Homo sapiens
tgcaccgttgcactccagagtg

SEQ ID NO: 7788298 - DNA, 22 bp, Homo sapiens
tgcacagtgtaatgaatcagaa

SEQ ID NO: 7788299 - DNA, 22 bp, Homo sapiens
tgcacaggtgagactcaggaag

SEQ ID NO: 7788300 - DNA, 22 bp, Homo sapiens
tgcacagtaaacatgactggag

SEQ ID NO: 7788301 - DNA, 22 bp, Homo sapiens
tgcacatggcaatgctgctccc

SEQ ID NO: 7788302 - DNA, 22 bp, Homo sapiens
tgcacagttggctacatcgtgg

SEQ ID NO: 7788303 - DNA, 22 bp, Homo sapiens
tgcagaaacaagccatcattca

SEQ ID NO: 7788304 - DNA, 22 bp, Homo sapiens
tgcacttttatatcactctggc

SEQ ID NO: 7788305 - DNA, 21 bp, Homo sapiens
tgcactttgggggacaggctg

SEQ ID NO: 7788306 - DNA, 21 bp, Homo sapiens
tgcagaaatggtttttctaag

SEQ ID NO: 7788307 - DNA, 22 bp, Homo sapiens
tgcagaaataactcatattgca

SEQ ID NO: 7788308 - DNA, 22 bp, Homo sapiens
tgcagaaataactcatattgca

SEQ ID NO: 7788309 - DNA, 22 bp, Homo sapiens
tgcagaaacagtcattaatgta

SEQ ID NO: 7788310 - DNA, 22 bp, Homo sapiens
tgcagaaaccaattcaagtaag

SEQ ID NO: 7788311 - DNA, 22 bp, Homo sapiens
tgcagaaagcattgactcttcc

SEQ ID NO: 7788312 - DNA, 22 bp, Homo sapiens
tgcagaaataaagatattatca

SEQ ID NO: 7788313 - DNA, 20 bp, Homo sapiens
tgcagaagaacgttctggtt

SEQ ID NO: 7788314 - DNA, 22 bp, Homo sapiens
tgcagaagacacaaggtaacgt

SEQ ID NO: 7788315 - DNA, 22 bp, Homo sapiens
tgcagaagtgagtcatgaggaa

SEQ ID NO: 7788316 - DNA, 22 bp, Homo sapiens
tgcagaagtattccaggcccca

SEQ ID NO: 7788317 - DNA, 22 bp, Homo sapiens
tgcagaagtgagtcatgaggaa

SEQ ID NO: 7788318 - DNA, 22 bp, Homo sapiens
tgcagaagctgcaggtcagtgg

SEQ ID NO: 7788319 - DNA, 22 bp, Homo sapiens
tgcagaagaccttccagggctg

SEQ ID NO: 7788320 - DNA, 22 bp, Homo sapiens
tgcagaagcagagagttgccaa

SEQ ID NO: 7788321 - DNA, 22 bp, Homo sapiens
tgcagaagcagagccggtggcc

SEQ ID NO: 7788322 - DNA, 22 bp, Homo sapiens
tgcaggagcccttgggctctgg

SEQ ID NO: 7788323 - DNA, 22 bp, Homo sapiens
tgcaggagggagggttacagtt

SEQ ID NO: 7788324 - DNA, 22 bp, Homo sapiens
tgcaggagtccaatcaggagac

SEQ ID NO: 7788325 - DNA, 22 bp, Homo sapiens
tgcaggcagctgaaaggtgcct

SEQ ID NO: 7788326 - DNA, 22 bp, Homo sapiens
tgcaggcagctaaaccatgtaa

SEQ ID NO: 7788327 - DNA, 21 bp, Homo sapiens
tgcaggagtgtaatgtgaccc

SEQ ID NO: 7788328 - DNA, 21 bp, Homo sapiens
tgcaggctacttctgactcta

SEQ ID NO: 7788329 - DNA, 22 bp, Homo sapiens
tgcaggctatatcttatttgac

SEQ ID NO: 7788330 - DNA, 22 bp, Homo sapiens
tgcaggctatcctttgctgcaa

SEQ ID NO: 7788331 - DNA, 23 bp, Homo sapiens
tgcaggctaggaagagagccttc

SEQ ID NO: 7788332 - DNA, 22 bp, Homo sapiens
tgcaggctcaccctggagctga

SEQ ID NO: 7788333 - DNA, 22 bp, Homo sapiens
tgcaggctcaccctggagctga

SEQ ID NO: 7788334 - DNA, 22 bp, Homo sapiens
tgcaggctcaccctggagctga

SEQ ID NO: 7788335 - DNA, 22 bp, Homo sapiens
tgcaggctcacctgccagggcc

SEQ ID NO: 7788336 - DNA, 22 bp, Homo sapiens
tgcaggctcatctcaagagtag

SEQ ID NO: 7788337 - DNA, 22 bp, Homo sapiens
tgcaggctccaggtgcacatat

SEQ ID NO: 7788338 - DNA, 22 bp, Homo sapiens
tgcaggctccaggtgcacatat

SEQ ID NO: 7788339 - DNA, 22 bp, Homo sapiens
tgcagctgtgcctgaaaagtac

SEQ ID NO: 7788340 - DNA, 22 bp, Homo sapiens
tgcagctgtaacagaggcctca

SEQ ID NO: 7788341 - DNA, 19 bp, Homo sapiens
tgcagctgtatgagcttaa

SEQ ID NO: 7788342 - DNA, 20 bp, Homo sapiens
tgcagctggtttcacaggga

SEQ ID NO: 7788343 - DNA, 20 bp, Homo sapiens
tgcagctggtttcacaggga

SEQ ID NO: 7788344 - DNA, 22 bp, Homo sapiens
tgcagctgtaacagaggcctca

SEQ ID NO: 7788345 - DNA, 22 bp, Homo sapiens
tgcagctgtaacagaggcctca

SEQ ID NO: 7788346 - DNA, 22 bp, Homo sapiens
tgcagcttctctgcaacaggag

SEQ ID NO: 7788347 - DNA, 22 bp, Homo sapiens
tgcagcttgctgtaggctaagt

SEQ ID NO: 7788348 - DNA, 22 bp, Homo sapiens
tgcaggaaaaataaatagtgtt

SEQ ID NO: 7788349 - DNA, 22 bp, Homo sapiens
tgcaggaaacagaggctcaaat

SEQ ID NO: 7788350 - DNA, 22 bp, Homo sapiens
tgcagcttatctctttggcagt

SEQ ID NO: 7788351 - DNA, 22 bp, Homo sapiens
tgcagcttcactcaggaagcca

SEQ ID NO: 7788352 - DNA, 22 bp, Homo sapiens
tgcaggaacttggttttactca

SEQ ID NO: 7788353 - DNA, 22 bp, Homo sapiens
tgcaggaagacttcccaagcca

SEQ ID NO: 7788354 - DNA, 22 bp, Homo sapiens
tgcaggagcagagatggctgga

SEQ ID NO: 7788355 - DNA, 22 bp, Homo sapiens
tgcaggagcaccagctcaccct

SEQ ID NO: 7788356 - DNA, 22 bp, Homo sapiens
tgcagctgacccactccagtcc

SEQ ID NO: 7788357 - DNA, 21 bp, Homo sapiens
tgcagctgacactggtatgcc

SEQ ID NO: 7788358 - DNA, 21 bp, Homo sapiens
tgcagctgacactggtatgcc

SEQ ID NO: 7788359 - DNA, 21 bp, Homo sapiens
tgcagctgacaccctttggga

SEQ ID NO: 7788360 - DNA, 22 bp, Homo sapiens
tgcagcctttagaagttcagat

SEQ ID NO: 7788361 - DNA, 22 bp, Homo sapiens
tgcagccttgcctcctcccagc

SEQ ID NO: 7788362 - DNA, 22 bp, Homo sapiens
tgcagctcaggattctcagggc

SEQ ID NO: 7788363 - DNA, 22 bp, Homo sapiens
tgcagctgcttgattcatcttg

SEQ ID NO: 7788364 - DNA, 17 bp, Homo sapiens
tgcagctgctcccaggc

SEQ ID NO: 7788365 - DNA, 17 bp, Homo sapiens
tgcagctgctcccaggc

SEQ ID NO: 7788366 - DNA, 22 bp, Homo sapiens
tgcagctgctggcccaggtgct

SEQ ID NO: 7788367 - DNA, 22 bp, Homo sapiens
tgcagctgatgatacccccatg

SEQ ID NO: 7788368 - DNA, 17 bp, Homo sapiens
tgcagctgatggggaaa

SEQ ID NO: 7788369 - DNA, 22 bp, Homo sapiens
tgcagctgggtctgccctggct

SEQ ID NO: 7788370 - DNA, 22 bp, Homo sapiens
tgcagctggaacttagaggaga

SEQ ID NO: 7788371 - DNA, 22 bp, Homo sapiens
tgcagctgcttgattcatcttg

SEQ ID NO: 7788372 - DNA, 21 bp, Homo sapiens
tgcagctgggttctggtttgc

SEQ ID NO: 7788373 - DNA, 22 bp, Homo sapiens
tgcagctggtttagaactagat

SEQ ID NO: 7788374 - DNA, 20 bp, Homo sapiens
tgcagctggtttcacaggga

SEQ ID NO: 7788375 - DNA, 22 bp, Homo sapiens
tgcagccatctttcttggagga

SEQ ID NO: 7788376 - DNA, 22 bp, Homo sapiens
tgcagccagactttgtgcgaaa

SEQ ID NO: 7788377 - DNA, 18 bp, Homo sapiens
tgcagcctgtagtcttgt

SEQ ID NO: 7788378 - DNA, 22 bp, Homo sapiens
tgcagcctggtggtcactggag

SEQ ID NO: 7788379 - DNA, 22 bp, Homo sapiens
tgcagcctctctgcttcaggaa

SEQ ID NO: 7788380 - DNA, 22 bp, Homo sapiens
tgcagcccaggcgtcaggtggt

SEQ ID NO: 7788381 - DNA, 22 bp, Homo sapiens
tgcagcccttccttcctctggg

SEQ ID NO: 7788382 - DNA, 22 bp, Homo sapiens
tgcagcctagacattctggtca

SEQ ID NO: 7788383 - DNA, 21 bp, Homo sapiens
tgcagcagagtaagcagggga

SEQ ID NO: 7788384 - DNA, 22 bp, Homo sapiens
tgcagcagcagggaggaggctc

SEQ ID NO: 7788385 - DNA, 22 bp, Homo sapiens
tgcagcagagtgggcctgggtg

SEQ ID NO: 7788386 - DNA, 22 bp, Homo sapiens
tgatcccaatctttcctgctcc

SEQ ID NO: 7788387 - DNA, 22 bp, Homo sapiens
tgatctgaaggacatgggaccc

SEQ ID NO: 7788388 - DNA, 22 bp, Homo sapiens
tgatcctatttcagtgtatgtt

SEQ ID NO: 7788389 - DNA, 22 bp, Homo sapiens
tgatattttatgagctttcata

SEQ ID NO: 7788390 - DNA, 22 bp, Homo sapiens
tgatcattatcaaactggtcat

SEQ ID NO: 7788391 - DNA, 21 bp, Homo sapiens
tgatcatttgtgtaaaggaga

SEQ ID NO: 7788392 - DNA, 22 bp, Homo sapiens
tgatcaggtctgaacagggagg

SEQ ID NO: 7788393 - DNA, 22 bp, Homo sapiens
tgatactttggagacttgagta

SEQ ID NO: 7788394 - DNA, 22 bp, Homo sapiens
tgagttctgactgtgatgccag

SEQ ID NO: 7788395 - DNA, 22 bp, Homo sapiens
tgagttctccaagagaaggtat

SEQ ID NO: 7788396 - DNA, 22 bp, Homo sapiens
tgagttctagtggctgcagatt

SEQ ID NO: 7788397 - DNA, 23 bp, Homo sapiens
tgagttctaggcttaaaactagc

SEQ ID NO: 7788398 - DNA, 22 bp, Homo sapiens
tgagttctccaagagaaggtaa

SEQ ID NO: 7788399 - DNA, 22 bp, Homo sapiens
tgagttctcacccattcttctt

SEQ ID NO: 7788400 - DNA, 22 bp, Homo sapiens
tgatatgtgaagctattagttc

SEQ ID NO: 7788401 - DNA, 22 bp, Homo sapiens
tgatatgcatgtaagggagaca

SEQ ID NO: 7788402 - DNA, 22 bp, Homo sapiens
tgagttctaggcttaaaactaa

SEQ ID NO: 7788403 - DNA, 22 bp, Homo sapiens
tgagttatctaaaatagtcaaa

SEQ ID NO: 7788404 - DNA, 22 bp, Homo sapiens
tgagttaagcaggtagcaagct

SEQ ID NO: 7788405 - DNA, 22 bp, Homo sapiens
tgagttaaatgagaacatgaaa

SEQ ID NO: 7788406 - DNA, 22 bp, Homo sapiens
tgagttaaatgagaacatgaaa

SEQ ID NO: 7788407 - DNA, 22 bp, Homo sapiens
tgagtgtctggtcatggcaggc

SEQ ID NO: 7788408 - DNA, 19 bp, Homo sapiens
tgagtgtcacgtcagtgcc

SEQ ID NO: 7788409 - DNA, 23 bp, Homo sapiens
tgagtgtgaaaatcctggagatg

SEQ ID NO: 7788410 - DNA, 22 bp, Homo sapiens
tgagtgctttaaatgttatttt

SEQ ID NO: 7788411 - DNA, 22 bp, Homo sapiens
tgagtggagaacagaggctctc

SEQ ID NO: 7788412 - DNA, 22 bp, Homo sapiens
tgagtggacgtgaggctgagta

SEQ ID NO: 7788413 - DNA, 17 bp, Homo sapiens
tgagtggccgggggaca

SEQ ID NO: 7788414 - DNA, 22 bp, Homo sapiens
tgagtggagactgtgtgtagag

SEQ ID NO: 7788415 - DNA, 20 bp, Homo sapiens
tgagtggccactgggtcgca

SEQ ID NO: 7788416 - DNA, 22 bp, Homo sapiens
tgagtgaggaagcggtggagga

SEQ ID NO: 7788417 - DNA, 22 bp, Homo sapiens
tgagtgaggctgggcagtccct

SEQ ID NO: 7788418 - DNA, 22 bp, Homo sapiens
tgagtgagacatcctgtcttaa

SEQ ID NO: 7788419 - DNA, 22 bp, Homo sapiens
tgatctttcctcttgtttgtct

SEQ ID NO: 7788420 - DNA, 22 bp, Homo sapiens
tgatgaaaatgttcagcaatta

SEQ ID NO: 7788421 - DNA, 22 bp, Homo sapiens
tgatgaaagtgtttactcacct

SEQ ID NO: 7788422 - DNA, 22 bp, Homo sapiens
tgatgaaactgaggttccaaga

SEQ ID NO: 7788423 - DNA, 22 bp, Homo sapiens
tgatgcaatgtttacatcttga

SEQ ID NO: 7788424 - DNA, 22 bp, Homo sapiens
tgatgctctcctaatatgaaaa

SEQ ID NO: 7788425 - DNA, 22 bp, Homo sapiens
tgatgcttcacgctgaatatgc

SEQ ID NO: 7788426 - DNA, 22 bp, Homo sapiens
tgattgtatgattgaaatattt

SEQ ID NO: 7788427 - DNA, 21 bp, Homo sapiens
tgattgatatttgcaaacaga

SEQ ID NO: 7788428 - DNA, 22 bp, Homo sapiens
tgattgatggaggtgatttacc

SEQ ID NO: 7788429 - DNA, 22 bp, Homo sapiens
tgattctatggaaggcataagg

SEQ ID NO: 7788430 - DNA, 22 bp, Homo sapiens
tgatgttcaacaagtacatatt

SEQ ID NO: 7788431 - DNA, 22 bp, Homo sapiens
tgatgttctgtatatcatatag

SEQ ID NO: 7788432 - DNA, 22 bp, Homo sapiens
tgattaaaatttaacttagtta

SEQ ID NO: 7788433 - DNA, 22 bp, Homo sapiens
tgattaagttcaaaatatagaa

SEQ ID NO: 7788434 - DNA, 22 bp, Homo sapiens
tgattaaattaattaagatgag

SEQ ID NO: 7788435 - DNA, 18 bp, Homo sapiens
tgattcaagttgccctcc

SEQ ID NO: 7788436 - DNA, 22 bp, Homo sapiens
tgattcaataggaattgagtag

SEQ ID NO: 7788437 - DNA, 22 bp, Homo sapiens
tgattcaattatctgatgcttt

SEQ ID NO: 7788438 - DNA, 22 bp, Homo sapiens
tgattcatcagaataggagttt

SEQ ID NO: 7788439 - DNA, 22 bp, Homo sapiens
tgcaagaatgacccatctaccc

SEQ ID NO: 7788440 - DNA, 22 bp, Homo sapiens
tgcaagagattcaaaccataaa

SEQ ID NO: 7788441 - DNA, 22 bp, Homo sapiens
tgcaagagcccaaactatatac

SEQ ID NO: 7788442 - DNA, 22 bp, Homo sapiens
tgcaagaggcatcttttaaaaa

SEQ ID NO: 7788443 - DNA, 22 bp, Homo sapiens
tgcaagaggttggattttaaga

SEQ ID NO: 7788444 - DNA, 22 bp, Homo sapiens
tgcaagaggattgtatcaataa

SEQ ID NO: 7788445 - DNA, 22 bp, Homo sapiens
tgcaactaggaggttcttagct

SEQ ID NO: 7788446 - DNA, 22 bp, Homo sapiens
tgcaactaggaggttcttagct

SEQ ID NO: 7788447 - DNA, 23 bp, Homo sapiens
tgcaacaatgaggaaagctactg

SEQ ID NO: 7788448 - DNA, 22 bp, Homo sapiens
tgcaacaaggcctcatttcttg

SEQ ID NO: 7788449 - DNA, 22 bp, Homo sapiens
tgcaaatttgacttcacacatc

SEQ ID NO: 7788450 - DNA, 22 bp, Homo sapiens
tgcaaatttctttagtacataa

SEQ ID NO: 7788451 - DNA, 22 bp, Homo sapiens
tgcaaatttctttagtacataa

SEQ ID NO: 7788452 - DNA, 21 bp, Homo sapiens
tgcaatccagcctgggcgaca

SEQ ID NO: 7788453 - DNA, 21 bp, Homo sapiens
tgcaatccagcctgggcgaca

SEQ ID NO: 7788454 - DNA, 22 bp, Homo sapiens
tgcaagggtagaagtgatggca

SEQ ID NO: 7788455 - DNA, 22 bp, Homo sapiens
tgcaagggtgacaggttgctct

SEQ ID NO: 7788456 - DNA, 22 bp, Homo sapiens
tgcaagggtgtttgagctgccc

SEQ ID NO: 7788457 - DNA, 22 bp, Homo sapiens
tgcaagggcttagggggctgtg

SEQ ID NO: 7788458 - DNA, 22 bp, Homo sapiens
tgcaagatattatctttgctgc

SEQ ID NO: 7788459 - DNA, 22 bp, Homo sapiens
tgcaatgtgttagatggtttta

SEQ ID NO: 7788460 - DNA, 22 bp, Homo sapiens
tgcaatctcggcactttgggag

SEQ ID NO: 7788461 - DNA, 22 bp, Homo sapiens
tgcaatttgacgtcagcacagt

SEQ ID NO: 7788462 - DNA, 22 bp, Homo sapiens
tgcaatttcaaatatcagaaag

SEQ ID NO: 7788463 - DNA, 22 bp, Homo sapiens
tgcacacacaggagtctcctcc

SEQ ID NO: 7788464 - DNA, 22 bp, Homo sapiens
tgcacacacacgtagagaaaag

SEQ ID NO: 7788465 - DNA, 22 bp, Homo sapiens
tgcacacacatgaagtagcatg

SEQ ID NO: 7788466 - DNA, 22 bp, Homo sapiens
tgcacacacatgcagagggaga

SEQ ID NO: 7788467 - DNA, 22 bp, Homo sapiens
tgcacacaccgtgcttcactga

SEQ ID NO: 7788468 - DNA, 22 bp, Homo sapiens
tgcacacacgcggcacatctgt

SEQ ID NO: 7788469 - DNA, 22 bp, Homo sapiens
tgcacacacggagataggcttt

SEQ ID NO: 7788470 - DNA, 22 bp, Homo sapiens
tgcacacagatggtacatgcat

SEQ ID NO: 7788471 - DNA, 22 bp, Homo sapiens
tgcacacagctgggcctggctg

SEQ ID NO: 7788472 - DNA, 22 bp, Homo sapiens
tgcacacactctgcatatactt

SEQ ID NO: 7788473 - DNA, 22 bp, Homo sapiens
tgcacacactctgcatatactt

SEQ ID NO: 7788474 - DNA, 19 bp, Homo sapiens
tgcacacagataagtatct

SEQ ID NO: 7788475 - DNA, 22 bp, Homo sapiens
tgcaaagatgaaatattaaagg

SEQ ID NO: 7788476 - DNA, 22 bp, Homo sapiens
tgcaaatatttccttatagcca

SEQ ID NO: 7788477 - DNA, 22 bp, Homo sapiens
tgcaaatgagttgcagatcagg

SEQ ID NO: 7788478 - DNA, 22 bp, Homo sapiens
tgcaaatcataaacaatagtgt

SEQ ID NO: 7788479 - DNA, 22 bp, Homo sapiens
tgcaaatgcccatttattttct

SEQ ID NO: 7788480 - DNA, 22 bp, Homo sapiens
tgcaaatgagttgcagatcagg

SEQ ID NO: 7788481 - DNA, 22 bp, Homo sapiens
tgcaaatgatgaaactaacttt

SEQ ID NO: 7788482 - DNA, 22 bp, Homo sapiens
tgcaaatggagcatgtataaga

SEQ ID NO: 7788483 - DNA, 19 bp, Homo sapiens
tgcaaatgctgttgagaat

SEQ ID NO: 7788484 - DNA, 22 bp, Homo sapiens
tgcaaatgcccatttattttct

SEQ ID NO: 7788485 - DNA, 18 bp, Homo sapiens
tgcaaatggctgtttgat

SEQ ID NO: 7788486 - DNA, 22 bp, Homo sapiens
tgcaaatgggaaacccagcagt

SEQ ID NO: 7788487 - DNA, 22 bp, Homo sapiens
tgcaaatgggcatctccaagtg

SEQ ID NO: 7788488 - DNA, 22 bp, Homo sapiens
tgcaaatgggcatctccaagtg

SEQ ID NO: 7788489 - DNA, 22 bp, Homo sapiens
tgcaaatgggtgagggttagga

SEQ ID NO: 7788490 - DNA, 23 bp, Homo sapiens
tgcaaattaggccgggactcagc

SEQ ID NO: 7788491 - DNA, 22 bp, Homo sapiens
tgcaaatgtgttttaaaccaaa

SEQ ID NO: 7788492 - DNA, 22 bp, Homo sapiens
tgcaaatgtgtggtgaggcatt

SEQ ID NO: 7788493 - DNA, 19 bp, Homo sapiens
tgcaaatgtaggaagaata

SEQ ID NO: 7788494 - DNA, 22 bp, Homo sapiens
tgcaaatgtgtaggtttacata

SEQ ID NO: 7788495 - DNA, 22 bp, Homo sapiens
tgcaaatgtcaagggttagtgt

SEQ ID NO: 7788496 - DNA, 19 bp, Homo sapiens
tgcaaattctaaaaactga

SEQ ID NO: 7788497 - DNA, 22 bp, Homo sapiens
tgcaaattccatttaaacacta

SEQ ID NO: 7788498 - DNA, 19 bp, Homo sapiens
tgcaaattctaaaaactga

SEQ ID NO: 7788499 - DNA, 22 bp, Homo sapiens
tgcaaatttaatgaaactatgt

SEQ ID NO: 7788500 - DNA, 22 bp, Homo sapiens
tgcaaattggtgaggaccactt

SEQ ID NO: 7788501 - DNA, 22 bp, Homo sapiens
tgcaaactattggtagagatgg

SEQ ID NO: 7788502 - DNA, 22 bp, Homo sapiens
tgcaaactagcatcaactagta

SEQ ID NO: 7788503 - DNA, 23 bp, Homo sapiens
tgcaaagaaatctgggtcattgt

SEQ ID NO: 7788504 - DNA, 22 bp, Homo sapiens
tgcaaacagccttgaaagaggg

SEQ ID NO: 7788505 - DNA, 22 bp, Homo sapiens
tgcaaacatccgactgaaagcc

SEQ ID NO: 7788506 - DNA, 22 bp, Homo sapiens
tgcaaacaatttcctataaagt

SEQ ID NO: 7788507 - DNA, 23 bp, Homo sapiens
tgcaaaatttgcagagttcgatg

SEQ ID NO: 7788508 - DNA, 22 bp, Homo sapiens
tgatttccctcatcataacaga

SEQ ID NO: 7788509 - DNA, 22 bp, Homo sapiens
tgatttacttctggataaatcc

SEQ ID NO: 7788510 - DNA, 22 bp, Homo sapiens
tgatttacacacctatgattta

SEQ ID NO: 7788511 - DNA, 22 bp, Homo sapiens
tgatttacaattgtaaaagttt

SEQ ID NO: 7788512 - DNA, 22 bp, Homo sapiens
tgatttaccagttactatcttg

SEQ ID NO: 7788513 - DNA, 22 bp, Homo sapiens
tgatttacagtagtgtctaaac

SEQ ID NO: 7788514 - DNA, 22 bp, Homo sapiens
tgatttacacatcaaagcagca

SEQ ID NO: 7788515 - DNA, 22 bp, Homo sapiens
tgatttttagctattctgaaga

SEQ ID NO: 7788516 - DNA, 22 bp, Homo sapiens
tgcaaaaacagccttgaggcct

SEQ ID NO: 7788517 - DNA, 22 bp, Homo sapiens
tgcaaaaacagccttgaggcct

SEQ ID NO: 7788518 - DNA, 22 bp, Homo sapiens
tgatttttggatctgagctgca

SEQ ID NO: 7788519 - DNA, 22 bp, Homo sapiens
tgatttttagctattctgaaga

SEQ ID NO: 7788520 - DNA, 22 bp, Homo sapiens
tgatttttagctattctgaaga

SEQ ID NO: 7788521 - DNA, 22 bp, Homo sapiens
tgatttttagctattctgaaga

SEQ ID NO: 7788522 - DNA, 22 bp, Homo sapiens
tgcaaaatgacttctgaaaaga

SEQ ID NO: 7788523 - DNA, 22 bp, Homo sapiens
tgcaaaaattgctggaatcttt

SEQ ID NO: 7788524 - DNA, 22 bp, Homo sapiens
tgcaaaaagagcgaggagccct

SEQ ID NO: 7788525 - DNA, 22 bp, Homo sapiens
tgcaaaaactgcaattgctttt

SEQ ID NO: 7788526 - DNA, 22 bp, Homo sapiens
tgcaaaaactgcaattgctttt

SEQ ID NO: 7788527 - DNA, 22 bp, Homo sapiens
tgcctaggaaacctcatgcttc

SEQ ID NO: 7788528 - DNA, 22 bp, Homo sapiens
tgcctaggaaacctcatgcttc

SEQ ID NO: 7788529 - DNA, 22 bp, Homo sapiens
tgccgctccaggtctcgcggtg

SEQ ID NO: 7788530 - DNA, 22 bp, Homo sapiens
tgccgcagtgcggggagggccc

SEQ ID NO: 7788531 - DNA, 22 bp, Homo sapiens
tgccgcagtgcggggagggccc

SEQ ID NO: 7788532 - DNA, 22 bp, Homo sapiens
tgccgcagtgcggggagggccc

SEQ ID NO: 7788533 - DNA, 22 bp, Homo sapiens
tgcccctgacctcaggcgaagg

SEQ ID NO: 7788534 - DNA, 22 bp, Homo sapiens
tgccctggaaatgagaggtgtg

SEQ ID NO: 7788535 - DNA, 22 bp, Homo sapiens
tgcctggcaccccagtctgcac

SEQ ID NO: 7788536 - DNA, 19 bp, Homo sapiens
tgcctggcaccagctccac

SEQ ID NO: 7788537 - DNA, 19 bp, Homo sapiens
tgcctggcaccagctccac

SEQ ID NO: 7788538 - DNA, 22 bp, Homo sapiens
tgcctggcacagagcaggtggc

SEQ ID NO: 7788539 - DNA, 22 bp, Homo sapiens
tgcctggcaatgccagaagcca

SEQ ID NO: 7788540 - DNA, 22 bp, Homo sapiens
tgcctggcaatgccagaagcca

SEQ ID NO: 7788541 - DNA, 22 bp, Homo sapiens
tgcctgccatgcagaaagctga

SEQ ID NO: 7788542 - DNA, 17 bp, Homo sapiens
tgcctgccagcattgga

SEQ ID NO: 7788543 - DNA, 17 bp, Homo sapiens
tgcctgccagcattgga

SEQ ID NO: 7788544 - DNA, 22 bp, Homo sapiens
tgcctgcatcttggaggcccca

SEQ ID NO: 7788545 - DNA, 20 bp, Homo sapiens
tgcctgcccaggtcctgcac

SEQ ID NO: 7788546 - DNA, 22 bp, Homo sapiens
tgcctggaaggcccatgggaag

SEQ ID NO: 7788547 - DNA, 22 bp, Homo sapiens
tgcctcttggagcctttcctct

SEQ ID NO: 7788548 - DNA, 22 bp, Homo sapiens
tgcctctgctgctgtggcatca

SEQ ID NO: 7788549 - DNA, 22 bp, Homo sapiens
tgcctctgtggaaatggtggtc

SEQ ID NO: 7788550 - DNA, 22 bp, Homo sapiens
tgcctccctctctgccactgga

SEQ ID NO: 7788551 - DNA, 22 bp, Homo sapiens
tgcctcgtgtctgagtctgttc

SEQ ID NO: 7788552 - DNA, 22 bp, Homo sapiens
tgcctccctggcaagtctctcc

SEQ ID NO: 7788553 - DNA, 22 bp, Homo sapiens
tgcctcagtctaaagtctctca

SEQ ID NO: 7788554 - DNA, 22 bp, Homo sapiens
tgcctcagctgaggccgctcca

SEQ ID NO: 7788555 - DNA, 17 bp, Homo sapiens
tgccagcctgtcccagg

SEQ ID NO: 7788556 - DNA, 22 bp, Homo sapiens
tgccagctagagaagctagaaa

SEQ ID NO: 7788557 - DNA, 22 bp, Homo sapiens
tgccagctagtcacatattaga

SEQ ID NO: 7788558 - DNA, 18 bp, Homo sapiens
tgccagccgactggcctg

SEQ ID NO: 7788559 - DNA, 19 bp, Homo sapiens
tgccagctcacaggagctc

SEQ ID NO: 7788560 - DNA, 22 bp, Homo sapiens
tgccagctcagagttaggactg

SEQ ID NO: 7788561 - DNA, 22 bp, Homo sapiens
tgccaggccctgtgctggatgc

SEQ ID NO: 7788562 - DNA, 22 bp, Homo sapiens
tgccaggcccagctccagagct

SEQ ID NO: 7788563 - DNA, 22 bp, Homo sapiens
tgccatcactgaacttctgaaa

SEQ ID NO: 7788564 - DNA, 22 bp, Homo sapiens
tgccagggtgtcaggagagcta

SEQ ID NO: 7788565 - DNA, 23 bp, Homo sapiens
tgccagggtttgtttgtggttca

SEQ ID NO: 7788566 - DNA, 22 bp, Homo sapiens
tgccagggtcagctgcagctct

SEQ ID NO: 7788567 - DNA, 22 bp, Homo sapiens
tgccaggggacctagggatgtc

SEQ ID NO: 7788568 - DNA, 22 bp, Homo sapiens
tgccagggtcctgagggccttg

SEQ ID NO: 7788569 - DNA, 22 bp, Homo sapiens
tgccagggtcctgagggccttg

SEQ ID NO: 7788570 - DNA, 22 bp, Homo sapiens
tgccagggccatagggagtcta

SEQ ID NO: 7788571 - DNA, 23 bp, Homo sapiens
tgccagggccctgtgtgcaatgc

SEQ ID NO: 7788572 - DNA, 22 bp, Homo sapiens
tgccagggctgctactggctga

SEQ ID NO: 7788573 - DNA, 21 bp, Homo sapiens
tgccagggatttacagagcct

SEQ ID NO: 7788574 - DNA, 20 bp, Homo sapiens
tgccagggccagcagaggct

SEQ ID NO: 7788575 - DNA, 22 bp, Homo sapiens
tgccagggaccctgtcggccct

SEQ ID NO: 7788576 - DNA, 22 bp, Homo sapiens
tgccagggaccctgtcggccct

SEQ ID NO: 7788577 - DNA, 22 bp, Homo sapiens
tgccagggagccctgctgacca

SEQ ID NO: 7788578 - DNA, 22 bp, Homo sapiens
tgccatgtttaaagttgaaggg

SEQ ID NO: 7788579 - DNA, 20 bp, Homo sapiens
tgcccagcaagagtgcagtt

SEQ ID NO: 7788580 - DNA, 22 bp, Homo sapiens
tgcccagcactgtgccagtcac

SEQ ID NO: 7788581 - DNA, 22 bp, Homo sapiens
tgcccagccaatttgttatgtt

SEQ ID NO: 7788582 - DNA, 22 bp, Homo sapiens
tgcccagcagggagctacctgg

SEQ ID NO: 7788583 - DNA, 22 bp, Homo sapiens
tgcccagcaataaaccagaaga

SEQ ID NO: 7788584 - DNA, 22 bp, Homo sapiens
tgcccagcacccagcatgatgc

SEQ ID NO: 7788585 - DNA, 22 bp, Homo sapiens
tgcccaggattgtgaggtcagg

SEQ ID NO: 7788586 - DNA, 22 bp, Homo sapiens
tgcccaggcttcaccctcagag

SEQ ID NO: 7788587 - DNA, 22 bp, Homo sapiens
tgcccaggctggagtgcagagg

SEQ ID NO: 7788588 - DNA, 21 bp, Homo sapiens
tgcccaggggccaaccgctgc

SEQ ID NO: 7788589 - DNA, 22 bp, Homo sapiens
tgccccaggtgctgaggttgga

SEQ ID NO: 7788590 - DNA, 22 bp, Homo sapiens
tgccccctggtggccagagccg

SEQ ID NO: 7788591 - DNA, 20 bp, Homo sapiens
tgccccaggcctgcacctgc

SEQ ID NO: 7788592 - DNA, 22 bp, Homo sapiens
tgcccaggtttgagtgcccaag

SEQ ID NO: 7788593 - DNA, 19 bp, Homo sapiens
tgccagcattaggctgaag

SEQ ID NO: 7788594 - DNA, 22 bp, Homo sapiens
tgccagccaggttctgaggcta

SEQ ID NO: 7788595 - DNA, 22 bp, Homo sapiens
tgccagcccaccttggggcctc

SEQ ID NO: 7788596 - DNA, 22 bp, Homo sapiens
tgccagcagtagcagtaggcca

SEQ ID NO: 7788597 - DNA, 23 bp, Homo sapiens
tgccagcagggaatgggaaggac

SEQ ID NO: 7788598 - DNA, 22 bp, Homo sapiens
tgccagcagaaataaatacttg

SEQ ID NO: 7788599 - DNA, 21 bp, Homo sapiens
tgccagcatgtaggctagttg

SEQ ID NO: 7788600 - DNA, 21 bp, Homo sapiens
tgccagcattaaacagtcatt

SEQ ID NO: 7788601 - DNA, 23 bp, Homo sapiens
tgccagaggcagtcacagtggtg

SEQ ID NO: 7788602 - DNA, 22 bp, Homo sapiens
tgccagcaagaatagacagtaa

SEQ ID NO: 7788603 - DNA, 22 bp, Homo sapiens
tgccacaggcaatccctgcacg

SEQ ID NO: 7788604 - DNA, 22 bp, Homo sapiens
tgccacagggtcctcaggccag

SEQ ID NO: 7788605 - DNA, 22 bp, Homo sapiens
tgccaccaggagaaccagtgca

SEQ ID NO: 7788606 - DNA, 22 bp, Homo sapiens
tgccacagtttcatggattctg

SEQ ID NO: 7788607 - DNA, 22 bp, Homo sapiens
tgccacagttgtttgtgctcta

SEQ ID NO: 7788608 - DNA, 22 bp, Homo sapiens
tgccacagttgtttgtgctcta

SEQ ID NO: 7788609 - DNA, 23 bp, Homo sapiens
tgccacccttctcttcccagctt

SEQ ID NO: 7788610 - DNA, 22 bp, Homo sapiens
tgcattcctccacctcctgcac

SEQ ID NO: 7788611 - DNA, 21 bp, Homo sapiens
tgcattcctccatccaacagg

SEQ ID NO: 7788612 - DNA, 22 bp, Homo sapiens
tgcattcttggaagaagctctc

SEQ ID NO: 7788613 - DNA, 22 bp, Homo sapiens
tgcatttaagaaaacatgagtc

SEQ ID NO: 7788614 - DNA, 22 bp, Homo sapiens
tgccaaatgccaccacagctgc

SEQ ID NO: 7788615 - DNA, 22 bp, Homo sapiens
tgccaaatgccaccacagctgc

SEQ ID NO: 7788616 - DNA, 22 bp, Homo sapiens
tgcatttttgaggttaactcaa

SEQ ID NO: 7788617 - DNA, 22 bp, Homo sapiens
tgccaaaatggccaaaagctag

SEQ ID NO: 7788618 - DNA, 22 bp, Homo sapiens
tgcatttttaacaaggctaatt

SEQ ID NO: 7788619 - DNA, 22 bp, Homo sapiens
tgcatttccagatttctggagt

SEQ ID NO: 7788620 - DNA, 22 bp, Homo sapiens
tgcatttcagaagaaaattcgg

SEQ ID NO: 7788621 - DNA, 22 bp, Homo sapiens
tgcatttagttttaataaagga

SEQ ID NO: 7788622 - DNA, 22 bp, Homo sapiens
tgcatgttaagaaaatattgag

SEQ ID NO: 7788623 - DNA, 22 bp, Homo sapiens
tgcatggaggataataattgag

SEQ ID NO: 7788624 - DNA, 17 bp, Homo sapiens
tgcatgtcctttgttcc

SEQ ID NO: 7788625 - DNA, 22 bp, Homo sapiens
tgcatctttttccaagtttatt

SEQ ID NO: 7788626 - DNA, 23 bp, Homo sapiens
tgcatgctaacacagtgcacagg

SEQ ID NO: 7788627 - DNA, 22 bp, Homo sapiens
tgcatgctctgtagaaagcagg

SEQ ID NO: 7788628 - DNA, 22 bp, Homo sapiens
tgcatgcttcaggctggctctg

SEQ ID NO: 7788629 - DNA, 22 bp, Homo sapiens
tgcatacatgtttgtgtatttt

SEQ ID NO: 7788630 - DNA, 22 bp, Homo sapiens
tgcatacataatcgagaccagt

SEQ ID NO: 7788631 - DNA, 18 bp, Homo sapiens
tgcatatactgcctatct

SEQ ID NO: 7788632 - DNA, 21 bp, Homo sapiens
tgcataaagaaatacaaatac

SEQ ID NO: 7788633 - DNA, 22 bp, Homo sapiens
tgcataaagtgccatagtatta

SEQ ID NO: 7788634 - DNA, 19 bp, Homo sapiens
tgcataaattatatacttt

SEQ ID NO: 7788635 - DNA, 22 bp, Homo sapiens
tgcagggtagacaggtgaggtc

SEQ ID NO: 7788636 - DNA, 22 bp, Homo sapiens
tgcagggtctctgcaaatgagg

SEQ ID NO: 7788637 - DNA, 22 bp, Homo sapiens
tgcagggtgcacagtggggtgc

SEQ ID NO: 7788638 - DNA, 22 bp, Homo sapiens
tgcagggtggtttgaagggtct

SEQ ID NO: 7788639 - DNA, 22 bp, Homo sapiens
tgcagggtggagcggaagcgga

SEQ ID NO: 7788640 - DNA, 22 bp, Homo sapiens
tgcagggtagatgcaggctgtg

SEQ ID NO: 7788641 - DNA, 22 bp, Homo sapiens
tgcagggtatccttgtctctgc

SEQ ID NO: 7788642 - DNA, 22 bp, Homo sapiens
tgcagggtcccgaagggaagac

SEQ ID NO: 7788643 - DNA, 22 bp, Homo sapiens
tgcaggtgaaaattatgaggat

SEQ ID NO: 7788644 - DNA, 22 bp, Homo sapiens
tgcagggtgtccggaggatcac

SEQ ID NO: 7788645 - DNA, 23 bp, Homo sapiens
tgcagggtgttcctgcctttgct

SEQ ID NO: 7788646 - DNA, 22 bp, Homo sapiens
tgcaggtggcagcggggcacca

SEQ ID NO: 7788647 - DNA, 22 bp, Homo sapiens
tgcaggtggctccagggactgc

SEQ ID NO: 7788648 - DNA, 22 bp, Homo sapiens
tgcaggtggacacgggagacgg

SEQ ID NO: 7788649 - DNA, 22 bp, Homo sapiens
tgcaggtgattctgatgcagtt

SEQ ID NO: 7788650 - DNA, 21 bp, Homo sapiens
tgcagtgtccctaacagtggt

SEQ ID NO: 7788651 - DNA, 22 bp, Homo sapiens
tgcagtggttgagagcccagac

SEQ ID NO: 7788652 - DNA, 23 bp, Homo sapiens
tgcagtgtttaacaatgacttga

SEQ ID NO: 7788653 - DNA, 22 bp, Homo sapiens
tgcaggtgtgggcaggggagca

SEQ ID NO: 7788654 - DNA, 20 bp, Homo sapiens
tgcaggtgttggagaaggta

SEQ ID NO: 7788655 - DNA, 22 bp, Homo sapiens
tgcaggtgtgtgcaagggaggg

SEQ ID NO: 7788656 - DNA, 22 bp, Homo sapiens
tgcaggtgtctccagggcaggt

SEQ ID NO: 7788657 - DNA, 22 bp, Homo sapiens
tgcaggtggtttggacactgct

SEQ ID NO: 7788658 - DNA, 22 bp, Homo sapiens
tgcagggccatggtggcggctg

SEQ ID NO: 7788659 - DNA, 22 bp, Homo sapiens
tgcagggcccctctgcatgagt

SEQ ID NO: 7788660 - DNA, 22 bp, Homo sapiens
tgcaggctggggaggcagactt

SEQ ID NO: 7788661 - DNA, 22 bp, Homo sapiens
tgcaggctgtaatctgaggcta

SEQ ID NO: 7788662 - DNA, 22 bp, Homo sapiens
tgcaggctgtaatctgaggcta

SEQ ID NO: 7788663 - DNA, 22 bp, Homo sapiens
tgcaggctgtaatctgaggcta

SEQ ID NO: 7788664 - DNA, 22 bp, Homo sapiens
tgcaggctgtaatctgaggcta

SEQ ID NO: 7788665 - DNA, 22 bp, Homo sapiens
tgcaggctggggaggcagactt

SEQ ID NO: 7788666 - DNA, 22 bp, Homo sapiens
tgcaggctgggaagagggacaa

SEQ ID NO: 7788667 - DNA, 22 bp, Homo sapiens
tgcaggctgctggcagtagctt

SEQ ID NO: 7788668 - DNA, 22 bp, Homo sapiens
tgcaggctggaggagggactaa

SEQ ID NO: 7788669 - DNA, 22 bp, Homo sapiens
tgcaggctggcagtgctgaaat

SEQ ID NO: 7788670 - DNA, 22 bp, Homo sapiens
tgcaggctggcagatatctcat

SEQ ID NO: 7788671 - DNA, 22 bp, Homo sapiens
tgcaggctgccttcacagagcc

SEQ ID NO: 7788672 - DNA, 22 bp, Homo sapiens
tgcaggctgctcaagacttagt

SEQ ID NO: 7788673 - DNA, 22 bp, Homo sapiens
tgcaggctgcagtctcaggtgg

SEQ ID NO: 7788674 - DNA, 22 bp, Homo sapiens
tgcaggctgaggctggctcaac

SEQ ID NO: 7788675 - DNA, 22 bp, Homo sapiens
tgcaggctgaggctggctcaac

SEQ ID NO: 7788676 - DNA, 22 bp, Homo sapiens
tgcaggctgcacccctgccctg

SEQ ID NO: 7788677 - DNA, 22 bp, Homo sapiens
tgcaggctctgtgtgtgcctgg

SEQ ID NO: 7788678 - DNA, 22 bp, Homo sapiens
tgcaggctctgtgtgtgcctgg

SEQ ID NO: 7788679 - DNA, 22 bp, Homo sapiens
tgcaggctcttggtgacgtggg

SEQ ID NO: 7788680 - DNA, 22 bp, Homo sapiens
tgcaggctccatgaggacaggc

SEQ ID NO: 7788681 - DNA, 17 bp, Homo sapiens
tgcaggctcctgtccct

SEQ ID NO: 7788682 - DNA, 22 bp, Homo sapiens
tgcaggctctctgctgccagat

SEQ ID NO: 7788683 - DNA, 22 bp, Homo sapiens
tgcaggctctctgctgccagat

SEQ ID NO: 7788684 - DNA, 22 bp, Homo sapiens
tgcaggctctctgctgccagat

SEQ ID NO: 7788685 - DNA, 22 bp, Homo sapiens
tgcaggctttagccccatggct

SEQ ID NO: 7788686 - DNA, 22 bp, Homo sapiens
tgcaggcttggatcacatctcc

SEQ ID NO: 7788687 - DNA, 22 bp, Homo sapiens
tgcaggctgtttggtggatctc

SEQ ID NO: 7788688 - DNA, 20 bp, Homo sapiens
tgcaggcttcgctctaggag

SEQ ID NO: 7788689 - DNA, 22 bp, Homo sapiens
tgcaggctttagccccatggct

SEQ ID NO: 7788690 - DNA, 22 bp, Homo sapiens
tgcaggctgtaatctgaggcta

SEQ ID NO: 7788691 - DNA, 21 bp, Homo sapiens
tgcaggctgtgcgctcctgcc

SEQ ID NO: 7788692 - DNA, 21 bp, Homo sapiens
tgcaggctgtttaagaggcaa

SEQ ID NO: 7788693 - DNA, 21 bp, Homo sapiens
tgcaggctgtttaagaggcaa

SEQ ID NO: 7788694 - DNA, 22 bp, Homo sapiens
tgcaggctgtgtcatttagtga

SEQ ID NO: 7788695 - DNA, 18 bp, Homo sapiens
tgcaggctgttgaaactg

SEQ ID NO: 7788696 - DNA, 22 bp, Homo sapiens
tcgaaataatttagaatataga

SEQ ID NO: 7788697 - DNA, 22 bp, Homo sapiens
tcctttttggtccaaggtgacc

SEQ ID NO: 7788698 - DNA, 22 bp, Homo sapiens
tcctttttatagttagagaaac

SEQ ID NO: 7788699 - DNA, 22 bp, Homo sapiens
tcctttttaagtcgttgtggta

SEQ ID NO: 7788700 - DNA, 22 bp, Homo sapiens
tcctttggcaagctctgctctt

SEQ ID NO: 7788701 - DNA, 22 bp, Homo sapiens
tcctttgcttctgtcattctcc

SEQ ID NO: 7788702 - DNA, 22 bp, Homo sapiens
tcctttccatgcttctagaggc

SEQ ID NO: 7788703 - DNA, 18 bp, Homo sapiens
tcctttctccctcatctt

SEQ ID NO: 7788704 - DNA, 20 bp, Homo sapiens
tcctttcctccttctaaatg

SEQ ID NO: 7788705 - DNA, 22 bp, Homo sapiens
tcctttccctttccatcctggc

SEQ ID NO: 7788706 - DNA, 19 bp, Homo sapiens
tcctttgaatatcagttga

SEQ ID NO: 7788707 - DNA, 22 bp, Homo sapiens
tcctttcttcttctgcccatgg

SEQ ID NO: 7788708 - DNA, 22 bp, Homo sapiens
tcgcccagctcatctcccacaa

SEQ ID NO: 7788709 - DNA, 22 bp, Homo sapiens
tcgcccaggctggaagtgcagt

SEQ ID NO: 7788710 - DNA, 22 bp, Homo sapiens
tcgtgatctgtccacctcggcc

SEQ ID NO: 7788711 - DNA, 22 bp, Homo sapiens
tcgttttaggtggacattgtgt

SEQ ID NO: 7788712 - DNA, 22 bp, Homo sapiens
tcgttttaccaaattgaatgtt

SEQ ID NO: 7788713 - DNA, 23 bp, Homo sapiens
tcgttgaatagcaatagcacaac

SEQ ID NO: 7788714 - DNA, 22 bp, Homo sapiens
tcgttcttgtcagtttataaag

SEQ ID NO: 7788715 - DNA, 22 bp, Homo sapiens
tctaaactgcgagcatgccccc

SEQ ID NO: 7788716 - DNA, 22 bp, Homo sapiens
tctaaactgctagctgactgag

SEQ ID NO: 7788717 - DNA, 22 bp, Homo sapiens
tctaaacattgtgatagacctt

SEQ ID NO: 7788718 - DNA, 22 bp, Homo sapiens
tctaaacattggtatggagcag

SEQ ID NO: 7788719 - DNA, 22 bp, Homo sapiens
tctaaactagggttaaaggaaa

SEQ ID NO: 7788720 - DNA, 19 bp, Homo sapiens
tctaaactctatactggta

SEQ ID NO: 7788721 - DNA, 19 bp, Homo sapiens
tctaaactagtcccataac

SEQ ID NO: 7788722 - DNA, 22 bp, Homo sapiens
tctaaactctctttgaattatg

SEQ ID NO: 7788723 - DNA, 20 bp, Homo sapiens
tctaaagtacagtttgtgtg

SEQ ID NO: 7788724 - DNA, 22 bp, Homo sapiens
tctaaagctccttccactaaaa

SEQ ID NO: 7788725 - DNA, 22 bp, Homo sapiens
tctaaagccttccatataacgc

SEQ ID NO: 7788726 - DNA, 22 bp, Homo sapiens
tctaaagatgtttattgacata

SEQ ID NO: 7788727 - DNA, 22 bp, Homo sapiens
tctaaacacgtctctttgaata

SEQ ID NO: 7788728 - DNA, 22 bp, Homo sapiens
tctaaacagcctcttaccaact

SEQ ID NO: 7788729 - DNA, 22 bp, Homo sapiens
tctaaacactaagtcttgatgc

SEQ ID NO: 7788730 - DNA, 22 bp, Homo sapiens
tctaaacactaagtcttgatgc

SEQ ID NO: 7788731 - DNA, 22 bp, Homo sapiens
tctaaacattatgatagtagag

SEQ ID NO: 7788732 - DNA, 22 bp, Homo sapiens
tctaaacataactttgtgtgat

SEQ ID NO: 7788733 - DNA, 22 bp, Homo sapiens
tctaaacagtttcactcttaat

SEQ ID NO: 7788734 - DNA, 20 bp, Homo sapiens
tctaaacagttggcatgggg

SEQ ID NO: 7788735 - DNA, 22 bp, Homo sapiens
tctaaacagtttcactcttaat

SEQ ID NO: 7788736 - DNA, 19 bp, Homo sapiens
tctaaacacagggacaagc

SEQ ID NO: 7788737 - DNA, 22 bp, Homo sapiens
tctaaaatgcagatctactggt

SEQ ID NO: 7788738 - DNA, 22 bp, Homo sapiens
tctaaaaaagtctgttcacttg

SEQ ID NO: 7788739 - DNA, 22 bp, Homo sapiens
tccttcctggggtctctgctgc

SEQ ID NO: 7788740 - DNA, 19 bp, Homo sapiens
tccttctccggccaccccg

SEQ ID NO: 7788741 - DNA, 17 bp, Homo sapiens
tccttggcaaccagttc

SEQ ID NO: 7788742 - DNA, 22 bp, Homo sapiens
tccttggaagagcattcccagg

SEQ ID NO: 7788743 - DNA, 22 bp, Homo sapiens
tccttaaatgtgatctagattt

SEQ ID NO: 7788744 - DNA, 22 bp, Homo sapiens
tccttacaacttgttatttttc

SEQ ID NO: 7788745 - DNA, 22 bp, Homo sapiens
tccttaaatccttcagagatta

SEQ ID NO: 7788746 - DNA, 22 bp, Homo sapiens
tccttaaatgaactctgcatga

SEQ ID NO: 7788747 - DNA, 22 bp, Homo sapiens
tccttcagggctgaccacaggc

SEQ ID NO: 7788748 - DNA, 22 bp, Homo sapiens
tccttcagcctcccagctcaaa

SEQ ID NO: 7788749 - DNA, 22 bp, Homo sapiens
tctagggtccacagggtcagcc

SEQ ID NO: 7788750 - DNA, 22 bp, Homo sapiens
tctagggagaagctctgtctgt

SEQ ID NO: 7788751 - DNA, 22 bp, Homo sapiens
tctagtttaagatctgttagtc

SEQ ID NO: 7788752 - DNA, 22 bp, Homo sapiens
tctagtgttaaggcaaagtaaa

SEQ ID NO: 7788753 - DNA, 22 bp, Homo sapiens
tctattacttaccactaattca

SEQ ID NO: 7788754 - DNA, 19 bp, Homo sapiens
tctatgtggcagtgatggc

SEQ ID NO: 7788755 - DNA, 22 bp, Homo sapiens
tctatctggccccttttatata

SEQ ID NO: 7788756 - DNA, 22 bp, Homo sapiens
tctataaagggccagatagtag

SEQ ID NO: 7788757 - DNA, 22 bp, Homo sapiens
tctataaagggccagatagtag

SEQ ID NO: 7788758 - DNA, 22 bp, Homo sapiens
tctataaatgcagatatgtgtg

SEQ ID NO: 7788759 - DNA, 22 bp, Homo sapiens
tctatttcgcatataagttttg

SEQ ID NO: 7788760 - DNA, 22 bp, Homo sapiens
tctattttatactcaaatcttc

SEQ ID NO: 7788761 - DNA, 22 bp, Homo sapiens
tctattttcttgccaaaactgc

SEQ ID NO: 7788762 - DNA, 22 bp, Homo sapiens
tctattttatactcaaatcttc

SEQ ID NO: 7788763 - DNA, 22 bp, Homo sapiens
tctattttatactcaaatcttc

SEQ ID NO: 7788764 - DNA, 22 bp, Homo sapiens
tctattgtaggcatgtagcttg

SEQ ID NO: 7788765 - DNA, 22 bp, Homo sapiens
tctattcaggcagagtgcagca

SEQ ID NO: 7788766 - DNA, 22 bp, Homo sapiens
tctattctgataaatgcatgga

SEQ ID NO: 7788767 - DNA, 22 bp, Homo sapiens
tctattttgtttccagctctac

SEQ ID NO: 7788768 - DNA, 22 bp, Homo sapiens
tctattttgtttccagctctac

SEQ ID NO: 7788769 - DNA, 18 bp, Homo sapiens
tctcaaaaataatggctt

SEQ ID NO: 7788770 - DNA, 22 bp, Homo sapiens
tctatttttatagttgaagtgc

SEQ ID NO: 7788771 - DNA, 22 bp, Homo sapiens
tctcaaatatttggagagagga

SEQ ID NO: 7788772 - DNA, 22 bp, Homo sapiens
tctcaaataggccttggtcctg

SEQ ID NO: 7788773 - DNA, 22 bp, Homo sapiens
tctcaaactacactgtaaattg

SEQ ID NO: 7788774 - DNA, 22 bp, Homo sapiens
tctcaaactaacaatgattata

SEQ ID NO: 7788775 - DNA, 22 bp, Homo sapiens
tctcaaggactttgggcactaa

SEQ ID NO: 7788776 - DNA, 22 bp, Homo sapiens
tctcaagttatgtaacagctgt

SEQ ID NO: 7788777 - DNA, 23 bp, Homo sapiens
tctcaaatctttgcgttgtatct

SEQ ID NO: 7788778 - DNA, 22 bp, Homo sapiens
tctcaaatggacaatattgtgg

SEQ ID NO: 7788779 - DNA, 22 bp, Homo sapiens
tctcaaatggacaatattgtgg

SEQ ID NO: 7788780 - DNA, 22 bp, Homo sapiens
tctcacagcaggggccaggtct

SEQ ID NO: 7788781 - DNA, 22 bp, Homo sapiens
tctcacagccatttctccctct

SEQ ID NO: 7788782 - DNA, 23 bp, Homo sapiens
tctcacagcgatctaggaagagg

SEQ ID NO: 7788783 - DNA, 22 bp, Homo sapiens
tctaattttaggcatttgttca

SEQ ID NO: 7788784 - DNA, 22 bp, Homo sapiens
tctacaaagaagaattaatgtc

SEQ ID NO: 7788785 - DNA, 22 bp, Homo sapiens
tctacaaagccattcaggatct

SEQ ID NO: 7788786 - DNA, 22 bp, Homo sapiens
tctaaatggaaagaaaatacct

SEQ ID NO: 7788787 - DNA, 22 bp, Homo sapiens
tctacaaataaattactatgta

SEQ ID NO: 7788788 - DNA, 22 bp, Homo sapiens
tctacaaaggttgaggtgccct

SEQ ID NO: 7788789 - DNA, 22 bp, Homo sapiens
tctacacaagtgagtggcacaa

SEQ ID NO: 7788790 - DNA, 22 bp, Homo sapiens
tctacagaaactggctactctc

SEQ ID NO: 7788791 - DNA, 22 bp, Homo sapiens
tctacattttctttatgtacat

SEQ ID NO: 7788792 - DNA, 22 bp, Homo sapiens
tctacagtgtcaatgtgtcttg

SEQ ID NO: 7788793 - DNA, 22 bp, Homo sapiens
tctacagggtcagagtttcatg

SEQ ID NO: 7788794 - DNA, 22 bp, Homo sapiens
tctagatttttgtgcacctttg

SEQ ID NO: 7788795 - DNA, 22 bp, Homo sapiens
tctagctctgcttatcatggct

SEQ ID NO: 7788796 - DNA, 22 bp, Homo sapiens
tctaggagctgagagtgtgtac

SEQ ID NO: 7788797 - DNA, 22 bp, Homo sapiens
tctaggagcttaaaggaggcca

SEQ ID NO: 7788798 - DNA, 22 bp, Homo sapiens
tctaggagttgataaaagggct

SEQ ID NO: 7788799 - DNA, 22 bp, Homo sapiens
tctactatgtatgctttatgcg

SEQ ID NO: 7788800 - DNA, 22 bp, Homo sapiens
tctactgccacttaagacattt

SEQ ID NO: 7788801 - DNA, 18 bp, Homo sapiens
tctaccctctcagagtct

SEQ ID NO: 7788802 - DNA, 22 bp, Homo sapiens
tctaccatgtgctgtgcattgg

SEQ ID NO: 7788803 - DNA, 22 bp, Homo sapiens
tctacttttccctatacagttt

SEQ ID NO: 7788804 - DNA, 22 bp, Homo sapiens
tctagaaaaccaatattacatg

SEQ ID NO: 7788805 - DNA, 22 bp, Homo sapiens
tctagaaaaacaaagtatctga

SEQ ID NO: 7788806 - DNA, 22 bp, Homo sapiens
tcctgtccacagccctgacctc

SEQ ID NO: 7788807 - DNA, 22 bp, Homo sapiens
tcctggtgttactaaattgaaa

SEQ ID NO: 7788808 - DNA, 22 bp, Homo sapiens
tcctggtggtttgaaaactgaa

SEQ ID NO: 7788809 - DNA, 22 bp, Homo sapiens
tcctggtgtaatggtaagcatg

SEQ ID NO: 7788810 - DNA, 22 bp, Homo sapiens
tcctgtgccatctctagagact

SEQ ID NO: 7788811 - DNA, 22 bp, Homo sapiens
tcctgtcttaatgatctcgtgc

SEQ ID NO: 7788812 - DNA, 22 bp, Homo sapiens
tcctgtcttaatgatctcgtgc

SEQ ID NO: 7788813 - DNA, 22 bp, Homo sapiens
tcctgtctgctcacagagctgg

SEQ ID NO: 7788814 - DNA, 22 bp, Homo sapiens
tcctgtctgctcacagagctgg

SEQ ID NO: 7788815 - DNA, 22 bp, Homo sapiens
tccttaaatatttactgttaac

SEQ ID NO: 7788816 - DNA, 22 bp, Homo sapiens
tccttaaatatttactgttaac

SEQ ID NO: 7788817 - DNA, 22 bp, Homo sapiens
tcctggggctctttgatgtgat

SEQ ID NO: 7788818 - DNA, 22 bp, Homo sapiens
tcctggggctgcaaggcctgtc

SEQ ID NO: 7788819 - DNA, 22 bp, Homo sapiens
tcctggggctgcaaggcctgtc

SEQ ID NO: 7788820 - DNA, 21 bp, Homo sapiens
tcctggggggtaggtgagttt

SEQ ID NO: 7788821 - DNA, 21 bp, Homo sapiens
tcctggggggtaggtgagttt

SEQ ID NO: 7788822 - DNA, 20 bp, Homo sapiens
tcctggggtaagccatggtc

SEQ ID NO: 7788823 - DNA, 20 bp, Homo sapiens
tcctggggtaagccatggtc

SEQ ID NO: 7788824 - DNA, 22 bp, Homo sapiens
tcctggggaggtcgaggctgag

SEQ ID NO: 7788825 - DNA, 22 bp, Homo sapiens
tcctggggccagcactggtgga

SEQ ID NO: 7788826 - DNA, 22 bp, Homo sapiens
tcctggggccagcactggtgga

SEQ ID NO: 7788827 - DNA, 22 bp, Homo sapiens
tcctggggctcatgggatttgt

SEQ ID NO: 7788828 - DNA, 22 bp, Homo sapiens
tcctggggttttggccgcagct

SEQ ID NO: 7788829 - DNA, 22 bp, Homo sapiens
tcctggggtttagagggaagtg

SEQ ID NO: 7788830 - DNA, 22 bp, Homo sapiens
tcctgggcgaggtactggggct

SEQ ID NO: 7788831 - DNA, 19 bp, Homo sapiens
tcctgggctgcgtcttgcc

SEQ ID NO: 7788832 - DNA, 22 bp, Homo sapiens
tcctggggaggtcgaggctgag

SEQ ID NO: 7788833 - DNA, 19 bp, Homo sapiens
tcctgggctgggccaggtc

SEQ ID NO: 7788834 - DNA, 22 bp, Homo sapiens
tcctgggcaaagaggggcagtg

SEQ ID NO: 7788835 - DNA, 22 bp, Homo sapiens
tcctgggacaagccgtggaagt

SEQ ID NO: 7788836 - DNA, 23 bp, Homo sapiens
taagaacagacaagcatttacat

SEQ ID NO: 7788837 - DNA, 22 bp, Homo sapiens
taagaacagtgtctgtctcaca

SEQ ID NO: 7788838 - DNA, 22 bp, Homo sapiens
taagaacttcggacatgttatc

SEQ ID NO: 7788839 - DNA, 22 bp, Homo sapiens
taagaacttggcagcaagaaat

SEQ ID NO: 7788840 - DNA, 22 bp, Homo sapiens
taagaactttgtagcctgttct

SEQ ID NO: 7788841 - DNA, 22 bp, Homo sapiens
taagaatcgatgtttatttaga

SEQ ID NO: 7788842 - DNA, 22 bp, Homo sapiens
tcctgctggcaaggaagggact

SEQ ID NO: 7788843 - DNA, 22 bp, Homo sapiens
tcctgcttcttcgagcttctgg

SEQ ID NO: 7788844 - DNA, 22 bp, Homo sapiens
tcctgctgtttacctacaatgg

SEQ ID NO: 7788845 - DNA, 22 bp, Homo sapiens
tcctggagagtgggcgagcaca

SEQ ID NO: 7788846 - DNA, 22 bp, Homo sapiens
tcctggacagatccccatcatc

SEQ ID NO: 7788847 - DNA, 22 bp, Homo sapiens
tcctggaagtgcttggtgaggg

SEQ ID NO: 7788848 - DNA, 22 bp, Homo sapiens
tcctggaagccagagttgagga

SEQ ID NO: 7788849 - DNA, 22 bp, Homo sapiens
tcctggaagatctctgtgagat

SEQ ID NO: 7788850 - DNA, 22 bp, Homo sapiens
tcctggagccaatgtgctgctg

SEQ ID NO: 7788851 - DNA, 20 bp, Homo sapiens
tcctggaggcttcatccata

SEQ ID NO: 7788852 - DNA, 22 bp, Homo sapiens
tcctggcacattgcaggggctc

SEQ ID NO: 7788853 - DNA, 17 bp, Homo sapiens
tcctggcagtcccctgg

SEQ ID NO: 7788854 - DNA, 22 bp, Homo sapiens
tcctggcacattgcaggggctc

SEQ ID NO: 7788855 - DNA, 22 bp, Homo sapiens
tcctggccaagtagatgtggcg

SEQ ID NO: 7788856 - DNA, 22 bp, Homo sapiens
tcctggccatgcaagatgagga

SEQ ID NO: 7788857 - DNA, 22 bp, Homo sapiens
tcctggccacccgacagaagtc

SEQ ID NO: 7788858 - DNA, 22 bp, Homo sapiens
tcctggcctcgctgtccacctt

SEQ ID NO: 7788859 - DNA, 20 bp, Homo sapiens
tcctggcctccctggggctc

SEQ ID NO: 7788860 - DNA, 22 bp, Homo sapiens
tcctggctcggcttggggactt

SEQ ID NO: 7788861 - DNA, 17 bp, Homo sapiens
tcctggctctgccactg

SEQ ID NO: 7788862 - DNA, 22 bp, Homo sapiens
tcctggctctctacaaaccaga

SEQ ID NO: 7788863 - DNA, 22 bp, Homo sapiens
tcctggcccactatgccagcat

SEQ ID NO: 7788864 - DNA, 22 bp, Homo sapiens
tcctggcccgatccctgtgaag

SEQ ID NO: 7788865 - DNA, 22 bp, Homo sapiens
tcctggcccggccgggcctgct

SEQ ID NO: 7788866 - DNA, 22 bp, Homo sapiens
tcctggccctgtggcctgcagt

SEQ ID NO: 7788867 - DNA, 22 bp, Homo sapiens
tcctggccgccgcgtggggccg

SEQ ID NO: 7788868 - DNA, 22 bp, Homo sapiens
tcctggccgctggcccctgaga

SEQ ID NO: 7788869 - DNA, 22 bp, Homo sapiens
tcctggcctagctcaccctgga

SEQ ID NO: 7788870 - DNA, 20 bp, Homo sapiens
tctctggccagaaacaacag

SEQ ID NO: 7788871 - DNA, 19 bp, Homo sapiens
tctctggcagttcagagca

SEQ ID NO: 7788872 - DNA, 22 bp, Homo sapiens
tctctggcagaggccctatccc

SEQ ID NO: 7788873 - DNA, 22 bp, Homo sapiens
tctctgaaagcagctgctcatc

SEQ ID NO: 7788874 - DNA, 22 bp, Homo sapiens
tctctgaagagtcagacataac

SEQ ID NO: 7788875 - DNA, 22 bp, Homo sapiens
tctctgaagagctcagactagt

SEQ ID NO: 7788876 - DNA, 22 bp, Homo sapiens
tctctcagaaagcccatgtctg

SEQ ID NO: 7788877 - DNA, 18 bp, Homo sapiens
tctctcagggaaacagaa

SEQ ID NO: 7788878 - DNA, 22 bp, Homo sapiens
tctctcagggggaaggctgaag

SEQ ID NO: 7788879 - DNA, 22 bp, Homo sapiens
tctctcatagagaaaaatatat

SEQ ID NO: 7788880 - DNA, 22 bp, Homo sapiens
tctctccttatcattgtgttta

SEQ ID NO: 7788881 - DNA, 22 bp, Homo sapiens
tctctcccaaatctgcagatag

SEQ ID NO: 7788882 - DNA, 22 bp, Homo sapiens
tctctccctttccttatcagtt

SEQ ID NO: 7788883 - DNA, 22 bp, Homo sapiens
tctcttctagcttcttgtggtt

SEQ ID NO: 7788884 - DNA, 22 bp, Homo sapiens
tctcttcttgattttcactgga

SEQ ID NO: 7788885 - DNA, 22 bp, Homo sapiens
tctcttcttgtgttttcctgcc

SEQ ID NO: 7788886 - DNA, 22 bp, Homo sapiens
tctcttctgaaacctgtcttta

SEQ ID NO: 7788887 - DNA, 22 bp, Homo sapiens
tctcttctgaaacctgtcttta

SEQ ID NO: 7788888 - DNA, 22 bp, Homo sapiens
tctcttccagtaagagtcttta

SEQ ID NO: 7788889 - DNA, 22 bp, Homo sapiens
tctcttaattcagaggcagtta

SEQ ID NO: 7788890 - DNA, 22 bp, Homo sapiens
tctcttagtcttatatgtaaaa

SEQ ID NO: 7788891 - DNA, 23 bp, Homo sapiens
tctcttacctgagacatttccta

SEQ ID NO: 7788892 - DNA, 22 bp, Homo sapiens
tctctgtctgagcctggcagac

SEQ ID NO: 7788893 - DNA, 22 bp, Homo sapiens
tctctttaaaaatagtgaaata

SEQ ID NO: 7788894 - DNA, 22 bp, Homo sapiens
tctctttaagtataatcttata

SEQ ID NO: 7788895 - DNA, 22 bp, Homo sapiens
tctctttctattgcaccatgct

SEQ ID NO: 7788896 - DNA, 22 bp, Homo sapiens
tctctttgtctgctcttagttg

SEQ ID NO: 7788897 - DNA, 20 bp, Homo sapiens
tctcttttagcttacagctg

SEQ ID NO: 7788898 - DNA, 22 bp, Homo sapiens
tctgaagagtcttgcaagaaag

SEQ ID NO: 7788899 - DNA, 22 bp, Homo sapiens
tctgaagcacagcaggaagggt

SEQ ID NO: 7788900 - DNA, 22 bp, Homo sapiens
tctgaagcagaaaatggggata

SEQ ID NO: 7788901 - DNA, 22 bp, Homo sapiens
tctgaagcacagcaggaagggt

SEQ ID NO: 7788902 - DNA, 22 bp, Homo sapiens
tctgaagattctttccactatt

SEQ ID NO: 7788903 - DNA, 22 bp, Homo sapiens
tctgaagagctttggaagtatg

SEQ ID NO: 7788904 - DNA, 19 bp, Homo sapiens
tctgaagaattagagagca

SEQ ID NO: 7788905 - DNA, 22 bp, Homo sapiens
tctgaaggaaaagggtagatat

SEQ ID NO: 7788906 - DNA, 22 bp, Homo sapiens
tctgaagctggaggaagctttg

SEQ ID NO: 7788907 - DNA, 22 bp, Homo sapiens
tctgaagctggaggaagctttg

SEQ ID NO: 7788908 - DNA, 18 bp, Homo sapiens
tctgaaggaatgattcca

SEQ ID NO: 7788909 - DNA, 22 bp, Homo sapiens
tctgaaggtgctagagaaagct

SEQ ID NO: 7788910 - DNA, 22 bp, Homo sapiens
tctgaaggttgagaagggctga

SEQ ID NO: 7788911 - DNA, 22 bp, Homo sapiens
tctgaagaactgagtaaacatg

SEQ ID NO: 7788912 - DNA, 22 bp, Homo sapiens
tctcataatagcatttctcacc

SEQ ID NO: 7788913 - DNA, 22 bp, Homo sapiens
tctcagtgcagcaaggaattta

SEQ ID NO: 7788914 - DNA, 23 bp, Homo sapiens
tctcagtgcacgcaccatgcctg

SEQ ID NO: 7788915 - DNA, 23 bp, Homo sapiens
tctcagtgaatctcagaattcgc

SEQ ID NO: 7788916 - DNA, 22 bp, Homo sapiens
tctcattcataccctacatgct

SEQ ID NO: 7788917 - DNA, 18 bp, Homo sapiens
tctcattacaatctttgt

SEQ ID NO: 7788918 - DNA, 22 bp, Homo sapiens
tctcatttacttccacaggctg

SEQ ID NO: 7788919 - DNA, 23 bp, Homo sapiens
tctcatttcccttgatctatctt

SEQ ID NO: 7788920 - DNA, 22 bp, Homo sapiens
tctcattcataccctacatgct

SEQ ID NO: 7788921 - DNA, 22 bp, Homo sapiens
tctccaaatagttatatttaga

SEQ ID NO: 7788922 - DNA, 22 bp, Homo sapiens
tctcatttgtgtgcaattcaga

SEQ ID NO: 7788923 - DNA, 22 bp, Homo sapiens
tctcatttggctttgttttaaa

SEQ ID NO: 7788924 - DNA, 22 bp, Homo sapiens
tctcatttgcctcatctataaa

SEQ ID NO: 7788925 - DNA, 22 bp, Homo sapiens
tctcatttgcctcatctataaa

SEQ ID NO: 7788926 - DNA, 22 bp, Homo sapiens
tctcatttggctttgttttaaa

SEQ ID NO: 7788927 - DNA, 22 bp, Homo sapiens
tctcatttgcctcatctataaa

SEQ ID NO: 7788928 - DNA, 23 bp, Homo sapiens
tctcagaggattcctgggccttg

SEQ ID NO: 7788929 - DNA, 19 bp, Homo sapiens
tctcagagccctagaggcc

SEQ ID NO: 7788930 - DNA, 22 bp, Homo sapiens
tctcagagatgtcaagagtcta

SEQ ID NO: 7788931 - DNA, 22 bp, Homo sapiens
tctcacatttcattgacagctg

SEQ ID NO: 7788932 - DNA, 22 bp, Homo sapiens
tctcacagtgcaggtctgtctc

SEQ ID NO: 7788933 - DNA, 22 bp, Homo sapiens
tctcagagttcctctggagtcc

SEQ ID NO: 7788934 - DNA, 22 bp, Homo sapiens
tctcagagtttagagctgagcc

SEQ ID NO: 7788935 - DNA, 22 bp, Homo sapiens
tctcagcagccagatccagagc

SEQ ID NO: 7788936 - DNA, 22 bp, Homo sapiens
tctcagctcttttttcacagaa

SEQ ID NO: 7788937 - DNA, 22 bp, Homo sapiens
tctccttcgaggcccagctccc

SEQ ID NO: 7788938 - DNA, 22 bp, Homo sapiens
tctccttcgaggcccagctccc

SEQ ID NO: 7788939 - DNA, 22 bp, Homo sapiens
tctcgctctgtcgcccaggctg

SEQ ID NO: 7788940 - DNA, 22 bp, Homo sapiens
tctcctttgaaagttaggactg

SEQ ID NO: 7788941 - DNA, 22 bp, Homo sapiens
tctcgatctcctgaccttgtga

SEQ ID NO: 7788942 - DNA, 22 bp, Homo sapiens
tctcgctctgtcgcccaggctg

SEQ ID NO: 7788943 - DNA, 22 bp, Homo sapiens
tctcgctctgtcgcccaggctg

SEQ ID NO: 7788944 - DNA, 22 bp, Homo sapiens
tctcctggtatgtatgcacctg

SEQ ID NO: 7788945 - DNA, 22 bp, Homo sapiens
tctcctggtacccttcctagca

SEQ ID NO: 7788946 - DNA, 22 bp, Homo sapiens
tctcctgggtgctttatcagaa

SEQ ID NO: 7788947 - DNA, 21 bp, Homo sapiens
tctcctgggtccaacccatgc

SEQ ID NO: 7788948 - DNA, 18 bp, Homo sapiens
tctcctgggtaggggcct

SEQ ID NO: 7788949 - DNA, 22 bp, Homo sapiens
tctcctgggtaaaagggttgat

SEQ ID NO: 7788950 - DNA, 22 bp, Homo sapiens
tctcctgggcttggttgaagtt

SEQ ID NO: 7788951 - DNA, 22 bp, Homo sapiens
tctcctgtgcaccctccctgtg

SEQ ID NO: 7788952 - DNA, 22 bp, Homo sapiens
tctcctgtcttctcagcacccc

SEQ ID NO: 7788953 - DNA, 22 bp, Homo sapiens
tctcctggtttgttaaataatt

SEQ ID NO: 7788954 - DNA, 20 bp, Homo sapiens
tctcctggtgacagtaccca

SEQ ID NO: 7788955 - DNA, 20 bp, Homo sapiens
tctcctggtctggtccgtgc

SEQ ID NO: 7788956 - DNA, 22 bp, Homo sapiens
tctcctggtcacctcagaagtc

SEQ ID NO: 7788957 - DNA, 22 bp, Homo sapiens
tctcctggtcacctcagaagtc

SEQ ID NO: 7788958 - DNA, 22 bp, Homo sapiens
tctcctcccaggctcttccagg

SEQ ID NO: 7788959 - DNA, 22 bp, Homo sapiens
tctcctggagcaggaaggtggg

SEQ ID NO: 7788960 - DNA, 22 bp, Homo sapiens
tctcctggagcccagatgctgg

SEQ ID NO: 7788961 - DNA, 22 bp, Homo sapiens
tctcctggagcccagatgctgg

SEQ ID NO: 7788962 - DNA, 22 bp, Homo sapiens
tctcctggagcccagatgctgg

SEQ ID NO: 7788963 - DNA, 22 bp, Homo sapiens
tctcctggcatgtgggtcatct

SEQ ID NO: 7788964 - DNA, 22 bp, Homo sapiens
tctcctggcatttggttgagta

SEQ ID NO: 7788965 - DNA, 22 bp, Homo sapiens
tctcctggatagatactatcca

SEQ ID NO: 7788966 - DNA, 22 bp, Homo sapiens
tctcctggatagatactatcca

SEQ ID NO: 7788967 - DNA, 22 bp, Homo sapiens
tctcctggatggaccttctctt

SEQ ID NO: 7788968 - DNA, 22 bp, Homo sapiens
tctcctggatggaccttctctt

SEQ ID NO: 7788969 - DNA, 22 bp, Homo sapiens
tctcctggaagtgattcccctg

SEQ ID NO: 7788970 - DNA, 22 bp, Homo sapiens
tctcctggaagaataccacact

SEQ ID NO: 7788971 - DNA, 22 bp, Homo sapiens
tctcccactgcaagcccaggct

SEQ ID NO: 7788972 - DNA, 22 bp, Homo sapiens
tctcccactggccttgtatgat

SEQ ID NO: 7788973 - DNA, 22 bp, Homo sapiens
tctccccagctgagctgccctt

SEQ ID NO: 7788974 - DNA, 22 bp, Homo sapiens
tctccctagggccgctggctaa

SEQ ID NO: 7788975 - DNA, 22 bp, Homo sapiens
tctccctactgactccaggacc

SEQ ID NO: 7788976 - DNA, 22 bp, Homo sapiens
tctccctcattcctgcttccat

SEQ ID NO: 7788977 - DNA, 19 bp, Homo sapiens
tctcccagctgagaagggc

SEQ ID NO: 7788978 - DNA, 22 bp, Homo sapiens
tctcccaggctgccctgtggac

SEQ ID NO: 7788979 - DNA, 22 bp, Homo sapiens
tctcccaggtgggtgcctggag

SEQ ID NO: 7788980 - DNA, 22 bp, Homo sapiens
tctcccaggtgggtgcctggag

SEQ ID NO: 7788981 - DNA, 22 bp, Homo sapiens
tctttcaatgagcattctttcc

SEQ ID NO: 7788982 - DNA, 21 bp, Homo sapiens
tctttccaatattcatgtctc

SEQ ID NO: 7788983 - DNA, 22 bp, Homo sapiens
tctttcccagtagctctcccag

SEQ ID NO: 7788984 - DNA, 22 bp, Homo sapiens
tctttcccagtagctctcccag

SEQ ID NO: 7788985 - DNA, 22 bp, Homo sapiens
tctttcccgccagagcatgagt

SEQ ID NO: 7788986 - DNA, 22 bp, Homo sapiens
tctttcccctacatttggttaa

SEQ ID NO: 7788987 - DNA, 19 bp, Homo sapiens
tctttagccagagctctgg

SEQ ID NO: 7788988 - DNA, 19 bp, Homo sapiens
tctttagtcacatttttat

SEQ ID NO: 7788989 - DNA, 22 bp, Homo sapiens
tctttagtattgagttatggta

SEQ ID NO: 7788990 - DNA, 22 bp, Homo sapiens
tctttagagcacgggaaaaaca

SEQ ID NO: 7788991 - DNA, 22 bp, Homo sapiens
tctttagagctcagaaatacag

SEQ ID NO: 7788992 - DNA, 22 bp, Homo sapiens
tctttataaaagtcattatgtc

SEQ ID NO: 7788993 - DNA, 22 bp, Homo sapiens
tctttatgagaaaaagattgta

SEQ ID NO: 7788994 - DNA, 22 bp, Homo sapiens
tctttatgcctacctgggaaga

SEQ ID NO: 7788995 - DNA, 22 bp, Homo sapiens
tctttgatgggagatctgagag

SEQ ID NO: 7788996 - DNA, 21 bp, Homo sapiens
tctttgattaagcttgactag

SEQ ID NO: 7788997 - DNA, 22 bp, Homo sapiens
tctttgatacagatgtaagctg

SEQ ID NO: 7788998 - DNA, 22 bp, Homo sapiens
tctttgatggagagatagatat

SEQ ID NO: 7788999 - DNA, 22 bp, Homo sapiens
tctttgatgcttctgaaggtgt

SEQ ID NO: 7789000 - DNA, 22 bp, Homo sapiens
tctttcctagaggctgatgagt

SEQ ID NO: 7789001 - DNA, 23 bp, Homo sapiens
tctttcctaatgaaacagtgaaa

SEQ ID NO: 7789002 - DNA, 22 bp, Homo sapiens
tctttcccttagaacattaaca

SEQ ID NO: 7789003 - DNA, 22 bp, Homo sapiens
tctttccctgtgttagcctgta

SEQ ID NO: 7789004 - DNA, 17 bp, Homo sapiens
tctttccctgggagatg

SEQ ID NO: 7789005 - DNA, 22 bp, Homo sapiens
tctttcccgccagagcatgagt

SEQ ID NO: 7789006 - DNA, 17 bp, Homo sapiens
tctttccctgggagatg

SEQ ID NO: 7789007 - DNA, 17 bp, Homo sapiens
tctttccctgggagatg

SEQ ID NO: 7789008 - DNA, 22 bp, Homo sapiens
tctttccctgtgttagcctgta

SEQ ID NO: 7789009 - DNA, 22 bp, Homo sapiens
tctttctacatcatttgcttct

SEQ ID NO: 7789010 - DNA, 22 bp, Homo sapiens
tcttgggatcacctcctggctt

SEQ ID NO: 7789011 - DNA, 22 bp, Homo sapiens
tcttgggcatgtgtttgatttc

SEQ ID NO: 7789012 - DNA, 22 bp, Homo sapiens
tcttgggaaataaacagattga

SEQ ID NO: 7789013 - DNA, 22 bp, Homo sapiens
tcttgggaccatttacacatac

SEQ ID NO: 7789014 - DNA, 22 bp, Homo sapiens
tcttgggaaatgtttgcgagct

SEQ ID NO: 7789015 - DNA, 22 bp, Homo sapiens
tcttgggagtcccaggacatag

SEQ ID NO: 7789016 - DNA, 22 bp, Homo sapiens
tctttacagtcctctgtcaatc

SEQ ID NO: 7789017 - DNA, 22 bp, Homo sapiens
tctttacacaagacaagaataa

SEQ ID NO: 7789018 - DNA, 22 bp, Homo sapiens
tctttagacatccagtttctct

SEQ ID NO: 7789019 - DNA, 23 bp, Homo sapiens
tctttagaagaacatcagaaatg

SEQ ID NO: 7789020 - DNA, 22 bp, Homo sapiens
tctttagaaacttttcttcatg

SEQ ID NO: 7789021 - DNA, 22 bp, Homo sapiens
tctttacaagtcacattttctg

SEQ ID NO: 7789022 - DNA, 22 bp, Homo sapiens
tcttggaagtagaacacagtct

SEQ ID NO: 7789023 - DNA, 22 bp, Homo sapiens
tcttggactcaaaattgcctta

SEQ ID NO: 7789024 - DNA, 22 bp, Homo sapiens
tcttggattttaatggatcaaa

SEQ ID NO: 7789025 - DNA, 22 bp, Homo sapiens
tcttggccaggtgtggtgcctc

SEQ ID NO: 7789026 - DNA, 22 bp, Homo sapiens
tcttgaaagtatcttattttgt

SEQ ID NO: 7789027 - DNA, 22 bp, Homo sapiens
tcttgctgtgccccagcagggc

SEQ ID NO: 7789028 - DNA, 22 bp, Homo sapiens
tcttgattaataccttagccct

SEQ ID NO: 7789029 - DNA, 22 bp, Homo sapiens
tcttgattgttttctgacctta

SEQ ID NO: 7789030 - DNA, 21 bp, Homo sapiens
tcttgattattggcctcacac

SEQ ID NO: 7789031 - DNA, 22 bp, Homo sapiens
tcttgattcatgttccctgcat

SEQ ID NO: 7789032 - DNA, 22 bp, Homo sapiens
tcttgaggtcatcatctgaaac

SEQ ID NO: 7789033 - DNA, 22 bp, Homo sapiens
tcttctctcatgtaggagggaa

SEQ ID NO: 7789034 - DNA, 22 bp, Homo sapiens
tcttcttatgtgccattatctc

SEQ ID NO: 7789035 - DNA, 22 bp, Homo sapiens
tcttcttcctcatttatacata

SEQ ID NO: 7789036 - DNA, 22 bp, Homo sapiens
tcttcttcctccacagggccca

SEQ ID NO: 7789037 - DNA, 22 bp, Homo sapiens
tcttcttcctccacagggccca

SEQ ID NO: 7789038 - DNA, 21 bp, Homo sapiens
tcttgaaaagttagattctct

SEQ ID NO: 7789039 - DNA, 22 bp, Homo sapiens
tcttgaaagcattttcttcatc

SEQ ID NO: 7789040 - DNA, 22 bp, Homo sapiens
tcttctttggatgaaagaatat

SEQ ID NO: 7789041 - DNA, 22 bp, Homo sapiens
tcttcctttcattcatgtgtta

SEQ ID NO: 7789042 - DNA, 22 bp, Homo sapiens
tcttccttgtaagggctttaga

SEQ ID NO: 7789043 - DNA, 22 bp, Homo sapiens
tcttcctttcattcatgtgtta

SEQ ID NO: 7789044 - DNA, 22 bp, Homo sapiens
tcttccttgccttgcttcatca

SEQ ID NO: 7789045 - DNA, 22 bp, Homo sapiens
tcttccttctttgatgacaagg

SEQ ID NO: 7789046 - DNA, 22 bp, Homo sapiens
tcttcctccctacagagctcag

SEQ ID NO: 7789047 - DNA, 22 bp, Homo sapiens
tcttcctcttctgctgagaagt

SEQ ID NO: 7789048 - DNA, 22 bp, Homo sapiens
tcttcagtatttggataacatt

SEQ ID NO: 7789049 - DNA, 22 bp, Homo sapiens
tcttcaggttaacttgtctttt

SEQ ID NO: 7789050 - DNA, 22 bp, Homo sapiens
tcttcagggtctgccccagggg

SEQ ID NO: 7789051 - DNA, 22 bp, Homo sapiens
tcttcaggtagtgagtggggtg

SEQ ID NO: 7789052 - DNA, 22 bp, Homo sapiens
tcttcaggctctggctgccttt

SEQ ID NO: 7789053 - DNA, 22 bp, Homo sapiens
tcttcagggtatgggaaaggga

SEQ ID NO: 7789054 - DNA, 22 bp, Homo sapiens
tcttcaggagctgaaagcctgc

SEQ ID NO: 7789055 - DNA, 22 bp, Homo sapiens
tcttcaggaagggaaatcatcc

SEQ ID NO: 7789056 - DNA, 22 bp, Homo sapiens
tcttcatacaatttcagacatc

SEQ ID NO: 7789057 - DNA, 22 bp, Homo sapiens
tcttccagagcctccatcccta

SEQ ID NO: 7789058 - DNA, 22 bp, Homo sapiens
tcttccagcaatgtgaaatcac

SEQ ID NO: 7789059 - DNA, 22 bp, Homo sapiens
tcttccagcccttctaatggta

SEQ ID NO: 7789060 - DNA, 22 bp, Homo sapiens
tcttccagccaatagcgtcctt

SEQ ID NO: 7789061 - DNA, 22 bp, Homo sapiens
tcttccagctccccacggtgtc

SEQ ID NO: 7789062 - DNA, 22 bp, Homo sapiens
tcttccaaatgaatatggtttt

SEQ ID NO: 7789063 - DNA, 22 bp, Homo sapiens
tcttcattttatagcatctgtg

SEQ ID NO: 7789064 - DNA, 22 bp, Homo sapiens
tcttcacatgaccttcatgtct

SEQ ID NO: 7789065 - DNA, 22 bp, Homo sapiens
tcttcacaggagcctgcctgcc

SEQ ID NO: 7789066 - DNA, 22 bp, Homo sapiens
tcttcaatttagaatggattta

SEQ ID NO: 7789067 - DNA, 22 bp, Homo sapiens
tcttcacaccgggcagcaggaa

SEQ ID NO: 7789068 - DNA, 22 bp, Homo sapiens
tcttcaatatgtgtttaatatt

SEQ ID NO: 7789069 - DNA, 22 bp, Homo sapiens
tcttcaaatgctagtaatatca

SEQ ID NO: 7789070 - DNA, 22 bp, Homo sapiens
tcttcaaatacagtcatattga

SEQ ID NO: 7789071 - DNA, 22 bp, Homo sapiens
tcttattattgttgtaaaagca

SEQ ID NO: 7789072 - DNA, 22 bp, Homo sapiens
tcttatgggaaagatgtaatta

SEQ ID NO: 7789073 - DNA, 22 bp, Homo sapiens
tcttattttgttagatgctgta

SEQ ID NO: 7789074 - DNA, 22 bp, Homo sapiens
tcttattttttaatgacagaga

SEQ ID NO: 7789075 - DNA, 22 bp, Homo sapiens
tcttcaaaaactgcaccttgct

SEQ ID NO: 7789076 - DNA, 22 bp, Homo sapiens
tctgggctgggagcgtgtggac

SEQ ID NO: 7789077 - DNA, 22 bp, Homo sapiens
tctgggctgtctacaggttggc

SEQ ID NO: 7789078 - DNA, 22 bp, Homo sapiens
tctgggggcgaccagggactgc

SEQ ID NO: 7789079 - DNA, 22 bp, Homo sapiens
tctgggggaggaggcatggccc

SEQ ID NO: 7789080 - DNA, 22 bp, Homo sapiens
tctgggggcgaccagggactgc

SEQ ID NO: 7789081 - DNA, 21 bp, Homo sapiens
tctgggggtgagcctagaaat

SEQ ID NO: 7789082 - DNA, 22 bp, Homo sapiens
tctgggggttaagtgaggacaa

SEQ ID NO: 7789083 - DNA, 22 bp, Homo sapiens
tctgggggttaagtgaggacaa

SEQ ID NO: 7789084 - DNA, 22 bp, Homo sapiens
tctggggtcacctggggtgctt

SEQ ID NO: 7789085 - DNA, 18 bp, Homo sapiens
tctggggtgtgctgtgta

SEQ ID NO: 7789086 - DNA, 19 bp, Homo sapiens
tctggggtgtggcctggca

SEQ ID NO: 7789087 - DNA, 22 bp, Homo sapiens
tctgggtgaccctgggcaaggc

SEQ ID NO: 7789088 - DNA, 22 bp, Homo sapiens
tctgtaaaacttctttgtaaat

SEQ ID NO: 7789089 - DNA, 22 bp, Homo sapiens
tctgggtgtagggcctggcaac

SEQ ID NO: 7789090 - DNA, 20 bp, Homo sapiens
tctgtctctgagctagactt

SEQ ID NO: 7789091 - DNA, 22 bp, Homo sapiens
tctgtataaggacaaacattta

SEQ ID NO: 7789092 - DNA, 22 bp, Homo sapiens
tctgtagggtagtagtggagat

SEQ ID NO: 7789093 - DNA, 22 bp, Homo sapiens
tctgtaggttaaaagtagacaa

SEQ ID NO: 7789094 - DNA, 20 bp, Homo sapiens
tctgtaggcaagttagcagg

SEQ ID NO: 7789095 - DNA, 22 bp, Homo sapiens
tctgtaggacagagaaatgggg

SEQ ID NO: 7789096 - DNA, 22 bp, Homo sapiens
tctgtaggacagagaaatgggg

SEQ ID NO: 7789097 - DNA, 22 bp, Homo sapiens
tctgttttagataagaaaggct

SEQ ID NO: 7789098 - DNA, 22 bp, Homo sapiens
tctgttttgtaccagatacagc

SEQ ID NO: 7789099 - DNA, 22 bp, Homo sapiens
tctgttttgtaccagatacagc

SEQ ID NO: 7789100 - DNA, 22 bp, Homo sapiens
tctgttttggtcacctttatat

SEQ ID NO: 7789101 - DNA, 22 bp, Homo sapiens
tcttaaaagtatgccaattgga

SEQ ID NO: 7789102 - DNA, 22 bp, Homo sapiens
tcttaaatgactgataagagga

SEQ ID NO: 7789103 - DNA, 20 bp, Homo sapiens
tcttaaatccccagggccat

SEQ ID NO: 7789104 - DNA, 22 bp, Homo sapiens
tcttaatgaaagtgaaatatca

SEQ ID NO: 7789105 - DNA, 22 bp, Homo sapiens
tcttaggagtagaattctcaca

SEQ ID NO: 7789106 - DNA, 22 bp, Homo sapiens
tcttagatgttagctctgtgtg

SEQ ID NO: 7789107 - DNA, 22 bp, Homo sapiens
tctgtttaggcaaaatagctac

SEQ ID NO: 7789108 - DNA, 22 bp, Homo sapiens
tctgttggttctgtttctctga

SEQ ID NO: 7789109 - DNA, 21 bp, Homo sapiens
tctgttggaggcctctcttcc

SEQ ID NO: 7789110 - DNA, 21 bp, Homo sapiens
tctgtgctgccgtcaacatcc

SEQ ID NO: 7789111 - DNA, 22 bp, Homo sapiens
tctgtgctgagctctgagatgt

SEQ ID NO: 7789112 - DNA, 22 bp, Homo sapiens
tctgtggtggagtgggcatgag

SEQ ID NO: 7789113 - DNA, 22 bp, Homo sapiens
tctgtgtatttgtgacctgtat

SEQ ID NO: 7789114 - DNA, 23 bp, Homo sapiens
tctgtgtctccacccaaatctca

SEQ ID NO: 7789115 - DNA, 22 bp, Homo sapiens
tctgtgtctgcagaagttcagc

SEQ ID NO: 7789116 - DNA, 22 bp, Homo sapiens
tctgtgcactaacattcctggt

SEQ ID NO: 7789117 - DNA, 22 bp, Homo sapiens
tctgtgctaatgcttcacaata

SEQ ID NO: 7789118 - DNA, 22 bp, Homo sapiens
tctgtgcaccagaatgatattt

SEQ ID NO: 7789119 - DNA, 22 bp, Homo sapiens
tctgtgataggaaaataaatgg

SEQ ID NO: 7789120 - DNA, 22 bp, Homo sapiens
tctggctgaaaggggctgtgcc

SEQ ID NO: 7789121 - DNA, 22 bp, Homo sapiens
tctggctgaaaggggctgtgcc

SEQ ID NO: 7789122 - DNA, 22 bp, Homo sapiens
tctggctgaattagccttgggt

SEQ ID NO: 7789123 - DNA, 22 bp, Homo sapiens
tctggctgaaattagaaggttc

SEQ ID NO: 7789124 - DNA, 22 bp, Homo sapiens
tctggctcctggctccactgcc

SEQ ID NO: 7789125 - DNA, 22 bp, Homo sapiens
tctggctctataactcctagct

SEQ ID NO: 7789126 - DNA, 22 bp, Homo sapiens
tctggctccactctgtgcatgc

SEQ ID NO: 7789127 - DNA, 22 bp, Homo sapiens
tctggctccctggagctccaca

SEQ ID NO: 7789128 - DNA, 22 bp, Homo sapiens
tctggctgggaagggggcccga

SEQ ID NO: 7789129 - DNA, 22 bp, Homo sapiens
tctggctgggtgagagcttctc

SEQ ID NO: 7789130 - DNA, 22 bp, Homo sapiens
tctggctgtgtaatatgtgtag

SEQ ID NO: 7789131 - DNA, 22 bp, Homo sapiens
tctggctgtgtaaggtagcacc

SEQ ID NO: 7789132 - DNA, 22 bp, Homo sapiens
tctggctgtcattggaggcccc

SEQ ID NO: 7789133 - DNA, 22 bp, Homo sapiens
tctggctgtcattggaggcccc

SEQ ID NO: 7789134 - DNA, 22 bp, Homo sapiens
tctggctgctgcgtgagtgctt

SEQ ID NO: 7789135 - DNA, 22 bp, Homo sapiens
tctggctggcagtgatggtgtg

SEQ ID NO: 7789136 - DNA, 22 bp, Homo sapiens
tctggctggctcggccgggagt

SEQ ID NO: 7789137 - DNA, 22 bp, Homo sapiens
tctggctggctcggccgggagt

SEQ ID NO: 7789138 - DNA, 22 bp, Homo sapiens
tctggctgacatcctgtatgag

SEQ ID NO: 7789139 - DNA, 22 bp, Homo sapiens
tctggctgattccctgggactg

SEQ ID NO: 7789140 - DNA, 22 bp, Homo sapiens
tctggctgcaccattatagtag

SEQ ID NO: 7789141 - DNA, 23 bp, Homo sapiens
tctggctgctcctttcaatgctc

SEQ ID NO: 7789142 - DNA, 22 bp, Homo sapiens
tctgggctgctatgaggcagag

SEQ ID NO: 7789143 - DNA, 21 bp, Homo sapiens
tctgggcccatgctgcctcac

SEQ ID NO: 7789144 - DNA, 23 bp, Homo sapiens
tctgggccacttgtctgcacttc

SEQ ID NO: 7789145 - DNA, 20 bp, Homo sapiens
tctgggcagggcacatggaa

SEQ ID NO: 7789146 - DNA, 22 bp, Homo sapiens
tctgggagtaaggcctaggcat

SEQ ID NO: 7789147 - DNA, 22 bp, Homo sapiens
tctgggagtgggtccaaggaat

SEQ ID NO: 7789148 - DNA, 22 bp, Homo sapiens
tctggcagtaataggggagaga

SEQ ID NO: 7789149 - DNA, 22 bp, Homo sapiens
tctggcatggatttgagtgtct

SEQ ID NO: 7789150 - DNA, 22 bp, Homo sapiens
tctggcatcactcgcaagagca

SEQ ID NO: 7789151 - DNA, 22 bp, Homo sapiens
tctggcattttggctgggaaac

SEQ ID NO: 7789152 - DNA, 22 bp, Homo sapiens
tctggagtatgtgtgaacggtg

SEQ ID NO: 7789153 - DNA, 22 bp, Homo sapiens
tctggagtatgtccctggtgaa

SEQ ID NO: 7789154 - DNA, 22 bp, Homo sapiens
tctggagtaggacctgaaaata

SEQ ID NO: 7789155 - DNA, 22 bp, Homo sapiens
tctggagtaactctgtttctgg

SEQ ID NO: 7789156 - DNA, 22 bp, Homo sapiens
tctggagtccagatccatttgg

SEQ ID NO: 7789157 - DNA, 22 bp, Homo sapiens
tctggagtctaaagaaccaaaa

SEQ ID NO: 7789158 - DNA, 22 bp, Homo sapiens
tctggagtgccctgctctgccc

SEQ ID NO: 7789159 - DNA, 22 bp, Homo sapiens
tctggagtggagctgatcattt

SEQ ID NO: 7789160 - DNA, 22 bp, Homo sapiens
tctggaggctctgagggtgagt

SEQ ID NO: 7789161 - DNA, 17 bp, Homo sapiens
tctggatgtcatggaag

SEQ ID NO: 7789162 - DNA, 22 bp, Homo sapiens
tctggagttactgctggctttg

SEQ ID NO: 7789163 - DNA, 22 bp, Homo sapiens
tctggagtgtgtgtattcagct

SEQ ID NO: 7789164 - DNA, 22 bp, Homo sapiens
tctggagtggaggtgccttggg

SEQ ID NO: 7789165 - DNA, 22 bp, Homo sapiens
tctggagtgggactttgcatct

SEQ ID NO: 7789166 - DNA, 22 bp, Homo sapiens
tctggagtggcagtcatctgaa

SEQ ID NO: 7789167 - DNA, 22 bp, Homo sapiens
tctggagtgtccagttctactc

SEQ ID NO: 7789168 - DNA, 22 bp, Homo sapiens
tctggagtttgaggacaagctt

SEQ ID NO: 7789169 - DNA, 22 bp, Homo sapiens
tctggagttttttctgtctgtg

SEQ ID NO: 7789170 - DNA, 22 bp, Homo sapiens
tctgctgtgttgaatgattggt

SEQ ID NO: 7789171 - DNA, 22 bp, Homo sapiens
tctgctggttccgaattaggcc

SEQ ID NO: 7789172 - DNA, 23 bp, Homo sapiens
tctgctggtgacacggtcacatt

SEQ ID NO: 7789173 - DNA, 22 bp, Homo sapiens
tctgctggtcaaggctgggtcc

SEQ ID NO: 7789174 - DNA, 22 bp, Homo sapiens
tctgctggaaaaccagggaatt

SEQ ID NO: 7789175 - DNA, 19 bp, Homo sapiens
tctgctggcagaattccct

SEQ ID NO: 7789176 - DNA, 22 bp, Homo sapiens
tctgctggccttagcaggtcta

SEQ ID NO: 7789177 - DNA, 22 bp, Homo sapiens
tctggactaacagcagcctcag

SEQ ID NO: 7789178 - DNA, 22 bp, Homo sapiens
tctggaattaaactcaggagac

SEQ ID NO: 7789179 - DNA, 22 bp, Homo sapiens
tctggagaacttgcaagaggat

SEQ ID NO: 7789180 - DNA, 22 bp, Homo sapiens
tctggagaaagttgagtttgtg

SEQ ID NO: 7789181 - DNA, 22 bp, Homo sapiens
tctggagaaggaagagtctttg

SEQ ID NO: 7789182 - DNA, 22 bp, Homo sapiens
tctggagaatctgtcagtgtgg

SEQ ID NO: 7789183 - DNA, 22 bp, Homo sapiens
tctggagaatctgtcagtgtgg

SEQ ID NO: 7789184 - DNA, 22 bp, Homo sapiens
tctggagaggaggatgtggaca

SEQ ID NO: 7789185 - DNA, 22 bp, Homo sapiens
tctggagaggggcctagaattt

SEQ ID NO: 7789186 - DNA, 22 bp, Homo sapiens
tctggagataagacagacagat

SEQ ID NO: 7789187 - DNA, 22 bp, Homo sapiens
tctggagagtcacagtgccaga

SEQ ID NO: 7789188 - DNA, 22 bp, Homo sapiens
tctgccctggggtcagcctcca

SEQ ID NO: 7789189 - DNA, 18 bp, Homo sapiens
tctgccctgccattcact

SEQ ID NO: 7789190 - DNA, 22 bp, Homo sapiens
tctgcccactgctctgctgccc

SEQ ID NO: 7789191 - DNA, 22 bp, Homo sapiens
tctgccctaattcagtgcttag

SEQ ID NO: 7789192 - DNA, 22 bp, Homo sapiens
tctgccctcattgctgcctgga

SEQ ID NO: 7789193 - DNA, 22 bp, Homo sapiens
tctgcagccagaggcatgaaaa

SEQ ID NO: 7789194 - DNA, 20 bp, Homo sapiens
tctgcagcacttgacaatgt

SEQ ID NO: 7789195 - DNA, 22 bp, Homo sapiens
tctgcagcgtgcaggctggtgc

SEQ ID NO: 7789196 - DNA, 22 bp, Homo sapiens
tctgcagcccaaagtctcttag

SEQ ID NO: 7789197 - DNA, 22 bp, Homo sapiens
tctgcagcacttaatgtttcgt

SEQ ID NO: 7789198 - DNA, 22 bp, Homo sapiens
tctgcagcaacctttcacctcc

SEQ ID NO: 7789199 - DNA, 20 bp, Homo sapiens
tctgcactcctgcatgtgcc

SEQ ID NO: 7789200 - DNA, 18 bp, Homo sapiens
tctgcactcctgagagag

SEQ ID NO: 7789201 - DNA, 22 bp, Homo sapiens
tctgcaccccgcagggtcaggt

SEQ ID NO: 7789202 - DNA, 22 bp, Homo sapiens
tctgcacccttctgggttggaa

SEQ ID NO: 7789203 - DNA, 22 bp, Homo sapiens
tctgcaccctgtggtcctctag

SEQ ID NO: 7789204 - DNA, 19 bp, Homo sapiens
tctgcaagtgtcagaggcg

SEQ ID NO: 7789205 - DNA, 22 bp, Homo sapiens
tctgcaagtgacccgggcccag

SEQ ID NO: 7789206 - DNA, 22 bp, Homo sapiens
tctgcaaggggttctttaggcc

SEQ ID NO: 7789207 - DNA, 22 bp, Homo sapiens
tctgcacaccgccaggctgact

SEQ ID NO: 7789208 - DNA, 22 bp, Homo sapiens
tctgcacataggtaggctggaa

SEQ ID NO: 7789209 - DNA, 22 bp, Homo sapiens
tctgcacaggagggccgtggtg

SEQ ID NO: 7789210 - DNA, 21 bp, Homo sapiens
tctgcacagccccgcaggagg

SEQ ID NO: 7789211 - DNA, 22 bp, Homo sapiens
tctgcagctttttggtggggtg

SEQ ID NO: 7789212 - DNA, 22 bp, Homo sapiens
tctgcagctttcccctgattta

SEQ ID NO: 7789213 - DNA, 22 bp, Homo sapiens
tctgcagcttactttcacatga

SEQ ID NO: 7789214 - DNA, 22 bp, Homo sapiens
tctgcagcttactttcacatga

SEQ ID NO: 7789215 - DNA, 22 bp, Homo sapiens
tctgcagcttgcacaggcaggc

SEQ ID NO: 7789216 - DNA, 22 bp, Homo sapiens
tctgcagcttcttgccagagag

SEQ ID NO: 7789217 - DNA, 22 bp, Homo sapiens
tctgcaggctctagatgaggtt

SEQ ID NO: 7789218 - DNA, 22 bp, Homo sapiens
tctgcaggatggatgctcagaa

SEQ ID NO: 7789219 - DNA, 22 bp, Homo sapiens
tctgcaggcatttttggttgtc

SEQ ID NO: 7789220 - DNA, 22 bp, Homo sapiens
tctgcaggaggctggctgcagg

SEQ ID NO: 7789221 - DNA, 22 bp, Homo sapiens
tctgcaggagcagggcgtggag

SEQ ID NO: 7789222 - DNA, 22 bp, Homo sapiens
tctgcaggcttataggatgggt

SEQ ID NO: 7789223 - DNA, 22 bp, Homo sapiens
tctgcagggatgtgaggggtga

SEQ ID NO: 7789224 - DNA, 22 bp, Homo sapiens
tctgcaggtgttggaagggtca

SEQ ID NO: 7789225 - DNA, 22 bp, Homo sapiens
tctgccagtattcacggcccgt

SEQ ID NO: 7789226 - DNA, 22 bp, Homo sapiens
tctgccagtgccagagtacata

SEQ ID NO: 7789227 - DNA, 22 bp, Homo sapiens
tctgccaggccacacagggcac

SEQ ID NO: 7789228 - DNA, 22 bp, Homo sapiens
tctgaggaatcttgacacattt

SEQ ID NO: 7789229 - DNA, 22 bp, Homo sapiens
tctgagggtgggagaaggagct

SEQ ID NO: 7789230 - DNA, 22 bp, Homo sapiens
tctgaggctgcatctatgtgac

SEQ ID NO: 7789231 - DNA, 22 bp, Homo sapiens
tctgcaagatggtcttagaggt

SEQ ID NO: 7789232 - DNA, 22 bp, Homo sapiens
tctgagagatacaaggaggcaa

SEQ ID NO: 7789233 - DNA, 22 bp, Homo sapiens
tctgagccagacaagacagcca

SEQ ID NO: 7789234 - DNA, 22 bp, Homo sapiens
tctgagcccctagaactgagcg

SEQ ID NO: 7789235 - DNA, 21 bp, Homo sapiens
tctgagctgagtcctctaggt

SEQ ID NO: 7789236 - DNA, 22 bp, Homo sapiens
tctgagctgtaagtagacaagg

SEQ ID NO: 7789237 - DNA, 22 bp, Homo sapiens
tctgagctgggcacagaaggcg

SEQ ID NO: 7789238 - DNA, 22 bp, Homo sapiens
tctgagcttctgcctgctgcaa

SEQ ID NO: 7789239 - DNA, 22 bp, Homo sapiens
tctgagcttactcagggataca

SEQ ID NO: 7789240 - DNA, 22 bp, Homo sapiens
tctgacattttgagaatgacat

SEQ ID NO: 7789241 - DNA, 22 bp, Homo sapiens
tctgacattttgagaatgacat

SEQ ID NO: 7789242 - DNA, 22 bp, Homo sapiens
tctgacttggcgctcttgtctt

SEQ ID NO: 7789243 - DNA, 22 bp, Homo sapiens
tctgacttgcatcttaaaggag

SEQ ID NO: 7789244 - DNA, 22 bp, Homo sapiens
tctgacattagattaattggaa

SEQ ID NO: 7789245 - DNA, 22 bp, Homo sapiens
tctgacattagattaattggaa

SEQ ID NO: 7789246 - DNA, 21 bp, Homo sapiens
tctgagaacttctgctgcagc

SEQ ID NO: 7789247 - DNA, 22 bp, Homo sapiens
tctgagaatgagtgttttctta

SEQ ID NO: 7789248 - DNA, 22 bp, Homo sapiens
tctgagaatagtgccactgtgg

SEQ ID NO: 7789249 - DNA, 22 bp, Homo sapiens
ttccaggaacaaactcacctta

SEQ ID NO: 7789250 - DNA, 22 bp, Homo sapiens
agataacttttgggtattcatg

SEQ ID NO: 7789251 - DNA, 22 bp, Homo sapiens
agataactcattttgtatatcc

SEQ ID NO: 7789252 - DNA, 18 bp, Homo sapiens
aatgtgaatatttacttc

SEQ ID NO: 7789253 - DNA, 22 bp, Homo sapiens
acattgttgtgcaattatagtt

SEQ ID NO: 7789254 - DNA, 19 bp, Homo sapiens
acatttaaattcagatctc

SEQ ID NO: 7789255 - DNA, 22 bp, Homo sapiens
acatttctgctagaataggtga

SEQ ID NO: 7789256 - DNA, 22 bp, Homo sapiens
acatttctgcatctcagagcta

SEQ ID NO: 7789257 - DNA, 22 bp, Homo sapiens
aagctattgaatttatagcata

SEQ ID NO: 7789258 - DNA, 22 bp, Homo sapiens
aagcatttttcacagcaacagc

SEQ ID NO: 7789259 - DNA, 22 bp, Homo sapiens
aagcattttgttttaagaatga

SEQ ID NO: 7789260 - DNA, 22 bp, Homo sapiens
aagcattttgccacttgaagtt

SEQ ID NO: 7789261 - DNA, 22 bp, Homo sapiens
aagcattttagtaatgaacttg

SEQ ID NO: 7789262 - DNA, 22 bp, Homo sapiens
aagcattttagataaagcatca

SEQ ID NO: 7789263 - DNA, 20 bp, Homo sapiens
acatatgaatgatagagcca

SEQ ID NO: 7789264 - DNA, 22 bp, Homo sapiens
aatcagttagaaggaagagaat

SEQ ID NO: 7789265 - DNA, 22 bp, Homo sapiens
aatcagttgttcactctgaaaa

SEQ ID NO: 7789266 - DNA, 22 bp, Homo sapiens
agaaattattagtgaatagtct

SEQ ID NO: 7789267 - DNA, 22 bp, Homo sapiens
aatatagaatcactttccttca

SEQ ID NO: 7789268 - DNA, 22 bp, Homo sapiens
aagcagacagagaatgggtttg

SEQ ID NO: 7789269 - DNA, 22 bp, Homo sapiens
aagcagacatcccatacttttg

SEQ ID NO: 7789270 - DNA, 22 bp, Homo sapiens
aagcaattggttttagtaaaat

SEQ ID NO: 7789271 - DNA, 22 bp, Homo sapiens
aacacaatcttccagtttgctg

SEQ ID NO: 7789272 - DNA, 22 bp, Homo sapiens
aaatgtcagaggaacatattga

SEQ ID NO: 7789273 - DNA, 22 bp, Homo sapiens
aacatcatcatgaacaactaat

SEQ ID NO: 7789274 - DNA, 22 bp, Homo sapiens
aacatgttgctttaataatatt

SEQ ID NO: 7789275 - DNA, 22 bp, Homo sapiens
aatgaacaacactgaaggaaga

SEQ ID NO: 7789276 - DNA, 20 bp, Homo sapiens
aaacattcatgtacaagtga

SEQ ID NO: 7789277 - DNA, 22 bp, Homo sapiens
aaacatgttttctgaatatttt

SEQ ID NO: 7789278 - DNA, 22 bp, Homo sapiens
aaaattattcatggcttttgga

SEQ ID NO: 7789279 - DNA, 22 bp, Homo sapiens
aaaacataaactgacagcccat

SEQ ID NO: 7789280 - DNA, 22 bp, Homo sapiens
aaacactagcaggaagcactga

SEQ ID NO: 7789281 - DNA, 22 bp, Homo sapiens
aaacacattttaggaaaatcta

SEQ ID NO: 7789282 - DNA, 22 bp, Homo sapiens
aagatattcaaagatttattag

SEQ ID NO: 7789283 - DNA, 22 bp, Homo sapiens
aagaacatgctataattatctt

SEQ ID NO: 7789284 - DNA, 22 bp, Homo sapiens
aagaacatggtaggataacaaa

SEQ ID NO: 7789285 - DNA, 22 bp, Homo sapiens
aagataaactcttgatttctga

SEQ ID NO: 7789286 - DNA, 22 bp, Homo sapiens
aagaaataagacttctctgtcc

SEQ ID NO: 7789287 - DNA, 22 bp, Homo sapiens
aagaacatgaagtcacaaatgc

SEQ ID NO: 7789288 - DNA, 22 bp, Homo sapiens
aagaacatgagttatgatgatt

SEQ ID NO: 7789289 - DNA, 22 bp, Homo sapiens
aagaacataacagaagctgtgt

SEQ ID NO: 7789290 - DNA, 22 bp, Homo sapiens
aacatataaactcttaagttca

SEQ ID NO: 7789291 - DNA, 22 bp, Homo sapiens
aaagcagaactgagagagctgg

SEQ ID NO: 7789292 - DNA, 22 bp, Homo sapiens
aaagcacttcaggagcagtttg

SEQ ID NO: 7789293 - DNA, 22 bp, Homo sapiens
aaagcagagcagggcacttatg

SEQ ID NO: 7789294 - DNA, 22 bp, Homo sapiens
aaagcagagatcatggcttgta

SEQ ID NO: 7789295 - DNA, 22 bp, Homo sapiens
aaagcagactgatttgcatcac

SEQ ID NO: 7789296 - DNA, 22 bp, Homo sapiens
aaagcactctatcctttgtaga

SEQ ID NO: 7789297 - DNA, 22 bp, Homo sapiens
aaagcactggagtcatcatcta

SEQ ID NO: 7789298 - DNA, 22 bp, Homo sapiens
aaagcactgcacatatatttgc

SEQ ID NO: 7789299 - DNA, 22 bp, Homo sapiens
aaagcagaggttgcagtgagct

SEQ ID NO: 7789300 - DNA, 22 bp, Homo sapiens
aaagcagaggtgatatgactta

SEQ ID NO: 7789301 - DNA, 19 bp, Homo sapiens
aaagcagaggagcatctga

SEQ ID NO: 7789302 - DNA, 22 bp, Homo sapiens
aaagcagattctgatgcagtag

SEQ ID NO: 7789303 - DNA, 22 bp, Homo sapiens
atatcctttgtgtaggcaattt

SEQ ID NO: 7789304 - DNA, 22 bp, Homo sapiens
atatcttctttattttgtgagg

SEQ ID NO: 7789305 - DNA, 22 bp, Homo sapiens
atatatttgagaatattcatga

SEQ ID NO: 7789306 - DNA, 22 bp, Homo sapiens
atcatttgcctcaagtgaaagt

SEQ ID NO: 7789307 - DNA, 22 bp, Homo sapiens
atcattttatggctgagaggac

SEQ ID NO: 7789308 - DNA, 22 bp, Homo sapiens
acttcataaattagactaatgg

SEQ ID NO: 7789309 - DNA, 22 bp, Homo sapiens
agtttcctcatctgtaaaatga

SEQ ID NO: 7789310 - DNA, 19 bp, Homo sapiens
acctggctggcgcacttgt

SEQ ID NO: 7789311 - DNA, 23 bp, Homo sapiens
acctggctgctcaacctgcaggg

SEQ ID NO: 7789312 - DNA, 22 bp, Homo sapiens
acctggctggttgtgattccca

SEQ ID NO: 7789313 - DNA, 22 bp, Homo sapiens
acatttttctaggaggcaaggt

SEQ ID NO: 7789314 - DNA, 22 bp, Homo sapiens
acatttttgggttgatgtctga

SEQ ID NO: 7789315 - DNA, 22 bp, Homo sapiens
acattttttagagtcccacatt

SEQ ID NO: 7789316 - DNA, 22 bp, Homo sapiens
acatttttcacatttgtagggt

SEQ ID NO: 7789317 - DNA, 22 bp, Homo sapiens
acatttttattcatcaaagcag

SEQ ID NO: 7789318 - DNA, 22 bp, Homo sapiens
acatttttatcctgagtgccag

SEQ ID NO: 7789319 - DNA, 22 bp, Homo sapiens
acatttttactgggcatctgca

SEQ ID NO: 7789320 - DNA, 22 bp, Homo sapiens
acatttaaccctcaggtttctg

SEQ ID NO: 7789321 - DNA, 22 bp, Homo sapiens
acatttaaccaaactgtttaat

SEQ ID NO: 7789322 - DNA, 22 bp, Homo sapiens
acatttaatgatcctactgtga

SEQ ID NO: 7789323 - DNA, 22 bp, Homo sapiens
atgttaaatggtttattattaa

SEQ ID NO: 7789324 - DNA, 22 bp, Homo sapiens
attaaacaatgtaaagttcttg

SEQ ID NO: 7789325 - DNA, 22 bp, Homo sapiens
attctctgtttccaagatgaaa

SEQ ID NO: 7789326 - DNA, 22 bp, Homo sapiens
atttgctttcaggtataaaagg

SEQ ID NO: 7789327 - DNA, 22 bp, Homo sapiens
atttgctttaaggtataaaagg

SEQ ID NO: 7789328 - DNA, 18 bp, Homo sapiens
agatgaaagcaaatgaca

SEQ ID NO: 7789329 - DNA, 21 bp, Homo sapiens
agaataatggtatcatttgct

SEQ ID NO: 7789330 - DNA, 22 bp, Homo sapiens
agaatataaagataattctgtt

SEQ ID NO: 7789331 - DNA, 22 bp, Homo sapiens
attttctctttgtatatgctag

SEQ ID NO: 7789332 - DNA, 22 bp, Homo sapiens
attttctgagtccagaatttac

SEQ ID NO: 7789333 - DNA, 22 bp, Homo sapiens
caaatgttaagacaggatcaag

SEQ ID NO: 7789334 - DNA, 22 bp, Homo sapiens
caaatgttgctgtaatgtttgt

SEQ ID NO: 7789335 - DNA, 22 bp, Homo sapiens
caaatgtttttattctacaaca

SEQ ID NO: 7789336 - DNA, 22 bp, Homo sapiens
caaatgtttgcatcacagggca

SEQ ID NO: 7789337 - DNA, 22 bp, Homo sapiens
caaatgtttcttgaacaccaac

SEQ ID NO: 7789338 - DNA, 22 bp, Homo sapiens
cagaagaatggtgtctgagctc

SEQ ID NO: 7789339 - DNA, 22 bp, Homo sapiens
aggaaataggaccagacaaagc

SEQ ID NO: 7789340 - DNA, 22 bp, Homo sapiens
atcattttgtgacaatgcctgt

SEQ ID NO: 7789341 - DNA, 22 bp, Homo sapiens
atataacatacatacagaaaag

SEQ ID NO: 7789342 - DNA, 22 bp, Homo sapiens
atatttctgggggtgtgtttct

SEQ ID NO: 7789343 - DNA, 22 bp, Homo sapiens
atatgacataaaatcatttttg

SEQ ID NO: 7789344 - DNA, 22 bp, Homo sapiens
ataatcagaattcatgaaagat

SEQ ID NO: 7789345 - DNA, 22 bp, Homo sapiens
ataatcaaagtcctatgacatc

SEQ ID NO: 7789346 - DNA, 20 bp, Homo sapiens
ataaaataactgccacaaga

SEQ ID NO: 7789347 - DNA, 22 bp, Homo sapiens
ataaatatcactgttgtccctc

SEQ ID NO: 7789348 - DNA, 17 bp, Homo sapiens
ctctggaattggtgaag

SEQ ID NO: 7789349 - DNA, 22 bp, Homo sapiens
ctccttctgggcctggcagtgg

SEQ ID NO: 7789350 - DNA, 22 bp, Homo sapiens
ctccttctgaggctctgggttc

SEQ ID NO: 7789351 - DNA, 22 bp, Homo sapiens
agtatgaagctgaatgatttta

SEQ ID NO: 7789352 - DNA, 18 bp, Homo sapiens
ggctcaagtgatcctcct

SEQ ID NO: 7789353 - DNA, 22 bp, Homo sapiens
ggaaaatactgattcatgccat

SEQ ID NO: 7789354 - DNA, 22 bp, Homo sapiens
caagataagatcatttacacta

SEQ ID NO: 7789355 - DNA, 22 bp, Homo sapiens
caacatgtgttagacaatagac

SEQ ID NO: 7789356 - DNA, 20 bp, Homo sapiens
attgaaatttttctgagatt

SEQ ID NO: 7789357 - DNA, 22 bp, Homo sapiens
attgaaaaatgactattgctta

SEQ ID NO: 7789358 - DNA, 22 bp, Homo sapiens
attccttctattctctgtgggt

SEQ ID NO: 7789359 - DNA, 22 bp, Homo sapiens
attccttctaaaacgctgccct

SEQ ID NO: 7789360 - DNA, 22 bp, Homo sapiens
attaaatgttggcatattttgt

SEQ ID NO: 7789361 - DNA, 22 bp, Homo sapiens
caaaacattctctgcagcaggg

SEQ ID NO: 7789362 - DNA, 22 bp, Homo sapiens
caaaacattcagagagctcact

SEQ ID NO: 7789363 - DNA, 22 bp, Homo sapiens
gcctggctgaggcctctgctaa

SEQ ID NO: 7789364 - DNA, 22 bp, Homo sapiens
gcctggctgaggtggggaggca

SEQ ID NO: 7789365 - DNA, 22 bp, Homo sapiens
atttcatagattgtaaatccct

SEQ ID NO: 7789366 - DNA, 22 bp, Homo sapiens
atttcatatgtatcacctagcc

SEQ ID NO: 7789367 - DNA, 22 bp, Homo sapiens
atttcatactaaggctcaaaaa

SEQ ID NO: 7789368 - DNA, 22 bp, Homo sapiens
atttctacagtacacatgcatt

SEQ ID NO: 7789369 - DNA, 18 bp, Homo sapiens
atttctactactataaag

SEQ ID NO: 7789370 - DNA, 22 bp, Homo sapiens
atttccttcccagatttggttc

SEQ ID NO: 7789371 - DNA, 22 bp, Homo sapiens
atttccttcggacagtttgggt

SEQ ID NO: 7789372 - DNA, 22 bp, Homo sapiens
atttccttgcaagtttctgtaa

SEQ ID NO: 7789373 - DNA, 22 bp, Homo sapiens
atttccttgcaacttaggcatg

SEQ ID NO: 7789374 - DNA, 22 bp, Homo sapiens
atttcctttgcaaagactgtgc

SEQ ID NO: 7789375 - DNA, 16 bp, Homo sapiens
atttccttgtgagttt

SEQ ID NO: 7789376 - DNA, 22 bp, Homo sapiens
atttagaaattccaaaagtatt

SEQ ID NO: 7789377 - DNA, 22 bp, Homo sapiens
atgtgtatgatacctttgctga

SEQ ID NO: 7789378 - DNA, 22 bp, Homo sapiens
gagcagtgactggagcatgaga

SEQ ID NO: 7789379 - DNA, 22 bp, Homo sapiens
atcttgaaggttctaccataca

SEQ ID NO: 7789380 - DNA, 22 bp, Homo sapiens
atcttgaaatactttctagaat

SEQ ID NO: 7789381 - DNA, 22 bp, Homo sapiens
atcttccttcactttctcccac

SEQ ID NO: 7789382 - DNA, 19 bp, Homo sapiens
cttttcatcaacagccaat

SEQ ID NO: 7789383 - DNA, 22 bp, Homo sapiens
atgaaatatttcagagcagagt

SEQ ID NO: 7789384 - DNA, 22 bp, Homo sapiens
atgaaatatcttgaagaaattc

SEQ ID NO: 7789385 - DNA, 22 bp, Homo sapiens
tattaaagggaagttatgcatg

SEQ ID NO: 7789386 - DNA, 22 bp, Homo sapiens
tattaaagagagaatcatcatc

SEQ ID NO: 7789387 - DNA, 22 bp, Homo sapiens
tatgtgtacaaatcagtaagtg

SEQ ID NO: 7789388 - DNA, 17 bp, Homo sapiens
tatctcatacaattata

SEQ ID NO: 7789389 - DNA, 22 bp, Homo sapiens
catacattttgcatatttacca

SEQ ID NO: 7789390 - DNA, 22 bp, Homo sapiens
catctttagttattgaatatag

SEQ ID NO: 7789391 - DNA, 22 bp, Homo sapiens
tcattttcacacataaatagca

SEQ ID NO: 7789392 - DNA, 22 bp, Homo sapiens
tctgcggtccccttctcgccct

SEQ ID NO: 7789393 - DNA, 22 bp, Homo sapiens
tctgataaatgccatctttttg

SEQ ID NO: 7789394 - DNA, 22 bp, Homo sapiens
catttatgatagtaatatgaaa

SEQ ID NO: 7789395 - DNA, 22 bp, Homo sapiens
catttagttatactaaaacatt

SEQ ID NO: 7789396 - DNA, 22 bp, Homo sapiens
tccctgctgggagatgacctta

SEQ ID NO: 7789397 - DNA, 22 bp, Homo sapiens
taaaaagcagctgagattttct

SEQ ID NO: 7789398 - DNA, 22 bp, Homo sapiens
taaaatcaccaaaagcaggtgg

SEQ ID NO: 7789399 - DNA, 22 bp, Homo sapiens
taaacatttgttattcttgttt

SEQ ID NO: 7789400 - DNA, 22 bp, Homo sapiens
taaagcatttttgaaattatga

SEQ ID NO: 7789401 - DNA, 22 bp, Homo sapiens
taaagcatgtgttagaagtgca

SEQ ID NO: 7789402 - DNA, 22 bp, Homo sapiens
taaagcatgtttcagtaaggtt

SEQ ID NO: 7789403 - DNA, 22 bp, Homo sapiens
taaatatcagtccagctcttcc

SEQ ID NO: 7789404 - DNA, 22 bp, Homo sapiens
taaagcataatgaatatctaga

SEQ ID NO: 7789405 - DNA, 22 bp, Homo sapiens
tacaaatgggttaaaatatagt

SEQ ID NO: 7789406 - DNA, 22 bp, Homo sapiens
taatgttagtatgtaatcttat

SEQ ID NO: 7789407 - DNA, 22 bp, Homo sapiens
taacatttaaatttttcacata

SEQ ID NO: 7789408 - DNA, 22 bp, Homo sapiens
taagaaacccaggaatttctta

SEQ ID NO: 7789409 - DNA, 22 bp, Homo sapiens
gtttcctttctattgccttgat

SEQ ID NO: 7789410 - DNA, 22 bp, Homo sapiens
cctggctttgcggatttacagg

SEQ ID NO: 7789411 - DNA, 18 bp, Homo sapiens
cctggcttccatcttggt

SEQ ID NO: 7789412 - DNA, 22 bp, Homo sapiens
cctcccttttggtgtctgcata

SEQ ID NO: 7789413 - DNA, 22 bp, Homo sapiens
ccctggctctgcctcagagccc

SEQ ID NO: 7789414 - DNA, 22 bp, Homo sapiens
ccctggctcttcaccacctgcc

SEQ ID NO: 7789415 - DNA, 22 bp, Homo sapiens
ccctggctgataccggaaaggc

SEQ ID NO: 7789416 - DNA, 22 bp, Homo sapiens
ccctggctgccagtcaccagac

SEQ ID NO: 7789417 - DNA, 17 bp, Homo sapiens
ccctggctctaggtgga

SEQ ID NO: 7789418 - DNA, 22 bp, Homo sapiens
ccctggctcaggcagctttgtt

SEQ ID NO: 7789419 - DNA, 22 bp, Homo sapiens
ccctggctatttttacgcaagg

SEQ ID NO: 7789420 - DNA, 22 bp, Homo sapiens
tttttaatgcagtctgagacat

SEQ ID NO: 7789421 - DNA, 19 bp, Homo sapiens
ctgaaaaacattctcagga

SEQ ID NO: 7789422 - DNA, 22 bp, Homo sapiens
tttgtgaacaaacatgaagatg

SEQ ID NO: 7789423 - DNA, 19 bp, Homo sapiens
tttgtgaagaaaatgatgc

SEQ ID NO: 7789424 - DNA, 22 bp, Homo sapiens
tttaaatttagaagaaacactg

SEQ ID NO: 7789425 - DNA, 22 bp, Homo sapiens
ttgatacatagcacagtttagg

SEQ ID NO: 7789426 - DNA, 22 bp, Homo sapiens
ttccttcctcctccagttctgg

SEQ ID NO: 7789427 - DNA, 22 bp, Homo sapiens
ctaatcatctttctcttaaagc

SEQ ID NO: 7789428 - DNA, 22 bp, Homo sapiens
ttcccttcctcactctacttgt

SEQ ID NO: 7789429 - DNA, 22 bp, Homo sapiens
ctatttcaaggcccagatatga

SEQ ID NO: 7789430 - DNA, 22 bp, Homo sapiens
ttcttcctcacactctcaccca

SEQ ID NO: 7789431 - DNA, 22 bp, Homo sapiens
ttcctttcccttgcttctgtgc

SEQ ID NO: 7789432 - DNA, 22 bp, Homo sapiens
ttccttctaatattctgcctgt

SEQ ID NO: 7789433 - DNA, 22 bp, Homo sapiens
ttccttctaattttacacctga

SEQ ID NO: 7789434 - DNA, 22 bp, Homo sapiens
ttcctttccctcacagcctcgg

SEQ ID NO: 7789435 - DNA, 18 bp, Homo sapiens
ttgataaacaatttcatt

SEQ ID NO: 7789436 - DNA, 22 bp, Homo sapiens
ttgagaaaatagttcgaatgtt

SEQ ID NO: 7789437 - DNA, 22 bp, Homo sapiens
ttgagaaacatctaatctttgt

SEQ ID NO: 7789438 - DNA, 22 bp, Homo sapiens
cttgaaaaatatgccttgcttc

SEQ ID NO: 7789439 - DNA, 22 bp, Homo sapiens
cttgaaaataagaaagactttc

SEQ ID NO: 7789440 - DNA, 21 bp, Homo sapiens
gaaaagcaagggagtagaaca

SEQ ID NO: 7789441 - DNA, 22 bp, Homo sapiens
gaaaacatccagagatagacct

SEQ ID NO: 7789442 - DNA, 22 bp, Homo sapiens
gaagtgaagagattagaaatca

SEQ ID NO: 7789443 - DNA, 22 bp, Homo sapiens
gagataaatttttgataaatat

SEQ ID NO: 7789444 - DNA, 22 bp, Homo sapiens
gagtcctgatccttagctctcc

SEQ ID NO: 7789445 - DNA, 22 bp, Homo sapiens
gatcatttcagtccagtaaata

SEQ ID NO: 7789446 - DNA, 22 bp, Homo sapiens
gatcatttgcaggaaacattaa

SEQ ID NO: 7789447 - DNA, 22 bp, Homo sapiens
gatcatttgactttataaggct

SEQ ID NO: 7789448 - DNA, 22 bp, Homo sapiens
gatcattttgatgcccttttag

SEQ ID NO: 7789449 - DNA, 22 bp, Homo sapiens
gatcattttatagctatagcaa

SEQ ID NO: 7789450 - DNA, 19 bp, Homo sapiens
gatcatttttgcactgctt

SEQ ID NO: 7789451 - DNA, 22 bp, Homo sapiens
gatcattttgtatagcaaaggt

SEQ ID NO: 7789452 - DNA, 22 bp, Homo sapiens
gatcatttacttgttctggact

SEQ ID NO: 7789453 - DNA, 18 bp, Homo sapiens
gatatataggaggaaagt

SEQ ID NO: 7789454 - DNA, 22 bp, Homo sapiens
gatatttttaggtgatgcaggc

SEQ ID NO: 7789455 - DNA, 22 bp, Homo sapiens
gatattttcgcagggagaattc

SEQ ID NO: 7789456 - DNA, 22 bp, Homo sapiens
gatattttcattcggatgctca

SEQ ID NO: 7789457 - DNA, 19 bp, Homo sapiens
gatttaaacgtggctctat

SEQ ID NO: 7789458 - DNA, 22 bp, Homo sapiens
gatttaaagtagacctttgttt

SEQ ID NO: 7789459 - DNA, 22 bp, Homo sapiens
gattcacaactgccctgaaggg

SEQ ID NO: 7789460 - DNA, 22 bp, Homo sapiens
gcctggcttttgcctcatgttc

SEQ ID NO: 7789461 - DNA, 22 bp, Homo sapiens
gcttccttccttacattggtgg

SEQ ID NO: 7789462 - DNA, 22 bp, Homo sapiens
gtaaagatgagcggtaatacaa

SEQ ID NO: 7789463 - DNA, 22 bp, Homo sapiens
gtccttctcaaatcctgtgttt

SEQ ID NO: 7789464 - DNA, 22 bp, Homo sapiens
gtccttcttttcatccctggtt

SEQ ID NO: 7789465 - DNA, 22 bp, Homo sapiens
taaaacactcagcacctagcaa

SEQ ID NO: 7789466 - DNA, 18 bp, Homo sapiens
tctgtccttccattcttc

SEQ ID NO: 7789467 - DNA, 22 bp, Homo sapiens
tctgtcctgtttcctcctgaca

SEQ ID NO: 7789468 - DNA, 22 bp, Homo sapiens
tcttcctgaaaccctgttccag

SEQ ID NO: 7789469 - DNA, 22 bp, Homo sapiens
tcttccttctttgatgacaagg

SEQ ID NO: 7789470 - DNA, 22 bp, Homo sapiens
tcttccttctttgatgacaagg

SEQ ID NO: 7789471 - DNA, 22 bp, Homo sapiens
tcttccttcgcccttgctgttt

SEQ ID NO: 7789472 - DNA, 21 bp, Homo sapiens
tcttcctgctccacactcccc

SEQ ID NO: 7789473 - DNA, 22 bp, Homo sapiens
tcttccttgccttgcttcatca

SEQ ID NO: 7789474 - DNA, 22 bp, Homo sapiens
tcttccttgctccttgtcactt

SEQ ID NO: 7789475 - DNA, 22 bp, Homo sapiens
tcttctttggatgaaagaatat

SEQ ID NO: 7789476 - DNA, 22 bp, Homo sapiens
tcttctccagttcatcctacca

SEQ ID NO: 7789477 - DNA, 22 bp, Homo sapiens
tcttctccagtgcttctgcaca

SEQ ID NO: 7789478 - DNA, 22 bp, Homo sapiens
tcttgaaagcattttcttcatc

SEQ ID NO: 7789479 - DNA, 22 bp, Homo sapiens
tctttcctctgagctcctgtag

SEQ ID NO: 7789480 - DNA, 22 bp, Homo sapiens
tctcctcccaggctcttccagg

SEQ ID NO: 7789481 - DNA, 22 bp, Homo sapiens
tctcactaagttatgataatca

SEQ ID NO: 7789482 - DNA, 22 bp, Homo sapiens
tctgaacagcatggaatcattt

SEQ ID NO: 7789483 - DNA, 22 bp, Homo sapiens
tctgaaagggctaaataatttg

SEQ ID NO: 7789484 - DNA, 22 bp, Homo sapiens
tctgaaagcattacagtttatt

SEQ ID NO: 7789485 - DNA, 21 bp, Homo sapiens
tctctttctggaagcttccct

SEQ ID NO: 7789486 - DNA, 22 bp, Homo sapiens
tctcttcttgtgttttcctgcc

SEQ ID NO: 7789487 - DNA, 22 bp, Homo sapiens
tctcttctatttgagactattt

SEQ ID NO: 7789488 - DNA, 21 bp, Homo sapiens
tctctcctcaagctcgacccc

SEQ ID NO: 7789489 - DNA, 22 bp, Homo sapiens
tcctggctctctacaaaccaga

SEQ ID NO: 7789490 - DNA, 22 bp, Homo sapiens
tcctggctctaagtcctgagtg

SEQ ID NO: 7789491 - DNA, 23 bp, Homo sapiens
tcctggctctgcacttgctaatg

SEQ ID NO: 7789492 - DNA, 22 bp, Homo sapiens
tcctggctctgctgcctcctag

SEQ ID NO: 7789493 - DNA, 17 bp, Homo sapiens
tcctggctctgccactg

SEQ ID NO: 7789494 - DNA, 22 bp, Homo sapiens
tcctggctcgattgctaccaat

SEQ ID NO: 7789495 - DNA, 22 bp, Homo sapiens
tcctggctcggcttggggactt

SEQ ID NO: 7789496 - DNA, 22 bp, Homo sapiens
tcctggctcctggagacctgct

SEQ ID NO: 7789497 - DNA, 19 bp, Homo sapiens
tcctgctgtgtgaagggga

SEQ ID NO: 7789498 - DNA, 22 bp, Homo sapiens
taagaatattgggaatggatgg

SEQ ID NO: 7789499 - DNA, 22 bp, Homo sapiens
taagaatagtccctagatgtgt

SEQ ID NO: 7789500 - DNA, 22 bp, Homo sapiens
taagaacagtgtctgtctcaca

SEQ ID NO: 7789501 - DNA, 22 bp, Homo sapiens
taagaacagtgtttcatctcta

SEQ ID NO: 7789502 - DNA, 22 bp, Homo sapiens
tcctggctggaatttctcactc

SEQ ID NO: 7789503 - DNA, 22 bp, Homo sapiens
tcctggctgtcactcgggttga

SEQ ID NO: 7789504 - DNA, 22 bp, Homo sapiens
tcctggctcttctgagttttct

SEQ ID NO: 7789505 - DNA, 22 bp, Homo sapiens
tcctggctgagttcccaagtcg

SEQ ID NO: 7789506 - DNA, 22 bp, Homo sapiens
tcctggctgccgtcgtcctgcg

SEQ ID NO: 7789507 - DNA, 22 bp, Homo sapiens
tcctggctgcaccagtgaccct

SEQ ID NO: 7789508 - DNA, 22 bp, Homo sapiens
tcctggcttccactcctctgtt

SEQ ID NO: 7789509 - DNA, 22 bp, Homo sapiens
tcctggcttcctgctcttgtca

SEQ ID NO: 7789510 - DNA, 22 bp, Homo sapiens
tcctggcttccacacctgtcat

SEQ ID NO: 7789511 - DNA, 22 bp, Homo sapiens
tcctggcttaggtttccagaac

SEQ ID NO: 7789512 - DNA, 22 bp, Homo sapiens
tcctggctgttagagaggcaag

SEQ ID NO: 7789513 - DNA, 22 bp, Homo sapiens
tcctggcttctgtctccttatt

SEQ ID NO: 7789514 - DNA, 22 bp, Homo sapiens
tcctggcttgtcacatctacgt

SEQ ID NO: 7789515 - DNA, 21 bp, Homo sapiens
tcctggctttatgctacctct

SEQ ID NO: 7789516 - DNA, 22 bp, Homo sapiens
tcctggcttttcttggctcatc

SEQ ID NO: 7789517 - DNA, 22 bp, Homo sapiens
tcctgtctgctcacagagctgg

SEQ ID NO: 7789518 - DNA, 22 bp, Homo sapiens
tcctgtctaaagacctgcaggc

SEQ ID NO: 7789519 - DNA, 22 bp, Homo sapiens
tctagaaacaggtttctagaaa

SEQ ID NO: 7789520 - DNA, 21 bp, Homo sapiens
tccttgctattttcctcagct

SEQ ID NO: 7789521 - DNA, 22 bp, Homo sapiens
tccttctttccccctagtcatt

SEQ ID NO: 7789522 - DNA, 19 bp, Homo sapiens
tccttctccggccaccccg

SEQ ID NO: 7789523 - DNA, 22 bp, Homo sapiens
tccttctctggtttttactgta

SEQ ID NO: 7789524 - DNA, 21 bp, Homo sapiens
tccttctctatgattgtctga

SEQ ID NO: 7789525 - DNA, 22 bp, Homo sapiens
tccttctcctccttgagtgaca

SEQ ID NO: 7789526 - DNA, 22 bp, Homo sapiens
tccttctgtagtccctgtccct

SEQ ID NO: 7789527 - DNA, 22 bp, Homo sapiens
tccttctggaggctgtaaagga

SEQ ID NO: 7789528 - DNA, 22 bp, Homo sapiens
tccttctggaggctctaagggg

SEQ ID NO: 7789529 - DNA, 22 bp, Homo sapiens
tccttctgaaaaatgcacacga

SEQ ID NO: 7789530 - DNA, 20 bp, Homo sapiens
tccttctgaggtgaggagga

SEQ ID NO: 7789531 - DNA, 21 bp, Homo sapiens
tccttccttgaggtcctttcc

SEQ ID NO: 7789532 - DNA, 22 bp, Homo sapiens
tccttcctggggtctctgctgc

SEQ ID NO: 7789533 - DNA, 19 bp, Homo sapiens
tcctttctgttcctgagat

SEQ ID NO: 7789534 - DNA, 17 bp, Homo sapiens
tcctttctttacctgtt

SEQ ID NO: 7789535 - DNA, 22 bp, Homo sapiens
tcctttcttgtgtatcaaatgg

SEQ ID NO: 7789536 - DNA, 22 bp, Homo sapiens
tcctttctgggcctcagtgact

SEQ ID NO: 7789537 - DNA, 22 bp, Homo sapiens
tcctttctgtctttactctgga

SEQ ID NO: 7789538 - DNA, 22 bp, Homo sapiens
tcctttctccgggggactgttg

SEQ ID NO: 7789539 - DNA, 18 bp, Homo sapiens
tcctttctccctcatctt

SEQ ID NO: 7789540 - DNA, 22 bp, Homo sapiens
tgcatttataaaatgttcgtgg

SEQ ID NO: 7789541 - DNA, 22 bp, Homo sapiens
tgcatttagttttaataaagga

SEQ ID NO: 7789542 - DNA, 22 bp, Homo sapiens
tgcatttatggagcaaggcagt

SEQ ID NO: 7789543 - DNA, 22 bp, Homo sapiens
tgcatttatttgaattgatcta

SEQ ID NO: 7789544 - DNA, 22 bp, Homo sapiens
tgcatttaactagaatattaat

SEQ ID NO: 7789545 - DNA, 22 bp, Homo sapiens
tgcatttaagaaaacatgagtc

SEQ ID NO: 7789546 - DNA, 21 bp, Homo sapiens
tgcatttaacagaaacaggaa

SEQ ID NO: 7789547 - DNA, 22 bp, Homo sapiens
tgcatttagttatgagaaaaac

SEQ ID NO: 7789548 - DNA, 22 bp, Homo sapiens
tgcatttacggtacaacagcag

SEQ ID NO: 7789549 - DNA, 18 bp, Homo sapiens
tgcatttagtacatctag

SEQ ID NO: 7789550 - DNA, 20 bp, Homo sapiens
tgcatttacagtgtggatac

SEQ ID NO: 7789551 - DNA, 22 bp, Homo sapiens
tgcatttacctggaggtcattt

SEQ ID NO: 7789552 - DNA, 22 bp, Homo sapiens
tgatgaatgtcatacataatga

SEQ ID NO: 7789553 - DNA, 22 bp, Homo sapiens
tgatatttaagcaaaaatatgg

SEQ ID NO: 7789554 - DNA, 22 bp, Homo sapiens
tgagaaattcgacatatattta

SEQ ID NO: 7789555 - DNA, 22 bp, Homo sapiens
tgaataatcttgggtattaata

SEQ ID NO: 7789556 - DNA, 22 bp, Homo sapiens
tgaataattcctttttgtcaag

SEQ ID NO: 7789557 - DNA, 22 bp, Homo sapiens
tgaatgtgatgctaaacatatg

SEQ ID NO: 7789558 - DNA, 22 bp, Homo sapiens
tgaatctttttggaaataaaga

SEQ ID NO: 7789559 - DNA, 22 bp, Homo sapiens
tgaatttaaaataaatgtagtt

SEQ ID NO: 7789560 - DNA, 22 bp, Homo sapiens
tgacaaaactgcaattactttt

SEQ ID NO: 7789561 - DNA, 23 bp, Homo sapiens
tgaagcatggataactcacacct

SEQ ID NO: 7789562 - DNA, 21 bp, Homo sapiens
tgacatttggattcatagtaa

SEQ ID NO: 7789563 - DNA, 22 bp, Homo sapiens
tgacatttcttgttgatataaa

SEQ ID NO: 7789564 - DNA, 22 bp, Homo sapiens
tgaaacattaggaaatcattat

SEQ ID NO: 7789565 - DNA, 22 bp, Homo sapiens
tgaaacattatagaatatttat

SEQ ID NO: 7789566 - DNA, 23 bp, Homo sapiens
tgaaacatttagggtagaatttc

SEQ ID NO: 7789567 - DNA, 22 bp, Homo sapiens
tgaaacataaagttatcttcag

SEQ ID NO: 7789568 - DNA, 22 bp, Homo sapiens
tgaaacatttgatgatctttgg

SEQ ID NO: 7789569 - DNA, 22 bp, Homo sapiens
tgaaagaagggtggaaaatgta

SEQ ID NO: 7789570 - DNA, 22 bp, Homo sapiens
tgaaaattgttgtacttgataa

SEQ ID NO: 7789571 - DNA, 22 bp, Homo sapiens
tgaaaatatagttttccagact

SEQ ID NO: 7789572 - DNA, 22 bp, Homo sapiens
tgaaaacagaatccttgttttc

SEQ ID NO: 7789573 - DNA, 22 bp, Homo sapiens
tgaaaactccaagtttcatcag

SEQ ID NO: 7789574 - DNA, 22 bp, Homo sapiens
tgaacattgtcacattcctagc

SEQ ID NO: 7789575 - DNA, 22 bp, Homo sapiens
tgaacatacaattattaagaac

SEQ ID NO: 7789576 - DNA, 22 bp, Homo sapiens
tgaaatgttggtaattttatat

SEQ ID NO: 7789577 - DNA, 22 bp, Homo sapiens
tgaaatgtcagtgttttataag

SEQ ID NO: 7789578 - DNA, 22 bp, Homo sapiens
tgaaatgtgtccatgttatttc

SEQ ID NO: 7789579 - DNA, 22 bp, Homo sapiens
tgaaagattgtgattcaatatg

SEQ ID NO: 7789580 - DNA, 22 bp, Homo sapiens
tgaaagataagttattatgtac

SEQ ID NO: 7789581 - DNA, 22 bp, Homo sapiens
tgaaatatttagagagtaagtt

SEQ ID NO: 7789582 - DNA, 22 bp, Homo sapiens
tgaaatatgctcccattcactt

SEQ ID NO: 7789583 - DNA, 22 bp, Homo sapiens
tgaaatatcattttcatctccc

SEQ ID NO: 7789584 - DNA, 22 bp, Homo sapiens
tgaaatatccagcccagcagga

SEQ ID NO: 7789585 - DNA, 22 bp, Homo sapiens
tggagcaggaaacatctagagg

SEQ ID NO: 7789586 - DNA, 22 bp, Homo sapiens
tggagcagctaagcctctgaga

SEQ ID NO: 7789587 - DNA, 22 bp, Homo sapiens
tggagcagctctagcgggcgcc

SEQ ID NO: 7789588 - DNA, 22 bp, Homo sapiens
tggagcaggaagtctatggctg

SEQ ID NO: 7789589 - DNA, 22 bp, Homo sapiens
tggagcaggtgggatgtcgtga

SEQ ID NO: 7789590 - DNA, 22 bp, Homo sapiens
tggagcagtggtcctggagatg

SEQ ID NO: 7789591 - DNA, 22 bp, Homo sapiens
tggagcagagttcagcggggag

SEQ ID NO: 7789592 - DNA, 22 bp, Homo sapiens
tggaaaatgtgactattctaaa

SEQ ID NO: 7789593 - DNA, 19 bp, Homo sapiens
tggaaaatggattgaatca

SEQ ID NO: 7789594 - DNA, 22 bp, Homo sapiens
tgctccttcccttcccagtgag

SEQ ID NO: 7789595 - DNA, 22 bp, Homo sapiens
tgtacacatggtgtacactccc

SEQ ID NO: 7789596 - DNA, 22 bp, Homo sapiens
tgtaattttacgtgacacagtt

SEQ ID NO: 7789597 - DNA, 22 bp, Homo sapiens
tgtaagaaaagtaaatagtgac

SEQ ID NO: 7789598 - DNA, 22 bp, Homo sapiens
tgtaaaataccattccttgtca

SEQ ID NO: 7789599 - DNA, 22 bp, Homo sapiens
tgtattttcttctggaagctta

SEQ ID NO: 7789600 - DNA, 22 bp, Homo sapiens
tgtcacaacagaggaactgaat

SEQ ID NO: 7789601 - DNA, 22 bp, Homo sapiens
tgtatgaacctttaatatagtg

SEQ ID NO: 7789602 - DNA, 22 bp, Homo sapiens
tgtcatttatcttatagtaatc

SEQ ID NO: 7789603 - DNA, 22 bp, Homo sapiens
tgggatataatctgaaaagtat

SEQ ID NO: 7789604 - DNA, 22 bp, Homo sapiens
ttagtgatgaagaattactagg

SEQ ID NO: 7789605 - DNA, 22 bp, Homo sapiens
ttagtgatgggttgaagttaac

SEQ ID NO: 7789606 - DNA, 22 bp, Homo sapiens
ttagtgattacagatatataaa

SEQ ID NO: 7789607 - DNA, 22 bp, Homo sapiens
ttagtgattctcttttgaattt

SEQ ID NO: 7789608 - DNA, 22 bp, Homo sapiens
ttagaacaccattctatattac

SEQ ID NO: 7789609 - DNA, 22 bp, Homo sapiens
ttaaagcagtttgtatacatgg

SEQ ID NO: 7789610 - DNA, 22 bp, Homo sapiens
ttaaagcactaaatgatgaggg

SEQ ID NO: 7789611 - DNA, 22 bp, Homo sapiens
ttaaagacatcacagattacac

SEQ ID NO: 7789612 - DNA, 22 bp, Homo sapiens
ttaatacactatatgatcacat

SEQ ID NO: 7789613 - DNA, 22 bp, Homo sapiens
ttaatacaactgttgtcactgg

SEQ ID NO: 7789614 - DNA, 22 bp, Homo sapiens
ttaatacaagcatatgcacaca

SEQ ID NO: 7789615 - DNA, 19 bp, Homo sapiens
ttcactaattgtaagattt

SEQ ID NO: 7789616 - DNA, 23 bp, Homo sapiens
tgtgaattgaggacatcaaaagc

SEQ ID NO: 7789617 - DNA, 22 bp, Homo sapiens
ttaaaacagcgtgaatctggca

SEQ ID NO: 7789618 - DNA, 23 bp, Homo sapiens
acatagaacagaatatatttgtg

SEQ ID NO: 7789619 - DNA, 22 bp, Homo sapiens
aatactttcctatataaggtgc

SEQ ID NO: 7789620 - DNA, 22 bp, Homo sapiens
aatatgttccacttaaagctgg

SEQ ID NO: 7789621 - DNA, 22 bp, Homo sapiens
agaaaatattcattgagaggct

SEQ ID NO: 7789622 - DNA, 20 bp, Homo sapiens
acctggcttgggggaggagt

SEQ ID NO: 7789623 - DNA, 22 bp, Homo sapiens
acctggcttgtttctacctcct

SEQ ID NO: 7789624 - DNA, 22 bp, Homo sapiens
acctggcttctaatcatggctc

SEQ ID NO: 7789625 - DNA, 22 bp, Homo sapiens
acctggctttggggataggctt

SEQ ID NO: 7789626 - DNA, 18 bp, Homo sapiens
acctggctgtgtgagctg

SEQ ID NO: 7789627 - DNA, 22 bp, Homo sapiens
acctggctgttctcatttctag

SEQ ID NO: 7789628 - DNA, 22 bp, Homo sapiens
acctggcttcaaccatcatttg

SEQ ID NO: 7789629 - DNA, 22 bp, Homo sapiens
acctggcttcagagtctggcca

SEQ ID NO: 7789630 - DNA, 22 bp, Homo sapiens
acctggcttccaatctaggagc

SEQ ID NO: 7789631 - DNA, 20 bp, Homo sapiens
acctggcttcctcttggcat

SEQ ID NO: 7789632 - DNA, 22 bp, Homo sapiens
aataaagcatgaggcatttatc

SEQ ID NO: 7789633 - DNA, 22 bp, Homo sapiens
aataaagcagggtccttgcact

SEQ ID NO: 7789634 - DNA, 18 bp, Homo sapiens
aataaagcaggatttctc

SEQ ID NO: 7789635 - DNA, 22 bp, Homo sapiens
aataaaatggtcagttttctca

SEQ ID NO: 7789636 - DNA, 22 bp, Homo sapiens
agcatctagcaattgtcctctt

SEQ ID NO: 7789637 - DNA, 22 bp, Homo sapiens
agcatttaatcctacatagatc

SEQ ID NO: 7789638 - DNA, 22 bp, Homo sapiens
aatgtataaagtgttaataact

SEQ ID NO: 7789639 - DNA, 22 bp, Homo sapiens
aatgtaaacagcaagagaaggg

SEQ ID NO: 7789640 - DNA, 22 bp, Homo sapiens
agagataaagctatgatttatg

SEQ ID NO: 7789641 - DNA, 22 bp, Homo sapiens
agagataattaggttaaatgag

SEQ ID NO: 7789642 - DNA, 22 bp, Homo sapiens
agatatagttgttgagaagaac

SEQ ID NO: 7789643 - DNA, 22 bp, Homo sapiens
agatatatttaaggtaataagt

SEQ ID NO: 7789644 - DNA, 22 bp, Homo sapiens
aaaaagatgtcctgaagtttag

SEQ ID NO: 7789645 - DNA, 22 bp, Homo sapiens
aaacatgagcatctcttcaagc

SEQ ID NO: 7789646 - DNA, 22 bp, Homo sapiens
aaacatttttcttcatcatcct

SEQ ID NO: 7789647 - DNA, 22 bp, Homo sapiens
aaacatttgcaactcggtttgg

SEQ ID NO: 7789648 - DNA, 22 bp, Homo sapiens
aaacatgaatagatattaaaca

SEQ ID NO: 7789649 - DNA, 22 bp, Homo sapiens
aaatcatggtggaagaaacaga

SEQ ID NO: 7789650 - DNA, 22 bp, Homo sapiens
aaatcatgttggcacaataaaa

SEQ ID NO: 7789651 - DNA, 22 bp, Homo sapiens
aaatataatttctgcctcaata

SEQ ID NO: 7789652 - DNA, 22 bp, Homo sapiens
aaactaaacctggcttagtaag

SEQ ID NO: 7789653 - DNA, 22 bp, Homo sapiens
aaaggcattttaattctaaaga

SEQ ID NO: 7789654 - DNA, 22 bp, Homo sapiens
aaatatgaatgataagagttat

SEQ ID NO: 7789655 - DNA, 22 bp, Homo sapiens
aaatatcatttataacttttaa

SEQ ID NO: 7789656 - DNA, 22 bp, Homo sapiens
aagcactttagtgagaataagg

SEQ ID NO: 7789657 - DNA, 22 bp, Homo sapiens
aacattcacctctacctccttc

SEQ ID NO: 7789658 - DNA, 22 bp, Homo sapiens
aacacatgccttaagaataagt

SEQ ID NO: 7789659 - DNA, 22 bp, Homo sapiens
aaatggtatgaaaagagatttc

SEQ ID NO: 7789660 - DNA, 22 bp, Homo sapiens
aaatggtaagacaacacattat

SEQ ID NO: 7789661 - DNA, 22 bp, Homo sapiens
aaagcactatagccaaatagcc

SEQ ID NO: 7789662 - DNA, 22 bp, Homo sapiens
aatgtcaaaatggaatgagact

SEQ ID NO: 7789663 - DNA, 22 bp, Homo sapiens
aactcttaattttcatgaaatg

SEQ ID NO: 7789664 - DNA, 22 bp, Homo sapiens
aatgttaatgtgtttgcttatg

SEQ ID NO: 7789665 - DNA, 22 bp, Homo sapiens
aatgtgaaaccgcacagaataa

SEQ ID NO: 7789666 - DNA, 22 bp, Homo sapiens
aagcacatctcaaacttcatct

SEQ ID NO: 7789667 - DNA, 22 bp, Homo sapiens
aagcacattaaggaacattgaa

SEQ ID NO: 7789668 - DNA, 22 bp, Homo sapiens
aacaataattgcggttctctat

SEQ ID NO: 7789669 - DNA, 22 bp, Homo sapiens
aagtatttcgttctgaaaaagt

SEQ ID NO: 7789670 - DNA, 22 bp, Homo sapiens
aataaacaaaggacaaggaggt

SEQ ID NO: 7789671 - DNA, 22 bp, Homo sapiens
agctacctgatccttcttctga

SEQ ID NO: 7789672 - DNA, 22 bp, Homo sapiens
acatacacaagcgtacatgaac

SEQ ID NO: 7789673 - DNA, 22 bp, Homo sapiens
agtgtcctttctgttccagcca

SEQ ID NO: 7789674 - DNA, 22 bp, Homo sapiens
atcaaaatgctccagtgatggt

SEQ ID NO: 7789675 - DNA, 22 bp, Homo sapiens
agaacatttgtcgatcaatttg

SEQ ID NO: 7789676 - DNA, 22 bp, Homo sapiens
ataaaaactgacccatcctttg

SEQ ID NO: 7789677 - DNA, 22 bp, Homo sapiens
acttccttgtactgactccatt

SEQ ID NO: 7789678 - DNA, 22 bp, Homo sapiens
acttccttgtcaggtgcatcat

SEQ ID NO: 7789679 - DNA, 22 bp, Homo sapiens
acttccttttgggaaactgttt

SEQ ID NO: 7789680 - DNA, 22 bp, Homo sapiens
actttaaagcagaatggctatg

SEQ ID NO: 7789681 - DNA, 22 bp, Homo sapiens
agtgtcctacagctcctgcctg

SEQ ID NO: 7789682 - DNA, 22 bp, Homo sapiens
agtgaaaagatgcatttctctg

SEQ ID NO: 7789683 - DNA, 22 bp, Homo sapiens
agtgataatgtggtaattattt

SEQ ID NO: 7789684 - DNA, 22 bp, Homo sapiens
ccttctcctgccttgggttcat

SEQ ID NO: 7789685 - DNA, 22 bp, Homo sapiens
ccttctccctctgagaggaacc

SEQ ID NO: 7789686 - DNA, 21 bp, Homo sapiens
ccttctccattacagtaagct

SEQ ID NO: 7789687 - DNA, 22 bp, Homo sapiens
ccttctcccctctgcagggtgt

SEQ ID NO: 7789688 - DNA, 20 bp, Homo sapiens
ccttctccagcttgttcttg

SEQ ID NO: 7789689 - DNA, 22 bp, Homo sapiens
cttccttctcactagcagcgcc

SEQ ID NO: 7789690 - DNA, 22 bp, Homo sapiens
cttccttccttccccgaaatgc

SEQ ID NO: 7789691 - DNA, 22 bp, Homo sapiens
cttccttctgaagcatagaagc

SEQ ID NO: 7789692 - DNA, 22 bp, Homo sapiens
cttccttctgtaagaccagttg

SEQ ID NO: 7789693 - DNA, 22 bp, Homo sapiens
atcataattgctccagtgatat

SEQ ID NO: 7789694 - DNA, 22 bp, Homo sapiens
atacacatatatacacgtttaa

SEQ ID NO: 7789695 - DNA, 22 bp, Homo sapiens
atacacatgcacacatgtgtgt

SEQ ID NO: 7789696 - DNA, 22 bp, Homo sapiens
ataaagatttctttttctctac

SEQ ID NO: 7789697 - DNA, 22 bp, Homo sapiens
ataaagcaatagattgtgtaat

SEQ ID NO: 7789698 - DNA, 22 bp, Homo sapiens
ataaagctattcctctcttttt

SEQ ID NO: 7789699 - DNA, 22 bp, Homo sapiens
ataaaacttattagaattgtgt

SEQ ID NO: 7789700 - DNA, 22 bp, Homo sapiens
ataaaaatgagggcggtagcta

SEQ ID NO: 7789701 - DNA, 22 bp, Homo sapiens
atatacactccactgatacagg

SEQ ID NO: 7789702 - DNA, 23 bp, Homo sapiens
atagttttccctggttcttgcca

SEQ ID NO: 7789703 - DNA, 22 bp, Homo sapiens
atagttttatagatattgtgta

SEQ ID NO: 7789704 - DNA, 22 bp, Homo sapiens
atataaagtgtttagaaagctg

SEQ ID NO: 7789705 - DNA, 20 bp, Homo sapiens
catcattttaaaatctctcc

SEQ ID NO: 7789706 - DNA, 22 bp, Homo sapiens
catcattttattaaccaagaaa

SEQ ID NO: 7789707 - DNA, 22 bp, Homo sapiens
catcatttgtttgcatgcagga

SEQ ID NO: 7789708 - DNA, 22 bp, Homo sapiens
catcatttcacttagatgaagt

SEQ ID NO: 7789709 - DNA, 22 bp, Homo sapiens
catattttagttgctgaacagc

SEQ ID NO: 7789710 - DNA, 19 bp, Homo sapiens
catatttttgggctggcat

SEQ ID NO: 7789711 - DNA, 22 bp, Homo sapiens
atttaaattttctgatggagag

SEQ ID NO: 7789712 - DNA, 22 bp, Homo sapiens
atttaaatgcttaagagggttt

SEQ ID NO: 7789713 - DNA, 22 bp, Homo sapiens
attgtaaaagtattctaagatt

SEQ ID NO: 7789714 - DNA, 22 bp, Homo sapiens
gctaatcaatgttaaggctgtg

SEQ ID NO: 7789715 - DNA, 22 bp, Homo sapiens
gcctggctctgagggagctcct

SEQ ID NO: 7789716 - DNA, 22 bp, Homo sapiens
gcctggctctgagtttctctcc

SEQ ID NO: 7789717 - DNA, 22 bp, Homo sapiens
gcctggctcctaaggactggct

SEQ ID NO: 7789718 - DNA, 22 bp, Homo sapiens
gcctggctcgggcactcgccag

SEQ ID NO: 7789719 - DNA, 21 bp, Homo sapiens
gcctggctctcactggcctgg

SEQ ID NO: 7789720 - DNA, 22 bp, Homo sapiens
gcctggctcctaagagcacaac

SEQ ID NO: 7789721 - DNA, 22 bp, Homo sapiens
gcctggctcacagagcagcctt

SEQ ID NO: 7789722 - DNA, 22 bp, Homo sapiens
gcctggctccctctgcagctcc

SEQ ID NO: 7789723 - DNA, 22 bp, Homo sapiens
attttgaaatacttgaaggaaa

SEQ ID NO: 7789724 - DNA, 22 bp, Homo sapiens
attttgaaaccaagttatttcc

SEQ ID NO: 7789725 - DNA, 22 bp, Homo sapiens
attttgaaaagcatttgagtaa

SEQ ID NO: 7789726 - DNA, 23 bp, Homo sapiens
attttaaccttgactaacatgca

SEQ ID NO: 7789727 - DNA, 22 bp, Homo sapiens
gacataaaattcaataatttgt

SEQ ID NO: 7789728 - DNA, 22 bp, Homo sapiens
gacataaaccttgagatattaa

SEQ ID NO: 7789729 - DNA, 22 bp, Homo sapiens
gaacatttgatgatgacattgg

SEQ ID NO: 7789730 - DNA, 19 bp, Homo sapiens
gaaaacatgggtgagggtc

SEQ ID NO: 7789731 - DNA, 22 bp, Homo sapiens
gtgaataattttttagtataag

SEQ ID NO: 7789732 - DNA, 22 bp, Homo sapiens
tagtttcttcacctgtaaaatg

SEQ ID NO: 7789733 - DNA, 22 bp, Homo sapiens
tagttttacttgcgatgataat

SEQ ID NO: 7789734 - DNA, 22 bp, Homo sapiens
tatgaagaaatctttgaaaatc

SEQ ID NO: 7789735 - DNA, 22 bp, Homo sapiens
tatgaacatgttcattgactta

SEQ ID NO: 7789736 - DNA, 22 bp, Homo sapiens
tagacatattgtatttacttaa

SEQ ID NO: 7789737 - DNA, 22 bp, Homo sapiens
tagacatagtttttatgactta

SEQ ID NO: 7789738 - DNA, 22 bp, Homo sapiens
tcctggctccactgagcaggcc

SEQ ID NO: 7789739 - DNA, 22 bp, Homo sapiens
tcctggctaatgctgctgatgg

SEQ ID NO: 7789740 - DNA, 22 bp, Homo sapiens
tcctggctcaggcccctggtgc

SEQ ID NO: 7789741 - DNA, 22 bp, Homo sapiens
tcctggctagttttgctgaaat

SEQ ID NO: 7789742 - DNA, 22 bp, Homo sapiens
tcctggctaacacggtgacacc

SEQ ID NO: 7789743 - DNA, 22 bp, Homo sapiens
cattttgtagcaatgactgttg

SEQ ID NO: 7789744 - DNA, 22 bp, Homo sapiens
cattttaagatgacctggtttc

SEQ ID NO: 7789745 - DNA, 22 bp, Homo sapiens
catttcactattcactaaaagg

SEQ ID NO: 7789746 - DNA, 22 bp, Homo sapiens
tcagtttcctggttttaatatt

SEQ ID NO: 7789747 - DNA, 22 bp, Homo sapiens
tcataattgtatacatttatgg

SEQ ID NO: 7789748 - DNA, 22 bp, Homo sapiens
tcacttaggccttcctgtcata

SEQ ID NO: 7789749 - DNA, 22 bp, Homo sapiens
tgaaatgatatctgataacaaa

SEQ ID NO: 7789750 - DNA, 22 bp, Homo sapiens
tcttttctggactctgcatgga

SEQ ID NO: 7789751 - DNA, 17 bp, Homo sapiens
tcttctcttccagtctt

SEQ ID NO: 7789752 - DNA, 22 bp, Homo sapiens
tcttcctcatgaattctcgtat

SEQ ID NO: 7789753 - DNA, 22 bp, Homo sapiens
cctgcctatgagacgttttgcc

SEQ ID NO: 7789754 - DNA, 19 bp, Homo sapiens
tgcttcctcaccatctccc

SEQ ID NO: 7789755 - DNA, 22 bp, Homo sapiens
ccctcctcaactctggcttcca

SEQ ID NO: 7789756 - DNA, 22 bp, Homo sapiens
ccctggctggaaattaagtagt

SEQ ID NO: 7789757 - DNA, 22 bp, Homo sapiens
ccctggctggctctgcccggac

SEQ ID NO: 7789758 - DNA, 22 bp, Homo sapiens
ccctggcttaaaaacctcatat

SEQ ID NO: 7789759 - DNA, 22 bp, Homo sapiens
ccctggcttggcactctccact

SEQ ID NO: 7789760 - DNA, 22 bp, Homo sapiens
ccctggctgcgtgatggatgaa

SEQ ID NO: 7789761 - DNA, 22 bp, Homo sapiens
ccctggctgctaccaggtagct

SEQ ID NO: 7789762 - DNA, 22 bp, Homo sapiens
ccctggctgcttgtagtctggc

SEQ ID NO: 7789763 - DNA, 22 bp, Homo sapiens
tgttttcatcacagaatgtaac

SEQ ID NO: 7789764 - DNA, 22 bp, Homo sapiens
tgtttctgtatgatcaatattg

SEQ ID NO: 7789765 - DNA, 22 bp, Homo sapiens
cctgccttctaaagcgcccgcc

SEQ ID NO: 7789766 - DNA, 22 bp, Homo sapiens
cctgctcctgctattcttctgg

SEQ ID NO: 7789767 - DNA, 22 bp, Homo sapiens
cctgctcccgggacgcgttcac

SEQ ID NO: 7789768 - DNA, 22 bp, Homo sapiens
ttaaaagagcagcccagcatat

SEQ ID NO: 7789769 - DNA, 22 bp, Homo sapiens
ttacaatagttccttcttttgt

SEQ ID NO: 7789770 - DNA, 22 bp, Homo sapiens
ttaccttttaggcaagcatctt

SEQ ID NO: 7789771 - DNA, 21 bp, Homo sapiens
ccttctccacagggtctccgg

SEQ ID NO: 7789772 - DNA, 22 bp, Homo sapiens
ccttcttcaccagtttacctga

SEQ ID NO: 7789773 - DNA, 22 bp, Homo sapiens
cctttcttgcttagtggctcat

SEQ ID NO: 7789774 - DNA, 22 bp, Homo sapiens
ctaaatgttggtgttccccaca

SEQ ID NO: 7789775 - DNA, 22 bp, Homo sapiens
ttcctcctacgcttatcacttt

SEQ ID NO: 7789776 - DNA, 22 bp, Homo sapiens
ttcctctcaacatgcctgccgg

SEQ ID NO: 7789777 - DNA, 22 bp, Homo sapiens
ttcttcatctgtaagataagca

SEQ ID NO: 7789778 - DNA, 21 bp, Homo sapiens
ttcttcatgatgattaatggc

SEQ ID NO: 7789779 - DNA, 22 bp, Homo sapiens
ttctgaaaacacactttgcagc

SEQ ID NO: 7789780 - DNA, 22 bp, Homo sapiens
ttctgaaattcgactatccaat

SEQ ID NO: 7789781 - DNA, 22 bp, Homo sapiens
ttctgaaagtctttttaagtta

SEQ ID NO: 7789782 - DNA, 22 bp, Homo sapiens
ttctgaaagccaattcattgaa

SEQ ID NO: 7789783 - DNA, 22 bp, Homo sapiens
ttctgaaatttcaactttacta

SEQ ID NO: 7789784 - DNA, 22 bp, Homo sapiens
ctccttctcctcgggaggccag

SEQ ID NO: 7789785 - DNA, 22 bp, Homo sapiens
ctcccttcaggagaggctcaca

SEQ ID NO: 7789786 - DNA, 22 bp, Homo sapiens
tttcttgactgcttaggaatgc

SEQ ID NO: 7789787 - DNA, 22 bp, Homo sapiens
tttcttgaccactatgttgata

SEQ ID NO: 7789788 - DNA, 22 bp, Homo sapiens
tttcttagggactgtaaaatag

SEQ ID NO: 7789789 - DNA, 22 bp, Homo sapiens
ctctggaattgacctgggaggg

SEQ ID NO: 7789790 - DNA, 22 bp, Homo sapiens
ctctggaattaaggaagcctgt

SEQ ID NO: 7789791 - DNA, 22 bp, Homo sapiens
gagcatttttgtctgcatttta

SEQ ID NO: 7789792 - DNA, 20 bp, Homo sapiens
gagcagtggagtttccaggg

SEQ ID NO: 7789793 - DNA, 22 bp, Homo sapiens
gagcagtgccaaagaatttgcg

SEQ ID NO: 7789794 - DNA, 22 bp, Homo sapiens
gagcagtgagtgaatgttgcct

SEQ ID NO: 7789795 - DNA, 22 bp, Homo sapiens
gagcagtgatgggaggacgtca
